United States Patent 7,494,798 (BACILLUS LICHENIFORMIS CHROMOSOME) - sequence listing, part 3

SEQ ID NO: 866 - DNA, 990 bp, Bacillus licheniformis
gtgaaaaaatggccgttgtatgtgctgggctgcctgttgcttcttgcgggctgttcagcagccaaatcaagtgaagggggcggagatttaaaagagatcaacatcggagtgcagcaaagcttaagcccgttgctccttgcgaaagaaaaaggctggtttgaaaaagagttcgcaaaagaaggaattaaagtgaaatggacagagtttcaaagcggtccgccgcagtttgaaggtcttgccgcggataaactcgatttttcccaagtcggaaattcaccggtgatcgcagggcaggcggctggcattgattttaaagaaatcggcctttctcaagacggtttaaaggcgaacggcattcttgtgaaaaaagggagcggaatcgatgacataaaagatttgaaaggaaagaaggtggcggtggcaaaaggcagcagcgggttcgatttcctgtataaagtgatcgataaagcgggtctgaagccaacagacgtcaacatcattcagcttcagcctgacgaagccatgccggcatttgacagcggagcgattgacgcctggtcgatttgggagccgtttttgtctcttaaaacgatcaaaagtgacgcggacatattggttgacggggaacaaatcgacaagtattccccgggttttacgcttgtacgaagcaaattcgccgaacagcatccggatgaggtgattcgttttctgaaggtgtatgacaaggccgtgaaatggcagaaaacccataagaaagaagcggttgaagcgtacgcaaaaattaaaaacctcgacaaagaggtcgttgaaaacgtgctgaataacaccgaaccgttaaatgagccgatcacagaccgcatcattcaaacacagcaggagaccgccgattttcaatacaaattaaaagcgattaacaaagagattgatgtaaaagaagtggtcgacaattcatttataaaaaaagcgctgaaagaaggagatgacaaatga

SEQ ID NO: 867 - DNA, 837 bp, Bacillus licheniformis
atgagagctgtttcatcaagcaccccctcgatccagccgaaaacaggcgcaaaactgagaccggccgcttttcggctggcatgggggaagggatttgtattacccgtcatgttgattttattatggcagcttgtcgggtcattggagctcatatcaaaaaccgtgcttccggctcctttagatatattgcttacatttcgggatcttatcgtatcaggagagcttttcactcatttaggcatcagcattcagcgcgccgcgctcggctttttcctgggggccgggctcgggctcctgctggggcttgtaatcgggttttcgaaaattgccgaggattacctcgatccttctctgcaaatgctgagaaccgttccgcatctcgccgtcacgccgctgtttatcttatggttcggtttcgatgagctgtcaaaggtgctcttgatcgctcttggggctttcttcccggtatatatcaacacattttcagggatcaggggcgtcgattcgaaactgttcgatgtggcgagggtattggagttccattggctgaagcaggtgacaaagctcattcttcctgcatcgctcccgaacattctcttaggcatccgcctgtcgctcggcgtatcgtggctgggccttgttgttgccgagctgatgggatcaagcgctggagtcggctatatgattatggatgccagacagttttcgcaaaccgataaggtgtttgtcgggattttgatttttgccgccgtcggcaagctgacggattcattcgtcagaattctggaaaaaaagtgccttggctggagaaacagctatcaaggaaacaaaaagtaa

SEQ ID NO: 868 - DNA, 459 bp, Bacillus licheniformis
ttggacattttatggtttattccgactcatggcgacggacgttatcttggtacaaacacgggaggaagagccgcagatcacacctactttcagcaggtggcgcaggcggctgacaggcttgggtatacaggggttcttcttccgacgggaagatcgtgcgaagacccgtggattaccgcagccgctctggcgtcagtcacgaaaaatctgaagtttttggtcgctgtaagacccggtttgatgcagccgtcggttgcggcgcggatggcttcgacattcgatcgtcttgcagagggcaggcttctcatcaatgtggtcgccggcggtgatccgtatgaattagccggcgacggcctgtttatcagccatgatgaacggtatgaagcgacaaatgagtttctcgacatatggcggtcgcttttaaaggcgagaccgtcagctactcagggaaacacctga

SEQ ID NO: 869 - DNA, 723 bp, Bacillus licheniformis
atggcggtcgcttttaaaggcgagaccgtcagctactcagggaaacacctgaagactgaaaacgggcgcttgcttttcccgcccgcccaacagcctcatccgccaatctattttggcggctcgtcaaaggccgggcaggagactgccgccaaacacgcggacgtctatttgacatggggagagccgcctcatctcgtcaaagaaaaaatccaatctgtcaaaaagaaggctgaaaaagaagggagaaccgtccgttttggaatcaggctgcacgtgatcgtcagggaaacggaaaaagaggcctggcaggcggcggatagactgatcagccgcttggaggatgaaacgattgccgcagcccaaaacgcgatgaaacggatggattcatcaggacaaaagaggatggttcagcttcaccagggaaacagaagcaatcttgagatcagcccgaatctttgggcggggatcggactggtcagaggcggagcgggaacagcgctcgtcggtgatccggaaacggtagccagccgaataaaagaatacgccgacatcggcattgagtcctttatcttctcaggttatccacatcttgaagaagcgtaccattttgcagaaaaggtttttccgctccttccgtttcgaacgaaacttcaaagtaaagcatcaggcgaagtcatcggaaatgaccattttccgtcgaggcaaaaagaaaaaaccgtttaa

SEQ ID NO: 870 - DNA, 459 bp, Bacillus licheniformis
atgaatatgataacacggactttctttcacatccttctgttcggactcgcatgctggacgtttataacctttttccacacatcggaacaaattgccaaaagcctgaaaacaaacgattcagagcttcattttgtgtttaatctgattcccatccttctctttgggctcgtcctttcgatttacacatacttggagaaaaaaagcggttcacgcaagcagcgctttatgctcgtccccgacgaatttaaagagcaggatgaaagagagcagatgattaccgcaaaagcatgcagaacatcatatatcgtgctgtatgtggcgatgccggtcgcagcgcttttattgatcttttatccgtttttccaagtcaggattccgtcttttccgattatcgtcatctttatgctgatcattattcagcatctttcatatatgttttcattttataaaaacagataa

SEQ ID NO: 871 - DNA, 207 bp, Bacillus licheniformis
atgaacaacagggtaagagaattgagagcaagatacgggtattcacaggaagcccttgcaaaggcgatcggggttacaaggcagacggttgcggccattgaaaaaggcaattacataccgtcgcttcttttggctttgaaaatttgcaaggaatttcaattaaaaatggaagacgtattttggctagagggggacaaaaacgaatga

SEQ ID NO: 872 - DNA, 213 bp, Bacillus licheniformis
atgacatacgcagcacctcaggttgactattctgtcaatccgtcgatcgaagatcaggcttggttcttggtgtttgttgcagtgcttttggcacttggagcaactgttgttcttggcgccgctgtatggtgtgtggctaacggaaacggcagcttcacgggatccgtcaaatgggtcagcggtttgcaggtcagcatcgaatgtaggaaatag

SEQ ID NO: 873 - DNA, 747 bp, Bacillus licheniformis
atgtttataatagatcatctgtctaaaacatataaaaacaatgtgactgccgttagcgggtttcatataaaaatcgaaaaaaaccagatcgtcgcgatagcgggtccgaacggttcagggaagacgacgatcattaactccattttaggaatcatcacgcctaccgaaggaaccattctgttggatgacctgccgaacacgacggcggaattcaagcagaaattcgcctacgttcccgatgaactccttttgccggacgccctttcagccgcagaatatttggattttgtatcttctatgtatcattgtacatcaaatgaaaaacggaaacaattaatcgagcttttcgatatgaaagaggctttgcaggagccgattgaaacgtactcgcacggaatgaaaaaaaagacgcagctgatcgccgcttttatgctggagagcgaatttgtcattatggatgagccgtttcgcgggctcgatatagaagcggtcatcaatacgaaaaagctgatgaagcgctatgcggccacgcaagggtcgatactgctggccacccatgacatgctttctgcggaagaactgtgcgataagatagcaattctatcaaaaggcgtcaaaatggatgaaggaaaagtgaaagaattgaaggctaaatataacagcgattcacttgaagaagtattcttaaaagcttcgatgctgagtgataggggtgctcattttgatcaaatcattcgaaatttctaa

SEQ ID NO: 874 - DNA, 1461 bp, Bacillus licheniformis
ttgatcaaatcattcgaaatttctaaaatgatgctgaaaatgtggcagaaggaaatgggcaagctctttaataccggtacaaaaaaagcgatcgccgtgctttttttgcttttggcggtaacgatgggaagcatcatcggctacagttttacaggcatgtttttaagcgcgtttctgaacggcgaagttcgttctctcggattgttcgtgatttccatgtttatgaacgcgtcgatttttacatttgttttcttcattttatttaaagtaaggacgccagagcagcacagcttttccatgcagctcagctggtttccgctgacggccttccagagaagcctcggatatttcatcccgtttgccggagcggtttcatttcttgtcctgtttatgattttcattctgctgattccgaactttgtcgccagcggtgttgggttttggtttgcttttgcgttttttgcacttctttttgtacagatcatctttttcttttcgcttctcaatcttgtctataacttggtgtatatgttgattttaaaattcggctttccgctgcaaaagtttttttcaatgtttgtccttgtcgtgttagccgtgttttacggaatcacatcattcgatcttggaaacattcagaacgcttattcgtcttttgattatcatttgacatattttgcagcgccgctgtttctcatgctgaacggtcaggcgtcggatgccggcgtcattccgattgtgctgatcttgacagcagcagtcacggcctcttttatgtcgctgaatgttgtgccgatcctcactgaaaaaaaatcatctaaactgttttcatttattaaaatcccgtcatcaaagccgctgtctttggcggtgaaagaaataaagtctcaagcccgaaatgaagaaaatattttaaacttcatttttttgcttttggctctatgctttttgaaatacaagtttcagtttggatttaccggtgagagctatttggttctgggaggcgtgacaggtatcatcgccttcaattcatttggcaacgatctgcggatgatgcagatgtataaggcgcttcatttaaaaacggcaacggtactgtggtcaaaatatctcgggctctgtatgctcggcctcattcagctctttttgttttccgtgctgacgtggactttcccggagagctttccggtctttttaaagacggttgctgtgatcttaaactcgattgcgatgttctatttagcgggcattatttttccgcttgaccgaaacaacccttatatggggatcttctctttcggaatgctcctgctctttttgattccgctgtttttcatcgtgaattatgcggttgataacgtcacgggcgaagcgctgctgtttttcataccgtgccttgaattactgctgatcctgcttttatacggagggtttaaatggaggtaccattatgatcattaa

SEQ ID NO: 875 - DNA, 768 bp, Bacillus licheniformis
atgatcattaatatgttgaaatcgctggccggaatcaaaaaaattccctatttcccagagcatgtgacactgaatcggaagcatatttcagatcatgatcttgatgctgattttcccattaatccgactgcttatcaaatgctgaaggaagtcgacgggaaaaaagacgagctggagattgccgaagctctcaaaggtgtgtttaatgtcagggaagaggtgctgcagaaagatttgcacgaattgctgacagggctcaaccgccgttatttgatcaattggaggtacggagagggcccgtcttttgcgggagtgctttatcaattcttcagccagtatcatatccgctacaaggagaggttttcaagccattctgattcgtttctgctgttgtacataaagtttctgcaagtgatttctaagaaaatcatcgtgttctggctcgtctttttgatgttgtcgcttgcagcgtacaccgttgttccggatggatcgatcgtcggcatcgcggcttatttttccgtcgtctatttcgggttgatcaccggaacggcgcttcatgaagtggtgcacggcatcgcgcaccggaaagctgccggcaggaacggcccgcaggggtttttagcggctgatatgatgtcagtcaaatttgtccgccctgtcatgtcgctgcatgataaaaggtcgatttggattacggcgttgggaccgcttgttcccaggtgtgctcggaatagccggcgtgctgtttacggtcttttttcttaa

SEQ ID NO: 876 - DNA, 198 bp, Bacillus licheniformis
ttgttcccaggtgtgctcggaatagccggcgtgctgtttacggtcttttttcttaaggaaaacgcggtttccgtcggagtgctgctgttcttttccacctatgctttgcatatgatgtatctgcttccgtttatgggtgacggaaagtcgattatgaaacagctgatgatcagaggaattggaggtaaatcatcatga

SEQ ID NO: 877 - DNA, 285 bp, Bacillus licheniformis
atgaatacaaactctttaaagcagggactaatctttgccagtttctcaagctttctcgcatttccgatgcttgcggctgcgcttttgttttatcaccttttttcaaatcaaacgagcaatgatatcttgtttaacagtttgtcgtttgtcatggagagcgaatcggctttttcattccaggtgaagccaaactttttcttcattatgatcgggctgtttatcggcatttttattataacggctgcgatttcatcaatttatcagaaaaaaaagggtgaatcttaa

SEQ ID NO: 878 - DNA, 270 bp, Bacillus licheniformis
gtggccaagaaatcaaaaattgctaaagaaaaaaagcgccaaaagcttgttgaacaatatgcagaactcagaaaagaactaaaagaaaaaggcgattacagagctttgagcaagcttccgcgcgactcggcgccagcaaggctgcataaccgctgcgaagtgaccggaaggccgagaggatatatgagaaagtttaaaatgtcgcggatcgcgttcagagaattagcatataaaggccagattccaggtgtgaagaaatccagctggtaa

SEQ ID NO: 879 - DNA, 630 bp, Bacillus licheniformis
ttggaacttcgtttgcaaattgcgcctgctattttaaaccgtattccttcatttaaggttggcgctgtgttatatcaaggtattgagatcaacggctccccgcaaatgcttaaaggccggctccgcctttttcaggaatcgctgttttttgactatgccgaccgcagtatcgaagatgaatcggccgtaaaagaatggcatgatgccttcagggagctgaatccgtctttttcaggccgggaaagcggactcgaacggatgctggaagacatcaaagagcagcgctttgtcgagccgaaaaattcggcggttgatctgagccgttttttctctctcaaatatttgattccggttcatatatatgacgcccggaatttgaagggtccgatcaaaatcgaacccggcggcccggacgagatcatcacgttctccgatgatgcgggagcattcggcacgatcaccgaaaacctcagtcttcatcatgcaggagcggacacaaaagatgccttgcagctcgtctttttcaggccgtcattatctaaagaagaagccagccggctgctcgattctttgacaaaaatgtttgaacaaattcacggcggcaggcacatttcagccgtctttccgtaa

SEQ ID NO: 880 - DNA, 1149 bp, Bacillus licheniformis
atggatgtgaaaaaactgaaacaggatgtcatcgaattcgcacagcaaatcggcattgataaaatccggttcgccagtgcagatacatttgaaacattaaaagaacgattgattgagaaccgggcccttggctatgaatcaggctttgaagaacccgatcttgaaaaacggacgaacccggatctgcttttgccgaaggcgaagtcgattatcgccatcgcccttgcatacccctcaaaaatgaaagacgcgccgagaagcaagaaaggcgaacgaaggggcatcttttgcagagcttcctggggaaaggattatcatcatgtcctgcgcgaaaagcttgatcagcttgaagaatttttgaaagcacagcgaagcgatgtcagaacgaagtcgatggtggacaccggtgagctttcagacagagctgtcgcagagcgtgcgggcatcggctggagcggaaagaactgcatgatcattacgcctgaattcggatcttacgtttacttggcggaaatgattacgaatattccctttgagcctgatgagaggatcgaagaccaatgcggctcatgcaacaagtgcatcgaggcatgcccgaccggcgcgctcgtcaagcctgggcagctcaactcccagcgctgcatcgcttttcagacgcagacaaagggttttctgcctgacgagttccgtacgaaaatcggaaacaggatctacggctgtgatacgtgccagatggtatgcccgaaaaataaaggggtcgattttcatctgcatcctgaaatggagccggaccctgagattgccaagccgcttttaaagccgcttctgacgatgtcgaatcgcgaattcaaagaaaagttcggccacgtggccggctcatggagaggcaaaaagccgattcagagaaatgcgattatcgcacttgcccattttaaagaaacggacgctctccctgaactgattgagctgatgcacaaagatccgcggccggtcatcaggggaaccgccgcatgggctgtcggaaagatcggcggagcggatgtgatgagtgaattggagcgcgcgctcgcgcacgagcaggatgaagacgcaaaagctgaaattcaaaaaggcatcggcctgttaaaagaaacgagtgcgactaattga

SEQ ID NO: 881 - DNA, 906 bp, Bacillus licheniformis
ttgaaacagatcatcgagcagctcctgaaagccagacttcaatacttaattaacggcaatgatgaaacaaactggcgggatgccggaggttttgaagtcattgaacggaagcggaggctttttcaaaaacgcggcgtgcatatcgtgaaggccaatatagaagcggctgtaaaagagcattggcttgatgaagacggcgcgtcacatgtgaactatcaaacccataccgcatatttgtgcaaagacggggatgatatgtatatggaagaacatatggaagacagaaacgcccttttgtatgatcagatggtcattaaagactccgaggccctgcgtccggccgcacagtctcatcctgagcctgaaaacggcgatgaagatatgcgcgaattgctgggaagggcgttccgctatgaccggcttgccgcggtgcgctatgctgaaacgtattggaataaacgaaatcctgcttataaaaactttgaagacaattgcacaaactttatttcccagtgcataagggccggagatgcgccgatgcgcggctatccgaacagaggcaagggctggtggatgcaaaaccattcctggagctacagctggactgtcgctcattcgctcagaacctttttgaagcattcaaaagccggtctccgagcggttcaaaagccggctgcgaaagagctgatcgaaggcgatgtcatctgctatgattttaacggagacggcagatttgaccacgtggcccttgtgacagcgaaggataaaagcaatatgccgctggtgaacgcgcaaacgcacgactgccggatgaggtactggtcttacgaagattcgcctgcttatacttcatcgattcgatatgcgttttttcatatatcagatgatacgacaaaatcgaaatga

SEQ ID NO: 882 - DNA, 474 bp, Bacillus licheniformis
ttggcattgcatgtcgtactatatcaaccagaaattcctgcaaacacaggaaatatcgcacggacttgtgcagcaacagatacaacacttcatttaatcagaccgctcggcttttcaaccgacgataaaatgctcaagcgggcaggtcttgattattgggaattcgtcaatgtcgtctaccacgactcattggatgaattgtttgatgcccatcctgaaggccgttttttcttcattacaaagttcggtcaaaaaccgcacacttcatttgattattcagatcaaaacgaagattacttctttgtcttcggcagagagacgaacggcttgccgaaagagctgatcgaacaaaacatggatcgctgtctgcgcctgccgatgacagagcacgtcagatcactgaacttatcaaacactgcggcaatcctcgtgtatgaggcgcttcgccagcagaattacagagatttgacttaa

SEQ ID NO: 883 - DNA, 639 bp, Bacillus licheniformis
atgtgtgtgaaggagctgaaacagatggttcaggatgatttaatttcaaaaaaagagctgctggatttgacttcgatctcgtacggacagctctatagatggaaacggaaaaatttaatacctgaagagtggtttatccggaagtctacgttcaccggacaagaaacgttttttccgagggaagacattttaaaaagaattgaaaccattcaaagcatgaaagaaaacctttcccttgatgagatggcggaaatgttttcgcccgatttgaccgaactaaacgcgagccgcggggagctgctaaaaaaaggcatcgtttcagaagcggtcatggcgttttttgaagaatgcaccggaaaacgcgatcatccatttaatttgacagaagcacttgcggcttatgtgctggaaggcttgcttcaatccggcgacatcagcctggatgaagggaaaatggtgctggatgtcatcatgtcgaacgaggcggaaaacaagggaaggctgcttgtgctccggaagctcggcgttgcaacatgtctgattgccgagggcagcattgtgttggaaaagggagtcaaggtagccgctgacatcaatctggcggcgagcagtgaagaattgaaaacaaaattcatgtaa

SEQ ID NO: 884 - DNA, 711 bp, Bacillus licheniformis
atggagaatttattgataaacggattcggcagttcaggcggaggcgcgtatcaaacggttgagttaaacggcaaaggtacgattaacggcgatattgactgcgaaaggttcagctgcagcggcaccgggactgtaaacggagacgtaaaagcggatgagctgagaatcagcggccatgcaaaactaaacggcgccatcgaggcttcaaaggttagaattgatggttctgcaaaagtggatggcgatgtcgaagcagaaaagcttaaaatcttaggctacgccggcattagcggacatgtgaaaggcgacgaagcgatcgttcgcggaaaaacgtcgatcggcaaagactgccaagtggaacatttttctgcagaaggctattttacaatcgacgggctgttaaacgcggagcaaatcgaaattaaggttcacggcggcgaaagtaaagtgaaagaaatcggctgccggaggatcgtctgcactgcacatcaatcgaagctgttctcgtttttatcggagcttatttctcctccaaggctgtctgccgagctgattgaaggggatcatatcgaacttgccaatacgaccgcaaaagttgtccgcggcaattcggttatcatcggcgaaaattgcgacatcggcctgattgagtataaggaagatatccgggtggccgaaacggcaaaagtcggagagaaaaggaaattatag

SEQ ID NO: 885 - DNA, 702 bp, Bacillus licheniformis
atgaagaaacacgacttgaaaatacacggatccggaagcgcggggggcggatcattccatcgtgttctcattagaggtgaaggaatgatcacgggaaacattgattgcgaaaaattcagtacacacggtacaagcgaactgtcaggcgacgcgaaaattaaaagctttagtgtacacggggaaacagagatccgggggaggctgaaagctgacaaagccagagtatacggcacggcggatgtttctgagaacgccgagatcagcgatgcagccgtgaaaggcatcatcaatatcgggggaaatatgacggctgacacttgcgatgtcaaaggcgccctgaacgtaagaggcgattgcgaggcagaggattttaaactgacgggcagcctggatgtaaagggcctcctgaacgcaggtgtgattgacatcggcttaaagtacggaaacagttcgattggcgatatcggcggtacggatattaagatcgtcaataaacgcgggctgttgtttaatagaaacggaggtactctctcggcagggacgattgaaggagacgatatttacctggaaaacacggcggcccgaatggtcagaggaaaccgcgtgcatataggaccgggatgcaagattgagaaagttgaatacaagagcagctaccgggtatctccgaagtctgaggtaaatgaggatcaacagcaataa

SEQ ID NO: 886 - DNA, 87 bp, Bacillus licheniformis
atgagaacgctgatcatgatgggggtcatcctcgcgtttctcgtatccatatttactgccggatacgaaagcaaacccggaaagtaa

SEQ ID NO: 887 - DNA, 1896 bp, Bacillus licheniformis
atggatatattaaaaaagattgaacagtatagagaggaagagcagcgtctgaaatgggaaggaaccttcgctgaatatctggaaatcgtaagagaaaatccgactgtcgcgcaatctgctcattcccgcgtttacaatatgattaaagacagcggcattgaagagaaagacggcaaaaaagtatacagcttctttgacaaagagctgtttggtcttgaagagcctttggaacgccttgttgaagaatactttcatccggccgcgaaacgccttgatgtcagaaaaagaatcctgcttttgatggggcctgtcagcggggggaaatcgactttggtcaccatgctgaaaagggggcttgaagcatactctcttacagatgaaggggctgtctatgcgattaagggctgcccaatgcatgaagatccgcttcatttaatccctcagcatctgcgggacgatttttacaatgaatacggcatccgcattcaaggaaacctgtccccgttgaacatgatgaggcttgaacaggaatacggcggaagaatagaagacgtgaaggttgaaagaatctttttttcagaggataaacggacggggatcggcacgttcagtccgtcagaccctaaatcgcaggatatcgccgatctgacgggaagcattgatttctcgacgattgccgaatacggatcggaatccgatccgcgcgcataccggttcgacggagaattaaacaaagcgaacagaggaatgatggaatttcaggaaatgctgaaatgcgatgaaaaattcctctggcaccttttatcgcttacacaggaagggaatttcaaagcgggccggttcgcgctcatctcagcggatgaattgatcgtagcccacacgaatgaaaccgaataccgttcatttatatccaataagaaaaacgaggcgctccattcgcggattatcgtcatgccgattccatataatttaaaagtatcggaagaggaaagaatttatgagaaaatgatcgctgaaagcgatgtgtctgatgttcatattgcgccgcacacgctaaaagtggccgcgatgttttcaattttgacaaggctgaaggagccgaagaggtcagacattgatctcgtcaaaaaaatgaggctgtatgacggagagagcgttgaaggatacaattcagtcgatgtcgaggatttgaaaaaagaatacactgatgaaggaatgagcggaatcgatccgcgttatgtcatcaaccggatctcgtcgacgatcatccgcaaaaatatggagtcgatcaatgcgctcgatgtcctccgttctttaaaagaaggactcggccagcatccgtcgatttcggcagaagaccgcgagcgctatttgaactttatttccgccgccagaaaagagtacgacgaaatggcgaagaaagaagtccaaaaagcgtttgtatactcttatgaggagtcggcgaaaacgctgatggacaattatcttgataatgtcgaagcgtactgcaataaaattaagctccgcgatccgctgacaggagaagagatgaatccggatgaaaagctgatgaggtcaatagaagaacaaatcggcatttccgaaaatgcgaaaaaggcattccgagaagaaattctcatccgcatttctgcctatgcaagaaaagggaagcgatttgattataattcccatgagcggctcagggaagcgattcagaaaaagctgtttgcagacttgaaagatgtcgtcaaaatcacgacgtcgacaaaaacgccggacgaacagcagctcaagaaaatcaacgaggtcgtcgcccgtctcattgatgagcacggctacaactcgacaagcgcaaacgacctcttaaaatatgtaggaagcttattaaaccggtag

SEQ ID NO: 888 - DNA, 1167 bp, Bacillus licheniformis
atgtcccataaagacaatggccattttattatttctcaggaagactggtccctccaccgaaaagggtatgatgaccaacagcgtcaccagaaaaaggtgcaggacgcgatcaaaaacaatctgcctgacctgattacagaagaaagcatcattatgtccaacggcaaagatattgtcaaaattccgattcgctcgttggatgagtataaaatccgctataactatgataaaaataaacatgccggccagggagacggcgacagccaagtaggagatatcgtcgcaagggacggctctgataagcggggcgccggcaaaggccagggagcgggcgatcaggccggtgaagattattatgaagcggaagtttcgttaatcgatttggaagaggcgctcttcagcgaaatggagctgccgaatttagaacagaaagagcgcgatgatatcgttgtcgaagatattgaattcaacgatatccgcaaaacgggtttgacgggcaacatcgataagaaaagaacgatgctcagcgcatttaagcgaaacgcaatgactggaaaaccgtcgttttatccgatctatcccgaagacttaaaatttaaaacgtggaatgactctgtaaagcctgaatcaaaagccgttgtgctcgccatgatggatacgagcggatcgatgggcgtttgggaaaaatatatggcgcgaagttttttcttttggatgacacgttttttacggacaaagtatgaaacggtcgatatcgagtttatcgcccatcatacagaggccaaagtggtatcagaagaagatttcttttcgaaaggggaaagcgggggaacaatttgttcatctgtataccgcaaatccctcgagctgatcgaagacaaataccatccgacacgctataacatttatccgtttcatttttcggacggcgataatctgacatccgacaacgcgcggtgcgtcaagcttgtcggagagattatggagaaagcgaatatattttgctacggcgaagtcaaccagtacaacagacattcaactttaatgtcagcctacaaaaatattaaaaatgaaaaattcaagtattatgtgctgaaacagaaagccgatgtttttcaggctctgaagagcttcttcaacaatgaagaacggcaccaatatacatga

SEQ ID NO: 889 - DNA, 633 bp, Bacillus licheniformis
atgagcaaaggacgtttaattgcgacgaacattatcggactcatcatcgtgcttgccatcttagcaggaggtgcgtatttctattatgacagcatcagctatgtgaaaaccgatgaagcgcacgtggcaggcgagatggccgatattacggcgcctgcatcagggaagctcgcagattgggatttgaaagaaggatcaaaagtttcgaaggacgaaaaaacagcgaaaatcaaaggggaacaaacggttgacgtgaagtcgatcatggacggaacgattgtcaaaaacgaagcgaaggaaggccagatcgtacaagccggtcaaacgcttgcgaaaacaatcgacatggatcatctgtacattactgctaacattgaagaaaacgacctgaaagacatcgaaaaaggggacaaagtcgatatcgtcgttgacggtgattcaggcactacatttgaagggaatgtcgaagaaatcggctatgcgacaaactcaacatttgacttgctttctcaaagcaattcaagcggaaactacacgaaagtaacgcagaaagtacctgtgaaaatttcaatcaaaaacccgtctgacaaagtgctgccgggaatgaacgcatccgtgaaaatttcaaaataa

SEQ ID NO: 890 - DNA, 1590 bp, Bacillus licheniformis
gtggcttctcagaaaaaaggaaatatgtcactgcttatcatattaatggccggcttgtttctggccattttaaaccaaacgctgctgaatgtggcgatgcctcatctcatgacagagttcaatgtgagcgccacaacgattcaatggctgacaaccggatatatgcttgtcaacggcgttttgattcctttatcagcctttctgattatgcggttcggcggacggagcctgtttttaacggccatgctgctgtttacggccggaacgctgatatgcggaatttcgcctaatttctcgacgatgttaaccggacgcctcattcaggcagtcggcggaggcatacttcagcctttggtcatgacgacgattctctttatctttcctccggaaagccgcgggaaaggaatggggatctttggccttgcgatgatgtttgctcctgctgtcggtccgactctatccggctgggtcattgaaaactacagctggcggatcatgttttacagccttgtgccggttggtgtcatcgtcatcattttcggttttttcctatttaaaaatatgacggaacctaaaaaaatcaaattggatacagcaggcgcgattctttcagtcgtcggatttgcggcgttgctgtatggcgtgagcgaagccggctcagacggctgggatgatccgatcgtactttctacagttgtgatcggtgtaatcggcattgccgcttttatcatccagcagttgaaatcgaaagaaccgatgcttgacttcagagtgttcaaatacgatatgttttcactgtcaagcgtgatcaacgccatcattacggttgctttgtatgccggaatgttcctgattccgatttatttgcaaaacctggtcggttttacagcgcttcagtcggggcttcttatgctgccgggcgcactcgtcatgcttgtgatgtcgccgatctcaggaattttatttgataaagtcggcccaaggccgctggcgattgtcggtttattgatcaccgttgtgacgacctacgaatttacgacgcttacgatcgatacgccgtatatgtacatcgtgctgatctatgcgattcgggcgtttgggatgtctatgctgatgatgccgattatgactgccggcatgaaccagcttccgcagcatctaaacagccacggaacggcgatgtcgaatacgcttcgccaaatcagcggttcgatcggaacgagcttgatcacgacgatttatacgaatcgtacgacattccactatgcatcaatggccgatcagacaaatacggctgatccgtcatttatgagcacattgcagtcaacgattcagtcaaccgcgcaatcgatgcatatatctctcgaacaagcacaacaatatgtcgtgaaatatttgaccggacaggcgcagctcaactcgaacgtcatgggtattaatgacgcgtttatgtgggcggccgggttctgtgtcatcggtctcgttctcagcctgtttttgagggatgtcagaaaagacaagctgcgcaggaagaacaaagcgcaggagctgacattgcttccggctcctaaagaagcgaaagaatcttaa

SEQ ID NO: 891 - DNA, 531 bp, Bacillus licheniformis
atgaaaatttatgttgtttacgacagtgaaggcgagcatacgaaaaagctggctgaagccattgcagaaggcgcgggggaacatgatgctgcagacgtgcggatcgatcatgtcagccaggcggatattagaaagctcgaagaaatggacgctatcatctggggatgcccgggccatttcggtacaatcagctccggattaaaaacttggatcgacaggctgggctacctttgggcggaaggaaagctgatcaataagatcggcgcagtcttctgcacaacggcgacgacccacggcggtcttgaggcgacaatgctcaacttaataacaccgatgcttcatcaaggcatgatggtcgtcggcttgcctggaaatgtacctgaaaatgctttatacgggtcttattacggtgcaggcatcacgtgtcctgtcgacagtgacgaattgatcggcgaggaaggcctggagctgggccgggctttaggcagacgcgtcgcccaggtggcagaccgctttacagcaggacagtga

SEQ ID NO: 892 - DNA, 333 bp, Bacillus licheniformis
atgaccattatactgaccatcatcgctgctgtcctcgtcattatcggtctggtggtatttaatgtgcggtcggcgtcttctcaggataaacccgaacatgaggataaagctgcatctgcggctggcattcctcaggttcaggaagaagaagagcctgagcaggttaaagccgatcagcaagatccgttcgaaatgaatgatcaaacctatcgggcgatcctgcaaaaacttcaacaaccaaaagaggaaaaaaaatatcccgagaagacggaaatggacgatatggattaccgaaacgcattaaaatccatgaaaaaacgggaacaggattaa

SEQ ID NO: 893 - DNA, 216 bp, Bacillus licheniformis
atgagcgctcagaaaatattcggctatcaaaaaatcatccgggacatttccttgttgatctacgatgcttatggattattcgaggcgctgttcatcaagagcggcttattccagaaagtgcagagattctggagcatttctttaaatgctgatttcaaatttcatgatgaacagccagaaaggagacgaagaacgtctctatttaacagagcttga

SEQ ID NO: 894 - DNA, 210 bp, Bacillus licheniformis
atggtgagggagtcgacagtcaaaagccttcttacatatttggagcttgacaagcagacaatcgccatcgccacctatgaaattgaacaaatattggatgtcgtcttaaatggccgaattgaagcaaaaaaggatgtcgaacagctgcgcgaggaatccggaatgtcgcttttggaatggctgaaacggtttattaaagaaaaaaattga

SEQ ID NO: 895 - DNA, 924 bp, Bacillus licheniformis
ttggaaacacttttggaattaaaaaatgtatcaaaaacgatcagggggaaaaagatcatcgagggcttgagttttgacgtgcgggcaggcgagatattcggcttcctggggccgaacggcgccggaaaaacgacgacgatccggatgattgtcggacatatgagcattaccgccggtgaaatcgccgtgtgcggcgtcagcgtaaaagaaaactttgaaaaggctgcacggcatatcggagcgatcgttgaaaacccggagctttataaatttttaacgggctaccaaaaccttcagcaatacgcgcgcatgacgaaaggcgtgacgaaaaagaaaattgacgaaatcgtcgagctcgtcggattgaaaaacaggatcaacgacaaggtcaaaacgtattcgttaggaatgagacaaaggcttggccttgcccaaagccttttgcacgatccaaagctgttgattctcgatgagccgacgaacgggcttgatccggcaggtatccgggaaatccgtgactatttaagaaagctgacgagagaaaagggaatggcggtcatcgtttcaagccacctgctttcagaaatggagctgatgtgcgacaggatcgccattattcaaaacggaaagctccgggatattcagcatgtgcacggacccgctcgggatgagaagaagcgctattatattcaagcggacgacacccaggctctcacacgggaagcggctgctttcagaaaggtgaaggttgacgaagcggaaggcgggatagagctcagcattcaaaaggatgaagtgcctgatttgattaaacacttgacagacagcggtgttcgcttatatgaagtgaaggctgtgaacaaatcgctggaagaccgattcctggaaatcaccgcagataaggaggaagctcagcatgtttaa

SEQ ID NO: 896 - DNA, 942 bp, Bacillus licheniformis
atgtttaatctcatcgtaaatgaatggatcaaaatttttaatcgaaaaggcacatacgtcatgatcggaattttgctgttagctgtcatcgggctgggcgttctcacaaagacgatcggagagacagaccaaaacacggactggaaaaaggaattggcgcaggaaaataaggacatgaaggaacagcttaaagggaacagcaatccaacacttgaaaaaaattatgaacagtcgatcgcaattaatgagtatcgaatcaagcacgatttaccggcagatggggattattcagctctgtctttcatcagcgatacgagcgggctcatctcgctcgccggtttgtttgtaatcacggtggcggcgggaatcgttgcgaatgaattcagctggggaacggtgaagctgcttgtcatcaggccgatcagccgctttaaaatcctgctggcaaaatattttacggtcctgcttttcgcattggctttgcttttcattctgttcgcaagcgcagggatcacaggccttgctttattcggggcaggcgacagcagccaggttcacttggtgtatgtcggtggaacggttgaagaaaaaagcctgctattgcatttggccggcagctatttgctgaattcgatttcgcttttgatgatggcgacaatggcctttatgatttcagcggttttcagaaacagctcgctcgccgtaggtatttcgattttccttttggttatgggcggaacggtgacaggcctgctcgcgacgaaatttgcttgggcgaaatacatcctgtttgccaacacggacctcactcaatactttgacggatctccggttgtttcagacatgacgctgggattctcgattgtgatgctggctgtctattttatcgtttttcatgtgctcgcctttgttgtattcacaaagagagacatcgcttcataa

SEQ ID NO: 897 - DNA, 201 bp, Bacillus licheniformis
atgctagaaggtaaagtaaaatggtttaactctgaaaaaggtttcggattcatcgaagttgaaggacaagacgatgtattcgttcatttctctgctattcaaggcgaaggcttcaaaactttggaagaaggccaatctgtatctttcgaaatcgttgaaggaaaccgcggaccacaagctgctaacgtaacaaaagcgtaa

SEQ ID NO: 898 - DNA, 1002 bp, Bacillus licheniformis
atgattacatttgaaggcgttgaaaaggtctatgaaagcggcggacagaaggtccatgcgctcaatggaatcgaccttcatgtggataaaggggaaatatacggcgtcatcggcttcagcggcgcaggaaaaagcacgctgatccgctgtgtgaacttccttgaaaaaccgacggccggaaaggttttcgtcggcggaagagacttaatgtccctgtcgaaagctgagatacgaactgtgaaaaggaagatcggcatggtttttcagcattttaacctgttaaattcaaagacgattttcgctaatgtcgctgagccgcttgcgcttgttaaaacaccgaaagccgacataaagaaaaaagtgacggagctgctccgttttgtcggacttgaggataaagcccgcgattatccggatcagctttcgggcggacaaaagcagcgcgtcgggattgcccgggcgctggcgacaaatccggaggttctgctctgtgatgaagcgacatcagcgcttgacccgcagacgaccggcgatattttgaagctgctgaagcgcgtcaatgaacaatataacatcacgattctgttaatcactcatgaaatgaatgtggcaaaagaaatctgcgacaaagttgcggtaattgaaaaaggaagaatcattgaatccggcagtgtgtttgacgtattttccgcgccggaaaccgaaacggccaaaagctttgtcaaatcagccatcgaccacgagatacctgaatcgattcaaaaattaaatctgaagcacctctaccagcttcaatttgtcggcgaatcttctgggaagccttttctttctcaagtgtcaaagcggtatgacgtagaagtcaacattctgcacggaacgattacagagcttcagggaattccgtttggcagcatgacggtcgagctgcagggggaagatggtgaaatcgggcgggcgctcgaatatatacgcagggaaaacattcgcatcagggaggtataa

SEQ ID NO: 899 - DNA, 651 bp, Bacillus licheniformis
atgctagttacatatgaccaaatcattgacgcactggttcagacgattcaaatgacggttttttcgcttttattttcaagcgtgatcggcattccgctcggcattttgctggtagtcacaagaaaggggcatctgcttgagaatccggcagtttttacgtttgtcaatatgatcattaacattttccggtccgtcccgtttatcattttaatggttgctttaattccagtgacaaggctgattgtagggacgtcgatcggcacatcggcagcgattgttcccttgactttttatgcggggccttacatcgctagactcgtcgagaactctctgcttgaagtggatccgggagtcattgaagccgctgaagcaatgggagcgactccgagacagatcatcttcaggtttctgattccagaagcgctcggttcgcttgtgctgagttttacggtggcaacggtcggattggtcggggcgtcggcgatggctggtgcgattggtgcaggcggtcttggggatttggcgatcacatacggctatcaaagatttgacacgctgacgatgatcatcacggttgcaattctcgtcatcgtagtgcaaggattgcagacatccggaaacgttctgtcaaaaaaattgagaagaagatag

SEQ ID NO: 900 - DNA, 819 bp, Bacillus licheniformis
atgaaaaaatttgcatgtgttgtgatcttcctgctgcttgcggcagtgatcgcggggtgcgcggcagactctgatgcgaaaaccattaaaatcggcatcagcggaacggatacgagaatttgggactttgtgaagaaaaaagccgaaaaagaaggcttaaagcttgaaatcgtcaaatactccgactatgttcagccaaaccaggctttggcgagcggcgacattgacgccaacgcttttcagacgatatcctactttaatgcattcaaaaaggaacgcaaccttgaattatcgccggtcggcacaacgatcatcgctccgatgggcatttattccgagaaatatgattcgcctggcgatataccaaacggcgcggaaattgccgttccaagcgaagcgacgaacatgggcagagccttgcttctgctggagtccgccggcctgcttcaattaaaggacggatttgacggaaatggaacgcttgatgcaattaaagaaaatcctaaaaaactcaaaatcacaacggtggccgcagagcaaacgccgcgcgtgcttgccgatgtcgctgcatccgtcatcaacaacggcatagcggttgacgccggcttccatcctgtcaaagattcgatcaaactggaagatgaaacagcgacaccgtacatcaacattattgcggccagaacagaagaccgggatcgcgaagatttgaaaaagatcgtcgagctgtatcaagcagacgacactgctgaattgattaaaaaagaatttgacggagcacagctgccgactttcgttcctctaaaagacatcggcgaataa

SEQ ID NO: 901 - DNA, 1386 bp, Bacillus licheniformis
atgacattatttgttgttattaatattatcgtcatgctcggcctgatggcgctcctttatatgatgcaaaaaaagcatgtttctttttctaagcgggtatttaccgctctgggaatcggaattgtttttggattcgctttgcattttatatatggttcgtcttcagaaacgattacgcagacttctgattggtttaatatcgcaggcggcggctatgtcaagcttttgcagatgatcgttatgccgcttgtattcatctcgattttgggtgcttttacaaagcttaagctgacgcacaatatcggaaaaatcagcggattgatcatcgggctcttaatcgcgacgacagccgtcgctgctgcggtgggtatcgcgtccgcgcttgctttcgacctgcaggccgtccatgtggaccaaggccaggcggagacaatgagaggggcggaactcgaacagaaatcgcaggacatggaagccaaaacgcttccgcagcaaattgtcgagcttcttcctggaaatccgtttttagactttactggagcaagaccgacatcaacgatcgcagttgttatttttgcggctttccttgggatcgcttatctcggggtcaaccgaaaacagcctgaacaagctgaacttttcaaaaaaatggttgatgccgtgtatgcgatcattatgcgtgtggtcaccttaattctgaggttgacgccttacggtgtattggcgatcatgacaaaaacgattgcaacgagcgacctcgacagcattgccaaactcggcaaatttgtcatcgcttcatatgcggcgctgatcgtcatgttcatcattcacctgctgctcattacattcagcggtttaaatcctgtcacatacttgaaaaaggcgtttccagttcttgtattcgcgtttacatcaagatcaagcgcaggcgctttgccgctgaacattaaaacgcagcgaagccttggtgttccagaaggcattgcgaactttgccggatccttcggactgtccatcggtcaaaacggatgtgccggcatttaccctgcaatgctcgcgattatgatcgcgccgactgtcggccaaaatccgcttgatccgtcattcttgttcacggttatcgcagttgttgcgatcagctctttcggagtggcaggcgtcggcggaggtgcgacctttgcagcgcttctcgtcctttcggcattaaacatgcctgtagcgcttgccggacttctgatttctgttgagccgctgatcgacatggggcgtacggctctcaatgtcagcggcagcatgacgtcaggacttgtcacgagcaaagtgacaaatgagcttgaaaaagacacgtaccaagaccgtacaaatatcattgaagcagaagtgtaa

SEQ ID NO: 902 - DNA, 342 bp, Bacillus licheniformis
ttgtttagaagaagatctggcatccatcccgctgtattagttttaggatcagctgcattaaccgcggctttttctcccgaaatccgcaaaagattgaccggcatgttcgcgaatggcatgagaggacggcagcaaggaagcggccgcaatcagacgatgatgaatccggctgacatgatcaagcaggcttttaatccgggaggacaatcacatgaacaccgccagtcaggccatacggcaaatgaccagcatcaatcaagccatatgactgctccggtgaatgtcatgaacgatcaggctgcagctcagacgatgttcgatgacgatcaaagctattcataa

SEQ ID NO: 903 - DNA, 1797 bp, Bacillus licheniformis
atggaaaaagcggatagcattttgcatgcgctgcgcattaaagactttgcggtacatcccgatgagactcagcttatttttgatacaaacctcaacggaacatcgaacctgtgggcgatggatcttcccgatacatacccgtaccagctgtcattcttgaatcaggactcaaaaggaattgcctacaatcccgacggctcaatcctttatgctggttttgacaatgacggaaacgaacaaagcggactgtacaagctttctttaaaaaacgggacgttccaatcattaaacggaaatcaaacagaccgccacttcgcccccatccctgtgcaaaacgcagtttactactcctctacaaaggacaatccgacatttttaaatacatacagatatgattgtctcactgaaaaagaagagcttatttttgaaggaaaagacggaacttcaatgctgtctgatgtaagcccgggcgagaaagccgtcagcatacatgtctactatgtcaacagccattctgtctgtatggtccatacagctgaaggcgtgacgacaggaatcttcccggatgagacgctgcctcacatggtttattcttcccattttgcatctgatgatcggttattcgtcacgacaaactacgaagccgagttctcatatcttgccttgtacactgtttcatccggtatttttacgccggtgctttcgattgataaaactgatttaacatccatccacgctgacccgaatggaactttcctttatctcattggaaaaaaaggtgtcaaagaggtgatgtatgagtacaacacagcaacggggcaaagccggcagatcgattgcccttgcacatccatttcgaaaatacactgcgcctattctggtacgctgtacattctcggctcaacgccgaccaggccgactaatctctacgtattaacgaaaggacagtcaaaatggcggcaattaacgaaacattcggttccgggtttctccgaacaggagctgtcttatcctgaagttgtgacatatccttcttttgatggcctgccaatagaaggactgctgtttaagccctccccggtagaagcgaacggctggacgattatttggccgcacggcggaccgcaagatgcagaaacctttatgttctacgatctctttcaactcgctgcaaaaatgggttaccagttattcgctcctaatttcaggggatcagcgaattacggttattcattctttaaaatggttgaacaagattggggagacgggccgcgcctcgatatgaccgcgggcatcgactggcttatcgatcaaaagcttgcagaccgcgaaaaactctttttaatgggcggcagctatggaggatatatgtcgcttttgctccacgggaggcatcctgagtatttccgcgccgtcgtcgatatatgcggagtcagcaacctgttttcgttcgtcaaaaccgtacctgatttctggcagccgatgatggaaaaatgggtcggcaatccggagcgggattatgaaaaaatgaaagccgattctcctgttacatatctggagaatatgactcagccgatgctgatcatccaaggcgcaaacgatccgcgcgtcgtaaaggaagagtccgatcaggtcgtcgatcagttgaggaacatggagcggaatatcgagtatctcgttttggaaaatgaagggcacggtttttccaaaaaagaaaataaaatgaaagtctaccgcgccattttcgaattttttgaaaagcaccgcttatatcacgcggccaaggttgaagaataa

SEQ ID NO: 904 - DNA, 561 bp, Bacillus licheniformis
atgttcaatatgaaaaaaggcgcgattgctgctttgctccttccgctgctgttcacagccggatgcggcatggcaaaccaaggggcagataacaaccggcgcaatcaggacaatgcgcttcaaaatgtaacaaacagagataacgacgctacgaatgtcaatgacggcagaaatgtcaatgaccgaatgaatgtgacagacaaccgcgatgccaatcgtgaagacaataatatggaagtggcggataaagccgcagataaagtggcggaacttaaagaagtcagtagtgcaaacgtgattacgacaaaccgcaacgcttatgtcgcggtcgttttgaaaggcaatccgaaaggcaacttgacgaatgagctgaaagggaaaatctcgaaaaaggttaaagaaacagacaataacatcaacaatgtgttcgtttcggcaaaccctgactttgttgaccggatgagaaactatggcgacagaattcaaaatggcgaaccgatcgaaggactttttgaagaatttggtgaaacgatcaacagaatttttccgaatcaaagataa

SEQ ID NO: 905 - DNA, 894 bp, Bacillus licheniformis
gtgacgggggagatgaaagcagcctttgttttaatcatggcgggcgctctatccgctctgttattggccatttttgtcgtgttcagccaagagagccctgaggcggctgtgctttcgggaaaaaaagaaaaactgaaagaatcgctggaaatggtcaaatatgaaagtgtcagcatttattacgctgaaaaagataggccgattctggagctgacaaaggagacgcttcgggatgccgctgatatgaatcgggaactgtttgtcagtcctcttcaagacagcgttgatttgatctttttttcaaaccgcgatgatatggagtcattttcaaaattaaaggatataaccggattttattcaaacgatatgaggatgatcgggcttttgcccgaggagaggaagcatctgaataacggcgagggattcgccgtcttcctgtacaaacgggtgctggtgcatgagtatacccattatgcttttcacgtcaagctgagagaactgaatgccgacccgggaacttatccgctctggtttcacgaaggagtagctgaatgggcttctgctcatgccgcgatagaaatccggactttgccttcagtcgtccccttgagcaagctgaagaccgaccggcaatggcaaaaagcccggactggatatgaaaccgatatttatttgcaaagttattatttgatcgaagagcttgcggagaaaaaaggaaggggcgtcatcctcgacattatcgaggaaacggctgagcggggaagttttgcagacggatttaaggccgccgtcggccagtcgttgacaggttttgagaaagaatttaaacgaaaatacgaagcgaaaaaaacggcgttgaagtttcatcttcaatgccgttttcatgatcaatga

SEQ ID NO: 906 - DNA, 648 bp, Bacillus licheniformis
gtggaacagcaaaaccagccgcaaatgcagatcaatcaaggcaatgaaggtatgcagcatatgaatcacggggggcacgaagtgttcgacatgcatgaagtgctgtccggaatgatcggcgtccttgagcagtatatgatgttcagggagcatgtcaaagatccggagctgctcgacattttggacaggcagcatcggtttatttcgtctcagtacaacattacgacagaatgtttcagaacggggcaaaagccgagtcaggaaacggcaacgtatatgatgaaagaggaccgcaaattcgtctacggtttaaaagatgcccagccgaaacaaccgaagcaatctgtgcaggctattgatgacgcctgcatcagcagctttatgctcggcttgatgaaaacttgttgttcgtcgctggccatggcggctcccgaagtgacaaaccctgtctgcagaagggttctggcagaccagattcctcactatatcgaaatggcttatgaaattttcctttatcaaaacaaacacgggtactatcaagttcctcagcttgcgccgcaagacatgcagaagatgacttcagcattcgctccggtgcaaggtcagccgcaaatgcctccaagcgggcagcagagacctattcattga

SEQ ID NO: 907 - DNA, 2025 bp, Bacillus licheniformis
atgctgggctcaagtgagacggttggaaaaaagtcaggtttatttggtaatgattctgtgtatccaaaggtgcaaacagaagtatataaaaaaatcaatgaactgagtggttttcataggctggatgatatttatctttccttgatcgacaagtatatgtttccttgtctgatcctgaatgaccggggagaaattgtcgcgtcctcggaaagtgctgatcaatatttgaaaagctcaaaaggcagcattcatcaggtttttcccgcgagcttatccgtacaggtcaatgccgcgttacagcgggcgaagaaagagaaaaaagaagtatcgtttaaaaacgtcccgatttatttaagcggagaactatcctttgttcatttgagattaaaatgtttcttccgccagtatcacaagctttatgtgctgtttatcgaaaaagcacaagaaggggcagccaacgcgccggtatccggcggagaggacggccagcttcatctgcaacatctgtaccggacggtaaaagagctcgaagcgtccaacgatgctttagtgtccgcaaatcaaaagctgcaggaggaaaacagaaaattgacggcgctcaacagggcgtttgaaaagaaagtgaacgagctgaacacccttaaaaatgatatgaacaatctgctgaccagcacgaacatcgccgcagtttttttggatcaggaattgaaattgaaattatttactccagaagccgccaatatgttcgacctgaaaaacgaggacctttcaagacctgccgataagctgacagagaggtttaagtatgaagggtatgccgatgacttaaggcgcacgctatatgaaaacaagacggtcgtaaaagagtttgaaatgccagacggcggctggtatgccgtaaaaatgatcccttattatacatcgggaaacatggttgaaggcattgttgtcacattcacgaatgtcactgagctgaaaatgacaaacgaggcgctgcatatcagctcacaagctatagatcaaagtccggccaacatattgatcacttcggtcgacggttcggtcacttatgcaaacaaacgcttttgccggatgttcggaaaacatcaggatgacatcatcggcggcaatgtgtttgatatttaccgcaagcattttcactgtgaggatctcactcgcttctggaaacgcgtccttgaaaagaaaccatggtcaggagaacttaattaccaggatgaggagcagcaggacaggtgggagcaaatctcccttgttcctgttgaggacagcgcggggaacgttcagcaggttatgctgatatccgaggacattacaaaccaaaagcgatctgaaaaaatgctcatgaaatcggaaatgctgtcggcggtcggccagctagctgccggaatcgctcatgaaatacggaacccgctcacttctctgaaagggtttctccagctgatgatccaatccaaaaaatatcaaaaagactatgcggaagtgatgatgtccgaattcatcaggcttgaagcaatcatcaacgaatttctcgtattggccaaaacgaaatcgaatacatttgatccggttcaggtcaactcgattgttgaagatgtctgcatggtattggagtcgcaggccgtgctgaacaacgtaaggatcgagaaacagctgagcggagatctacctgagattctcgctgtttcaaatgagctgaaacaggttttcatcaacatattaaaaaatgcaatcgaggcgatggaggatgctgaaggctttattacgatacgttcctattttgaaaaagacagcgtattcatcacctttgaagatcagggaaagggcatctcaaaagaagtgctagaaaagcttggggagccattttatacaacgaaggaaaaaggaaccggtctcggattaatggttacatttaaaattattgaaaatcacggcggaagcattcatttcgaaagcgaagaaggaaaaggaacgatcgtaaaattgaagcttccgattaaagaatga

SEQ ID NO: 908 - DNA, 3621 bp, Bacillus licheniformis
atggtcaatgttgtaaagagccgttttatggctggtttgacaatcacgtttatgatgattgcgtcttttttgacgccgtttgcggacgtaacgcacgcttcagaaacgatttcagtagaagaagccattaagcataacgaagggcatgcagccgttgaaggctatgtcgtcgggcacacaatatcgagcggccattatcgtttcagcggaaatttcgctaacgattataacgtcgcaatcgctgataaaaaggaggaaacatcacctgagaacatactccccgtgcagatacccgcacctttcagagaccagttcggtttaaagacaaaccctcatctcatcggaaaaaaactcatcatcgaaggcgaacgcactacatattttaattccccgggtttgaaatctgttcaatccatcacattttccggagacgatgcaccgtctgcccagccggagaccaaaacgatagccgaagcgcgcaagcttttaaatgaaacggtcaaaatcaaaggaatcgtcactgccgatcaggcggctgtcggaggaggaaagctgtccacatttatccaggacgatacggcgggaatcaatatctattccgctgcgcaaggcgattttccggaactaaaagagggtatgtctgtttcggtcacggggaaaatcacgacatacaaaggcttgacagaaatcgtacccgcaccgtcaggcattgaagtaaccggagaaggggcggcactgcccgaccctgttccgctgactattaaagatgtgctcgatcagggaaccgcagctgaatacgaaggccggcttgtgaggatgaaaggctttattgaaacaaagccggatgcgccggcaggcggcggctataatatcacaatgatcgatgaaaactatcatccgctcacactaagggtgatggaacaaacgaatgccgccgcttcgatagaacaaggacaatggtacgagattaccggcatattaagccgctatgattcggtgcagcttctgccgagaaaacaggaggatcttcggaaattagacggcgccgcgcatcctccccccgctgctgaaggggaatacgaaagcgttgtggaacgagtcgtcgacggggatacgatccacttaaaagagcctgttctcggatctacaaaagtccgctatgtcaacatagatacagccgaaacttatcataagccgaaaaatgaattagatgaaaaccagctgcagcacggaaacaaggcgaaggaatatttgcagtcgatattggccccgggagacaaagtcaccgtgaaagtgggcaaggaagcaaaagacagctacggccgcctgcttgcccaagtcatcactgaagacggcgtcaatacgaatttgcagcttgtccaaaaggggatggctgtaacctacttcatttggccggttggaagtgatgaagactatcaattgtttcaaaacgccgtcaaaaaggcgaaaggcgataaaatcggcatttggaatcccgctgatccgctcctcgaaatgccgtttgaatttcgcgacagggagcaaggcaaagggctgacgcggcatgtcggagactctgcggaaaatacgtatgtcgcgcctgaaaagtggcgggagattccggtggaaagacgaattttctttgcgtcggctgaagaagcggaagctgcgggctattcgaaaaaagagcaaagcggcaatattccgctgcgcctgttaagcatgaatgatctgcacggaaagatcgatcagcaatatcagctcgatctaaacggcgatggccggacggatggaacattcggcaggatggattatgcagcatcattgatcaaagagaaaaaagccgagcaggaaaacacgctgatcgtccacgcaggcgatatgatcggaggaagctcgccggtttcttccctgcttcaggacgagccgacagttgaagtcatggaggaaatcggatttgatgtaggaaccgtcgggaaccatgagtttgatgaagggaccgaagagctgctgcgcatgttgaacggaggcgaacaccctgaaggcaaagggacaaaaggttacgacggacaggatttcccgcttgtctgcgccaattgcaagttgaaggcaagcggggacagctttcttcctccatatgaaattattgaagttgaaggagtgcctgtcgcttttatcggcgttgtgacacaggcggccgccaatatggtcatgccagaaggaattcgctcaattgaatttacagatgaagcaaaggccgtcaaccaggctgcaaaagaactgagagcgaaaggtatccgggcaatagcggtgctcgcccatatgacagcttcacaggacggcggggttgtgaccggcgaatcagccgaacttgctaaaaaagcagatcccgagatcgatgtcatctttgccggccacaatcatgaagtggtcaacggccaagtcaatgatattttaatcgttcaagcatacgaatacgggaaggcaatcggtgtcgtcgatcttgaaatcgaccgggaaacgaaagacatcgttcacaagaaagcggaaatcgaatatgtgaatcaggaaaatctcaagcccgatccggcggtcggtcagatactggataaatatgagcggatggttgcgccgatcatcagcgagaaagtcggtgaggctgcgcacgatatggccggcggctattcaaatgacggagacacccctctcgggaatctgattgctgacggtatgcggcaagcgatgaattcagatttcgcattaatgaacgggggcggcatccgccaagatttaaaaaaaggaacgattacatggggagacttgttcaatatccagcctttcggcaatgtactcgtccggcttgaaattaaaggcagggatttatacgatattatagacgcgcaaatatccccatcttacggcccggattactcgatcagcggcttcgcttatacatgggacccgaaaacaaataaaaccgcggctatttttcttgaagacggaacaccgattgatttagaccaaacatatacgctgaccgtaaacaactttatggcatctgcttcaggaagcaagtatttgccgatttccaggcttggaaaaaatccggtcacaggtccggaagatatcgaagccacagtcaaatttgtcaaaagctttaaagaaccgatcgcttatactgccgaagggcgaatcaaaaaattagcagaagatgattcgcgtccgggagaacagcccggacgcggggctgatccagatgacaaagaaaaacccggaagcggaggcgctgatccgaatgacgaagaaaaaccgtctggtgataagggcgatggggggaaacccggcaatgacaccggagaaagtccggttcatgacggtaccggcaatgcttcaaggagcggcgctattcctgttgcgggcatgacgaccggtgaaggatcagatgcgcctgcggagaagatggacggtctgtcaaatgatgcgtttctgccagacgagcgtgaagagcgcaagctacccgatacggcggcagcttacggcggtttccttttatacggcttcctgacgtttatgttcggagcgattctttatatgcggaaaaggggtattgcgagactatga

SEQ ID NO: 909 - DNA, 591 bp, Bacillus licheniformis
atgaaagtcaagatgttatcgtttctgctgatgatagcggggcttgccacttttgcatacggcggctggaaaatattcgatatgaacagacagacggatctttctttaactgaagcaaaagaagccattgcatcgagtcaatccgcccgttcggctaagcacccatcggcgcccgcttcatttaagcccgccgccggcgaagcggcaggcatactccatattcccaaactgggcgcagagcttcccatcgttgaagggaccagtcccgatgatttggaaaaaggcgtcggtcattataaaggcagctattatccaaaacaaaacgggcaaattgttctttcaggccacagggatacggtttttcgcagaacaggggagctggaaatcggagataagctgaaaatcgagcttccatacggaagcttcgaatatgaaatcacacacacgaaaattgttgaccaaagtgacacgtccatcatcacgctgcagcgtgaaaaagaagagctgctgttaacgacatgctatccgttttcttatatcggaaatgcgcctgagcgctatattatttatgcaaagccgctgaaaggatga

SEQ ID NO: 910 - DNA, 918 bp, Bacillus licheniformis
atgaaccaaaaaaatcacggcttattcttcagtgcagacatacggcatcacggcgaacttttatatgcatatttaaaaagagaggcgaaagcatcgaagcctgtcattcaatactggatcgcaaacgagaaagttaaagtgaatcataaatcggtgaatcataacgttcggctggagagcggagacagcgtgatgatcgatctcagagaggaggaagaaagcggaatcgtccctgaatacggggaacttcccgtcctgtttgaagatgatcacatgcttattgtcaataagccggcgggaatggcgactcatccgaatgaagccggccagaccggcacgctgagcaaccttgtggcgttttattttcaaatgaacggggaggagcgaaaagtccggcacgtccaccgtctggacaaggatacgagcggcgctgtcgtttttgcaaagcaccgcctcgcccacgcgcttttagacgaacagctgcaaagaaaagaactggcgcggacatatgtagccgtagcggaagggaaattcagaaaaaaaacgggaaccatttcggcgccaatcggcagagacaagcaccaccccgtcagaagaagggtgtcccattccggacagcccgctgtcacccattttgaatcgaaaggatatgacagccgtcacgatgttacactgtgcagacttcagctggagacaggccgaacccaccaaatacgcgttcaccttgcaagcatcggtcatcctttgtcaggcgacaccttatacggcggttcaaaggggctttttcagagacaggctcttcacgcaatcgagatcaatgtcacccatccgatcacaaaagaacgtgtcactgtcgcggcaccgcttccggatgatttaaaagacgaaatcggacgactgttcggcacggttgattaa

SEQ ID NO: 911 - DNA, 360 bp, Bacillus licheniformis
ttgcgaattgtaaaggcagcaactgaagaacaagaaatttatatcgaagagcttgtatcagagctgtatcaaatatttccattgtacttgaataaacaaaaaataaaagaactcaaaaagcagggcgcgcttcaattgaaagaggatgaatacaaaggaacgctcgatgaagcgtttcagattatgacaagcctgcaattgatccatgcattattaactaaggcgaagcgcaagtgggtgctcaaagaccgtgatctgttcgataaaaatagccgcaagctgaatgactgcggtctgtacttccctctaacatctgccgactttcatatcgtgaataccgagaataaaatgctgatgtaa

SEQ ID NO: 912 - DNA, 426 bp, Bacillus licheniformis
ttgacgacaatcagcaatgcgatgtctagacaagtggcgacaatttcttccaatcaaacggttcaagaagcggctgagttgatgagccgccataatgtaggtgcgattccggtcgtagatcaaggcgtattaaaaggcatgatcacagaccgtgatatcacgctcagaacgacagcggaaggccaggacggacagacacctgtttcaaacgtcatgacaacaaatgttgtttcaggaaatccgaacatgagccttgaagaagcatcacagctgatggctcaaagccaaatccgccgtctcccgatcgtcgaaaacaaccatttagtcggcattttggcgctcggggatctggcggtaaacgaattgtccaatgaatctgccggacaggcgcttgcgaacatttccactccggcacggactcagtaa

SEQ ID NO: 913 - DNA, 663 bp, Bacillus licheniformis
atgattaaagcagtgatttttgattttgacggtcttattttagatacagaaacgcacgaatatgaagtgctccaggaaatttttgaagagcacggctcagagctgccaatgtcggtttggggaaatgtcatcggcacggccgccggattccagccgttttcttatctggaggaacagctgcaaaaaaaactggaccatgaacaactaacgaaattgagacaagagcgttttacgaaaagaatggaaaatgaaaaagcgcgcccaggtgtggaagcttatttgtccgcggcgaaagagctcggtttaaaaatcgggctggcgtcaagctcagattataaatgggtgtcccagcatttaaaacaaatcggtctgtacgatgatttcgaatgcatcagaacggccgatgatgttgaggaagtcaaaccgaacccggaactctatttgaaagcggcggaatgcctcggtgtgaagcctgaggagtgcattgcattcgaagactctgtcaacggatcaatcgccgcgaaaagagccggaatgaaatgtgtcattgtaccgaataaagtaacgaaaagcctgctgttcgagcattatgaccaccgcctggaatcaatggcggaaatggagctggaacagctgatcgaaaaaatctccgatccatcataa

SEQ ID NO: 914 - DNA, 1539 bp, Bacillus licheniformis
gtgtccgaaaaactggatctttcccgctttgaaaaaaagatcgtcatccgcaatattgaagaaaaagatatcgacagcatcatcgggcttcaagagctttgttttccgggaatgatcccatggaaacgggagcatctggaaagccatttggaacacttcccggaaggccagttttgcgcagagcttgacggagaagtgatcggttcctgttcaagcctgttgatcaactttgatgaatatgacgacagacatacatggcaggatattacagacgacgggtatattacgaatcacaatcccgacggcttaaacatgtacggcatcgaggtcatggttcatcccgaatacagacggatgaagatcggccaccgtctctatgaagcgcgaaaagatctggcaaggcgcttgaatttaaagagcattatcatcggcggcagaattccgaactatcataagtacgcttccgagatgacgccgagggagtatgtcgaacaggtcatccaccaccagatatatgatccggtcctttcgttccagctgctgaacggattcaccatgatgcggatcaacccgaactatctcccggatgacagagcatcaagcaaatatgcgacattgatggagtggaataatgtcgactacttgccgcagacgaagcgctattacaaatcagcttttccggtgagaatatgcgtgattcaatatgaaatgaagcagatccattccttcgaggagttcgccaaccaagtcgaatactatgcagatgtggcttcagacgcaggagcggattttgccgtctatccggaaatctttacgacgcagctgatgtcgtttctggaagagcgctcaccgagcctggccgttcagcggattaccgaatatacagaagactatatcagcctgttcacagaccttgccgttaaatacaatgtcaacattatcggcggttcccacttcgttgaagaagaaggaaagatctacaatatcgcttacttgttcagaagggacggaaccatcgaaaagcaatataagctccatattaccccgaatgaacgaaaatggtggggcatcagcaggggggacgaagtgcgcgtctttgacacagactgcggcaaaatcgcgatccagatctgctatgacatcgagtttccggagctaggcagaatcgcaaccgaaaaaggggccaagattatttttacccctttctgcacggaagaccgccaaggctatttgcgagtcaggtactgcgctcaagcaagagcggttgaaaaccaggtgtacacggttatttccggaacggtcggcaatctgccgcaaaccgaaaatatggatattcaatacgcgcaatccgcgattttcgctccttcagattttgaatttgcaagggatggaatcgtcggcgaatgcaatccgaacattgagatggtggtcatcggcgatgtcgacctggaaattctcagaagacagcggcaggacggaacggtccggcagctcaaggacagacgccatgacatctacaggattcattataaaaaatag

SEQ ID NO: 915 - DNA, 1629 bp, Bacillus licheniformis
atgattatatgcagtttgcaacatgtcggtcaaacttacggaggacatacgattttcaacgggctgtcatgggacctgcaccaaggggagcgcgtcggtctgatcggacgaaatggggaagggaaaacgacgttgttgaagctgatcagcggccaaatgaaacctgatgaaggtcttgtgacatggaaaaaaggattatcaacagggctcttggagcagaatcccgcatgggacggcagcaaaacggtaaaagagctgctgtatgatgttttttcatcattatggaacacacagcagaagctttcccggatcgaacgtcaattggcggttgaaaaggacgcggaaaaactcagattccttttggaaaagtacggggctttgcaggatgaatttcagcgaaaaggcggctacggcatcagcgcgcaaatcgaacgggtggcgcacggcttgaatatcgagcggctattcgatgccgagtggcgggagttaagcggaggcgaacggacgaaagcgggtcttgcaaggcttctcctgtcagctccggatctgcttttgctggatgagccgacaaaccatttggatttaacatcgatcgaatggctgacgtcttttttaaagcagtacaaaggtactgcggtcattgtgtcgcatgatcgctatttcctggatgaatcggttacttcgattctcgaaatcgaccaaggagagcttcacttttcaaaaggcggctatacacactatgctgatgaacgggaagagcgccttatgagagaatttcatgactatcaggatcagcagaagaaaatcaaaaaaatgaaggaaacaatcaagcggctgaaggaatgggcgaatcgcgccaatcctccgaatgacggcctgcaccgaagagcgaaaagtatggaaaaagctttggagcgcatggagaaggtgaaaaaacccgttctggaacgcaaaaagatcgacttagttttcagcatggatgaacgaagcggaaaagatgttgtcaggcttgaggatgtctgcaaaagcttcggtgagcggcagctttttgacaatctcagtatgcatgtccgttttcaggagcgcgccgccatcgtcggagagaacggcagcggcaaaacgacgctgctcaacatcatcagcggaaaggaaacgccggacagcggtgacgtgcagcttggcagcaatttatcggccgcatatctgactcagcatgtcggtgaaatggaggaagagcgcaccgttttagccgaattccgtgaacatgtttctgcatcagaaggcgaagccagaatgatgcttgcaaagtttttgtttttcggccaatccgtcttccgaaaagtgaaagatttaagcggaggcgaacggatgcggcttcgcttggcacagctcgttcaccaaaatcataatgtgctgatcctcgatgagccgacaaaccatttggacatcgaatctaaggagatgcttgaagaagcattaagccaatttcaagggacgattattgcggtttcgcatgacaggtactttcttgaccggcttttcaatgtcatctggtggcttgacggcagaaaactcgtcaagtatgaaggaaactatacattcgcaagggagaagcggcagcagggttga

SEQ ID NO: 916 - DNA, 801 bp, Bacillus licheniformis
atggcttttcgaaaaccggatgaaatagcgaatgcagcaattgaagcagggatgaaaaaagtacagctcccgctgccgtctctgcttgtattggggtttttaggcggcgcatttatcgcgcttggttatttgcttgatatcagggtaatcggcgacctgccgaaagaatggggaagcctgtccagcctgatcggagctgccgtatttcctgtcggtctgatactggtggtgctcgctggcgctgaattgatcacagggaatatgatgtccgttgcgatggctttattttcaagaaaaatatcactaaaacaattggcggttaactggggaatcgtcacgattatgaacttaatcggcgcactgtttgttgcttactttttcggacatttggttggattgactgaaacaggcccttatttagaaaaaacgatcgccgttgcacaaggaaaactagatatgagcttcggcaaggttctcatttccggcatcggctgtaactggcttgtatgtcttgcggtatggctttctttcggcgcacaagacggagcagggaaaatccttggcatctggttcccaattatggcgtttgtggccatcggatttcagcacgttgtcgccaacatgtttgtgattcccgcagccatttttgcaggctcattcacctgggggcagtttatcggaaacatcattcctgcttttatcggcaatgtcatcggcggagcggtgtttgtcggtctcatttattttattgcatatcctaagaaagaccgctccagaaaagaaatgaagcaggtatcatga

SEQ ID NO: 917 - DNA, 912 bp, Bacillus licheniformis
atggagtttctgtttgttttactgccggttttcgggatatttgcgatcgggttcatcggacaaaagctgcttcattttgatattcagaacctatcgaaaatgtccctgtatttaatgtctccgtttttagcgtttgatacgttttatgagaacaagctgacgatggattatatttatatgtctgtctattgtctcggcctctgtttaactttgattctatttgtctacctcatttcatatgttcacggatattccaatcaggagcggtgcgctctcgttttatcatccgctttcatgaataacggaaactacggaactcccgtcgtcctgcttgtctacggcacggccgggcttgatatcgccgttgtgctgatggttcttcagcagcttgtcatgagcacgattggcatgtattacgcagcgaaaggaagcccagaagcgggcggatttaaaatcgtgatgacgagggttatccggatgccggtcgcatacggtgcgctgctcggcatatgctttcagctggggcatatttcgattcccgaacagttaatgacaggaattaaattggtgggagatgccgcgattccgacgattatgattattctcggcatgcagcttgcggtgatttcctttcaacatatcgaataccggaaaatttcttactcgcttttgctgaaattattcgtgtctccgctcattgccctggggtttgcgctgattcttccggtcgacgggctggtcaaacagatcatggtgttggcggcggccatgccgacggcggcgaacacgactttgatggccgtacagtttgaaacaaagccggaaatcgtttcaagcgcgacttttatcagtacaatgctcagcatcgccacccttccggtggtgctgtggctgctttcattatggggctga

SEQ ID NO: 918 - DNA, 993 bp, Bacillus licheniformis
atgaaagcgatcatccatgaaggaatcaagggcctttcagggctgaaatatacagacgtttccgacaaaacgcccggccccggtgaagtcaaaatcaggctgaaagcagccgggctgaaccaccgcgacttgttcctttttcagtccagaaaggcaggcgatgccccgtttattcccggatccgacggagcaggtatgatcgaagagacaggtgaaggcgttcgggacctcgccgttcatacagaggtgatcatcaatccgagcatcggctgggaatatacggattccgttccgcaagtgccggacattctcggcggcccctctgacgggactttcgcagagcatgtcatcgtcccggcgaagcacgtgttgaaaaagccggcgcacctttcctgggaggaagcaggcgtcctgcctttatccgctctgaccgcttacagggctttatttacgaaaggacatttagaaaaaggcgaacacattctcataccgggagccggcggaggcgtcgccacaaatgcgctgctcatggcaaaggccgcgggcgcgcgggtgattgtaacctcccgaagcgaagaaaaaagaaaagaagcgctccgctatggggcggacttcgcaattgacagccgcggcctgtggaaggaaagcttggatggggaacgggtcgatttaattctcgacagcatcggtcccgccacttttgcaaattatttcgatgtcattaaaccgaacggaaggatcgtcattttcggtgccagctctggagaaagtatccagcttccgctgcgctcgctctttttcccgcagatcagcatcatcggcacttcgatgggcagcctcgaagaatttcggcaaatgattgattttatcgaacgccattcccttaagccggtgatcgatcaagtatttcctttatcagaagcggttccggcctttaaacggatgaaagacggggagcagtttggaaatatcgcattgcaaatagacgggtaa

SEQ ID NO: 919 - DNA, 558 bp, Bacillus licheniformis
atgagttttcacgatcaaaatattttacctgcggtacgcaatatgaagcagttcgatacattcctggacagccctttttcatacggggtgctgcttgacatccatcttggacagctgggaggcgtgatcagcgcggcaagatcccatgggaaaaaaatgtttgttcacgtcgatctgatccaaggaattaagcatgatgaatacggtgcggaattcatttgccaggaaatgaaaccggcgggcattctttctacgagatcaagcgttatcgccaaagcaaagcagaagaaagtgtatgcgatccagcgcatgtttttaatagacacaagcgccatgaagaagagcattgaattggtgaaaaagcacagacccgactatatagaagtgcttcccggagtagtgccggaattgatcagggaagtcaaagaaataaccggcattccgatctttgcgggcgggtttatccgtaccgaaaaagacgtcgagcaggcgcttgcagcaggggcgtccgcagtcaccacctcagacactgatttatggaaaaaatactggaactaa

SEQ ID NO: 920 - DNA, 816 bp, Bacillus licheniformis
ttgacagcattttggggggaagttatcggaacgatgctgctcatcgtctttggagctggagtttgtgcaggagttaatttgaaaaaatcgctgtcccatcaatccggatggattgtgatcgtcttcggctgggggcttggcgtggccatggcggtatatgccgtcggcggcatcagcggagcgcatttaaatccggccgttacattggggctggcatttgtcggagattttccttgggaagaagtgccttcatatattttgggacagatgatcggcgcatttttaggagcggtgctcgtttttcttcactacttgccgcactggaaagaaaccgaggatcaaggcgcgaagcttggagtattttcgacaggtccggcgattccaaatacatttgcaaacctgttcagtgaaacattggggacttttattctcgttctcggacttttaacgatcggtgcaaacaagtttactgacggactgaatcctcttgttgtcggatttctgatcgtggcgatcggtatctcgctcggcggaacaacaggctatgcgattaaccctgcccgcgatctggggccgagaattgcccattttgtccttccgattgcaggcaaagggagttcaaactggaagtacgcgtggatccctgttttaggaccggcgcttggcggttcatttgcaggcgttttttacaacgccgtattcaaagggcatatcacaaacacattttggattgtaagcgttatactagttgtgatattgttaggtttctatattcatatgaaaaaacaagcagttgatcaatcggtcaacatttaa

SEQ ID NO: 921 - DNA, 1491 bp, Bacillus licheniformis
atggaaaagtacattttgtctcttgatcaaggcaccacaagcacaagggcgattgttttcaacaaagcaggcgaaatcgtccatattgcgcaaaaggaattccggcaatattttccaaaccctggctgggttgaacacaatgcaaacgaaatctggggctctgttctgtcggtgatcgcttcagcgctttcagaatcggggatcgaagccggacaaattgccggaatcgggatcacaaaccagcgggaaacgaccgtggtttgggataaacataccggcaaaccggtctacaacgcgattgtgtggcagtcccgccaatcggctgagatatgccaggaattaaaagagaaaggctatgaagagacgatcagagaaaaaacagggcttttaatcgatccttatttttcaggcacgaaagtgaaatggatcctggatcatgtggaaggggcaagggagaaagccgaaaacggcgaccttctcttcggtacgatcgattcttggctgatctggaaaatgtccggcggaaaagcgcatgtgacagattattcaaacgcctcaagaacattgatgttcaacatctatgacctaaaatgggatgatgaacttctcgatattctcggcgtgccgaaatcgatgcttccggaagtcaagccttcatcgcatgtatacgctgaaacggtcgattatcatttcttcggcaaaaacattccgattgcaggtgcagccggcgaccagcaggcagcattgttcgggcaggcttgctttgaagaaggaatggttaagaacacgtatggaacaggctgctttatgctgatgaacaccggcgagaaagcgattaaatcagagcacggcctgctgacgacaatcgcttggggcatcgacggaaaggtggaatatgcgctggaaggcagcgtcttcgtcgcgggttccgctattcaatggctgcgtgatgggctgagaatgtttaaagacgccaaagaaagtgaaaaatacgctgtaagagcagaatctgccgatggtgtttatgtggtccctgcatttgtaggtttaggcacgccttattgggacagcgatgtccgcggcgctgtattcggactgacccggggtacgacgaaagagcattttatcagagcaacgcttgaagcgcttgcctatcaaacgaaagacgtgctggacgcaatgaaggaagactccgggatcccggttaaaacgctgagagtcgacggcggagctgtcaaaaacaacttcctgatggattttcagggcgacattttagatgtccctgtagaacgtcctgaaatcaatgaaacaacagcgcttggttcagcctatttagcgggccttgctgtcggcttctggagcgatcgttccgagatcaaagaccagtggcagcttgacaaacgttttgaaccgaaaatggaagaaaaagagcgtgagagcctgtacaacgggtggaagaaagctgtaaatgcagctagggcttttaaataa

SEQ ID NO: 922 - DNA, 1668 bp, Bacillus licheniformis
atggaatcattattttcaagccgtaaacgggacgacattttacagaatatgacaaagcagaagtatgacgtgtttattatcggcggaggtattactggggcagggacggcattggatgccgcatcgcgcggaatgaaaacggcgctttgcgaaatgcaggactttgcagccggaacgtcaagccgttccacgaaacttgtacacggcgggcttcgctatttaaagcaatttgaagtgaaaatggtagccgaggtcggcaaagagcgggcgatcgtctatgaaaacgggccgcacgttacaacgcccgaatggatgctgcttccgatgcataagggagggactttcggcaaattcagcacttcaatcggactgagggtgtacgactttttggcaggcgtcaaaaaagctgagcggaggagcatgctgactgccgaagaaacgcttcaaaaagagccgctcgtgaaaaagaacggcctgaagggcggcggctattatgtcgaataccggacggatgatgccagattgacgatcgaagtcatgaaagaagccgttaaattcggagccgaggccgtcaattatgcaaaagtaagcgattttatatatgaaaacggcaaggtcaccggcgtggtcattgaagacgtcttcacgaaaaaaacgtaccgcgtctacgcgaaaaaaattgtcaatgccgcggggccgtgggtcgaccgtctgcgggaaaaagaccattcaaaagaaggcaaacaccttcagcatacaaaaggcgtgcatcttgtttttgatcaatcggtctttcctttaaaacaagccgtttattttgatacgcctgacggccgcatggtgttcgccattccgagagacggaaaggcatatgtcggcacaacagacaccgtctacaacgagaatttggaacaccctcgaatgacgacagcagacagggattatgtcatcaatgcaatcaactatatgttccctgaacttggaatcaaagccgaagatgtcgaatcaagctgggctggcctcagaccgctgattcatgaagaaggaaaagacccgtccgagatttcccgaaaagatgagatctggacttctgaatccggactgatcacgatcgccggcggaaagctgacaggctacagaaaaatggctgagcatatcgtcgatcttgtcagagaccgattaaaagaagagggcgacagagacttcgggccttgcagaacaaaaacgatgccgatttcaggcggccatatcggcggctccaaaaatctggaggcttttattcaagcgaaagcagccgaagggattgaggccggactgtccgaagagacggccaaacaaatcgccgcacgatacggttcgaacgcagaccgcctgtttgatcgtattccatcgctgaaagatgaagcagcaaaacgccgcatccctgtccatgtactagcagaaatggattacgggatcgaggaagaaatggcagccgtcccggcagacttcttcgtccgcagaaccggtgcgctgttctttgacatcaattgggtccgcacttacaaagagagccttacggactacatgagcgagaagctgaactgggatggcgaaacgaaggcccggcatgtcaaggcattggaaggactactacacgatgctgttgtcccgctggaaagcaaatga

SEQ ID NO: 923 - DNA, 1749 bp, Bacillus licheniformis
atgagctggagaacgagctatgaacgctggagaaacaaagaaaacttagattccgaattaaaagcgcttcttttggaagcggaaggaaatgaaaaagaactagaggattgcttttataaaaaacttgagtttggtacagccggtatgcgcggtgagatcggaccgggcccgaaccgcatgaacgtttatacggttcgcaaagcatcggcgggccttgccgcatacataggagcgaacggcggcgaagcaaaaaagcgcggcgttgtgatcgcgtacgattcccgccacaaatcgcctgaatttgcaatggaagctgctaagacgctcgcagaaaacggcgttcaaacgtacgtgtttgacgaactgcgcccgacacctgaactttcctttgcggtaagagaactgaatgcgtttgcaggtattgtcatcacggcgagccataacccgcctgaatacaacggctataaagtgtacggagaggacggcgcgcagcttccgcctgctgatgccgacaaactcaccggctatgtcaatgcgatagaaaacgaactggaaatcgaagccggagatgaagctgctttaaccgaaaaagggctgattaaaataatcggcgaggaaatcgatcaagcgtatctcgataaactgacatcgatttctgtcaaccctgatctggcaaaggagaccgaagtcaaagtcatcttcaccccgcttcacggcacggcaaacaagtctgtcagacggggcctgaaagctctcgggtatgaacatgtcacagtcgtccccgaacaggagctccctgaccctgacttttcgaccgtatcttctccgaatccggaagagcacgccgcttttgaatatgcgatcagactaggagaagaaaatggagccgacattctgatcggaaccgatccagacgcagaccggctcggcgtcgctgtaaaggatcaagaaggccgctacgtagtgctgacaggaaatcaaaccggcgcgctgctcctgcattatctgctgtcgcaaaaacagcagaaaggcatgctgcctgataacggcgtcgttctgaaaacgattgtgacgagcgaaatggggcgcgacatcgccgcttctttcggactggacacgatcgacacgctgaccggctttaaattcatcggagaaaaaatcaaacaatttgaagcatcgggcgaatatgctttccaattcggttatgaggaaagctacggctacttgatcggcgacttcgcaagggacaaggatgccgtccaggccgcactgcttgccgttgaagtatgcgccttctataaaaagcagggaaaatcgctttatgacgggctcctcgaattgtataaatcgttcggcttctatagagaaggcttgaagtccctgaccttaaaaggaaaagagggagcggagcaaatcgcagccatcctcagcacattcagagaacagccgcctctttccatcgccggaaaagatgtcgtatccgccgaagactatttgacagggaagcggacgctgctaaaggaaaacaaaagggaaacgatcgaccttccgaaatccaatgttttgaaatatttccttgaagacggctcatggttctgcctccgtccatcaggaacagagcctaaagtgaaattttatttcgcggtcaaaggccgaaccaatgaagaaagcgaagcgcttctcaatcaattgacagacgaagtgatgaaaaaaatcgacgatattgtaaaagcgacctcaaattcgtaa

SEQ ID NO: 924 - DNA, 459 bp, Bacillus licheniformis
atgaaatggatcaaaatcggggatgaatacatagaaaagaaaatgacgcaatttttcagcgaagccggtacgattgtcgctgccattttatgtttggatatgatcatccgcggctttattttaggaaaacctgcatccgaatacatcatcagtgccatcggttttgcggtctatgcaggctggattttgctccgctatcttttgtcgggatttgaatatccggagatcgcaggccaatcggcgtatcggaaaaaaagaaaagaaatcgcagccctcagcctcgcttccggcctcatatttgctattttaacgcttctctttaccggcataccagagcatcccggcagttgggttgactttattggtatggtgatgttgtttgcattccttcattttctgatcaactttatctcgttgcgcaattcctttcggaaaaatcaagatctattagatgattaa

SEQ ID NO: 925 - DNA, 198 bp, Bacillus licheniformis
atggttaaccgggtcaaactcgcccggatcgaaaagtctttgacacaagcccagctcgccgagcgggtcaatgtgacaaggcagacgatcgggctgatcgaaaaaaataaatacaatccgacattgcagctctgcatcgcgatcgcaaaggcattagacaaaacgcttgacgatttgttttgggaagaaaaagcctaa

SEQ ID NO: 926 - DNA, 1158 bp, Bacillus licheniformis
atgaaacttttgcgggaagacacacagtttgaaaaactgaaaacgctcaaagaaatagcggaaactttaaacgaagggaacgatctaaaggaaacgctccatgccgttttaaagaagctgctccgcctaacgggactcaaaacggcatggctttttctgatcgatgaaaaggggagctttgaactggctgcttcggcccgcctgcctcaagccctttcttaccggcaaaaccgtttactatgcgaaggaagctgctactgtcttgaacaatacagggacgaaaagctggacagggcgaaaaatatcatccactgccggcggattacgacggccatgaaacagaagacaggagatccggaaggcatcacccatcatgcaaccgtcccgctcagtgaccaaaagaagcggttcggtttgctgaacgttgcggcaccgggcaaaattcatttcagccgcggggaactggcgctcctcgaagctgttgctctgcaaatcgggatggcgatcaaacggatgaggcttgctgaacaacagcaaaaacacctgctgctgaccgaaagaaacagattggctcaggacttgcatgattccgttaatcaaatgcttttttcgctcagcttgaccgctaaagcggcgggggaaatgacagaccagccggaaatcagggaaatgctcgagtttatgcaaaatctttctcatgaagcgcttcttgagatgcgggcgttaatttggcagctcaggccccaggggctggaagaagggttagcggcggctcttgaaaaatatgcggaagtgctcggccttcaagtaatcttcaagctcagcgatgtgctccgtctgcccccttctgttgaggaattgatgtggcggctgagccaggaagccctcaacaattgcaaaaagcatgccggtgcaagccgcatacaagtgaaaatcaatgtattccagtcgtctgccgtcttggaaatcgaagatgacggcaaagggtttcagtacgatcctaatgtggacattccgacgcttgggctgaaaggaatgaaggagcggacggaaaaagcgggcggcacgcttttgatcacctccgcaatcggtaaggggacaaaaatccgggcggttttgcctatgaaggagaagggggaggcaggatggagaaggtga

SEQ ID NO: 927 - DNA, 654 bp, Bacillus licheniformis
atggagaaggtgaaaatcatcattgccgatgatcatcatattgtcagaaaagggctcttgtttttcttcaaaacaaaaagcgattttgatgttatcggagaggcttcgacaggtatcgaggcgctcgatgtcttgcgaaaacgtgaggcagacatcgtattaatggatttatcaatgcctgatatggacggcattgaggcgacaaagcgaataaaaaaggaatatccgtctgtcaaagtcatagcgctgacaagctatgcggacgagagctatgtgattcccgccatccaggcgggagcctgtgcctatcagctgaaagacgccgagcctgatgaacttgtcgagacgatccgcgcagtttatggcgggagatactcattggatccgaacatcatgtcccacgtctttcaccatgtgtcacaggcggatgagaaagaaaaaatacatcaattgacaaatagagaaaaagatgttttattggaaattacgaaagggaaaagcaataaagaaattgcagcatctttatttatcagcgaaaaaacggtaaaaacccatgtatccaatctgctttcaaagcttggcttatccgatcgcacgcaagccgcgctttttgcagtaaaacacggactacaacaaaatgacgggagaggatga

SEQ ID NO: 928 - DNA, 540 bp, Bacillus licheniformis
atgacgggagaggatgaccaaatgaaaataaccgtaattagcggaactgcgagaaaacagggcagaacgcggatcgccgcttcctatatcgcccgcgcttatcaggctgagcttatcgatctaagcgagttcatccttccgattttcaacggagacgaagagcaaagctcgctggagaatgttcaaaaattgaaagcttcggtcaaagaagcagacgctgtcgttttattatctcccgaataccacagcggtatgagcggcgctttgaaaaatgcactcgattttttaagcaatgagcagttctcgggcaaaccggtggcgctttttgcttgtgcagggggcggcaaaggcgggatgaacgcgctcgccaatatgcgcattgtcgcacgcggagtttatgcgaacgtcatcacaaagcagcttgtgctcgatccgattcatattgatgaggagcaccaaacggttactgaagcagccaaagccaatattaaaaatgtaatggaagagcttctgctctttgccgaatttcaaaaagcctga

SEQ ID NO: 929 - DNA, 258 bp, Bacillus licheniformis
gtggcgaaattgaattacgctgattatgacaaagctttgtactatacgcaccggtcgcagtgggacaacctgctgatcctgatggtgcggacagaagacgatttattatcaaagcggatcgaacattttttgcacgcctacaattttgaaagagatgacgccattgtcgaaaaaaggctttatgatctgctgcagtatattgatcacgcctcattttccggacatgaacacgaaaacggcgtgcttgtctttacgtaa

SEQ ID NO: 930 - DNA, 321 bp, Bacillus licheniformis
atgaaaaaacgatattgcacgtactttttttgcatattaacacttttatcattcccggcgaaaggccactttcaaacagatgttttcgatgcacctgaacggtgggaaagaatcgcctggagcgcgcttgaagaaaaatacaaaggcgcaaagctcgaggattatgaatatttagggcgcacacaagtaaatgatgaagagacaaaggatgtcttcagggtaaccgtcaatcaagaaggcaaatcattttcggcgcacgccgaggtgtattttcatccggtgaccaatgcgatcatcaatgtcaatatttttcccttatag

SEQ ID NO: 931 - DNA, 432 bp, Bacillus licheniformis
atgaaattaacaaattatacggattactcattgagggtactgatttttctagcaaccaaaaactcaaacgagcttgtcaatattaaagacatcgccgattcttattccatttcaaaaaaccaccttatgaaggtgatttacgagcttggcaagcttggctacgttgaaacgatccgcggccgcaacggcgggattcgtctcggaaaagcgcctgaactgattaatatcggtgaagtcataagacatacagaagatgattttaaccttgtcgagtgttttaacggagaaaaaaaccattgtatactttctccgatctgcggattaaagcatgttttaaacaaagccctttccgcctatttggacgtattggaccaatacactctgcaagatattatcatgaatcaggaccatatacgtaaattattgagttga

SEQ ID NO: 932 - DNA, 1215 bp, Bacillus licheniformis
atgctatctgaaaaaaccatgcaaattgtcaaatcgaccgcccctgttttaaaagaaaagggaacagagatcaccacttgtttttacaagcggatgtttgatgcccaccctgaattgaaaaacattttcaacatgtcccgacagcaaaccggcggacagccgaaagctttggcttttactgtgctgcaggcggctgaaaacatcgaccggctcgaagacctgctgccggttgtcaagcagatcggacataaacacaaaagtttgcatgtgaaaccagagcactatcctattgtcggtcagcaccttttggaagcaattgaaatcgtgctcggcgaagctgcgacagaggacattctccaggcatgggcagaagcctatgaagagatcgcccgtgtatttattgaagtcgaaaaacaaatgtatgaggaagacaaaaagcaggatggaaattgggaagggtttaaaccgtttgtcatcatggataaacgagtcgaatccgatacgataacctccttttatttgaagcccgccgatggaacggctttgcccgctttcagccccggacagtacgtatctgtctgcattaaaattccgggcgaaccatatttcttaacaaggcagtacagcttgtcagatgcttggaataaagactactaccgcatttcagtcaaattggaagcggaggaaggccaaccggtgggaaaggtatcaagctatctgcatgagaacatggaaatcggcggcagcttggaagtgagcgctcccgccggagatttcacactttccgaaggaacggatcgtccggtttatttcattagcgccggatcaggcatcacgcctgtcatgagcatggtgcaaacgttggctcaaaaagaaagccgccgcgagatcacattcgtgcatgccgcgaaaactgaacggcatcacgctttcaaggaagaaacggagaagctgctcggcgccaatccggcgaaccgtctcctgttcgtctacagcagaggtgctgaagcgacggaagagcatactgtaaaaggccgggtgaatgaagagcttttgaaatcggtcgtgatagatccaaatggcgaattttatgtatgcggtccgctttcatttatgaaaagcgtgattgaaggattgcaaaaccttggcgtttcgatggaaaacatccgctatgagagctttgcttcatctcttgatatgcaaatagcgaactaa

SEQ ID NO: 933 - DNA, 1410 bp, Bacillus licheniformis
ttgagcatacgggagcaaaaagagctgcagcgggcgattgaagaaattacggaaatcgcggaaggattcggccttgatttttacccgatgagatatgagatttgtcctgctgaaattatttatacattcggtgcatacgggatgccgacaagatacagccattggagtttcggaaagcaatttcacaaaatgaagcttcactatgactttggcttgagcaaaatatatgagcttgtcattaattcagatccgtgttatgcgtttttgctggacagcaattcattgattcaaaataagctgattgtcgcacacgtccttgctcattgtgatttctttaaaaataactgccgttttcaaaatacgaagcgcgatatggttgaaagcatgtcggcgacagcagagcggattaaacattatgaaacggtacacggttcaaaagaagtcgaagcatttctcgatgcggtgctggcgattgaagaacacattgacccttcgctcgtgaggccgaagctgtcgtggagcgtagatgatgaagaggaagaagaaaccggcgcgccggccactccttatgacgacctctgggaactggatcataaaggatcgaaagagaagaagaaaaggacgaaaaaaaagtttccgccgaaaccggaaaaagacattctgctgttcatagaagagcattcgcgggagctggagccttggcagcgcgatattttaacgatgatgagagaggaaatgctgtatttctggccgcagcttgaaacgaaaatcatgaatgaaggctgggcgtcctattggcatcagcgaatcatccgtgagcttgatctgacatcaagtgaagcgatcgaattcgccaagctgaacgcgggagtggttcagccgtccaaaacgggaatcaatccttattatctcggattgaaaatatttgaggacatagaggagcgctacaacaacccgacagaagacatgaaaaagatgggggtagagccgaactctgggagagaaaaaatatttgaagtcagggagatcgaatcagacatttcatttatcaggaactatttaacgaaggatcttgtgatgcgggaagacctctacttgtttcaaaaacagggaagggattataaaatcgtcgacaaggattgggaggctgtgcgcgatcagcttgtcagcatgagagtcaacggaggatttccttatttgacagttgaggacggagattacttaaagaacaatgaattatacatcaagcattggtatgaagggatcgaactcgatttgaagtatcttgaaaaagttctgccttacctccaccagctatggggaagaagcgtgcatgtcgagaccgtgctcgaagataaacccgtcatgttttcctatgatggaaaggctgtccaccgcagatatttataa

SEQ ID NO: 934 - DNA, 834 bp, Bacillus licheniformis
atgaaaaaacaagtaataacagcagcatcagcggttgttttaggatcgactttgtttgcgggagccgcttccgcgcaaaccataacggtgaaaaaaggagacacgttatggggtttttcgaagaagtatggcacaactgtcagcaagattaaacaggaaaacaagctgaaatccgatatcatttacataggacagaggctgtcgatcaatggaagcagttcttcgtctgcaaaagcgtcgaaagtttcatcagctacgcataaagtggtcaaaggagacagcctttggaaaatttcgcggacatacggcatgactgttaacgaactgaaaactctgaacggtttaaaaacagatttaatccggattggacaagtattaaaagtcaaagggacgaaaagcgtaaaagcagcatcaacaaccaagccttccgcatcaagcgggacaagcaaaacaagcgcacctgcgcagaaatcttcaacgctgaatacgtcaaaacttgtttctgatgcaaaagcccttatcggaacgccttataaatggggcggaacatctacatcaggatttgactgcagcgggtttgtctggtacatcctcaacaaacagacaaatgtagcgagaacgaatacagtcggatactggaattcaatgaagagcgtatcaagcccggcagtaggcgatttcgtattcttcacgacatatcagccgggaccttcgcatatgggggtttacatcggaaacaatcaattcgttcatgccggttctgacggcgtaacgatcagcgatatgacaaacagctattggaagccccgctatcttggagcaaaacgcttctaa

SEQ ID NO: 935 - DNA, 432 bp, Bacillus licheniformis
gtgcaatcgtcaaacctgaactgctattccatgtacagcgatcccgtgattttggttgcccctcatgacggccgcgctgcagaacaagcgccgccgctcgatgtcgaggatttgcttgaagaatatttgctgttgacccacaatcaccctgaatactgggacgacctcgtcaggcagctgaggatcaagtttccgtttgtcagaacgatgctcgtaagccaggcgcatattacgaaacgatttatttcagaaggactcggtatatcatttttgccgctgtcgactgtgcgccgcgagctgatggaaggaagattaatagaggtgccgtgcgatttcatgaagcttcccgttgcagggggatatgcgattagtctgaaagataatgagaaggtcgagcactttttggcgtttttagccgagttccgtttctaa

SEQ ID NO: 936 - DNA, 855 bp, Bacillus licheniformis
ttgatccgcagtcttccggccgaattagacgatatggcggttctgcgcacggccgtctcttcattcggggacatatcgtttgcgttcaagccgacaatggagcaggccctcaggctgattgcggccgtcccgtcaattatcgcgttcagaaagaggctggctgatggagaagagcctgttcagccgctggatgagctaggttttgtggaaaattatttttacatgctgaaaggaaagcgtccgacagaagctcagaaaaaagcgcttgaaacgtacatgattcttgcgatggaacatggcatgaacgcttcaaccttttcggcaagggttacggtgtctacggaatccgatcttgtttctgccgtcacatctgcacttggcacgatgaaaggacctttgcacggcggagtgccgtctgcggtgacggatatgctggaaggcatcggggaaaaacagcacgctgaaagctatataagagaaaagcttgaaaaaggcgagagactgatgggatttggacaccgcgtctataaaacgcatgatccgagagcgaaggctttaagggtgaaagccgaggaaattgccgggggcgacagggatatcgaccttgctctccatgttgaaaatacggcgatccgccttttggaagaatacaagccgggccgcaagctttatacgaatgtcgaattttacgcagccgctgtgatgaaggcgatcgattttgatgccgcattgttcacccctactttttcggcagcgagaatggtcggctggtgcgcccatgtgcttgagcaggctgacaacaacatgattttcaggccatcggctaaatatgtcggagaattggtctcacagtaa

SEQ ID NO: 937 - DNA, 1065 bp, Bacillus licheniformis
atgaaaaaaggattcctgatgttgatcatgctgttttttctaggtgcatgcacggaaggccgggattttgatgctgaatatgaagcgacaagcgcgaaagaaggcggaagcggcgccgaagtcatcgcagatcgcctggatgtgccttggacgatcgctcatactggcgagaccttttacattacggaaagaaacgggggaattgtgtccattgctgacggcaaaaaggagcgcatgcagcttcagctgaaaaagcccgttcatcaagaaggggagggcgggctgctcggatttgtactccatccggattttagaaacagtcaggaggcgtacgtttatcatacatacaaagacgggagccatctgaaaaaccggatcgtaaaattgacgcttgaccgcctcacttggacagaaacggatgaactgcttgccgatttgcctggaggcgcgattcataacggcggccggatggcgatcgggcccgatcaaaagctgtacatcacgacaggcgatgcaggggaaagggaatgggcccagcagcctgaaaagatggcgggtgtgattctaaggatggagcttgatggtacgataccggctgatcagccctttagctcgtcttatgtatacagtttcgggcaccggaatccgcaaggcctcgcatggatcggccgacagctttacagctccgaacacgggcagtctggacatgatgaagtaaataaaatagaacccggagccaattatggctggccggtgattgaagaaagcgatgagaagcagggaatgaaggcgccgctcatacattcgggagaaaaaacgcgggcgccatccggtttagcacagaaaggggacgtcctctatatggccgggctgcggggagagggtgttttccaggtcgatccggcggaagccaaagtagtcaagtggcttggcggatacggcagaatcagagatgtgaaagtgatcggcgatgatctgtatttcattacgaacaatggcgacggaagaggcgaaaaaaaacagacagacgatcggctcatccgcgtacctctgcctgacaagtaa

SEQ ID NO: 938 - DNA, 870 bp, Bacillus licheniformis
atgaatccggcaaacagacagacagatggacagaaagcgcaaaaacaagaaaaacaacccggtgctgagcacaagatggtgccccttccgctctcggaagaccgcgactacaaaggaagcggcaaattaaaaggaaaaacagcgattattaccggaggagacagcggaatcggcagagcggccgccattgcatacgccaaagaaggtgccgacattgccgtcatgtacttggatgaacacaaggatgccgaggaaacgaaagagcgaatcgaacaggaaggagcagaatgcctcttgattcccggagatgtcggtgatgaggcgcattgcaaatcatctgtcgaaaaaacggtgaatcactttggcgggcttgacattctcgtgaacaatgctgcagaacagcatccgcaaaaagggatagaagatatttcgaccgaacagcttgaaagaacgtttagaacgaatattttctccatgttccatatgacaaaagccgcgctcccgcatttaggggaaggcagcgcgatcatcaataccgcatcgatcacggcgtatgaaggcagtccggcgctgattgactattcgagcacaaagggcgcgattgtcgcgtttacccgttcgatggctgcatcccttgtcaaaaaaggaatacgcgtcaacgctgtagcgccgggtcccatttggacgccgcttattccggctacttttccgccggaaaaaacggaaaaacacggcacagatacgccgatgggaaggcccggacagccttctgaacacgctgcagtgtatgttctgctcgcttcagacgactcctcttatatgacaggacagacgatccacatcaacggcggaagatatgtgacgacataa

SEQ ID NO: 939 - DNA, 1359 bp, Bacillus licheniformis
atgagcgaccgcagaatgacagcaaagtgggcatccaaacttggatttgttctcgccgccgcggggtccgccatcggtctgggagcgatttggaagtttccctatgtggcgggaacgagcgggggaggcgcatttttccttgtgtttgtcctatttacgatactgctgggataccccctgcttttgggggaatttgtattaggccgaaaaagccaatcggacgctatcggcacctatcaaaaaatagcgccagggacgccttgggtgatcacaggctggatcggaatcgccgcctgcttccttgtcctgtcgttttacagcgtgatcggcggctggattttgctttatatcattaaagcagtaaccggttcattgtcgggtctcacgcaggccggatacggggagctattcggttcgatcatccaagatccgctgcagacactggcagcgcagcttgcgtttatcatcatgacgatcctcgtcgtggcgaaaggtgtgcaaaaaggaatcgagcgcgtcagttcgattatgatgccgctattatttattttatttattgcgctcgttttaagggctctgacgcttgagcatgcgatcgacggcgtgcgttttctgcttgtgcccgattttggcagcctgacgccgcaggcgattctttttgcgctcggacaagctttctttacactgacgcttggcgtatctgtgatggtgacgtacagctcctatttgtcaaagtcacaaaaccttccgaagtcggcgctgtcgatcgtgatcatgaaccttgccgtcacgctgcttgccggcttggcgatttttccggccgtcttttcattcggccttcagccggatcaggggccgactttattatttgcggttctgccggcagtttttgaccggcttccattcgggatgctgttttttatcggatttttgacggcctttttattcgccgccttgacttcggctttttcgatgatcgagatcattgttgcggccattacaaaaggcgaccaaacgaaaaggggaaaatggacgtggacgatcggccttttgatttttgccgtcggcattccttcctgcttgtcttacgggatgcttgatgagccgttcatttttaagaagacgttttttgatgcggcggattatgtcgtcagcaatattttgatgccgcttggcgcgctctttatctccatttttattccgctgaaattgtccaaacacgatctatatgaagagatgaaaagcggatcaaaagcggggaaaggcttttttatcgtgtggttttatcttcttcgtttccttgttccgcttgcgattgtacttgtttttttaaatttaatcggagtgttttcattttaa

SEQ ID NO: 940 - DNA, 1629 bp, Bacillus licheniformis
atggtgttagactttcaacagatgtttccgagcgaggatggcaatcacgaggcgcggtatcagctgctggcattgcttgaagcggtattggccggaatggacaggctgaaggatcccggccggctgacgcttggccgcgagtctgaagtttcatctgactactatcaaagcgtcattgaagaggccgtcttgccggaaaaaggcttcggggcggaaaaaagcgttgaagagctattgaaattgcttgacggccaccgctttttaaacaggcattatgtggccaacgcgacgcctctgccgaacaacgccagcatcgccgggaatcttttaatggttcttttaaacggaaacaatttatgggatgtcgacggcacggctgcagccaggacggaagtgcagatcacggcgatgctttctgatattgtcggctatgacaggcacaagagcggcggttttacaacctggggcgggcagggagccgtttttcagtcgctcaggctggcgatcgcaaacgcgtaccctgaagcgaatcagcaaggaacgccgcatcatctgtacgcgttctgttcagagctttcgcatttcagcctttataagtcgatggaagcttccggaatcgggacggaccatttgatcaaggtcaagacgaatcacgatcattcgatggatctggccgatttgcgggaaaaaatgcaagccgtgattgaaaaaggcggacatccgatttatgtattggcaacgcttggcacaaccgacgcatttggcatcgatgatttggccggaatcaagaacgtgactgaagaaatagaggccgcatacggtttgccgcctgtttatattcatgccgatacggcgatgggcgggatgtacagcttttttaacggatacgatttctccggcaatccgctgcatattgaagatgaggtgcttgagacgcttgcccgctacaaacaacattttcagcatttgcacctggcggacagcttggtctttgattttcataaactcggacaaacgccgtatatcacaagccttttcttggtgaaaaaccgcaaggcattgcaggctgttgatttggatccggatgagacgccttatgtcggcaacagagggtttggcagctatcatacgagctatacgctagagtgttcgcgaatgggaagcagcataccgatttatgcttctctgctcgcatttggaatcgaaggctaccaggagatcttggccaattacatcagggttaacctggcgtttcgaaaaaaactgctgcaggcttttccgaatgcagccgtcaccaatgatgtatcacctgtgacgacattccgcttctatccgggaaatgtccgctatcacgaagaaatcagcggcgccatcacggaggaagaagtgcggaatattaacaaatacaatgagaaaatcgccgaaacattgggaaggtaccgcagtcacacctatttcggcagcacgaaaaagcaaacatacgtttatcctgctgacagccgtttgccagtgccgctttatgtccagaaattctacagtgtctcgccttacacgacggttgatacaactgatcaatatatcgcctttttaaaagcgcatgttgaaacgtcggatgtagcggctggataa

SEQ ID NO: 941 - DNA, 888 bp, Bacillus licheniformis
atggatttgctgaagaacatgaatcaagccatggcgtatatcgaagaacacctgacggacagtatcgactttcaaacggttgcgaagctttcttactgctctgaatatcattttaaaaggatgttttcttttcttgccggggtttcgctgtccgaatacatccgccgcaggcggcttacccttgcagcgtttgaactgaagaacacaaaaagaaaagtgattgatattgcggtgaaatacggctatcactcgccggatgcttttacgcgcgcatttcaaaagctgcacggcattacgccgacagaggccagacacgatatcagcacactgaaagcatatcctccgatgaccttccagttaacaattagaggaggaaacgaaatgaactaccgtattgtagaaaagaaggcattccggatcgtcggaatcaaaaaaagagtccctgtcgtctttcacggaatcaatccggatatcgcctcgatgtggaaaactttaagcagtgaaaacatcgatgaattaaaggagctttcaaatgtggaaccgcttggactgattcaagcatcagcgaacttctccgaaggcaggatggaagagcagggagaacttgaccattatatcggtacagcgacaacgaaagaatgtccggaccaatatgaacagcttgaagttccggcctcgacatgggctgtctttgaagcggccggcccgtttccggacacccttcaaaatgtctgggggcgcatttatgctgaatggttcccgtcttcacattatgagcaaacgaaagggccggaaatcctctggaatcaggatcaagatatcagctccccaacgtttaaaagcgaaatatggataccggttcaaaaaagaacggcatgtaagaactaa

SEQ ID NO: 942 - DNA, 1413 bp, Bacillus licheniformis
atggatataaccccttttttaaaccgcagcggcagcgagccgctttatcagcagctgtacacgtttttcaaacgcagcattcattcgggacacataaagcctggaacaaagcttccctccaaacgaatgctttccaaacacttaaatgtcagcctgacaactgtagaacacgcgtatgaacagctggctgcagaaggatatttgctcagcaagcctagaaaaggctggtttgcggctgaagcggaaggagactttgcacagactgcgcctcctccccctgccgaaaaagaactggaagaacatgagacggcggctaacatgatcgattttcaccacggccacgtagacctcgcgtcatttcctgtttcccaatggaaaaaaacgctcgccaaaaccgttggtgaatcagggtacgacctttttcaaagcggcccgccggccggagacattccgctgcggaaaatgattgcggtttacctcagagaatcgcgcggcgtggtctgttcccccgagcaaatcatcatcggagccggcacaccggttttgctgcagttgctgtgccatctgtttcctaaaggcacaaccgtcggatttgaaaatcccggatttcatcgctcaaaaacagtcctgaaaaccggcggcttcaatgtggttccaataccggttgacgaaagcgggatttccgtgcaggatcttgaacaatatcagccgcagctcgcatacaccactccgtcccaccagtttccgctcggaatgatcatgccggtcggccgcaggctgcagttgcttgactgggcagcagcgaccggagcttatatcattgaagacgattatgacggggaattccgctatgcgggacagccgattccttccctgcaagggcttgaccggaacgaccgggtcatctatttagggactttttcaaaatcgctgattccctccctcaggatcagctatatggttctcccctttccgctcgtcaaagaagggcttaacatggcatccttatttaaacaaacggtttcccgccatgtacagcatgccattgctctttttatgaaaaacggggattatcaaaggcacttgaatcgaatgagaacactctaccgaaaaaagcgaaaaacgctccttgatgccatcaagcgtgaatttggcggtcatgccgcagtcagaggagagaacgccggtcttcacatcatccttgaggtgaaaagcgccccgagtgaagagtggctgacccaaaaagcgctggaaaaaggggttaaagtatatccagcctcagtctcgtatatgcccccccctgatacacacgcggtcctcctcgggtttggcggactttctgaaaaaagcatcgcagacggcatcaaaaagctgaagactgcatggtttaacggcggacagtctcaagattga

SEQ ID NO: 943 - DNA, 435 bp, Bacillus licheniformis
atgttgcttgattatagggaattgcattgtgaaacagagctcaaggaagtctatccgatcatgaaacagctccggccccatttggatgaaacgtcttttttggagctcgtcaaagaagctcgggaggctgaaagctacacgttatttgcgctgtacgacggtgatattccggtggctttggccggctttttgccgagggtttctttgaaccaaggccgtcatgtttgggtagcggacctggtgacgtgtgaaaaacaccgttcaaaaggctatggaaagaagcttttaggcgctgttgaagagtgggccaaagggaacggattggcttcaatcgctttatcatcaggcttgcagcgggcagacgctcaccgtttttacgaagagaaaatggggtatgaaaaagcgagctacctatttcgcaaggctctgaaatga

SEQ ID NO: 944 - DNA, 291 bp, Bacillus licheniformis
atggaactggtaagaatctttaaggagcacaacgtatttggatgggtgtctgtcggcacggccattctgtccctgttcgtcttaaacttggccattttaagcgacacgattgcatattcgtataagatgcttccttttgcgatggccgccgttccgctcggaattatcgagctgttcataaaaaaaggacggaccggtctcggatttctcggcgtcgtcctgaacattttcattctcgtttgcgtatggaccatcgtctccatcgatacgaatctgcagctcggcttttaa

SEQ ID NO: 945 - DNA, 1071 bp, Bacillus licheniformis
atgaatgaagattttaaaaaacgttgggaaaaatataaaaacggcgaactttccgaatcggaaatgctccgggtcgaagaagagcttgaacagcttgaagaataccaggacatgctggaacaggaaatgaaagacgaagactgggatttggcgatcagtcctgaaaagcaaaaagcgattttaagatacggaaaaaataaatcatatatgcggatctccacccttgctgttatttctacgcttattattctgccgatctgcacactcggcagctatctatactacgggttgggcgggcatgaaagcaaagggaatgaactggtgcaaaccgcttcaatgacagttgccgtcacaaacccgaatattcaagtcgatactgaagcccttgtcaacaaagtaaaactctttggaatcgaaacacagttcccgttaaagaagcaaatcggaaacgtcacaaaagtagttggaaatgaagaagtggaaatgttcttcgatcagctgaagtctccgcagattcatcaatacaatcaggagctttcaaaagaagaacgtcattttgtctaccctgacggcatcaaagaaaaatcagtgtccaaagccgagtcgattttaaaacagctgcctgacggaaccgtaaccgaagctttcctttcctttgaaaaagcatacccgacaaaggagctgtatgaaaaattaaaaggctatgatgttcgcgttctgtggaatgcgattgaaacagagggcgatttaaaagatcatccatacgcagagccgatcggatttcccggaaaagattcaaaccggatttttgaaattcagcaacctgccgaaaacgatgacgaacagtttaaagcggcgctttcctacatgatcaagaacaagaaatgggctgaaaccatttcaggcaggaaagacctgaagctttccaaacggcttgactatgtggaacagaatggtgtgaacgtgtatggagccgtcattaccggaccgtcaaaagaggttgaacggctgatcaaaaaagggcctgtcaaagcagctaaagtaggtgaggtggaattatggaactggtaa

SEQ ID NO: 946 - DNA, 492 bp, Bacillus licheniformis
gtgactatcgacgaaatttaccaaatgtatatgaatgatgtttacaggttcctgctctccatgacgaaagataaacatctagcagaggatttgcttcaggaaacctttatgagagcttacatacacatccattcttacgaccacagcaaagtgaagccatggctttttcaagtggcacgcaatgcgtttatcgactatgtcagaaagcataaaaaggaagtgacgatttctgacgacatgatcggaaacctgtttcaaaacgcggtgcaaagccctgctcaccaggtcgaaatcaaggaagtgttaaccttatatatgaaccagctccccgataactaccgggaagcgcttacgctgtactatttaaaagaattgaactacaaggaagcgtcaagcttgatgaatatctcagaggctaattttaaaagtgttttatttcgtgccagacagcggctgaaagcactttacaacagaggtgttaacgatgaatga

SEQ ID NO: 947 - DNA, 543 bp, Bacillus licheniformis
atgcatccatatcaatttccttatcaccttccttcgccttacagcgccggacggtttcacggatcagggtatgcaggcgcttttcgaacacccggcaccgaagaacgtatcgtgttaagagattatggacaaaaaccgtttgcctctaacatcaatgaagcggcaaagcagaacaaaacgtttcgcaccgctttatggacaggaaggcatttgcaagttaccctgatgagcctcaacccaggcgaagacatcggattggaaatgcatcctcacgtcgatcagttccttcgtgttgaactaggcaggggaattgttcagatggggccgagcaaacatcatttgccatttagaagaaatgtatatgatgacaccgctatcgtcgtccctgccggaacatggcacaatctcaccaatacaggcaatactccgcttaaactttattcgatctatgctccgcccaaccatccattcggcaccgtccatcgaacgaaagccgatgcgctggccgcggaaggacaccgcgctcatgaccgttacttttga

SEQ ID NO: 948 - DNA, 600 bp, Bacillus licheniformis
atgtatcaatttactggttatgctgcaaaagcgattctttctttgcgcggcggaattaaagtatacaataaagaaaatcttcctaaagacacaggtttcgttattgcctgcacacatgcaggatgggtggatgtcgtcgcactgggtgtcggcattttgcctatggaaattcattacatggcgaaaaaagagctttttgaaaataaattaagcggttcttttctttcaagcatcaacgcttttcccgtcgacagggaaaatcccgggccaagcagcatcaaaaccccgatcaagctgttgaaagaaggaaaaatcgtcggcattttcccaagcggaacgagatcatctgaagacgttccattgaaaagaggggctgtcacgatcgcccagatgggaaaagcgccgcttgtgccggctgcatacagcggcccttccaacggaaaagagcttttcaagagaggcaaaatgaaactgatcatcggcgaaccgctcaatcaggaagatttcgctcaatactcgtcaaaagaaaagctggtcaaaatgacggaggctttgaatgacagtattaaagctttggagaaaaagctggagcagctataa

SEQ ID NO: 949 - DNA, 366 bp, Bacillus licheniformis
atgaaatggtatttgaaagcaataaaaaactatgcaggatttacgggaagggcgaggcgaaaggaattttggctgttttgccttttctcatacatggttctggtcatctacggattttttaaagccattctgcatcttccggaatatgaaatagagacatttttaggaatggtttatttgctcgccaaccttgtgccgggcttggccgtcacgatccgcagattgcatgatacagggaaaagcggattctggatctttatcggtttaattcctctcattggaaagatcattttgctcattatgctttgtcaagacagtgaaaaaggggaaaatcaatacgggccgaacccgaagacagcgctctaa

SEQ ID NO: 950 - DNA, 1278 bp, Bacillus licheniformis
ttgattaccttgcaaccggttttgcacatacctgcagtttccaaatgggatgaaaaaataaacttgaagataagcggacttcaaccgtttgacaccattgatatcatcgttacagtgaaagatgaagctgacgcagagtggagatcacacgctgtttttcaagcgaatagattaggagaagtcgaccctgcagcagcagccccactaaaaggaacctaccagtctaaagatcaaatggggcttttttggtcaatgcaggctgttgaatcttcctgctcgttttacaaaaaatcggttcatccgtccgcttaccgtattgaagtgaagcaaaaagaacgcatcatcttgagtaaagaaataaaacgagtgctgctttctgaaacagttgatagactggaagtaaacgaagatgggttgtgcggcactttttttcgcccgcttgccgttaaccgccctcccgcaatcattatattagggggatctgacggcggccttgacgaaacaatggcaggcatgttagcaaattacggatacgcaacacttgcaatcccttattttcaatacaaacagctgcctaaaaaactggttgaaattccgcttgaatactttcaaaaagcgatcgattggctcggtcgccaggaaggacttcatcatcgtcagatcggaatatgcggacggtcaaaaggcggcgaactggcgctgttaataggttctcattttcctgaaatccgctttgtcgtttctcatgtaggcggcggagtcgtctttcaaggggttggattaaaaaaattccggcagacatcttcctggagcctgaacggcgcaccgctcgcctttgcaccgctgccgatgttttcgcttcctcagctgtggaatatgatgaaacataagctcacaagacagcctcatgcttttcttgatctttaccaaaaggctttacgaaaagtgaaagatgatcatcctgcaatcattaaagcggaacttattaaaggtcctatactgttaacttcaagcactgacgatttagtatggccctctgcctcaatgaacgagaaaatcgaagaacggctgaaaaagaacagattctcttattctgttaaacatctgtattttgaaaaagccggtcataatatcaggcctccatactttccgacatccggaagaaaaagcagaaaaatagcctatggcggaaaaactgaatacgatgccattgcagctcaaacattttggcaggaactgcttttgtttttagaaaaagcaactgcacccggcaattaa

SEQ ID NO: 951 - DNA, 597 bp, Bacillus licheniformis
atgtcagcacaatctacaagggatcgattaatccaagcggcgcttgcccttttcaaagaaaaaggatatcaagccgcatccaccagagaaattgcccaaaaagcaggcgtcaatcatttgaccctttttagacacttcggaaataaacagaatttatttcgggaaagtgttattcaacatgtgtcatcgggagattttattggagaacttgaaggaatactgagcggcgatttacgacaagacctctcattcattgcgaaagcatatctaaaagaaaacctggaaaaaggtactgtttttttactttactttaatgatgcagtacaggataaggaagtttgcgaattaatcatggatattccccgccgtctcaaccgctttttagaggcttattttgcaaagctctacgccgaaaaaaaaatttcagacggcaactttcaaatgttaagccaaatgtttttcggtttactgaatcaatatattatgtttcaacatttgcccggattcaaggagtcgttcaatgatcggattgatgactatgttgaagagtgcgtcgatttattttacacaaaacttgaaaaggaagtgccgtcttga

SEQ ID NO: 952 - DNA, 1308 bp, Bacillus licheniformis
ttgatttttgttgctgtattaattgctttaacagcatttttcgtagcgtctgagtttgcgattatcagaatcagaagctcgcgggttgatcagctcattgctgaaggaaacaaaacagcgatttcggtgaaaaaagtcattacgcacttagacgaatatttatcggcctgccagctcggcatcactttgacggctctcggtctcggatggctcggggagccgacggtcgcccggctgcttgaaccgctatttgttaaatggagcattccgagctctgtatcacacatcgtttcagtcgtgatcgccttcagcttgattacgtttttgcatgtggttgtcggcgagctcgctccgaagacgcttgcgatccaaaaagcggaagccgtttcctttctttttgcaaaacctttgatctggttctaccgcattatgttcccattcatctgggcgctgaacggatcagcaaggctgttgacgaaagcgtttggccttgaagcggtttctgaaaatgaaatggcgcactcagaggaagagctgcgaattattctgtcagaaagctataaaagcggcgaaatcaatcaatctgagttcaaatatgtcaacaaaatttttgaattcgatgaccgtcttgccaaggaaatcatgatcccgagaacagaagtcgtcagttttccaaatgatatgaaaatcgccgagatgattgacatcacgaaggccgaaggctatacccgctatcccgtcgaagacggtgataaggacaacatcgtcggcgtcatcaatgtcaaggaaatactgacggcctgcatcagcggagaatgctccaaagaagacacgattgaacagtttatcaatccgatcattcatgtgatcgaaaccgttccgatccacgatctgcttctgaaaatgcagaaagagcgcgttcatatggcgatcctttctgatgaatacggcggaacggccggactcgtgacggtcgaagacatcattgaagaaatcgtcggcgaaatccgcgacgaattcgatattgatgaaattaatgaaatccgcaaaatcggcgaaaaccactacattctcgacggcaaagtgctcgtcaaccaggtcaacgatttgctcggcattcagctcgacaatgaggagattgacacgatcggcggatggttcctgacgcaaaaatatgacgtccaaaaaggcgacatgatcaccgagcagggatttgaattcacgatcaacgaaatcgacggccaccatgtttcatacgttgaggtgaaaaaagctgcggaaacgccgctgcttgaagaagcggaataa

SEQ ID NO: 953 - DNA, 426 bp, Bacillus licheniformis
ttgaggagggatgcagatggggcagagaaatatcgcattggcgaattagcagctgctgcaggcgtaacaaaacggactgtcgattattatacgaatctcgggctgttaacgcctgacagatcatgttcaaactaccgttattacgatgaagccgctctcaaacggctgaagtttattatggactgcaagcagcagagattggccctgtccgacattaaagaaaggctggaaaaccagtttccctcttcaactgtgaatgatgatgaaattggaagcctgacaacggaaatcgatcatgtcaatgacaatatctccgtgatcataaacagattgaaacggctgaatcccgatgaacggaagattctgaaaagccgtctttctcctgaaaaaatgacggtcatccagtcatttttgctgctgctttag

SEQ ID NO: 954 - DNA, 1317 bp, Bacillus licheniformis
atggacgatattgttagtctgataatcatcgggattctgattgctttaactgcttttttcgtggcatcggaatttgcgattgtcagagtcagaagctcccgtattgatcagctgattgctgaaggaaacaaaaaggcggtccgcgcaaaacaagtggtgtcggatttggatgaatacctttcagcttgccagctcggtattacgattacagcgcttggactcggctggatgggggagccgacggttaaaaaggtgctgcatccggtctttgaaagcctgcatgtttctggcgctgtatcgcacgctctttcagttgccattgcatttttagtgattacattcctgaacgtcgtggttggagaactcgctccaaaaaccatcgcgattcaaaaagccgaacagatgacgctgtggctggcgggacctctgcactttttcaatgttgtcatgttcccgttcatctggacgctgaacgcctcagccagagtgctgaccgggttattcggtttgaagcctgcttcggaaaaggatgaatcccattcggaggaagagctgcgaatcctgttatcagaaagctacaaaagcggagaaatcaatccgtctgaatatagatatgtcaataaaatctttgaattcgacaatcgaatcgccaaagaaattatggtgccgcgtacggaaatcgcctctgtcccgctggatatgccgattgatgaggccatttcggtcatgctgcaagaaaaatatacgcgctggcccgtctataaaggcgataaggatcatgtcatcggcatgatcaatacgaaacagctgtttacggatatgctcatgatgtcagaggcagagaaaaagctgctgtctcttgaagcctacgtccgtccggttattgaagtcattgaaaccgtgcctgttcaaaagctgctgatcaaaatgcagcgggaacggattcacatggcgatcttaacggatgagtacggagggacatcgggtcttgtgacggccgaggatattcttgaagaaatcgtcggggagatcagggacgaattcgatgaagacgaaaaaccgctcatcgaaaaagtttccgatcacgaatacatcatggatggaaaagtgagaatcgatcaggtcaatgagctgtttgaagacgatatcgaggaagaggaagtcgaaactgtcggcggacttgtgctgaaagaaaacatagatatcgcggaaggccaggcggtgcatatcggctcttacacgataacggttctcgaaatggaagggcgtctgattaagcacgtcgaagtcaagcgggaacaaacacagaacatgtag

SEQ ID NO: 955 - DNA, 402 bp, Bacillus licheniformis
ttgctgtggtacgagatcatttcggaggaagagagaaaaacgtatattaagcggatcgaatttcatttgaggaattggaaaaattacaaagccgccgtgctcaatttagaaaggagaatggagaaggagcaaaagaatgggctcgccgtcaaagaaagaaacgctgaatatcggatcgacgccgaaaaaaggctctatcaatttttgcttgattcgatggaaacggctgtctccgaattggatgaactcgagcggaagctggtagaatgccggtatattcataactggagcatgggcaaatgcgcgatggaaatcggctacagcgaaaaaacgctgtttttaatgaaaaaatcgctgctggacaagctgcttgtcagcttggcggcgatcacgaatatttaa

SEQ ID NO: 956 - DNA, 288 bp, Bacillus licheniformis
atggatttttctgaaatcgcgctcgttccgctgattacgggattggtgcatacagtaaagcttgtcggcattcagaaacgatttctccccatctgtgcaattgtcttcggcatctcgatttctctgttgtttaccgcagggaactggaaggaagacatgatgatcggaacttggcttggattgtcatcagttggattttactccggttcaaaaaacgtcttgaaaccattatcaaaggaggaaattgaacatgaagatttatttggatccgggacacggcggaagtga

SEQ ID NO: 957 - DNA, 678 bp, Bacillus licheniformis
atgaagatttatttggatccgggacacggcggaagtgatccgggagcatcgggaaacggtttgctggaaaaggacgtgacgcttgccattgctctcaaaatcaatgacattttattaaaagagtatgcaggcgcagagacgaggctgagcagaacgacagacaaaacggttacgcttcaggagcgcacagacgatgcgaattcgtggggggccgatttgtttgtctccattcatacaaacgcttttgacggcacggcgtacgggtatgaggattacatctacagcggcctgtccgatgaatcagttaccgctctttatcaacggatcattcacggcgaagtaatcaagcagaacggactcagggacaggggaatgaaaaaggcgaactttcatgttcttcgggaaacagcgatgcacgccgttttaacggagaacggctttatcgatcaccccgaagattcggcaaaaatgaaaagcgccgcctggatcgaacagactgcgcggggacatgcaaatggcatcgcgctctgcctcggcctgacgcagcgcgaattccccttgtataaagtgacgatggacggggggcaaatcggggcttaccaagaaaaagacgacgttttgaaagttatttctgcgaattgggacagctttcaaaaagcggctattgaaaaagggtag

SEQ ID NO: 958 - DNA, 357 bp, Bacillus licheniformis
atgatggcagctgcttttatgatcgcgggaggaatcgggtccgttttgagattttggctgggcaatgtgctcatggcgatgattccgcgcccccgcattccggtcagcgtgatggtgatcaatattctcggctcattcgctctcggcatattcataagcctcggcattgacaatcaaacggtctctatcgtggtcggaactggatttttcggaggcttcacaacattttcgacgttcagcgttgaagctgttcagcttttggctgcaaagcgggtaaaggcttcagcggtttacatcctgcttacaatggcaggctcaatcggcggattctgggccggcagcatgctgattccgtga

SEQ ID NO: 959 - DNA, 399 bp, Bacillus licheniformis
atgaaatcatatgttgccgtttttatcgggggagccatcggatcgctgctgcgctacgcagtcaatctgctcggcggcaccgccgtttttccttggccgacttttattgaaaacacgtccggaagccttctgctcggccttttgacaggcttttttgcggctcgggcaaaaaagccgctcgtccaattatgcttagggacggggttttgcggcgggtatacgacaatgtccgctttttctaaagaaaccgtacttctgctgcaatcggccgctcacatcggagttctgtacttgatggcatcgcttgcctgcggggtatgcttcgcatttttggggatcgtgatcggcaaaaaggtcagcggagctgcggggaaagaaaaggagcggtatcaatcatga

SEQ ID NO: 960 - DNA, 705 bp, Bacillus licheniformis
ttgcatattatcgcacatcgcggagcctcggcttacgccccagaaaatacgtttgccgcttttgaaaaagcggtggagctcggggctgattttatcgaactcgacatacagattacaaaggatggaaaacttgccgtcatccacgatgacaaggttgacagaacgacgaacggtaccggtttcgttcgcgagtatacgatgaatgagctcgaacagctggatgcaggaagctggttcggccctgaatatcaaggcgaaaaaatcccttcacttgaagctgttctgaggaagtatcacaataagacgggccttctcatcgaaatcaagtcgtccaaaacccagcccggaatcgaaaaagcggccggacaactgatcagccggtatggccgttcaatgaacacaattgtccagtcgtttgacgccggcgccatgagggcgtttcatcacatgtatccttcgattcagactgccgttttgatcaggccgagatttggattgctgccgcgcggccggctgcggcaaatcgcttcgtttgcccaatacgtcagcctgaaagctacgatgatcagcccttttctgatcaaatcgattcacagctgtgatttgaaggcgctggcttggacggtcaacgggcagaaaacgggaagccgcctcaaaagctggaaaatcgatgggatcattaccgactacccggattatttttga

SEQ ID NO: 961 - DNA, 108 bp, Bacillus licheniformis
atgggtaaagggagaattaaagtggaagaacggattaagatcgaaaccgatgctgaaatgtttaaagcgactctccttgatcaaacacagtctcagaagaagaaatag

SEQ ID NO: 962 - DNA, 1077 bp, Bacillus licheniformis
atgttcgaaaagtatatgacaatggatttcgctgccgatatcgggatcagcatcggtatccttcttttatttttcgcgtttagaaaaatatttacgaagtacttattcaacctgatactgaaattgacgaataagacgaaaacggactttttcaatcaggtggtgctggcgtttgaaaagccggccaggtggttttttgcgatactcggtatttatctggcgattatttattccccgttttttgaggggcatatggggatcgttcataaactgtacagagtgtccgtgattttggtcattgtaagcggcctgtataacttaacggcggcttcgtctgttttattcgataaaatcaataagcggcttgagcttgatatggatgatattcttgcgccgtttttgtccaagattctccgatttatcattgtagcgcttggaatcagcgtcatcgccggagagttcaattatgatgtcaacggatttgttgccggactcgggctcggcggattcgcttttgcccttgcggcaaaagacacagtcggaaactttttcggcggagttgtcattattatggagaagccttttacaatcggcgattggattgaaacgaaaattgtcacaggaactgttgaagatatatcgttcagaagcacgaaagtccgcacggccggagaggctctcgttaccgttcccaactctgtgctggccaacgaagcgatcatgaactggacgaaaatgcgaaagcgtcaggtcacctttacgctcgaaatcgatccgtcaaccccgcgggagaaagtcgagcggtgtgtggagcgttttaaagaaatgctcgaatcgcacgaaggggtcaacccggatgtcattatggtcaatttcgatgtcctgaaggatacgcatttaagcatcttcttcaactactatacaaatacgacggtctgggccgaaaacttggacgtcagacaggatgtgaactaccgcattcttgacattatgaaagaggagcaggttgattttgtttctccggggcacagcctctttgagttgaagaaaatgaaagatcagcaaggaaatgcttag

SEQ ID NO: 963 - DNA, 750 bp, Bacillus licheniformis
atggaggaagaagccctgagatttgcggatatgatcgaaaatgccgagcgcattaccgttttgacaggcgccggtatgagcacggaatcaggcattcctgattttcgttcagccggcggcatatggacggaagatctgtcgagaatggaagcgatgagccgtgattattacgaacgatatccaaaattgttttggccgaagtttaaagagctttttcaaatgaaaatgacgggaacttatcggccgaatgacgggcacctttatttagccgaactcgagaaaagcggtaaggatgtcagggtgttcacgcagaatatcgacgggctgcatcttaaggcgggaagccgccatgtatatgaactgcacggttcgattcaaacagccgcttgcccaaaatgcggggcgcgctacggtcttgaccacattcttcaagaagaagtgccaaggtgcaatcgcgtcaatggcaaggggagagcatgcggatttatattaaaaacggatgtcgtgctgttcggcgacgccgttcagcatttcgacacgctttttgaagtcctcaacgaatccgacctgcttctggtgatcggcacttcactcgaagtggcgcctgtcaggtttgttcctgaagaagcgcacctgatccccggtttgaagaaagccatgatcaatctcgatgaaacgccttacgatcatttattcgacattgtcatcaatcaaaaaatcgccgagtttgttcggaaactcaatcattaa

SEQ ID NO: 964 - DNA, 492 bp, Bacillus licheniformis
atgaaaatcgaagagttgcattcaaccgcggaatatgccaatcaattggccgagcttctcatccgcgtcgtcgatgacggggcatcagtcggctttctgcctccgctcgaaaagcggctggcggaggcttactggaaaacagccgtcgcaccggattcggttttatggattgccaaacaaaatggccggatcgcaggaagtgttcaattgcacttatgcacaaaacaaaacggccgccacagagcggaaatctgcaagttaatgacagatcccgccttcaggcggcagggcgtcgccaaatcgttaatgcaaaagcgatcgacaggcgaaacaggaaggcagactcttctcgtgctggatacaagggaaaaagacccctccaacctcctttacgcttcgctcggctttgccgaagccggacgcattcctgaatacgcggaatctgcagacggccggctcgatgcatccgttttttattataaaaaactgtga

SEQ ID NO: 965 - DNA, 912 bp, Bacillus licheniformis
atgcgccaagtatcaaaaaaaactgccccatctgtagcttatttgttgacgaaagcagcgtgctttttcgtgttgtgtctgattctcctgtacgtgtgggacctttcacagtcctctgccgctactgagaaaagagagcttacggtgtcggaaaacagccaaatgaggcatgaaggagacagcgttccgctcaaaaaagcaacgcaaggcgaacttctcgatcacttgagcacaaaacagcagatcgaaaagcgcaagcaggaaaaagagaagcaaaaagctgctgcggaaaaaaagaaagaaaaatcgaaggaaaaaacggtttatttgacgtttgacgatgggccttcagccgtaagccaaaggctgctgcaaattttatccgaacatgatgctaaagcgacattcttcatgctcgaaccgaacatgaagcttcacaaagaagccgttctcaatatgaagcagcagggccatgcacttggacttcacggggtgacccatgaccaaaagcaattttataaaggcgccaattctcctaatctggaaatgaagcaggctcaaaaaacgctgaagtctatcaccggggttgaaacccatttgatcagaacgccgtacggaagcaaaccgtcgctgaccgaagcgcagaaaaaagtgctgaaaaagaacggatttatttattgggactggaatattgacagcctggactggaaatacagaagccaaaaattcgttccggaagtcatgaaccagctgaatatcctggaaaagcggcagacaaaacagccgatcgtgatcctgatgcacgatattccttcaacggttcaatcattgccgttattgctgacaaatttaaaaaacatggggtattcatttgcaacacttgatgaatccatgacacccgttcatgaataa

SEQ ID NO: 966 - DNA, 852 bp, Bacillus licheniformis
atgaaagttctttttaacggccggctgattgaacggagcgagtgtgcggttgatattgaggacagaggctaccaatttggagacggcgtctatgaagtcatccgcatttacaatggaattttgttcacgcttgatgaacacattgcccgcttatataaaagcgcagccgaaatcggaatcgacctgtctttttcagaagccgagctgaaaagccagctgaaagagctcgtcgacatcaatcagatgcgggaaggcgggctgtatcttcaagtgacaaggggaaaagctccgaggaagcatcaatacggagcagggcttacgcctcaggtgacggcttatacatttcctattcagaagcctgaaaaagaacagcaaaacggcgtttcggctattactgcggacgacatgcgctggctgaggtgcgacattaaaagcttaaatctgttgtacaacgtcatgatcaagcaaaaagcgcatgaagcttcttcattcgaagcgatcttaattcgcgacggtttggtgacggaagggacgtcttcaaatgtttatgtcgtcaaacaaaacgctatctacacccatcctgcgacaacgctcatcttaaacggcatcacgcggatgaaagttcttcagctgtgtgaagagaacggcttgaattatgtagaaaaagcggtgacaaaggatgaattgctgaatgcggatgaagtattcatcacgtcaacgacagccgaagtcattccggtcacctcgattgacgggcaaacaatcggctccggagcgcccggaccgctcacaaaaaatgtgcagaccgctttgcaaaacagcattttgtcggaaacagccaaaacggtttaa

SEQ ID NO: 967 - DNA, 1359 bp, Bacillus licheniformis
ttgtcaaacgaaaaacgactatcgttttccatatcggctctattgtttatggccatattgtttattattttcacctgcttattcatatttaaagcagaaccgcacataccgcttttgatttgcgtcggttttttggccgctgtcggcgcggtgaaagggcattcttggaaagatcttgagagcggcattgtctcaggcatccgaaatggcgttcagccgatcatcatcctttgcctaatcggcatcttaatcggagtctgggagtacagcggcgcgattccgacggtaacggtttacgcgttgaatctgattgaaccgcagcacctgctgctcaccgcacttttcagctgtcttgtgatcagttcattggtcggctccagctttacgacggtcagcacgatcggcgtcgccctcatcggtgtggccgcggcggcaggcgttccactgacatgggcggcgggagccgtgatttgcggcgcctgcttcggcgacaaaatgtctccaatgtcagacacgaccaactttgccgcaggagtcggggagcttccgattttcaagcatatcagacatatggcgggaacgacgatccccgctcttttgatcacgattttgcttttctttttcatgggccgttctttaacggcggcaccggcttcaaccgaaaacattcaagcgatcataaacggaatagaaggcatggtcaacatcagcgtcttcacgcttctgtcgcctctgcttgtgattgtacttgctgtcagacggacgcccgtcattccgtcgcttgcagcagggatcgtttccgccggaatttttgccgcgctgattcagcctgacgccggcatttcatcgtttttgtcagcgatgcagaatggcccggttttctcagccgatactgaagccgttgaaaagattttaaatcgcggcggccttcaatcgatgatgggctctgtttctctcatcatcatcgcattcgcgctcggcggtctcatggaaaagatcggcatgattacaagcctgcttgaaggcgtaatcaagggcattcatacgaaaggccggcttgtgttctcaaccgtttcatcaagcatcggcatgaacctggcgacaggagaacagtatttatcgatcttgattcccggtcagtcctttaaaaagctgtatgacaagcttggaatcgaccggaagcatttgtcgagatcacttgaagacggagggacattaattaatccgatgatcccatggggagtcagcggcgcgttcatgtccacagcgctcggcgttcccgtcattgaatatttgccgtttgtgtttttcctttatttatcgccgctcttttcgattttgttcggtttccgcaaataa

SEQ ID NO: 968 - DNA, 981 bp, Bacillus licheniformis
atgtcttgcactgttcagaaaagccggtttttacatgaggaagcgatacggtttgaaaatgatgatttagaggcagtacttgtgcccgggtggggaagcaatttgatttcattgaggtggaaggcgggcggtttgaatttgttgaaaacgcctgaaacaaaggaagaatatgacgcgaatccgtttttattcggaatccctgttctttttcctcccaaccggatcgatcacgggagatttacatatgcgggaagaacatacgagctgccgatcaatgaaaagccgctcgaaaaccacctgcacggatttctttacgataaaaagtggacggtaaaaaaaatggaggcaacagaagagcggatcatcgtgcagacgatgctggactctgatgatcatccgggcatcaaatcgatcttccctcactctttttccatcaccatcacctacacattagaaggacagcatctgaaaattgatgcgtcggctgtcaaccgcggtcaagatccgatgccgatcggattggggtatcacacatctttccgctatcctttaaacgaatcaggggataaagaaaagtgcctgtttactcttcctgcctcaaagcattggacgctgacagaccgcatgctgccgactggcgagtatcgggtgacagaggagttcaaagcgggaaaaatggcagcgggtgaaaggcttgatgatatattggcggctgagcaagaccaagaaggaaacagcaccgccgtcattgcggacagcctcgccggcattcgcgtacgctatcaatgcgacggccattttaagcactgggttgtgtttaacggtacatctgatcaggatgatctgctttgtattgagccatacacttggatgacgaatgcaccgaacgtgaaccttccgaagagtgtgaccggatttcgggatttggggccgcaggaagagctgacgatgcgaagcaaaattgaggtaggcggaatataa

SEQ ID NO: 969 - DNA, 477 bp, Bacillus licheniformis
atgaaacaggaatacaagcggccggtgcttttcatcgcctcccttttcatggccttttgcgccgtttatttcggcgggaggctgatcggtttttatatggcggaatacccaaaatggaacgggcaaagcgccgacggaaattgggaggccgtgatcaaaaagatagatggccgcgcgctgttcggcggagagctctactggacaggcgaccgcggcaagctggacgatacatatttggaaaaattggtcgtaaagtttggtgatgaaatcgttttgaacgcccaaatcgaaacgccggtgaaagattacgcgggaggcaaattccccggcggagggtcaaaagaacaatccgtttcttttttggaagggcttgaagaagctgaaatcgccggccgcgaggtgacggttcaattggattggagagagggcaaacaagcgtcccatacaggatttacgcttgataaaagctcatggtaa

SEQ ID NO: 970 - DNA, 1935 bp, Bacillus licheniformis
atgaagcgctgtattttggtcgttggcgaaggattgatggctgaaggcgcatcacaacaattatctgctgaatataacgttatccgcaggtctgattttgagaacagaataccggcggagacttcgttcgttcttgtgctgcacgacgcttggcggcctttgttatatcgcgaggccgaaaaagtgctaagggcggcagggattccctggcttcgcgggtttgcatcttttggggaaggggtaatcgggccgctcgtttatccgtcagagtcaggatgttcaaaatgcgccgatatgaggtggtatgtctccggccccgacagcatggagacgcttgaactggaacaaaaaagcaatgacataaaccgcgatccgtgggcttcaaagaccggctgccgccagatggtcagcctgatctgcacagaagtcgacaccatcatgaacggcgggcgcggccgattggaaaaaaagctgtacatcgtcaatttgaaaacgctagaaagttcgctgcacgctttcataccggaaccgacatgccctatatgcggaaatctgcccgaagacggaccggaatccgcgcggatatcgctccggcccagcctgaaaacgaacccggacagctttcgcgtgcggaacacggacgacttaaaacaaacgctctccaaagactatttggaccagagaacggggatattcaacgccaaaatttatgacgcgattctgccgtttgccgatatgatcgtcaatatccctttatggatgggaaatgaaggggtaggtgggcggagccattcgtatgaagacagcgaattaaccgccattttagaaggtttggaacgctattccgggattgaaccgcgcggcaaacggacggtcgtacatgacacctatgaaaatgtaaaagatcgtgcgctcgacccggcaaaagtcgggcttcatcaagccgaacaatacacgcatcccgattttccttttcagccgtttcatccggcccgcccgctccgctgggtatggggctattcatttctgcagaaacggccgattctcgttcctgaatcgctcgcgtattacagcctggggcgggaagacagctttgtctatgaaacatcgaacggctgtgcactcggagggagtttggaggaagcgattttccacggcatattagaagcggctgagcgcgattcatttttgcttgcctggtatgccaggcttccacttcggcagctggatctcgactcttcaggagatccggaattgcgcctcatgacagagagggtgcgaagtgtggcgggatatgatctgcatgtctttaattcaacgatggaatacggcattccaagcatttgggcgatcgccaaaaacagaaaacgggaaggattgaatctgatttgttccgcaggcgcccaccccgatcccgtaaaagcggtgaaaagcgcccttcatgagctggcaggcatgatgttgaagcacgaccgcaaatttgaatctgaaaggagcaaatatcaccagatgctccgcagtcctgctttagtgcgggaaatggaggatcacagcttaatgtacggactgcccgaagcggaagagcggctcagttttttgctgaatcaaagccggcctctgcaaacattcgacgatgcctttaaaaaaagaaagaaacaccttgatttaaccgaagacctctgcgacctgcttgaagctttccggagtctcaaccttgaagtgatcgtcgttgatcagacttcccctgttatcaaacggaatggactttattgtgtgaaagttctcatcccgggcctgattccgatgacattcggacagcgcttcatccgcctggaagggcttgagagaattttcaccgtgccgaagaagctcggctttgcggaagagccgttaagaccagaacagctgaacctgcacccgcacccgttcccttaa

SEQ ID NO: 971 - DNA, 1854 bp, Bacillus licheniformis
atgacacacctgactgcttccgctcgcctgaaagtaaaccgggatacatggtttcttcctgatccgaacggcggcgcgtattttagaaataattccgggtcgtttcgcttaaaaggatcttcgattgctcaatggttcgaaaaacttctgccaatgttcaacggggaacattcgcttgaagatttgacaaaaggactgcaagctccgtaccgaaagagagtatatgaaatcggagaaacgctttataaaaacggattcgttcgcgacgtcagccgcgatcacccgcacaaactggaaagctcagtgcttaaaacgtatgaagcccaaatcgaatttattgaaagctttgccgattccggcgcttaccgctttcagctgtcgcgccaaaccaaaatattggctgcagggactggctcctttctcacgaaattggtccggtcgctgatcgattccggtttttcaagaatccgtgcgatcgtgacggatgcatccgggcatgctttagacgaactggcagaaatatcagagcaaacagaaagcggactggagattggcttcgccgaaacgcaacattggcgggaagcggtgcgatctgccgattgggttttgtatgtctctgaccgcggcttcacagatgatctccacgatcttcaaacgttttgccttgaagagaacaaaggattcatacccggcatctgtctgaaacaagtcggactggcaggccctgtcttccaacaacacggagacagccgcttcgaggctgcctggaggcgcctccatcggtctgcgctccatgaagaacgaacgcttggaacctttcctttggcaggaaaagacatgctggcaaatgttattgtgttcgaattgatgaaagcagctgcggagcttgagccattatctaagaagaatcaagtgtacctgcttgatttggcaacgctcgaaggcggctggcatgcgtttcttccccatccggacttcagttgcggcaaggattcggctgaactcatctgcgaccttgaagcgaaactttcggaacaccccggaaaagaaacagaaagccggctattccaatgtttcaccgaactgacctcacccgtaacgggcatttttcatctgtgggaagaaaaacatttgccgcagcttccattagcacaatgctttgttcagacagcagatccgctctcttccggacctgcggagcttttgcctgagacggtttcggtcggtttgacccatcaagaggcgcggcgggaagccgggctgacggggattgaaatgtatgcatcaaggttgacccgttcttatccgaataacggagatttcgcgatcgccaccggagaaacgctggctgaaggcgtattaaggggattggagaaatgcctggaacaccggttgtgcgaacggataaaaagcggaaaagaaatgatttccctcgttcagctggacggaatcgaagaccggcattctgcattttatttaaaagcgctgacagtcttgtacggccaaccggaaatcggtttagggaaaaacatagaaggcttccctgtcgcatgggcgggaattcgcgggcgctggtacagaagttctggactcaacatcacatccgctctcagaaaagtgctcgaacgggcactgacagacaaagatcctttgaaaggtgcggatgttctgctggagcctggtgaactgaagcttgctatccccgtttcagctgctttgcaaaaaacactgctttccgccttgaaaaacaaccggggcttgcagctgtatgtctatgagctgcctgttgaaccatttttaaaagaaaaactagcaggaatctattgcgtgcagttgcgaaaggaggaaccttga

SEQ ID NO: 972 - DNA, 501 bp, Bacillus licheniformis
ttgtttaaagctgaccggatcatagtcgcgtttgacggaaaagaggaaagcaaaaaagcgctgagaaaagcgatcgacctgtcgaaaaggctcggctcacaattgaccgtcgcccatgtccatgaaccgaggcaagtgagaacagaggctgcggccgaaagaccagctgccggagcgccatacctttacagcggcttcccggccgcaccccggatcccccgcgattcagacttggccggtgaacccatgatctacgaggacagcgcggaagaagcgattgcggcagcgaaaatcatattgagcgaaaaccagtacgacgcggaaatcgaggtgctggaaggagacacggccaacgcagttctgcagcatgcggaaaacatcggcgctgacctcgtcatcacaggtacgcgcgaccagaaccgcctgaaaaagctcctgttcggcagcgtcagcgacaagatatcgacaaaatcggagatccccgtgctgattgtgaaataa

SEQ ID NO: 973 - DNA, 1755 bp, Bacillus licheniformis
atgttttctgttttatggaagctgggctggttttttaaagcctcatggcggcgctacacgatagcggtcgtcctattgattattgtaaacgtattggaaatgtttccgccgaagctgcttggcaacgcgattgacgatatgcaggcgggcactttttccaaggccggcatgctcggctatatcggtttatttcttgcgcttggcgcagttgtttataccctgtcctattattggatgtatcagctgtttgggggagcgaacctggtcgaaaaaattctcagatccaagctgatgggccatttgctgaaaatgacgccgtctttttacgagaagaaccgcacaggggatttgatggcgagggcgacaaatgatttaaaagcaatttccatgacggcgggcttcggcattttgacactggtcgattcgacgatgtatatgctgacgatccttttaacgatgggttttttgatcagctggaaactgacgcttgcttcgatcattccgcttccgctgatggccgccgccatcagcatctacgggaaaaaaattcatgagcgtttcacggaagcgcaggatgcgtttggcgctttaaatgatcaagtgctcgagtccgtgtcaggggtaagggtgatccgggcctatgtacaggagaaaaatgatgtcagccggttcaacagcatgacggctgatgtgtacaagaaaaatatgaaagtcgctttgatcgattcgctgtttgaaccgacggtgaagcttttggtcgggatcagctatttaatcggtcttggctacggcgcctatcttgttttccgcagccagctgacattgggtgaactcgtctctttcaacgtgtacctcggcatgctgatctggccgatgtttgcgatcggagagctgatcaatgtcatgcagaggggaaatgcttcgcttgacagggtaaatgaaacattggcatatgagcctgatgtgagagagcccgctgaacccgaagcagcggagccgggcgatattgtgtttgacggggtcacttttacgtatccgagctctgcgtcggaaaacctggccgatatttcatttaccgtattagaaggacagacggtcggaatcgtcggaaagacggggagcggcaaaacgacattagtcaagcagctgctgaggcagtatccgcaaggaaaaggaacgatcaccatttcgggcgtgcccattgaacgtctgccgcttgatcagctccgcagctggatcgggtatgtgccacaggaccacgtgctgttttcaaaatcagtgaaagacaatattttgttcggcggacacctcgctgaagaacgcgatttgcacgccgtcatctctgcagcacatctgaaaaaggatattgagatgctttcagacggcttggagacaatggtcggagagaagggagtcgctttatccggggggcagaaacagcggatttcaattgcgagagcgatgattgcggagccccatattttaattttggatgattcgctgtccgctgtcgacgcgaaaacggaagcggcgattattgaaaacatccgcagcagacggaaaggcaaaacgacgtttattacatcacaccggatgtcggctgtcgaacacgccgatttcattctcgtcatggaggatggaaggatcgttgagagagggacgcatcaagaactgatcggccggaaaggctggtattttgaacaatatgaagcacagcagcttccttcgggagaagaagggggcactgtagcatga

SEQ ID NO: 974 - DNA, 2019 bp, Bacillus licheniformis
atgacaacaggaaaaaggcttttccaatatgcgcttctttataaaaaaattctcatctgggcgctcgtcatgctgacgatcgccgtcacagccgagctgactgggccgatgatcgccaaaaagatgatcgacgatcatattctcggaattgaaaaaacgtggtatgaaacgacagagaactcgaaatatactgtttcctacaaaggaaaggaatatatcagggaagacaggacagacccttcagctgaaaagctgcaggaagttcacatctttcaagtcggtatgaactactactttgtggggaaaccggtttcctttgacggggagcggacggtttccgggggagagctgagaatgacgagcggagaccggacggaaacctacaaggccgatcgcctgtctttgtctgaagtgtatgctttttacgagcctgaaataggagggctgatctcgctcgtttctatttatttcggccttctcattttctcgatctttttccattacggccaattctacctcttgcagatgagcgcaaaccgcatcattcaaaagatgagacaggatgtattcgccaacattcaaaggcttcctatccgctattttgataatttgccggcaggaaaaatcgttgcaagggtaacgaatgataccgaagcgatccgcgatctgtatgtgaccgttctttcgacgtttgttacaaatatcatttatatggccggaatattcgccgcactgtttttccttgatgtcaggctggccggcgtctgtctgttgattgtgcccctgattgtcatttgggctgctgtttatcgaaaattcgcttcaggctacaatcataaacttaggtcaatcaacagcgagatcaacgccaaaatgaatgaatcgattcaaggcatgacgattattcaggcattccggcgcggacaggacacaaaagaagaatttgaacagctgaatgacagccactttcattaccaaaataaaatgctgaaattaaactcgcttatgtcccacaacttggtcaacattctgagaaatgtgatgttcaccgctctaatatggtatttcgggggagctgccctgaacgcggaaggaatgatttcaatcggcgtactctatgcattcgtcgattacttgaatcgtttatttcagccgattacgggcatcgtcaaccagtttgccaagcttgaattggcgcgcgtatcatcggagcgggttttccgcctgctggatgagccgggcgtcgatgtcaaagagccgagcagcgaaagagcgcgggggcgagtcgtgtttgaggatgtatcatttcgctatcatgacggtgaagatgtgctgaaaaacatctcatttgaagcgaagcaaggggagaccgttgcattggtcggtcatacgggctcaggcaaaagctcaatcatgaatgttcttttccgcttttacgatattgaaaagggcgatgtcaaaatcgacggcagaagcatatatgatatgtcaaggcaggaaatcagaaagcatatgggcatcgttctccaggatccttacttattttccggcacgattgcttcaaatgtcagccttgacaatgctgatattactagagagcaaatagaagacgccttgaaacaggtcggggctcttgaggtgctcgcccgtctgccgaaaggccttgacgagccggtcatcgaaaaaggaagcaccctttcttcaggagaaaggcagctgatctcgtttgcccgtgcgctggcatacgatccggctattcttattttagacgaggcgacggcccatatcgataccgaaacagaagcggtcattcaaaaagcgcttgacgtcgtcaaacaagggcgcacaacctttatcatcgcccacaggctgtcaacgatcaaaaacgccgaccagattctggtgcttgaaaaaggccggattatcgaaaggggaaatcatgaagagctgatgaagcaaaaaggccaatactatcaaatgtatgaactgcaaaaggggaaaggaaccctgatagggtaa

SEQ ID NO: 975 - DNA, 648 bp, Bacillus licheniformis
atgatagatccgatgggagtgatcatgttgaagattgcgctttttggaggtacaggccgtgtcggacaggcctttctcaattttgttgaagaggatgggcaccattccgttaacgcacttgtccggaggacggaaggcgcccgcattccggatttatgccaagcacatataggaaacgccaggaaccggcatgacgtcgagtctttaataaaagattgcgatatcgttgtcagctgtttaaacacagatggagacgatacattgaccgtctccatcgaacacatcataaacgccatgaacgtacatcggatcaaacggctgattaccatcggaaccgccggcattttaaacgcaaggcagaacccggccctttaccgctttgaaacaaacgaatcaaaacggcgctctacgcgcgcagctcaagaacatgcccgtgtgtacgaacggctccgcgaatctgatctggattggacgatcgtctgcccgacgtatctccccgatgggccggcattgaagacataccgttttgaacaggatgttctgccgcccggcggaagagaaatatccaccggcgacaccgcccattttctttttacacagctagagtctgaccagtttgtcaaggcgagggtggggctcgcttattaa

SEQ ID NO: 976 - DNA, 204 bp, Bacillus licheniformis
atggctaatcaaaattcttcaaatcaactgcttgtcccaggagcagcgcaagcgatcgaacaaatgaaattcgaaatcgcttctgagttcggcgtaaaccttggcgctgacacgacttcccgtgcaaacggttctgtcggcggagaaattacaaaacgtttagtttcccaagctcaagcatctatgggcggtcaacaattttaa

SEQ ID NO: 977 - DNA, 222 bp, Bacillus licheniformis
atgtgtccagtgtgcaacgggattctcgtccagacgaggcattgtccgaagtgcggcggggaaatggcggacgccgggagagcaaccgattttttcggtccttacagtccgtacatggagttcgattcatttaaacaaacgcaaaccgcgtgcgttcatttatatacgtgccaagactgcacttatgaagaaaccgttgaaattgaaacgaccgaagcatag

SEQ ID NO: 978 - DNA, 1107 bp, Bacillus licheniformis
atggcggaactcgtgctcgatcggatatacaaagtgtatgacaacaaagttacggctgtggataattttaatcttcatatcgaggataaggaatttatcgtctttgtcggaccgtcaggctgcggcaagtcgacaacgctcagaatgatcgcaggccttgaggaaattacggatggcgaattcacaatcgacggcaaacggatgaatgatgtcgctcctaaagaccgcgacattgcgatggtattccaaaactatgccctgtatccgcacatgaacgtctatgacaatatggctttcggcttgaagctgcggaagtttccgaaggatgaaatcaaacggcgtgtccatgaagcggccaaaattctgggccttgaacaatatttggatagaaagccaaaagcgctttccggcggacagcgccagcgcgtcgccttaggccgggcaattgttcgggatgcaaaggtgttcttgatggatgagccgctatcaaaccttgatgccaaattgcgcgtacaaatgcgcgcggaaatcacaaagcttcatcagcgtctgcagacgacgaccatctatgtcacccacgaccagacggaagcgatgacgatggctacgcggctcgtcgtcatgaaagacggaatcatccagcaggtcggggcgccgaaggaagtctacgaaaatccggaaaacgtgtttgtcggcggctttatcgggtctcctgcaatgaacttctttaccggcactctgaaagaagacatgtttacattcgacggcgtttcggttcgcgtgccggaaggaaaaatgaaagttctgcgcggccagggttatgtcggcaaggaaatcatcatgggaatcaggcctgaagatatccatgatgaacctgttttcattgaagcgtcaaaagactcgaaagtcgatgcgaaaattgaggtagccgagctgatgggcgcggaaacgatgctttattcgcaggccggcactcagccgtttatcgccagagtcgattcaaggaccgacgttcaggccggcgatacgattccactggcgcttgacatgaataaagctcacttttttgataaagaaacggagctccgcatccgctctgaaggataa

SEQ ID NO: 979 - DNA, 882 bp, Bacillus licheniformis
atgctggagaaattaaagacgctttacggtgaacggatggttggatctaaggctgtttcaaagcacgatgcattatggtttcaaaccgacgaaggcgaaactttcggcgttttgaaaagcgcggtcaccgaccgggaaaaagagctgctctattgcctattccggcctttttcagaaccgcatcgtccgcagcagctgacaaagcgggagaaagaatggcacgaatatttcttttgcgatgcccccctccaaaacccgggaaacattcagctgattcaaggccatttttttaaaatggagcatgcccctgaagaaagacaggcgattaaagaagcggtcagcggcttttttaaagacccgcttgttgtatggtacgaccggcatgaagccgttatcgtccacgaaaatccttcaccgtttctcgcaaaaaaagagctgtccgagcttgcggatgcactgacaagcgatttcatggcaactcctgtgtttttcagcggccagcttcatccagtcaacggatcgcttcaaggcaaaatccgctttgaaaaacaaatgtttcattacatgctggaagcgggtgacatcggaaacgtcgccacgttttgccagtgcctcccgtcttttttgacggcaaaaccggagcgggttcatgcttcttcattttcggacgccgtaagagaagcgctgtctgatcccgagacatccctgaccatcaaaacgtatatgagatgcaacctgaatgcctctcttacagccaaacgtttgtttatccaccgaaacagcctgcagtacagaattgataaatttatcgaacggactgcaattgacatcagacagtttgaagaagcagccgctgtttatttgatgatgcatctcctttag

SEQ ID NO: 980 - DNA, 210 bp, Bacillus licheniformis
atgatttctcactttcaatggaagccgctgtttaaaaaagaaaggcttcccggctggaaaatatcgttttatcataaagggattcattatgaaggaatttatcataaatcgggggaaatcgagtggggcagcacctatcccccgcatgatgacgagccttccctgaaaagcgaaattcatgaattaatgctcttccatatttacgagtaa

SEQ ID NO: 981 - DNA, 1359 bp, Bacillus licheniformis
atgaccggtcaaccgctgacggtcggcatccaccagacgagtgaaaacacgatgctcctgcccgcttctttcaaacaggacggtctgttattcgccgctttcggtacgagtgttgaacggtgccatgtctcatttgacagccatttgaagcgcaccgttttattatccgaaaatctgtacaaaaacctgcggattccgtaccgcggcaaagcctccctgctttttcgcgacaataccgtctatatcgggcctttaatcgggattttcaccgccggtttcacaaaatcgcagctggatcctgtcagaggaaggtctttatttttttcgaagcttttgacgatggatctcccggcaggaggctacagctatctgttcggggcgcaccagattaattgggaagaaggcacggtgcaggctctcattttcagggaaaacggctgggaggaggccatagtcccgctgcctaatgttgtatacgacagactgccgaaccgcaaagccgaagaatcctccgccttgcgggaaacaaaaaaacggcttatggatgaataccgcattccgtggttcaatccgggcttctttaataaatgggagatctatgaatgtctgcagcaagacgagaggacagcggaattgcttccattttcggcattggagcccgatgccgataaaatcgaagacatgatcgaccaatacggcttcatttatgtaaagcccgccggcggcagtttcggcaaaggcatattccagctttcaaaacgggaagaaaacggtattcttgccagacatgccgaaggcgtcacatctttttcgtccgctgctgaatgtttaaaagaatggcagatgcttcacaaacatacttcttatcttgcccagcaaggcatcgaacggatcgaagtggatcatcacccggcagatttcagggttcatacaaacaaaaacggaaaaggtcaatggaccgtcacagccatcgcggccaaaatcgctggaaaggacggaattacaacccatatgtcgagcggcggcgccgtgaaaacacttgcagagatttatgatgatcctcaggaaaggcttcacactctgcaaaagctgacaaaagcggcggtccttctcagccgggtccttgacgaaaagcttgacggtttcatcggagaaatcggctttgacctgggattggaccgttcgggaaaggtgtggctgtttgaagccaactcccggcccggccgaggaatcttctcccatccccgtctggcatctgtcagccgcttaacgaagaaaagaagctttgaatatgcttcttatttaaccgaacagtcaatccttaatccggaggacatgtggcatgacctcaagccgtga

SEQ ID NO: 982 - DNA, 1086 bp, Bacillus licheniformis
atgatcacgcttggatttatgtcgctgtcgcacggacatgaaaaagcctatgccgaagaactggccaaagtggcttcggactacggaatccgatttatccggttcacccccctggatatttcccccggttccctgcttgtgaaagggctctcctttcacccgaagtcaggacagtggaatgaaattgaaagagaaatcccggaattgatctatgaccgctgcttttacggcagagatcagcaatcgaaaaaagcaaaaccgattgtcgaatggctcaaaaagtatcctaaaacgacatttttaggacttggacttcctgacaaatggacggtttacaaagcattgaaagccgatcccgtcatcaagtcctaccttcctgcaacaacgattgcagaaaatgcccaggatatcctgcgcaagcttgcaaaagaaaaatcatgcatcttgaagcctgcatccggatcaggaggccgcggcatcattcatcttgagcttacgggaaaaacggtaaaggccgcctaccaaaccggaaaacacaaacagctgaaatcattttcgaaacaggcctcatttgaaacgtggtgccaaaaagttcttcagcaccgctatctgctgcaatcgttcctcgatattcaagacaaggacggttttccttgtgatatcagattgctgctacagaaaaacggctatggcgaatgggaaacagccggtaaaacggtaaggcggagctatcagcatggactgcttgcaaacctggccggtggctctgaggcggtgagctttgacagctggcttttatccgtgccgaaaaagcgccaggccgtccttctcgatgatttagagacaatggcgcaggccgttcccctggcgcttgaatcaaatcacgggccattattcgagctcggccttgatatctgcctgacaaaagacggaaaagtctggctgctggatgtcaactcaaagcccggaaaacacgcttttatcaagcactctcctgaaaaaagggagcttttgtataaaggtcctttggagtactgctcattcttaacggcttcagccggcgcgaaaggggctgagaaaagatga

SEQ ID NO: 983 - DNA, 1131 bp, Bacillus licheniformis
atgtatgtatttgggatttttgccgttatgattgcagtcggtgcacttatcggcgctgtaacgaatcattttgcgattaaaatgctttttcgcccctataaagcgatctacatatttggaaagcgggtaccttttacgcccggattaattccgaaaaggcgcgatgaattggcgagacagatgggacagatggtcacaggccatctgctgacaacagaagggctcaaaaaaaggcttgcatccgatgcggtcaaaagccaggcggtgcaggttggagagaggcttttggcccgcctctcgcaatcaacggccaccgttgaagaagcattggaaagcatcgggatttcaaaccccgcccaaaaagcggatcgagcggtatccagattggcggatgagaagctgaccgcatttttagaggcgtatgagaatgaaccgctgaaaaagcttttccctcttgaggctcaagaaaagctgaaagaaaaaattccgatggtgtccagctatattttaagccgggctgtcagctactttgaaagcgatgaaggcaaggaacgcctcggacatatgattgacgattttttgaaagaacggggcatgctcggcagcatggtgcagatgtttttaggcaacagcagtctggttgaccgggttcagccggagattgtgaagtttttaaagaacggcgagaccgcggggcttttacaggatctgcttgaaaacgaatgggacaagctgaaagaatatacgttcaaggaagcagatgacaaatggaacctcaaacctctcattttcgatttgaaggaaaagcttttgaaacgattctcgcttcagccgtttttcgaaaagacgataggctcctctatttccagttttgagcaggatatcgctttgcgccttccgcagatggccgaccgccttctggaagaagcgggccgccgccttgatcaagcgctcaaacagctggaactcgagcaaatcgtcaaggaacaggtggacaacttccccgttgaacgtcttgaagaaatggtgctgtccatttccaagcgggagtttaagatgatcacgtatttaggcggcctgcttggcggaatcatcggagcggtgcaagccatctttgtgattttgatctga

SEQ ID NO: 984 - DNA, 354 bp, Bacillus licheniformis
atgacggtcaatttacatgactcggcttatgacttggaacaagcattgcgtcaaagcgaagaatattcccgattgaaaaatctttatgatgaggtgaatggcgacccatctgctaaaaagatgtttgataactttcgcgatattcaattgaaccttcagcaaaaacagatgaacggcgaagacatcacccaggaagaggtcgaacaagcgcaaaaatccgtggcgctcgtccagcagcatgagaaaatctcgcagctgatggaagcagaacagcggatgagcatgctgattgctgatttaaacaaaatcattatgaagcctttggaagagctttacggaaatccggagagctga

SEQ ID NO: 985 - DNA, 864 bp, Bacillus licheniformis
gtgtcaaaacaaatgcttgcgctgaatatagacggaacgctgcttcggacaaacggacggcttcatcccgcaacgaaggaagcgatcgaatatgcaaagaagaaaggtgtatatgttacgcttgtgacgaacagacatttccgctccgctcaaaaaatcgccaaatctttaaagctggatgcgaagctgattacgcacagcggagcgattatagcggacaaaatcgccgaacctttattagaaaaaaggatttccgaagaacagacatttaaccttgttcaaatactggaaagctatgattgcaatatcagaatcctccatgaaaaatattcgattggaaatcggaaaaaaacgaattcaaacctgctggggaaaacgatgattcacccgtctgacccgattttttatcccgtccagtttgtcgattcgctgagcgacatgctgatggatgaaccggtcagcgcgccggtgatcgaggtttattgctcaacaggtcagtccgaagaaatcaggcagacgatcacaaatgcgtttcctctcgtcgacatcattgaagcgggagaaaaaatgctgattgtccataaaggagtttcgaaagaagcgggattgacgatgctcgccgccgacctcggattaaaaatggaagatgtcgttgcgatcggccatgatatcgacgaccttccgatgatcgagcttgccgggctcggagtcgcaatgggcaatgctcctcaggaggttaagcaaaaagcggattgggtgacgcgctccaatgatgaacagggcgtcgcctatatgattaaagaatacttcagaatgcagcaaagcaaagggtttcttaaaaaattccatattaaaaaaatctga

SEQ ID NO: 986 - DNA, 1587 bp, Bacillus licheniformis
atgtatgtttcccggattgattttgcccatttatttttgtacactaaagaaagttttgaaacgaaaaaggtgatgacattgcgcatttatatagaagggctccaagacgaaaggttccagagaccgcttgagcatatagcgaacttattctttgaggaaagcgaagtcgctcttggcgaagaagcgccggcagaccttgcgatcgttctcggctatgaacgggaagaaaacggcgtcaaggcttccggtgcgataaaggatacggacattacagcagaatatgcgaaaaacattgaccccaagctgacggaaaaggaagcgtttaagcaggtgaagaataccgtttcctacgtttttttgagcatgcttcaggagcataccgggatcattcagaaatgggggattctcaccggtgtccgtccgacaaagctgcttcacaaaaagctggagagcggcatgccaaaggaagaggcccatgccgagctgaagcgggattatttaattcacgacgaaaagatcgaactgatgcaaaacattattgaccgtcagctgaaagctgtacctgatttgtatgagctgggccaagaggtcagcatttacatcggcatcccgttctgccccacgaagtgcgcctactgcacgttcccggcgtatgcgatcagaggacaagccggacgagtcggctcatttttgtgggggcttcactatgaaatgcaaaaaatcggtgaatggctcaaggagaacgatgtcagcatcacgaccgtgtatttcggcggcggaacgccgacaagcattaccgccgaagaaatggatttattgtatgaagaaatgcaccgttcatttcccgatgtgaaaaacatccgcgaggttacggttgaggccgggcggcccgatacgattacagaagaaaagctcgcggtcttaaaaaaatggaacatcgaccgcatcagcattaacccgcagtcttacgaaaatgaaacgctgaaagcgatcggacgccaccataccgtggaagaaacgatcgaaaagtaccatctgtcgcgaaatgccggtatgtcgaacatcaatatggatttgatcatcggccttccgggcgaaggagtaaaagaattcagacactctctttccgaaaccgaaaaattaatgcctgaatcattgaccgttcatacgctgtcatttaagcgcgcgtctgaaatgacgaagaacaggcataagtataaggtggctgaccgcgaggaaattgtcgcgatgatggatgacgctgtctcgtggacgaaacagcacggttaccatccctactatttgtacaggcagaaaaacattctcggcaacctggagaatataggctattcccttcccggccaggagagcatctataacattatgatcatggaggaaaaacagacgattatcgggatcggctgcggagctgcgagcaaatttgtcgatccgagatcgggaaaaatcacgcacttttccaatccgaaagacccgaaaacttacaatgacagatttgaacattatacaaacgaaaaaatccgctacttgtctgagctttttcagaaggatggttctcaacaagaatag

SEQ ID NO: 987 - DNA, 777 bp, Bacillus licheniformis
atggaatatatcaaatggaaagacgaagacgggatttttgaaattgtactgaatcgctctgaggcgtacaatgccttgaatgaaaaaatgcttgaagaactgaatgaagctttgcgtgttgcagaggaaagcgaatcgctgcttctccttgtgagaggcagcggcaaaggattttcggcaggcggagacattaagatgatgctgtcttccggagatcaagacagctccgcccgcgtcattgacacaatttctgaaattgcggtgaagctttacagcatgccgaagatgacgacagcggctgtccacggtgcggctgcgggtctgggattgagcctcgcgctcagctgcgaccatgtactggtcgaaaaagaggcgaagctggcgatgaattttatcggcatcgggcttgttcccgacggaggcggacacttctttttagagcggagaatcggtgaaactgcggccaaagaattgatttggagcgggaaaaaattgacgggggccgaagcgcacgagcttcggatcgcagacgccgtattcagcggggactccggccgttttgcgcgcatctatcttgaaaagcttctgcacgctccgctggcagcgatgattgagacaaaaaagatctatcaggcgttgaatggaggcaggctgcagaaaacgcttgaactcgagaaaacggcccagatgaaaatgaggctgacaagcgaccatcaggaagggatccgcgcatttttagaaaagcgccagccgcaatttaaccgtcagcaagtataa

SEQ ID NO: 988 - DNA, 1119 bp, Bacillus licheniformis
ttgaaacagaagattccatctgaatacgttgctagaaagctgaatgattggtacaacgccattcggaaaaatcagatcgccgccagtgaatcattgaaagcggaaattttaaatgattttcaagacatggaagaaaatcgggacgtcctgctctactattcgctgcttgaattcaggcataaactgatgctcagctatttgaaaccgaaagagactgaaaatattgaaaaaaacctccgcgacttagaagaaaaagaagaccaaatgacgggtttattaaactattattactggttttttaaagggatgtatgagttcaaacaaaagcggttcgtcaaagcaatcggctgctataaaacggctgaacaaaaagtcagcgcactggaagacgaggttgaaaaagcggaattttattataagcttgcggaaatctactattatatcaaccagagatacctgtcgatcaactatgcgacgctagcttccgacatttttaaccggtatgaaacgctaaaagaaaaaaagattttctgcgattttatcattgccggtaattgggttgaatcgatgacatacggacccgcgctgaaaagcctggccaatgcgcttgaagacgccaggaaaatcaaaaacagccatttgacggcagccgctcattttaatttgggaaattgctatttccaccaagaatcgtaccgggaagcctcagatcatatggagagcgccctttccatttttgaacaggaaagttcatcatatattcccaaagtgctgtacaacttgatgtacgtccgtctcaagcaggggaaccatgccggagctgccgcctgttatgaaaaaggcatccgaagcgcggcatcgctcggggatgaagaacacgcggcaaagcttaacattctgtgcgggctgtatttagacggaggggatcagaaagccgtggaaaacggatttgattatttggagtcaaatcatttatatgctgctgttgaagagctggctttagatgcagcccagtattataatcaaattgagcggctgaaagattccattttttactatgaaaagtgcgctcaggcaagtcgaaaaatcaaaaggggagatgcgttgtatgaaagctaa

SEQ ID NO: 989 - DNA, 186 bp, Bacillus licheniformis
atggaaaattattatgtaaccgttttcgacactagtggagaaacgcttttgaatgagcgatttgaagcggccgatgatgaagaagcgaaagagaaaggaagaggaatgctgaaggaaaagcaatttttggagcatacacaccgggtagtacattcgtccggtaaaatcattgttttccgcagctga

SEQ ID NO: 990 - DNA, 897 bp, Bacillus licheniformis
atgctcaaaatcgatcacgttacgaaaaggttcggttcatttacagccgtaaacgatctgacgctggagattccagacaagcaaatgttcggtctgctcggcgccaacggagcagggaaaacgacgacattccgaatgatactcggccttttgaatgcgacagagggtactgtcacatggaaaggacagccgattaactacggtgtcacaaacagcatcagctatttgcccgaagagcgcggactgtacccgaagctgaaggtgaaagatcagctcgtgtacctcggacgcctgaaaggcatgaccaaacaaaatgcgctcaaggaaatggagaagtggctcgaacgcttccatattacagaatacgccgacaaaaaggttgaggagctgtccaaagggaaccagcaaaaaatccagtttatcacggccgtgctgcacaagccggagcttttgattctcgacgagccgttcagcgggctcgatccggtgaatgtcgagcttttaaaagacgcggtcatttctttgaaagacgacggcacctcgattgtattttcaagccacagaatggagcatgtcgaagagctgtgcgaacacgtctgcattttgcagcgcgggacgcctgtcgttcaagggaaattaaaagaaatcaaacgttctttcggcagaaaaaatgtcacgattcacgcggacggcgacttgagcttcttgaaagaggcggacggcatcgtcaaatggcgtgatcattccgaaggagtccgcctgcaggtcgagaatgaagaagtctctcaagagctgtttacaatgctgcaaggacgcgggtttatcagaaagtttgaacttgaagagccttctttgcatgatattttcgtcgaaaaggtaggtgcccgttatgaataa

SEQ ID NO: 991 - DNA, 1269 bp, Bacillus licheniformis
atgaataagttttggattgttctttttcatacatatatcagcaagctgaaaacgaagtcgttcatcatttcaacggccatcacgcttgcgcttgtcgtgctcgtcacaaatttgggatcgattatttccatgtttgacgacggcggagagggtgacaagatcgctgtcattgatcgctcaaatcagctgtacgacacgtttgcccagcaggtgaaagcactcgatactgatgaagcgctggaggtccaaaaagcggataagccggaaaaagagcttgaaaaagacgtcagagacgaaaagctcgagggcattttaatcctggagagagataaaaaaggggtgctgaaaggaacgtataaagcgctcgatatcgctgattccacagctgtctccacgattgaacaggcgctctcgcaagcaaagatcgccgttggaacggctgaattgaacgtacctcaggaaaagctgagtgaactgtttacaccggtaaaagtcaacagtgttgccttgaaagaaggcgcgaaaaccgaggaagagcttcaaaaggcgacagggcttgtgtatgttgtgctgtttgtcatctatttttccgttttgatgtacgcttcaatgattgcgacagaagtagcgacggagaagtcttcccgcgtaatggaaattttaatttccagtgtgccgcctgtccagcaaatgttcgccaaactgttcggcgttgccctattaggcctgacacagcttgccgcgctccttcttgccggctatctgtcgcttcagtccagccaggaaagcggaggggatgcggctgagctggttaaaggattttttgatgtttccggcgtacctactgcaacgcttgtgtacgcggtcattttcttgatgctcggctacttcttatacgcaactcttgcggcatttctcggaagcgtcgtcagccggattgaagatgttcagcagatgatttcgccgatgatcctgttggtcgttgccggattcatgattgccatgttcggactgaatgctccggattcgacgtttattaccatcacttcattcattccgttttttgcgccgatgatcatgttcctcagagtcggcgtgcttgatattccgttttgggaagcggctctcggcatcggcatcaccgctctcacgattgtgattctcgccgtcatcggggcgagggtgtataaaggcggcgtgctcatgtacacaagcggcggcggattgaaaaatatcaaacaggcgcttcgtctgtcaaaagatcgataa

SEQ ID NO: 992 - DNA, 1227 bp, Bacillus licheniformis
ttgacaaacatcactttcattcatgcggcagatctgcatctggacagtccgtttcacggcatcagccagcttcccgaggagatttatcagcggatcaaaaacagcacatttaaaagcgctgaaaatgtgtttaagcttgccattgatgaacaggccgacttcattttgcttgccggggacctgttcgacgaagcaaaccgcagtttaaaagcacagatgtttttgagaaaacaatttttaaagcttaaagagaacaacatccaagtctatgtgatttttggcaatcacgatcatctgggcggcgattggacgccgattgaatggccggacaacgtccacatcttttcagcggaagacattgaagaaaaatcgttttacaaagacggccggctcgccgcaagcatctacggctacagctatcccgagcgctcagtttatgccaataaggccgctgaaatcaaaaaaacgaccgacgcgcccttgcatatcggcatgattcatggaacgctttccggggagagcggccatgacccgtactgtcctttctcccttcaagatttaaaaaacggacagatggattattgggcgcttggacatatacataaaagacaggtcatttcagccgccgatccggcggtgatttatccgggaaacacacaatcccgccatatgaaggaaacgggggagaaaggctgctatctcgtcaatgtttgcggcggagaactgtccttcgaatttaaagccgtatcggatgtcctgtgggaaacggccagcatcgatatctccgggacaaagcagatgacagagctgatcagcctcatgcacgatgcctttcaatctttcagaaaaagaggcaagcccgcatgcgtcaagatggtatggacaggagaaacaccctcttatttggcggaaggacaggccggcatcgcggacgagatccttgacatcttccatgaagaagaacgggaggaagacgcgttcatctggcttaccgcgatcgaagatcaaaccgatgccgccttgtcgggaatcgaacgggacgcttttttccaggagcttttgcaagaaatccatgagtttcaagatttcagcctgattcttgacgatttggagcggcatccggtctttagaagacacggagagctgtttaatgaggaagacttccgggacattcgcacgcaggctgaaaaactgctgcttcatgaactgaagacattgaaaagataa

SEQ ID NO: 993 - DNA, 2967 bp, Bacillus licheniformis
gtgaatatacatgcgatacatatatacggatacggtaaattcgccaatcagacattccgcctgtctccttcaaatctgcatttgatctacggactcaatgaagccgggaaaacgacgctcatgtcgtttattgaaagcgtgctgttcggttttccgaagacgaaacggtacgagccgaaaacgggcgtcatttacggggggatgcttgaggtcggacaccctgatttcggccaaatccgaatcgaacggacggccggaaagcccgagcgggtcaccgtttacttggaagacggcagcacgaagccggaaggttttttaaatgagctgctgtcaggcatcgacaggcagctgtataaagcgatctactcatttgacgtgttcggccttcaggaaatccataaattcaaccgcgacaaaatcggccgttttctgctgttttcaagtctgttcggctctgatgcgatttccaagctggatgccggcctcgtgaaaaagcaggaagagctgtttaaaccgaacggaaggaagccggagctgaaccaggagcttgatcggttaaaaaggctttctgaagatttgaaaaaggcgaaagcgcgggaaggcggctattaccgtctcttaaacgaaaaaaaaggcgctgaggcgtcgataaaggaaagcggacaactgctcaaagatcttgagcatctcgtcttacaaatcgagcaggccattgagattctgccggcggccgcggaaatgcgccagctaaaagagcagctcgcatccctcggcggctcagaagaaagccgtttccccgaaggcggacttttcgagctcgaaaagctcgaatcccacctgcatccaaaagcggctcagctgaaggcgctggaagaaaaaaagcgcggtttggaacagcgcgccgccgcttttgcaccggctgaagacttcctcgagcacgaagccgaagcggaagagcttttaacggcgtatccgttttaccagtcgtataccgaaaaaatcgcgtctttgactgaacagcttcaccagataaacggacgggttcaagcggggcttgaccgcctgcaaatcgaggaatacgatatcctcaatgcggacaccacgtatgaatacgagtggaaactgcaggaaaccgttcaggcatacatagagctgcgcgaactgaagcggtcgctcgacgagcggtttgagcaggcgagggctgatctggaggaagcggaacaggcccatgccgctctcagcaatgaagtgatgcccgatgatgtccgaaaacaaaaggaagaaacccttggccgccttgcgtccgccggcggtcatgccggaaggcgggaagagctgatccttcagctgtcctatctgaagcaagaacaaaaagttcggatgaaaagaagaaggaccgcttttgcgggagcgctttgcgctgcttttgcggcagcttttgcggcgctctttttcaaggagtggttcccgggcgctttgctcgcgccgattttgctgatatttgccgcttttattttaaaaaagcctgagccttccgcggcggcggcttttattcaaaaacagctggatgatattgaccacagcggttcaaaaggcggagtaagcgacagcgctttaagggaggagctgtggaaggacgaccaaacccggcagctccttatcgccaaacaagctgagctcagacagaaagaagcggaatatgaaagagcgattcaaaaattcgaagagtgggaaaaggatatccgtccgtatcaggagaagaccgagcgctatttaaaagagctgaatctttcaattgacccgtcatttttagctgatgcgtacgctttgattaaggaactcagagaggaaattttgaaaaagcgggatatcgagaaggaactgagccgccttcatgctaaaaaagcatcctttgaagcgggattgagaaagcttgtcacatccctcagccttgcgggcggaagcgtccaagagcaggtgtttcagctgaaaagcgagcttgagtcccaaaaagagaaacttcgtcaaaaacaggaagcagacgtgtctttaaagcatgcggccgaacaaatcaaagagctggcgaaagaggtggaatacttccaatctcaaattgccgaactctttcaaaaagcaggggcggacggccgtgagatgttcgtcggactggcgaagcgcgatcaagccagaaaagaactaacggctaggctcgggcagctcaaaagagagctcggcagacaggacgagaaggccgttatgctcgcctcaggccactctctggcagaactgaaaggaaagctggccgagactcaggaaaaaagagcgcgcatagaaaagcagctgacagaagaaaggcagacggcggctaatttccatgcagagctcgccagacttgaggaatcaggagcggtatcggagcttgcctatcagaccgggatgcaaaaagagcgggtcgccgaattggccaaaaagtgggcagccgtcaagctgatccggcaggcggtccaaaacaagatagatgaacataagaaggttcggcttccgaagctgttacagacggctgaaacattactgaacccattgactgccggacaatacgaaaaaatttatttttctgaaacagatgattccatgatggtcatgcggaaagacggagctcttttttgcgcacacgaactgtctcaggcgacttgtgaacagctctatttagcgatccgattcgctctggccctctcccatcaaaagaatgtcaaattgccgttccagctggatgacagctttgtccacttcgaccaagagaggtttaaacaagtgctgaacattttaaaaaagctttcaggcgaagatcagcaaatcttgtattttacgtgtcatgaacatgtaagagaagctttccgcgatgaagatgtgattctgctgccttccggaatgaaaaaggtggaaggaaaggagatgactaacaaataa

SEQ ID NO: 994 - DNA, 975 bp, Bacillus licheniformis
atggcaaaaggtatcatgctgcacgaagttggcgagcaggtggatttgtacttgctcattaaatcgtcaacgaaaggaatcgcaagcaacgggaaaccgtttttaacgctgatgctgcaggatcagtccggagatatagaagcaaagctgtgggacgccaagcagcaggacgaagtgacctacggcccgcagacgatcgtgaaagtggtcggcgacattcatcattaccgcgggcggaaccagctgaagctgagaaacatcagacctgcaggcgagaacgaaaacgtcaaaatcgatgactttcttgaaactgcaccgattcccaaaaacgaaatgatggatgcggtcactcaatatatttttgaaatgaaaaacccgaatatacagcgaatcacaaggcatcttgtcaaaaaatacggcaaggaattcattgattatccggctgcgacgaaaaatcaccacgagttcgtgtcaggtctcgcgtaccatgttgtttccatgctgaacctggccaaatcggtcgcagacctgtatccgtcgctcgatcgcgaccttttatacgcaggcgtcattctgcatgaccttggaaaagtaaaagaactatccggcccggtgtccacgacatatactgtcgaagggaacctgctggggcacatatcgattatggtgacagaaattgcaaaagccgccgaagagcttcaaattgattcagaagaagtgctgattcttcagcatttgattttaagccatcacggcaaacccgaatggggcagtccgaagccgccgatggtcaaggaagcggaaattcttcactatatcgacaaccttgacgcgaagatcaatatgatggacagagcgctcgaacgggttaagccgggagaatataccgaacgggtcttcgcattggataaccgttccttttataagccccgtttttcacaaataagcgtcataacttgtctcccttttgcataa

SEQ ID NO: 995 - DNA, 234 bp, Bacillus licheniformis
gtgctgctgtttccgtggtgggtgtacctttgcatcgtcggcattattttcagcgcctataagctgatgacgacggcaaaggaagaggaaaagattgaccaggcttttatcgaaaaagaaggccgcatttatatcgaacggatggaaaaagaaaaagcaaagcgcatgaagcgtacactggatgaagatcaagaacagcatgaaaaatcggctgacagccattccatcgcataa

SEQ ID NO: 996 - DNA, 861 bp, Bacillus licheniformis
atgaagaagattgcaattgcggcgattacagcgacaagcgtgctggctctcagcgcatgcagcgggggagattctgaggttgttgcggaaacaaaagctggaaatattacaaaagaagacctttatcaaacattaaaagacaatgccggagcggacgcactgaacatgcttgttcagcaaaaagtactcgatgataaatacgatgtctccgacaaagaaatcgacaaaaagctgaacgagtacaaaaaatcaatgggtgaccagctcaaccagctcattgaccaaaaaggcgaagacttcgtcaaagaacagatcaaatacgaacttctgatgcaaaaagccgcaaaggataacataaaagtaaccgatgatgacgtaaaagaatattatgacggcctgaaaggcaaaatccacttaagccacattcttgtgaaagaaaagaaaacggctgaagaagttgagaaaaagctgaaaaaaggcgaaaaattcgaagaccttgcaaaagagtattcaactgacggtacagccgaaaaaggcggcgacctcggctgggtcggcaaagacgataacatggacaaggatttcgtcaaagcggcatttgctttgaaaaccggcgaaatcagcggacctgtgaaatcccaattcggctatcacatcattaaaaaagacgaagaacgcggcaaatatgaagacatgaaaaaagagcttaaaaaagaagtccaagaacaaaagcaaaatgatcaaactgaactgcaatccgtcattgacaaacttgtcaaagatgctgatttaaaagtaaaagacaaagagttgaaaaaacaagtcgaccagcgtcaagctcagacaagcagcagcagctga

SEQ ID NO: 997 - DNA, 99 bp, Bacillus licheniformis
atgggcgacggttatgcaggaggtttcgctggcggctttgcgctgcttgtggtgctgttcatcttattaattattattggtgcttcttggatatgctaa

SEQ ID NO: 998 - DNA, 516 bp, Bacillus licheniformis
atgagttgctggaaaaccatcaatctcgttaaagattatggaggcatgcgcatcgtgctcactgccgtcagtttaatgattttattttttattcccgaatatttagcgatgcagcttattcatccgcaaactgttcagagaggcgatcatgcccttttgtttgcaggacttttggttgcagctataatcgcccataaaattcttcatatcttgccgatgatcagcaagaaaaagttagaaaaaaagatttattggttgaaaatgagaacatggagagaaattccgaaaaacatgatgcttgtctctcttctctgcccttttttggtcatcacgcctgttttgttttacgcgggggcggcgatgccgagctttgctcactatttctgcatcatctcaagcattcatttcggctattgtctgcctgattttctgtttgcctggaaactgatcaaagcgcctaaaaactgctttgtcgatcaggaagccgacgattttgatattttaatacaaaaataa

SEQ ID NO: 999 - DNA, 348 bp, Bacillus licheniformis
atgaactcaatggagcaacgcctcgagcggctggaatattacatcaaactgttattgaacaatgcggatatggaagagtatccgtactataaaatattgatcgaaaagggcttatcagaggaagaagcaaaggaaacggaaaagctgtgcgaagagctctcaaaggagcttgaagcacaaaaagcgcaaggatttgtgatgttcgatcatctcctcacgctttttgccggacagttaaatgaaaaacttgaagtgcacgaaacgattttcgcccttcacagacaaggtctttacaaaccgctgatgagcgaattcatcagcattatcaggcagtacgatctggcttag

SEQ ID NO: 1000 - DNA, 621 bp, Bacillus licheniformis
atgaatcgagcggaagagccctatacggtgaaagaagcccttttattcagtcaaagaatggcacagcttagcaaggcgctttggaagtcgatagaaaaggattggcagcagtggattaaaccttatgatctgaacattaacgagcaccatattttgtggatcgcctaccagctgaacggagcatccatttcagaaatcgccaagttcggcgtcatgcacgtatccacagcgtttaatttttcaaaaaagcttgaggaaagaggttacctggagttttccaaaaaattgaatgacaaacgcaacacttacattcagctgactccgaaaggtgaagaagttttccttaaaatcctcgagtcttacgatccgacccggaacgccgtcttaaaaggcgctcagccccttcatcagctgtacgggaagtttccagaaatcgtcgagatgatgtcgatcatccgccatatttacggcgatgatttcatggaaattttcgaaaaatcgttttcaaacatcgaaaatgaatttacgagcgaagagggcaaaatgaagaaaaaacaagaagcaaaagaagccggggaatcgatagaggtggacaaaccgcttgagcctcttaaaaactaa

SEQ ID NO: 1001 - DNA, 357 bp, Bacillus licheniformis
atgtcaaaaggccgatctttagcagctggactgattgtaggcggtgttatcggcggtgttgcagcattgctgaccgcgccgacttcaggaaaaaacttgagaggacagcttaaagccaactgcggtaaatgggaagacaccgtcaaaaggctgaaaaacgacggaatcgcattaaaagagcaattcgtcaaaaccgccatagaaggcgcggaaatcattaaagacgtcggcagcgaactgcaaacgtccatccaggaatggcgcgaggaaatcaaacctcatcagcaggacttaaaaaaggaaatcgctgagatcgaagaaaagataaaacagctggagaaaaccttacaaaactaa

SEQ ID NO: 1002 - DNA, 528 bp, Bacillus licheniformis
atgaaaacaaaagaattagtggctatggccctgtttgtcgccattggagcggcgctgcacgctgtgattccgccttttttctacggaatgaagccggatatgatgctgatcatgatgtttatgggaatccttttgttccctagactgcaaaatgttctcgtcatcggagccgtgacaggcgtcatttccgcgttgacgacggcttttcccgggggacagctgcccaacatcatcgacaaaccgctaacagccttgatgttcttcggcgtatttctgcttgtgaaaaagctgaacagcaaaacgcttgctgccgccggattaactgctgcaggaaccgttctttccggaacgattttcctcacggctgcactgttcattgtcggcctgcctggaaatcagggattcatcaccctgttctctgttgtcgttttaccagctgccgtgatcaacacgatcgccatggcggtcatctttccgatcgtgcagtcgatcatgaagcgttcaaggctgattgaacaagtcaaataa

SEQ ID NO: 1003 - DNA, 1074 bp, Bacillus licheniformis
atgatacgtacaacgaactttaacgcaggaccagcagcactgcctttagaagtgcttcagaaggcaaaagacgaatttcttgatttcaatggtgcggggatgtccgtgatggagctgtcccatcgcagcaaagagtatgacgccgttcatcaaaaagcgaaagctctgttaaaagaactgatggacatacctgatgattatgaagtcatgtttctgcaaggcggagcaagccttcagttttcaatgattccgatgaactttctctccaaagacaaaacggcccacttcattatgacaggcgcttggtctgaaaaagcgctggccgaagcaaagctcttcggaaacacatcgatcatcgcgtccagcaaagaagatacgtacagctatattcctgaagtaccggagattccggcagacggggcctaccttcacctgacttccaacaatacgatctttggaacgcagtggcaaaagttccccgacgctccgattccggttgtcgcggacatgtccagcgatattttaagcagaaaaatcgatgtttcccaatttgacatcatctatgccggcgctcagaaaaacctcggaccgtcaggggtgaccgttgtcatcatgaaaaaagactggctcggcaaggaaaatgagcaagttgccaaaattctgaagtactcaacacatgccaaagcggattcgctctacaatacccctccgacatttgcgatttatatgctgtctctcgtgctggagtggctcaaggaaaaaggaggcctcgatgccattgagaaacgcaaccgcgaaaaggccggaattttatacaatgcgatcgacgaaagcggcggattctaccgcggccatgcgagagaagacagccgctcaaacatgaacgtcacctttacgctcaaaaatgatgagctgacagcatcattcatcgcaaaggcaaaggaagaaaaaatgtcagggcttggcggacaccgttcggtcggtggctgccgcgcttcgatttacaatgccgtatcagttgaagactgcgaaaagctggctgcctttatgaagaaattccgcgaagaaaactga

SEQ ID NO: 1004 - DNA, 420 bp, Bacillus licheniformis
atgagcgactgtattttctgcaaaatcataaacggggaaatcccttgtgcaaaggtatttgaaaatgaacatgtgctggcttttctcgacatcagccaagtcacaaaaggacacacgcttgtgattccaaaagttcataaaaccaatatttacgaaatgacacctgaagtttcacgagagttttttgaagcggttccgaaaatcgcgcaagccatcaaagacgaatacgagccgatcggcttgaaccttctgaataacaatggcgaaaaagcgggacagtccgtcttccattatcacatgcacattattccccgctacggcaaaggagacggattcggagccgtctggaaaacccatgcggatgactattcaccggaagacttgcagaacattgcagcttccatcaacaaacacctgtaa

SEQ ID NO: 1005 - DNA, 303 bp, Bacillus licheniformis
atgacgaagacgtcaaataaagcaggtgctttctcaattcagtggatgaaagaaatttctaagcttgacatgtttcatactcaggactcttgccggattttgtctttgacaaacacctcattcgccagagttgataagctttcccttcttcaagaattagaatgtcctaaggcgctttcgattattcgttttatttttacggccgaaaagcgggagggaaaacgtttcaaatacattcttgtttttggtactattaagaaaaatgcaggaaaggaacgaacgtatgtcactactgactgttaa

SEQ ID NO: 1006 - DNA, 741 bp, Bacillus licheniformis
atgtcactactgactgttaaagagttaactggagggtatacaagaaacccggtgctgcgcgatgtttcatttgcgattgaacgggagcagatcgtcgggctgatcggtttgaacggagcggggaaaagcacgacgatccggcatatcatcggcttaatggaaccgcacaaaggatctgttgaattgaacggcaaaacgttcatggacgatccggaaagctaccgttcccaatttacgtttattccggaaacgccgattttatatgaagagctgacattgaaggagcatttggagctgactgcgatggcgtacgggctttcgaaggaaacgttcgagaaaaggctgccgccgcttttgaaggaattcagaatggagaagcgtctgaaatggttcccggcccatttttcaaaaggaatgaagcagaaggttatgatcatgtgcgctttccttgtcgaacctgacctgtacattatagacgaaccgtttctcggtcttgatccgctggcgatcaatgcccttctcgagcggatgaatgaagcgaagaaaaacggctcggccgttttgatgtcgacgcatattttggcaacggcagagcgatattgcgactccttcatcattctccataacggcgaagtgcgggcgaaaggaacgcttgaagagctcagagaacagttttcgatggaagaagcgagcctcgatgacctgtatcttgaactgacgaaggaagagagctatgaatag

SEQ ID NO: 1007 - DNA, 1224 bp, Bacillus licheniformis
atgaatagcattctggggatttggaagacaagaattgaggagtatgtcaaagaaacaagatcatatttgaaatacatgctgaatgaccaccttgtcatcgtcatgatttttttcctcgctggagctgcgagctggtacagcaaatggctgaaagagatgcccgaaggttttccagcctattgggtgatggccgtcatcttttcgctcattttgacaggctcgtacgtccgcacgctgattaaagaagctgaccttgtctttttgctgccgcttgaagcaaagatggggccgtattttcagcaggctttccggtttagttttttgacgcagctgtttcctctggccgccgcggccctcgctttggcgccgctgtattttgaagcaagcggcaaggggttttccgcgtacctcgtcttgctgattcaactgctcgtcttaaaaggatggaacacggctatgcaatggcggatgacgtttttcggcgaaaaaaacatgagggttaccgaccggtttgtcagactgcttctcaacacgatcgggatctatttcgctttagagtcttcatacgcatttgccgcagctgtctacctgatcatggccgcactgtatgtgtattttaaggtgatcgataagaaaaaatcgtttaaatgggaactgcatattgaagacgaaatcagaagaaagcagcggttctacagaattgcgaacttattcacggacgttccccaccttagaaaacaggcgaaaagaagagcatatctcgattggatgctccggtttattccgtatgaacagagccggacatttacatatatgtacggaagggcatttatcagatcaaacgactatttcggcatcgtcgtcaggctgaccgtgatttttggcatcatcatcgcttatttttcggcatatgagtgggtatcggccgcgctcatcgtcttcaccgtattcattacaggaattcagctgacgccgctgtttgatcatttttcacacctgccactgcaggagctttatcccgtcaaagcagaagaaaaacggaagagctttttcggcctgcttcacatcgttctgagcgtccaggcgcttgttttgtctgccgctgccggagccatgatgcagtggaccgggatgctcgccggactggccggatccgcgctgcttatatttgtgattttgaagccttatttcagcagcagattgaagaaaagtgccaagagatag

SEQ ID NO: 1008 - DNA, 711 bp, Bacillus licheniformis
atgaatgaaaaccagctatatttggaggaagcgacccgctggaaaatgaagtttctcagaaagccgtcgatggctgagcggatgtcgaaaggggtacagtcgaaaattaacgcccgcattcccgccaaagttcacaaggcgataacagaaagcattaaaaagatggtcgaggctactttgctcggctcaaatttaacgacttttgacaagaaaacaggcacgctttcgctaagggaaaaagatgagctggctcagaagacaatcgctcaatatcaaaaggcggctgctgttgaagggatcggaacaggcgcgggcgggatttttctcggactggcggactttccgctcttgctcggcattaaaatgaaatgcctgtttgaattggcgtcgatttacggatacgatattaaggagaaagaagaacggatgtttcttctgtatatttttcagctcgccttttccggagaagcgcaccgaaaagaaattttccgcatgatcgaacattgggataccgaaaagcgcgaaatcgattggcaggcttttcagcaggagtaccgggactatctcgatcttgtaaagctgcttcagcttgtgcccggcttcggcgcggtcgtaggcggaacggctaactataagctgcttgggcaccttggggaaacagcgaggcacgttttccatctgagattgattcatgagacagccggatattga

SEQ ID NO: 1009 - DNA, 1233 bp, Bacillus licheniformis
ttgagcgcatccggatttgtccgacaaatcaataaccagcttgatgcccactacgatgaaatggtcaaattgaggcgccattttcatcagcacccggagctttcttttcaagaaaagaaaacagccgcatttatcgcctcttactatgaagcgctcggtattcctatccgcaccaacgtaggcggaggcggagttctcgcctacatcgaaggcggatctcccggccccgtcattgcgcttcgagccgattttgacgcgctgcccattcatgatgaaaaagacgcgccttaccgatcgactgtgccgggagtcatgcatgcctgcggacacgacgggcacacggcaaccctgcttgtcctcgctaaagttttgaatgagcacgcggaccgtttaaaaggaaagatcgtcttcattcatcagcatgccgaggagtattcgccgggcggagccaggccgatgattgaagacggctgccttgacggggttgacgtgattttcgggacccatttgtgggctacagagccgacgggaacagttcaataccggacaggaccgatcatggccgctgcagaccgttttacgattacgattaaaggcaaaggggggcatggcgcacagcctcataaaacaaaagacgccgtgctgatcggatcgcagatcgtcacttccctccagcagattgtcagccgcaggcttgatccgactcagccggctgtcatttcgacaggttcatttgttgccgacaactcctttaatgtaatcgctgataaagccgttttaatcggaacggcgcgttccttcaatgaagaaatccgcaccttgattgaaaacgaaattgaacaggttgcaaaaggtatatgcggcatgcatggcgctgactgcgactattccttcgaaaggggctatccgcctgtctgcaaccacccggaagaaacgtcttttctcgcaaaaatcgccaaacagacggaaggcgttgaaaaagttgaagaaagcggcatgcaaatgggcggggaagatttcgcttactacttgcagcacgtcaaagggacatttttcttcacaggcgcccgtcctgaagatccggaggcggtgtttccccatcaccatccgaagtttgatatcgatgaaaaagcgatgctgatcgcagccaaagtgctggcaaatgccgcggtctcctatcaggagaaagagcaggcggtccgcgaaacgcctgcaatggaacaaccgaaatag

SEQ ID NO: 1010 - DNA, 1374 bp, Bacillus licheniformis
atggaaattgaattaacgtccgttcactttttatatttgggctttattgcagctattctcgcatttatgctacttcgtcttgataccacctttatatcgcttgtcgggatttttttcatctcattagccgcgacccattcagtcatggcgtctgtgatgggcatgtttaacagcttaatctacgccgccggggaacttcttccgactattttcatcatctgctttaccgtttcgatgagtgagctactggtaaagaccggcgtcaatgaagcaatggtcactccgatcgccaaatggatgaaaggccctgtcttggcctactggatcaccggagctttaatgtttatcatttcttcatttttttggccctccccggctgtcgcattggtcggcgccgtcctcctgcccgccgcgctgaaagccggcctctccccgatggcggtagcgtgcgccatgaatttattcggccacggtttcgctttatcaggcgattacatcatccaggcagcgcctaaattgaccggagatgcagccgggctgcccgttgcggaagtgatgtctgcaagcgttccgctcgtcttgatcatgggcttttcgacaacgggggcagcctttttgatgctccggaaagagaaaggcaatagagcagcggccagtaagcagctgcaaagcgagcctgagtggcttcttccccagacctccagaaaatggctcgcgctgttgattccggtcatttttttaggagatatcgccgcgatgctgatattggaactgcagggggacgaagcgacggcgcttgtcggaggaacggcagtcttcgtcatgattctcattcattttatcgtccacaaacaccggcgtcttgagaaaatcaccggctatttcattagcggatttcagtttggctttaaagtgtttgcccccgtcattccaatcgccgcctttttttacttgggcgatgcgggttttgaaaaagtactgacagcagagattcccggtttttctaataggatcgtgcaggacctcggctcggcctttgcccacagcgttccgctctctccggaaatcgccgctgttgcgctcactgtcacaggagcggtgaccggtcttgacggatccggattttcggggatttctctcgcaggatcagccgcttcgatgtttgctgcggcggttgacagcaatccagccgttctgactgcgctcggccaaatctcagccatttgggtcggcggcggtacgcttgtgccatgggcgctcattccagttgcagcgatttgcaaagttgacccgttcgatcttgccagaaaaaactttattcctgtagctgccggattaaccgtcacaacgattgccgccatttttcttctataa

SEQ ID NO: 1011 - DNA, 504 bp, Bacillus licheniformis
ttgaatttttacattacatacggaactgtcgattttttaaaaaagctcgccaaacagcacggtcttgaaaacatgttatttatgaaaagccacgattccgccattctctttcacgaaaccgacggagaaagcgtctttcattctcctcaccgctacgaaatcatcgatcagtcgggatctttggaacattccggattcaccgtcctcaacaacatccctgtcacaccggaaggaaggccgcttttcgaagcccgttttaaaaacagagccggaaaaatcgaaaatcagcccggctttaaagccctcagggtgctgaggccgaaagacagcgatacgtatatcgtattgacactgtgggacagagaacagtcatttcaagactggaaaaactccaagtcgttcagcgaagcccaccaaaagaaggaatcttccgcaggaatcaaccaaggcggaacgattttttcccgcccatcctatatttcttcgtatcattctgtcgaataa

SEQ ID NO: 1012 - DNA, 2139 bp, Bacillus licheniformis
atgagaaagagatttttcattccaatcatcattacagcggcgatattccttttatcgttaatcggatatattacgattttgttcctgggggattatgtgattgatgaaaagaaactgattttccatgcttcttctaaaatcgtcgaccataatggagaagaagtcgcaagcctctataccgaaaacagaaggcctgtttcaattgccgaggtgccggacaatgtaaaaaatgcctttatcgcggttgaagacaagcgcttttatgagcaccacggcatcgattttaaatcggttagccgtgcggtctataaagatatattagcaggaggaaaagtggaagggggaagcacgatcacccagcagctcgcaaaaaacacttttttgacaaatgacaaaacgtttttaagaaaaacgaaagaagtcattatcgctatcaatttggagcgggattacagcaaagacaagcttttggaaatgtatttgaaccagctatatttcgggcacggcgtctatggaatccaggcggcggcaaactacttttttaacaaagatgtgaaagacttgacggtcagtgagggagcggtgctggcttccattcctaaagcgccttcaacgtattcgcccattctcaatccggaaaaaagccgggagcggcgcaatgtcattctcggcatgatgaacgagcagggatatatcagctcaaaggaaaccgtcagggcccaaggcagcacattggggctccatgtgaaagaaaaatcaaaaaatccgtggcttgacagctatattgatcttgtcatgaaagaagcggaagacaaatattcgatatcgagcgaacagcttctccaaggcggatacacgatcagtgttccgctcgatgtttcgattcaaaaagcggcctacacgctgatgaagcaggacggctattttcccggcacagacaacaaagctgaagggagcgccgtttttatcgataacaggacaggcggcgtagtagccgctctcgggggacgggaatatgctccaaaaggctataacagggccaccgcccagcgccagccgggttcgacgtttaaaccgcttgccgtatacggccccgctcttgaagaaaagctgttcaagccgtattcgatgctcgaggataaacagctgtcatacggcggctactcgcctaaaaactatgacggccaatacgcgggcaaggtctcgatggtggatgcgctgacatacagcaaaaacgcgcctgctgtatggacgttaaatgagatcggaatcgaaacggtgaagccttatctcagccgtatgggcatgaacgtgccggatgaagggctggcattggggctaggcggtctggaaaaaggggtgtcgccgctcgagcttgccggggcataccggacattcgcaaattcaggacaatacaccgagccgttttttattaaaaaaatcaccgatgaaaacggggatgtcatgttccgccacgaggaaaaatcggaaaaggttttcagcaaacaaacagcgtggaacatgacgcggatgctggaggaggtcgtgaaaagcggaacgggaaaggccggtgatttttccggggagattgcaggaaaaacgggttcgaccacgtataccggaaaagagggcggaactaaagacgcctggtttgcggggtatacgcccgaagtgacgggagctgtctggatgggatacgataaaacggatgagtcccattatttaaaaggcggcagcgcttatccgacaaggctgtttaaagacattttaaaacgcaccaaccataagcctgaacggtttaaggcgcctgaaggggtaaaagatctggacaggccgatacgcctcgaagacctggaaagcgttaaagcagactattcctttacgccgatggggctgattacggtgtcattaaaatggcatgaacaagaggataaaagggttgaataccgaatatatgaaaggaaaaacggaaaagaaacgctgattgatacggttaagggaaaaggaagcttttcaatcccttatgcaaacatcttttccgatgcttcctacaaaattgttccatacaatccgcagacgaaaacagagggaaaagggactgattatgttgaaccgaaagtgtttccttcgggtcattag

SEQ ID NO: 1013 - DNA, 1062 bp, Bacillus licheniformis
atgaaaaacgacaaggcttttaatgacacattcttaaaagcatgccgaggagaaaaggccgcccatgtaccggtatggtacatgaggcaggccggaagatcacagcctgagtacagagcgctcaaggaaaagtacggtctgtttgaaattacgcatcagcccgaattgtgcgcttatgtgacaaggctgcccgtcgaacagtacgatgtcgatgcggcgatactttataaagacataatgacaccgcttccaggtattggcgttgacgtcgaaattaaaaacgggatcggccctgtcatcgatcagccgattacatctctcgcagatgttgaaaaactcggcgaactcgatccgcaagagcatattccatatgtgctggagacgatcaggctgttgacggaagaacagctgaacgttccgctgatcggttttacaggggcgccctttacattggccagctatatgatcgaaggcggcccgtccaaaaactacaataaaacaaaagcgtttatgtacagccagcctgctgcatgggatcttttgatgaaaaagctcgggaagatggcggctgtatacgtcaaagctcaaatccgcgccggcgccaaagccatccaggtgttcgattcctgggtcggcgcgctgaacgccggtgattactgccgctacatcaaaccgacgatggacgttcttttcaaagagttgaaaaaagaagacgtgccgctgattatgttcggggtcggcgcaagccacctcgcgactgaatggcacgatcttgacctcgacgtcgtcgggctggattggcggatgagcgtacaggaagccagggataaagggctgacaaaaacgctccagggaaatttggatccttcgatcctgcttgccccgtgggaagtcatcgaagaaaggacgaaagccattctcgatcagggcatgcagacggaccggtttattttcaacctcggacacgggatctttccagaagtgagtcccgacacactgaaaaaattgacggcatttgttcatgagtattccgcctcaaaaaaatcgagcctgatcacatga

SEQ ID NO: 1014 - DNA, 939 bp, Bacillus licheniformis
ttgggtaaaaagaaaatggggcttcttgtcatggcatatgggacgccgtacaaagaggaagacattgaacgttattatacacatatcagaagaggcagaaagcctgagcctgacatgcttcaggacttaaaagaccgctataaggcgatcggaggaatttctccgcttgcaaagatcacgcaggagcagacgaagcagctggaaaaacgcttaaacgagcttcaggatgatgtggtgttcaaggcatatatcggtctcaaacatatcgaacctttcattgaggatgccgttcgggagatgcataaagacgggattacagaagccgtcagcatcgtgctcgcgccccatttctccacctttagcgtacagtcgtacaacaagcgggcgaaagacgaggctgaaaagctcggcgaattgtcgatcacatcgatcaacagctggtatgatgagccgaaatttatcgcttattgggcggatcaggtgagaaaaatctatgacgaaatgccttcggaagagagggaaaacgccgtcttgattgtatcggcgcacagccttcccgaaaaaatcgtcgaaatgggtgatccgtatcctgaacagcttaaagaatcagcgaagctgattgccgaagcggcgggagtaaaagattacgccgtcggctggcaaagcgaaggaaacacccctgatccgtggctgggaccggatgttcaggatttgacgcgcgacttgtcagagcaaaaagggtacagcgcttttgtttatgctcccgtcggctttgtagccgaccatttggaagtcctttatgacaatgactatgagtgcaaagtcgtcacggacgatatcggagcaagctattacagacctgaaatgcctaacgctaaacatgagtttatcgatgctttagcggatgttgtattaaaacaattggagaaagaacagtaa

SEQ ID NO: 1015 - DNA, 1413 bp, Bacillus licheniformis
atgagtggagaacgcaggcagattgtcatcatcggcggcggtattaccgggttggccgccgccttctacttggagaaggaaatcaaaaagaatgatctcccggccgaagtcacgcttgttgaagcaagcccgagactgggcggaaagatgcagacggtacacaaagacggctatgtgattgaacggggtccggattcatttttggaacggaaacaaagcgcacctcagctcgtgaaggatctcggactggagcatttgcttgtgaacaatgcgactggccagtcttatgtgcttgtcagcgaaacgctctatccgattccggaaggagccgtgatgggggtgccgacaaaaatcggtccttttctgacaaccggcttgttttccttgccggggaagttgagagccggaatggatttggtgcttccagcaagcaagccgcaggaagaccaatcgctcggagaatttttcagaaggcgcgtcggcggtgaagtggtggagaacctgatcgaaccgcttttgtcaggcatttatgccggggacatcgaccgtctcagtctgatgtcgactttcccgcagttctatcagacagagcagaagtacagaagcttgatcatcgggatgaaaaaatcgcgcggcgcccagagcgtcggaaagcctgcaaacaaaaagaaaggccagttccagacggtgaaaaccggcctgcagacgatagttgaagaattggaaaagcagctcggcatcacaaaggtttataaaggcacaaaggtcgtcagcattgagcgtgcgggctcggcttacagcatgaagcttgacaacggcaaggtgcttcacgccgattcggccgtggtcaccgctcctcataaagcagctgccgcgatgtttcaaaaagaggattggctgaagggtttagaggatatggtgtcaacatctgtcgccaatgtggcgctcggatttccggaagaagccgtccaaatggagcatcaaggcacgggctttgtcatttcaagaaacagcgatttttccattacggcgtgtacctggacaaacaaaaaatggccgagcacaacgcctgaaggaaaagtcctgctaagggcttatgtagggaaagccggcgatgagtccgttgtcgaacagtctgataacgaaatggtgaaaatcgtcctcgacgatttaaaacggattatgaagatcgacggcgaaccggaaatgacctgcatcacaagatggcatgaagcgatgccgcaataccatgtcggccataagaaaagaattaaagaaatcagggaaggcttggaagcgtcctatccgggtgttttcattacgggggcctcatttgaaggggtcggcatccctgattgcatcgaccaaggcaagcaggccgtcgccgatgtactctcgcaccttttcgaataa

SEQ ID NO: 1016 - DNA, 582 bp, Bacillus licheniformis
gtgagaaaccgtgagcaaagatcgaaagcactgattttagaagcggcgacaaaatcgtttacacaattcggctacaaagcgacgacgatggatctggtggcgaagcttgccaatgtcggcaagggtacgatctatacctttttcaagaataaagaggaactgttcgatgacattttttcttcgcttctgattgaaatgaagcaaacggctgatcaagcgattgaccctgatctgccttttcacgaaaatgcccatcgcgcgatgatggcgatattggagtacagaaagaggcaccagctgaccattaagatctttcaggaaggcgcggagctcggcacaccggcggcccgcgaggtgattgaaaagctggaacgcatggtcatcggctatattaagagaaaaattaaagaagcaattaaaaatgacgatattagaccgtgtgacccagagctgaacgcgtttgtcatcttcaagctttacatcgcgctcatctttgactgggaaaaaaaccatgaaccgctgaaagatgaagagttggcagagatgctgaaaatgtatattttaaaaggattatctcgttag

SEQ ID NO: 1017 - DNA, 2163 bp, Bacillus licheniformis
atgaatgttttcaaaaaccagtggagagaactgataaccaataaaaaactactgatatccgtgatcggggttctctttataccgctgatttacagcagcatatttttggcggcttactgggacccatacggaaacgtcgatcagctccctgtggcggttgtgaattccgacaaggggacgacatatgaaggaaaagaccttcatatcggcgacgaccttgtcaaagaactgaaagaaaacgataaattcgactggcattttacgacgaaggaaaaagcaatgagaggcttgcaaaatgaggaatactacatggttgtagaaatccctgaaaacttttcgaaggatgccagcacggttatggataaacatccgaaaaagctgaatctgatttatcatacaaacgccggacgaaactatgtcggcgcccagatcagcgataaagcgattgaacagcttcagcattcagtcggctctgaaatcacggagcaatatgctgaagtcatctttgacaatttcggcaaaattgcaaaaggtctcggtgaagcaagcgaaggagccggaaagctggataaaggactgaaagatgcgaaagaaggaagcgaaaagctgaaaaagaaccttgaaaagctcgcgaaaagccaaattcagttcaacaaagacggaatggagaagttcggcgcggcattcaatacgctgaacgacaaaattcatgagcttgattccgggcttgcacaatttttggaaaaaagcggccagctgcacagcggtgctcaacagctccaacaaggcatgcctcagattgtggcgggattggagcagatgaatgaaaaagcgcagaagataagcaaactcgaagaagcgatttcaaatgaaaaaattcagcagctcgaaacggcgctttcaaatgccgaaaaagcgaaaaaagaaatcagccagatttcgaaaaatattgatgagcttgaagcggcattgaaaaaccagcacagcgaagtcaaacaaattattgaatccagcaacatgctgacacaagaacagaaagccgcgcttatgaaacaagtcgatgaaaaaatgggaacggtgaaactccctgagtttgacaagttgaaagcgcaaattcccgatgtcagcgaacttcccgatttatccgggctgaaacagaagcttgaggaattgaagcgagtcccttcggatgtgaataaactttataaaggatcgcagaagattcagcaagggcttgatgcgctgacaaacggtttgggtgcttacaacgaaaaattcgcagaagcgaaaagcggatcatccaaaatcgccgaaggcagccagacgttagtcggaaagttcggcgatctgcaaagcgcggccgataaactgaaagacggttcttccaaacttgcagaaggggctaaatcccttgatgaaggtcttggcaagctgtctgacggaagcggggagctgtttgataagctgtctgacgctgccgatcaaaccggcgatattcaagcgggagacgaaaactacaatatgttctcagaccccgttgatgtgaaaggcgataaaatcgatccggtttccaactacggaacaggattaaccccgtatatcttgtcgctcggcttattcgtcggcgcattgatgattaccgttgtcttcgatgtgaaagagccggctgtccggcccgaatcagcctttggctggtttatgagcaaattcagcgtgctttttgcagtgggaattcttcaagcggcgattgcctgcacgatcattctctggggcatcgggcttgaagtgcaaagcgtctggagattctatctgttcagtataatcatgagcattacatgtcttgcgatcattcagtttttggctgcgacaatgggaaatccgggacgattcattgccgtcattctgctcgtgcttcagcttggaggaagcggaggaacatttcctcttgcacttgtccctaagttcttccaggtcatccattctgcactgccgatgacctacagcattgccggatacagagcggtgatttcaagcggagactacgcgtatatgtgggaacaggctgccgtgctcggcggtgttgcgatcgtcatgatggctctgacgctgatttattttaaagtgctgctgaaaaaaggaaaaattgaagagcagcatgcataa

SEQ ID NO: 1018 - DNA, 996 bp, Bacillus licheniformis
atgaaaactttatcaaaagcgcgaatttccgccatcggcacctatgttcccgaaaagcgcatgacaaacaaagagtttgaaaagatcgttgatacttctgatgaatggatcattcagcggacaggaatgaaagaaaggcgaatcgccgggagtcacgaattcacatcagatctttgcataaaggcggttgaagatctaaaaaacagatacagcggcacgcttgacgatattgacatgatcatcgtctctaccacaacggcggattacgcttttccaagcacggcatgccaggttcaggaacacttcggatggaacgaagtgggcgcggtcgatgtaaatgcgacctgcgcaggattagcgtacggattgcatatggccaacggcctcatcacttccggactgcatagaaaaattcttgtgatcagcggggaaaccttatcaaaaacaaccgactatacagaccgcacgtcttgcattttgttcggagacggcgcaggcgccctgcttgtcgaacgggacgacaaagacccaagctttattacttttgcccaggacacgaaaggtgacggagcccgccatttatacagaaccggcttgcgaagcgaccttaaaggagagccgctttcaggtgaagggaaaatggttcaaaacggccgcgaagtgtataagtgggcggtcaggtccgttcctgaaggcgtcaaaaaactgcttgcccaagctgaaatggagctgaaagatatcgattggttcgtcccgcacagcgcgaatctgcgaatgatcgaatcgatttgcgaaaaaaccgaaattccagccgaaaaagcgctgacaagcgtcgaatggtttggcaacacctcatccgcatcaatcgttctcgcccttgatgaagccgtcaaaaacggaaagctgaaaaaaggcgacaccttgattctgttcggttttggcgggggtcttacatatacgggcctgattgtaaaatggggcgcgccagcttcctaa

SEQ ID NO: 1019 - DNA, 1038 bp, Bacillus licheniformis
atgtcaggacagaaaacgatggagctcatcaaggagctcgtctccatcccgagccctaccggaaatacgtatgacattatagactatatcaaccgccttttagagaaagaaggagttgaaacaaggcataaccgtaaaggcggcctgatcgcgacgataccgggctctgacaaatcccggcacaggatgctgaccgctcatgtcgataccctcggagctatggtgaaagagattaaaccgaacggaaggctgaaaattgatttaatcgggggcttcaattacaactcgattgaaggcgagtattgcaacattgaaacagcatctgggaaaacttacaccggcaccatcttaatgcatcagacatcagtgcatgtatacaaagacgccggaaaagccgagcggaaccagaaaaatatggaggtccgcattgacgaaccggtcaatagtgaagaagaaacccgggcgctcggcatcaatgtcggcgattttatctccttcgatccgcgcgttgaaatcacgccgagcgggtttatcaaatcgcgtcatctcgacgataaagcaagcgtcgccctcctcatcgagctgatcagaaccatcaacacagaagggatgacactgccttatacgacgcactttttaatttccaacaatgaagaaatcggttatggcggcaactccaacatcccgcctgaaacggtggaatatttggctgttgatatgggagcgatcggcgatggacagtcaacagatgaatatacggtatccatttgtgtaaaggatgccagcggcccatatcactacgggcttcgaaagcgcctgacagccctttgtgaagcacatggaatcgattataagcttgatatttacccatactacggttcagatgcttcagcggccgtcaaagcgggccatgatatcgtccacgggctgatcggcccgggaattgacgcatcccatgcgtttgaaaggacgcatcaatcgtccttggagcagacggcaaagctgctgtatcactatgttcagtctgacatggcataa

SEQ ID NO: 1020 - DNA, 198 bp, Bacillus licheniformis
atgtatttttaccatgaccattgcaagaaagattatgactatgattaccacaagaaagaccatgactgcaagaaatactactactactattattactactattatccatgctttaagaagtatgattatgactatgactacaagaagtttgaccactttgatcactgcaaaaagaaaaaacactatgattactggtaa

SEQ ID NO: 1021 - DNA, 1287 bp, Bacillus licheniformis
atgaaaagacttaaattcggattagccacacaaattttcctcgggctgattttaggtgttgcagcaggagcgatttggttcggaaatcctgcggttgcaacgtatctgcagcccgtcggcgatttgttcttaagattaatcaaaatgattgtgattcctattgtcgtttcaagcttgattgtcggggttgcgggggccggcagcggcaaaaaggtcggcaggctcggctttcggacgatcctttactttgaaatcattacgacttttgcgattgtgctcggacttctcctcggaaacatcattcagcctgggcacggcgtaaacttttctggtgctgaaaaacaggatatcagccaatatgtagaaacagaaaaagaagcaagcaccaaatctgtcgcagacacgttcctgcacattgtgccgacaaactttttccagtcgctcgctgaaggcgatctgcttgcgatcatttgcttcactgttctgttcgcactcggggtgtctgccataggcgaaaaaggcaagcctgtgctctcctttttcgaggcaacgtctcaagccatgttccacgtcgtcaacatcgttatgaaattcgcgccgttcggcgtttttgctttaattggcgtgacggtttcaaaatttggtttttcttcgcttttatcattgggaaagctcgttttacttgtctacctggctcttgctttcttcttgatcgttatctttgggatcgtcggcaagctttgcggtatcaatatatttaaatttttggcttttttgaaagatgagcttcttcttgcgtacagtacatcaagctctgaaaccgtgcttccgcgcgtcatggaaaagatggagaaaatcggctgcccgaaaggcatcgtgtcgtttgtcattccgatcggctatacatttaaccttgacggctctgtcctgtatcaagcgatcgcggcgctgtttctggcgcaggtctacggcatcgatctatccattggacagcagctcacgttaatccttgttctgatggtcacttctaaaggtatggctgccgttcccggcacatctttcgtcgttcttcttgcgactttgggcacgatcggcgttcctgctgaagggctggccttcattgccggagtcgaccggattatggacatggcgagaacggtcgtcaacttgaccggaaacgctctcgccgctgtggtcatgtcaaaatgggaaggtgaatatgacgccgttaaagggcagaacgtcttaaatcaacgggagccggcagatatagaagtatccggctga

SEQ ID NO: 1022 - DNA, 735 bp, Bacillus licheniformis
atgaaggtgacagtcatcggctgctgcggaggatttccggctgcaaatgaagcgacttcaggctatctctttcaatccggggactattccgttttaatcgactgcggcagtgccgttttatccaaacttcagctgtttctgcccgttgaggagctagatgccgttatattatcccattatcatcatgaccatattgcggatgtcggccctttgcaatttgccaaactggtcggctcattcctcggcaagggagcggatgcccttccgatatatggacatccttttgatgaagagcagttttcaaagcttacatataaaacgcataccgctggattggcgtatgatccgacacagcctttggctatcggaccgtttacgttcacgtttttaaaaacggttcaccctgttgactgctttgccatgagggtgacggacggtgttcattctgtcgtttatacggccgactcgagctttcaggaagcctttattccgttcagcgaaggagccgatctcttgatctcagagtgcaacttttatgcggatcaggatgggaggagcgccggtcatatgaacagtcttgaagcggggcggatcgctgcggaagcgggtgccgggcagcttctcttgacacacctcccgcatttcggggaacaccaaaaactgatagaagaggcccaaaccgtttataaaggtgcggttgttctggcgcacaccggttatgtgtggggagaatag

SEQ ID NO: 1023 - DNA, 990 bp, Bacillus licheniformis
atgctgtttatcgataatcaaaatattacagatccgaggatcaacttggcgattgaggagtactgcttaaagcatctcgatcctgaagagacgtatctgctgttttatatcaaccagccgtcgatcatcatcggcaaaaatcaaaatacgatcgaggaaatcaacacaaaatatgtagatgaaaacgggatcattgtcgtccgcaggctgtcaggcggcggagctgtctaccatgatctcgggaacttgaacttcagttttattacgaaggacgacggcaacagcttccacaacttcaagaagtttactgagcccgttgtggccgctttaaaacggcttggcgtcgatgcggagctgagcggccgaaacgatttgatggcaaacggccggaaaatctcgggaaacgcccagttttcaacgaaaggaagaatgttcagccacggcacgctgttgttcgattctgagattgaacatgtcgtatcggctttaaaagtgaaaaaagataaaatcgaatcaaaaggcattaaatcgatcaggagccgtgtggccaatattagcgagtttctcgatcagaagatgacgacagtggaattccgaagcatgcttctccgctatatttttgataccgaaggggaaataccggagtataagctgactgaaaaagactggaaaatcattaatcaaatttcaaaggaacgctatcaaaactgggattggaactatgggaagtctccgaaattcaatctgcagcattctaaacgatttcaagctggatcggtcgacatccgcctcgaagtgcaaaaaggcgtgatccgcgagtgcaaaatattcggtgactttttcggagtcggagatgtcagcgacatcgaagagaagctgacaggcgtgcagtatgaaagaaaagcgattgaagaagctcttcaaggcgtggacattaagcattacttcggcaatattcaaaaagaagaatttttggatcttgtctactaa

SEQ ID NO: 1024 - DNA, 1542 bp, Bacillus licheniformis
atgaatttagtttcaaaattaggggaaacagctcaatcaaagcctgacagaaccgcttatatttttggagagcaaacggaaacatacgggggattgcagcagaaaattgattgctttgccgaagggctgcgcgaaatcggggtggaaaagggagatcatgtcgctttgctactcggcaatacaccgcattttgtgattgcgttttacggcgcgctgaaggccggggctgtcgtcataccgatcaatccggcctatacgccgactgagatcggctatatgctgacaaatggcgatgcaaaagtgatcgtggctctgggacagctgcttccgctttacgaaaaggtgcatgaatcccttccgaaagtcggctgcgtcgtgctttgcgaaactggagagccgcttcaggaaccggaaaacacagaggttaagatgaaattgaaatcgtttacaagcattatgaaacctcctgtccggccgtttcctgaaatcgatgacgaagatacggccgccatcctctatacgtcaggcaccacgggaagaccaaaaggggcgatgctcacacatcaaaatctattttcgaatgcaaatgatacagcccgctatctgacaatgaatgaatctgaccttgtcgtcgccgccctgccgatgttccacgttttttgtttaacggtctgcatgaatgcaccgctcatgaacggcgcagcgattttgatcgtgccgaaattcagtcccgccgaggttttcaagctgattaaaaagcatcaggcgacgatcttctcaggcgttccgacaatgtacaattacctgtaccagtatgaaggagcggatgaaacaggctttcggtccatcaggctttgcatctcaggcggagcggccatgcctgtcgctctcctgaaaagctttgaagaaaggttcggcgtcctcgttttagaaggctacggcttgtcggaggcttctcctgttacatgctttaacccgttcagcaccggccgcaagccaggatcgatcggcacgaacattctcaatgtgaaaaacaaagtcgtcaatgaactcggggaagagctgcctgccggccaagtcggcgagctgatcgttaaagggcctaatgtcatgaaagggtactacaaaatgccggatgagacggcccatacgataaaagacggatggctgtatacaggtgatttggcaaaacgggatgaagacggttatttttatatcgtcgacagaaaaaaagatatgattatcgtcggcggctataatgtctatccgagggaaatcgaagaggtgctctacctccatccaaaaatcgcagaagcggttgtgatcggagtgcccgatccgaatacgggagaagccgttcattgctatgtcgttccgaaggataaaacgctgacagaggaggatgtcttgtcgcactgcaaaaagcatcttgccaaatacaagcgcccgtcggcgatcgttttcatggatgaaattccgaaaaactcgaccggcaaaattttaaggcgcgctttaaaagacattctgacaaacaaatcttga

SEQ ID NO: 1025 - DNA, 447 bp, Bacillus licheniformis
atggggatcgcactttttttcggcattttatccatcactgtcttttatgtattccacttgatggcggagcctttcgactcaagaaatgcagaagaaatcatcttgaagcaggcgggagacagtgaaaaaacggtcagcatcaaagacaggcacaacatagccgtcctgcttgatacatttaataaagggaaaagaatgaagaaaaagacagcgcatcacctgccttctccggcgtatcacggatacatcagcatgaccggcacacatcgcgttcacttcaccgtctggctgaagaaagatgaagccgtcatcctgaaagaagaggaaggcacatatttcgttctccaacaaagggaaaaagacgccctcctaggagaattgcaaaaaagggacgcggcaggcgtcccttttagcgggtcaagatttgtttgtcagaatgtcttttaa

SEQ ID NO: 1026 - DNA, 552 bp, Bacillus licheniformis
atgaattcgattgaaaaacaagtggcagaaaacattaagaggctgcgaaaaatccgcaattacagccttgatcaattgtcatcgatgaccggcgtcagcaaaggcatgctcgcgcaaattgaaaaaggctcttcaagtccgacaatcacaaccttgtggaagatcgcaaacgggctgcaagtatcatttacttctttggcagaaaggcctgccggggagccgacggtcgtcagaaagcacgagaaaacgcctgttatggccggagaagaaaaatacgcggcatttccgcattttccgttcgaccagaaaaagaagtttgaaatcttttatattgaacttgcgcccggctgtgtgcacgaatcagagcctcaccacggagggattgaagagtacgtgctcgtctctaaaggcgcgcttgcggtgacggcgggtgattacacctgcgacttgaacgagggtgatgcaatgcatttcaccgcaaacaccgttcatacgtacaaaaacaacacggaacaaacggcatcatgctatacactcatttattatccgtaa

SEQ ID NO: 1027 - DNA, 717 bp, Bacillus licheniformis
atggaaaagcaggattcactcaactttctagacgggcttcgttcaggggtttcccttgccgtcggctacatcccggtcgccttgacattcgggcttttggcaaaaacaacggggctgtcgctttttgaaacgtttttgatgagcgcccttgttttcggaggagcgtcccagtatatgtctctgagcatgcttgccgttcagacaggaatcatcgaaatcgtcatgacgacgttcattgtgaacatcagacattttttattttcagcgactttgaatcaattggtagaaaaagattcgccttggaaaaaagcgttttactcatttttcgcggtgacagatgaatcgtttgccgtcgctgctttaagaaaggaaaagctgacgaccgggtacatgatcggcctcggctcgatcggctatgtaagctgggttttttggagtgcggccgggcattttgcaggagccgccatgccggctgttcttcaggaaagcatgagcatcgccctttatgccatgtttatcggattgttggtgccgcctttgaaaaaacagcgcaaagtcctgctgctggcgggagctgccgcgctattcaatacggttttccaaatgaacggaatgttgtcggcaggatggtcgatcgtctgcgctacgcttttatccgccatcctgatcgaatggctgtaccaatttagaacagaggggaagagaaactatgtttag

SEQ ID NO: 1028 - DNA, 312 bp, Bacillus licheniformis
atgtttagtccgatcatctggatgattatcggcatggctgccgttacatatgtgccgcggatgttgcccctcattgcttttgaaagcctgaagcttcccggatttttggagcgcgtgctgaaaaatgtgccgtacgccgttttaggagctctcatttttcctggaattttttcggtgcaaagcggtatgctctatggacttgccggcgctcttatcgcatttttattttcctattttggagcaagcgtcatagtcgtcgtgatggggacgattttgacgctcgcaggggccggcctcttgctctcattgtaa

SEQ ID NO: 1029 - DNA, 1257 bp, Bacillus licheniformis
atgcggaaatggatcgcgggagcctttctcctgtatgtgctgtacggcctttttttctattggtatctctttatggccggtgaaccctccgttcccgaggcgctgaaagggacaagcgcagacccggcgacatttatgaacgaaagggaactcatgctgacggaagagtactcgaaaataaaggactttctgttttttatccggattccgtttgagtggttcttatttttaatattgttgattgccggtttatcgaagaaaatgaagaattgggcggagcagacgtcaaagcggagaacgattcaaataacggcatatgtttttgctttgtttctgatcgtcacgatcgtttctttgccgcttgactggatcagctatcaatattcgcttgactacggcatatcaacacagacaaccgcgagctggatcaaagaccaggtgatcgacttctggatcagctttccgataacggctgcggcggtgatcgtcttttactttttgatcaaaaagcatgaaaaacgctggtggttttatgcctggtgcctgacggttccggttacgctgtttttatttttccttcagccggttgtcatcgatcctttatacaatgacttttatccgctgaaaaataaagatctcgaacaaagcattctgaagctggccgatcaggcagatattcctgcgaatcacgtctatgaagtgaacatgtctgaaaaaacgaatgcgttaaatgcttatgtgacagggatcggcgccaataaaaggattgtgctctgggataccacgctgaacaagctggatgagccggaaattttattcattatggcgcacgaaatggggcactatgtgatgaagcatgtttacataggactcggcgggtacctgcttttatcccttgccgtcttttatgtgatcgacaagctgtacaagcggatcatcggccgctatggaaaaagcctccgcattgcgggaaaatccgatcttgccgcactcccgcttctcctgatgctgatgggggtcatctctttcgcgtcttctccatttacaaacgcagtttcgaggcatcaggaaaaagccgctgaccagtatgcgattgaactgacgaacaacagcgatgcagcggttgcgacttttcaagagctctcaaaagccgggttgagcgaggcgaacccgccgtttctcgtcaagatttttaaatacggccatccgaccataatggaacggattcaaaatattgaacagtcttcaactgaatga

SEQ ID NO: 1030 - DNA, 1140 bp, Bacillus licheniformis
atgatgaggaaaaagagtttttggcttgggatgctgacggccttaatgctcgtgttcacgatggccttcagcgattccgcgtctgctgctcagccggcgaaaaatgttgaaaaggattatattgtcggatttaagtcgggagtgaaaaccgcatccgtcaaaaaggacatcatcaaagagagcggcggaaaagtggacaagcagtttagaatcatcaacgcggcaaaagcgaagctagacaaagaagcgcttgaggaagtcaaaaatgatccggatgtcgcttatgtggaagaggatcacgtagctcatgctttggcgcaaaccgttccttacggcattcctctcattaaagcggacaaagtgcaggctcaaggctacaagggagcgaacgtaaaagtcgccgtcctggatacaggaatccaagcttctcatccggacttgaacgtagtcggcggagcaagcttcgtagctggcgaagcttataacaccgacggcaacggacacggcacgcatgttgccggtacagtagctgcgcttgacaatacaacgggtgtattaggcgttgcgccgaacgtatccttgtacgcggttaaagtgctgaattcaagcggaagcggatcttacagcggcattgtaagcggaatcgagtgggcgacgacaaacggcatggatgttatcaacatgagccttggaggaccatcaggctcaacagcgatgaaacaggcggttgacaatgcatatgcaagaggggttgtcgttgtggcggctgctgggaacagcggatcttcaggaaacacgaatacaatcggctatcctgcgaaatacgactctgtcatcgcagttggcgcggtagactctaacagcaacagagcttcattttccagcgtcggagcagagcttgaagtcatggctcctggcgcaggcgtgtacagcacttacccaaccagcacttatgcaacattgaacggaacgtcaatggcttctcctcatgtagcgggagcagcagctttgatcttgtcaaaacatccgaacctttcagcttcacaagtccgcaaccgtctctccagtacggcgacttatttgggaagctccttctactatggaaaaggtctgatcaatgtcgaagctgccgctcaataa

SEQ ID NO: 1031 - DNA, 930 bp, Bacillus licheniformis
atgaaatcagctcatgtgaaaggcgtattgatggtgctggcaggggcttcgttgtggggattatcggggagcgctgcacagtttgtatttgaaaggggagcggctgatgccggctcgcttgtctccgtcaggcttctggcgtcgggcgtcattctcttgctatatgtttcaatgaaaaacggatttcaacatgtgtgtcagatatggaagaaaaaaacagatatttgttcgattttggtattttccatttttggaatgctggccgtccaatatacattttttgcctcaatcgaaaagggaaatgccgctgctgctgcaattcttcaatatttggcgccttttttcgtattgttttacctatatgttaaaaaagaacttccgcctaagtggaaagatgccgtgcttactttattggcgctttccggcgtgtttcttcttttgacaggcggaagaccggacagtttgtatattccggccgaggccgccgtttggggcgttttgtccggtggtgcgcttgctttctatacggtttttgcaggaggtttaattcaatcgttcggtgccttgacggttacgggatggggaatgctcgtcggaggggccggtttttcttttttgtttccgccgtttcggtttaacctttcgcacattggggcaggagaggcggcagccattctgtttgttgtattgtgcggcacagctttggcgtttgcactatacattggcagtctctcttatctttccgcaaaagaaacgagctgtctgagctgcgccgaaccgcttgcggccgttctgtcgtcggcgctctggctgggtgtgcccttcaatgcctttcaaggagccggtacggtgatggtgatcattacggtcatcatcctttccctcagcagagaaagaaaagcagcagattctgtcaatgaaagggtgtag

SEQ ID NO: 1032 - DNA, 978 bp, Bacillus licheniformis
atgaagcacaaatattttgctattttatttttattgatgatatcagtgatgacggcctgctctggaggaagcgagagcacgaaaacttccggtcaggattccgtgacagttaagcatgatcttggagaaacgaaagtgcggaataaaccgaaaaaagttgtggttcttgaattgggatttattgatgcgctccttgatgcgggtattaagcctgtcggaattgcggacgacggcaaacctaagtttattaacgagaaggtcaggggaaaaatcaaagggtatacttcagtcggttcgcgcgcccagccaagctttgaaaaaattgcttctttaaagcccgatttaattattgccgattcgagcaggcacagcggcgtctatgataagctgtcgaaaattgcgccgacaatcgcgctcaaaaacttgaatgccgattatcaggacacgcttgatgcatctcttacgattgcgaaagccgtcggcaaagaaagcgcaatggagaaaaaattggctgaacataaacaaaagctggatgaattgaaacagaaattcggcagccggaaacagagcattcttctgctcgggaacacaaatgaagaaatcaccgtgcgcgatgaaaactttttcacgtctcagcttctgacgaaaatcggctatacatacggtgtcggagacagcggcaaaggcgatgccgaaaacggtgaatccgtcaatattaaaatgacgctcgaacagctgcttgagaaagatcccgacgttattgtcctgatgacgggagaaaaagataaagtcgatgaagacgggaaaagaccgatcgaaaaagatcctctttggaaaaagctcagcgcagtcaaaaacggcaaggtttatgaagccgacagattcgcctggtcgctccgacgcagcattgacggagcagatgagctgatggatgaaatcgatcagcatcttctgtctgaggatcaaaagaaatcttag

SEQ ID NO: 1033 - DNA, 999 bp, Bacillus licheniformis
ttgatatatatgaaacgttttgcaccgctcatttttgtttttcttttgcttgcgagttttgcgctttctgtttcaatcggttcgtcaatgattgcactgtccgatatttgggcggctgtttttgcgtacgacggttcaaaattgcacgcgattattcagtccatccgaattccgcgcgcattgaccgccgcattaatcggcgcgaatctaggggctgcgggcgcgctgatgcaggcggtgacaagaaatgcgctcgcatctccgagcatcttcggaatcaatgcaggggcctcgcttgctgtcgtatgtttgacggtgatgtttcctgcgcttgcagctccccagacagcgatgggagccgcatttgccggcggtgcagcggccgcgctgatcgtgtacgcggttgcctcagtattcagcgaacatgacagggatatcagctttgccttgattggcgttgtcattcaggcgattcttgcttcgatgacgcaaatgctgcttatctttcatgaagagtcgacggaaacgctattgttttggctttccggttctttagcggggagctcatgggataagcttcatttattggttccggtgagcattgcgggtttgttgacggctttggccttagggagggcggcttccgtcatgagtctcggagatgaagtttctcatgggctgggacaaaaagtatggctcagcagattgctaatcgccttcactgttgtcgcattggcgggagtgtccgtttccgccgccggtccgattggtttcatcggtttgatggttcctcatatgatccggtatctcatcggtgctgactaccgggcggtgattccgtattcggcattgcttggagccgttcttttgctgtttgccgatattttgtcccgctttgtctattttccgtaccaaacgcctgtcggagttgtcacggcaatgattgggacgccgttttttatctatttggcgagaagacggaaaaagggggcggcataa

SEQ ID NO: 1034 - DNA, 1029 bp, Bacillus licheniformis
atgaacaatccggcaagaaagacgaaaaggcggcgcggacaatcggcggttgttctctgtgcgctattcgcctgtttgtttgtgctcattgtactcaatttggcgatcggcgatgaaaacatcggactgtgggacgtattgaaatcgctggcaggacaaggcgatgcgggagtccgctttttggtgatggaatttcgaatgccgcgaatcctcctcgctgtgcttgccggaggggcgctttcgatcgcgggtgtagtcgctcaatttctgatgaaaaatccgctggccgcccctgacacgcttgggattacaggaggagcgggattgggcgctgtgatcgttacggtcttgttttcacagcaaagtccgcttctgctgacaggcgccgccttttcaggaagcgttttagctgcgatcctcgtctatttattggcttatcgaaatgggatctctcctgtgcggctggctcttgtcgggatagcggtcaatgctttctgccattcgggcattcagctgttaatctcaagggggagcccgaatgtcaacagcgcattaatttggctgaacggaagtctgtggggaagaggctggcaggatgtattgcctcttttcatatggtgctgtctggtgattcctccgatatggcttgcggcaaaaccgctcgatatcatcaaatcaggggacgggattgccgtcggcctcggcatccggcttgaaagaacaaggtttctgctgcttgccggtgcggttttgctgacagctgctgctgtgaccgctgtgggaacgatcggttttatcgggctgatggcgcctcatatcgcaagaaagctcgcaggggctgaaacgaagatcttgattcccgttgcagctctcgtcggcggcatcgtccttttgatagccgatgccgccggaagaggtcttgttccgccgcttgaaataccggccggattgatcgcagccgttatcggcgggccgtattttatctatttgctgcgccgcgaagaacataaaaaaagacggcatgcttga

SEQ ID NO: 1035 - DNA, 573 bp, Bacillus licheniformis
atgactgcgatttgtttgatccggcacggcgagacggactggaatgctttaggaaaactgcagggaagaacagatatccctttaaatgaaaccggtaaaaaacaagcaaaagaaaccggggcgtttttgaaagggtccgactgggacgtcatcattacaagccctttaagaagagcgaaagaaaccgctgaaatcatcaatcaatacctcggacttgaaatcatcgaaatggaggatttcatcgagaggaattacggagatgcagaaggaatgccattcgaagaaagaatgaggctctatcctgataaagaatatccgaatcaggaatcaaaagaagcgcttgccgaacggctgatggccggcgttcaaaaggtcagtgagcggtatccggacaaaaaagtgctgatcgtcgcacacggagccgcgatacacgcgcttctgtcaaaaatctcaaacggcgacatcaacctggaaaacacgaagctcgtcaatgcctgcctaagcaacatcaaatttcatgaaaataaatggcatgtgaaggattacaacctttcacaccatttgtcagattaa

SEQ ID NO: 1036 - DNA, 1293 bp, Bacillus licheniformis
gtgttattcaaaaaggatagaaagacagaacgatcattttttgctggggaaagccctgaccaaacaaaaagaatcaggctcaatcagcacgcagaatttaaaaaacagctggcaatggtcgatttgacggatgaggatctttgggtgctgagcaggctgaagcccttagtcactgaacatattgaaaccatcgtcacccgattttatcaaaatcttgagcatgaaagctctctcatggagatcatccatgacaacagctcggtcgaccgtctcaaaaagacattgacgatccacatccaggaaatgttttcaggcgtcatcgacgaagcctttttagaaaaaagaatccggatcgcccacgttcatcttcgcatcggactgttgccaaagtggtatctgggggcatttcaagatctccttctttcaatgctgaagatctttgaaaacgccttatccgatgaggaatacaggcggtctgtcaaagccgtcaccaaaattctcaacatcgaacagcagatcgtcctggaggcctttgaagacgaacacgcgagactccgcagacttgatgaagaaagcaaaaatgaacttcacaggcaaattaaagatacttccggttctttggccgctatatttgccgaaacgacgggcgccgtacaggaattggtcgacaaatcttccgagatcgccgaaacgtcaagagccggaacgaagacagccgtttctgtcgaacaaaaatcgatcggcggaaaaaaggagcttgaggaacaggaacagcagctgaatcaaatgggaagcagcatgacgcaaatcgagcaggaaattaaaaagctggaagaaatcgcgctgcagatcgaaaagatattcggcatcgtaacaggcattgccgaacagacgaatttgctttcgctcaacgcctcgatcgaatcggcaagggcaggagagcacggcaaaggtttcgcagttgtcgcaaacgaagtcagaaagctgtccgatgatacgaaaaaaaccgtctccaccgtatcagagctcgtcaataacacaaacgctcaaatctcgatcgtcacgaagcatattacagatgtaaatcagcttgtgaacgaaagcaaagacaagatgtcggagatcaatcgcctattcgatgatatcgtctccaatatgaaaacgagcaaagagcaaagcggccgaatcgaaggcgacctgcagtcgtttttaagcggccttcaagatgtcaatgccgccgtatcacaagtcgcagtttcagtcgattctctcgtagagctgacaaaaaaatga

SEQ ID NO: 1037 - DNA, 1530 bp, Bacillus licheniformis
gtgagcaatcaagaacaaaaactgccggactcgcctgaatcgtattggagaaacagtacagaccttccttcgttcgaggaactgtctgaagatgtcaaaacagatgtcgccatcatcggcggcggcatgaccggactgacgacggcttatttgctgacgaaaaaaggctacagcgtcgtcttgatcgaatccggccggatactcgacggaacaaccggctatacgacagccaaaatcaccgcgcagcacgatctgatctatgacgaactgatcgggcatatcggaatgccgaatgcgaggctgtattatgaagcaaatctcaaggcgctgtcctttatcaaaaacctcgtgcttgagcaaaagataccgtgcgattttgaagaacaggacgcgtgcatttacacaactgaagaacaatcggtccaaaaactcagaaaggaatatgaagcataccaaaagctcgggattgacagggaattcatcaaagatctccccgtcccaattgatgtaaaagcaggactcgtcatgaaaaaccaggcccagtttcatccgctgcactatttgaaataccttgcagaggccgtccgggaagccggcggaaaaatatacgaaaacacggcgtctaaggaaatcaaagaaggcgaccggccaaaagtgctgacaagaagcggacatcaaatcttcagcgattatgtcacgtgctgcacgcactttccatttcatgataaaaaaggattctattttgcaaggcttgagccgagccggtcatacgtgctcgccgtcaagccgaaaacgccgtatccaggcggcatgtacttaagtatagaccagccttcacgctcgcttcgctcggtgacgatcgacggagaaaaaatggttcttgtcggcggtgaaagccacaaaaccggccagggagaagatacaatcaagcattatcaggcgcttgaatcatttgcggaaggcgtgctcggcatcgaatcgatcccttaccgctggtcagcgcaagatttaatcacgcttgacaaaattccgtatatcgggccgatctatccgaaagaaaagcgcattctcgtcgccaccggatatcggaaatggggcatgacaacgagcaccctcgccgcgcagctgatgacagatcatatcgcgggtgaagacaatccttatcaagccgtctttcagccggcccgtttccacccggatccaagcatcaaaaaagcgatttcctacaacgcggatgttgcaaaacactttgccgaaggaaaactcgagcagccgatcaggaagccggaagaccttgtcaacggagaaggcgcggtcgtgtcgcatgccgggaaacgggcgggcgcttatcgcgatgaaaaaggcgagcttcatctggttgacacaacatgcacccatatgggctgtgaagtcgagtggaatgatggagaaaagacatgggactgtccgtgccacggctcaaggttttcgatcgacggcgatgtcattgagggccctgccgtagaacctcttaaagatccagaaagctga

SEQ ID NO: 1038 - DNA, 858 bp, Bacillus licheniformis
ttgagcaagcagccgaagaaagtactgcctccccagcaccaaacacagcgtcccggattggagtatttgatggatccccggcccgttttcgaccggccgaaacgagagcgaaaactggctgggaaaaccgcgattattacgggaggagacagcggaatcggccgtgccgtgtccgttttgtttgcgaaggaaggcgcgaacgttgtcatcgtttacttaaatgaacaccgcgatgcagaagaaacaaaggggtatgtggaaaaagaaggcgtcggatgcaagctgattgcaggggacatcggggacgaggctttttgcaacgatgtggtgcgccgggcaaaggaagcattcccaacgatcgatattctcgtcaataatgcggctgaacagcatccgcaaaagggaatcgaaaaaatcacgagccatcagctgatccgaacgtttcagacgaatattttttccatgttttatttgacaaaagctgtgctgccgcatttgaaaaaaggcagctcaatcatcaatacgacctcgattacggcttatgccggcaatgaaaggctgatcgattattcttcgacgaaaggagcgattacatcatttacgcgttcgctcgctttgtcgcttgtcgatcagggcattcgtgtgaacggtgtggcaccggggccgatttggacgccgcttataccgtcgacgtttactgagagagaggtcgaaatattcggttcaacaacgccgatggaacggccgggacagcctgctgaagtggcgccgagctatctgtttctagccagcgacgattcttcctacatgacgggccaggtgctccatgtcaacggcggaacgattattaacggataa

SEQ ID NO: 1039 - DNA, 234 bp, Bacillus licheniformis
atgaaagagaaaaaatcgtacgctgagctcatgaagtcccgcaatacccaaaaggtgaaagaacttgatgtaaccatcacggatatctacattcaaatggtccttgatgaatcgctttttaaacggcgtttgcacacgctgagcaagaagattaatgaagcattagacaaaggagataagcaatctttccttgagctttcaagagaatatacagcgctgaaaaagcacgcataa

SEQ ID NO: 1040 - DNA, 579 bp, Bacillus licheniformis
atgagcacagaggatatgacaaaggatacgtatgaagtaaacagttcgacaatggctgtcctgcctctgggagagggggagaaacccgcctcaaaaatacttgagaccgacaggactttccgcgtcaatatgaagccgtttcaaattatcgaaagaagctgccgctatttcggatcgagctatgcgggaagaaaagcgggcacatatgaagtcattaaagtttcccataaaccgccgatcatggtggatcactcaaacaacatttttcttttccccacattttcctcaactcgtcctcagtgcgggtggctttcccatgcgcatgttcacgagttttgcgcggcaaagtatgacaacacgtttgtcacgtttgtcaacggggaaacgctggagctgcccgtatccatctcatctttcgaaaaccaggtttaccgaacggcatggctgagaacaaaatttatcgacaggattgaaggaaaccccatgcagaagaaacaggaatttatgctctatccgaaagaagaccggaatcagctgatatacgaattcatcctcagggagctgaaaaagcgctattga

SEQ ID NO: 1041 - DNA, 366 bp, Bacillus licheniformis
atgacaagaattcccgccgaagccagggatatgattgaaaaggcgatttacctcccgatgaccgtcagcatattaaaccgggacatgaaaatcatccagcaggggccgtttaagctgaaagacccctatctgcatctgatcgaacaggcgttaaagcttgcccagcgcgacctgtacgacgtaaaaaatgaactgcgccgccggaaaatcaaggtgcatgaagtgtcgcgggacgaagcctttacgatgtattcctttatatatgagggttacgaagaagagcataagtactttaatccccgcatccgcaaccaggtatccgcgcttcttgagcactatttattcaaagccgctccagatcaatag

SEQ ID NO: 1042 - DNA, 609 bp, Bacillus licheniformis
ttggagcaattattcagctattttacagaagagaatttaacagagttttttcagagctacagggcttttggtccttttgtagccgtactgctgccgtttattgaagcgctgctcccgtttttgcccctgctcgtgtttgttgttgccaatgtaaattcgttcggtttatggcaggggtttttgttgacgtgggtcggggcatctttaggttctatagcggtttttctttttatccgccatttcggccagcaaaaagcactcggttttatccgcaggcatccatccgtaaaaaaactgatgatctgggtggaaaaacggggcttcggtccgctgtttctcctgctttgctttccattcacgccttcggcggcggtaaatgttgtggcaggactttcgcgagtcagcctgctgcctttttcattggcggtgctttgcggcaagttcgtgatgatttttatggtgagctttgtcggccatgatctgaaggcgctttttacccagcctttgcggacagccgccgtgatcatcgtcatgctgatcttatggtacgccggaaaacgggttgaacatcgtctgaacgtgagattcagccagagagagaaagactag

SEQ ID NO: 1043 - DNA, 519 bp, Bacillus licheniformis
ttgaaaaagcgttttttggtcatagccggggtactgcttgtcatcgtcgtcgggattcaggtcaaaaatgccgttttcattgaatataaagtagaaggcgtcagcatgaatccgacctttcaggagggcaacgagcttttgatcaacaggttcgcccaccgctttaaaacgatcagccgatttgacatcgtgctgtttaaaggacctgacaaagatatattcattaaaagggtgatcgggcttccgggcgaaaccctcaggtatgaagatgatcagctgtatatcaacgaagaaaagatcaaagagccttatctggacgacttaaaggccgtcaccgccggaggggacttgacaggggattttacactgcaggaagtgaccggagaggagaaggtgcctgaaaacgagtacttcgtcctcggggacaaccggatccacagctttgacagccgccatttcggctttgtttcagaacgggacatcgtcgggattgtgacggaaagaattgataagaagtga

SEQ ID NO: 1044 - DNA, 1776 bp, Bacillus licheniformis
atgaaaaagttatggaaaatcgcggtttcggctgcaatgttcgtcggttttttcgcaaattcaccccgcattcaagcggaaagcaataagcaggaaaacgaggtcattgttgtatataaaaataccagcggaaaagaaaccgtcatcgaacaggcagacacggtagaacacgtttaccggcacattcccgcagccgctgtcactgcggacgacaaaacagtgcgcgaacttgaacacgatcccgacgtcctgtatgtcgaagacaacctcccggtagctgctgccgacagcaccgctctaaaagctttctccagcagcacagcgcaaaacgcctccgcgttttcacagtggaacatcaagctgattcaagccgcactggcttggaataaaggtttgaccggaaaacaggtgaagatcgcggttattgacagcgggatttccccccatgaggagctgtcgatcgccggcggtgcatcgatggtcggctataccgcttcataccgtgacgataatggccacggaacccatgttgccggaatcatcggagcgaagcataacggacgggggatcgacggcatcgcgcccggcgcgcagctgtatgccgtaaaagcgctggaccggaatggtgcgggggatctgaaaggtatcttacaaggcatcgattggtcgatccagcacggaatcgatatcatcaatatgagcctcgtcgtttcaggcgacagtcaagttctccacgatgcagtagataaagcatacaaacggggaatcattttagtcggagcgagcggaaatgccggaaacggaaaatccgtttattacccggccgcctacagcagcgtcattgccgtctcggcaaccaatgaaaaaaatcagatcgcctcattttccaacaccggcagcgccgtcgagttttccgctcccggcacatcgattatcagtacatcttccgatcgcggctatgcaatcggaagcggcacttcacaggcaacgccgcacgtcaccggcatgtttgcacttttgaaacagctgtacccaaccgcttcaaatgctgagctgcgcaagaaaatgcagttttatacaagcgatttgggcgctcccggccgtgatcatttgttcggctacggattaatccgcttcaaagaggtcacacagccattggaaaaagcgcaaaaagccgtcggacaagcggaaaagacaaagaaaaaagcggacattcaaaccgcacaaaaagcgatcgaaccgctccctgcagacgcagataaaaccgctttgaaaaagagactcaatactgttaaagagcagcttaaaaaaacagccgaaagcaaagtgaaactcgctgagaagcaaaaaaagaaaaccaatgccgactccgcccaaaaagcggtcaacgaactcgacagcggcactttcaaaacgaatttgcaaaaacggatcaacgcggtccgttcaagcctcttgaagaccgcaaagcaggccgttgccaaagctgaaaaagcggcaacagactcaaacctcggcaaagcgcaaaaagcgatcaatgagcttcccgccggaaaagacaaatcaaatctgcaaaaaaggctgaacaccgcgaaaaagcaagcagctgcagcctataataaaaaagtttctgcagcaaaggccaaagtcaaaacggccgaacaaaagagaacgaaaaaaacaaaatcagcagcgcaatcagcagtaggcaagctgaaagcatccgccgaaaaaacgaagctgcaaaaacggatcaatgccattaagctgaagtag

SEQ ID NO: 1045 - DNA, 1242 bp, Bacillus licheniformis
gtggaaaaaacaattaaacatgaccccaattattacaaaaagataattattgcattgtgtttagggtgggtcgctatttggatttatcgtacaatacttacgccaatatatccgcagattcaagaatcattagggaatattagtgacacgcaaatagggttggttgcttctatttatttctttgcatatacgggtatgcaaattccatcaggagcacttgtcgataaatttggacaaaaaaaggtgttaattcctgcatttatcgtttttgcgctggctacatttgtgattggcacaagttcaactatcatgcaagtatacattggttcgttattggctggtatttcgactggttcatattacggtgcagccttttccttatcagctaaacatacgccaaaagataaaaaaagcttttccaatgcgattataaatagcggttcagcattagggatggtaattggactaatcggatcatcggttttagtaggcggttttgaaattcaatggaattatatgctttttataacagctatcgttatcgtagctgtaacatttgtgtttgtgctgtttattaaacaagataaaacatcagataaggaagtggctgaagagaagaaagacactgtacaaagcacagatattcaaaatgaaagcttattttctccaagacaattagttgtatattttgtatattttgcaacatgctatggctattatatgattgtaacttggttgccgtcctttcttgtagcagaaaaaggatttgctcaaggttcagtaggatatgtagctgcactagttgcggtcactgcagtgcctggtgctttgatatttactaaatatatagacaaaaatgcacatttgcgtctgcgtttaattttatttttattaattgcagcagcagtaacaattagtttgacagtgtttgcaccaaatcctgcagtactgtatattgcgttaattttatatggcttattaggtaaacttgcgattgatccagttttaataacctatgtatctgattccgtatcaggagacagagttgccagagcattaactctctttaacttctttggaatgagttcatctgttattgcaccaacacttactggttatattggtgatgtaaccggctcgcgagtattagcattctatattgcaaccattcttcttgcagcagcagcgttgctatttttccttgtggttatgttaagacagaataaaacagcagctaactaa

SEQ ID NO: 1046 - DNA, 1614 bp, Bacillus licheniformis
atgacaacattaaaagaaatattatctgtactgcaattttcagatttaacattgctgaatgagcagggcgatttggaacgagtggtagaaatggttgatattacagaaacgcctgatattaaaaattttacaacgccgcactcacttatcgtcacaacaggaatgagctatcaggatgatcaatccggactaatcaatcttattagagagttaaatgatatacaagttgctggtctaggtatcaagctatcccgatttttaaaaaaattagatgatgaggttattgcatttgcaaataaattaaaattcccaattattgaaattccggaaagttggaatttgggatccattactcatcatatatcttcatttatcttggatgaagaaacagaaaaattacacttcgcattagatatccaacaagagttaaatgctatgctaatgcaagggtttagcctgaacatgatgattgaacgtttaagtagactcataaaggttcctgtaatgctgctaaattcttttcatcaagttgaatcatcgagtcatcactttcatcaaaactcagaacatgttcaaaaaaaccttaattatttcagaagatatttaaattcagagcaaaccgaaccaaatcataatggtgttttccaggaagaatatgctgtatttaaggttcctgcatttaaatattttccgtattatcttatgatttcaaatgttaatttgctcaactatccgattagtttattaacaatagaacaggcagtgaacacacttagtctcgctatttataaaaatagtaaaatcaaggaagcagagcagcaggacgtgaaccattttttcacaacacttatgtccgaacatcctgacaaccttgtttcactagcacaacacactgatcttttaaaaaaatatcacattcaaccttctacattctatcaagtgattatttgcgggattgacaaagaaaagaatgtagaaaatagcgcctacttaaatgagcgatatcagatgacttttgagtggctgacgcataagtttactggaattgacccttccattagcatatatatgtctcagggagaacgcagatttacgatacttctgcaaagaagacatcattattatttggaatactgcagatatatccaaaaagagtatcagctattttttaatagctccctttcatttggcattggtaatgaggtttccgagctttcacaattgccactgtcttttttcgaagcgaatgaggcttatgataataaatatgaacaaggcgaaatggaatttatagagccctacaaatccaaaagcgtagaagaattattacaactcattccaacgaataaattaaagccatttatcatttatacactcggtcctttagcctatcctcagacaacgaaggaaaaagaactaagattcacattaagtgtctatatggcaaaccaatgtgatcttacaaaaacctcagaagatatttttattcaccgtaatactgtgaaatatcgtattaaaaaatgcgaagaaatattaggtcaatctgtagagtctcctgatacatcactgagcattcgtttggcgttatttgcttcagagaaaatatcgttgtga

SEQ ID NO: 1047 - DNA, 1365 bp, Bacillus licheniformis
atgaattttgattcaattatcaaaaatggattagtcattctagaaaatggtgaacaagaagtcgaagtagggatcaaagatggcaaaatcgcagcaatcggtcaggatttgggtacaagtgcaaaaattatcgatgcaaaaggatctattgtatctccaggtatgattgatgcacatgtgcatatcacagagccgggcggcggctatcgtgatgaatgggagggctatgacacaggaacacgtgccgctgcaaaaggcggtgtaacgacgtttattgaaatgccattaaatcaagtgccagcaacggtagatgaggaatctattcaagaaaaatttaaagccggaaaaggaaaattatcagtagacgttgcgagttacggcggtttagtaccatttgacttagatgggggtattcaagaattagatagcaatggtgttgttgcatataaatgttttttagcaacatgtggcgaccgttctatagaaggagatttcatgaacgtagatgactattccctctacgaaggcatgaaacaaattgcgaagacaggcaaaatattatctatacacgctgaaaatgccgcaattaccgataagttaggggaaatagcatctaaaaatggggaaacttcattgcgtgcttatgtagattctcgacccgtatttactgaagtagaaccgattagaaaaattattctatttgcgaaagaaacgggatgtcgtgtacacatcgttcatatagcttgtgaagagggcgtagacgaaattgtcaaagcacaacaggaaggggtcgatattacatgcgaaacatgtacacactatttatatttctataaagaagaactagatcatatcggaccggttgtaaaatgctctccgccaatccgtgagcaatcacgcttagaaggcatgtggaatcgggtattaaacggagatatttcattcgtaacatcagaccattcaccatgtaccccggacttaaaagctacggataatgcatttgaagcttggggaggtatcgcaggtttacaaaataatgtcgatgtattatttgatgaaggtgtgcaaaaacgtaatatgccattatccaaatttgcagccattattgctacaaaccctgcgaaacgttttaatctcgcatcaaaaggcagtattgcagtagggaaagatgcggatttcgtatttattaagaaagatgcaccttatgaattaaaggctgaggacttagcatatcgacacaaaattagtccgtatattggccgcaaaattggtgctcaggtagtgaaaacaatccttcgcggtgtcgaaatctatgataaagaaaaaggaatttcaaatgaaaaagtaggaagatttattccttaa

SEQ ID NO: 1048 - DNA, 1203 bp, Bacillus licheniformis
ttggataagaaattcacaagttttggcggtttagaacaagggggtattacgcgtctgttatactctcctgaatggattgctgcagttcgcgaactggaagcgacattcaaggaagaaggtttagaagtaagctttgatgatgttggaaacttatctggtcgccttgttggaagtaagcatcctgaagaaactattttaacaggatcacatatcgatacagttgtagaaggcggtcatctggatggacaattcggtatcttatctgcattggttgctgtgaaatatttaaaagaaaaacatggtcaaccattacgaacaatagaagtactatctctcgcagaagaagaaggaagccgattcccatatacattttggggaagtaaaaacttctttaacttagccaaaaaatcggatgttgaaacaatagaagatgctgatggaattaaatttgaagatgcaatgcacgaatcgggttttgattaccgtaaaacagatcatgttcgtgacgatattaaagcatttgttgaagtacatatcgaacaagggaaagtattagaggcggaaaataaagcgataggtgttgtaactgggattgttggccaaaaacgttacacaattaacttgaaaggtgaagcaaatcacgctggcacgacaccgatgtcattacgaagggatacagttgttgcatatagtgaaattgtaacagacttaacgaaacgagctagagaaattggggagcctcttgtattaacgtttggacatgtcactcctgttccaaacacggtaaatgtcgtccctggagaaattactttttcgatagactgtcgtcatattgatcaacaactattaaataattttgcgaaagaaattgaagataaagttaaagcggttgcagaagcaaacaacatgacttatgacattaatttatggatggatgaagcaccgtcattgatggataaagaaatcattaaaataattgaacaagcagctaaggccaatgtgggggacagctataaattgatgccatctggtgcaggtcatgatgcgcaaatttttgcggattttgtcccaacagcaatgctgtttgtaccttctattggcggaattagccacaataccaatgaagaaacgaagatagaagaccttgtgaaggggattgaagtattgaaagatgtattgtttgaactagcttataaggaataa

SEQ ID NO: 1049 - DNA, 789 bp, Bacillus licheniformis
atgagttacttaaatcataatcaaggatacagagaaggtttattagaaacacgttcagtaataaaaaaggataattatgcggtaatcacacctgatggcttggttaataatgttgtacctggctttgaagattgtgatgtaacgattttaggatccccgcgtttaggtgcaaggtttgtagattatttggtaacagttaaaaacaagggcggaaacaaaacaggttttgccggtgatggtatccaatcatttgtgtacgttgaatatggtaaaatcaacgcttttgcggatggtgaaaaatacgaattagcaaaaggcggattcttatatgtgcctccacacttacaattgacatttgaaaataataataatggtgaggacagccgtttgtttttatacaaaaagcgctatcagccgcttgaaggacatacaccagaaatcgttgcaggtaatgtgaataacattaaacaagaagcctatgaaggtatgaaagaagtattaattcaagatttactgccaaaagaaatcgcatatgacatgaacattcatattctttcattcgagccaggtgcttcgcatggttacattgaaacgcacgttcaagaacacggtgcctatatattaagtggacgaggtgtttacaacttggacaacgagtggatgccagttgacaaaggtgactatatttttatgggagcttatacgccgcaagcaacctatgcaattggtttggatgaaccattctcgtatatttattctaaggatgcgaatagagatattaatctataa

SEQ ID NO: 1050 - DNA, 1029 bp, Bacillus licheniformis
atgagtgaaccattagtgtatgtagaacgtaatcgtctccggcagctaatgaaagataaattagtgaaagcaggtttacctgaagaacaagcggataaaacagctgatttactcatttttgcagatgaacgaggtgttcactcacatggtgcagtaagaatgcaatactattccgaacgtgcattaaaaggtggatataacctgaaaccaaacttaagcttcgaaaaaacgggccctgcatcggggatttatcacggagataatgcattagggcattatgtgagttatcaagcaatgaaaaaggcaatcgaattagcaaaaacatcagggatcggtgttgtcggtgttaaagaaatgggacacagcggtgctattggttattatgcacatcaagcagcattagaaggtatggcggcattaacagtatgtcaatctgatcccatggtcgtgccatttggcggcaccgaaccatactttggcaccaactcaattgcttttagtgcgcctagaaaagacggtagtccaatcctttttgatatggcaacaacggtacaagcctgggggaaaatcttagatgcaagaagtaaaaacaaatctatcccagactcatgggcagtggataaaaatggagcgccaacaacagacccgtttaaggtaaatgcattattaccaatggctgggcctaaaggatacgggttagcgatgatggttgatattttatcggggagtttgctcggcttgccatttggcaagcatgtcacttctatgtataaagatttatcggagtaccgtcgattagggcagcttcatctcgtaatcaatcctgaatactttggtgggaaggagcaattcctcgaaaaaatatctcaaatggttgaagaattacatgacaacccacctgctgaaggatttaacaaagtgtattatcccggtgaaattcaaatagatgtgatgaaacagtataaaaaaacaggtatcccagttacaaaggaaattttagattatttagagtcagacaaaatttactaa

SEQ ID NO: 1051 - DNA, 1050 bp, Bacillus licheniformis
atgcgcgtatctaagcaggagctgtttcatttaatcaaacagaagctgatcaaagctggattaaacgaaggagccgcacacgatgtttcagatgtattgacattcgccgatcatagagggatccattcccatggtgcagtacgtgtggaatactatgccgaacgaatcgcaaaaggcggtattacagcaaacccaaactacacatttgaacaaacaggacctgcatccgccgtctttagcggagataatggcccaggtcaccaagcagcaaaacaagcgatggaaaaagcaatcgaaatggcaaaaaattcaggtgttgctgttgtaggcatgaagaatatttcgcatagtggtgcattgggttactttgttgaaatggcagcagaacaggacatggttgctttaagcatgtgccaatcagatccaatggtcgtaccgtttggaggaacagaaccatactttggcaccaatccaattgcttttagcgcaccatcggctgatgaacgcatgatcacatttgatatggcgacaactgttcaggcatggggaaaagtattggatgcaagaagtaaaaatgaatcgatcccggaaacatgggcagtagatgcagccggtgcaccaacaacgaatgcaagagatgtccatgcacttgtgccaattgccggtccaaaaggttatggattgatgatgatggtggatgtcttatcaggcagccttcttggagtacctcatggcgtacatgtatcttccatgtatcaagacctgacaaaaggccgagatttagggcaaattcatattgtgatcaaccctgcatacttcacagatttaactgcttttaaacaacagatttcgacgatgcttgatgaattaaaagcacaaccggcagcagaaggctatggggaaatttattatccgggtgagcgcggtaaattaagaagtgcaaaatatgataaagaaggaattgaaattgtagacgatatttataactacctcgtttcaggcgatgttcattacaatcgttatcatggaaagaatagatttgcagaataa

SEQ ID NO: 1052 - DNA, 1758 bp, Bacillus licheniformis
atgttatacacaattataaaagaaaacacctatcaagattctatcgtgttaatgcttttatcaaacaagttatctgcaatagatggtataaacaaagtttctatcatgatgggaacaccagctaacaaagacatttttaaatcttcgggtttgggcacagatgaattggaaaaagcaaacccaaatgatatcgtcatcgttatagatacaaaccaagaagaaaaggtatcggaagtgaaagaagaagtagaagcagctttaaaaggagactctgcttcacaagacagagctaaagaccaagaagcacataactggaagcgtgcaatggagcttgcgaacaaccctaatctggcattgatctccattcctggtcagtatgcagcaatggaagcggaaaatgcattgaatgaagggttacatgtatttctattcagcgacaatgtatctaaagaagatgaggttaagttgaaacaaaaggcgcatgaaaaaggattattagtcatgggaccagactgcggtactggaattattcacggcgtgccactggcatttacaaatatcgtgaataaaggagatattggcgttgtgggtgcatcaggtacagggattcaggaagtgacatgcatcattgaccgtcttggtaaaggtgtaacaaacgcaattggtacaggtggtcgggatttatcaacagaggttggtgctaccatggttttagatagtatcaaagcattaaatcaagatccacaagtaaaagtgattacagtaatttctaaaccgcctgcaaaggaagtgcagcaaaaagtattaaatgtgttaagaaatattgaaaaaccggttgttacgttatttttaggagataaaccaacttatcaggaagaaaatatttatcatgcgtatacacttgaagaagcagcggttgtatctgttcaattatccaatggcgacaaaccgaattttaaaccgacagtggctgaaaatgtaaacgtgtcgttaaaagattcacaagttggtattaaaggttattactcgggcggcaccttggcatctgaagcagctgtgttagtgaaagaggcattcaaagaagaagtacctgaagagaagaaaggtgcctatattctaaaaacaaaacatcatgaaattattgacttaggcgatgatatttatacccaggggaagccacacccgatgattgatcctgaaaaacgcatcgaaatgcttgaaacatctggaaacgatcctgaaacagcagtcatcatgattgataacgtcattggctatggcagtcatgatgatatggcaaatgaattagcaccagccattaaacgtattttagccaatgcacatcaggatggccgtgaacttgcagtgcttgtaacagttgtaggtacagataaagatcctcaaggttacgaaaagcaaattgaaaccttaaaagaaagtggtgcaatgatttgtgagacaaacgatcaaatggttcgtacagcgattaaactggcaggaggaaaagtggaacagccagtccttgacatacaaaaatttgaatatacccaagaagacttgacagtagacgaaaaaattatgtccttaatcaatacgaaaccaagtgtcatcaatattgggctgaaaagttttacagcagctgttcagaagagcggatcagagtgtgttcaatttaactggcggccaattgctggcggtgatgaaaagctaatgaaagtgcttcaatatctaaactactatgaaggagagacaatctaa

SEQ ID NO: 1053 - DNA, 1266 bp, Bacillus licheniformis
atggggtacaaaacaataaatgaagcgaacgaagctgttatccggaagatcatagcagctgaaccattcttgaccgatgttgtacctgccaagtctgtgattcctgaattagaagattatgtgttattacatgctgggcctccaattaaatatgaaaatatgacagatcctatgcaaggctcttgtgttggagcgattctttttgaaggatgggcagaagatgaagagggagcgcgtggtctgcttgaaaacaataagattacatttattccatgtcatcatgtgaatgcagttggaccaatgggaggcattacatcacctaatatgccggttcttgttgttatgaacaaagagagtggcaatgaggcgtactgtcaaatgaacgaaggcatcggtgcagtattacgcttcggtgcttatcatgagcaggtaatcaatcgcctgcactggatgaaagatgtgttgggtccagtgttaagtaaggccttaagaaaaattgatggaggcataaacgttaatgttttgatggctaaagctattgcaatgggggatgaatttcaccagcgcaatattgcagcatcattggtgtttttaaaagaagttgctccagtaattgtggcattagatgatgttgaaaacgaacaaagtgcagaagttatccaatttttagctgatacagaccaatttttcttaaacattgccatggcgactggaaaagcaataatggatgcagcgcgtacaatcaaacatggtacagtcgttactgcaatgtgccgaaacggtgaaaactttggcattcgtattgctggtatgggagatgagtggtttacagcacctgttaatacaccacaagggttatattttaccggctactcagcggaagatgcaaacacagatatcggtgattcagcgattacagaaacaatcggtgttggcggcgtagcaatgattgctgcccctgcagtaacgcgttttgttggaacaggcggatttaatgatgcgcttgaaacaagcaatcaaatggctgaaatctgtgttggagaaaatccgaactttgttattccgacgtgggacttcaaaggtgcgtgtttaggtattgatgcacgtaaagttgttgaaacaggcataacaccggtaatcaacacaggtattgcacataaaattgctggatatgggcaaattggtgctggtacagttcatcctccaatcgaatgttttgagaaagcaatcacagcatatgctgaaaaactaggttttcaaggatga

SEQ ID NO: 1054 - DNA, 771 bp, Bacillus licheniformis
atgattttacaggcaagtgcggttggttcaatcgcacttcagctattaattgagggaaaaacgtttactgtacacagcatttttgaaaaaggtttaaatattgttgatcggaatgatgaattgatatttatcggcacaaatgaaaatgggaccttcccatttggaatcttgcttgactcacaaacgaagcaaacattaaaagcagatcttgaagtgggagatacatttcacgttcgcaatagccatctttcccacaattgttttgaactcaattttaatgcggaaatacttccgttatatacagattttaaacatgcaaatataaataaattaaaagaaaacgtgaaacaaatttcatttaaatcgtatgaatctactgattttgaatcagctcgcgtgtcggacttgataaataaattacacgatccaactgaaaatttggaggaagagcttcgttactttatcggtcggggccaaggtttaacgccgacgggtgacgatatactggtcggtatattgtatggacacttcatcaactcttttatcgccgaaaaacaccttgaaacattgggaagtctaatcagagaacccttaacaacccttgtcagcacgcgctttttaacttgtgctatagaaggcttgtttagttcaaaaattacaaaattacaacatgattcatctttgaaaagtataaaaagtcttataaaagtaggttcttcttctgggatggatactttatatggaatttatatggctttaacaaaggagtga

SEQ ID NO: 1055 - DNA, 933 bp, Bacillus licheniformis
atggggaaaagtgtagtaatcgcactaggaggtaatgcaattttacagccaaaacaagaagcaacttatgctaatcaattcaaaaatgtaatctctgcaacacgtcatatgattgaaattaaagaagcaggacataaaattgtgattacacacggcaatggtccgcaagttgggaatattattgctcaaaatgaagctgccaaaaatgtcgttgaaccgctgccgatctatgcttgtaacgcagaatcacagggattcattggttatatgctcgaaaaagctttaaaaaaccatattaaaaaacggggcattaccgcgaatgtagctacatttctaacaatggttgaagtggacaagtatgataaagcatttgaaaaaccaacgaaaccaataggagtattttattcagaggaagaagcgaagaaattggagaaaaaagggtttgctatgtcagaagatgcagggcgtggctatagacgagttgtgccttccccagaaccgaaagtgatccatgggatagaagagattcgacgtttaattgatgaaacgattgttatctcctcgggcggcggcggtatacctgtatatcgtgacgacagcggtctattacatggtcttgaagcagtaatagacaaagatcgttcaggattaaagctggcacaacaattaaatgctgatgttttcatgatgttgacagacgtaccaaatgtgtttatcaattttggcaaagaaaatgagcaaaaactaagccgaattacagtagaagaagcagaacaatatgtggcagaaggtcaatttcctgctggcagtatgctgccaaagatgcaagcggctatagaatttgcaaagttaggtaaagaggcaattatttgttcattgaaccaagcggcagctgcactagacggaaaagcggggacgcgcataacaaaataa

SEQ ID NO: 1056 - DNA, 1254 bp, Bacillus licheniformis
atgacaaaagaggcgggatcagttgaaggtaaaggaaaacaaccactggttccctattgggtaaaagttgttatcgtatttttcttcggttgggtggctctttatgcaacgcgaacaatattaaaccccattatgggggatattgaatcagcgttttcattaagcaaggcacaacttggcttaattatgagtatatttttcatcggttatgctggtatgaatgttcctgcaggaatattaggagataaaattgggaaaaaacgagtgttggttccaggtgttattctatttggctcgcttgcagcagttacagggatgatgcccacattctttctgtttatctctgcatggcttatggttggtatggctcagggggtatattatgggccgcaatatggaatatcatccgaaattatcccgaagaaccgtctaacattaggcagtgctgtgattaatgcagggatggcttttggtacttcaattggctattatatctccagttatgttgttggagaatggggattcggatggggaaccccattttttgccatcgcagtgccggttgtacttatcggcatcgcaatggcaattgtaattaaagacaaaccaaaaactgataaagaggttaaaaggagcgctgaaccgtttaagttttcatctttatttaatagaaacttaattttggcatatattattattttctgctctatttacggattctttatgattattacttggttgccatactatttagaaacagcacgcggtttaaccggaggaaatattgcctttgttgcatcacttgttccatgggcagcaattccaggttcattattttttagttggctgtcagataagttaggccggcgcaaaccagtattgctcatgatgttgccatttggtattttatcaacagctgcaattgtttactttgatagcttaccaattctgtatatgacactaattgtgtatggaattgtagggaaaattagcgttaaccccgttttaattgctgttgtagcaaataatgcaccaaagcaatcattaagtacagcatttggattctacaactttgttggaatgttaggttccattttagctccatatattactggctggctgacagacactacaggaagtatgaatataggattttattttgcagcagctctgttagtaatcgcgttgattgcaacatatttaatagacgaaagtaatttgccatctgttgataaagcagctaaacatcattag

SEQ ID NO: 1057 - DNA, 339 bp, Bacillus licheniformis
atgctcagtcagattaagtatgaagagactcattcactgcaattgcgcttcaagcggcacaacaaaggcgacagccagaggctgatagatgcaaataataaacaattcggaatcgtggtgttaaaattcagcagcgtctgcaaaacagcatgggctaaaatgacgctggacaaagcagtgtccttaggcttggaggcaaatgcatatttgaaaagaaacacagacggaaaagaactgagctgcagcccggctggaggaaaaggaaaagtgctcccggggcagacatcctgttatacaccgatggttgatttcgatccgcgttcttcatatgcgatgtag

SEQ ID NO: 1058 - DNA, 1101 bp, Bacillus licheniformis
atgaacaagatcgccgcggaagaagtcgccaacatccttaatacatggtaccgcgccatcagaagaaatgatgctgaacagtcgatccgaatatttgaagaagtcaaaccgatgctggcagagatggaggaagaccaagaggttttaatctactattctctgctggaactgcggcataaaatcatgctgtatgatacgcggggaaaaaagatagaacagcaagaggagttaacgaacggcggcagtgctgcatcacatatgacatcctattactactacctgttttcaggagcttatgaagtgtataaaaagaattatgagcaggcgatcagcttctataaaattgccgagaagaagcttgctcatgtacatgatgaaattgaggtggcgcaatttcacgataaagtcggaaagctctactattacttgggccagaatatcgtctctttaaaccatacccggcaggcgatggaaattttcaaggggcatggcgaccatgatatgaaccttgtttccacttatattacgatggccggaaattatacagagatggggaaatatacagaggcggaagaatatttaacagaagccatccatacggtaagaaaagccggcgactgttttaaagaaatgcagctccttcataattttgccttgctttatgcggcgatggacaattcggaaaaaagcattcagtttttagaaatcgttttggatgatcaagcatatgctgcatcagattattatttcaatgctgtgtttttaatgatcaaagagctgtttaaagtcggagaccataaacgcgctgcagccttttacaaagaagggaaggaaaggtcgaaatccgcggcgaataaaatatttgacgccaaaatcgatattttatatgcggcttatgcaggagatggtgaacaggcggttaaagactgcaaagacaacattgaaatcctgtttcaaacaaagcaatacgacagcgccagagaactttcgctcttaacggccaatgtttacagatcaaagtcactttataaagaagccgcacatttctttttggaagcgattaaagcggaagaaaaaatgaaaaaagtggagggaatgtga

SEQ ID NO: 1059 - DNA, 117 bp, Bacillus licheniformis
atgaaaaaactgttcattgttgctgcgattgctgccgtcgtatgttcgggatggtttgcggcagaaactcactgggcatccggcgacatgcaggttgctgaaaagatggtcggttaa

SEQ ID NO: 1060 - DNA, 150 bp, Bacillus licheniformis
gacaatgaacacttcttcaccactatttagggtggtcaacctaaacaaaggtacgaaacctgtgctgactacttttactccgatgtcctttcagctattcttgtcagtaagatcattccccatctcttcaacgcctcaggcatcacctat

SEQ ID NO: 1061 - DNA, 528 bp, Bacillus licheniformis
gtgataacacttacggccacaacccttatcatttcaggatttagtgggttcgcatcatctgtctcagccgctgaacaagaacagtcaaccacatcaattaccgaaacgacgtatgtcacattgccagcttctcttcaagaatatatggaaacacatcaagagcctactactctagaagattccaaagcattcatccaatttgcatcacaaactccagaatttcaaacttacaatcagttaaatcaggatggacaagtacatactgcaggccttattggtggatctctaaaagccataaaagcatttggatgggtttgcagagttgggggaaaaactcttaaatgggcgattagaccactctctccttctaaagcgagactcgtcgacaaatatgcacgtaaaattgcatatgccacagaaagattaaatagtgcttcaaaaggcgctcttgtaaaagccttagtgaaagccggagttcctaaaaaaacagcagattcccttgcggaaatcatcttatggctcgtataa

SEQ ID NO: 1062 - DNA, 1038 bp, Bacillus licheniformis
atggcgacgattaaagagattgcgcttcaggctaaagtatcaagcacaacggtttcaagggttctgaaccatgaccagtcattatcagtagcgcctgaaacaaggcagcggattttggatatagcagcccggctcggctataaaagcacgcgcaggcgccgcgaggtatatgcctcaggaagcggggaaagcccgcgcatcggcattgttgtctgccaatcacaggaagaagagctgaacgatccgtacttttattccatcaggcagggaattgaaagtgagtgttttgaaagaggagcgtttattacgaaatttattcagctgagcagcatccgctcgaatcagcctgtaggcgatgtcgacggcttaatcgtcatcggaaggatcaactttgccggtttgcagcagtgcatgggcgcgctcaacaacgtcgtgtacatcaaccatacagacaatgaagagctgcgcgactcggttgtcgtagattttgagaaggctacggggagggcgctgaaccatttgaaatcgctcggctatacaaggatcggttatatcggcggaagagaaaaagagcactttcgaatcagcgatcaggagacaagcgccattgaaatcgaagacaaacgtctgactgcgtttctggagatggccggttcggataacgcaaagcacatttatatcggcgagtattcgatgcagcaaggctatgaactgatgaaaaaagcgcttttagagaaaaacgttcccgaagctttttttatcgccagcgattcaatggccatcggcgcgctccgggcgcttcgagaatcgggactcaaggttcccgaagatgttgcaatcgtcagcttcaacggcattgaagcgtccgaatttgctaatccgccattgacaaccgtaaaggttcatacagaagagatgggccggacgggtgtgaagctgctgctcgacagactgaaaggaagggaactgccgctgaaagtgaccgtaccttcagagctgattattcgggaaagctgcggattcagcaaacggagctaa

SEQ ID NO: 1063 - DNA, 1254 bp, Bacillus licheniformis
atgaaaaaaatcattttctcttttgttctcctgatcattttgtctgcaatacttgcgggctgctccggaaagaatgccggaaagagcggagatgtcacgctcacaatgttttcgacaatgacaaacgacagtgaaaaaaacacgctcagaagcatcgcagatgattttgaaaaagaaaatgaaggcatcaagatcgatatcagctttcccggcccggactatgaaaatatgctgcgcgtcaaaatggcggcaaatgacatgcctgatttgttcgatacgcacggctgggcgaagatccgctacggggaatacactgctgatttaaaagacatggattgggtgaagcatctcgatccaaacctcgatccgattttgaaggatgaaaaaggcaaagtatatgcctaccctttcaatcaggcaaaagacgggatcgtctacaatgccggtctcttgaagaaatacggtctcaagcctccgcagacgttggacgaactgatgcatgcgctggaaacgatcaaagaaaaaagcaacgggagcgtcattcctttttggtttgccggttcagataaaggcgctttagctcagttttatgatcagcttgccaccccgctgctcatcacagatgatcgccgcaatgaaaaaaaagctttggaaaacggcacattcgactggtccgactacacacttctcgcagaaacctttaaagagatgcaggaaaagcaattgatcaataaagatatcctgacggcaaaaccgtcgcaattggtcgaattgatggcgcaggaaaaaatcggttttaccctctcagtcacgtcgatcggccctgatacgagggaagtcaatccagatatccagttaggcgtgatgccgacgcctgccgtttatgaaggcgacaaaccgagctggattggaggagagcgccataccgttgctgtctggaaagactcagaacacctcgaagaagcaaagcggtttatcgaattcgccgcacagcccaaatacgtgaaaaagatcgccgaagccacctcatttcctcaggcattaaccaacacagaagctgaaaactactattctaagttttatgatcaatatgaagaaatcaaaatcgaaccgtactttgaccgcgtctatctcccgagcggaatgtgggacgtcatgggaacgacgggacaggaactattggccggtacgttaacgccgaagcaggtatcggaaaaaatgaaacaggaatacagcagattacaagaacaatag

SEQ ID NO: 1064 - DNA, 924 bp, Bacillus licheniformis
atgagcgaattagctaaagaaaaaagtctgactattgtgaaaagtaaaaggagatatgtgaggaaaaatggatcgctctggtggatgtatcttcccgccttggcgcttgtatccgtctttatgatttatccgtttgcgagcggcattaaaatcacgttcacgaactggaacggtttctcacagtcgtatgactggatcggctttgcccaatataaacggatgctggccgacccggcgacatggcttgtcgtcaaaaacaccctcctgtacggattgggcagtacggttttccagaatgtcatcggtcttctctatgccctcctgctgtttaaaagcatcaaaatgaaagcgctgacaagaacggttgtctatttgcccgtcatcatcagcccgctgatcatggggtatatctggtacttcttcttctcctatgaaggaggcgccttgaacgatttgctgaaactatttggagcaggtcctgtcaacgccttgagcagcccggaaatcaatccgtggatcatcgtatttgtcaattcctatcagtttgtcggtatagcgatggtcatttatttagcaggtctcggaagcgttccgaaagatttttatgaagcggcgcaaatcgacggagcaagcggttttcagcaattttggaagattacgctgccgctgttgatgccttctgtcacgatcaacatggtaatcaatatcatcggcggactgaagctgtttgatgtcattttagcgctgacaggcggcggtccgggaaatgcttcgcaatcgatgtcgacttttatgtacgatctgtattttaagaggcaggatgccggctatgcagccgctcagggggttttcatggcggtgttgatactgctaatcagctttacggctctcatctattttaagcgcaaggaggtcgaagcctag

SEQ ID NO: 1065 - DNA, 831 bp, Bacillus licheniformis
atgaatcgccaagagaaaaagaaacgggcgctgtggactttgctggctgcatggattaccgtttttcacctgattccgttttatattttgctgacgacggcgctgaaagcaaagggagatttcagttcaaaatggaagttcccggacgaaatcagcctcggtaattttgcagaagcatgggataaagcaggtctggccggctcgtttttcaatactgctgtgatcacttttgcttcggcggctctgctcattgtgatcggctctctggcggcatatccgctcgccaggcgcagaacaaagctcaatcaagccgtttacttcctgtttatcggcattatgatcattccgccgctgacatccatggttcctttatacaaaatggtggtggagcttggcatgctgaatacgcttgaaatcgcgatattgaataatacggcggcttatatgcccttgacgatttttttgtatgccggatttatccggtcgacgattccgaaagagcttgaagaggctgcgagaatcgacggggcgagcacggcggggattttcttcagaatcgtctttcctttattaaagccggtgactgcgacgatttgcattattgcctgcgtattcatctggaacgactatcagttttcgatctttttccttcaagacaaaagtgtgcagactttgactgtagcgattgccggcttctttgggcaaaatgcgaacaacctgcacttggtggccgcggcttcgctgatggcgatgctgccgatgacgattctatttttattcctgcaaaagtactttataaaaggattatcagcaggagcgctaaaaggctag

SEQ ID NO: 1066 - DNA, 1299 bp, Bacillus licheniformis
atgactaaaattgcttttatcggagctggaagcacaatttttgcgaaaaatgtgctgggggactgtctgatggttccggcggtcaacggatttgaatttgctttgtatgatatcgatccgaagcgcctcaaagaatctaaagatatgcttgagcatttaaaaaaccgctataatgacacggtatcgatccgcgcctatgacgacagaaaggaagctttggcgggagcgaaatacgtgatcaatgccattcaggtcggcggctataaaccgggcacagtcatcgattttgagattccgaaaaaatacggcctcaagcagacgattgccgatacggtcggaatcggcgggatattcagggcgctgcggacgattcccgttttattggatatggcaaaagacatcgaaagcgcggcgcccgacgcctggctcttaaattacacaaacccgatggcttctttaaccggtgcgcttctccgctacacggacgtgaaaacggtcggtctctgccacagcgttcaagtatgcacaaaagatcttttcaaatccctcggcatgaagcatgaacgaatcgaagaaaaaatcgccggcatcaatcatatggcctggcttcttgaagtcaagcaagacggaagagacttgtatccagaaattaaaaagcgggcaaaagaaaaacagaaaacgaaacatggtgacatggtcaggtttgaactgatggataaattcggctactatgtgaccgaatcgtccgaacataacgcggagtaccacccttattttattaaaagccgttatcccgaactgattgaagaactgaatatcccgattgacgaatatttgagaaggtgcgagaagcagattcaaaattgggaaaagatgcgcggcgaaatcgtcggcaatcggcatttaacccacgagcggtcaaacgaatacggctcaagaatcatagaagcgatggaaaccggccagccgtttacattcggcggtaatgtcttgaataaaggattgattacaaatcttccggaaaaagccgtcgtcgaagtgacgtgcgtcgctgagcggaaccggatcactccgtgctacgcgggcgagctgccagaacagctggctgctttaaatcgcaccaatatcaatacacagctgttaacgattgaagcggcaacaacaaaaagaaaagagcacatttaccatgctgcattgcttgatccgcatacggctgcggaattatcgatggatgatatcgtaagcatgtgcgatgaattgatcgaagcacacggcgactggctgccggaatttgaataa

SEQ ID NO: 1067 - DNA, 1119 bp, Bacillus licheniformis
ttgatattgatcagcagttttgggggatttcttctctcattgaccggcatgacaatcggctggatggtcggaacaatgaccgccgccgcttgtctgtcgctgtttcgcccgtcaccgttgaaagcggcggtcagacaaaacggcatccaccatggatggcttcagttcggccaaatgctattgggaattgagcttggccaaaaaatcaacatgtctgtgatttcgatctttaaggaaaattggctgattgtcggcgtcatgcttctcctttccgtcgtgttcgccatgctgtcgggctttgtcttgtggagattcagcaagacagatatgctgacgagctttgtgggaacggctcccggcgggctttccgcgatgccgggcatcgctcaggaagtcggagcgaacacggcaatcgtcagtctcgtgcagatgatacgtgttcttctcgtcgtcatgaccattccctttttcgtttttttcataaatgcgaagcatcccgacgcccatgctgccggcagccaagtgatggccgcgggaacatcggcatttgaagcgcctcatatcgcatggactgcgttgatcgtgctgggcggattcggggtatgcaaagctatgaaagcactgcggtttcctgcgccatggctgctcggaagcatgaccggcgcggccgttctgcaaatcgcgggcgcctcaatgaccggactcagcacaaccgcctggtggccccacggcttttcagtgctgtcgcaaatttgtctcggcgcaacgatcggttcaaagatcagcaaagatatgtttatcggcgtcagaaaaacgctgatcgtcgcacttgccagctccgtcggactgatcattgcaatgattttaagcgccgccgtcaccgccaaagcggcaggcatttcgctgacaacggccatattggcgtttgctccgggaggaatcgcagaaatggcgacaacgtctgtcacgcttcacgccgactctacgttcgtcgtcgctgtccaagtgttgagggtggtgctcgtgatcgcaatgcttcctccattcttccgattgcttcatcaaaaatcggaaaaatatacacaccctcgcgtgaaaaaagccagagttgaaggctga

SEQ ID NO: 1068 - DNA, 234 bp, Bacillus licheniformis
atgaaacatcccaaggaatcattcaccaaagtcaaatcgtatcgcccgtttcacagcgcctttgatccgtgtccgccgatcggcaaaagatactacagaacccctccaaatctatatctaggttttcagccccgcggccttccgcagttttccccgatggaggcgctgcaaaaagggacgctttggcccgtattttacgatcattatgaaaatccgtatgaagatgggaggtaa

SEQ ID NO: 1069 - DNA, 264 bp, Bacillus licheniformis
gtgacgaactctttaccgcaagactattataaaaggcttcatgaaattcaggctgttgattttgtcatcgttgagctgatgctataccttgacacacatcccgatgataccgatgccatcaaacaatacaaccagtatgccggattttccagaaaactgaaagcgaagtttgaatcaaaatacggccctttgattcaaggaagcccggatcagacggaatcctattggagctggaaaagaagtccttggccatggcaagtttaa

SEQ ID NO: 1070 - DNA, 570 bp, Bacillus licheniformis
atgtggctttatgagaaaaaactgcagtatcctgttagggtgagagaatgcaatccgagacttgccaaatttttgattgagcaatacggcggagcggacggcgaattggctgcggcgcttcgctatttgaaccagcgctacagcatacccgataaagtcgtcggactgctgacggacatcggtacggaagagtttgctcaccttgaaatgattgccacgatggtatataaattaacaaaagacgcgacgcccgagcagatgaaggaagccgggctcggcgatcattacgcagaccatgacaaagccctgttttatcataacgctgccggcgttccgttcaccgctacatacatccaggcaaaaggcgatccgattgccgatttatatgaagatatagcggctgaagaaaaagcgagggctacgtatcaatggctgattgacatgtcggatgatccggatttaaatgacgggctggcgtttttacgggaaagggaaatcgttcattcacagcgcttccgcgaagctgtcgaaattttgaaggaagagcgcgaccgtaaaaaagtgttttaa

SEQ ID NO: 1071 - DNA, 1620 bp, Bacillus licheniformis
atggttacattaaaaaaacaaacgatcggcgggcttttaaaatcaaccgccggccggtttccgaatcatgaagcggttgtatattctgagctcgatttaagatactcgtatcaggagcttgttgaagaaacttctaaaattgcaaaagggctgctcgcgctcggcattcaaaaaggggagcatgtcgccatctgggcatccaatattccggaatggattctgctccagtttgctacggcaagaatcggcgctgtgctcgtcaccgtcaatacgagctatcaggcgagagaactcgagtacttattggaacattccgattccaccaccctctttctgatggacggctacaaaggaacatcctatatcaatatgatcgatgagatcatgaaaaatcctgaaaagctgccgaagctgaaaaatctcgtctaccttggcaagaacgagacccctgaacatatgacggcttttgccgagatcgctaaaatgggcgaaacggtctctgatgccgacctttttgaacgagagcagtcactcacacacgatgatgtgattaatatgcagtatacgtcgggaacgaccggctttccaaaaggtgttatgctgactcactacaatatcgtcaacaatgcggcgatcgttgccgacagaatggggctgacgagcgaagacaggctgtgcatcccggttcctctttttcattgcttcggctgtgtgttaagcacgcttgcctgcgtcgcgtcaggcgcggccatgctgccaatcatcgaattcaagccggacatcgtcctgcaaacggtcgaaaaagaaagatgtacagggctgcagggtgtaccgacaatgtttatcgccgagctcacccaccccgatttcgcaaactatgacctctcttctctgcggaccgggatcatggcaggctccccgtgccctagagaagtcatgaaaaaagtgatgaagcaaatgaatatgacggatatcacaatcgcatacggacagacggagtcttcacccgtgattacgcagacaaccgtcaccgacacgatcgaacgccgcgtcgagaccgtcggaaaagtgcatccgcatgtagaaatgaaaatcgtcgatcctgacaccggggaaacgctcggcccggatgagcagggcgaactgtgcacaagaggatacctcgtcatgaaaggctactataaaatggatgaagccacaaaaaaggccatcgatgaagacggctggctccataccggagatttggcagaaatggaccgggacggatacgtgaggattaccgggcgcttaaaagatatgatcgtccgcggcggggaaaacatttacccgcgtgaaatagaggaattcctttatgaacatgaggatattgtcgatgtacaggttgtcggcgttccggatgaaaagtacggggaaaaaacggctgcctttattaaatgcaggccgggcaaaaagctgacgctcgaagacgtcagagatttttgcaaaggacagctttcgtattataaaattccggagtacgtatttctgatcgacgaatacccgctgaccgcatccggaaaagttcaaaaatatgtgctgcgcgaccgcgcagcagaactgcttgcgagcccggtgcagtaa

SEQ ID NO: 1072 - DNA, 555 bp, Bacillus licheniformis
atgttcttgtcggttcccgtcagcctgttctatgctcagctggagtccaactaccgcctttatctcgaaactctttttgacgatttcctattcaccttgactgtttatacagtgtgccgcgcccttcttagcattacgatgcaaattccgctcgtcaaatggacggaaggactgaacatcaaaacgatcgtttccatatcatacgtatgctacgctgtggcagcgattggtttcgctttttcttcatcgatcttttggctgctttcgactgcggttttatttacggcggcagaaagcatgcttctgaatcacatgcaaacctttgtctcgcgccttgctcccaatcatatacggggcggatattttgcatttttcggcccgcattgggatatttcccggacaattggaccttttttaggcgggatgatcttcatcaagttcggcggggcagcgctttttcttgccattgcagggatcatggctctcggggggattgcacaatatcgagcagtgtcccggttaaaaaaactagtcctttatagtacctggtactag

SEQ ID NO: 1073 - DNA, 1242 bp, Bacillus licheniformis
atgaaattgagattcggtttactttttgtcatgcttgttttcgcgcttccgcttgcggcatgccaaaattccggctcgggaaacactggcggacatgaggagcatcatacaaaggatcattcggagatgaaagaaaaagacgctgattctcttccgagtgatttcaataagcgggccgaagaggggctcctggtgaaaaacacaaagaactcgacaaggcttgacgcgaatacaccagaagacatgagcatcaaaacctctcaaacgatatggccggccactcataaacaaaacaggccgggcgcagtgattctagtttcgggcggatcatggcagacagctcttgcatcagcagatttgatccatcatccaaataacgggcctgttttaatcgcggaaaaagggaaaatctccgggcaaattcagaatgaaatcaaacgcttgaacccgacgggcacttcagacgggacgcaaatcatggctgtcggagaatttgattcaaaagcgcttcaagctttgaacacttttaaaataaaagagctcaaagggaagaacgcggctgatctggcaaaagagattgacaaagaatacgcggaggcagccggtgaatatccgaaaagcgtcatcatcggatcatccgaggatgatgcagaactttattcgctcccggctgtaaactggatcgcccacatgcctgagccgatcctgtacgtgaacaaaaaaggcattcccgaagagacggctgaagcattaaagaaaagggacgccaaagcaaacatctatattctcggccctaaaaaagcggtttcggaaaaaacggagaatgcattaaaggaatacggaacagtcaaaagaatttccggagacactcctgtcgcaaattcgattgcatttgcgaaattcagggataagaacaccggctttggctggggcatcacagatccgggacacggactatcctttgcatcaaccgctgcgcccgagcttgcgcttgccggagcgccattttcccatttgggaaaacacgctcccctgcttttactcaaaaatggacaggcagacagcacactatacagctatctgtccgagatcgagccttcatttcatgacaggccgcaagacggcccatacaaccatgcattcattctcgggtcagaaaatgagatttcatttcggacacaaggcattcttgatggcatattggaaattaagtctgcggatggaggacattccggtcattaa

SEQ ID NO: 1074 - DNA, 1368 bp, Bacillus licheniformis
atgaaaaagatttcatttgagctcgcaggttcatttttcgttttaatccttttcatcgaagccgtcctttttgccgcgctgtatacaacgattgtcaacacgagaataaacgaagaaataagcgcgcttcaactaagaggcaacagccacagagacgtcctcgaaaagcattttgacaaaaggacgatagaccacgtcaccctgatggagactgaagcccggacaaacgtgatcatcacggaccaaaacagacgcgtattggcgcagtctgccccgggagacatgacggaacaccttcatttcgaagaacagaacatcccgaggaacgggaccgctttatcttcccattggaatacatcaaagtacatttgtacgatcagtccgatcatgaacggacgggaaacggccggctacgtcttcatgtatttggagacctcctcgataaaagccttggtggcaagcattacgaagcggtttttcctcagcttcggcttaaccggcgtcttaacggtcgcagctattctttggttcagccgtgttttagcgaagccgattattaaactgaaggaggcaaccgaaagcatcaaaaacggtcaagcttcgattccgcttgatatcaaaaggaatgatgaactcggagagctcgccgcatcaatcgaaagcctttcctcaaatctcagcaggcttcaaaaagagcgaaacgattttctgtcaagcgtcgcccatgagctgcggactccgatcacatatataaaaggctacacagatgtcgcgatgagagataagctcgaaccgcaagccagaaatcagtacttgtcgatcatcaaagaggaagcggacaatttaaacacccttgttgacgatttatttttgctgacaaaactgaaacagcccggatttcaaatcaataagaaacaggttcacctttacacattcgtgaaaaaagaaattcagaaagcggcggtcgctttttcggaaaagcgaatcagcgtttcgttcgacatcccgacggatctttatgtcacagtcgacgaggtccgcttttcacaagtgatctcaaatttgctgaacaacgcccgccaatactccgatcctgaatcaacagcggccgtcaccgcatcaaaattggaggaccaggtcaagattacggtagcggatgaaggctgcggcattccggaagaagaacgggattatatatttgagcgcttttaccggatcgataaatcgaggtccagacaaaccggcggtaccgggctgggtctggccatcgtgaaagaaatcgtcgagcttcatggcggtcagattgcagcgaaaaacagaaccccgaaaggaagcgaatttatcatcacgctgccttccgatgtgtaa

SEQ ID NO: 1075 - DNA, 675 bp, Bacillus licheniformis
ttgaacgtgctgcttgtcgatgatgaaaaccggatgctcgatctgctggagctttatttagagcattattcgtgcacaaaagccgccaccggaaaagaagccctggacttaataaaaatgcgcaatttcgatcttgtcatcctcgatatcatgatgcctgaaatggacggatggacggtttgcaaagagatccgaagattgacaagcattccggttatcatgctgacggcaaaaaacgggcaggatgatattgtacgaggcctgaactgcggtgcagacgattatttaacaaagccgttcagcgaaaaagtgctgcttgccaaaatagaagccgtcctgcgcagaacccgccgatttcatgaaatcaggttccgcggtttaatctggaataaacagcatcataccctgcatgtcaatcaccgtgaaatcagcattacgccaagtgaattcgatctgcttggaacactcttagaccatatggatcaagtgctttcgagagaccaattgattgagaacatctggggattcaactctgatatcgagccccgcaccatcgattcgcacatgagaaatttgcggcaccgattgaaaaaagcgggctttccggttgaagaccatctccggaccgtctacggcgtcggctacaaatggacaagcaaaggaaccggagcatga

SEQ ID NO: 1076 - DNA, 450 bp, Bacillus licheniformis
gtgaaaaacatgtggtatgttcagccgtatcatcccgcctatcccgccaggcaaaacaacaggctgatcaaagatctagaaaaagcggtaaacggagagcacagtgcggtcgtctgctaccaaaaaatcgcacaaaaggccccggatgctgaggcaaaacagcaaattttagaaatcagacaggacgaaatccgccactttaatgcgttcctggcattttatacgtctcttgccggccgaaagcctgacatttccattacggagccttgtccggaacagtattggaacgcgctggagtccgcattaaaagacgagcaggaaacggttgatttttatttggacatcgcagactatgtcaaagaccgggcgatacgggatgcgttcaagcgggcggcagctgacgaacaaaaccatgcagtctggtttttatacttcttgtcaaagaggtga

SEQ ID NO: 1077 - DNA, 795 bp, Bacillus licheniformis
ttgaaaaaggcaatattgacggtcatagctgtattgacgtcggttgttttgttcgccggctgccaagcggaaaaagggggatcagccaaggggcagtctgaaaaagttcaaattacggtttccgcggctgcgagtctcaaggatgttttaacagaactttcctccgtctatgagaaagaccatccgaatgtctctataaagtttaattttggttcatcgggtgcattgcagcagcagatcgaacagggcgctccggctgatttgtttttttctgccgctgaagacaaatttaatagagtagttgatcaagggttaattgacaaaaaagactctgtcaagctggtcgaaaacagtctggtgctgatcgtgccgaaaggaaaaagtcagcatgtcaacagcttcaaggatttggcggatgacaaagtcgaaaaaattgcgatcggcaaacctgaatcagtgccagccggaaaatacgcaaaagaaacgttgacgaaccttgacgtatggtctaaagtgcaatctaaagtcgtctacagcaaagatgtaaggcaggtcctttcttatatcgaaacaggcaacgcggatgccggaatcgtttaccggacggacgccctttcatcagatcaggtcgagaccgtagagacggcgaaaagcgatctgcatacaccgattgtctatccgctcggaattgtgaaaaatacaaagcacagggaacagtctgaggaattttatcaattcctgcaaagcgaccaagccgtcaaggcgatggaaaagtacggatttaagaagggctga

SEQ ID NO: 1078 - DNA, 657 bp, Bacillus licheniformis
atgcttgaggagttcttatccccaattgaaatttccatccaagtatcagccgcagcgggcatcatcgccgttttgcttggaactgctgcagcgaggctcctggcgaacagaaactttaaaggcaagtccattatcgagacggtgatgatgctgccgctcgttctgccgccgaccgttgtcggattttttttaattgtgatcttcggaaggcagagcgtgatcggacgcttgattgaaaacgtgtttcaagcgccggttatttttacctggtgggcagctgtgatcgccgcggcggttgtcgcgttcccgttaatgtatcagtctgcaaaatccggatttctggctgtcgaccgcgacatcgaggatgcagcgagggttgacggagcaaacgaatggagggtgttcctctttgtcaccgttccccttgcatccaatggaatcatgacggggattgtgctcagctttgcgagggcgcttggcgagtttggcgcaacgctgatgtttgcgggcattatcccgggggtgacgcagacggtgccgacggcgatatacttggcgatcgattcgggcaatatgacgctggcatggatgtgggtcgcctctatcgcgatcatctcgtttttgatgctgttttttgtgcagttcaagcaaaaatag

SEQ ID NO: 1079 - DNA, 3501 bp, Bacillus licheniformis
gtgggagcagtatttttatcaggcagatccgggagtgggaaaacgacctttatcctgaatgaaatcagagaaaaacttcgcgatgaaccgctcggaaaaccgatcatttttctagtcccggatcaaatgacgtttttaatggaatacgagcttagcaaaacaccagatttgggcggcaccatccgcgcccaagtgtacagtttttcacggcttgcctggcgagtgctccaacacaccggaggcatgaaccggccgttcttgacgggaacgggcattcagatgctgctgcggagactgattgaagagcataagggcgagtttaaagtctatcaaaacgcaagcgataaaagcggatttacggagcaggtggaacggatgctgaccgaatttaaacggcactgtctgccgcctcaaagcatccgggatatgatggaagggacaggcaagtcggaatacgaagatgaacggattctttccgataaattgcacgacttatatattttgtacagcaagcttgaggaaaatctggagaatcaatatgttcaatctgaagattatttgacccttttagccgaacagattccgtatgcggaagagattagaaacgctgccgtttacgttgacggatttcaccaattcacgcctcaggagatgagcgtactagaacagctgatggtacatgccgaagagatcacgttttcgctgacggcggataagccgtttacggcaaacagcccgaatgatctccatctgttcaggatgaccgggaaggcgtactatgacctttaccaaaaggcgaaggaactcggccttgatccgtctgaagtgcggctggaagaaacgaaacggcaccggcatcatccggagcttcagcatcttgaacgctattttgatgaacgtcctgcaaaaccgtatcccggacagacggaatcgctccgcatcatgcaggcgtcgaacagaagaaccgagattgaaggaattgcgcgcgagattcattctttaatccgccagggccggttccggcttagggatattgctgtcatcgcccgcaatgttgaagattataaagatacgataaaagaagtttttaaagactgcgaacttccttttttcatagacggcaaggaatcgatgcaaaatcatccgcttattgagctgatccgttcgacgcttgatatcattaaaggaaattggcggtatgaagccgtgttccgctgtgtcaaaacggagcttttattcccggaaggacagccgaaggaacggctgcgcgaacagattgaccagcttgaaaactactgtattgcttatggcattaaaggagacagatggacaagcaaagatccgtttgtttacagaagatacgcttcactggatgaggattttgccaagacagacaaagagattgaaacggaaaatatgctcaatgaactaaagggctggatcgttccgccgattcacaggctgcagaagcgcttgaaaaaagctgaaacagtaagggaaatggccgaagccgtctacctttatcttgaagaagccgatgttccgatgaagcttgaacaggaaaggcggctagccgaagaaggcggaaggattgccgagtcgcgccagcatgagcaagtatgggatgccgttattcaactgttggacgagtttgttgaaatgatgggcacagagcggatttcgtttgcgttatttcagcaaatgatcgaaaccggattggagtctttgaaattcgcgctgattccgcccgcacttgatcaagtgtttatcggcaatatggacctttcaaggatgtacggcacgaaatgtacatttctcatcggtgtaaacgacggcatacttccggcgaggcctgcggatgacggcgtgctttcagacgaggacagggagtggctgaaacgaaacggcgcacagctggcggcaacagggcgagagcagctattggacgagaattttctgatctatatgacgctttcaagcccgtctgaaaagctttatgtctcctatccgatcgctgattcggaagggaagacgctgcttccttcaacagtggtgaaacggctgaatgaactgttcccggacagcgaagaaaagatgctgattcatgaacccgagcagctggacgatgaagcccagcttgaatttctcgtgaataaaggcatcgccttgagccatttggcagggcagctcggcatctggacgaggcagtatgcgatcagcgatgtatggtggagtacatacaactttttaatgaatgagcctgaccgcatcttttctcaaaacatcctgtccagcctgtttttcagaaacaaggtcgaaaacctaaaccggcatgtgagccgcgatttatacggggagcacattcagggaagcgtgtcgcggatggagacgttcaaggcctgtccgttttcccattttgcttcgcacggcttaaagctgaaggaacgccaatttttcaagcttgaagctccggatatcggtcagctgttccactctgcgctgaagctgatttcagaccggcttcacgagcttaaactggattggcgcgacttaacgaaagcccagtgcgagactttgtcaagcgatgcagttgaacggcttgcgcctaaactgcaaaaggagattctgctcagttcgaaccgtcatcattatgtgaagcagaagctgcaaaaaatcattgccagggtatcgggcattttaagtgagcatgcaaaagcaagcggctttgcccccgtcggcatagagctcggattcggagggaaaggtccgcttcctccaatgcgtttcaccttgaagaacggttgcacgatggagcttgtcggccggatcgacagagtggataaagcggagagctcaaaagggttgctgcttaggattgttgattataaatcaagcgataaaggcctcgatttggccgaggtgtattacgggcttgccctgcaaatgctgacatatctcgatttgtcgatcacgcattcaaccgattggctcggcatgaaagcatccccggcaggcgtgctctattttcatgtgcacgatccaatgatccaggcttcagtgccgctcggccttgatgaaatagaaaaagagattttcaaaaagttcaagatgaaagggctgctcctgggagaccaggaagcggtcaagctgatggacaccaccctggaacaaggcaggtcgaatattatcagcgccggtttgaaaaaagacggctcgctccgttcggattctgacgttgttgcagaagaggattttcatgtattgaggcgtcatatccgccggacatttcagcaggccggcgaggagatcacagacggcaaagtgtcgatcgagccttacaagctaaaagaccggacaccgtgcacatattgttcataccggtcattctgccagtttgacgaatcgcttgaggaaaacgaataccgaatattaaaacctgaaaaagacagcgtgatattggagcggctgaaaaaggaggatgaggcagatggagatttctaa

SEQ ID NO: 1080 - DNA, 3693 bp, Bacillus licheniformis
atggagatttctaaaccgaagggcagcacctggactgatgaccaatggaaggcgattgtctcatccggccgggacattttagttgcggcagcggccggttccggaaaaacggccgtgctggttgaacggatcattcggaaaataacggatcaggaacgaccggtagatgtcgacaggctgctcgtcgtcacctttacaaatgcatctgcggctgaaatgaagcacaggatcggcgaagcgctcgaaaaagagcttgccgaaaatccgggatcgcttcatttgcgccgacagcttgctttattaaacaaagcgagcatatcaacattgcattcattctgtcttcaagtcatccgcaaatattactatttgatcgatgtcgatccggctttccggatcgccgatcagacggaaggcgagctgctcggcgatgaggtgctggatgaactgtttgaagaagaatacaaaaaaggcaatcctgccttttttgaacttgtagacagatatacgacagaccgtcatgacctcgacctgcagcatcttgtcaagcgggtctacgaattttcccgttcgcatcccgatccggagggctggcttcactcattggctgaactgtatgacgcggcttcggatacgaaggttgaggctctgccgttttattcttacattaaagaagacatcgcactcgttctggaaggtatgcggcaaaagctgacgcgcgcgcttgatttgacgaagcagcccggggggcctgctccgcgcgccgaaaattttctcgatgatttagcgcagatcgacaggctgattcagcagcaggatgatttttcggccctgcatgagcttgtaccgaccgtttcgtttcaacgattgaagccatgcaaaggtgatgagtacgatcccagattggttgatgaggcggcagacctccgcaacagtgcgaaaaagcagcttgaaaagctgaaaagcgattatttttcgcgaactccggagcagcaccttgagagcctgagggaaatgaagcctgtcattcagacgcttgtccagctcgtgctggagtatggcaggcggtttgcggaagcgaaaaaggaaaaggcgatcgtcgatttttcagaccttgaacacgactgccttgcgattttatccgtgaaaaatccggcgggcgaggccgtgccgagcgaagcggcgaagttttaccgccatcagttccacgaagtgcttgttgatgaataccaggatacgaacctggtccaggaagcgattttaaagctcgtcgccaaagaggagcatgaggggaacctgtttatggtgggcgatgtcaagcagtcgatttaccggttccgcctggctgagccgcttttgttcctctcgaaatataaacgctttacagacgatggctcgggttccggccagaaaatcgatttaaataaaaacttcagaagccgttcagatattttggacagcacgaactttttattcaaacagctcatgggagaaaaagtcggggaagtcgagtatgacgaacaagccgaattgaagctcggcgcctcttatccgccgaacgaagcgacaaaaacggagcttctgctcatcgaaaccccgagcggcgcgccgggtgaagaggctgaagagcttgaggcggtccagcttgaagcaagagcgatggccgggcagatccgcaggctgattacagaaaaatttcaagtatatgatgccaaagcgaaagcgtcgcgaaacatccagtaccgtgatatcgtggtgcttttgcggtcgatgccttgggcgcctcaaattatggacgagtttaaacagcagggaatacccgtatacgcgaacctctcaactggttattttgaggcgacagaagtatcggtcacactgtctttattaaaaatcatcgataatgcctatcaggacatcccgcttgcgtccgttctcagatcgcctgttgtgggtcttgatgagaatgagctttccttgatcagaatcaaagataaaaaagcgccgttttacgaagccatgaaagcgtaccttgctgcagcagacggcgatgagaggctcagcgaaaagcttcgccgctttgacggtctgctcaagaagtggagagcttatgcgaaaaaccactctgtagcagagctgatctgggaaatctaccgggatacgaagtatttggattatgtcggcggaatgccgggcggaaaacagcggcaggccaatttgcgcgcgctttacgacagggcgagatcctatgaagcgacatcattccgcggcttgttccgctttttaagatttattgagcggatgcaggagcggggcgatgacctcggaacggcaagggctctaagcgaacaggaagacgttgttcggctgatgacgatccactcaagcaaagggcttgaatttcctgtcgtatttaccgccggtctcggacggaattttaatatgatggacttgaacaaatcttatctgctggataaagagctcggttttggaacgaagtttatccatccgaagtggcggatcagctatccgacgctgccgcttatcgcgatgaagaaaaaactccgccgcgagcttttatcagaggagctgcgcgtcttgtatgtcgcccttacccgggccaaggaaaagctgtacctggtcgggacggcgaaggataaagaaaagctgcttgccgactggcggacacaagcggccgggtccgagtggctgctcccggattatgaacggtttcaggcaaaatcatatctggatttcatcggacctgctttgatgaggcacagagatatggatgaatccggggcgccgcctgtgattgatgagatccgcgaacatccggcgcgctttcaggtcagctggctgtccgccgcggatctacaagctgaggctgtcgatcaggccggtgaagaaagacacgaccggctcgtccaaattcaaatgggccatgcgattgaaggcgcctttgaatatgagcagcaagtcagagaacgactggcatggtcatatccatacaaggacgccgccaaagtcagaacaaaacaatctgtctcagaaatgaaacggcagaaggaatacgaggatgaatacggcgaccgctcgcttattcgtccatcacaggaggctctcctgtttaaacggccgtcctttatgatggcaaaaggcctgaccgcagccgaacgggggacggcgatgcacaccgtcatgcagcatattccgctgacccgtacgcctgaaaagaatgagctcagccgccttctagacaggcttgttgagaaagagctgttaacagaagaccagcgggcagcgattgaagaagacgacattcttgcattctttgatacggaaatcggacaaaagcttttcggcgcccgccgcgtcgaacgggaggttccctttaacatgacgctgtccgctaaagaggtttatccggatcttgagtcagccgatgaacctgttttgatacagggaattatcgactgcctattcgagacggaggacggtttttaccttctagattacaaaaccgaccggatacacggaaagtaccggaacggcttcgaaggggccgagccgattttaagaaaacgttacgaaacacaaattcagctttacgcacgagccgttgaaacgatgattaaaatgccgctcaaagggcgcgcgctgtacttttttgacggaggacacgtgctcttattttaa

SEQ ID NO: 1081 - DNA, 1182 bp, Bacillus licheniformis
atgcgaattttacatacagcggactggcatttgggaaaaacgcttgaagggagaagccgactgaaagaacaggaggattttcttgaagagctcgcaaggatcgtaaaagatgaaaagatcgacgctgttatcatggccggagacgcttttgacacagtgaacccgcctgcactggctgaacagcttttttatgaaagcctctcagccttgtctgacaaaggaaaccgtccggtcgtcgtgattgccggcaatcatgacaatccggaccgcctttccgcggcctctccgttaacgacagaccacggcatccacttgatcgggtacccgaggactgcgccggttgacatagaagtcgcttctagtggggagatcttgtcagtcgcggcgctcgcctatccttccgagtccagactgaatgaagtgctgtcggagacatttgatgaaaagctgctgcgcgaccagtatgatgagaaaatcaagcagacctttcagcgtatgtgcagcaaggcgagaaaggacgcggtgcagattgcggcaagccatatctatgtggccggcggcagccagacggattccgagcggccgatcgaagtcggaggcgcatatacggtcgctgcggaaagcctgccggaaaacgccgcatatgtggcgctcgggcatcttcatcgcccgcagacgatcaaaagggcccgcacgcttgccagatattcaggctcaccgcttgcctacagcttttccgaagcgggatacgcaaaatcagtcaccattgtcgaagccgcacccggtcaaacggcatcatgggaagaggtccatttgacgagtggaaaaccgctcgtcaaatggaaggcggaaaaagggatgtcccaagtgtacagctggctggaggaagagcgggataaaaacgcgtggatcgatcttgaaatccatctgacagaccagctgtcgattgaagagattcaccgattgagaaaagcgcgtcaaggcatcatccatatacgtccggtttttgaggaagccgcatcggctgaagagaagtcccggtccagaaacgttccgattgaagaacggtttaaagcgttttatgaaagacaaaccggcggagcggttcccgatgaggaaaccgtcaagctgtttctggaactcgcctcaggatcggaacaggaagagggggatgaaacatga

SEQ ID NO: 1082 - DNA, 3393 bp, Bacillus licheniformis
atgaagccgatttctctgtctattaagggcctgcacagtttcaggcaggagcaggtgatcgattttgagcgcctgtgcgatgccggtgtattcggcatcttcgggccgaccggaagcggcaagtcgtcgattcttgatgcgatgactcttgctttgtacgggaaagtggagcgggccgccaataatacgcacggcattttgaaccatgccgaagatgagcttgccgtatcgtttacgtttaagctgcagacaggccatgagacggcttataaagtggaacgggtctttaagcggacagacgccgtcaaggtcaaaacgtcgatatgccgctttattgaaatgaaagaggaacaaatcgtcctggccgataaagcgaatgaagtaaaccgaaaaatcgaagagctgctgggcttgacgatcgacgattttacaagggcagtcgtcctgccgcaaggaaaattcgccgaatttctttccttgaaaggagcggagcgaaggcagatgcttcagcgcctgttcaaccttgaacaatacggggacaggctcgtcaaaaaactaaagaaacaggcgcaaacagctcagtccagaaaaaacgagatgcttgccgagcaggctggattgggcgatgcgggggaagaggcgctgaagctggcggaacagcatctcgaagaagccgaaacccttttgcaaagcaagaggcgcgaacgagatgcggaagcgcagcgctttgcggagtaccaggaaatttggaatctgcagcaagaaaaagaaagctatctaaaaaaagaggcggagcttttaaagaaaaaggaacagatccgggaaaaagaaagccgcctgcatctcgctgaaacggcaaatacgctcaagccttatgcagacgcctttctggcagcgcgggaagatgccgagcgcgcacttcgggaagaaaaacaagcgcgggaacaattagaacaatacgaagagcttcataaaaaaacagagtgcgagtacgagaatttcaggcgtcataaaaatgaaaaagaaccggagcttctcaagcaagaagaacagctcaccgctttgaaggaaattgaaaacaagcggcttgccgcacaggcagaagctgagaaaaagcagcgggaacagcgcttgaaagaagaggaaatcaagcatgcggcagacgaactggccaaggtgaaaagcctgcttgaacgcgggacagccaagcaaaatcagctgaaagcggagctgaaatctgtccaggtatccagcgaagagcgcaaaaactgccggaaggccaatcagcttgcttttcacattcagcagcttaacagcgatgccgctttagaaaaaaaacggctcgatcagcaggaggcgctgatcaaagagctccggcaagaacagcaagcggtggatcagaaggtgaaggatgaaaccgaacgcatccaggcattgtttgccgctgtcgaacgagcgtatgcgctcgtttgcgaaacggacagatcgctctctgagaccgtccgtctcgcgactcaaaagaaagaagagattgtcgcaaaacggaaacaggcaaaccgtgatcagctggcaatcgaactggcaaagcagctcaaagagggtgagccttgtccggtctgcgggtctgtacatcatgaaatgcccgcgggtgtcggtacggaaagcccgtcctttaaagagacggaatccgaactggagaaaacggaagccatcatcgcagaagccggcgcgctggctcaggagtttctctcagccaaagtggcgctcgaacagcagtccggccacctgatgagcgaatgcccgtttttagtcaaaagcaaacacgaactgcctgaaactgctgcatcgctagaagaaggcaccattcccgaacggttcagccgcatcagctttgaatggaaaggaatcagacaggatctcgccgagacaaaaagccggatgtcaaagctccttcacacatataaagagctctgcaaaaaacgcgaccaaatcagcgaacgcctcagccatgaagaaaaagagcaaaacaggcttcaaaaccgcgtccgcgaattgaatgacgagttaaatgaacgccaaaaaagcttcggcgaacaattcggcggcctctcttatgaacaggctgaaaaatggcaaaaaacgattgaagaaaaagatctggccgcagaggaattcgaaaagcgaatcgaaacgagcgtcgaatttctcacggaacatgaacagcaaaaagagaagctcaccgagcgcttgtttgcgcttgataaagaaaagcttgaccttcattatgcggtcgaaagcctcaaaaaagacataaacgattatcaaaaagagctgacgggctatcccgatacagctgcgatcgacgaaaagcttcaagacgtgaaaacgcagttggccaagctgcatgagcaggaacagacgctttacggacggctcaaggagaccgaatccgaagtcagccgtttaagaggacagactaaagggtgtgagctcgctttgcgcgaagcggaagcaaggcttgcgaaagcggcggacatctggcaggaaaaagccggaggcacaccgttcgaaaaggcctctgaagtgaaagcgagcattttggaccgcgatgagctttcccggctgaaagaagacattcaactgtattgggatcacacaaagcagtgcgagtccaatatcaagcgaattacggaaaagcttgacggcagatctgtttctgaagagaattgggaaaaagccgcagtcacgaaggaccaggcggaggaggcattcagcaaagctctagaggaaaggggagcggccggcaaagctctcgccgtcatccgcgagaaccataaaaggtttaaggagcttgaaacatcgttggctgaatggcagacatacatcgaccgccttgataagctccaagccgtctttaaaggaaacagctttgttgaatacttggcagaagagcagcttgaaagcgtcacaagagacgcatctgcaagactcggagaactgacaaggcagcggtatgcaattgaagtcgactcagaaggcggctttgtgatgagggacgatgccaacggcggagtcaagcgccctgttacgagtctgtcaggcggggagacatttctgacttcgcttgcgctggcgcttgcactctcggcgcagattcagcttcgcggagagtatccgctccaattcttctttttggacgaaggatttggcacgctggatcaggatttgctggatacggtcgtgactgcgttggagaagcttcagtctgacaatctgtcggtcggtgtgatcagccatgttcaggaacttcgggcaaggctgccgaaaaagctgattgtgcatccggctgaaccaagcggcaaaggtacagccgtatcgcttgaaatgatttaa

SEQ ID NO: 1083 - DNA, 219 bp, Bacillus licheniformis
atgccagccattgtcggacccattaaaatcaatgaaatctcaggaggagtagtgaatttcggcgattctttttatctatctccaaaaagcacttcaaagtctgcgctcggttctggtgctggtaacactggagatttccttatcgtcaataatggtataaacgcgacaaattatatagacccggatgtaagcgaccagaatgttgtcggaaatgcataa

SEQ ID NO: 1084 - DNA, 387 bp, Bacillus licheniformis
atgattctcagaacgtccaaagtgaagtttttaaaagtacactctgtcggaataagcagcacgctgcaaatcggagacacggaagagcagtttctcaagtcaaaagttctcgccgttcaaagatacctttctcttttttacggaaatgaagggtcatttaaacaggatgattttcagcttttcaggcagccgatcccgcaacttctcccagaaaccggcgtatgctcggcttttttccatgagatccccttcatccgtgtaagggcgattaaaatcaacggtgtatcatcatcctccgttgctcaggtcggctcaacgcgccgcatcaatgccgactcgagagtcaaacatatcagaaagcttcctcccgcaaggaactcacaatag

SEQ ID NO: 1085 - DNA, 180 bp, Bacillus licheniformis
atgaattttaccgttgtgaaccgctgttttgatgtaggcaatattgtgatcaccggtgtgtccacttcttctgtttttctggtcggtgatacggattgcatttctctgtcatcgatttttgatacaccgcctgaatctctcattgtcgggccgtttgtcccgctggcgccggaatcatga

SEQ ID NO: 1086 - DNA, 606 bp, Bacillus licheniformis
atgaaacaaagcaatccacagaactggtatgtgtatttgcagcagcaggctgcgcaaatccagaggctcgaaagtcagattgccgtattgcattcggagttgaaccagctgaaagaaaatcccggcacccggatcgaccggatcgaatacaaatttgatcaactaaaaattgaacgcttggacggaacgctaaatatcggactcaatcctgcggacccggataatgtcgaaaactttgaaatcagccaacagccgccgggtatcggaatgcttcagcaggagcttgacagccagctgatgcagcaaacgagacagcttgtcgatgcctatttaaacgaagagacccctcgtttgctggaacagcttgaagaccggtatgacagcaaactggacgatacaaaccgccaccacattatcgaagacatcagaaagcaaatcgacagccgtatccgctactacgtcaaacatgtaaagcctgacggaaacatccagccccgcgagcatgcagaacggctggccgactatgtcaaacgagatatcgcacgggcaatcgagcactttctcaaatcaatacctgacgaaatgaaaggaaatgaaaacgaatga

SEQ ID NO: 1087 - DNA, 243 bp, Bacillus licheniformis
atgaacttttatatcaatcaaacaatacaaatcaattatttaagagttgaaggaatcagcaactcttccgtattgcagattggaagcgccggttcaatcaaaacacttgccaacctgtacaataccggaagctacacagaacccgcacctccggtaaccggcgaagtctttgacgacgcttttggagatgggactcaaccgactctcgttcctcttcacgctccttctgttacagtaccatag

SEQ ID NO: 1088 - DNA, 222 bp, Bacillus licheniformis
atgccagctattgtcggagcttttaaagtaaatgccgtcggtacgagcggcgttgttcatgtcggagactgcatcacgatttctccttatgcagaagttaaaacatttgcgggtgccggcagcttcaataccggagacggactcagagtatacaaccagaacagcatcaccaacacatatgacaacgatgtaatcgatcagccggtcgcaggcaacctgtag

SEQ ID NO: 1089 - DNA, 294 bp, Bacillus licheniformis
atgtattttcaattgaatccgatatcaatcgctgcagccctgctgttctttgcggccgcatatgcagtcggaataaaaaagcaaacctggatattgcgggggtttcgccgggaaagggtaagggatcaggttaagctggcgaaaatcgctgggtatttctttttgaacagcggatttttgttatttttaaatggggttgtttacatcccgtatcaagagtcttttacaccttcagccattcttgcctacggtatttgcacgatgatttatgttcaaaaaacaatggccgaatag

SEQ ID NO: 1090 - DNA, 183 bp, Bacillus licheniformis
atgatgaacaataaaattgaagcaaaaagactggccttatttgaagctgccgaaaagttcggcatcaactccaaagaggccattcgatgcagtcaggaattggacaacttgctgaatcaaagaatgcaaaaggatgataactgcgtgcatgcggaagaaagaaaaggccgccacacgtcatga

SEQ ID NO: 1091 - DNA, 1074 bp, Bacillus licheniformis
atgagtgccactgccttgccggcctttaggctgcacattcatccgaagcatctgcttgagttgaaaaaagacgtctggagtgatgaagccgttcccggcatgctcttgaccggttcagcaaagacgcctgtcgcagtgtcatacagaggggcccacacccgcaaactgacgaaaaaatcctatttcattcaatatccggacaataaagaaaaggctgcgtttcatttgaacgcggaatatcatgatccgtctttcatcagaaacaggctttcctttcatttttttgaacaaatcggcgtccttgcgccagcagcatcacacgttttcctttatatcaatgaaaaaaaagaaggcatctatttaaaaatcgaatctgttgacgatcatttcttaaagaggagaaatttagaaaggggggccatttattatgccgttgatgacgatgctaatttttctctgctgagttccttcaataaaaaggctaagcaaaatctcatgcagggatacgaaagaaaaacgggttcaagccgccacgatgactacctccatgagtttatctactttatcaataccgccaaagacgacatatttgaaaaagaaatcaaacgctatctcgatgtcaaacaatatttgctgtggctcatcggcgccgtctgcacccaaaatttcgacggctttgtccataattacgcgctttatttaaacggtcgcacaaaaacgtttcaaatcattccatgggattatgacgcgacatggggacggaatattcacggggaagaaatggagcacaaccggattccggcgaaaggctataatacgctgtctgcaaggctgctcgacatcccggcttttcaatcccaatactttaatttaatgaaaaatgtcttgcaccgccaatttacaatcagccggctttcgcggtatgcggtaaactggcacgagacaatcgcgccttttcttgaacatgatccttatacaaccgtcacatacagccggctcgaagatgagcaaaaacaaatttttcatttcatcgatcagaggaagcggttcctgcttttcgagctttcccgataa

SEQ ID NO: 1092 - DNA, 507 bp, Bacillus licheniformis
atgagtggtgtccatgatcatgacattaaaaaggcagtagaccagctgaagagcgaaggcagagaccattatttagaccgggaacccgaagaatacgccggctctggaaaagagcggcgtccgcataacatttgggatctttgggggggaataaagccggacagaagcaaaaaacatcataaaagcaagaagcatgacgactatgaaaagccggataaaagcaaaaagcccgacaaaagcaagaaacccgatgactgcaaaaagcctgacaaaagcaagaaacccgatgactgcaaaaagcctgacaaaagcaagaaaccagacgactgtaagaagcctgacaaaagcaaaaaacatcacgactgcaaaaaacgcgacaaatgcggccgcaaacgccccgaccatcatcgctgcaagaagactcaccatcataaaagaggcggctatgaaaccattacaaaatggtctgacggaaatctgaccgaggtcatctaccggaaaaaataa

SEQ ID NO: 1093 - DNA, 906 bp, Bacillus licheniformis
atgaagtttgcgacagcaaagctgcacagccgtacatttgtagggcttgtcatggatgagaagataatggatttgcaaaaggcggaaaaaaagctgtttgagcttgaaacgatacctgaaacgcttatcgaatgcgtaagcgagggagagaagtttgtccgccatgtcgaacagctagtggaatggtcaaagaagaaaaacagcgaagagagcggttcgtatatttatccgctgtcagacgtcgatttgcttgcaccgattcccgaaccgcggaaaaatgtgatctgcatcggaaaaaattatcgggatcatgcgattgaaatgggaagtgaagcagatattcccgaacatatcatggtgtttacaaaagcgccgacttcggtcatcggccacatggaagggattgatgcccacgaaggcgtgacagaggcgctcgattatgaaggcgagctcgcggttgtcatcggcaaaacgggaaaaaacatcccgaaagctgaagcgctcgactatgtgttcggctatacgatcattaacgatgtgacggcgcgcgatctgcaaaagaggcacaagcagttttttatcggcaaaagccttgatgcgacctgcccgatggggccgtttcttgtacataaatcaatgattgaagaccccggtgacctgaaggtggagacgagagtgaacggcgaactccgccagtcggggagcacaaaggacatgatttttccgattgcggaaatgatcgaaacgctgtccaaaggaatgacgcttgaagcgggggatattatcgcaaccggtacgccgtcaggagtcggcaaaggctttaatccgccgaagttcctccgaaaaggcgatcaggtcgacattacgatcgaaccgatcggaacgctttccaatccagttaaataa

SEQ ID NO: 1094 - DNA, 1053 bp, Bacillus licheniformis
ttgaatttatcagcattaggcatcaaatatatcatggaagctttaaaggatgaggaaggtctggttttgggaaggatcgcccttgagcataaaaggttgtaccgggtatggacggaagaaggtcagtggcttgccgaaatctccggcaggctgcggtttgaagtggaaagccgcggagactaccccgctgtcggcgattgggtgtatatgcgcccacgcggcggcgaaaagaagggaatcatcacggaggtcgttccccgattcagcaaattttcgcgcaaagcggcgggtgagccggcggaggaacagatcaccgcagcaaacgtcaatacgatctttctcgtcaatgcgctcggtctggattttaatgtgagaagaatcgaacgctacttgctgctggcatgggaaagcggagccaatcccgtcatcgtcttaagcaaagcggacattgctgaccggattgaagaaaaggtgcgccaggcggagtccgtggcattcggggtgccgattcacgtcatcagcgctcatgaaggcagtgggatggatgagctgaaagcgtatgtgaaacaaggggaaaccgtcgcccttttagggtcgtcaggcgtcggaaaatcaacgatcatcaacttttttctgaaggaagacaggcaagccgtccaatccgttcgtgaagatgatgacaaagggcggcatacgacgacgcacagggagatgtttatgctgcctgaaggcgggcttttaatcgatacgccggggatgcgggccttagagctttgggaatcggaagaaggattcaagcagagtttcagcgatattgaccagcttgcacaaaactgccgattttcagactgcctgcatcaaacagaacccggctgctccgtgcgggaggcgctggctgacgggaggctggatgccggccggttccaaagctacctgaaattaaaaaaagagctcgaatacctcgaaagaaaaacggataaacgggcgatgcagcaggaaaaaaagcggtggaaacagataacgaaaagcatgaaaaagaacaaaaacaaataa

SEQ ID NO: 1095 - DNA, 357 bp, Bacillus licheniformis
atgacgcatatgcatatcacgtcttgggtgatcgcgctcattttagtgttcgttgcttacgggctttactcatctggaaacagcaaaggcgcaaaaattacacatatgattctccgcttattctatattatcgttatcattaccggggcgcagctttttttaaagttcacggcatggaacggagaatacatagcgaaggccttgctcggcctcatcaccatcggattcatggaaatgcttttaatccgcaggaaaaacggaaaagcggccactgggatctggatcggctttattgtcgttctgctcttgacggttgtgcttggactccggcttccgctgggctttaaagtgttttaa

SEQ ID NO: 1096 - DNA, 567 bp, Bacillus licheniformis
atggacaccgaacgccagaaacgactttatgccgaaaagcgcaaatggatttacggcaaaattttaatggaagacgggatctgcctgattgaaaatgaagaaggagatttgcttttggttgaaagcctgaacagccccggagttttcatcagcatagacggagaatggcaaaaagccgaactgtttgatcaattcgccgtaacggaaaaaccggagaccgtgaagctgacaggaggagaaccgatccgttatctgaaaacggtaaaacaggcattcctcgaatttttgaacgatctggaagacggacagttctattcttttttggatcagctgaacagcctcggcttttccgtctttgactgcgtcttcgcctataacggcctgagcttttggcccgagaaaaaggatgtcaagggcgtttcgttttatcagttttctcatgatatgaaacaatgcgccctgcagcatcattacgaaagaaaagaggagtggaaggacagatttgaatggaccgcttcagatggggaacgaatcgttatgatttcaacattcaagccgccgacataa

SEQ ID NO: 1097 - DNA, 1842 bp, Bacillus licheniformis
atgtgtggaataacggggtgggtcgattttaagaagccgcttgtccgagagcagtcaatcatggagaagatgactgatacgctttcgaaaagaggacctgatgatacgaatatttggggaaagcgccatgttttattcggacataaacgcttggcagttgtggatctggaaggcggcagacagccgatgacccgcacacatcaaggatatgattatacgatttgctataatggcgagctctataatacggaggatttgcgaaaagagcttaggcggcgggggcatcaattcaagagccactcagatacagaggttttgcttcattcatacatggaatggaaagaggaatgcatcgacaggctgaacggaatttttgcatttgcggtatgggatgaaaagcgggatcttctttttgcggcacgcgaccggcttggtgttaaaccgttcttttacaccgaacagggctcatcatttttgttcggatctgaaatcaaagccatcctcgctcatcctgaagtgaaagcaaaggtagaccgttcagggctggcagaaattttcggcctcggcccgtcacgatcgccggggagcggtgtttttaaaggagtaaaggagatccgcccggggcatgcgatgattttctcaaaagacggtttaacggtttggcgctactggaatgtgaaaagcgagaagcatacggacagctttgacgaaacggtggaaaatgtgcggtcgctgtttcaggacgccgttacaaggcagcttgtgtctgatgtgccggtatgtacgtttttatctggaggggtcgattcgagcgccattaccgcaacggccgccaagcatttcgagagagaagggaaggcgccccttcatacgttttcgatcgattatgaagacaatgagcaatattttacgtcaagctcatttcagccaaacgccgacggcccgtggattaaaaaaatgtccgatgcattcggaacggttcatcacaattgcgtgatatcccaggaggagctggctgcctatttggaagaagccgtactggttcgggatttgccggggatggctgatgtcgattcttccctgctatggttctgccgcgagattaaaaaagactttgtcgtgagcctttcaggggaatgcgcggacgaaattttcggcggctatccttggttccattcggcagaagatgtgaaaggtttcccatggatgagatcaatggaagaacggatcggacttctgcaggacggctggcagaaaaagctgaacctcagcgaatatgtgaaggcaaaatatgaggaaacagttaaagaaacaccgctgctggaaggagaaacgggtgcggagaaacgaaggagagagctgttttacttaaatatgctctggtttatgacaacgctcttggatcgaaaagacagaatgagcatgggtgcgagcctcgaggtcagggttccgtttgcagatcacaggcttgtcgagtatgtctggaatattccatgggatgtcaaaatgcatggcagccgtgaaaaaggcatcttccgcaaggcgctggaaggcattttgcctgatgaagtgctgtaccgcaaaaaaagcccatatccgaaaacgcaccacccggcctatacgaaagccgtgatacgctggctggagtcattgctggagcaaaaagactcggcgctctatgctttcttagaaaagaaaaaactggagcggctgattgagacggaaggtgcatcatttcaagttccgtggtacggacaattgatgaagggaccgcagctgatcgcccaccttgcccaaatccatacttggtttgaaagttatcgaattgatatcgaggaataa

SEQ ID NO: 1098 - DNA, 1278 bp, Bacillus licheniformis
atgacatgggtagccatcggcactctgctcgtcttttttatgcacgccggttttgcgatggttgaatcaggctttacaagagctaaaaacacgttaaacattttaatgaaaaacttcctgacgatctctatcggctccatcctttatttcttcgccggatacgcgttcatgttcggggacagcgccggcgggttcatcggcacaagcggttttgctctagcgggtgatcaggatgtcggatttttcgtctttcaggccgtgtttgccgctacgtgcgccaccattatttccggcgctgtcgctgaacggatgaagcttggcagctacatgatcttgacgctgtttatgaccggtctcatctatccggttgtcggccattggacttggggggaaggctggctgtacgacctcggatttgtcgattttgccggatcttcaatcgttcacttgacaggcgctgcgggcgcagttgcggctgtcatgtttctcgggccgcggatcggaaaatatacaaacggcaaggtcaacgccattccagggcacagcattccgctgggcgctctcggcgtctttatcctgtggttcggctggtttgggttcaacggcggaagcacgcttgcggctgatcccgccgccgtcccgcacgtcatcaccacaacccttttagcggcatcgggcggagtcgtcagctcggcgctgttcacttatttccgctacggcaggatcgatccttccctgacgctgaacggcgcgctaggcggccttgtcggaattaccgcgggcgcggacggcgtttcatttacaggctcgatattgatcggattcatcgccggtgtcattttagttgtcggcgttcagtttatcgaccaggtgctgaagcttgacgatcccgtcggcgcccttgccgttcacggtatttgcggtgtttgggggacgcttgcagtcgggcttttcaatacatcgagcggtctcttttacggaggaggagccgcacagcttggcattcaagccgtcggcattttgtcgatcgcggcctggaccctcgctgccacatacgctgtcgccgcggcaatgaaagccctcgctccgatcagggtatcaaaagaggaggaaatttccggactagattatgccgaacacggttcttccgcgtacgagtataaagaaagctacatcgatcaggacgatgttgacgtaagctccgctttcggaacggatcttgtctcacggctcaacaatttaaagcctggaccttcttccaaaactgaacaggtgtga

SEQ ID NO: 1099 - DNA, 390 bp, Bacillus licheniformis
gtgaaaaaaatcgaaacgattatacgccccgaacagttcccccgcctccgcaaaaagcttgaagaggttggcataaacggattaaccgtctcagaggttgccggctgcggccagcagcgggggaagcaggctctgtttcgcggcacctcctacgaaatcaagctgctgcctaaagtgaaagtcgaaatggtgattgaatcggagagcgttgatgaaattatcaaatcgaaagcacatgttcgacaaatacggtcggcgacggaaaaatctttgtccttccaattgaaaacgcgatccgaatccggacaggggaatcaggaaaggaagcgattgtctaaaacgaccgattccctcctgctctcttttagtcgatactttaagaaagggtga

SEQ ID NO: 1100 - DNA, 1341 bp, Bacillus licheniformis
atgaaaaaaacagcacctcaaaacctctctttattcgcattgacttggcctatctttatcgaggtttcattatatatgttaatgggcaacgcagataccctgatgctcagccaatattccgacgacagcgtggcagccgtcggcgtcagcaaccaaatgctgaacttgatcattgtgatgttcggttttatcgcaacaggaacaaccgtcattatttctcaatttttaggggcgcggcaaaaagccgaagcaatggaagtcggctatgtttccatcagcgccaattttatcatcagtctattcatcagtgcggcgatttatatatttgccaaaccgcttttattgatgatgggcctttccgccaacctgcttgctgaagccggcatctttctccagatcgtcggcggactgtcctttgtccaagcgctcattatgacgttcagcgccattttgaaaagctacgggtatacaaaggacacaatggttgtaaccatcggcatgaatatcctgaacatcgccggcaactatcttgtcatattcggaccgttcggctttccggttttaggcgtggccggcgtggcaatgtccacttcaatcgcgcgcatcatcggccttttggcgatcgctctgctcgtcaaaaagcgcgtcggcatgccgctgttgtccaaacggctgtttgtcttaaagaaaagtcacctgaaaaaactgctgaaaatcgggattccttcagcaggggagcagctgtcatataacgcgtcacagatgattgtcacctattttatcacgctgatgggcgcgcaggcgctgacaacaaaagtctatacccaaaatttgatgatgtttatcatgcttttcggcacagcgatcagccagggaacgcaaatcttaatcggacgccatatcggcgcgaagcaatttgatgaagcatacagccgctgcctgaaaagcctgtggtgggctctggccattacaacatttacttccgttctcttcgctgtgttttcaaaacagctgatcggcattttcagcagcaatcccgatattatcgcaacggccagtatactgatccttttgacgattatcttggagcccggccgctcgtttaacgtggtcatcattaattctctcagagctgcgggagacgcgaaatatccggtttatatggcgattgtctcgatgtggggaatcggacttccgatcgcttacattttcggcattcagctcggattcggcctggcgggaatttggttttccttcatcgccgacgaatgggtcaggggaattttaatgtacagaagatggagatctaaaatgtggcttcaaaaaggatttgcagcataa

SEQ ID NO: 1101 - DNA, 864 bp, Bacillus licheniformis
atggaacatatcatctttacaattccgccgctccctgtgttgattaccggcggagaagggctgttcaaaagaggggaaaagcatgtgaggcgtgaatattccgtgtttgatctcttatatgtgatacagggggaactatttttgactgaggacggcgagccccatcagatccgggaaggggaatacatcatccttattccggggctcgagcattatggccaccgcggctgtcaagacgatacccgctatttttggctgcactttcaggagccgtcctatggcttcgcgcagcagggaggtgagaactggactgaactcaagctgaggaaggggacatttgaaacgccgacattgtatcatttaaagattccgagaaagggaaagatcgaccaaaaagcgtttatcgaacagcagtttaggcgtttgattgacgattccgcccaaaattccgacctgccgcttcgcaggcagctcttgttcgaagagctgctgattcacttgcagaaggaggcgttccatattccttcggcgagtgagcgtgtagcatccgaagcacagcattacatcgaccgccattataaggagaagctcagcatggagcagctctcggctgcccttcattatcaccaggactacattacccgctgcatgcaaaaggtgtttggcatcacaccgggccaatatgccaataaggcgaaagtttttgaagcgaagcggctcctctcttctacaaacgacaaaatgtcatcgattgccgaacaagtcggaatcgatgatccgacctatttctcaaagctgtttaaacaaatagaagggatttcgcccgttgaatacagaaagatgatgaagcgaaatattgagtga

SEQ ID NO: 1102 - DNA, 558 bp, Bacillus licheniformis
ttggcatccatcaatggtgaaaaagtgaaattgcgtacgatcacaatggatgacctgcccggattatggagaatgatttacggaactaaaaaccctgaatggaaaaaatgggatgccccttattttccgcttcagcccgaaccgtttcaatactttatcgattcttttgtgccggctttaaaagaaaaaccgccgcgctatttggcgatagagatcggcggagagctgaaaggaaccgtttcttactattgggaatcccggccgacacgctggctggaatgcgggatcggcatctatgatccgcggttttggaacgggggatacggtacggaagccgtagaattatggatcggcttcctgtttgaaaacgtcgatgtgccgagaatcggaatgacgacgtggtcaggcaacaggcggatgatgaggtgcgccgaaaaagccggatttaagatggaaggccggattcgcaaagtcagatattatgacggagtctattacgattcaatcagatacggaatcctgcgggaggagtgggagctgatttgccgcggaagctga

SEQ ID NO: 1103 - DNA, 1044 bp, Bacillus licheniformis
atgaaaaaaaccatttatgatgtagcggaagcggccggcgtttcgatttccacggtttcccgggtgatcaacaataccgggaggatcagcaggtcgacaaggcaaagagtgcatgccgtcatgaaagagctcgattaccagccgaatgttcacgcttctgcgcttaccggaaagcgcacgaacattatcggcctgttgacgcccgatattgcaaacccgtttttcggcgagcttgccaaaagtgttgaagagcgggcgggcgagctcggcttcagcattatgatgtgcagtaccgaccgcgatccgaaaaaggagacaacgtatttctcggtcctcaagcaaaaaagcgtcgacggcatcatttttgcgacaggcatcgaaaatcaggagacgatggatgcgctcgaggatattgccaaagagggcataccgctcgtgatgatttcccaggatcgcgcccttgttccgatggatgtcgtggtcatcgatgattttatgggcggatatttagcgacgcggcatttaatttcgctcggtcataagacaatcgcctgcatcgccggcgacggatcgacaaccggagaaaaagacaggctgaaaggcttcaaaaaagcgatggatgaagcaggcatcaaagcggatgaaacgctcatcgccggatccggtttttccctggaatgcggcaaaaaagcggccgctcagattttcaaaagcaatattccgaccgccgtttttgccatgaatgatgtgctcgcgtgcggagtcattcagactgcaagggaatgggggctccatgttccaacggatttatcggtcatcggctttgataatacgtttttagccgaaatgaccgatccgccgcttacgacagtgtctcagccgattgaagaaatgggccgccgcgcggccgagctgcttgccgaagaaatcagcggcaagaaaagctcgaaaagcaaaatcattctcacgcctgaacttgtcgtcagacagtcgacggcccctccatttaaaaaagaagcacatgccgaaaagagcgggttttga

SEQ ID NO: 1104 - DNA, 1029 bp, Bacillus licheniformis
atgacagaagttgtgagatgcgccgtattggggcttggaaggctcggctattaccatgcgaaaaacctcaaaaccgaggtgcccggagtcctgctcgccgctgtagccgatccggcagagggaagtgcgagggaggttgcagctgaactgggtgttgaaaagtggtttgaagacccgtttgagtgcctccgcgatccggaaattgatgccgttgtcatcgttacaccgacatccactcatgccgaaatgatcaaacaggcagccgaattcggcaaacagatttttgtggagaagccgctgacattaaatcttgaagagtcaatagaagtcatttccaaggtcaaagaaatgggcgtgatttgccaggtggggtttatgaggcggtttgatcctgcttatgcggatgccaaaagaaggatcgatgccggagagatcggcaaaccgatctattataaagggtttacgcgcgattttggctctcctccggccgaattcatcaaaaaaagcggcggtattttcgtcgattgttcgattcatgactatgacatcgctcgttatttaatgggggctgaaatcactgcggtttccggccacggaagggttttgaagcacgcattcatgccgggatgccatgacgtcgatcaggcgctcacctatatggagtttgattcgggagcggcgggtgatgcggaagcaagccgcaattcgtcttacggccacgatatccgcgccgaaatcatcggaacggacggcagcatcttcatcgggatgctgcggaacccggcggttacagtgcggaccggaaaggggagcagctataatatcattcccgatttccaggcgaggttccatgaagcgtactgtttggagctgcagcattttgctgattgtgttcgcatcaaaacgaaaccgcttgtgactgaagtggatgcggcggtcaatcttgaaatcgcgcttgcggccacacaatcctggtcaacaggcaggcccgtcaagattcagtatcagacgaaaaagcttacggtatga

SEQ ID NO: 1105 - DNA, 744 bp, Bacillus licheniformis
atggatgccggaggattagacccgtccgtcattccggcggtaaaaaaacggcatggcgccgatttgttgtacacgattccgtcatttcacaatccgacgggcaaactgatgtccgaagaccggaagcgcgagctgattcaaatcagcaagcagctgtcgctcccggttattgaagatgacgcatatggcgatttgcagcttgacggcccgccgtcgtcgccgctgaaggccatggacagagaaggcagcattctttatgtcggcacattatcgaaaaccgtcagtcccggcctccgcatcggctgggtcgcaggtccggagcccgtcatcgagaggctggccgatattaaaatgcagactgactacggatcaagttcattgtcgcaatgggcggctgcaaagtggctttcaagcgggctctatgatgaaaatctcagccggattaaagtcgaactgagacaaaggcgggatgaagcgctccggtgtcttgagacctattgcagaggaatcgcccgctgggaaaagccctcaggcggattttacatttgggtcacattcctaaaaccgctctcgctcagcgctttgttcgaacaagcattacagaaaaacatcctcatcaatcccggcaccctctacgataaggaagccaaatacagcatcagattgtcctattcgtacgcctctttgacagagcttcgctacggcattcaaacaatcgcagaactcgccggtaagctcatgtga

SEQ ID NO: 1106 - DNA, 1347 bp, Bacillus licheniformis
atgcctgtacaaacgagttctaaaaatcaagtgtttttggagcagcaaaatagaagagaatctaatgcgcgttcatatccgagaagatttccgctcgccatgcagacagcggaaggcgtcttggtgactgatgcggatggaaagcaatattatgactgtctggcaggagcggggacgcttgcgcttggtcataatcatccagttgtgattgaagcgattcaaaaaatgattgaggaaaaacgcccgctgcacacccttgatattacttcggaaatcaaagaggagtttgtcaacgaagtatttgcaagccttcctgaggcgtttgccaaacgggcgaagatacagttttgcggtccgaccggcggcgatgcgatcgaagccgctctcaagcttgtcaaaacggcgactgggaaaagaaccatcctatcgtttcacggcgcctaccatggagcaactcacggaacgatggcgctgagcgggaatttatctcctaaggaaaacgtccagggtctcatgcctgatgtgcatttcctgccatatccgtatgaataccgctgcccgtttggaaaaggaggagaggcgagccacaagctgtcgagcgcatatatcgaaaatatgctggatgatccggaaagcggagttttacagcctgcagggatgatctttgaagccgtacaaggagaaggaggctcagttccggcccgggctgaatggataagagaaatgagaaggattacaaaagaacgcggaatccctctgatcattgacgaggtgcagaccggcatcggcagaaccggcaaaatgtttgcgttcgagcacgccggcattataccggatgtcatcgtcctttcaaaagcgatcggcggaagccttcctctgtctgtcgtcatctatgatcaagaccttgatcagtggggacccggggcgcacatcggcacattcagagggaatcagatggcgatggcggccggaagtgcaactttaaaatatataaaagagcacgatgtgctatcacatgtagaaaaggtcggagcgaagctcatgcgggaattgcaagacattcaggagcacgttcccgaaatcggcgatgtccggggacgagggctgatgatcggcgccgaaattgtcgcaccgcataaaaagcaaaacgcaaacggcagctatccggctgatgcggagcttgcaagcacgattcaaagaaaatgctttgaaaaaggactgatcgttgaaacgggaggccgccacggaagcgtgatccgcttcttgccgccgcttatcgtaacagaggcgcaaatcgacgatatcatcacgatcttcagagaggccgtctatgaagcagtcaagtaa

SEQ ID NO: 1107 - DNA, 1512 bp, Bacillus licheniformis
atgaagcagtcaagtaaacaaaaaaactttgattccctgtttatgcacaacggggaacaggggatcaaagcataccgtgacgcggtagagaccgctgtagagacgctttgggccgattggaagaataaatcgaagccctacagcgggaagatgccgaaagaattggatctcgaaatcaaaagcttgttttcgtttcaggaagcgggagaatcgcttgcggatgttcttgagcatctgaaagaagcctatttgccgcaccggattcatgttgaagatccaaaatgcgccgcacacctgcactgtccgccgctgatcccggcgcttgctgcagagatgctgatcagcgtgctgaatcagtcgatggattcgtttgatcaaagcggagcggcttcattgatcgaggaagaaatggtgcagtggctttgccgaaagtttgaatacggaaaagatgctgacggaacatttacgagcggagggacacagtctaattacatggggcttcttttggcccgcgatgccttctgcgaaaagcagtggaactggaatgtacagaaggacggactgccgccggaagcgaacaggctgcggatcctctgttcaaaggatgctcattttaccgtgaaaaagtcggcttcccagctcggcctcggagagcgcgccgtcgtgcttgtcgataccgatgctgaaaagcggatgagcctttacgatttaaagcaaaaaaccgctatgctgaaggaatcgggcttacatccatttgcgattgtcgcaacatgcggaacgacggacttcggaagcatcgatccgctttccgagcttgcggatgccgcgcatgctggcgggctttggttccacgttgatgccgcatatggcggagcgttgattttgagcaggacccgccgctataaattggctgggatcgacagggccgattcaatcagcgtcgacttccacaagcagttttatcagccggtcagctgcggcgcttttcttgtaaaagacagaagacatttccgcttgattgattatcatgccgattatttaaatcctgaggaggatgaagcggagggaatcgttcatctcgtcaataaatcgattcagacgacgcggcgctttgacgccttaaagctgtttgtctcgctgcgtgtgcttggagaagatacattcgccgagatgatcgactggacattcgcattggctgaagcggcagcggaaaaaatctcagcaagcgatcggttcgaactgctgaatccgcaccctgaactgaacgctgtcgtcttccgctgcctcgcctcagaagacgacgcggagaacgaccgtttgaataaatgtatccacagagaattgttcagaacgggacaggcggtgatcgcaaagacggcagcagctgggaaaacatatttaaaattcacgctgctgaatccgcggacgacgctttcggatcttgatgacattctcgggaggattcaagagcttgcaagtctttatacgaatagcaggagggtaacaggatga

SEQ ID NO: 1108 - DNA, 1767 bp, Bacillus licheniformis
atgagttcatttaaagaaatagcagaaaacgccacgattcaaagctttttaaattgctatttgcgtgaaaccggcatcgaaacccgtgagatcgcggacggctctcaaaaaacgctgattgtcccgctagagcgccagcagatcgagctgatcgttccgatcaagtactggtcgaagacgggaaggcaccttttctcatttccgctttattatcaaacagcccaaaacggaaagccgcttccactcgactatgtgacgctcgtctccctcgcttcaaaggaattgcttcttcagcaaagccgcgggggtgccgaggatgaattcatgctcagagtcattttgagctgccgaaatatcagccgttatgttgaggaacgagccgatgatcaaagtgagcttagccgtgctgattttacgtttatcgaagcggagcagtcgctcttgctcggccatctgatgcatccgacgccaaaaagcaggcaggggatgaagcctgaagaggaaagcatctattcgcctgaacttaaaggggagtttcagcttcattactttaaggcacacgcctccctcgttctgcacgactcaagtacaggaacaaaagcgccgctagtcattcaagaggaattgagaaacgacccgatgattgacaatgcgtggctggatgagcaaacggccgatccggattttgcgcttcttcccgcacatccgctccaggcgagagccttgttggaggagccgtatgtgcaaaaattgatcgctcaaggtctccttacatatctcggcgcaaaaggccggaagtatacggcgacatcctccgtccgcacggtctacagcaagcactcgcgctatatgtacaaattttcggtaccgatcaaaatcacgaattcgctgcgtgtgaacaagcagaaagaattggacagaggtgttgaaatggcccggctgcttcagacagagctcggccaaaggttgaaacaggagtttccgggctttcgcgtcatcacagatcctgcttacatttccattcgaggagagaacggggagtccggctttgaagtcgtgatcagggagaatccgttttatgaagacgaccgttcggcatgtctgatcgccgggctttgccaagatcacgcctacgggaaagagtcgcggctgtgctctgtcatccgcgggctggctttagaagaagggcggacgacggaagaagtgagcatcgattggtttgacaaatacttatcgatttcgcttgagccagttttatggctgtttgaaacatacgggctggcgattgaagcgcaccagcaaaacgccgtcatccgcttaaaaaacggctatccggagacattttactacagggacaaccaaggctattattacagcgaatcaaaagccgggattctttccaagctgatcgaaggcttgagcgaaaggagcgagacgatctgctcggacagcgtggctgtagagagactgcgctattatttcttcttcaaccatttgtttgggcttgtaaacgggtttggctgcgaagggctgatcggggaagaaacgctcctgtccatgatcagagagcggcttgaaaaagcggagcaaatttacggtatcacagagctgacggacagcctccttcgttttgcggagcttccgtgcaaggccaatctgctgacgagattttacgacatggatgagctgacaggctcgcttgaaacccagtctcgctatacgtctgtcaacaatccgcttttaaaggaggcggcggctgtccaatga

SEQ ID NO: 1109 - DNA, 555 bp, Bacillus licheniformis
atgaatgaacggatcacatttcaaaaagcggactatgaaagagacatatcgctcgtctaccgctggatgcaggaggagcatgtcattccgttttggcatttaaacatgccgtttgcaaaatttgaagcccattttcacaaggccatcacagaccctcaccaaacgctgtacatcggctttatcgacggtgtgccgatgagctactgggagtcgtactgggtcaagggagacatcattgaacaccactatgacaatgaaccttttgaccagggcatccacctgttgatcggtgaaaaagcgtatttgggtaaaggtcttgcccttccgctattaaaagcgatggtcaacatgcaatttgccgtgcctgaaacaaaaaaggtgatcgcagagccggatatccgcaacaaaaaaatgattcatgtttttgaaaaatgcgggtttcgccctattaaacctgtgaatctccctgataaaaccggattattgatgttttgcgaacgagaacgtttttttgaaaaggagaaaaaagatgaactctacaaagagacccaatga

SEQ ID NO: 1110 - DNA, 1344 bp, Bacillus licheniformis
atgaactctacaaagagacccaatgatgtatacgatgtcatcggcgtcggcatcgggccgtttaatctcggccttgccgcattggctgactccgtgcctgagatcaatgcgctgttttttgaacgaaacgaaagctttaactggcatcccggcatgctgattgaaggaacgacactgcaggtgccgtttttggccgacttggtgagcatggccgatgtgacaagcaaatacagctttttaaactatcttcagcagcataaccgtctttattctttttattttctggaagactttcatattccgagacaggaatacaaccactactgccgctgggtggcagaacagctcgacccgtgccgcttcgggatgaatgtcgaaagcatatcactcgttgaatcgaacccggaggcgctttttaaggtgcgggtcgcgaatcgggagaacggaggggaagcggtttattacacgaggcatattgcgcttggcattgggacgggcccgcacgttcccgatgcgctctcagacgctttggggggctcggtgttccattcagccgagtatttaaagagaaagcccggcggatttaaagggaaaagggtggccgtcgtcggctccgggcaaagcgcagccgaagtgttttatgacctggtcggtgaagatgaagcggagcatgtcagctggctcacccgctcaaaaggcttcttcccaatggaatattcgaacctcggactcgaatatttttcgcctgactatatcgattttttctatcagcttccgcagtggaaaaaagatgaattgctaacgcagcaggatcttctttataaaggaatcagcgcgaagacgatcagcgatatttatcatattctgtatgagcggacctgcggggggcggaaagcggcttttgatcttcagtccatgacagaagtcgagcagatcgaacagcgtggggaaacgctggttctatactgcacaaaccgggtgaatgaagaccggtttgagcggcaggcagatgtggtcgttctggcgacgggctataaagagaggctgccggaatgtctggcgcctgttgacagtttgattgaaaaggacgcgagcggccgctacgtgattacacgcgactacagactagtgacagctgcaaaatcaaaaaaccatatttttattcaaaacggagagctgcacacgcacggtgtcggtgcacctgacctgggactcggcgcttaccggaactcggtgatcatcaatcagctggccgggagagaagtatacaccgtcagccataaaacggtttttcagacattcggaacaggaatcgcggaaaaaacagctgtaccaaacggctaa

SEQ ID NO: 1111 - DNA, 1815 bp, Bacillus licheniformis
atgttgtttcaagatgaattaaagagggtcctcgatcctgacaggtggagagaagtcaatcggcgattgctggcgaagatgctttctgaatatatgtatgaggatatcattaagcccgatttcattgaaactgaagacggcatcaaccgctatgagctgagaacggccgaggataaggtgtaccggtttgccgccaaaccacgcatgtttgacagttttgacgcggtgccggagacgattgaagtcttcaagggcggacaatggacaaaacatgtgagcgcgattgaatttctcctggatattcagccgcatatcccgatgagtccggagacagcgggtcatttgatcaaggagttcaaccatacgatgctggctgatgcccaccttttggcaaaggatgcgcttacggctgacgagctgaccgaagccgattatgccgtaattgaaggcgagatgaccggccatccgtggatcgtctacaacaaaggaagaatcggttttggctatgatgactacctccggtttgccccggaaaatcagagagccaaacggctgctgtggatcgctgtacacaaagataccgcgtcatttcactcggttgaagggctcgattatgagacgctgattcataaagagcttgatgagctgactttaaggcaattcgctaaagtcatagaaaagcagggcgcagccagtgaagactattattatatgcccgtccacgaatggcagtggacaaatacgatcattcagcagtttcctgaagaaattgcttcaaaagcgatcattcctttaggggaaggcggagacgagtacctgccgcagcaatcgattaggacctttacaaacatcacaaacaaacacaagcatcatattaaactgccgatgagcattttaaatacgcttgtatacagaggcctgccgtcggaacgtacggttatcgcgccgaaaatcactgagcatatcaaagggatcgccgaaaacgacgcatttctaaaagacgaatgccgggtgatcctgccaggcgaaaatgccagtctgaacgttgaccaccaatactatcactctcttgaaaaagccccgtatcaatatttggaaatgctcggcgctattttcagagaaagcatttatacgtatttggaagaaggagaacggcctgttacgctcgcttctttaacatacattgatcaaggcggcgtgccgtttatcaggcgcctgatcgaaaagtcggggctgtcagcggaggagtggatcggaaagctgtttgacaccgtgatgccgccgcttctgcatttcatgtaccgctacggaaccgtattttcaccgcacggacaaaatacgattctcgtcttaaaagatcatcagccgcacaggctggcgattaaagattttgttgatgacgtcaatatcagcgaccagccgcttcctgaactgagcggtttgacaggggatttaaaagccgttctcagaagcgagccgccggaagggcttgtgcagtttatctttaccgggcttttcatttgccatttgcgctatgtagccaacattttagaaaatgacggtctgcttcctgaaaagcgtctgtggaaagctctggctgatgcgattcttgattatcagcaaaaattccctgaactgcgtgagcgcttcgaattgttcgacttattcaagccggaattgacgaagctctgcctcaacagaaaccggatggtcgactacggctacaaggacggcgatgaccgcccgcacgcctccgaattcggaaaagtgacaaatgcgcttgcgaaatttaaaaaagaggccgcaaagctgtaa

SEQ ID NO: 1112 - DNA, 441 bp, Bacillus licheniformis
atgattgaagtcaaaccaataaacgcggaagatacgtatgagatcaggcaccgcattctccggccgaatcagccgcttgaagcatgtatgtatgaaaccgatttgctcgggggtgcgtttcacctcggtggatattaccggggcaagctgatcagcatcgcttcctttcataaagccgaacattcagagcttgaaggcgaagaacagtatcagctgagagggatggcgacgcttgaaggataccgtgagcaaaaagcgggaagcacgctcatccgccatgccgaagagcttcttcggaaaaagggggcagaccttttatggtgcaatgccaggacatctgtgagcggctactatgaaaagctcggcttcagcgaacagggcgaagtctacgacataccgccgatcggacctcatattttgatgtataagaaattgacgtaa

SEQ ID NO: 1113 - DNA, 834 bp, Bacillus licheniformis
atgaagccgctgaaaggaaaaatcgccctcgtaacaggcggaagcagaggcgcgggccgcgccatcgctgcagaacttggaaaagccggtgcaaccgtgtatattacaggccgcagcatcagaggggcttccacgaatcaatggcccggtacaattgatgacaccgtgtcacaaattgaagcttccggcggaaaggctattgctgtaagatgtgatcatacgaacgatgcagaaacagaggctgtcatcgctaaaattcgcgaagagcaaggaaaactggatattttgatcaacaatgtgtggggggcgcacgatctgggtgtcgaggcaaagcctttttgggaattgtcattgaaaaattgggatacgatgttcgccgccggggtgcgtgcccagctggcgacaaaccacttcgccgtgccgctccttcgcgaaaataaacaagctcttatcattcacacgaccttctgggatgagaacaagtacaccggacagttttattacgatttggccaagaacgcaatcgtccgcatggcgtacggtctttcattggaattaaaacgggacaacattgccgttattgccgtttcgccgggatttatgagaaccgaacttgtgctgaaataccatgaatcagatgaggcgcattggcgggagtcggaagatttaaggagaaccgaaacgccttattatgtcggacgcggaatcacagcattggctaaggatccggatgtgatggagaaaagcggacgtgcgttaagagttggtgatttagccaaagaatatcagtttaccgatgtggatggacgatatattccgccatttacgatatag

SEQ ID NO: 1114 - DNA, 963 bp, Bacillus licheniformis
atgagaggggatcgactgatatctattcttttaatgcttcaggcacaagggcaaatgacggcgaaagaattagcggaaaggctggaagtctccgagcgcacgatttacagggatatggaagctttaagcggagcggggattcccgttgtggccgaacgcggcataaacggaggctggtcattgcttgatgattaccaaaccactctaaccggcttaaaagaatctgaaatacgcgcactatttgttccgctttctgaacaattgcttgacgatctcggattaacccgcatatccgaagaagcccgaaataaactgattgcctcgctgccttcggaatatcgccaaaacgcaaaggatgtatggaaccgcatatatattgatacctgttcatggcgccataagaaagaaaaagcagaatcctttgaagtgctgaaagatgccatatggaaagatcaaaaattaaaaattgtctatcagcgggcagatggacaaacggctgatcgtgttgttgcaccgcttgggctggtggctaaaggggcgaactggtatctgattgcatctaaagaaaatggggagattcggaattacagggcttcacggattaaatctgccgtttttgtccgcgaaacgtttgataggcccgaaaattttgatattgctcacgtgtggcggtcttcaacaaaggaatttattgaaaggctgccgacgtatgaagtgcgggtgaaggcggcgcaggccatcttgccgaggctgtcgtttaccaatcattttgtgcggatcatcgaaacaaatgagatcgatcaggagggctggatccccgttacgctatcctttgatacggaagaagaagcaaaaaggtatatactcggattcgcagagcacatgaggatcattgaacctaaagaactgcacggaaagatacttaaaatggctgaatccatagttgcgcattataaaacctga

SEQ ID NO: 1115 - DNA, 3417 bp, Bacillus licheniformis
atgtctaacatcaatgaccagctgaagaaaaaaatcctcgtccttgacggtgcgatgggaacgatgatccaagacgccggtttgtccgccgcagacttcggaggcgaggcatatgaagggtgcaatgaatttctaagcattacggcgccccatgtcattcagggcatccacgaagcctatctcgaggctaaagccgatatcatcgagaccaatacgttcggagccacccggctcgttctggacgagtacgacctcgggcatcgagcctatgaagtcaacctcgcttcagtcaaactcgccaaagcggccgccgaaaagttttcaactcctgaatggcctagatttgtcgccggtgcgatgggtccgacgacaaaaaccctttccgtcaccggcggcaccacctttgacgaactgatcgataactacgaggaacaggcaagagcgctgatcacggggggagccgacctcttgctcctcgaaacgagccaggatatgctgaacgttaaagccggctttatcggcattagacaagccttcgaaaaaaccggcaaaacccttccgctcatggtgtcaggcacaatcgaaccgatgggcacgacgcttgccggccaggatatcgaatcgttctatatctccctcgagcatatgaaaccggtcagcgtcggtttaaattgcgcgacaggcccggaatttatgacagatcacatcaggaccctttcttccctagcgaggacggccgtcagctgctatccgaatgccggcctccccgatgaggaggggcaataccatgaatcaccgcaatcgctggcgaaaaaaatcaaggcgtttgctgaagaaggctggctgaacattgtcggcggctgctgcggaacgacgcccgcccatattgaagcgctggccgatgaagtagcccttctgcctccgcggacggttccttcgggagcaaagccgcacaccgtctcaggaatcgacggattaatttacgaagaaacaatgcgtcccctttttgtcggtgagcggaccaatgtcatcggctcgagaaaattcaagcggctcatcgccgagcataaatttgaggaagcatccgaaatcgcgagagcccaagtgaaaaacggcgcccatgtcatcgacatctgtctcgcagacccggaccgcgatgaagcggaagatatggaaggctttttaaaaaaagcgatgaaaaaagtaaaagccccgtttgtcatcgactcgacggacaaaacggtaattgaaaaggcgctgaaatactcgcagggaaaagcgatcatcaattcgatcaatcttgaagacggcgaagaacggttcgctgacatccttccgctcgtcaaacagttcggaggcgcactcgtcgtcggcacgatcgatgaagaggggatggcagtcaccgcggcaaaaaagctggccgtcgccgtccggtcgcatcagctgctcaccgaaaaatacggaataccggccagcgatatcatattcgatccgctcgtcttcccggtcggaacgggcgatgaacaatacatcggctcagctaaagaaacgatcgaagggatccgcctcatcaaagagcagctccctgaatgcttaacgattctcggcgtcagcaacgtctcattcggtcttccgcccgtcggccgggaaatcttaaatgctgtattcttgtaccacgcaacacaggctgggctcgattacgcgatcgtcaatacagaaaagcttgagcggtttgcttccattcctaaagaagaagtcgagatggctgaaaaacttctgtttcataccgacgataaaacgctcgcatccttcactgacttctatcgtggaaagaaaaaagcggacaaacagccgaaaacgtccctttccctcgaagagcgcctggccgaatacgtaatcgaaggtacaaaagaaggcttgattcccgatctcgaacaagcgttgaaaaaattcgccaccccgctcgacgtggtcaacggtccgctcatggacggcatggcagaggtcggacggctgtttaacaacaatgagctgatcgtcgctgaagttctgcagtcggcagaggttatgaaagctgccgtttcctttctcgaacaatatatggaaaagaaagacgacagcggcaaaggaaagatcattttggcaaccgttaaaggcgatgtccatgatatcggcaaaaacttagtcgacatcattttaagcaacaacggctacaaggtagtcgatcttgggattaaagtgacaccgcaggagttaattgaggcgatccgcaaagagaaccccgacatcatcggtctgtccggcctgctcgtcaaatcggcgcagcagatggtcgttacggcgaaggatctcgataaagcggatatttccatcccgatcatggtcggcggagccgcgctttcaagaaaattcacgaacatgaaaatttcgcctgaatataaagggccggttttatacgcgaaggacgccatggacggcctatcgctcgccaatcagctgcggacggacccgtcgcagtttctcgagaaaaaagaagccgctgcacccgccgccgtcgcggaaaaaaagcagacgaaagccgtaattgaaatgcttgaaaaacgggcgcacgttccgaaggcgccggtctttcagcctgaagacttgaaacggcactatttgaaaaacatcgacctttcctatattgtgccgtatgtcaatgaacaaatgctgctcggccatcatctcggcttgaaagggaaagtcaaaaaactactggctgaacagcatccaaaagcactggagctgaaagaactgatcgacgagctgctgagagacggaaaagaacacggctggttcgatcctgcggtcgtctaccaatttttccctgcgtacagcgacggggattcgcttcatattttagatccagtgaacaaagacagcatccttgaaacgtttgtttttccaaggcaggaaaagcttccgtaccgctgtatttccgattacgtccgaccgaagggagagcttgattatgtctcgttctttgccgtaacggcgggcaggcatgtaagagctgccgccaaccgctttaaggaggaaggcgactacttgaaaagccatgcggtacaagcgcttgctcttgagctggccgaagggctcgccgaacggacgcaccaggttatccgcgaccgctggggcttccctgatgcacccgacttcacgatggaacagcgttttcaggcgaaataccaagggcagcgctattccttcggatacccggcctgtccgaatcttgaagatcaggaaaagcttttcaggctcatccagcccgaaggcatcggcgttcacttaacagacggcttcatgatggagcccgaagcttccgtatcagcgatcgttgtctcccacccggaagccagatatttcaatgttcattaa

SEQ ID NO: 1116 - DNA, 1830 bp, Bacillus licheniformis
atgggttttttggaggatataaaaaacaaaacgttaatcgctgacggcgcaatgggcacgcttctgtattcctatgggatcgacaggtgttttgaggaactgaacatctccaagcccgaagaaataagacgcgtccacgaagcgtatgtacaggccggcgccgacattattcaaacgaacacgtacggcgcaaacttcatcaagctgtccagatacggactcgaagacgaaacaaaacaaatcaacgaaaaagccgtccgcctcgcccgcgccgccgccggctccgcttatgttctcggtacgctcggcggaatccggacgttcaacaaaaactcgtattctctcgaggacattaaaagaagcttccgcgaacagctctaccttctgttaaatgagcagccggacggacttctgctcgaaacctattacgacttagaagaagcgcgcgaagttttaaagattgccagaaaggaaacggagctgccgatcattttgaatgtctcgatgcacgaagagggcgttcttcaggacggcaccccgcttgcggacggtctgaagcagctggcatcactcggcgcagatgtcgtcggcatcaactgccgtctcggcccttatcatatgatcagagcgcttgaagaagtcccgcttttagaagatgcctatctttccgtctatccgaacagcagcctcccgtcccttgtcgaaggcaggcttgtttatgagacggatgatgaatatttcagggaaagcgcggaggaattccgcaatcaaggcgcacggatcatcggcggctgctgcggaacgacgccgaaccacatcagagcgatggctgaggccgtcaaaggacttcctccagtcaccgaaaaacgagtgaaaatcagaaagaaagcggcgcttgccgttcaaaacgaaaggacagagcctgctcttgacgatctggcaaagcagaaacggtccattatcgtcgagctcgatcctccaaaacaattaaactttgagaaatttttgcacgccgcagaggagctaaaatcagccggaatcgatgcactgacattggcggacaactcccttgccacaccgaggatcagcaatgtcgcctgcggggcgctcttaaaacagcgcctcgatatgaggtcgctgattcatatcacatgcagagaccgcaacctgatcggcctgcagtcccatttaatgggactcgatacgctggggctgtcagacgtgctggcgattaccggcgatccgtcgaaaatcggcgactttccgggagcgacttccgtctatgacctgacatcgttcgatttgatcagcctgatcaagcagtttaacgaaggcttgtcctattcgggtaaaccgctcggcaagaaaacgaatttctcagtggcggccgccttcaatccgaatgtcagacacattgacaaagcggtgaaacggcttgagaaaaaaatcgcctgcggcgcagactatttcatttcccagcctgtctattccgaggagcagctcattaaaatccacaaggaaacgcggcatcttgaaacaccgatctatatcggcgtcatgccgctcaccagcagccgcaacgcggaattcatccacaacgaaatccccggcatcaagctgtctgattcaatccgcgaaaagatggcgctggcaggaaacgacaaacaaaaacaggccgaggaagggctcgcgatcgctcgctctctgcttgatgcggcgtgcgacctgttcaacggcatttatctgatcacaccgtttttgcggtccgatctaaccgccgagctgacggcatatatccatcagaaagaaaaggagaagacaaatgtctaa

SEQ ID NO: 1117 - DNA, 492 bp, Bacillus licheniformis
atggcgaaagaaagctcatttgatatcgtctcaaaggttgaactgcctgaagttcaaaacgcaatccagaccgctctcaaggaaatcggcacacgctatgatttcaaagggtcaaaaagcagcatcacactcgaaggagacgaactcgttctcgtatcagacgacgaatttaaaatgaaccagttgaaagacgtacttgtcggcaaactgatcaagcggaacgtcccgacgaaaaacatcgaatactcaaagcttgagaacgcttcaggcggcacggtcagacagcgcggaaaattagttcaaggcatcgacaaagaaaacgcaaaaaaaatcaataaccttataaaaaaatcgggtctgaaagttaaatcgcaagtgcaggacgatcaagtccgcgtaaccggaaaaaataaagacgaccttcagcaaatcatcgcgatggtgagggaagccgacctgccgattgatgttcaatttataaattttcgataa

SEQ ID NO: 1118 - DNA, 855 bp, Bacillus licheniformis
atgaaacctggacagcagctaacattgaaaatagatcataaagcagattacggttactttttgacggacggcgaaacggcggtccttctgcatcagagcgagatcaccgaggatattgacgggagagaagaggtcgatgtttttttatatgtcgatcacgaagatcgccttgcggctacgatgagaaagccgatcatcagcgctgaacaatacggctgggtggaagtcgttgatgccgtcagcggcatgggcgttttcgtcgatgtcgggctctcgaaggacgccctcgttgcgacagagcatctcccgccgtatgaatcagtatggccgcaaaaaggagacaggctgtactgtatgctgaaaatcacggggcacggaaggatgtttgccaagccggcgccggaggacaagatcagcgaactgtttactgaagcttcacccggcctgatgaataaagagctcaccgggacgatctaccgcttgatcgcatcaggctcttttatgatttccgaagccggcatcagaggcttcatccattcttctgagcgaaaggaagagccgaggctcggcgaaaagctgactgcaagggtgatcaaagtaaaagaagacggttctgtaaatctgtcgcttctgccgagaaagcaggatgccttgtcggttgatgcggaacaaattctgacttatatgagatcgagaaacggcgcgatgccattctgggataaaagcgatccagaggatatcagagagcgcttcaacatgagcaaagcagcatttaaaagggcgctcggccatctgatgaaacaggataaaatctatcaggaagagggttggacgtacgagaaaaaattatcttga

SEQ ID NO: 1119 - DNA, 213 bp, Bacillus licheniformis
ttgtctgttcttttcggcgagccggtttttctgctggttgacggcgttattgtcaaccggctttttatcatcatctttcatgaggaagcacctcccgtcaaaatgtcgctcttagcttgctcactgccggcgaaactatgtactctcccaattgcgatgttttttgccgggaagtttatgccaccttgttccgtcagcatacacatatcataa

SEQ ID NO: 1120 - DNA, 198 bp, Bacillus licheniformis
ttgctgctcagttacattcatcgcgtttcggcaggaggggtcgtcaacttcggcggtgcgtacaaaatttgtccgatcacaatggaaaaagtggtcgagggatctggaggcccggatgtcgcgacagctgctgccggctttcttgatggagcgcttgcgccggccgttgaggaagggacagtcaccgaagacagctga

SEQ ID NO: 1121 - DNA, 861 bp, Bacillus licheniformis
atgaacgttcaccttttagcagacagcgcggcagatttgccgaaatctttttatgatgaacatcgcatctcatttattccgttaagggtgctgcttgatgaaaaagaatacgatgatcttctgacgattcagcctctggacgtttatgaagcgatgcgcgaaggcaaagcgccgaaaacgtcccagccgtctctgatgctgttcaagaacgcattcagcgagctggccaacgaaaataaacccgctctctatatcgccttttcctcagagctgtccggaacataccagacggctgtgatggcggcaaacgaagtcaaggaggagttccctgatttcgacctgcggatcatcgactcaaaatgcgcttcattaggctatgggcttgctgtcaagcacgccctcaaactcgcaactaacggcaatacaatacaagaaatcgagtcgtctgtaaaggacttttgcgaacatcttgaacatatttttaccgttgatgacttgacttatttggcaagaggcggaagaatcagcaaagcatcggcatttgtcggcgggctgttgaatattaaaccgcttttgcatgttgatgacggcaagcttgtcccccttgaaaaaatccggggcaaaaagaagctgctcagacggatgatcgaattaatgaaggaaagaagcgtcgatttgagcggacagacggtcggcatcagccacggagatgacgaagagacggccgaagaagtcaaacggatgatcgaagccgaattccagccggaggagatcgtcgtcaacatgatcggttcagcggtcggcgcccacgccggacccggaacattggcggtcttttttccggggaaagacaaaagataa

SEQ ID NO: 1122 - DNA, 843 bp, Bacillus licheniformis
atggtcatagcggaagcaaaaaaattgttcattgtcatcatcggcgccttgttaaatgccatcggattgaatctgtttctgattcccgccgatgtttacgccagcggctttacgggggtggcgcagcttttatcgagcgcgcttgaccagtacagcccgatttatttttcaacggggacgctattgtttattttaaacattcccgtcgggattctagggtggctcaaggtcgggcgctcatttacggtctacagcattttgagcgtggccttgacgacggtctttttggggatgctccctgaggcgagcctgtcaaacgacattttgctgaatgccgtgttcggcggggtgatcgccgcggtcgggatcggcctgacccttaaatacggggcttcaacgggcggtttggatattattgcgatgatcctggcaaagtggaaagacaaaccggtcggcacctatttctttattttaaacggtgcgattattttaacagcaggattattgaacggatgggagaaagcattatatacgctcgttacactatatgtgacaaccagggtgattgatgccatccacacccgccacgccaagctcaccgttatgattgtcacaaagaaagcggaggagatcaaagaagccatttacgggaggatggtccgcggaattacaaccgttccggcgaaaggcgcctttacgaatgaacagaaagaaatgatgatcattgtcatcacaaggtatgaattgtacgacttggaaaaaatcattaatgaagttgatccaaaagctttcacaaacgtcgtacagacaacacaggttttagggtttttccgcaaagattaa

SEQ ID NO: 1123 - DNA, 453 bp, Bacillus licheniformis
atgcggctgatttccatgattgtgatgctgctgtttgtcagtggatgcgggcaaaacggggatcaagtccccgataaggaggtatcaggggaagtggataacgggagtgtgacattgacggttgaacccgtccagaagcagggagaaatcgaatttcggatgtcggttgtaaaccatacggatgatgcggcagagtttgaattcagcagcggacagaaatttgagctgatcgtcagcgacaaagaagggaatgaaagataccgctactcgaaaggaaaaatgtttacacaggctttccagacgatgacgctcaatccgaaagagtcctacgattttactgatgtatggaaagaggtgcctgaacccggcacatacgaagtaaacgtgacatttttggggagatcggaacagtttgcaactttgagggccggcaaaacgtttgaagtgaaataa

SEQ ID NO: 1124 - DNA, 981 bp, Bacillus licheniformis
ttggaaaatgtatttgattacgaagatattcaactaattcctgcaaagtgcatcgtcaagagccgttctgaatgtgatacatccgtgcagtttggcggaaggacatttaaactgcctgtcgtgccggccaatatgcagaccattatagatgaaaagctggctgtttcattagcggaaaacggttacttttatgtgatgcaccgctttgagccggaaacacggatcgattttattaaagacatgaaggcacgcggtttgttttcttcaatcagcgtcggagtcaaagatgaagaatacgcgtttatcgaagagctgacgagagagaatctcacacccgagtacatcacgatcgatatcgcccacggtcactcaaacgccgtcatcaatatgattcagcacattaaaaaacatcttccggacagctttgtgatcgcaggaaatgtcggaacgcctgaagctgttagagagcttgaaaacgccggagccgacgctacaaaagtcggcatcggtcccggaaaagtctgcattacaaaaatcaaaaccggttttggaacgggcggatggcagctggctgcgctgcgctggtgcgcaaaagcggcaagcaagccgatcattgctgacggcggcatccgcacccacggagacatcgccaaatcggtcagattcggggcgacaatggtcatgatcggttcgctgtttgccggacacgaagaatcgcctggagcaacgatcgaaaaagacggcaagctctacaaagaatattttggttcagcttctgagtaccaaaaaggcgaaaagaaaaatgtcgaaggcaaaaaaatgtacgtggagcataaaggcgcgatcatggatacgctgacagaaatggaacaggatctgcagtcgtccatttcttatgcgggaggaaacaagctcgatgcgatccgcaacgtagactatgtcatcgttaaaaattctattttcaatggggatcaatattaa

SEQ ID NO: 1125 - DNA, 168 bp, Bacillus licheniformis
atggccaaagcagccgtacatgcagctgaagcttcggcggattcaggcgaaaaggcgaaagccgttgcaagagctaaaaacgccctttcctcggcgtatgccaattcaactgatgccgaacggcgacagcttcacaatcttcaggagcagctagatcaactatcataa

SEQ ID NO: 1126 - DNA, 192 bp, Bacillus licheniformis
atgagaagacggccgcaccggaccgtcacttgtgttaagggggaattcaagatgggtaaacgcagcaaatcaaaacggtttattcagcaaggcaaagactcgcttaaacagcatgccgccaggttcccttaccgctccacattagaagaggctgaacagaagagcggcccgacggaatgcggagggctgtaa

SEQ ID NO: 1127 - DNA, 813 bp, Bacillus licheniformis
atggagacaaaaccatatttaattgcattggacttagacggtacattattaaaagacgacaagaccatctcggaaagctccagcgaagtcatccgcaagctgcgggaagatggacattacgtgtgcatttctacgggaagaccgttcagagcaagctccatgtattatgatcagctccagctcgatacgccgatcgtcaatttcaacggcgcgtttgtccatcaccctaaagatgaaagctggggacgcttccatacatctcttgatctcgaggtggtcaaacagatcattgaagtcagcgaaacgtacaacgtacataatatccttgctgaaattgtcgatgatgtttattttcattatcatgacgaaaagctgattgatgtctttacgatgggcagcccgaatattacagtcggagatttaagaacaaacctcggccaggatgtgacaagcgtattgattcacgcaaaagaagaggatgttccggcgatccgctcctatctgtcagacgtacacgcagagatggtcgaccatagaagatgggcggccccgtggcatgtaatcgaactgattaaaagcggcatcaataaagcggtcggcttagagaaaatcacggactactacggaatcccgcctgagcgggtcattgccttcggcgatgaagacaacgaccttgaaatgcttgagttcgcaggctgcggagtagcgatgggcaacggcatcgaaggggtaaaaagcgttgcaaacaaggtcacgaaatcgaatgaggaagacggaatcgcagtctttttaaaggattacttcgctttataa

SEQ ID NO: 1128 - DNA, 768 bp, Bacillus licheniformis
gtgatcataatcgaaaagcagcatatttcaaacattcctcttttgcatattgtaaaagaggagaaaaaagagaaagctcttcctcttgttttcttcatacatggttttacaagcgcaaaagagcataaccttcacttcgcatacctgcttgccgaaaaaggaatgcgcgtgattctgcccgaggctctctatcacggggaaaggaatgaacagctcacccaggaagagctcgccccgagattttgggagatcgtcacgaatgaaatcaaagagctggaagtgctgaaaaaccactttgaacgggaaaacatgattgaaaagggccgcatcggcgccgccggaacatcgatgggcggcattgtcacgctcggcgctttgactcaatacgaatggattacaactgccgtcagtttaatgggcagtcccgcctatgtagaattttttgatcagcagctcgcatttatgcgtgaaaagaaaattgaacttcctatcacagaagaacaaatcgatcagcagcgcgaagaactgaagcgttttgacttgagtctgcagccggacaaattgaacatgaggccgcttttattttggcacggcaaacaggacggcaccgttccatttgctttaacgcgccgcttctatgaatcgattattccactgtatgaagctcggcctgatttgctgcattttatcgaagatgagcgggccggacataaagtatcgagggaaggccttttgaaaacagtcgaatggtttgacgcgcacttgtaa

SEQ ID NO: 1129 - DNA, 309 bp, Bacillus licheniformis
gtggatgaagcattaaaagaaaacatcatgggcgcccttgaacaggtcgttgaccctgaattgggcgtcgatatcgtcaatctcggccttgtatacgacgtaaatatggatgagaacggcaaaacagacgtgaccatgactttgacttcaatgggctgtccgctggcgccgatcatcgtagatgaagtcaaaaaagcgctcgcagatattccggaagtcaaggaagttgacgttcatatcgtctggaatccgccttggacaagggacaaaatgtcgcgatatgcgaaaatcgcacttggtatacaataa

SEQ ID NO: 1130 - DNA, 1038 bp, Bacillus licheniformis
ttgaaaataggtattataggtgctactggctatggaggggcagaaatcatgaggattatgaggactcacccttatgcagatgaatgcatattgtattcatcgagtgatgagggagcccgctatgacgccgcatacccgcaccttgtgaaactgacagatcaacacctgcaaccgatcgaggttaagaggattgcgaatgaaatcgattttttatttatggcagcgcctccggggatatccagccggctgacgccacagtttgatgcatatgacatacccatcattgatctgtccggcgatctcaggatacagaacccaagcgtctatgaaaagtggtataaaagggaagccgcgcctgaacacgtgcttcaaaaagcggtatacggactgtctgagctgaatcgggaagacattaaaacggcgcagtatatagccaatccaggatgttttccgacagcggttcttctcggcttggcgccgctcgtcaaaagcggcagcatcaacgaatcttttgtcatcatcgatgcaaaaacaggggtatcgggggcaggcagaaagccgtcgatgggcactcatttttcagaggtcaatgacaattttaaaatatacaaggtaaacgaacaccagcacacgcctgaaatcgagcagactgtcaaacagtggaactccgcatttaaaccgatcacattcagcacgcatttagttccaatgacaagaggcattatggcgaccatctacacagagctgaaagacagcatggatgccgaacagctgcagcttattttttctaaattttataaagattcatactttgtcagagtgagagaaacgggttcgttccctgccacaaaagaggtgtacggcagcaatttttgcgatatcggcgttaccgtcgatgaacggacgaacagagtgacaatcgtgtcagtgatcgataacttgatgaagggagccgcgggtcaagcggttcaaaacttcaacattatgaacggcttgagcgaaaccgccgggcttgaatttacgccaatttatccataa

SEQ ID NO: 1131 - DNA, 1221 bp, Bacillus licheniformis
atgattcaggtgagtcaagacagcataaaaaaaacagacggaagcgtcgcttcgcctaagggctatcttgcaaaaggggtccactgcggcctccgctattcaaaaaaggatcttgggatcatcatcagctcaagaccggcggtgagcgccgccgtttatacccaaagccactttcaggctgcgccgatcaaggtgacgcaggaaagcctcaaaaaaagcgcgcatctccaagccgtcatcgtcaacagcgccaatgccaacgcatgcacgggagagcagggcttaaaagatgcttatgaaatgcgccgtcaaagcgctgatatgctcgggatcgagccggatctggtggccgtgtcctcaaccggcgtcatcggcgaatacctcaatatggaaaacatcacaaaaggcatcagccttctcgccgagacagagcctgccgaaggcgatttcgaagaagcgatcttaacgacggacaccgtgatcaaacaaacgtgctatgaactgatgatcggcggccaaaaagtgacgatcggcggagcggccaaggggtcgggaatgatccacccgaatatggcgacgatgctcggctttgtcacaacagatgcatgcatcgaagaaagcgcgctgcaaagggctttaagggaaatcacggacgtttcgttcaaccagataacggtcgacggcgatacatcgacgaacgatatggtgctcgtcatggcgaacggatgcgccggaaatgagcgcctccatgaagaacacgaagattggccggttttcaaaaaaggcctgcagcttgtctgcacagacctcgccaaacaaatcgcaagagacggggaaggggcgacaaagctgatcgaggttgaagtgaacggcgcgaaaagcaatcttgaagcgcaaatcatcgccaaaaaaatcgtcggctcaaaccttgtaaaaaccgcggtttacggaacggatgcgaactggggcagaatcgttgtcgcaatcggggacagcatggctgctgtgacaccggagaaggtggaaatccgcctgggcggccaatgcctatttaaaaacaacgaaccccagccgttttcggaagagctggccaaaacatatttagaaaacagcgaagtgaaaatcgaggttttcatgcaggaaggtgaaggaaagggtacggcttggggctgcgatttaacttatgaatacgtcaaaatcaatgcgagctatcgtacgtaa

SEQ ID NO: 1132 - DNA, 777 bp, Bacillus licheniformis
atgggtaaaacaatcgtttttaaatgcggcggaagcgtcatccgcgaactctcggacgaattttttcaaaacctgaaagatctgactgaaagcggctggaaaatcgcgctcgtgcacgggggtggacccgatattacaaagatgctgaagaagctcaatattcgaaccgaattcgtcaacggacagcgcaagacgacaaaagcggttcttgaagtcgctgaaatggtcctgtccggttcgatcaacaaatttttcgttgctgagctgacaaagcacgggcttccggctgtcggcgtatcgggaaaagacgggggactgctccttgcagactatttaaatgaaaaggaatacggtcaagtcgggcgcattaaaaaagtaaacggccaaatggccgaagcgctcatggaaaaaggatttattccggttatcgcacccctctcgatgacggatggctgtgagaccttgaatgtgaacgccgatttggcggcgtcggctgttgcggcagccttgcgcgctgacaaattgatgtttgtgacagatgtcaaaggaattatgaaaaacgaagaaatgctgaaagagctgacgcccgaagacatcgaaagcctgattgctgaaggcgtgatctcgggaggcatgataccaaaagtgcattccgcaaaagaggctcttacagatgaagtggaagaagtaatgatcgtaagcgggaaaggatctttcctgacgaaagacgatttcatcggcacgaaaatcatcaaacaaaaggaggccgtatcgtga

SEQ ID NO: 1133 - DNA, 1158 bp, Bacillus licheniformis
gtgagtcacttatttcaaacgtacagccgctggaatatcaatattaaaaaagcgaaaggcacgatcgtccaggatgagaaggggaacgcctatctcgatttcgtccagggaatcgcggtctgcaatctcgggcattgccccgattcagtaacggctgctctcaaaaaacagcttgacgatgtctggcatgtttccaatttgtttcaaaatgagcttcaagaaaaggttgcacagctccttgccaaaaacagtgcaggcgatctcgtcttcttttgcaacagcggggcggaagcgaatgaaggggcggtgaagcttgcgcgaaaacatacgaaaaaaacaaaaatcgtaacctttcagcaatcgttccacgggcgcacgtatgcgggaatggctgcaaccggacaggaaaagatcaagcacggattcggaccgatgcttgaaggattccattacctcccttacaacgagccgaaagcatttgccgaattgcaggacgaaaaagatatcgcggcggtcatgctggagccgattcaaggcgaaggcggcgtcatcccggcgagcagagaatttctgcagagcgttcaagacttttgccgagataagcaggctctccttatcattgatgaagttcaaaccggaatcggccgcaccggtaaagcattcggatatgaacacgaagggctgtcacccgatatcgtcaccgttgcgaaagggctgggcagcggttttccggtcggagcggtcatcggcaaaaaagagctctcagaagcgttttcgccgggctcccacggcacgacattcggagggaacatgcttgcgatggctgcggcaaatgccacgttggagaccatttttgacagaagctttcttgaagaagtgagcgccaaaggagcatttttgcatcaacagctgaaagataagctccaatttccgcttgtgaaagatatccgcgggaaagggctgatcgccggaatcgagtgcaaagaacccgtgcagccgctgatcgaagcgcttcaaaaagaaggcctgctcgttcttcctgcgggtccgaacgtcatcaggcttctgccgccgttgacggttgcgaaaagcgaaatcaaagcggccgtggagaagctgaaagatgtcatggcaaatcattctgctgtaaagcagtaa

SEQ ID NO: 1134 - DNA, 1065 bp, Bacillus licheniformis
atggaaggatatttagttcttgaagatggtacatccttcagcggagaactggacggtcttgacggctgcaccggtgaagtcgtcttttttacgggcatgaccggttatcaggaggttttgacagatccttcatataaaggccagattattgtctttacgtatccgctgattggcaactatggaattaatggaagcgatgctgaaagcaaacagcctcaggtgagaggggtcgtcgtctatgaagcgtgcgacagattttcccaccatcaggcgacagaaagccttcgggaatacttggcgaagtgggatgttccgcttttgtcgcacgtggacacaagagcggttgttcagcatatcagggcaaaagggacgctgaatgcgaggctgacgaaacaaaaggacgacatcccggctccgcgccagctggaaaactatgcggcacaggtttccggacaaaacgaaaacggcgcttttggggaaggcaatacgcatattgcgctgatcgatttcggctataaaaagtcgatcgcttcatcgctagcaaaccggggctgcaaagtgacggtcgttccctatcaagagatggacggcattgcgaagctgaatccggacggaatcgtcctttcaaacgggccgggcgatccgaaagcgatccttccatatatggatgcactccggggtatcatttcttcctatccgacgctcggcatctgcctcgggcaccagctgatcgcgctcgcattcggaagcgacacgtataagcttccgttcggccacaggggagccaatcatccggtcatggacaaagagaccggacgcgtgttcatgacaagccaaaatcacagctatgtcgtcgatcgggacaccatcagcgaaaatgaattttccgtcaggtttcatcatgtcaacgacggttcagtagaagggctgatgcataaaacactgcctgtcctatccgttcagtttcatccggaagcccatccgggaccggctgaaagcgaatggatattcggagaatatttgcagaaattgaacgaagcaaggagagagatcgcccatgcctaa

SEQ ID NO: 1135 - DNA, 3090 bp, Bacillus licheniformis
atgcctaaagaccaaaccatcaaaagcattctcgttatcggatcggggccgattatcatcgggcaggccgctgaattcgactactcaggaacccaaggctgcatggcgctgaaaagcgaaggctaccgggtgattctcgtcaacagcaacccggcgacaatcatgaccgatgaatcttttgcagatgaaatctattttgagccgttgacagtggaaagcctcacacaaatcatcaagcgcgaaaaaccggatggactgctcgccaatctgggcggacagacagcgctgaatttggctgtcgagcttgaaaaggccggcattctgaaagcgtacggggtgaagctgcttggaacatctgtcgatacgatcgaaaagggtgaagacagagaaaagttccgcgccttgatgaaagagctgaatgaacctgtgccggattcagaaatcgttgacaatcaggatgatgcgcttcgttttgcgctctcaatcggttttccgattatcgtgcggccggcctatacactgggcggaaaaggaggcggcatcgcggcgacaaaagaggagtttctgcctttaatcgaaagcgccctcctcgcaagtccgatccatcaatgccttgtcgaaaaaagcattgccggttttaaagaaatcgaatacgaagtcatgcgggacagtaacaatacatgcatcaccgtctgcaatatggaaaacatcgatcctgtcggcgtccatacgggagattcgatcgttgtcgccccgtcgcagacattaacggatgcggattatcaaatgctgcgttctgccagcttaaaaatcatttccgcgctcgatgtcgtcggcggctgcaacattcaattcgccttggacccggagagcaaaaactattatgtcatcgaggtcaatccgagagtaagccgttcatcagccctcgcctcaaaagcaaccggctatccgatcgcaaaaatggcggcaaaactggctgtcggctacacgcttgccgagctgaaaaatccgctcacagattcgacctatgcaagcttcgagcctgcgcttgactatgtcgtcgtcaaatttccgcgctggccgttcgacaaattcaaacaagccgaccgcaagctcggcacgaaaatgaaagcgacaggggaagtcatggcgattgaccgcaatcttgaagcggccctgcaaaaagcggtcgcctcccttgagctgaaaacatcaggaacacatttgcccgaacttggcggcgtatcttctgaagtgctgtggaagctgcttgagacccctgatgaccgccgtttctttgcggttatggaactgctgagcagggggacttccatcagcgaaatacacgagaaaacgaaaatcgatgattatttccttcatgtgttttctaacatcattcagctggaaaacacgctgatggagcagggagactcgttgtccgtcagccttttgaaaaaggtgaaagaaaagggatttaccgactttacgatcgcttccctcaccggaaagacagaagaagaagtgcgcgcgcttcgcaagaaaatgggcattgccgcatcctttaaaatcgtcgatacatgcgcggctgaatttgatgcgaagacaaactatttttactcaacgtacttcgggaaaagcgacggagacatctctcaaaaaacgaaaaagcgggccttgatcatcggttccggcccgattcggatcggccagggggtcgagtttgactacagcgccgtgcacggcgtcatgacgctgaaaagcctcggatttgaaacgatcatgctgaacaacaatccggaaaccgtcagcacggattatgaaatggcggaccgcctgtactttgaaccgattacacccgagcatattctcaatgtcgctgaagcggaagacatcgactttgcgattgtgcaattcggcggccaatccgccatcaatgtagcgcaagcgattgaaaaagcgggcatcaccctgcttgggacatcatcggaaacccttgacatacttgaagaccgcgatcaattttatcagctgcttgacgagctcggcatctcccatgccaaaggagaaacggcttcatcaaaagcggaagcggtgaaaaaagcgaacgaaatcggctatcctgtgttgatcaggccgtcatacgtgatcggcggaatgggcatgatgatcgttcactcagaagcggagctcagagagctgctgggcggggcatcgcaaatgccttacccgattctgatcgatcaatacgtatcaggaaaagagtttgaaatcgaccttgtcagcgatggcggcgatctctacatcccgacttatatcgagcatattgaaaaagcgggcgtgcattcaggtgacagctacgcgattttgccggggccttcggttactccggagatgaaaagcgccgctcgggatgctgccgcaaaaatcgtccgcaagctcggatttaaaggcattatgaacattcaatttatagcggattcggatgagctgctcatccttgaagtcaatccgagggcgagccggacggttccggttgtcagcaaggtgatgggagttccgatgatcccgcttgcggcgaaactgttagccggttcgtcactcaaagaactgaagcccgccgccaaaaattcacgcggcgttgccgtgaagtttccggtcttttcatcgcacgccattcaagatgtcgatttgaagcttgggccggaaatgaaatcgaccggtgaaggcatgtatgtcggcttcaatccggaaagcgccctgaagaaaatctttgcaggaatctggcaaacgaaaggctgcatttacatggaaggagccggcgagctccgttctctcgcagaacaggcgggcttcaccgtacagtcggacgattttccgggctggatcaaacggaaggacaaagcgctgcacatccatttagccgagtcaaaagaggcgagaaagcagaggatagaagccgtcactcacggcgtggcggtgatgacggaagaagagacggtgcgggcatttttgacgagcgggcatggaacgactaaagccgtgtcgcttaaagatttatataaaaaggaagtggagacatgtctactgtaa

SEQ ID NO: 1136 - DNA, 951 bp, Bacillus licheniformis
atgtctactgtaaacatcggggcgacccgggagatcaatctgtcaggcaaggatttcttaagcctgaaagacttttcaaaagaggagatcgtctatttgctgaaagaggcagcggcaatgaagcgaaataaaattcaagacatctttaaaggaaaaacattggcgatgatctttgaaaaatcgtcgacgagaacgcgcgtatcgtttgaagccggaatggcgcagctcggcggaaacgccctgtttttaagcagtaaagacatgcagctgggcagaggggaaacgatcgcagataccgcgaaagtgctttcgcgatatgtggacgcgattatgatccgcacattcgaacacgaaaaagtcgaagagcttgccaagcacgccgagattcccgtgatcaacggattgaccgatctttttcatccgtgtcaagcgcttagtgacctattaacgattcaagagatgaaaggaacattaaaagggctgaaagccgtttatgttggcgacggaaacaatgtcgcgcattcgctgttaatcggctgcgcgaaagtgggatgcgacattacggtggcttcacccaaagggtatgagccgaatcaggacgtggtgaaactggccgagacattcgccgaagaatccggtgcggccgtcacgatcacaaatgatcccgtgtcagccgttcaacaagcggatgtcatctattctgatgtttttacaagcatgggacaggaggaggaagccgaagaacggatgaagatttttgctccttaccaagtcaacggaacgcttgtctcccatgccaagcctgattacatctttctgcactgccttcctgcccaccgggaggaagaggtcaccgcagagatcattgacggtccgaattcagcggtatttcagcaggctgaaaaccgcctgcacgtccaaaaagctttattaaaagcactgttatcttaa

SEQ ID NO: 1137 - DNA, 813 bp, Bacillus licheniformis
atggattttttagtgttgatcaagtatatccttttagggttgcttcagggattcacagagccgatccctgtttcgtcaagcggccatttggtgctggcacagcactttttgggcttgaatattgaaggcttcagttttgagcttttgatgaatgccggttctttaattgccgtactgctcgtttataaaaacgatattttcaggctggcggtaaacgggctgtcttatgtcacaacaaaaaatgaaaaaggaaaagcggacttcaggtttatcatctatctgatcatcgccacgattcctgccggtgtcatcggcgttttatttgatgatgagatttcggctttctttaaagacggcgtccggatcaccgcggttactttgcttattacgggtctggcattgtttcttattcgaaatttgcgcggccggaaaagcgacggcgaaatcaggctgagagacgccgtgatcatcggcttttcgcaaatggttgcacttgttcccggcatcagccgttcgggagcgacgatcgttcctgcgatggcgctcggcctcaaatctgaaaccgcgctcaggttttcatttttgctttacataccggtcagccttggcggaaccattttaagcattaccgatatttttcatgatccgcgtttaggagagctttttcttccttatttattcgcgttcatcgcatctgttatagctacatacttctcattgcgctggttcatgaatattatggcgaaaggaaacttggtttatttctcgatttactgctttgtcatcggcatcgccgttttgatattcgcctaa

SEQ ID NO: 1138 - DNA, 180 bp, Bacillus licheniformis
atgggacagcagcgtcaattccggccgggccaaaaagcgcccaataatggagtgtatgtggaaatcggcgaaacgggaagcatggttcagaaccctcagcaaatcaaattgagcgccggcgagttcttccctgaaacctccaatcataaccggctctggacatataaaagaaagccttaa

SEQ ID NO: 1139 - DNA, 186 bp, Bacillus licheniformis
gtgcgatttgtggtcgcttttttctggacatttcttttgacgcagatggcctgctacattgtcggcgccatgaacggtgctgggtatgaccttcaaaccagtgtcattatgggctttatcatcaccgcagccgttattgttcttggagaaattatgcctgttaaacaggatgcaagtcaacattaa

SEQ ID NO: 1140 - DNA, 735 bp, Bacillus licheniformis
atgaaaataaccgaacgtttttttcaaatggattcagaatggaacgtggttcatcttccgtacaagccgaacggttttctggtgttcattttcggcgaccggaaccattttgtcggggaagattcgagcttctggcttcagcattacggacgaaatcagcttctaacgagcctgagaaacaaaggctataccctggtaaacagcaatttattcggcaggcactggggctccgaaaaagcggttgcatacgcgaaacagctgattcattacgtgttcaaacaagagatattaaatgaaaaaattcatctattggcggaaggcacaggggccctcattgcagatgagctccttcgctcaatcccgaaccaaatacgttctacagcgatggttaatccttgcctcgatcttcaggctcatcataaacgagaaaaagaaaacaagtttttctacaaacagtttattaaagaaattgccgaaagctacggaattacggagcgggaggcagccgattatccgttcaaaagcatatccccttatcacaatctcgtacccgttcatatttggcaaagactgaacgggtcaccgtatccgtatatgatccatgccaaaacgtttgaggagcgccagcttaaaggccgtcacagcgtggggcttaccctgcacctgtccgaacatcctcagcgcattcattcagcaatcgcgaactttttcaaaacgcatgaaaaagtcttatag

SEQ ID NO: 1141 - DNA, 576 bp, Bacillus licheniformis
atgaagccggcacttgtatatggagcagatgagttcttcggcctttcattttgtgaacatctacttgaagagggtgttgacatagatgtaaagctggaacagacaagcgacgaaaaaaagctgatgtacctcgaagagcggctgatgtggctgggaagaaacgagcatttccgtctcatcgaaaaagagcttgaagccccgtacgaacaagtcttcatccaatacacaggctcagtgccggaagaagcgctggctgcaggcgttgaaaacaagcctgttattctgtttgtctaccaggaacaattggaagaggatttacgcgccggcatggaggaaaagggtgttgaactgatcgtgcttccggatctgttcggtccgtgggacgtcagggcagaggataaacaaaacagggacggagcgctttttgtgaacgacgcggccgcacaagccgctgcctgtgctgttgaaaaagatttttcagatttgcagtttgtacagaagacgccatacgataaagccgatgagatcattgaagaatggatcagacaaatgtctacatttttcgacaaaaaataa

SEQ ID NO: 1142 - DNA, 954 bp, Bacillus licheniformis
atggtgtacaggcttgtcgcgatttttttcattctcctggcgctaagcggctgcggacaatcgccgctgaaagggaaaattgaaaaagtcggtttgcttgtccctgatacgataaatgaccaagtatggggaaccaaaggatataaaggattattaagaatacaatccgtctacaatgtcgacgtctattataaagagggaatcgataatgacgctgccattaaaatggctgtagaagattttcacaaaaaaggcgtcaacctcatctacgggcacggaagcgaatatgaaaaagcctttaatgagatatgcaaagattatcctgatattcattttgttttaatgaactcgaaagccgaccaccaaaatgtgacaagcatatcgcttgaaggagaagcgatggggttcttcggcggaatgacggcggcccatcagtcaaaaacaaagaaaatcggcgtgctcgcaacgtataaatggcagcctgaagtagaaggattttccgaaggggctaaatacctcgatccggacattgaggtgatgacagaatatgtcggccagtgggacgacagcgaaaatgccgtcaaactgtatgaaaaaatgaagaaggcaggcgcggatgttgtgtatccggccggagacgggtataatgtccctgtcattgaacaaatcaaaaaggacgggctgtacgctatcggctatgtaagcgaccagtcggaattgggtgagaatgtcgttttgacaagcactatacagcatgtagatgacgcttatgaactcaccgccgacgagtttaataaaggaacgcttaaaggcggcaagcgctcatttgacattcaagacggcgtcatcgaaatgggagaattcagccctgttgtcgatcagtcatttcaagaaaagatgaatcggctgattgacgaatacaaaaaaacaaacaaactgccaaacgaacattga

SEQ ID NO: 1143 - DNA, 240 bp, Bacillus licheniformis
ttgacgaatacaaaaaaacaaacaaactgccaaacgaacattgaggtgatcaagatgcacgaaaaatcaatggaatttttgcaaattgccatgaagtacgttccggaagcgaaagcagagatggagaaagcgggaatcgaactttccccggaaatgcttgagccattcatgaacttgtttacgaaagtgatggccgaggcttacgagctcggtaaagcggaagccggttcagacgcctga

SEQ ID NO: 1144 - DNA, 243 bp, Bacillus licheniformis
gtggcgaacgacgattttttcacaaaaatgatgtttggctcaaatgcacccgccaggcatgaagagacggagacggatgcggaagcggaaaccgccgaagacgctgaagtatcccaagaagccgattatatgcacgtgttgaatcaggttggagaaattatggattcgctcgatgagctgaagcctgtgtttaaagaaatcggctcaatggtcagcgctttgaaaaataagatttccatataa

SEQ ID NO: 1145 - DNA, 939 bp, Bacillus licheniformis
atgaaagctggaattattggaatcggccggtacatccctgaaaaggtgctgaccaatttcgacttggaaaaaatggttgaaacttctgacgagtggattcgtacaagaacaggcatagaagaaagaagaatcgcagccgaagatgagaaaacgtccgatatggctgtggccgccgcaagaagagcgatggaagatgcaaacatcgagccggaagatcttgatatgattctcgtcgccaccgttactcctgatcaggcattcccgacagtgtcctgcatgattcaagaaaagctcggtgcattcaatgcctgtgcaatggatatcagcgcagcgtgcgccggttttatgtacggcttagtcactggaaaacagtttatcgaagccggcacatataagcatgtgcttgtcatcggagttgaaaagctttcaggcattacggactgggatgaccgcaataccgccgttctgttcggagacggtgcgggcgccgcggttgtcggccctgtcagcgacgataaagggattctgtcctttgaactaggtgcagacggcagaggcggaaaacacttgtacttggatgaaaaagatcatacaatcatgaatggcagagaagtgttcaagtttgccgtccgccaaatgggtgaatccagtgtaaatgttattgaaaaagcgggattatccaaagaggatgtcgactttttggtgccgcaccaagccaacatccggatcatggaagcggcgcgcgaacgtttggagcttccggtcgaaaaaatgtcgaaaacggttcataaatacggaaacacatcagctgcttctattccgatttctcttgtggaagagcttgaagctggtaaaataaaagacggtgacgtcattgtgatggtcggcttcggcggaggtttgacatggggagccatcgccatgcgctggggccgctaa

SEQ ID NO: 1146 - DNA, 1239 bp, Bacillus licheniformis
atgaatagtaaaagagtagtcattaccggattaggagctttatcacctcttggtaatgacgtcaaaacaagctggaacaacgcgatcaacggggtttccggagtcggcccgataacaagggtgaacgcggacgagtatcctgctaaagtagccgcagaactgaaagattttaagatagaagattatatggataaaaaagaagcgagaaaaatggaccgcttcacacaatatgccgttgtgtcggcgaaaatggccgtggaagacgcgggcctcgacattaacgaaagcaacgcagaccggatcggcgtctgggtcggttccggaatcggcggccttgaaacgcttgaacagcagttcgaaacatttttaacaaaaggaccgcggcgcgtcagcccgttctttgtaccgatgatgattcctgatatggcgaccggccagatttcgatctctctcggtgcaaaaggggtcaactcttgtacggtgacggcttgcgcgacgggtacaaactcaatcggcgacgctttcaaggtcattcagcgcggcgatgccgatgtcatgatctccggaggaacggaagccccgcttacaagaatgtcatttgccggcttttcagccaataaagcgctatccactaatccggatccgaaaacggcaagccgtccgtttgacaaaaaccgcgacggcttcgtcatgggagaaggagctggaatcgtcgttcttgaggagcttgagcacgccttaaaccgcggagcgacaatctacgcggaagtggtcggctacggatcaacgggagacgcctatcatattacggcacctgcgccaaatggagaaggcggcgtcagagccatgaaagaagcgatcaaagatgcgggtctgtcccctgtggacattgattatatcaatgctcatggaacaagcacgccgtacaatgataaatttgaaacgatcgccattaaagaagtgttcggagagcatgcctacaagcttgccgtcagctcgacaaaatcgatgacagggcacttgctcggggctgccggaggcatcgaagcgattttctccgtccttgccattaaggaaggcatcattcctccgacaatcaatatcgaaacgcctgatgaagattgcgatctggactatgtaccggatcaagcccgccgccaggacgtgaatgttgtgctcagcaactcgcttggtttcggcggacacaacgcaacgctgatcttcaaaaaatatgaataa

SEQ ID NO: 1147 - DNA, 789 bp, Bacillus licheniformis
atgagtatagcaagcacgtatgaatggcttgaacaggcttcatccgtgcgggaattgccaagctttctcctgccgtattttaaaggcgcttcaaaagcggatgcggcggcgattgtcagccacctgcagatccacggcttgttccgttcgtggacggacggcgaacgtacgatgaagcagcttaaggaaaacggcgtatttcagcatgtcagacgggaagaacagctgctctgcaaaagatggaacgggccggatgttccgattttcatcctgccggtcgatgaaagaaaccgcaaaatccgcgtcgaattcggctcgaaatcaggcctcgcgttcagcgacaaattatttttgtttttatcggccgatcttccccggtcttcaatttctgcgatcatgacacacgaatataatcacgtttgccggttagaaaatatgccgaaagaagaaaaaaagatgacgctgcttgatacaatcattctcgaaggccttgcagaatatgccgttttcgaacggctgggagaagccgaaacagccgcatggacgtcatattactccgaaaagcagcttcgtcatttccaggaccggttcgtaaagcctcatttcgacctgcgccgacacgatggccggctattctccaatattttatttggaaaaggacattaccctgacatgctcggatatgctgtcggttacagtattgtgaaaaaatatttatcggctcgaaaattgaaggttgccgatgttttagcctttccgtcagaagactttataaagctatcgctttaa

SEQ ID NO: 1148 - DNA, 975 bp, Bacillus licheniformis
atgagcgcattgctggaagtcaatgatttaaaaacttatttttttaggaaaaaacagccgatacctgcagtggacggcgtcgatttttcaattaaaaaaggggaaaccgttgcgctggtcggtgaatcgggatccggtaaaagcattacctctttgtcaatcatgggactggtcgagggctcgggcggaaagatcatgagcggctctatcaagctcgaaggacaggatctcgttacatacaaagaacaagatttatgcaagatccgcggaaatgaaatctccatgatttttcaggaaccgatgacctcgctcaatccggttttgacgatcggcgaacaaatcacagaagtgctgatctatcataaaaagctatcgaaaaaagaagccgccaaaaaagcggtagaattattaaagcttgtcggattttcaagagccggcgagctgatgaaagagtatccgcaccgcctgtcgggcggcatgaggcagagggtcatgatcgccattgccttaagctgcaatccgaagctgctgatcgcggatgaaccgacgacagcgcttgacgtcaccattcaagcccaagtgctggaactgatgaaagacctatgcgacaaattcgatacctccatacttctcattacccacgatctcggcgttgtgtccgaaattgcggaccgcgtgatcgtcatgtattgcggacaagttgttgaaaatgccacagtagacgagctattcgacgaacccctgcatccctatacaaaaggactgttaaactccatccctgtcattgaaggctccattgaaaaattaacagccattaaaggaaatgtgccgacgcctgacaaccttcctgccggctgccggttcgctccaaggtgtccgagcgcggtcgacaaatgctggggggcgcagccagacttgaaaacgcgtccggacggccggtctgtcagatgttttttatatgaggagggagaataa

SEQ ID NO: 1149 - DNA, 1023 bp, Bacillus licheniformis
atgacttcatcagctgaacaattacagcccggacaggaaatgaacccgcaagaatcccttctggagctgaaagacgtcaaaaagtactttccgatccgctcagggatttttcagaaaaaaatcggcgatgtcaaagcggtggacggcatcagcttttcgcttaaacgcggcgaaacgctcggcattgtcggtgaatcgggctgcggaaagtcgaccgccggacggacgatgatccgcctttataaaccgacggcagggcagattttttacaaaggccgcgacatttcaagtttgtcggaagaagctttgagaaaaagcgtccgcaaaaacatccagatggttttccaagatccgtttgcctcactgaacccgagaaaaacgctgcgttccatcatcaaagaacccttcaacacgcatcatatgtacaatttcaaagagcgcaacgaaaaagccgaagagcttttagccaaggtcgggctgcacccgtcgtttgcgaaccgctatccccacgaattttccggggggcagcgccagcggatcggaatcgcgcgggcgctggctttaaatccggagcttattatcgccgatgaaccggtatccgcattggacgtgtcaatccaggctcaagtgatcaacctgatggaagagcttcaggaagaattcaatctgacatatttgttcatttcccatgacttgagcgtcgtccgccatatcagcgacagggtcggcgtcatgtatctcggcaaaatgatggagctgacagacaagcatgagctgtacggcaacccgcttcatccatacacgcaggcgcttctgtccgccgttcccgtcactaggaagaaaggcggaacaaagcgggagcgaatcgttttaaaaggcgagctgccgagtcccgccaaccctccgaaaggctgtgtctttcatacgaggtgtccggccgcaaaagcgatttgcgcggaagccgaacctgctttcaaggaagtgaaaacaaaccatttcgtggcatgtcacctttacgaataa

SEQ ID NO: 1150 - DNA, 1644 bp, Bacillus licheniformis
atgaataaacgcaaaacaggattttcaattttaagcttgctgctgatcttatcgatttttctaacggcctgcaacagcggcgaagtcggaggggatgaaaaagaaggcaaatctgacgggaagccgcagcagggcggagatctgattgctggatccacaggtgaaccgacgctgtttaattcactgtattcaactgatacagcaagttcagatattgaaagactgatctacaacactttgttagacgttaatgagaaacttgaagtggaaaaccaactcgctgatgaagtaaaggaatcggaggatgggttaacattcgatgtgaagctaaaagaaggtgtcaagtttcacgacggtgaagaaatgacagccgacgatgtcgtttttacttacagcattccgatgagtgatgaatacgttggagaacgcggctcaaactttaaaatgatagagtctgtcacgaaaaaaggtaaatatgaagtgcagtttaaattaaagaagcaggatccgtatttttacaatgttacacttgccagttacggtattctgcctaagcacattttaaaagatgtcccaatcagcaaactcggtgaacacgaattcaatcgaaagaatccgattggaacaggaccgtttaaatttaaagaatggaaagaaggacaatatgtaaaggttgaggcttttgatgattattatgccgggcgtcctcatttagattcgatcacgtataaaattattccggattcaaatgcagcgctgtcacagctgcaagctggagatgtcgattacttggtcgttacaccaggaccagactataaaacggccgagaaatttaacaatgtgaagatggaaaccgatttaggtttgaattatacgtatatcggctggaacgaaagaaatgagctgtttaaggataaaaaggttcgccaagcgctgacacatgcgcttgaccgccaggcgctcgttgaccaagttctagatggagatggggaaatcgcgaacatcccggaaagcccgctttcatggaactacccggataacaaagataagtttaaaacgtttgaatacgatccagagaaagcaaaaaaactgctcaaagaagcaggatggacagactcagatggtgatgggattttagataaggacggcaaaaagttttctttcgttattaaaacgaaccaaggaaacaaaacacgggaagacctcgcggttgttgttcagcagcaattaaaagaaattgggattcaagcaaaaccgcagattgttgaatggagtgctttaattgaacaaatgaacccgccgaattgggattttgatgcgatgatcatgggctggagccttgctacgttccctgatcagagcaacattttccattcgaaagaagctgaaaaaggactaaactatgtttggtatcaaaatgaaaagcttgataaactgctggatgaagctaaaacgttgaaggaccgtgaagaatataaaaaggcgtatgaagatatttacgaaattctggcggaagatcagccgtatacattcttgtattatacgaattaccatagagcgatgcctaaaaatatgaaaggctacgtattccatccgaaagaagatttctataaagccgaagactggtggctggatcaaaaataa

SEQ ID NO: 1151 - DNA, 951 bp, Bacillus licheniformis
atgattacatatatcattcgaaggacgctcatgtcgattccaatattatttggtattacaattttgtcatttgcgattatgaaagcagcgccgggagatccaatggcattgatgatggatccgaccatcagcgcgggagaccgtgaaaaattcattgaaaaatacgggttggatgaacctgaacacgttcaatatttaaagtggctcggaaatatggttcaaggtgacttcggtacttcaatcgttagaaaaggaacgccagtgactgatttgattatggcgaggctgccgaatacgttattgttaatgctcgtttcaaccattttggctctcctcatatcgatcccgcttggagtgctttcagctaggcggccatattctaaattggattatggcatcacattcacatcatttatcggtcttgctgtcccaaatttttggcttggactgattctaatcatgtttcttgctgttaatttaggatggtttccaaccgggggcgttatgactctgaatgccgattttagtttatgggatcgcattcatcatctaattttgcctgcattcgtcctggcgaccgcagatatggcgggactcacccgctacacgagatcgagcatgcttgatgtgctcaggcaagactacatgcggacagcgagagcaaagggttttaaagaaaatcgtgtcgtgtacaagcatgggcttcgaaatggtttgcttccggttattacgatctttggtctgatgattccttctttcatcggcggagctgtcgttactgaacagattttcagttggccaggacttggaaagctgtttgtcgactctgctttccagagggactatcctgtcattatggcaatgacggttatttcagccacacttgttgtcattgggaatttagttgcggatattctttatgcaatggtcgatccgcggattgagtattaa

SEQ ID NO: 1152 - DNA, 915 bp, Bacillus licheniformis
atgacacagacaaatccatcgacaccttcgccggagatcacattgcaggaaaatgtcgcaccaaagcccgagacaatgacaaaaatcttttttgaaaagttttataaaaacaagctggcggtaattggaggagttttattatttattattatcctatcagcgatttttgctccggtgatcgctccatacccgccggaacagcaaaaccttctgaataagctaaaaccgccaagtggtgaacatctaatgggaacagacaagtttggccgagatattttcagccgtttactttatggggctcgggtttctttacttgtaggctttgcctctgtacttggatcgattacgataggtacggtggtcggcgcaatcgccggctactttggcggaataatcgacgctattatgatgagactggtggatattgtattatccatacccgacatctttctgttaatcacgctggtcaccatcttccagccgggcatagataaactgattttaatattcgccttgacgagatggacgacgacagcgcgccttgtccggagcgagtttttgtccttgaggtcgagggagttcgtcttggcggcgaaaacgatcggtacaagaaattacaaaatcattttttctcatatccttccgaatgcgatggggccgattatcgttgccgcgacgctttccgtcggtaccgtaatccttgcggaatcggcattaagctatcttggattcggggttcagccgccgatggcaagctggggaaacatgcttcaggatgcacagaactttacgatcatgatccaggcgtggtggtatccgctgttcccgggcctgatgatcctgctcactgtgctgtgctttaacttcttaggcgacggactccgcgatgcgcttgatccgaagaatattaaatga

SEQ ID NO: 1153 - DNA, 1266 bp, Bacillus licheniformis
atgttaagcgtattgaaaaataaaaactttttatttttgatattagggcgtttggtaaccaatattggggacagtatgtatacagttgcggcaatgtggcttgtgtttgatttatcaaaaagtacattttattccggattagctggttttttgacgatgttcccaactgttttgcaatttttaacaggtccgattgttgataaagtcagattaaataaagttttggtttggagtcaactcatccaagctattttggtgttgattattccgcttttttatttcattggatatttgaacatttggatcatcatgatgattatgcctcttatcgtattcattgagcaatttacttatcctgcgcaatctgccgcactgcctaaaataatcaaaagtcaagatctagttaaagcaaactcacttatgtcattttcatatcaaggtacagatattatatttactggtattgcaggtattgtgattgcttcggcaggagctataagcatatacttagttgactctttcacttttttgttagcggcgctgttttttaagtgcgtaaaattagaacaaaaaaatgagatagaacataagccccgattccacttcaaaaaagtcatacacaattatacaacggatataaaagagggatttacactcattcgtcattccctcattccaaaaatcctcttgggctcgatgatttctaacttcatgcttagtgcgacgattgtgattttgccaagcttctcttcgattagaggaggagaagaatactatggatattatttggcttccatgtcatgcggtttactgttaggttcaatattcgcaacagtgtttggccgattcgcgataggatcacttacgatatacggatttttcatttcaggggttttatggagtatttcggcgatcgccacctcttcatacatatcgattattttatttggtttgtctcaaatatccatcggcgtgacaaacgtcattttcatgtccattttgcaaagcatactgccggaagagtttatagggagagttttttcttttatcgcaagtttgacaagcatagcagctccttttggatctttgctgggagggtttaccgcgtcattgatcggcagcgataaggttttctttataggaggaattgccatgctgtttgtatctgtttattgggtgtttcagtcttctttaagatcaattccttcatcagaaaaaataaacgctaaagaatacagcttttttacaaacgtgttgaataaataa

SEQ ID NO: 1154 - DNA, 750 bp, Bacillus licheniformis
ttgtttcttcatgatgtgtgggtgaattggtttgagggagaagaaaatggctacaacgtctgccactttcatgaatggcggaaggaagacagtgttgaattgcttgaccaggtgcctttgttaagggtgtcgtccgttttgtttcactacatagaaaatgatttgtcagagcttccggccgaattattgaacgaggttcatcaaaaagcgtatattcgtaaaaatcatgagcggacacagcttgatcattgtttcgtcgtaacggacggcattggtattctcgcggtcgatacggccggttacacaataccggtaagaaaaagccgcctcattccgagacaggagcagctcgtttatgaaatggtgaaggacgttgaagcggaaacttacgagtttgcaccagagaagctgcaatcttccaaagaataccacattttatctttatcaccggagcatgtcagaggattaacgagaaaagaacgccagctcaaacagctgctgttcatggcgctcgatcagctcaaagggctccaaaatcgggccgagatcgcttattggtacaccgaatggaatccgtatatgtatgaacagatcaagcgcatgacatttgaagaaatctgggacatgcttttcaatgagacgatcgacggatggtcagacaaacacagggacttttgtgaaaatttgattaaaggacagccgttttttgaaaagctttgggaaattgagaatgagtctaaagtcaactaa

SEQ ID NO: 1155 - DNA, 993 bp, Bacillus licheniformis
atgaaaaaaacgattttttccggtatccagccgagcggctctgtcaccctcggcaactatatcggagcgatgaagcagtttgtcgacttgcaggatgactacaactgttacttctgcatcgtcgatcagcacgcgatcacagtaccgcaggaccggctcgcgctgagaaagaacatccggaaccttgccgcgctgtatttggcgatcggcctcgatccgaaaaaagcgacgctgtttatccaatcggaagtgcctgcacacgcccaggcgggatggatgcttcagtgtgtcgcctacatcggcgagcttgagcgcatgacgcagtacaaagataaatcagccggaaaagaagctgtcgtctccgggcttttgacatatcctccattaatggctgcggacattctgctttatggaacagacgtcgtccctgtcggagaagatcagaagcagcatcttgaattaacccggaacttggcggagcgtttcaataagaaatataatgacatttttacggttccggaggttaaaataccgaaggtcggcgcccgcattatgtcacttgccgacccgctcaaaaagatgagcaaatcagatccgaaccaaaaagcgttcatcaccctgctcgacgaaccaaaacagcttgagaaaaaaatcaaaagcgctgtcacggattccgacggaatcgtcaaatatgataaagaaaacaaacccggtgtatccaaccttctgacgatctattcgattctcggacaagcctcaatcgaagagcttgaagcaaaatacgaaggcaaaggctacggcgaatttaaatcagaccttgccgaagtcgtcatcggcgcgctgaaaccgattcaagaccgttaccacgaattgatcgaatctgaagagctggaccggattttggacgaaggcgccgaacgcgcaaatcaaacagcaaacaagatgctaaaaaaaatggaaaacgcgatgggactcggccgaaaaagacgctga

SEQ ID NO: 1156 - DNA, 1626 bp, Bacillus licheniformis
ttgaagaagcgtttgtcatttatcagtttaatgctcattttcacactcgtcctcagcgcctgcggcttcggctcaagctccggtgacggcggtaaaaaagacagcaaagggaaagacacattaaatgtcaacattaaaacagaaccgttttcactacatccgggactcgcaaacgattcggtgtctgcaaacgtgcttcgtcagacttttgaaggattgacgacaatcggtaaagatggaaagccggttgaagcggcagccgaaaaaatcgaagtcagcgacgaccaaaaaacatacacattcacgctccgcgacgcgaaatggtcaaatggagatcctgtaacagcagaggattttgaatacgcatggaaatgggcgctcgaccctaaaaacgaatcgcaatatgcgtatcagctttactacttaaaaggcggagaagcagcgaacaccggcaaagggaaaattgaagatgtcggcgttaaagctgttaatgataagactttaaaagtcgagcttgaaaaaccgacaccgtattttactgaactgacagcattctacacatatatgccagtcaataaaaaggtagcagagaagaatgcgaaatggtacacaaacgcagatgagaactacgtatctaacggacctttcaaaatggcgaaatggaagcacagcggaaacatcgtactggagaaaaacgaccagtactgggataaagacgctgttaagctgaagaaaatcaatatggcgatggtcaacgatccgaacactggtctgaacatgtacaaaaaaggcgagctagactttgtaggacagccgcttgaccagatttcaacggatgcgattccaagcctgaaaaaagaaggcctgaacattgatccgttcgcatcggtttacctgtacaaattcaacactgaagcggctccgctgaacaatgtcaacatccgtaaggcgctgacatacgcgatcaaccgcgaagcgatcgtcaaaaacatcacgcaagcggaacagctgcctgcgatgggattagtgccgccggcggtccacggctttgaatccaacaaaggctatttcaaagaccatgatgtcgataaggcgaaagaacacttggaaaaaggcttgaaagagctcggtttgaaaaaagcgtcagaccttccgaaaatcacgctttcctacaacacggatgaagcgcaccaaaaaatcgctcaagccgttcaggaaatgtggaacaaggaactgggcgtagatgtggaattaggcaatgaagaatggaacgtttacatcgataagctccatgccggaaactatcaaatcggccgtttaggctggaccgccgactttaacgacgggatgaacttccttgaaacataccgcgacaaagaaggcggaaacaatgatacgaactgggaaaacgcgaagtataaagagctgctgaataaagcatcaagagaaactgattcagcgaaacgcatcgagctgatgaaagaagcggaaagcatcatcatggatgagctgccggtcgcaccgatctacttctacacaatgccgtatcttcatgatgaaagcttaaaagactttgttctgaccggtacaggtgagatctatttcaaaaccgcgcattttgaataa

SEQ ID NO: 1157 - DNA, 936 bp, Bacillus licheniformis
ttgattaaatatttaggccgtcgtcttgtttatatgttaatttctctctgggttatcgtaacagctaccttcttcctgatgagagcgataccgggcggacccttttcaggcgagaggaaacttccccctgcaattgaagccagtctcaattcctactatggtttagaccagcctctttttaaacaatatctcgattatttagtatcggtagcaaagtgggatttcgggccgtcatttaaatataagggacaaactgtgaacgacttgatcagctcagggttcccgatttcttttacactcggattggaagcgatttgccttgcgctcgctttcggcgtattgttcggcgtgatcgccgcgctgaagcgaaacaagtggcaggactacacagcgatgatcattgcggttgtcgggatctctgtgccgaacttcatcatggccgcgcttctccaatacgtgctggcaatgaagctgggcatgtttcctgtcgcgcaatgggagtcatggggacatactgtgcttcctgcaatcgctgttgcctcgatgccgatggcgtttatcgcccgtttgacgcgctccagcatgcttgaagtgttgagcagcgactatatccgcacggcgcgtgcaaaaggtttgagcacatcagccgttacgtttaagcatgcgatacgaaatgccatcatgccggttgttacatatatgggcccaatggcggcgtccattttgacaggaacgtttgtcgtcgaaaaagtcttcggtataccaggactcggcatgcactttgtcacaagcattacgaaccgagactatacggtgatcatgggcgttaccgtcttcttcggggcaatcttgctgctttgcgtcttgattgtcgatcttttatacggcttaattgatccgcgcattaaattgtttggcgctaagaaaggggagtaa

SEQ ID NO: 1158 - DNA, 918 bp, Bacillus licheniformis
atgcagcaaataccaaaagacatgtttgaacctgcagctgttgaccatagcgaagccgaaaagatctcaaagaaaaacctttctttttggacagacgtattcttgagatttaaagaaaacaagctggcgctgtttggactggtggttctgatcctgatcgctctgatggctatcttcgcgccggtgttctcaagctttcaatatgaagaaacagatttaacgaatgcgaaccagccgccaagcggtgagcactggtttggaacagatgaccttggaagggacgtattcgtccgtacatgggtcggcgcccgcatctcgctgacaatcggactcgctgctgcgctgatcgacgttttgatcggtgtgatatggggtgcgatttccggcatcagaggcggacgtacggatgaaattatgatgagaatagcagatattttatgggcgattccttctttattaatgaccatcctgctgctcgttgttatgggaaaaggcctgatcacgatgatcgtggcgatggttattacgggctggatcaacatggcgagaatcgtccggggccaagtactccagcttaaaaatcaggagttcgtactcgcctcaagaacattgggagcgaaaaactcgcgcattatcagaaagcacctgctgcccaacatcatgagcccgatcttggtcaccatgacattaaccgttcctacggctattttctatgaggcgtttttaagctacctcggcctcggggttccgcagccgcttgcaagctggggaacgatggcaacagacggtgttcagggattggaatactacccttggcgcctgttcttcccggctacttttatctgtctgaccatgtttgcattcaacgttatcggcgacggactgcgcgacgctttagatccgaagctgcgtaaataa

SEQ ID NO: 1159 - DNA, 1068 bp, Bacillus licheniformis
atgaaacacttacttgaagtgaaagatttagccatttcttttaaaacatacgccggagaagtacaggcgatccgcggcgtcaactttcatgttgacaaaggagagacgcttgcgatcgtcggtgaatccggatcaggtaaaagcgtcacttcacaggcaattatgaaactgattccgatgccgccgggctattttaaaaacggacaaatcttatttgacggacaagacctggttccgaaaacggaaaaagagatgcagtcgatcaggggaaaagagatcggcatgatctttcaggatccgatgacttctttgaaccctacaatgaaagtcggccgccaaatcacagaagtgctgtttaagcatgaaaaaatctcaaaagaagaggccaataagcgggcggtagagcttctcagccttgtcggaattccgatgcctgaacgccgcgtcaaccagtatccgcacgaattcagcggcgggatgcggcagcgcgtcgtcatcgcaatggcgcttgcggccaatccaaagcttttaattgcggacgaaccgacaacggctcttgatgtgacgattcaggcgcagattttagagctgatgaaagacctgcagaaaaagatcgagacatccatcatttttattacgcacgatctcggcgttgtcgcgaacgtcgccgacagagtcgccgtcatgtacgcgggacagattgtggagatcggtacggtcgacgagattttctacaatccgaagcatccgtatacatgggggctgctggcttcaatgccgagccttgacaatgacggtgatgaggaattaatggcgataccgggctctccgccggatttgaccaatccgccgaagggcgatgcctttgcgttaagaagcccgtacgcaatgaaaatcgattttgaacaggagccgccgatgtttaaaatatctgatacacattatgtgaagtcatggcttttgcatccggatgctccaaaagtcgagcctccggcggctgtcaaaagcaagatgaaggagtttaaaaatcagtatgaaaaaccggttcaagtgaaagaaggtgaatga

SEQ ID NO: 1160 - DNA, 924 bp, Bacillus licheniformis
atggcagaaaaactgctcgaaatcaagaatttaaaacagcacttttcaacgccgaaagggattgtaaaagctgttgacggaatctcttttgacatttacaaaggggaaacgctcggtcttgtcggagagtccggctgcggaaagtcgacgaccggccgttcgatcattcgtttgtatcaagcgacttccggagaagtcttgtttaagggaaagaatgtccacgacaaaaagtctgccaaggaccttctcgaattcaaccggaagatgcagatgatttttcaggacccgtatgcatccttgaatccgcggatgacggttgccgacatcatcgcagaaggtattgacatccacggtttggccaaaacgaaaaaagaacggcttgagcgcgttcatgaactcctcaatctcgtcggcttaaataaagaacacgcgaaccgctatccgcacgagttttccggcggacagcgccagcggattggaatcgcaagggcgctggcggtcgaaccggaattcatcattgccgatgaaccgatctctgcactggacgtgtccattcaggcgcaagtcgtcaatttaatgaaggatttgcaaaaggaaagaggactgacataccttttcatcgctcacgatctgtcgatggtcaaatatatcagcgacaggatcggcgtcatgtatttcgggaagcttgttgaattggcgccggcagatgaattgtatgaaaatccgcttcatccgtatacacaatcattgctttccgccattcctctgcctgatccggattatgagcgcacgcgcgtgcggaagacgtatgatccgtccgtccatcagctgaaaggcgacgaacagatggagctccgcgaagtaaagcccggccatttcgtcatgtgtacagaggaagaatttaaagcctatcaatccaaataa

SEQ ID NO: 1161 - DNA, 579 bp, Bacillus licheniformis
atgaactggtatgagaagcttagcgagtatttccctattgaagaaatgaaatcaaaagagcatatggaagcattgttaaaggaacaaaacgatatttaccataaagaagaaggccgtcatcatgtgttgatgtacgccgaattcgactcttttattttcatcgactatttattcgtttctaaagacgcacgaggacagggacttggatccaagctgattgagaagctgaaaaagaaaaacaaaccgatcctactcgaagttgagcccgtggatgaagatgatgccgatacggcgaaacgtcttaaattttatcaaaaggaaaactttaaacacgctgagtcgattggttaccgccgccggtcactcgcaaccggcaaagtgaacaaaatggagattctgtattggtctccaaaatcaaacacagagaaagaagtgtttgacgcgatgaaagaaacgtacgaaaaaatccatacatacaaagatgaaaaatggtatggagaatcttatgaagatgtggatgacgtccttacgattgttgacgatcataaacagaagaacattttcgatgaattaagctaa

SEQ ID NO: 1162 - DNA, 396 bp, Bacillus licheniformis
atggttacattatatacatccccaagctgcacgtcttgcagaaaggcgcgcgcatggctagaagaacatgatattccgtttacggaaagaaatattttttcagagcctttatcaattgatgaaataaaagagattttacgaatgacggaggacggaacagacgaaattatttcaactcgttccaaagtgttccaaaagctgaacgtcaaccttgaaacaatgccgcttcaagagctgtaccagctcatcaatgaacatccgggccttttgcgccgtccgatcatcattgacgaaaagcgcctgcaggttggatacaacgaagacgaaatccgccgcttcctgccgcgcaaagtgcgcacattccagcttcgtgaagcgcagcgtcttgcaaactaa

SEQ ID NO: 1163 - DNA, 663 bp, Bacillus licheniformis
atggaacacgatatactgatgtcgttccttgtgatcatcggaatcgatctcatacttggcggcgacaacgctgttgtgattgcaatggcaagccgtcatttgcctccccggcaaaggcaaaaagcgatcatcatcggcacattgatcgccatcatgatgagaatcgcgctaaccatggcagcagtatacctgctcgcggttccttatctgcaatttatcggaggaatcttccttttgtacttaggatatcagcttctgattgagaaaaaagatgcccagcatgtcaaaggcgggacatctttatttaaggcgatccgcatcatcgtgattgccgacttgttcatgtcccttgataatgtgattgcggtcgccggagcctcacacggacgcctgatgcttgtcgttgtcggcctgatggtctccgttccggtcatcatttggggcagcaggctgattcaagcggctcttgccaaatttccgctcttaatatacgcaggaagcggactgctggcttatactggcggcgaaatgatcgtcagggagcaggagttgtcttcctttatggcgcagcacagcaccctcgaaatgctgctgcccgtccttacggttatttttgtgattttagccagtatttattatgaacagacgagtgaaaagcattaa

SEQ ID NO: 1164 - DNA, 639 bp, Bacillus licheniformis
atggaaatcgaaagaataaacgaacacacggttaagttttatatttcctacggtgatatcgaagaccgcgggtttgacagagaagaaatttggtacaatcgagaacgcagtgaagagcttttttgggaaatgatggacgaagtgcacgaagaagaagagtttgccgttgaaggccccctttggattcaagtgcaggcccttgacaagggattggaaatcattgtgacaagagctcagttgtccaaagacggacaaaagctggaactgccgattcctgaagataaaaaacagcatgtagcagaagaaagccttgatgctttgcttgacgactttcaaaaagaagagcaggcagaagagcagaaactgcagtttgttttaaaatttgacgattttgaggatttaatctcactgtcaaaaatgtctgtcagcggttgccaaacgacattgtactctcatgaaaaccgctattatttattcgtggatttcaatgaactgcctgatgaagaggtggaaaaccagctgagcattctgctggaatatgcctcagaatcaaagatgacgattcatatgctgaaagagtatggaaaactgattgcagcggatcatgctcttcatacaataaaaaagcactttgcataa

SEQ ID NO: 1165 - DNA, 1017 bp, Bacillus licheniformis
atgacaaagaggggcagatgttacggctttacgattttacttgtgtttgcgctgattttgggaggatgcggcggaaacacggcttcaaataaagccgcgaatgaaaaagactttaagccttcgaaagcaatcgaggtcgtcgcgcctgccggagccggcgggggatgggatacaacggccagaacgatctcgaaaatcatgggtgaagaaaaattgattgaaaagatggctgtcgtcaacaaaccgggcggcggtggagcgtccggatggtcgtatgtccaccgcaaaaaaggcgataatcatacgttgtttgttacatcaccgccgattttgttcgtgcctttaaacggacaatcccagtacggccacaatgattttacgccgattgcaagcgtgattgccgattacggagcgtttgtcgttcataaagattcgccttatcagtcgatgacagaccttgtggatgcgcttaaaaaagatccgaaagcagcttctattgtagggacgtcttctcctggaagcatggaccacatgcagtttgtcagcgctgttcaaaaggcgggcgttgatgcgaaaaagctgaaatatattacggctcaagacggcgcagggatgagcatgctgctcggcaaaaaagccgacgtctactcgacgggtgtcggtgaagcggccgaacaagcgcgagccggaaaagtcagagtgctggccatcaccgctcccgaacgcatgaaaggagataccgtcaaggatttcccgactttaaaagagcagggaatcgatgatgaatttacggtttggagaggatttatgggacctccgggaatgagtaagtccgccgtaaagtattatgaggaaaaaatcaaagagatgatggaaaaagacagctggaaatcgattcgggacagctatggatggacggataactttatgggccatcaagaatttaaggactatcttgacactcaatataaagaaatgaaagcgctccttgatgagattggattgggcgacaaataa

SEQ ID NO: 1166 - DNA, 456 bp, Bacillus licheniformis
atgagaatcacaaaccgggccgtttctgtcatcattttggctgtagcagccatttacctggcgctcagctttaatttagacagctatccgtacgcggtgatcgatgcggatgtgctgccgaaaagtttaggcatattgcttctcatattaggcatatttctgttttttgaaaaagatcaaaaggatacaacggtgaaaaagctgtttcagctgcagaaaaaagacgttaaggtcatgatgctttgtgttgtttctctgttgatctacatttccgttttagaattcatcggatttttgctatctactgtgatgctgctgctcgttttgcccgcggtgttgggatatcggaactggaaaactgctgcgatcgtttccctggttttcagcagcacaatttatttttcattcaattatgtactcaacatcatgcttccgcagggggttatgcctttttaa

SEQ ID NO: 1167 - DNA, 1506 bp, Bacillus licheniformis
atgttagatagtattttatacgggtttcaggtggcgctgactctgcagaatatcatgttcgcttttatcggagtgctgatcgggacgattattgggatgctgcccgggctcgggccgatcaccgcgattgccattatgatcccattaagctatggaatggatccggcctccgcgttaattttgatggcgggtgtctattacggagcggtctttggcggttcaacatcatcgattctgttaaatgcccccggagtggcaggcactgtcgcgacatcgtttgacggctatccgatggcaaagcaggggaaagcggggaaagcccttgccatcgctgcaatttgctcctttgcaggcggaacgatcaccgtagttgcgctgatgctcgtcgcgccgacaatggcaaacattgcggtgacatttgggccgacagaatattttgcattgatgatgctcggcttggtggcaatttcgagcctttccgaaggatcgacggtcaaagcgctgatctctgcgacattgggctttatgacggctaccatcgggattgatccgcagacggggaccgaacggtttacattcggtgcggcaagccttctggaaggaatcgattttctgatcgtggcgctcggtttgtttgcacttgctgaagttgcgtttttaatcaagacgcggaacaagccgatgacagagggagcgtctcaggtcggcagcctgaaggtgacgaaaagcgaaatgaaagagatttcgggaccgatcgcaaggcattcggtcatcggatttctgctcggcatcctgcctggtgcaggagcgacgattgcatcatttatttcttatattacggagaaaagaatctcaaaacatcccgaaacgtttggcaagggaaatattaaaggagtcgcagctcctgagacttcgaacaatgcggcaacgagcggcgcattcgtacctctcctgacactcgggattcccggatcagggacaacggccgtcctgctcggcgcacttttggtcgtcggcgttcagccggggccgctcatgcttacggatcatcccgacgtgttctggggcgtgatcgcaagcatgtatatcggcaatttatttctgctgattttaaatttgccgttaattcctttcttgtcaaaaattcttctgattccgaagcagcttttgatttcgctcatatttgttttctgcctgatcggcgtctacgctgtgacatttaatgtcgtacacctttatattctcgtgttcttcggaattctcggatattttatgagagtgctgtcttttccagcggctccgtttattttggcttttattctcggaagtttgatggaagagtcgttcagacaagcgatgacactgtcatcaggaagcctgtccgtgttttttgaaagtcccgtcacaatcggtttattgattacggctctattgtctctcatcgtgccgccgatttcccgggcaatgaagaacagaaataaaaagtcgatcgatttggaaggctaa

SEQ ID NO: 1168 - DNA, 717 bp, Bacillus licheniformis
atgaaagcattacaagtatttatcgtagaggatgacatcagaaacgctgacatccaccaaaaactgatcagcaaaattgatggattttctgtcattggaatcgcggaaaattttcaagatgcaaaagatttgcttccggacgtgaagcccgaccttgtcctgctcgacatttttctgccggacggctccggcatggagcttctctggctgatcagacaaacgctcaggcatacagacgtcatgatgattacggcggctaaggaagtcgaatatgttgaacaggcgattcgcgcgggagccgtcgattatttgatcaagccgattatgttttccaggctgaaagaaacgctgttaaactatcggtcttaccggctcaaagtaaatgaaatgtcttcaatcgaccagacagacgttgacagcctgatggcaaaaaggcggagcatcacgaaagaacaaattgctaaagccgattatccgaaaggaatcgacggactgacgctgaaaaaagtagccggcgttttaaacaaaagcgaaaacagcgatggcatcaccgccgaaagcctcgggcgcaccatcggtgtcagccggacgaccgcaaggcgctatttagaatttttagctgccgaaaagcatgtaaaaacagaactttactatggaaccgtcgggcggcccgaacggcgctacaagcccgtaaaaaatgaaagtccggaaacgtag

SEQ ID NO: 1169 - DNA, 1596 bp, Bacillus licheniformis
ttgagaaaaggagtttttgacatcaaacggaagctgaccaccaagctcacattgctgattcttaccctgcttttgctcttgctttctgtcatgagcggcctctatttaattattttagaaaattctttaaaaacacaaatccaggccagagcgctcgatatggcgaaaacgctcgcccacatgccttccgttcagaaagcgtttgaaacggacgatccgtctcgaacccttcagccaattgcagaaaatgcgagaaaacagtccggtgcgcaatacatcgtgatcggctcggcggatgcgattcgctatgctcatccggaccctggaaaaatcggcaaaccaatggtcggcggagacaatcggcgcgcccttgaaaaaggtgaagcatacgtttcggaagccgtcggcacgcttggcccggccatcaggggcaaagcgccgatccataatgaaaacggcgaaatcgtcggcatcatctcagtcggttttttaatagaaaatattcaggacatcgtctatcaatatcagtcaaaattcatatttttattgggatttgtcgtgctgatggggattttgggagccgtctatatttcccgcaatgtcaaaaagtccattttcggccttgagccttatgaaattaatcaattatatactgaaaagcaggcgattacagaatctgtgcacgaggccttgatcgccatcaataaacatgaagaaatcacgcttttgaatagaaaagcgtgtgagctgcttcgtgtcgaaagcgaagatcagtggctcggcaaaccgatttccgagcttcttccggatacgctgctccccgaagtgctgaaaacgaaaacggcgcaaaaagatcaggaattaacgatcggaaacgaagaattaatcgtcaacagagtgccgattttcgaaaacgaaaaaatccgcggcgccgttgcgagcttcaggagaaagacggatattgacgaactctccaaaaagctggcgcaaacttcgcaatacgcggaaggtctgagagcccagacccacgaatattcaaacaagctgaatacaatcgcgggactgattcagctggaaagctatcctgaagcactcgagttgatccaaaaagagaataaaagccatcaggatatgctgcaatttctcatccattcgattccagatccgcttctttccgggttgctgctgggtaaggtcaaccgtgccaaagagctgcacatcaacctggaaattgatgaaagctcaaaattgaacgctttgccggacgaaatggataagggaaaattcattacgattttaggaaatttgattgagaatgcctttgacgccgtttcccacaaaaaagaccgcagcatccttgtctttttgtcagacggtgcagatcacatattaattgaagtcgaagactcgggagacgggattccaaagggggaacaggagcggatctttcaaaagttttattcgacaaaaacggcaaaccaccgcggcctcggcctctttttagttaaagaagccgtcaatgcgttaaacgggcaaattaaagcggacaaaagcgaccttggcggagcattgtttactgtcgtgataccaaaatag

SEQ ID NO: 1170 - DNA, 1149 bp, Bacillus licheniformis
atgttcagtgcaatgatcgatcaaggcgggaccatctgccttgccgacggatacaaagccgaagatctcaagcgattgagaaaaagacatgcattttactgcccggtgtgccggtgtgaactcgacctgaaaatcggttccgtcaagcttccgcatttcgctcataagccggatgcagcatgtccggtgccccatgaaccggagagcccctatcacctgaaaggaaagcggctgttgtacgaatggcttggcagacaaggactccgcccggtgcttgaaccgtatttgcaagagatcagacaaaggcccgatttgctgctggaacacggaacccgccaggttgcggttgaatttcaatgtgcgaatctcaatgccgcagcgtatcgcaaaaggaccgaaggctttctcagactgggaatcgagcccgtatggattctcggcggaaaccggataaaacgcttgacgggggatttatttcagctttcgcggtttcactggcagttcattcagaaaagcgacaagcccccaaagctcctgtttttttgccccgaacaaaaggctttcatcatcctcgaacacctcattccctttcaaacaaacaaaacatccgcatccttgcgctttcttcctcttgctgaagcaagctggcgtaatgtaacagaacgagaaagccgttcgcctctccagctcaaaggctggaaaaagaacatcctcagctttcggatgtcggccgtgcgttttttatcaaaagaaacgaagcagattgccgccctcttttatgaaaatcatcagcttccgctcccgttttttccctcagaagcctttctcccggtgccgtcaggctatatttttgcccacccggtttatgtatggcaagggtacctttttttatttataacgaagcatgatacatttcgcctgcagtctgcgcttcactatatggactggctcatcaagggcaaaaggctgaagctgagatggagcgggcggcaaacggctgcggatgccgtcggtgaatacatttgttttttgcataaaaaaggatttttggtgaggaaagaggaattttattattccgcgggttcttttgttccggagccgcggttagaggcgctgttaaaaagggatgaacattatttttccgaatga

SEQ ID NO: 1171 - DNA, 2004 bp, Bacillus licheniformis
gtgtccggactgtttcagatcaaaagatatgtattttattttttaacggcgggattttgtgtcttttttttcgcatatgatttgacaaaagacggtgaaaaaacagaagatgaacacaatacaagtttattggataacaatggacttggagtaaagaaagcgaggggattgacagtggctgaagaaaaaaaatcgaagaaactgccttcaagagaagaggtgaagcaagaagacacgtggagactggaggatatcttcccgtcagatgacgcttggaacgaggaatttcaagccgttaaagaactgctgcccaagctttccgaattcaagggcaagctcggccattccgccgatgatttatatgaagcgctgacttatcaggataaggtgatggagcgtctcgggaagctgtatacttacgctcatatgcgctatgatcaggatacgggaaattctttttaccaaggtctcaatgataaagcggcgaacctctatactcaggctgcgagcgccacggcctacatggtgccggaaatattatcgattcaggaagaaaagcttcagcagttcctgttggaaaaagaggaattaaagctttactcacacgctctcgaagaaatcaataaagagcgccctcatgtgcttagcgaggaagaggaagggattttggccgaagcgtctgatgttctttcatctccttccaatacattcggcatgctgaataacgccgatatggaatttccggagatcaccgatgaaaacggagaaaaggtgcagctcacacacggcaattatatcacctttttggaaagcgagaaccgcgatgtccgccgcgcggcattcaaggccgtttatgaaacatacggccgctttaaaaacacgctagcttccacgctcagcggagctgtgaaaaaagacaacttttatgcgaaggttaaacattataaatcggcgcgggaagctgccttgtcgcgcaacagcattcctgaagaagtctacgacaatcttgtcagcacgatcaacaagcatctcccgcttcttcaccgctatgttgagattagaaaaaaagtgcttgagcttgatgaagtgcacatgtatgacctgtatacccctctggtcaaggattctggaatgaaagtcacttacgagcaggcaaaggactatatgctgaagggtctggcgcctttgggggaagaatattcatccatcctgaaagaaggattgaacaaccgctgggtcgatgtgtatgaaaacaaaggaaaacgaagcggcgcctattcttcaggaacttacggaaccaatccgtatattttgatgaactggcaggacaacgtcaacaatctgtttacgctcgtccatgaattcggccattccgtgcacagctactatacgagaaaatatcagccttacccgtacggtaactacagcattttcgtagccgaagttgcttctacgacgaatgaagcgctgttgggagaatacctgctgaatacaatcgaagatgaaaaacagcggctctatattttgaatcatatgctcgaaggctttaaaggaacggttttcagacagacgatgtttgccgaatttgaacatgagatccatgtcaaagcccaggaaggggaaccgctgacacctgagctgttaacgagcatatactatgatttgaataagaaatatttcggagacaatattgagattgataaggaaatcggtcttgagtggtcaagaattccgcatttctattacaattattatgtatatcagtatgcgacaggcttcagtgcagctcaggcgctcagccagcagattttaaaagaaggcaaatcggctgttgaccgctatattgagttcttgaaagctggaagctcggattatccgattgaagtgctgaaaaaagccggcgtcgatatgacgtcttcagagccgatcgaagctgcgtgcaaaaagtttgaagagcagctgaatgaaatggaagaactcctgcaaaaagtcaatcattcataa

SEQ ID NO: 1172 - DNA, 153 bp, Bacillus licheniformis
ttgggacttgcatcaattttattttttttcgtcttgaatattttaggtttgatgaatatgctacccctttatattacgtctcccctattatttatatcaatcctttttacgatcagccgcctcaaccaccgcaaaacgtttaaaggtttttga

SEQ ID NO: 1173 - DNA, 903 bp, Bacillus licheniformis
ttgacactcaatcagcgtgaccaatttttctcccattgccacggacatccgcaaaaaccgatggaaatttatatgtttgtcgaccctttatctcccgaatgctgggcattggagccggcgatcaaaaagttgaaaatccgctacggccgctttttcacactaaggatcatcgccgcatgcagcattacagcgctgaacgttcagaaacgcaaaaagcgccggctcgcagaggcatgggaaaagatcgcatgcaggtcgggcatgtcttgcgacggaacgctcctgcacgacaaagcactctctgcaccttaccttgcctcgctcgctttgaaagcagcggaactgcaaggcagaaaagcagggctgcagtttttgagatgcatgcaggaaagcttgtttctcaatcagcaggatatcactgaagaacaggtgcttttagcgattgcagagcacacgcagctcgatttggaggaattcaaaagggatcttcattcgcagagcgccgtgaaagccctgcaatgcgatttaaaaatcgctgccgaaatggaagtggcatctgttccgactcttacgtttttcaacagcctccgcgaaggagaaggcttaaaggtaaccggaaattattcatatgaaatttacgaagaagtattgtttgaaatgcttggcgatgagccgaagccttcacaaacacctccgctcgaactttttatcgaatactttcaatttgtagccgacaaagagattgccgtcgtttacgactggacgcttgaacaggtggaacgggaaatgaaaaagctcgcgttcgcccgcaaagtcgaaagagtggaagcgaaacacggcatgttctggcgctatataaatgaacatcacgatgccggtccgctctatcaatgcgaaaaatag

SEQ ID NO: 1174 - DNA, 399 bp, Bacillus licheniformis
atgggacaatcgtttaacgcaccttatgaagcgattggagaagagcttctatcgcaacttgttgatactttttatgaacgtgtaaagcggcatccgctgctctacccgatttttccggacgacttaacggaaacggcaagaaagcagaagcaatttttaacgcaatatttaggcggtccgccgctttatacagaagaacacggacacccgatactgagggcgcggcacctgccgtttccgatcacaccggaacgggcggacgcatggctttcgtgtatgaaagaggcaatggatcatgtcggtttaaagggcgaaatcagggaatttctttttgaaaggctgacattgacagccagacatatggtaaatcagccgaaaatggaggatggttcacattga

SEQ ID NO: 1175 - DNA, 654 bp, Bacillus licheniformis
atgaacgtcaaccatttggccgctctcttggaacttcaggcgatacggtcgttttatccggcttcagacagcggttccgaagatgcgggttttgatttcagctcgattttaaaccaatatttaagcaatgtcggcggcttggagtcttcacagcccgcggttgctccgactgtgtcgacagcgtctcagcttcaggccccgctggcagctgaaaagcctgaggcaattgcggccgtcccatctgccgcagcgaaacccgtctctttcggcggccaaaatcagaacattgaccagatcatcaaaaacgccgcagaaaaatacggggtcgatgagaaactgattcatgccgtcgtcaagcaggaatcacgctatcaagagaaagcggtcagcccggccggcgccatgggcctgatgcagctcatgccgtccacggcgaaggcgctcggcgtgaataacgcttttgaccccgttcaaaatatagaaggcggaacaaaatacttaaagcagatgctcgataaatacagcggaaatgtgaagctcgcattagcggcatacaatgccggaccgggaaatgtccaaaagtacggaggcattcccccttttaaagaaacgcaaaattatgtaaaaaaaatcacctcaaattactacgcttaa

SEQ ID NO: 1176 - DNA, 573 bp, Bacillus licheniformis
atgagccaggaacttgaaatcgaatttaaaaatatgctgacaaaaaaagaatttgagaaaatcaaatcatattatcaattttcctccgagcaatttgttatacaaaaaaaccattattacgatacgccttccttctctttaaaagaaaaaggagctgccctaagaattcgcgaaaagcagcagcgatttgtcctgacattaaaagaaccggcgcctgtcggactgatggaaacccaccaggagctgacccggaagcctgaaatcgaaacgttcatgattccgcatgggccggtatacgatcgtctgaagcgtctcggcattgaagcggacgagctcatccttttcggaacgcttgcgacaagccgtgcagaaaaaaaattgccgcagggcttaattgttttggatcacagccgatacttaatggtagaagactttgaaatcgaattcgaagtgacggattatgaacgcggaaaacgggatttctctgaactgctgaaatcgttcggcatccctgagcgtgaaaccaaaaacaaaatcgtccgattttatgagcaaaaacttaaagatcaataa

SEQ ID NO: 1177 - DNA, 366 bp, Bacillus licheniformis
atgcagaacagaattgagattacagaagccaatctgcgaaacgaccggctggtgttgaccagcgaaatcaatgacggagcggagcggaagccggccggacgcatgctgacagactccgatcattttgcatttgtatacatacttgaacaggacgaatcctttgaatacgtcattttaaacgaaggcatctggtccgatcttaaagcggcccttgacgccggtcttcctgtgtttttacatatcggaaacacggagctggagcttaacgggttccatgatgagctcggatatttaatagagaatattaaagataatgcaaattatggcgaagaaatggaagagagagtgaaacggatattcctctag

SEQ ID NO: 1178 - DNA, 636 bp, Bacillus licheniformis
atggatgaaaaacaatgggagcagtttttagcgccgtaccggcaggctgttgaagagctgaaagtgaagctgaaagggatccggaccctttacgaatacgaggaagagcattcgccgattgaattcgtgacggggcgggtgaagcctgtgccgagtattcttgagaaggccaagcgaaaaaacattcctctgcacaacattgaaagcatgcaagatatagccgggctcagaatcatgtgccaattttttgaggatattcgcattgtcgtcgatatgcttttggcgagaaaggacttcacggtggtggataagcgcgactatatcgcggaacataaagagagcggctaccgctcctaccatctcgtcgtgctgtatcctttgcagacaatcaacggggaaaaacagattttggttgaaattcaaatccggacgctggcgatgaatttttgggcgacgattgagcattctttaaattataaatacagcggcaacattccggaaaaagtaaaattaaggcttcagagagcttcggaagcagcatcaaggctcgatatggaaatgtctgagatcaggggcgagattcaggaggctcaggcggcgttttcacgcaagaaaaaggatgaggatgacggttag

SEQ ID NO: 1179 - DNA, 804 bp, Bacillus licheniformis
atgatgaagtttgcggtatcgtccaaaggaaatgcggtttctgattcattgaaaagcaaaattcagacgtatctgctcgacttcggtctcgaatgcgatgaagaagagccggatatcgtcatttccgtcggcggtgacggaacgctcttatacgcatttcacaaatacagcggccgcctcgacaaaacggcttttgtcggggttcataccgggcatctcggcttttatgccgactgggtcccgagtgagattgaaaagctcgtgatcgcgattgcgaaaacgccgtatcaaattgttgaatatccggttttggaagtcatcgtccgctataatgacggcagcgatgaagcgagatatttggcgctgaacgaatgtacgatcaagagcattgaaggaacgcttgtgacggatgtcgagattaaaggggaactttttgaaacgttccgcggcgacgccctttgtctgtcgactccttccggaagtacggcatataacaaggcgcttggcggtgcgattattcatccgtccatcagggcgatccagctggctgaaatggcgtcgatcaacaaccgggtgtttcggacggtcggatcgccgctcattctgcctgagcatcacacttgtttaattaaaccgataaatgatgtgacgtttcaagtcgcgattgaccacttgacattgctgcataaagacgtcaagtcgattcaatgccgcgtcgcaaacgaaaatatcaggtttgcccgctttaggccgtttccgttttggaaaagggtccaggattcctttatcggaaaaggagaatag

SEQ ID NO: 1180 - DNA, 891 bp, Bacillus licheniformis
gtgagcgattttttgatgaaacagatcataacagaagaggacagcggggttcttttgaaagaatacgtccagcggctgggcatttcaaaaaggatgctgacggacatcaaattcggaggcggcgatcttttggtaaacggcgggcatgtaacggtcagatacgttcttcaaaaaggggacgagctcgtcattcagtttcctccggaaaaaatgagcgaatctttgcaaccggaagaagtgccgcttcatattttgttcgaagatgaccatgtcctcgtcttaaataaacagccatgcatttcgtcgattccctcgcgtgagcatccatcaggcagtctggcgaacggtctgattcattattaccagcggacgggcgtacacgcgaccgttcacctggtgagcaggcttgaccgcgatacatcgggtgtcatgcttgttgccaagcaccgcttcgcccactcgcttttatcggggctgcaaaaaaagggagccgtcaaacggcaatatcgagcggtcgtccacggtttgatcgcggaagagcagggaacgatcgatgcgccgatcgggagaaaatcatcgagcatcatcgagcgggcggtaatcccggacgggcaaaaagcagtgacgcatttttgggtgaacaggcgtttcagcggcatgacggatgtctctatccgtctggaaaccgggcgaacccatcagatccgcgtccatatgagtcatatcggatatcccttgtgcggtgatacgctgtacgggggaacccgcggcttcatcaatcggcaggcgctccacagtgagaggctgacattttttcatccgttcacaatggaagagctgacgttccaagcgccggtgccgaatgatatgagacagttgatagagagctga

SEQ ID NO: 1181 - DNA, 741 bp, Bacillus licheniformis
atgaaatacgatgttatcggtgatattcacgggtgctatgacgaaatgattgcgctgattgaaaaactcggctactcgctgacatcaggagttcccgttcatccggagaacagaacacttgtctttctcggggatttaactgacagagggccaaaatcgctggaggtcgttgaatttgtaggacgggccgttgaagatggagctgtgcgatatgtgcccggcaatcattgcaacaagctgtaccgttttttcaagggaaatccggtgaagctgcagcacggactggaaacgacggcggccgaatacagaaaccttccgaaacaaaaacagaaggatatcagagaccttttcatgcgcctttacgaaaaggctccgctttacgagatcctgcataacggcgaacttgtcgttgcacatgccggcatcaaagcggaagacatcggcaaaaagcctgtcggaaaagtaaaacagtttgtgctctacggagatattacaggggaaacgctgccagacggacggccagtgagacgggactgggccgctcattacagaggcgagccgtgggttgtatacggccatactcccgtcaaaaacccgaggatgattcatcatacaattaatatcgataccggttgtgtattcggcaacaggctgaccgctttcagattcccggaactgacaaccgaatctgttccctcctctttgccttatgatgagtctagattccgcatggagccataa

SEQ ID NO: 1182 - DNA, 1845 bp, Bacillus licheniformis
atggagcacacatctgtctcatctttagttgtcgtactgattatcgcatttttaacacccatcctgctgcaccgtttcaggttaagcataccggtggttgtcgctgaaatcatcatgggtcttattatcggaaaaagcgggttcgatctggttgctcagcacgatacttggctcgaaactttatcgatgctcggatttatctttttaatgtttttaagcgggcttgaaatcgatttttccgtatttgaaaaaggtaagaaaaagcagctgcttccgagcggaaaggaagcgccgaatacgtttaaaacggcttccgtcatctttattgccgtctttatactatcgctcggcctctcctacagctttgtcatggcaggatttattgacaacgcctttttaatgacgctgatcatttcaacaatttcgcttggggttgtcgttccgacgctgaaggaagagcggctcatgaagacgaatatcggccagattattttgcttgtcgccgtgattgccgatcttgtcacgatgatactgcttgcggtgttcgcctcaatctacggagacgaaaacagcaatatgtggctgctgatgattttatttgccgccggcgttgttttatacattttcggtagggtatttaaaaagcggccttttgtcgaagtgctgtcaaaaggcacgatccagatcggcacaagggcgatatttacgctgatcatcgtactcgtggcgctttccgagtcgctcggtgcagaaaacattctcggcgcgtttttagccggggtgcttgtttcgctgctttcgccgaacaaagagctcgttcagcagcttgattcattcggctacgggttcctcatcccgatcttctttgtcatgacaggcgtcaaattggacatttggtcgctgtttggcaatccgaaaattttagtgatgatcccgcttctgtttgtggctctgttaatcagcaaagtcgttccggtgctgtttttgaaaaagtggtatgacatgaaaaccgtgctggcttccggttttctcctgacttccacgctttctctggtgatcgcggcgacaacgatcggcgagcgcatcggcatcattgacgcgcagatgtccggcgcgctgattttggtggctgtcattacatgcatcatcacaccgaccggctttaaaaaattaatgccgaaaacggaaagcgaaaaagagaaaaagacgatcacctttatcggcgcgaatcaaatgacgctgccggtcacgcttgaactttctccagaagattatcacgtcagaatcctgcatgtccggcaggaaaagaaggaagaaaagctggcggatccggtgtttgacgttgaagttttgccagattatgaatacgaaacgcttcaatcattcggcgttttccaaacggatatactcgtcgtggcgacaggcagcgaagagcgcaatacagggatcgccctttatgcgaaggagcagaaagtcgcgagaattatcgccagcgcagattccccagacgccgaatcgaggctgaaagaaaacggaattgatacattctccattctgctttccacgaaaacgctgctgcgcgcgcttatcgaggcgcctggcgttatgaaacttttgacgaaccaggatgcgtcgctgtatcagatcaatatgagcaatgagcgatttgacggcgtcctgttaagggagtttccgtttacgggagatgtcatcttcgtccggattttccgcggggttgacagcatcgtgccccatggggatacaaggctgcaaatgggtgacaggctgatcgccaccggttcgcgcgaatatattgcggaattgaaaaaaacgcttggagactga

SEQ ID NO: 1183 - DNA, 702 bp, Bacillus licheniformis
atgaagttttcagaagaatgccgaaacagcgctgcaacttggtgggaagggagttttgtccatccgtttattcaaggaattggagacggcacacttccggttgaccgatttaaatactatgtcatgcaggattcctactatttgacccactttgccaaagtccaatcctttggagcggcatatgctcacgatctatatacgacaagccggatggccgaacacgcgaaagggacatatgaagccgagatgtcgctccacaggaaattcaccgatctattgggcatcacaaaggaagagctggagtcgtttcagccgtcgccgacagcgtatgcgtacacatcgcatttgtaccgttctgtcgtcagcggcagttttgcggaaatactcgctgctttgcttccttgctattggctctattatgacgtcggcgaaacgctgaaaacgtgcaggcctgacaacgcgatttatcaggaatggatcgcgacatacggaggagactggtttaaaaaatctgtaacggaacagatcaaccgcttcgatgagctggctgaaaacgccgatgagaaaacgcgcgcgaagatgaaggagaatttcgtcatctccagcttctacgaataccggttctgggatatggcctatcaaaaagaaagctggtcaaaaagcggggtggatcagcttgcatctgcacgcgatcaccgatga

SEQ ID NO: 1184 - DNA, 612 bp, Bacillus licheniformis
ttgcatctgcacgcgatcaccgatgacaagcactccgtggaagagctttcagcaaaaatcatctcgattcacgatgccgttgactttatccacatcagggaaaggtcaaaaaaagtaagcgaaatatcaagtttgatcgatcgcctggccgaagaaggcgttgataagcgaaagctcatcatcaacgacagggtggatattgctttgtttcatcatattcaccgggttcagctgccttcacacggcttttccgtcaaaagtgtaagaagccgttttccgcatttgaaaatcggaaagtccgtacattcacctgaagaagcggtgcaggctgaaactgaaggtgcagattacgtgctgttcggccacatttttgaaacggactgtaaaaagggccggaaaggaagaggagctctgagcttggcagaagtgaaggcggctgtccgcattccggtcattgcgatcggagggattaccgaacaacgtctggcggaagtcaaaatggcagacggcatcgccgtgatgtcggggatcttttcccatgacagaccgaatgaggcggccgcgcggcttgccagtctcgcgaagggagattcatatgagaaagcgctatga

SEQ ID NO: 1185 - DNA, 1110 bp, Bacillus licheniformis
atgagaaagcgctatgatacgatcgtgatcggcggaggcatcatcgggacttccatcgcttatcatcttgcgaaagcggggaaaaaaacggccgtgtttgaaagcggggaagtcggcaaaaaagcgacgagcgcggctgcgggcatgctcggcgcccatgcggaatgcgataaacccggtacctttttcgaatttgccagagccagtcaaaaagcctataagcgcctgacgggggaattgaaagacataagcggcattgatatcagaaggcatgacggagggatattaaagctggcattttcagaaagcgaccgcgaacacctgatgcaaatgggtgcactggattctgtggaatggcttgaagctgatgaagtatataaattagaaccgaatgccggaaaaggaattctcggcgccaattttatcagggacgacgtccatgtcgaaccggctgcagtgtgcagggcatttgccaggggagcccggatgctcggtgcagatgtcttcgagtatacgcccgttttatcgatagaatccgaagcgggggccgtccgcgtcacgtccgcttccggcacagcggaggcggagcacgctgtcattgcaagcggcgtgtggagcggagctttgtttaaacaaatcggcttagacaaaaggttttaccccgtcaaaggggagtgcctgtccgtatggaatgacggcatctctttgacgagaacgctttaccatgatcattgctacatcgttccgcgccatagcggaaggcttgtcgtcggcgcgacgatgaagcccggggactggaatgagcagccggaacttggcggaatcgaggagttgatccgaaaagccaagtcgatgctccctgggattgaatccatgaaaatcgaccaatgctgggccgggttgcgtcccgaaacaggggatggcaatccgtatatcggaagacatcctgaaaatgaccggattttgtttgctgccggacatttcagaaacggcatcctcctggcacctgcaaccggtgagatgatggcagacatgatcctcggcaatccggtcaaaacagagtggatcgaggcgtttaaagcggagcgaaaggaggctgtgcacaggtga

SEQ ID NO: 1186 - DNA, 204 bp, Bacillus licheniformis
gtgaacattcagctcaacggccggaaaatagagtggagagacgacggcggcacgatttatgatttgctcgcatcctacaatttggaaaatcgtgttgtcgttgttgaaaaaaacaggcggattatcggaaaagaccaatatcaaacggtcaaattggaagaacacgatgtcatcgaaatcgttcattttgtcggagggggataa

SEQ ID NO: 1187 - DNA, 768 bp, Bacillus licheniformis
atgttaaaaatcgcagatcgtcaattttcatcaagattattgctcggtacagggaagtatccgtcatttgagattcaaaaagaggccgtcagcgcatctgaatcggagatcctgacgtttgccgtcagacggatgaatatttttgaagaatctcagcctaattttttggagcagctcgatttaagccgttatacgcttttgccgaatacggcaggagcaaaaacggctgaggaagccgtccggatcgccaagcttgccaaagcaagcggtctttgcgacatgatcaaagtcgaagtgatcggctgtgaccgttcgcttctgccggacccggtagaaacgctgaaggcgtcagaaaccttgcttgaagaaggcttcattgtactgccgtatacatcggatgatgtcgtcctcgcgagaaaacttgaagagctcggcgtgcacgccattatgcccggggcctctccgatcggttcgggacaaggaatcatcaatccgctcaacctgtcgttcatcattgaacaggctaaggttcccgttatcgtggatgccggaatcggttctccgaaagatgcggcatacgcaatggaactcggtgctgacggggtgcttttgaacacggcagtgagcggggcgaaagatccggtccaaatggcgaaggctatgaagtttgccgttgaagcgggcaggctcggatatcttgccggacgaattccggaaaagaactacggcatcgccagcagccctgaagaagggaagttgacgatttga

SEQ ID NO: 1188 - DNA, 1011 bp, Bacillus licheniformis
ttgaccggcaggtattcaagacaggagctctttcacccgatcggaccggacggccaggaaaaattaagccgcgcccgcgtcctcgtgatcggtgctggggctttgggcgcggccagcgcagaaatgctggtgagggccggggtcggttcgctgacgatagccgacagagattatgtggaatggagcaatctccagcgccagcagctctatacggaacaggatgtgattgatcatatgccaaaggccgccgccgctgaaaaaaggctgcgcctgatcaacagctctgttcaagtaaccggaatcgtagcggatgttactgcggaaaaagcgctcgagcttgcggaggaagcgtccctgatcgtcgatgcgacggataattttgaaacacggctgatcatgaacgacgcggcggtcaaattaggcatccctttcctgtacggcgcgtgtgtcgcaagctatggcatcacatatagcgtaattccgggaaaaacgccgtgtcttcattgtcttttggggcatttgcctgcgaataccatgacgtgcgacacagcaggggtgatcggtccggtcgtccagcaggttgccgcataccaggtaacagatgccctgaagctgctgaccgggcatgaaccgtcagggatgctccgctcatttgatatttggacaaatgagcggtctgaagtccgggctgacacgcttaaacatgagacatgtccgacgtgcggaaaaggcgagtttccgtttctttcagctgaaaacgaaacaaaagcagccgttctttgcggcagacaaacggttcagatcaggccggccgcggaacagccgctggaactggaatcgcttgctgccaaattaaaaaaagccggtttaaatgtgacgggaaatccttatttagtttcctgccgtgcggaggattttaagttcgtgatttttcgggatggacgtgctttaattcacggaacgaatgacatcaatcgcgcgaaaacgatatatcacaggtggattggctaa

SEQ ID NO: 1189 - DNA, 819 bp, Bacillus licheniformis
atgagcatatataaagcattaacaatcgccggatcggattcaggaggcggagccggcattcaagccgacattaaaacatttcaggagcttggcgtcttcggcatgacagttttgacagcagtcactgcgcaaaatacaacaggggttcacggcgtctacccgctttctccggaagcgctcggcgcacagattgatgcagtggcagaagatttaaaacctgacgccgtgaaaacagggatgctgtggagcgcggagatgattgaggtcactgctgaaaaaattgcagcatatgagcttaaacgtgtgatcgtcgatcctgtcatgatcgccaaaggcggcgcttcactattgaatgaggaagctgttgaaacattgaaacggcgccttcttccgcttgcttatgcggtaacgccaaacattcccgaagccgaagtgctgacagggagaagcattcaaacaatggaagaccgcaaaaaagcagctcgtgacttgcatgaaatgggcgtccgcaacattatcatcaagggaggtcatcagcctgaggatggcaaagtaaccgatctcctcttcgacggagagacgttcacagaaaaaaccaattcctatattaagacgaaaaatacccatggaacaggctgtacatttgccgcggctcttacggcgcaatcagcgaaaggaaacgggattcaaggagctttccgcatcgctgaggctttcgtccacgaagcggttgtacacagccttgattttggagccggccacggaccgaccaaccattttgcatatcaaaagttatccaacgcagggttggaactgtag

SEQ ID NO: 1190 - DNA, 777 bp, Bacillus licheniformis
atgaatttatcactagaaggccggaatatcgtcgtcatgggtgtagcaaataaacgaagcatcgcatggggaatcgcccgctcgcttcacaatgcaggcgcaaggctgatttttacgtatgcgggcgagcggcttgaaaaatcggtcaaggagctggctgattctttggagcgaaacgattcaatcgtacttccttgtgatgtcactaatgaccaggaaattgaagcatgcttcgccgacatcaaaaaagaagtcggggtcatccacggcattgcacactgcatcgctttcgccaacaaagaagacttggctggcgaatacttaaatactacccgcgacggttttctgctcgcacacaatatcagctcctactctctgacagcggtcgctaaagcggcgcgcggcatcatgactgaaggcggaagcatcgtcacgctgacataccttggcggcgagcgcgttgtatccaactacaatgtcatgggtgttgcgaaagcatcgcttgatgccagcgtcaaatacttggcgagcgatctcggaaaagacggaatccgcgtcaacagcatttccgcagggccgatccggacattgtccgcaaaaggaatcagcgacttcaactcgattttaaaagaaatcgaagagcgcgcgccgcttcgccgcacaacgactccggaagaagtcggcgacacggctgctttcctgttcagcgacctttcccgcggcatgaccggcgaaaacctgcatgttgattcaggctaccatatcatcgcgcgataa

SEQ ID NO: 1191 - DNA, 480 bp, Bacillus licheniformis
atgtctagcagaaaacacgatgcggagcaaaagccgctcatgtatattgtgcagccggactatgataaggcagaggcgaacatgcaggatattctgattaaaagaaagaagaaagcaaagcccgaagcttccgaacaaaaagcgcggcggaaggaacagcaggatgaagccgtccggcccgacgaaaaagacggagctgaagcggtgtttaacgatgaggcgaatcgatccgaaaaaggagtcaaaccgattaaaaagccgctcagcaagatgacgattgccgagaaaatcgactttttggcaagccttcccggcaatatgccgaaaaccctttgtctcattgaagcagacgggaagacatacaggggaacgatcgtcggaaagaagggcgattccgtctttgtcagaacgtcgagcaaaggggctccggcggaactgccgatcgagagcattacctccttgcacccgctcggcttttaa

SEQ ID NO: 1192 - DNA, 450 bp, Bacillus licheniformis
atgacgaaatgttcagccgaaaattgcgtgtgcgaagccgttgaaaacattcacgatctgcaaaacgccattgaggaagaaggctgcccgacaagctgcttcagcaacctgctttccccttcgagacacttaggcgacaccattccgtttattttatacacttctaagtctaagccgttcgtagcgtttggaaatgtcggagaacttcaggcaggtccttgcttcagcaccgtgtttttcagagttgaaaacattgatgactgctgcgctacattgagactgttgattgcctttgatgataatcgccgcgttctcgatttcacagaagataaagacaaaatttgcgatgtgttccgcttggaaaaaacaagtttctgcattgaagtcgatctggaatgcttctgtgcgatcgaatgcttaaatccaaaactgatcaatcgttcaaattaa

SEQ ID NO: 1193 - DNA, 489 bp, Bacillus licheniformis
atgagctgcggaaaacaccatggccggcatgaaaattgtgtatgcgatgcagtagaacagattataaaagaacaggatgccgttgaggaaacaacagcgtgctcgacaagctgctttggcaacctgctgagtccgacggtttccggtaaagacacgattccgttccttttgtacgacaaaaaaggcggactgttttcaacatttggaaatgtcggcggattttcagatgatatgcagtgcttcgaatcgattttcttccgggcagaaagtctcaaagattgctgtgcaacgctttcaatcctgaggcctgtggacataaacggcgacacattaagcgtctgccatccttgtgaccctgactttttcgggcttgaaaagacggacttttgcatcgaggttgacttgacttgtttctgtgcgattcaatgtctgtcacctgacctagttgatcgcgcagcagacaaaaaacacaatcaccaccacggttaa

SEQ ID NO: 1194 - DNA, 531 bp, Bacillus licheniformis
atggaaggaggaaaagaaatggaaacaagaccatattcatggattgcgcttgacccggaatgcgaacatccaggcaacgattatcaccctagttatcctaagaaaaaattatgtgacgactatacttgcaactgtggtaggaaagggcaaaatggctttatcgattctgacctagatcaacttcatcttaacaaacagctctcagatgaaacgatcatcattaaagactcttgtgatgttcaagtctcaactgaagacacacaaacgttggcatcagtcatgacagctgcacaaacactagctgttactattattctcgccattatcgatgatcctgatctagccgaacttgtcacaactgatctgttgcaggtaactgccaataaacaaacgaacagacaaaaattggtgatcgataattccagaaatgtacatgtcacaaccgaagatacagacacagctatcatcgtaagcacatttgttcaaactgttgtaatcaccatcaccgcccttatcgtcggccttctataa

SEQ ID NO: 1195 - DNA, 399 bp, Bacillus licheniformis
ttggcagattttgaaaaacttcaagagaacgtagatccgataatgaaatcagttgttaaaaatatcttgaaaaatcggggagtaaccagcgataaagttcggacgctctcagaagaagaaaaagaaaatattttcaatatgctggaagatctaaaaaaacaaaccgatgctttggttcaaaaacagaaagaaaaagcagccgcaccgaatgaaaaagggacaaagagagaaaagaacgctgatgcgtcatcagaaaatggcgagagaccaagaagaagaagaaacagaacaaatagactgagagaaaaacttcgacaacggagggagcaagaaaacacagcaacagcggaaaattcaaccgagtcagatacttcagcagaaaaaaatggggatttgtag

SEQ ID NO: 1196 - DNA, 411 bp, Bacillus licheniformis
gtggataagaaaggagtgaaagttatgtcgtttcatgaaaaagccgaagcgctgtacgcagaaacatttgacgaattacaccgggaatatgaccagctcattgaagtaattgattcagaacatgtcacggtaaacacggcaaacataacagcagctctctctttacaagccatcgtgatctctttgacgattttatcggctcagcttgcgatcgaagacgaggatacagcagacattgtctcagaacaccttttagccgtacacaggctgcaaagcaggagaagagtcatcatcaaagtcatcggcagccgcaatgtcaccattacgctttcctcgctggagatcctgctttccgtccaagttttaaccgaagtgctgatcgcgcttatcacagagcttgacatactttaa

SEQ ID NO: 1197 - DNA, 357 bp, Bacillus licheniformis
gtgatacaaagctggtttttattttttttattttctatcgcggtatttcggctgacgaggctgattgtgttcgacacgatcatggcgccgtttagaagcctgtttcatgaagaggttgaagaaaaaaacgaaaaaacgggagagaccgaaacgtatcttgtcatgaaaggaaaaggcgtgagagcgtgggtcggcgagctgctgagctgctattggtgcacgggcgtgtggtgtaccgcgtttttgcttgttttttacgcatttgttccggtcattgctgaatggctgattcttctgctttcgatcgccggcctggctggagtattggaaacgatcgtttccaaatggctcgattga

SEQ ID NO: 1198 - DNA, 210 bp, Bacillus licheniformis
atgaatttatttgaacagctggttgaatcgatataccgcaaacatgatcaaactcaagccggccatgacaaggtgctctttgaacagcagaaggaactggagacatttgaccgctcggccgaacagttcggcaggcagatcgaagcgtttgcggagaatgccgaaaaatggctgggagaggacgggagtctgccaggcatttttaaataa

SEQ ID NO: 1199 - DNA, 132 bp, Bacillus licheniformis
atgggcttttgttgcggaggctacggcggtggctacagcggcggctatggcggcggctatggttcaacgtttgtattgatcgttgtcttgtttattcttttaattattgtcggcgcttcttttaaatattag

SEQ ID NO: 1200 - DNA, 258 bp, Bacillus licheniformis
atggacaatcaatttttcaaaaacatcgaaaagaaaacgggcgtcagcatgaatgacgtcatgcagctcgcaaattcgctgcaaaatgccaacttcaaggatgaaaatacggtccgcagcgtgattaagcgcgtcgctaaattggcgaataaacgggttccgaaggaaatggaagataagattgttgaatccattgtaagcggcaaagaaaaaatggatttcaacacgatcgcgaaaatgatgaacagcaaaaaataa

SEQ ID NO: 1201 - DNA, 2280 bp, Bacillus licheniformis
ttgaaatgcgcccgattcaataaccgagacattcatatacatacatattcgagagaacacctgcaattcctctttgatgaagcaagaaaagacaggatcacgtgtaaatattgcggcttgccgctcagactgaaattgtcgattcatgaagagccgcattttttccaccgggaaaacggggatttttctcaatgtgaagcggcttgcttaaatgagaagacagagcagaagaccaaacagaacgattatactgaaagcggcgttttccgcctcccgaaaggcaaagcgatcggagaggaaaagaaggcggacacggacttctggacgccgcctcgcgaagcttccatccattctcctttctctccagcggcagaaacggctccggaaccggtctttccgaatgtgccgctgaatgagaaacagcttgccgccgtgacggcccccgaagaaccccttctcgttctggccggcgcgggaagcggaaaaacgcgggtattaaccgcgcgagcttatatgatatcccggctcgatatcccgccttctgccatattgctcgtcacattcacgacaaaagctgtgaaagaaatgaaagagcggatggcctcgctatacggtttgccgatgcagactgtgaaccgcctcgtgacaggcaccttccacagctttttttacaaaattctttatcatcatgatccggccaaatggaatggcgagcacctgctgaaatgggaatggcaaaaagaacagtacatcaaaatggcccttgccgaagaagggcttgatgaaaaagactttccggttgaccaggcgatccagcagatcggctactggaagaacgcttatcttccgggtgaacagattccgcttgaagacgaatgggaaaagcgggttcaccggctgtaccgtcattatgaagaacaaaaagcagcgcggcgccaattcgatttcgacgatatggcatctgcgtgctggcagctgtttcaagaacagccggacattttaaagcgatatcagacgcgctttcacgcgattttgattgacgaatttcaggacattaaccctgttcaatacgccatcatcaagctcttggcaagccccgaaaacaacctgacctgtgtcggggatgatgatcagtcaatctacgcgttcagagggagcagtccttcttttatactcgattttgaaaaagattatccgaaggcgaaaacggtccgcctcacgacgaattacagatcgagccatccgattgtggcaagcgccgatatggtcgtaaggaaaaacaaaaagcgttttccgaaaacattaagcgccgcgagagacgaccgccaaaaaccgctcttattttatccttatgatgaagaggaagaagcgattatgatcgtctctgatatccaagaaaaaattgaaatgggcgcaaagcctgatgacttcgccatcctataccggacaaacagcagcggccgcgccatttttgaacgtctgcaccagtcagccattccgtacacggctgaacaaggcgtccggtcgttttacagcaggaggatcgtccggcagatgctggcctatctctacttaagccaaaatcaagatgacgcggaagccgtaaagcagattttacccgccctctttctcaagcagtccgctttaaacacgcttaaagcgctctcgattacagaagattgcacaatggttcaggcgcttgaaaaattgactgacattaaaccgtttcagcttgataaaataaaaaaaatcgttccttttttcccaggcttaaaaacgatgaagccggttgaagccatctctttcgcagaagaaaagatgggcttttccgattacctgaaaaagcgcggaaacgaagggaacaagctcgaaaaagggtctgacgatctgcgggatctcaaaactgcggcaaaaaaattcaaaacgatccccgaatttcttgagcatgtcgatcatatgagagccgcggaaaagcaaaaagctgacggatacggtgttcagcttttgacaattcatcgtgcgaaagggcttgaatttaaaacggtctatatactgggagtgcaggacggctcgattccgcatgactttgccctggagacagcgagaaaaggcgatgaaaccgctcttgaagaagagcggaggctgctgtatgtcgccatgacccgggccgaggaccgcctgtatatcagcgtcccttccttcagaaggggaagaacggcataccgctcaaggtttttacagcctattttacgcccgaatccacaagttcagctgcaataa

SEQ ID NO: 1202 - DNA, 576 bp, Bacillus licheniformis
gtgaatgatattttaatgtggctgaccgatcttggctatttcggcattgcgatcggtttaatgatcgaaatcatcccgagtgaaatcgtactcgcctacggcggatacatggtctcaaacggctcgattacgataacaggcgccgtgattgccggcgtcatcgggggaacgattgctcaattgtttttatactggatcggctactacggcggacgtccgtttttatacaaatacggaaaatacttattgatccaaaagcatcacattcaaacagccgaaaaatggtttgagaaatacggcggaggcgtcgtcttttctgcccgcttcattcccgtggtcagacacgccatctccattccggccggcattgcgaaaatgccgattttaaaattcacgggtctgaccgtgctggccatcataccgtggtcgatactgttcgtctatctcggcgtacagctcggcagccggtgggaccatgttgaaaatgtagcaagaacgtacacgactccgatcatgctcggggcggcggctatgatcattctgtatttcggactcaaaaaactgcgcagaaaataa

SEQ ID NO: 1203 - DNA, 987 bp, Bacillus licheniformis
atgacatccgtactcgtaacaggaggagccggatacatcggcagccacaccgtactcgaattgacaaagcaaaaccgctccgtcgtcgtgcttgacaatttatctaccggacacagggaagccgtcagcggggtcagcttttacgaaggcgatatcgctgatgcggcacttgtcaaagccatcatcaaacatcatgatgtcgatgctgtcatccatttcgccgccaaaagccttgtgtccgaatcgatcgaaaagcctgagatatactttagggaaaacacgctaaagtcttgtgcatttttcgaaacggccatcaaggaaggcgtcaataacatcgtcttttcgtcaaccgccgccgtatacggcatcccggagaaagccccgattaaagaggctgctcccctctcccctgtcaatccttacggggaatcgaagctgatgatcgaaaaatatctgcactgggtcggaaaaacgcacggtgtcaaatgggccgccctccgctacttcaacgccgccggcgccgctttaaacggagcgatcggcgaggaccacgatcccgaaagccacctcattcccctcgtcctgcagacggctttgggacagcgaaagcagctgtccattttcggagaagattattcgacgccagacggaacctgcatcagggattatattcacgtcctcgatctggcttccgcccacctggctgcccttgatggattatatgaagacagactgaagcaaaatgtttataatgtagggacaggggccggacattccgtaaaagaaatcattgaaaccgcggaaaacatgacagagcgaagcattgcagcaaaaacggacgagcgcagagcgggagatccgccagtgctggtggcggacagccggacactggtggaagataccggatggaagccgcaatacagcgatttgcaaaccatcattcaaagcgcatggcaatggcacaaagcgcatccggacggtttttga

SEQ ID NO: 1204 - DNA, 891 bp, Bacillus licheniformis
atgaaagtaaaaaaagcagtcatcccagcagccggattaggtacgagatttttgccggcaacaaaagcgcagccgaaagaaatgctgccgattgtcgataaaccggccatacaatatatcgtggaagaagctgtccaatcaggcattgaagacatccttatcattacaggaagaaataagcgttcgattgaagaccattttgaccgctctgtggaacttgagcaaaacctgctggccaaaggaaaaaacgatgtgttaaaagagatacgcgagatcgccgatatggcgaatattcattatatccggcaaaaggagcccatcggcctcggacatgcagtgttatcggccaagcatttcatcggtgatgagccgtttgccgtcctcctcggcgacgatatcatggtgtcagaaacaccggcgcttaggcagctgctcgaagtatatgaagaatatcagaccgaagtgatcggcgttcagcccgtcgatccagcggacgtgagcaaatacggcatcattcagacatccgcgcaaaagaacaaagtgtatcaaatcgacgatcttgtagaaaagccgaccgtcaaagatgcgccttcaaatatcgcggtcatgggccgctatgtgctgaggccttcgattttccctgtgctcgaacaaacgaagcgcggcgcgggaaatgaaattcagctgactgacgcactaagggaaatctgccgggaacaaagcatgtatgcgcgcaaattgaaaggaagccgctttgatatcggcgacaagctgggcagctttaaagcgagtacggaaatcgccctcatgcgggacgagatgcggccaaaactgctcgcctacctggagagcgtcttaaaaaaagaagcgcagaaaggagcatggcaatga

SEQ ID NO: 1205 - DNA, 396 bp, Bacillus licheniformis
atgaacaaaaaaaacatccccacactcgttcgtttcgggacagtcggagccgggaacacactcgttgatttcgtcgtgtttttcctccttacgtcgctccacgtcccctacctggccgcacagttgttttcctattcggcaggcgtggcaaacagctatatctggaatcggacatggacgtttcaagtaaaagaaaaagcgcatggcgcggaaatcgtccggtttatcatgatcaatcttgcagcagcgggcgctacatttgtccttctgtacatttttcaaaaagccggcctgtccctttttatcagcaagatgtccgcaacagtcgcaggaatggccatcaactttaccggaaacaagctttgggtgtttcaagaacccggcacagattcataa

SEQ ID NO: 1206 - DNA, 420 bp, Bacillus licheniformis
gtggaagccgtcattgtgaagaatcaacaacagcttgaagacgccttctttgttagaaaggaagtctttatcaaggagcagcacgtatcaccggaagaagaaatggatcatcttgatcaggaatcttcacatctcgtcatctatgacgaaaaagagccgatcggcgctggccggctccggcttgtcgacggctacggcaaacttgaacgaatctgtgtgctgaaaagccaccgctccctcggcgtcggcaacctgatcattcaggcgcttgaagaggaagccgccaagcaaggcgcgtctcaatttatgctgaacgcgcagacacaggctgttcccttttacgaaaaacacggctataaagtcgtgtctgaagaattttcagatgcgaatattccccatgtcaaaatggtcaaaaagtaa

SEQ ID NO: 1207 - DNA, 510 bp, Bacillus licheniformis
atgaaatacggtattgtgctatttccatcaaaaaaacttcaggacattgcaaattcctaccgaaaacgctatgacccgaattacgctttaattccgccccaccttacattaagaacgccttttgaagtgtctgaagacgagatctcaggcgtcgtccgacacttgagagagctttcaaaagagctgaaaccggtcacgctgaagattacaaaattcagttcctttgcccccgtcaataatgtcatttacatgaaagccgaaccgacagaggaattgatgcagcttcatgaaaaaatgtacagcggcgttttggaagacaaacccgaatacgcgtttgttccccatgtcacagtcgcacaaaagctgtcagatgatgagcattccgacgtcctcggcacgctgaaaatgagagacgcgtcacacgaagaagtcatcgaccgctttcacctgctttaccaattggacaacggatcatggaccgtctatgaaacttttattttaggagcgtga

SEQ ID NO: 1208 - DNA, 717 bp, Bacillus licheniformis
atgaaaacaggagtcattcaggagaaaaagcttttttcggaagagctcggcgaggaaatggagcttctcgtctatttgccgtcctccttctcgccgctttacaaatatcatgtgatcatcgcacaggatggacatgactatttccggctcgggcgcatcagcagacaggttgaagaactgttggcgaacggtgaaatcgaaagaagcatcatcatcggcattccgtacaaaaacgtacaggaaagaaggcttacataccatccggaagggtcaaaattcgaagcgtataaacgttttttggcaaatgaactcgtccctttcaccgacagagagtatccgacatatcaagtcggatcaggcaggacgctgataggggattcgctcggaggaacggtttctctcatgacggcgcttgactacccgaatatgttcgggaacgtcattatgcagtcaccttatgtagaccgccatgttctcgataaagtgaaacagtccgattccctgcagcttatttcaatttgccaccaaatcggcgagaaggaaaccgccgtcaaaacgaccgatgatcaaattttggatttcacaggtccaaatgagcaattaaaagagttgcttgaatcaaagcagacaaactacgatttcaaagcttttgacggggatcacaaatggacgtactggcagccgctcatcacccccgctttaaaaaaaatgctgtag

SEQ ID NO: 1209 - DNA, 489 bp, Bacillus licheniformis
atgaatcaagttcaagcgctgcgcggcgatttgttccacgaattggagacgggcatccgctccacgtgtcatcttctgaaaaaagtgaaggaatctgactggtcttaccggcccgccgaccgcatgcgaagcctgaaagaactggcaagccatctgacggccatcccagaagccgacttggccatcatgcaggaaaaggaagaggacgtcatcgcccggattgaaaagaaatatggtgctttgcagtcggctgaccaaatggctgcagctatgcagaaaggattcgacgcttttcaaacgtatatgacttccctctccgacgaggattttttgacaaaaaaaacaaagccgttttacctcgatgaagggatgacccaaagccgctggctgacggaaacgctcacccacatcttccatcacagggcccagctgtttaattatttaaaacagctcggctatgacgtcaacatgttcgacctgtatctataa

SEQ ID NO: 1210 - DNA, 948 bp, Bacillus licheniformis
atgcccaaaacagagcgtttaatcgaattgatgatgaccattcatacaaaacgaaaatttacggccggggagctcgcggtggaattcggagtttcctaccgcacggttctccgcgatctggacgagctcagcgcactcggcgttccgatctattctgaaacaggcgcgaacggaggctattatttgctgaatgagccggtgcttccgccgctctttttcacacaatcggaggcggcggctatgtttttcgcgtatcaatctttgcagttcttcggatcgctcccctttgatgcggaaacgcggatggttttaaaaaagttctaccgccaccttcccccggaaacacaggagcggattgatgcgatgaaagacagaatcgtgttctggaatccgcatcgcccaaaagccgccgaacatttagagacgcttcttgacgcagccgtcactcaatccgttttgacggtcgtttatgacggaactgacgagtgcacggagagatccatccagcctatcggcttatacagctggaacggcttctggtactgtccggcctattgctttaaaaggcaggcgttcagactgttccgcgccgaccgcatcctccgtgcggaaaaagcggacagcgggcaggcccgccagcttccctatccatcagttctcagctggatcaaacattcggagagcgagtgccctgaaccggtgcggctgcaagcggaactgacacgtagaggagccaggcgggctgcggctgatgtggatttattcaagatcctcaccatgcgggatgacggaacgggggcgatcgatgccagtatccccaggtctgaacttgagtatttcggagaacttttgtggaatctcggcgctgaggtaactgtaacagaacccgcggaaatcaagcttcatctgaaacggaaggctgctgacattttagcgaggtacggctga

SEQ ID NO: 1211 - DNA, 1125 bp, Bacillus licheniformis
atgactgaacatgtacaaacaacgctggcgcaaatcggcaaccgcagtgacgaaataaccggaaccgtcaatcctcccgtttatttctcttctgcgtacaggcacaaaggaatcggggaatccacaggatttgattacattcgcacaaaaaatccgacaagacagcttgtagaagatgcaatcgcgaaactagaagggggaacgcgcggctttgcgttcagttctggtatggctgccattcagacgatcatggctctgtttcaaagcggggatgagctcatcgtttcatccgatttatacgggggaacataccgcctttttgaaaacgaatggaagaaatacggactgcgctttttatacgatgatttttcagacgaagactgtatcaagtcgaaaatcacggacaatacgaaggcactgtttgtagaaacgccgacaaatccgctcatgcaggaagcagacattcaaaaaattgcgcaaatcgccaaagagaacgacttgctgctcattgtcgacaatacgttttatacaccggttctgcaaaggccgattgagctaggcgctgatcttgtcattcacagcgcgacgaagtatttgggcggtcataacgatcttttggcggggcttgtcgtcgcaaaaggcgaagagctgtctgaggaaatgttccagcaccaaaatgccatcggcgcggttttatcgccgttcgattcgtggctcttaatgagagggttgaagacgctcgctcttaggatgagacagcatcaggaaaacgcgcgggagctcgcggcctttttggaagagcaggaggaaattgccgatgttctttatccgggaaaaggcggcatgctgtcattccgcgttcaaaaagaagaatgggtcaatccgtttctaaaaaatctcaagacgatctgtttcgccgaaagcctcggcggagtcgaaagcttcatcacctacccggcgacacagacccacatggatatcccggaagacatccgaattgcaaacggcgtctgcaacaggcttctgcgcttttcagtcggaatcgagcacgtctccgatttgaagcaggatctcaaagctgcactggaaaaagtgaaaggggaggcggttccgcatgagtcatga

SEQ ID NO: 1212 - DNA, 1176 bp, Bacillus licheniformis
atgagtcatgaaaactggacgcttgaaacaaagcttgttcataaccaaaataaaacggacggagcaaccggagccgtcagcgtgccgatccagcacgcatcaacctttcatcaagattcttttgacaaattcggcgaatatgactacagccggtcaggcacaccgacaaggaaggcgcttgaagacacgatagccgagcttgagggagggacgagaggatttgctttttcatccggcatggctgcgatttcctccgcctttctgcttttgtcaaagggcgatcacgtgctcgtcacaaaagatgtgtacggcggcacttaccggatgattacggaagtgctgagccgctttgggattgaacatactttcgtcgatatgacggatttaaatgaaattgctttaaacataaaggaaaacacaaaagtcatctatcttgaaacaccgtcaaatccgacgctcggcattacggatattagaggggtcgtcaagcttgccaaggcgcacggctgtctgacgttccttgacaacacgttcatgaccccggcgttgcagcgaccgcttgagctcggcgtcgatattgtgcttcacagcgcgacgaagtttttaagcggacacagcgacgtattatcaggccttgccgtcgtgaaagacaaaaagctcggcgaagaactctataagctgcaaaattcgttcggcgctgttctcggcgtccaagactgctggcttgtgctgagagggctgaagacgctccaagtgcggcttgaaaaagcaagcaggacggctcagcagctcgccgaatttttcgaaaaacatccggccgtcaaacaagtgtattatccagggctgtcttcgcatccgggtgcatcgatccacaaacaccaggcgaacggcgcaggtgcggtcctttcttttgaacttgaggatgcggaagcagtcaaacaggttgtggaaaatgtctctctccctgtcttcgccgtcagtcttggagctgtggagtcgatcctttcttatccggcaaaaatgtcgcacgccgccatgccgaaggaggagcgcacaaaacggggcattaccgacggacttctgcgcttgagcgtcggggtcgaaaatgccgatgatttacaggcggactttgcccaagcgttggaagccgtatccggagcgcttgcccgttcataa

SEQ ID NO: 1213 - DNA, 1191 bp, Bacillus licheniformis
atgaattcttcattgatttcaccggatgacgtgtgggtgctttggggatttatcgcggtgtgggctgctgtgagtatttatttagagcagcggtttcgctgggctgccgctgtatcgggggccgtattggcactgggcggatcgatgctgtttactaatgcagggattcttccggccgagtcgcccttctatgatgcggtgtggtcctatgttgttccgcttgcgattcctttgctgctttttcaaatcaatgtgcggaagatcctgaaagaaagcggcagacttttgatgatgttttgcatcagcgcgctgggcactgcggccggaagcgtcattgctttttttctgtttaaggatcagattccgcaccttgataaaatcggcggcatgatcagcgcctcttatatcgggggaggcgtgaattttgcagcgatggccgccaagttctcaactcccggtgagtatgtatcatcgacggtggttgcggataattttatgatggcttttctttttttcattttaatggggataccggcgctaacatggtttcaaaaacgcttcggcgttcaggaagtggcgggcggccgcgaaaatcaggcggaagcctattggaagagaaaagacatctccttgcaggacatcgctttaaacatcggaaccgcctttgcgatcgttgctgtgtctgtaaaagcagcggcttttttcaaggaacgtttttcttctgacggcggatttcagtttcttgcctttattctgggcgaccagttcctgctgctgacgacgctgacaattttgctgacggtagtgtttccccgctattttgaacggctgcgcggctcacaggagatcgggacttatttgatttacttattctttgtcgtgattggcattccggcggatttgcggatcatcctcatgaacgccccgctcctcctggcatttgtctttgtgattgccatgtccaacctgctcgtatcgctcttctgcggaaagctgtttcgttttcggctcgatgaaattctcttggcttgcaacgcatctgtcggcggaccgacgacagcggcggcgatggcgattgccaaaggctggcggggcctcgttgctcccgtaatgctggtcgggacgttcggatatctgatcggcaattatgtcggcaccttcttgggcacatggttttccaccctgttataa

SEQ ID NO: 1214 - DNA, 570 bp, Bacillus licheniformis
atggatatcaacggcttaatcaacgaattacatttgatgcagcaaagctatgcgacattgttttcggttgtcaataaggtgcaaacccgcggtgacgaatatatggaaatattaactgccaggcaacacatggcgctcatcgctatcgcgcatttgccgcctgaaactgccacgcttacgaatatctccaaaaagcttggcacaaccaaacagaccgccaacaagctgatgactggtctggtcaaaaaaggctatgtcaaatcagtgccaagccaaaaagacaaacgctccattaatattgaaatgaccgctgaaggaaagaaagcgctggtggagtgttccgaaaggtccgtctatttcctggccgacttgtttcagcaatttacatccgaagaggttgcgacattttggcggctgttgcaaaagctttaccgttttgacggtgaggaacatgacggttttgaggagaatgcaaacattcagcttggcgtggggaattcgttagatacagaaaggattctcggagaatttgagaaacgccgctatggaggagaaaacgatgaaaagtga

SEQ ID NO: 1215 - DNA, 1374 bp, Bacillus licheniformis
gtgaaacagaacaaaagagaacaacttgttaacctgtttagtgtgttaaaagaaaaaggtcagatcaacgcggcagtgctagtcgctgaagacggagacattctttatcaaggcgccttcggatatgaaaacttggcagataagcgtttattgcaggaacattccttatttgaattagcatcgctatccaagccgttcactgctttgggcatccttcaattagcccagcaaggggaattgaaaatcgaggatcccgtagaacggtggataaccgggtttccctaccagggcgtaacgattcgcgatttattgacacatacgtcgggtctgcccgattatatggagtggtttctacaacattgggatcataacaagattgctgttaatcaagatatcgttgatatgctgatgaatcatcatccgcaacgctattttgccccgggtgaaggttggctttacagcaatacgggatatgtgctgcttgcggttatcattgaaaaggcatcaggtctgagttttgcagaatatatgaaaaaaaacatctttgaaccggtgaaaatgcggaactcaagggtttataacagaaggctgcagcctgaaaccattgagaactatgcgtatggatatgtgtatgacgtgcatacagcacagtacgttctgcctgatgaccttgaagaaacaaaatatgtctgctatcttgacgggattcagggggacggaaccgtaaactcaaccattcatgacttatatttgtttgatcaagccttatatacagattgtttgatcaatcaagtctcaaaagagcttgctttttctcccgcgtctctgaaaaacggagagtctatagattacgggtgtggatgggtgcttcgggatagtcctgaaacagggagaattgtcggtcacagcggcggctggccaggctattcaaccgtaatgatccgatatatcgatcagcaaaaaaccttcatttatttgagcaatgtggaacaggatgatgaatatgaacaggccatctttgaagccgttgaaaatatcctgtttgacaaggcctacaaaatccctgatcgccctgccgataaaaagaaaaaagagatcgatccggccatttacaaaagatatgtcggaagttattcacttcaggatggcaccgccgctgatgtgacagttgataagggccggatttatatgcaaatcaccggacagatccgttttgaattatttccagcctcggaaacgcgcttttttctcaggtcattgtctgttgaagtggaatttattttggaggatggtgtcgcaacccggttgattatttatcaaaatggcgcagaggaagaagcggtgcggatagtggaagcaaacagcaaggtatga

SEQ ID NO: 1216 - DNA, 951 bp, Bacillus licheniformis
gtggctaagactatcatttctggttttattttattttttctgcttattttctcggcggctgaaccaacatcagcggctttttgggatacaaaaggagacaacattattcatgatccttccatgattaaagaaggaaatacgtggtatacattcggcacgggtatcggcaatggaatccgcgtcatcaaatcgacagacggaaaaacatggagcgcagcgccaagcatatttgcaactccattatcatggtggaaaaagtacgtgccgaaccatgaagaaaaccaatgggcgcctgatatcagctattataatggacgctattggctttattatgcggtatccgcgttcggctccaatacttcggcgatcggactggcttcaacagaccgaatctcatccggaaattggcgcgacgacgggcttgtcatccggacgacgacctctaacaattataatgcaatcgaccctgagttagtgattgataaagaaggaaatccgtggctgtccttcggctcgttttggagcggcatcaagctgacaaagcttgataaaaaaacgatgaaacctacagggaaggtttattccatcgcatcaaggccgaacaacggaggagcggttgaagcgccgtctatcacatataaaaacggctactattatttattcgtttcgttcgataaatgctgtcaaggtgtgaacagcacgtataagatcgcttacggccgctcgacaaaaatcacggggccttactatgacaaaagcggcaagaaaatgacggaaggcggaggcacaatcctcgactccggaaacgaccagtggaagggcccgggcggcgcggatatcgtgaacggcaacatcatcgtcagacatggttatgatgcgcttgacaacggggcgcctaagctgctgatcaatgatttaaactgggattctaaaggctggccgaagtattag

SEQ ID NO: 1217 - DNA, 180 bp, Bacillus licheniformis
atggatctgatacttaaaagtgttgatagtattttaatcgtatttttagcaatcttttttatgtggaaattcgtttatgaaattaaacatgagaagcggaaggctgttatcttgcttttgctgctcatcaatgtctattttattgtaaaagtgttcaatctcgtgttgcaattgatgtag

SEQ ID NO: 1218 - DNA, 579 bp, Bacillus licheniformis
atgaaaacagaaaagcaaaaaatgctggacggagagctttatcatgcttctgatccggtgctgtgccatgacagactcaaggcgcgcaaaattacgaatgaattcaaccattcgaacgaaatcgacgacaataaaaggaccaagctaatcaaagagctgtttggatcaacaggggaaacgatcctcatcgaaccgtcgtttcgctgtgattacggctttaacatacatgtcggggaaaatttcttcgccaattttgactgtgttttcctcgatgtatgcgatatccggataggcgatcattgtatgctcggaccgggtgtccatatttatacggcgtcccatccgctcgatccgtccgaaaggataagcggtgcggagtacggaatacctgtcatcatcggccggaacgtttggattggcggcggcgcggtcatcaatcccggcgtcaaggtcggcgacaatgcagtgatagcttccggagccgtcgtcacaaaagatgtcccggataatgccatcgtcggcgggaatccggcgaaaatcattaaatacgttgatagcaaaaacaccaattctatgtaa

SEQ ID NO: 1219 - DNA, 360 bp, Bacillus licheniformis
atgaagtggttaggtaaaagtttagttgcttcatcattactggcgggtatccttgctgtttcgggaagtcccatgcatgtacaggcccaggagctctcgaagactgaaaatctctcttctcacgcatttgcacaaggaatcatcgcccctcaggcgatcgtcatcaacaggcagatgagagtcggacaggaggatcaatacgtcggcatttcgaacgtctcctacagcggcagcgccattaccgtcagaatcacttcggaccgcgtatacgtaaaggccgtaagcccaggcaaagcgacattttcgtatctcaattcattgggacagcttgtcatcaacaatattacggtcacccgatag

SEQ ID NO: 1220 - DNA, 891 bp, Bacillus licheniformis
gtgcattatgatgcgctgaagacattcgttacccttgcagaagtcaaaaatttcacgaaaacggccgagcttcttctcatgtcgcagccgagcgtaagcatgcacattaaaaatcttgaaaaagaattccagacgaaattatttgaacgctctccgaaatatttaaaaatcacgccgaccggtgaaattttatacgaccgcgccaaacaaatgatcaccatctatgaacaaacgaggcaggacattctcgatcaccacaactcgatcaaaggcgagctgaaaatcggcgcaagcttcacaatcggtgaatatattttgccttcgctcctcttcgaccttcaaaaggaatatcctgaactcgagctcaaggccgtcattggaaacacggaagaaatcgtgcaatccgtccgcctgtacaaagtggacatcggcttgatcgaaggacagacaaatgaaaaagagctttctgtacacgcctttatgcaggacgaattattcatcgctgcttcaagcgatcatccgcttgcggccaaacaggacgtgacaatctccgatctgcaaaatcaaacgtgggtaacgcgcgaagtcggctcaggcacacgcgaatacttaaaccatgtcatccgttcaaacggtttaaaagtgaaatcgtttctgacgatcagcagcaaccaggggatcaaagaaacgctcatgacgggcatcggactgtctctcctgtctggaagcgtcattgaaagagatgtacagcacggaaacctttccgttatccggctgaaaaatcaaacctttaacaggacgctttcctatatatattcacctgtcatgcaggacaagaaaaatgtgaaaacctttattaacgctttgaacaaaagaacatcttcgaaataa

SEQ ID NO: 1221 - DNA, 1830 bp, Bacillus licheniformis
ttgcaacttcaggtaatgaacagtccttttaatcaggagcaggcagagctcctcaaccgtcttctgccaactttgacggcatcacaaaaagcctggctgagcggttatctggcagctgtgcaaaccgccgatgccgcggcggctcttgaaacattgccggcggaagctcctgctgcaagcccggctcagcctgtttccaaagaagtgaccattttattcggatcgcagacaggaaatgcacagggacttgccgaaaacgcggctaagacgcttacagaacggggatttcaagtcaccgtctcttcaatgagcgattttaagccgaaccaattgaagaaactaaaaaaccttctcatcgtcgtcagcacgcacggtgaaggggatccgccggacaacgcgctgtcattccatgagtttctccatggaagacgggctccgaagctcgatgatctccgttattctgtgctggctcttggcgacacgtcgtatgaatttttctgccagaccggaaaagagttcgaccagcggcttggtgagcttggaggcacaaggctccatccgcgcgtcgactgcgatctcgattatgatgagccggctgcagcatggcttgacggtgtcatctcaagcttaaacgaaggacaggaacagggcgcaagcgccgcacctgctcaaacggcagctccgcaagccgcgggaggagtaacagtatattcgagaaaaaatccgttcagagcggaagtgctggaaaatttgaatttaaacggccgcggatcaaataaagaaacgcgccatcttgaattatcgcttgaaggctcaggtttgacttatgaacctggcgacgcgctcggcatctttccggaaaatgaccctgaactcgtcgatatgctgctgaaagagctgaaatgggatccgaatgctgccgttgctgttgatcaaggggaaaacctttctttgaaagaagcgttgacttcttactatgaaattacggtgctgacaaagaaattcattcagcaggcggcagaaatcattgaaaatgaaaagctgcgcgagcttgccgctccggaaaatgcggatcaattaaaagcgtatatcgctggccgcgacctgattgattttgtgcgggatttcggtccgatcgcagcagctccgcaggaatttgtatcgattcttcgaaaaatcccgcctcggctttattcgatcgcatcgagcttcgctgcaaatccggatgaagtgcatttgacgatcggtgctgtccgctacaatgcgcacggcagagaccgaaaaggggtctgctcggtattatgtgccgaacgtctgcagcctggcgacaccctgcctgttttcattcagccgaataaaaactttaagctgccggagaatccggagactccgattatcatggtcggccccggcacaggcgttgcgccgtttaggtcatttatgcaggagcgcgaagaaaccggagcatcggggaaatcgtggatgttcttcggcgatcagcattttgtcactgatttcttatatcagacagaatggcaaaagtggctgagtgaaggcgtgctgacaaaaatggatgtcgcgttctcgcgggatacggaagaaaaagtatatgtacagcatcgcatgctggagcacagcaaagaattgtttgagtggcttgaagagggagcggctttctacgtttgcggcgacaagaacaacatggccaaagatgttcaaaacgcattgcttgaaattatcgaaaaagaaggcggcaaaagccgtgaggaagctgaagcctacctcgcagaaatgaaaaagcaaaaacgttatcagcgcgatgtatactga

SEQ ID NO: 1222 - DNA, 1719 bp, Bacillus licheniformis
atggggaacgaaatattaaaagcgcctgaaggcccgccgagcgatgtagaacgtattaagaaagaaagcgattatttgcgcggcaccctgaaggaatcgatgctcgagccgctttcagccgggatttcagatgacgacaaccgtctgatgaagcaccacggcagctatttgcaggatgaccgcgatctccgcaatgagcggcaaaagcagaagcttgagcctgcgtatcagttcatgctgcgcgtccggatgccgggcggtgtggcgacgcctgagcagtggcttgtcatggatgagcttgcccggaaatacggaaacggaacattgaagctgacaactcgggaaacattccaaatgcacggcattttaaaatggaacatgaaaaaaacgattcagtcgatccattcagccatgctagataccattgcagcatgcggcgatgttaaccggaacgtcatgtgcacttccaatccgtatcagtcagaaatccatcgagaagtgtatgaatggtcgaaaaaactgagtgatgacctgctgccgcgcacacgtgcgtatcatgaaatctggcttgatgaggaaaaagtggccggcacgcctgatgcggatgaagtcgaaccgatgtacggaccgctgtatctgccgcggaaattcaaaatcggcatcgccgttccgccgtcaaatgatatcgatgtattttctcaggatcttggttttatcgcgattgtggaggatgacaagctcatcggcttcaacgtcgcgatcggcggcggcatgggcatgacccacggggacaaagcaacgtatccgcagcttgccaaagttattggcttctgcaagcctgaacagctatacgatgtcgctgaaaaaacgattacgatccagcgggactacggaaaccgttcggtccgcaaaaatgcccgcttcaagtatacggttgaccgcctcggcttggaaacggtcaaaaacgagctggaaaaccgtctcggctggagcctcgctgaagcaaagccttatcatttcgagcataacggcgaccgctacggctgggtaaagggcgtaaaaggaagatggcactttacaatgtttgttgagggcggccgtgtcactgattatgatgattacaagctgatgaccggcttaagggaaatcgccaaagttcataccggcgatatccgcctcacagccaaccaaaacttgatcattgccaatgtcacaagccaaaaaaagaaaaagatcagcgagctgatcgaacagtttggcttgactgacggcaagcattatacagcgctccgccgcagctcgatcgcatgcgtcgcactgccgacgtgcgggttggcgatggccgaagcggaacggtatttgccgaagctgattgacaaaattgatgaaattgttgaagaaaacggcttgaagaatgaagaaattaccatccgcatgacagggtgcccgaacggctgcgcccgccatgcgctcggcgaaatcggcttcatcggaaaagccccgggcaagtacaatatgtatctcggcgccgcttttgacggcagccgtctgagcaaaatgtaccgggaaaacatcggcgaagaagaaattttaaaagaacttcgcaatattcttccgcgctatgcgaaagaacgcaatgaaggagaacgtttcggagatttcgtcatccgcgccggaattgttaaagaaacgacggacggaacgaattttcatgactga

SEQ ID NO: 1223 - DNA, 874 bp, Bacillus licheniformis
ttggttataaacatgaacagtcttcacatctttgtgaaagtcgcagagactttgaatatgacagaagcagccaacgaactgtatatttcacagccggccgtgagcaaagccgtaaaaagcttggaaacgtcgctcggggtcaaattattgattcgggataaacaaaacaagataaaacttacggacgcgggaaaggaaatcgtcgtactggcgagacagatgatcgtgattgaaaacaaaatataccaagtggccgatcaagaaaatcatctgctcagagggaaagtcaaggttggctccttccccgccgtctcagcaaatattttgccgcaggctatcgcctccttcagatcaaagtatccgctcgtacaaatcgaactgcttgagggaacctccgaccaaattaagcaatgggtcgaaactcgcatggttgatttaggaatcgtcgcctctccctttgacggattcgaaagccaaccggatgacggccgtgattcctgagcaatatcaccacttaaaagacgcaccgttcattgatctgaaaaaatatcaaaatgaattgattttttgtaaaggcgggcacgaaatcgcggtatctcaaatctttcaaaaacaccgcctcgagttaaaagaaaacctgactgtgcaaaacgcggaaacattggtcaatatggttcataacaatttgggaatcggcttgatatcaagcttctcgctttcctccgtgtcccatcggttgatcaaaaaagacatctctcctcaaattatccgcgaagtcggcatgataacaccctcatttgaagaagcaacacctgcggctgcagagtttatgaaaatgatcatagagtcggaaactgtccgggcattttcgtaa

SEQ ID NO: 1224 - DNA, 873 bp, Bacillus licheniformis
atgtttaaagtacttttggggatcatctctgtaacgctgatttgggggtatacctgggtgacgatgaaaatcgcaatcactgacattccccctgttttattttcggccctgcggctgttcattggagctgttcctttgtttgtgattctcttgatcaaaggaaggaaacgttcaataggaaaggagaatatcaagcattatctggtgatgagtttattgatgggtttaggttatatgggggtgttaacttacggcatgcagtttgtcgattcgggaaaaacgtctgttttggtgtacaccatgcctatttttgttactgtcatcagtcattttaaattaaacgagaaaatcaatgtgtataaaatgctcggtttattttctggtctgatcggtcttttgtttatattagggggcgggattctgcatgttgatcaaaacgtcatatttggagagctttgcgttttaatcgcagcgctcagctggggcgtcgccaatgtttacagcaaactgaaattcaaaaatacagatatgattcatatgaatgcatggcagcttctcacaggagcggtgatgttattgattttctcttttatactggaaccgtcccggccgattcactggtcaaatgaagcaatcttgtctctattgtttaacggtttattctctacggctttgacgttcgtcatttggttttggatactgaatcaaatcgaagcgtcgaaagcatcgatggctttaatgtttgttcccgtattaggccttttgttcggctggctgcagctgcatgaaccggtcacattcagcatcctgatcggcgcattcatgatctgcatcggcatttttatgaatacttatcaatttaaaaaagtgtaa

SEQ ID NO: 1225 - DNA, 378 bp, Bacillus licheniformis
atgaaaatcgaacacatcgccatatggacgaacaatttagaggaaatgaaagatttctatacccgtttttttcacggaaagacgaatgaaaaatatgtcaatccgaaaaagcatttcgaatcatatttcatccagtttgaatcgggaacacggcttgagctgatgagacgccccgaccttgcaaaaggagaggagaacgcttccggctatgcacatatggcgttttccttagggtcgcggcaagaggttgacgagatgacgagccgctttgaaaaggaaggataccaggttgccggaaagccgcgcgtcacgggagacgggtattatgaaagagtcattctggatcctgacggcaacatcgttgaactgaccgtttga

SEQ ID NO: 1226 - DNA, 549 bp, Bacillus licheniformis
ttgaaaaagttaatcgtttgtttattagctgttttactgatcttgcctgccggagcgtccctcgcagcgaaaaatcaaacatcagggaatttaacaaataagcaagtcatgcaattaaccttgcaggcacgggagcacttttggaatacgatgagcggccacaatccaaaagcgaaaaactcaacttgcccatccaaaacatttgaataccgcggtcttccatatacgtatatgtgcagtgaattcagcacaaaagcaaaattaacagactacttgacgccggttttcacaaaagacgccattaaaaaaggcttggaaaaatacaacatcatttcttataaaggaaaaatggccgtgcctgtcggcgatggggacaacctcttaggatgggacaaggcaaaaatcaaactgatctctcaaaaaaacaatacccgcacttatgaattttccgtaccggcattggatggatcggtgactgcgaaaagaaagatcacgtttgtgaaagaaaacaacaaatggaaaatcaatcagctcgatgctgccatctaa

SEQ ID NO: 1227 - DNA, 735 bp, Bacillus licheniformis
atgaagaagacaatcatgtccttggctgcagccgcggctatgtcggcgactgcattcggagcgactgcctcagcaaaagaaatcgaagttcaaaaaggagacacgctctgggggatttctcaaaactacggaatgaacctcaaggacttaaaaaaatggaatcagctttcatcagatctgatttttccaggtcaaaagctgaacatttcttctcaagaagaaaaatctgaagaaaagcagtacaccgttcagccaggggacacgctctcaaaaatcgcaaaagagttcggtgtgactgtaagcgatcttcaaaaacggaacaacctgaagtcagacttgattattgcagggcaaacgattgcaataaacggagaagcggcagctgcagcagcgcctgtgaaacaagagtccgctccaaaacaaaatgatcagcctgtcaacgtacaaaaggaaatcacagtgaccgcaactgcgtatacggcaaatgacgggggcatttcaggcatcacaaaaacgggagtcgacctgaatgcgaaccgcaatgcgaaagtcatcgcggttgatccaagcgtgattccgctcggcacgaaagtatatgtggaaggctatggcgaagcgacggctgaagacaccggcggcgccattaaaggccataaaatagacgtatttattccagataaaaaagacgctttcaattggggcgtcaaaaccgtaaaggttaaaattttaaactga

SEQ ID NO: 1228 - DNA, 1425 bp, Bacillus licheniformis
atggaacaagctagaaaaggctccttcatgattatcgcaatcttaatcgtcggaaattttctcgctctgattaatgagacggtcatgaatgtggctttgccgaaaatcatcgacgattttggcatttcagcgaacacagcccagtggctgtcaaccggatatatgctcatgatcggcatcgccgtgccgattaccgcgtttttaatgcagcgctttacgacaaggcagctgtttctgtctgcgatgacgctttttacagcgggaaccttgctggccggaattgctccggtcttcccgctcgttctcgccggacggatcatccagggttcaggtacaggcctgatattgccgcttgtgatgaatgtgatactgactttgattccgccgcaaaaacgcggaacgatgaccgggatccttacgctcgttatcttatttgccccggcgatcggtccggtcatctcaggctatattgtcgaacattattcatggcgcgttgttttcttcatgatgctgccagtatcggtcttcatgattttttatgcggcgttccgcttgaaaaatgtaaccgaactgacgtatccgaaaattgacatattatcaattcttttatcgaccgtcggatttggcgggatcgttttcggcttcagcaacgccggggaagcagcgggctggagcagtccgaaagtcatcatcggactggcggccggtgtcatcggattaatattgttcgtcatgcgccagctcagattggaagtgccgatgcttgatatgaggccgtttcgttcaaagatattttcaatctcggttatcctgatgtggatcgtgatgatgctgcagttttcgatgatgctgattttgccgctttacttccaaatggcgcttgagctgtcaccgctttatacaggcattctcatgctgccgggcggcctcgtcctcgcgatgacatcccttgttgcagggcgcctgtttgataagcttggctttaaaccgctgttgatcaccggattgatcattgtgattgccgtcctttcgctgtttacgaatatttcaagcgatacgccgatggcggtcggaatgatgctctacgccggctttacactcggcgtcgggttgacaatggctccgattatgacgctcggtttgaatcaggtgcccaaaccgctttacccgcatggttcggcgataatgaatacagttaatcaagtttcaggggcaatcggtccggcattgtatacgacgatcctgacaaccgtttcgaatcgctttatcgcgcactcttccggaggcagccgtcaggagctgcacatgcaaggcatgacagaaggcgttcatatggtttatttcgtagccatcgcctttgcagccgccgctcttgcgatttcggtttttgtaaaaagcagacgcgcggaacagcatgcagcataa

SEQ ID NO: 1229 - DNA, 579 bp, Bacillus licheniformis
atggcagaaaaaatgagcagccgcgacaaaattttgcggacggcttcacgattgttccgcaaacaaggctaccatgccacaggcttaagccaaatcacagccgaaagcggagcgccgcggggatcgctttattattatttccccggcggcaaagaggaactggcgcaagaggcgattcaattaaccggagaaagaatcaaagcgtatatatcgtcagcgatcagcggtgaagctgatcctgtcaaggcgtttcaatcttatatccagatgatggctgacggaatcgaggaatacatcatcgaagaaaacgacgatattccgatcgtatccgtcgccgcagaaacgtggtcgttcagtgaaaggctccgccaaacgtgtgaacaggtttatcaagactggcagcttgtctatcaggaaaaactgctccagtcaggctatgcgccggaaacggccgagacgctgagcgtcgcgatacaagcgatgattgagggtgcgtatgtgctctcagtgacgaaaaaaaacggccggcctctcagtgcagccgccgaacaaattccttttttgctaaaacgttcataa

SEQ ID NO: 1230 - DNA, 336 bp, Bacillus licheniformis
gtgacgtttatcattttaatggccggattgtttcttttgattcaactcaaaagaccgttccgcagaaaaatgttcggctatgtttttttagccgtttatttaacggcgctcgcactctataccatcaattccgcttttgttcacttcatatctgacagccttttgtcgatattggcagcgattgctgtggcgcctgctgcttgccggctttctgaagccttcagcggattcccgctgaaccgaatatggacaaatcgtccttattttaaaacaggccttcaaaaaaggtcttttttttcgttaaaattatatagaccgatcagtataaaatcataa

SEQ ID NO: 1231 - DNA, 414 bp, Bacillus licheniformis
atgattaaaaaaactctcggtaccatgttcgcagtgactatgatctttcttttgatcctcactgtgtttacgctctttttcgggtcttattatttcggcgtcgccggtttttttgcgattttcggcgttacatacgaatcgccctggtcgctcttctggtatatccttttatcttttggcctcggcgcgctgtttgaaatcccggaaaaaattctgagctttatgattgggcataaagctgcgacctttatgatcgaatgtttttttacttggcttgccatccatctcgctgatgaattgatggacagcatcaccatcccgctggatgtcgaaatcatcgcctgtctgtttttattcgtcattcatctggcatttgaagacaacaaagaaagaaaccggacatacgaggattga

SEQ ID NO: 1232 - DNA, 2535 bp, Bacillus licheniformis
atgaagactctggacgttcaggcgctgcacaaagcgattgatcaaacggtggaacaattaaagcaacaatcggaagaaatcgtcaacattaaaaaaagcgtggaaggtatcacgtcgctcaacgatgccttaaaaggaaaaggcggcgacgcaatacggaatttttataaagagtgtcacaccccattccttcaattttttgaaacttttatcgaggaatatcaatcagcattgaagaaaatcaaaagtgcattgaattccctggagccacaacacaatggatatatttcgcaagccttcctcgataatgagctggaacaaggagtgaaagatgccgatcgcaccacgaagcgtttggtttctaaaacgaatgctacaatcgctaaagtcagccatatagtcgatttgccggaattagatgacagtaattttcacgagaattactcgaaagctttaaaagaaatcaatcagacaattgaaaaattacatacattcgacagggagcagacgaacaccatcaaagccgctgaaaacgacttagaaacaatgcaaagatacatcgctaggcttgaaaaaatgtacacaggccctaaaattgaaatcaccggctatcagaaaggttctattttaaaacaggataaaatggataccttgagtggaaaccaggaaacagcgatgggcgttatgttggctaagctcgataagagatcaaaactcgaaaaggaagttagtgaagctaacaaacaggttaataaaatctctcacctaaaggaaaagctcgaaaatgtcattgatcctgatgaatttgttgagattgcacaagagattggaattgaaaatctgacagaaaagcagcaaaattactatttttacactataaatcgaaaacgaaaacaaagtggtatcatggggcgtattaagcagggcattgaagaaggaatagaagatgtggccgtcgatacagtgacaggaatacgagataccataaccaatccaaaagaaacgctagagggcattgcctacacagtcacccaccctgtagaaacatttgaaatcataaagaaagatatcgaggactccttcgtgagggacgtcatcaatggtgatgcagaaagcagggcgagatggtttacatacgctaccggaatggttgcgtcatccattgtcggaacgaaaggtgcagacaaagttagcaagttggctaaggcgggcaagatgggaaaagccgcatctaagataaaggatgtctctaaaaagacagctagcaagggcatagagagtgcgaaaaaggcaggtaagaaagcagctgataaagttgtcagggattttaaagatattaaaaatctcactccgaaagtccaaatcgcttctcctcaactagctttagccaatgctggtaaagttccgttcaatacgatagatggatctcgattgaaagataaattaattcaacaaaccaaaaagatttctgatcaagcaaaacaagcaagaaatcgaatggtcagcatcattgcgggtgtttcttccaaaacaaaaacagacattaaagtagactcaaaaaccatccataaagtgaaatatggtgaccatttcacaagagtcaaaagaagaaaggtgttaaaaccgaacattgagtatacaacgcctgtaggctatacttataaaactgatcataaaggacgtattacaaatgtcagcggcaaactaaatttgggagcagcaaagagaaacaaatacgcccaaagaattgccggccgtgaagatcgattaaaaaccgatgagggcggtcatctcattgcaagtatattcgaagggtctggaaagcttgacaaccttgtgccgatggatggtaacttaaataaaggagaatggaaaaagcttgagaacatgtgggccaaacacctcgaaaaaggaagaacagttgaggttaaaatacagccagtatacaaagggaattcccaaagaccggcaagctttgagatagaatataaaatcggaaaacgggaatgggaagttgtgaaatttgataataagcctggaggtaagtagccaatggatgaaaatcaattaaacacgatatatcaagaaattgcggagacagtagttgagactattccagaggaatggtcaaagattttgatttatggagaaattcttgaagatgtgcaaaaaggattcttttattattatcctgaaggaaatgattcaccggtatattgtcataatatccctgaattttttaggattgaaaaagaagcctatcgaaatctttggagacaattaatcaataacttagaaaagctatggtacgaatttaagaatagtgatcaagagacttggacgagtctctctatgatcattcacagtgatggtgaatttaatatcgactacgactatgaggatttatcagatgctgatgattatgaaagaagaattgtatgggaacacaaatatttaggactctggccagaagatgaagatgataaggaatttttagagcaataccttgaatctaatcaagatgaaaatgaatag

SEQ ID NO: 1233 - DNA, 648 bp, Bacillus licheniformis
atgaagcgggctttaactgaccaatacggcagctttacagagatggcagaaaacgaaatagaagggaccgattattcggtggctgctcgggatgcagggagcgctctgcttgtgatggctccccacgggggcgggatcgagccgggcatcagtgaaattgtcaaggcttttgcagagggcgcttcggtttatttattggaaggattgaaaaggcgcggcaataagagccttcatgtgacaagcgctcattttgactgcccgcttgccttgcgaatggctgcaggacaccggtacatactggcttttcacgggtatgaggagcctgctcatcgacatacgctcatcggagggacagatcgaaggcgcgccttgatgtttaaggagacattggagaggcacggattttctgcggagctggcggctgaaaggggctatctttcaggtacaaaccctgcaagcatcaacaatcgctgccaaaccggtttaagcgtgcaatttgaaatcagcacagcccagcggaaggcgatgtttgagcaattcacattaaagggcaggcgaacgtctcaaaatgaggtgttttcccgctatgtcaaagctttgaaggaaggagcatgcatcgcatatgggccgagtgcagccggcagctga

SEQ ID NO: 1234 - DNA, 657 bp, Bacillus licheniformis
ttgaagttttatttatctcacctagaagaatacgtcaaaaatatgtaccaaaagttcggtttttttgaacctcaccagattgatatgaatcgcatagccgctcattttaatatttggattcactatgaaaatgtcaacagcatgatgattaagcatgacggcatgtacagcattattctcaacagcagtctttcaaaggaaaagcagtgggaggactttgcccatgagctgtgccacgtattaaagcacgccggaaaccagctttacatgaatcagatgttcagggagctgcaggagttccaggccaatcaatttatgtaccatttttgcgtccctacttttatgcttttaaaaatggattttcctcagctgcgatgccaagccgctaaaatgatcgccgacctctttaaagtcacggagtcgttcgctgtcaaacggatcgagctctttgaaaaacggcaggccggaatccagtttcatgaggcgtggatggcaagcctttcccaagagagcgaatcggcgaatgctccacgctttgaagaagtagacgaacttgcacgctaccggcgggaaacccgccgcccgtacgcagcggcaaacggcctcggcaaaatggtcgctgcggaaagccggccggcttatatgctgagaaaataa

SEQ ID NO: 1235 - DNA, 354 bp, Bacillus licheniformis
atgttaggcggcagactgaagagcctgagaggaaaaaggacacaggaagaagtggcaaagcagatcggtgtatcgcgggcacgctactcccattatgaaaacggaagaagcgagccggactatgaaacattaaaaaaactcgctgattactataaagtgacgatagactatctgctgacaggcacggaaaagaaaaaaaacatcgaagacgaaatcgcagatccggatctgcaaattgcctaccgcgacatgcaggaattttcccccgaaagcagacagcaggccatcgagttcattcaatacttaaaagaaaaagagaagaaacgaaagcccggagataaacaaaacggataa

SEQ ID NO: 1236 - DNA, 207 bp, Bacillus licheniformis
gtgtcggaaagacttggactctccgaggtttatgttcgcaaaattgaaaggggaacacgcaatcccggcagagaaacgatgctgaaattcgaaacgctttattcagtgcctgatcgtttgctgtttcccgatctttttcaggtctttatagatacatattgtatcaaagaaaacctgcataaaagaaggcgatgtcatgaatcttga

SEQ ID NO: 1237 - DNA, 297 bp, Bacillus licheniformis
atgaatcttgaacatccgatggtcacacgcatccgaacacacggctatccaaaggaagccgacagagagcaaatgagaagccacggcggacttgccggatatccaaaaggaggaagcatgggtaaaattgtgatttcctacagctcagaccggtttgatcaatggcggctcggagaagccgggggattcaacgcttttacgaaagacggaaagcctgtattccaatttgatcataaaggccaatacgaacggtatctcaggctgaaccgcaaaaggcagaaggaagggggaagatga

SEQ ID NO: 1238 - DNA, 831 bp, Bacillus licheniformis
atgtcccgcccgccggatcaaagctatcccttttcggtttactcagggcttttaacacctgttcactacgagaaaataggcaatgccatttggctttttttatggtgcatcagttcaacaacaaaggaaatcgaacgcgatggggagacatggggcatcgtgctcggcaacaagccgctgaaagcagccgaactggctcttcaattcggcgtcaacgaaaaaacgatcagaagatggctcgctcttctcgaacgaaacggctacattgcagtcacaagagcgccttacggaatgattttgtcagtcagacattcaaaaaaatttgcctacgccagccatgtccgaacagaactgcctgatcggacagaagagactggcagtgcggacaagcttgtccaatccaataaagatatcacacaaatcaacacaaaacataatatgagttccataaaaacaatagcagaacgatttgccgccctcaggtcgatgcaggaaggaaagcccgtccatccctcgtcaaaagactatcaggccatcgcccggattgtcgcccgcggagtgtctcttccgcaaacaatcaaatggcttgaacaatgttttgaggagtatgaggcgcggcgccgaagccgtcatgaaacgatcaaggtcttcagctactgtgaaaaatatatcatcggccggctggctgaagcggaagcgaaaacgaaaacaactgtcaggagggagaacaatgcccaaaagaacaatcgaagaggtcatggacgaactgagaaacaggagccgtcaatcacaggggggcaaaccggaagaatccgccgcaaaacggtatga

SEQ ID NO: 1239 - DNA, 801 bp, Bacillus licheniformis
atgcccaaaagaacaatcgaagaggtcatggacgaactgagaaacaggagccgtcaatcacaggggggcaaaccggaagaatccgccgcaaaacggtatgactgtccgaagtgcaaagatgaactcggatttatcgaacggcgcggaacgatggaagtatgggtatcatgcgtctgccgcgaatggcgcaaagcgcaaaagctgttgaagacgagcgaaatcaccgaacaatttaaaaacttaaactttgctcaattcaagacggaaggaaagcatcaatctgtaaaagaggcgtatgaatgcgccgttgaatatgtacaagcttaccgggacattcaggaaagccgcagaaacagcatcgcgctcttgggacgacccggttcagggaagactcatttgctgacggctgccgccaatgagctgatgaggaagctttttgtacccgtcctgtattttccgtttgtcgaaggattcaatgatttaaaacaggacttttcgttgcttgagaataagctgaaccggatgaagcaagtcgaggtgctgtttcttgatgacctgtttaagccggtggcaggcaggccgcgggcaacggaatggcagatcgaacagacatatgccgtcgtcaattacaggtatttgaaccataagccgatcatgctgtccagcgagctaagcgttgaagaaattgtcagcatagacgaagcgctcggaacgaggctggtcgaaatgtgcggggactttctcgtcgtcctgaacgggagctctttcggcatcaatcatagactggaggggatggtttga

SEQ ID NO: 1240 - DNA, 342 bp, Bacillus licheniformis
gtgaaaaacgaaagtgaggcgtacagcccatcaccatggcgcgtcgtcagaacaaataccgacgtatacatttattcagcatacagcaaagccgaaaagaaacggttttcttattccaacggaagggtgattgccaaagtcgccgactacagcgcatattccaaggaaaaaaatgcccgcttaatcgctgcagctcccgaactgttgaccgcagtgaagctcacgcttgcctatttgaagcgaaaacggcccgttcacagcgattcagttgagaatcaattgaagaatattttagaaaaagtcgtcgcaaaagcagaatttgaagaggaggaaacaagatga

SEQ ID NO: 1241 - DNA, 204 bp, Bacillus licheniformis
atgaaccatccggcaaagttaacagatatcaacgatacgacggttgcaagccgcatcaaaaaaggaaaggtgacggtgatcgtccttgacggaatgaacggcacggcatggcaggccgaggcgcctgagcacggcaaaaccgtcattgaaacgagaaagggagatctcgcaaggatcgaatttgaaatcggctataagctatag

SEQ ID NO: 1242 - DNA, 504 bp, Bacillus licheniformis
atggaagatttgcttttcgaatataaaagagcgctgaaaaacacgaaaaaattgtataagccctatcaagatgaacaagggctgacggctgaacagctgaatgataaaaaactgatcagaaacatgatgaccgatttggaatatgtgatcgactggcttgaaaacggaagagaacctggaatcagacgggcgattgacaggcgcgactcttataagcggatgctcctgaaagatccgcggatcatcgacacgttttcagaacagagtgcatttgaaccggctcaggaagtgtcagcatacgataaagcccggattgaatcagcgctgtctgcccttacggcacgcgaaaaagaaatcttcattttacataaggtcgaacagttttcctatgagcggattgccgccatgctcggcatcaaaaagtctactgttcaaaccaatgtgaaacgggcgcagctgaaaatcgcgaaacagatcgaaaagcctctcgattgtatggcataa

SEQ ID NO: 1243 - DNA, 801 bp, Bacillus licheniformis
atgccaaggaaaagggatccaaaaagggatgaagcttttcgtctctatcaaaaatacgggggaaacattacgaatctcgcaatcgcaagagaactcggcgtttcaaataaaaaaatcagcgtttggaaaacccgcgaccgctggcaagaggctttagccggagatgacgcgaaccgtggaaaagcagacattcacaatgaagggctgaatgaacggcagcggctgttttgcatctattatgtgaaaagcttcaatgccacccaagcggcggtaaaagcgggctattccccggccagcgcccatgtgacaggctgccggcttttgaaaaatgaaaaggtggccgatgaaatcaggcgaatcaaaaaagaaatggtaggggagatattcgtcgaggcgatggatgttctccaagtctatgtaaaaatcgcgtttgccgatatgaccgattatgtgactttcggcaaaaaagaggtacaggctgtcggaaagtccggaccgctgtttgatgaagaaaacaatccggttatgaaagaggtcagctttgtggatgtgaaacattccgacctcgtcgatggcacagtcatcacggaagcgaaactcgggaaagaagggatcgcgatcaagctggccgataaaatgaaggcgctcgataagctctcacagtattttgaccttttccctgattcatttaagcggaaaattgaaaatgagaagctgaagctcgccagacaaaaagccgacaaagatgcggaaacgggtcccgttgaagtggtcatcgcccgaaaaggtgatcaggcttga

SEQ ID NO: 1244 - DNA, 1299 bp, Bacillus licheniformis
ttgatcataaaagaagtcaatccgcattttgaagattatttgtttaactgggatcagacctttcaatttcttgtcggcggatacggttcgtcgaaaagctatcataccgctttaaaagtcgtattaaaactgcttcaggaaaagcggaccgctcttgtcgtaagggaagtgtttgaaacacacagggattcgacgttttctttattcgcatccattatcgatgagctgggtgtccaaaaggcggctcaggcggtttcttctccgatgcatatcaggtttgcaaacggcagccgaattatttttaaaggaatggacaacccggcgaaattgaaatccgtcaacaacatctcgctgatttggattgaagaatgttcagaggtgaagtatgaaggcttcaaggaactgatcggccggctgaggcatccttatcacaggctgtatatgatgttgacgacaaaccccgtcagccagtcaaactggacgtacagacactttttcaaggatgagcggaacaagcggttcattttggatgatgaggtcttgtataaaaagcgggtcgctgtcgtcggtgatacgtattaccaccattccacagctgatgacaacctgtttttgccgaaaagctacctcaaacagcttgatgatatgaaagcatatgatcccgacctgtaccggattgccagaaaagggcggtttggggtaaacggcaccagggttctgccgcaatttgaagtgatggagcatgaggaggtcatgaggcagatctccgccatttccaacccgctgaagagaaccggaatggatttcggatttgaggaatcatacaatgccgtcgtccgggcggccgtcgatcccgacaaaaaatatctatatatctattgggagtactacaaaaataaaatgacagatgataagacggccgaagaacttcacgaattcgcggttgcgaaggagctgattaaagctgatcccgctgagccgaaaagcattcagtttttcaggcagaatggttttaacatgacagcagcacgcaagttccaaggctcgcgcctgcaatatacgaaaaaaatcaagcggtttaaaaaaatattctgttctgaccgatgtgccaatacgatctacgaattgcagccgctgacctatgcgacggatcaagacggcaatctgaaggaggatcagtttacaattgatccgcacacgctttccgcgctatggtacgcgcttgatgattatgaagtaaccgatttgaaggctgagccggaagtgagaaaacggccgaacaggaaaagggggagatag

SEQ ID NO: 1245 - DNA, 1515 bp, Bacillus licheniformis
atgtccactcagcaaacggtaagagcgaaagtcatgaaatcccgttttcacgggcctgtaacaaaacaaatatatgaagatcaattttcggagatctacggcgatgatattatcgctccgccgtacaatttgaaagaattgaaagccattgccgaatattcttcaattcttcagcaatgcattgacgcctataaaacgaatattgcggggttcgggctcgatgtagaatacgcttttgatttcaacggggcggatgtgacgcccgatcggaaaaaagctgctgagtccgattggacaaggcttgaagatttttgccgccaccttcattttgacgaatcggctgaaacaattttaagccatatgatagaggaccgcgaaaaaaccgggaacgggtttttggaggtgctcagaaacggtgcggggcagccggccggaattgaatatctcgatgtcaaaaatatgcgggtatgcggattgacagaaccgatcgaagttgaattcgcctacatggaaaacggatcgctaaaaaacatcaagagggagaaaaggttccgcaaatacgttcagatgattgacggcaggaaagtgtactttaaagagtacggcgatccgcgcgtcatggatatgaccaccggagagtttgacaggcagactccccctgaacgaagcgcgaatgaagcgatccattttaaaatcggcagcggcgtctacggcgttccgcgctggatcggaaatattgtcaacctgtacggggcgcggaaagcggaagagctgaattatatgtacttcagacaaggccggcacgtacctgccgtcattacggttgaaaacggcatgctctcagaggcttcctacagagagctgcaggaatatatgaacgacttggaaggggttgaaaatgcccacaaatttttgctgatcgaagcggagggaatcgcacaggaaaaagacattcacggcagccaggacattacgccggtgaaggtggacatcaaatccctcgccgaaattttgcaggaagatgcgctgtttcttgaatatgacgagaaaacccggaataaaatccgctcttccttcaggctcccgccgctctacaccggtgatgcccatgaatataacagggcgacagccgataccgcccgcaaaatcaccgaagaacaggtttttgaaccggagcggaaaatattgatcggcaagctgaatacgctgtttctccgcgatttaaacattttccacgcgaggctccagctgaaaggaccggactttcgcgatccgcttgagatcgcaaaagtgctcggtccttttattcaggcaggagcagtatctgcaaatgatttgcgcgacctggccggcagagtgctcggcaagacgctagatgaatggccggaggaagaattcagcaggccgctcgtttaccaggaaagctcaaagcgtgcggaagcggaagcaggagcattgctgcctgaactgcaggaagccgtcgagacattgaaacagatcactgaaaggaggtga

SEQ ID NO: 1246 - DNA, 849 bp, Bacillus licheniformis
gtgccgagagagcttaaaaatgccaaaatcaatttcgtcagttatgtcgacaaagcggcgaacaaaaagaaattcttcatgacgaagtcgagtgaaccgccgacatttcaaaaggaagtcaagctgattgcaaaagccgaggatgaaaagaagctcgtctacggcgttgtctacgagccggacattcaggatgcccacggcgactttatgacggctgaagaaatccaaaaagccgcccacggttttctgaaaaatgcccggaagatcgacaaggatcacaatttccagggaggcgtcggagaagtcgtggagtcctacgtagcgccggctgattttgaagtaaacggcgaaacgattgtgaaaggctcttgggtgctggtgacaaaagccggcgatgagatctgggaacagattaaaaaaggaagcatcaccggctacagcatggcgggcactgccgaaacggtcgagcacgcgccccaagccgactctgaaaccgatgagcccggcagtttctttcagctgtttaagcagttttttgccggcgacaaacaaaaaacgggagaggaagaaaaaaagatgaaacgatcagaagttcaaggaacgattgaagccgtcttggctccgcttctcaaacgtcttgacgatttggaaggggataaagcggcagatgaaaaagagcaacagacagaccaagacgcacatgtgaaggaaatcgtcgaggacatgctcgcccctcttattgcacgcattgaagcactcgaaaagatgagaggcgcctcaaagcaggcagcagccgaaaaagacggggaagaagaagttaaaaaatcgatttggagcggattgctttaa

SEQ ID NO: 1247 - DNA, 936 bp, Bacillus licheniformis
atgagaaatcaagagattattcgtaaagccgagatgtcgcttgcgactttgaaaagcggaggattaatgaatccggcgcaggcttctgcatttattcgcatggtgcaaaacacgccgacaattttcagcgaatcgcgcgtgattcaaatggaaaacgactcgcaaaaatttgaaaagatcggctttggccagcggattttacgagcggctgatgaaggtaaggcattggcgaaagatcaattaaccgcaccggtgaccagcacggtcgaactgaacgcgaaagaagtcattgccgaagtcaacatcacttatgacacgctcgaaaataacattgaaaaagacggccttcaacagacgctgatgcaaatgctggcggagcgggctgccgttgatattgaagaactgatcgtcaatggtgatgtcgcatcctcagatccataccttgcccagctcgacgggatccggaagcagtccgtctcccatatcgtcgatgcgggcggggagcaaatcagccggcagcttttcaaacaggggctgaaagctgttccggcaaaatatatgcgcgttcctcaggaattcagattcttcacatcgctcggccaggagattgaatggaaagaccgcgtcgcagaacgtcaaacgactctcggggatgcggcggtacagggcggactttctaccgcttttggcgtgcctgttaaaggggtctcaaatattcagccgtatgcatacggagaaggagatgcggccgccgaagcatcagacattattttgacgcacccgaaaaatatcattctcggtttctcgcgcaatatcagaattgaagtcgataaagacattcgcgcgcgcaaattcatcattgtcctgacggcaaaactggacagcaaattcgaggaagaagacgcggttgcaaaaatcatcaatgtaaaagagtaa

SEQ ID NO: 1248 - DNA, 375 bp, Bacillus licheniformis
atgctgatcacgcccgacgatatcatccaatattccgttattgaagccgtgaaaaaccggccgcaggaattgctgcgtcaggatatccttgaagctgaagcggaagccgagcagataacggggcaccgttttacagatgaaaaatatgatccgctgccggaaaaggcaaggctcgctttgctgcagctggcacagtactttgcattgaaaaacggtgatgaatcgcttttgaaaggctacaaatctgagaaattgggagactactcctatacgctttcaagaagcggaggcctagtgaagcccgacgtctataaactgctcgaagaatttattcttgattatgaatctgttcgattcaaggtgcgcccgctatga

SEQ ID NO: 1249 - DNA, 357 bp, Bacillus licheniformis
atgagctacaaaaggttattaagcgaccgctgcgatatctatcatttaaaggaagaccaggctgaggaagcaaggtacggcattcctgcgcgagacctgcagccgattcgcacatacggggaaacacctgatcttcaaaacgttccctgctattttacggaaaaaaaccagtcgatcgtccagcaagatcccgaacaggttatttatcattcatatttggcccattttccggcggaggcagatgtgcgccttcacgataaggcggtctggaacggtgtcgcctacacgctgcagcagccgcgcaacatcaaaggccatcacctcgaagtgttagcggtcagggatgaaaaactatga

SEQ ID NO: 1250 - DNA, 489 bp, Bacillus licheniformis
atgaaaatcaaaggattgaaacagctgtcgcagacgctggaaaaagcagggcagagcggctttcgaaatgaagctgccaagtggcttgaacaggcgggaaccgattttttggacctggtctgtgacgaaatcgtgcgcgccggatcgattgataccggcagccttttgcgctctttcaagcggggagccgaagggaacaggtgggaaatcgaaaaaggcggactcacgcttgaagtcgggacggagttagagtacgcctcatttgtaaatgacggccattggacaggcggaaaagacgaagtcaggtgggttccgggacaatggcacggcggccggtttcaatatgatcccggttcatcgtccggcatggccttaaaacggcaatgggtaaagggaacaggctattgggagcatgcgctttacatatttgagcgtttatttgaaaaacgcctgaatgaaaggctgcaaaaatggctgaattccctttaa

SEQ ID NO: 1251 - DNA, 441 bp, Bacillus licheniformis
ttgaacgacgaaacgggatctgtcatgaatttcttttatcaagtctttcctgtcgtctgttatgaaaaggaaatacccgaccactttcaaataccgtcgctgtattttcctcccccttctgtttttgatgagaatgatacggtttcaacatttaaaaaagtcttcaccctgaatgtgaaactgtttcaccacgattcgcagcaggcccatgatcatgccgagcgcattgcagacgccgtaagggaagcgaggcacatcataccgctcattgaccgatcgggtaaaggcacaggggacagcttgaggatcagccggatcgagacgagaataggggattccggcaccgcgtccattattattcaatggaacagccgctactggtacaaacgggaaagcgaactttctctggaaacaattgattttacaaacggggtgaaataa

SEQ ID NO: 1252 - DNA, 225 bp, Bacillus licheniformis
ttggcagtcagcaaaaaaacaaacaccgaagcaaaaaaggcgcctcaagaggaacgtgaagcgctgttctacatcgaagacctgagggagcacgcgaaagagcttttcggcattaagccggaagttctcgatggtgctctttttcatgtgaaagaagagcagatttcaaaacctgaggcaagtcagcttattcaaacatttttagccaaggaggtcatgaattaa

SEQ ID NO: 1253 - DNA, 1347 bp, Bacillus licheniformis
atgaacggcggaacatttacaccaggcaaagaaaaagatcgtgccggcatttattttaattttaaaacgacagcagaggaacgcgtttccatcggggatcgcggtacagttgccctccctgtcgtcatgagctggggggagccgaaaacattcgtatcgatttccagcattgaagacttaaataaaaaagtagggttgaacatcgatgatccgtctcttctgcttttccgggaagcgaagaaaaacgcacagaccgttttgctgtaccgtctgaacacaggagcgccggcgaaagcccaaatcggcgaaacgctgagcgtaacggcaaaatacggaggcgagaaagggaacgacatttcgatccgcatttccgaaaatgtgctcgattctaaaaagtttgatgtcaccacctttgtcggaacagatgaagctgaccgacaaaccgtcaaaacggcagaagagcttaccgcaaatgcgtacgtcgcgtttcaaggggaaggcgcgcttgaactgacagcgggcacaaagctgtcaggcggggagaacggaacggcaagcgttgccgattacaccgcatttttagatgctgccgaaacggaatacttcaatacgatcgcactcccggtcgcagacaatgaacagctgaaagccacttttgccgctttcatcaaacgccttcgcgacaagcagggccagaaagtccaaggcgttgtcgccgattatgccggagactatgaaggcattattaatgtaacgggaggcgtcgtgctggaagacggcactgaaatcactcctgaaaaagcgacggcatgggttgccggagcgagcgcaggcgcgacttttaaccagtcgctgacatttgtcgaatacgaaggtgctgttgatgtcctgaaccgtctggatgaagaccaggtcatcgaacgtctgaaaaaaggcgagtttttatttacatttgatgcacgcgatcaatcggtcagcgttgaaaaagacatcaactctttaacgagtttcactgccgacaagaacaaaaaattctcgaaaaacaaaatcatccgcgttctcgacggagtcaacaatgacctgacccgcgagttaaaggctttaatcaaagcacgaaaagcaagcggcagcgacatccctgcatcagacgatggtttgcaatacgtcaaaacgctgatcattcagtatatgacggcgcttcaggaagccggcggcattaccggctttgattctgaaagcgatattgccattacactgaatgaagaccgcgacgggtttttaatcgatttagccgttcagccggttgatgcagcagaaaaattctactttaatgtggaggtaaaatag

SEQ ID NO: 1254 - DNA, 444 bp, Bacillus licheniformis
atggcattaaaagcgcaaaacacgatttccggaaaagaaggccgtctttttctcgacggacaagagatggctcacatcaaaacatttgaggccaatgtcgaaaagaataaagctgaagtcaatattatgggccgccgcatgaccggccacaagacaacaggggcaaacggcacgggaacggcgacattttataaagtcacgtctcaatttgtcacgttaatgatgaactatgtgaaaaaaggcgatgatccgtatttcacgctccaggccgtccttgacgaccagtcatcaggccgcggaacggagcgggtcacgctgtatgacgtgaattttgactcggccaaaatcgccggtcttgacgtcgactcagaggcgctcgaagaagaagtgccgttcacatttgaagatttcgacgttcctgaaaaactgaaagatacgttttaa

SEQ ID NO: 1255 - DNA, 450 bp, Bacillus licheniformis
atgagcgaaaaacaagaagaaaaagtatatgatttatccttttttatgccgggacaaaccgttgaagccgaagaaatcaaagtgccgatctcaaagcggttcgtcgataaaaagggcaatgtcattccgtttgtgtttaagccgattacaaccgagcgcattgacgagcttgaaaaagaaaatacgacttataaaaacattaaaggcagaggccgtgtcaaggatctagacacccagcgcttttacgccagaatcgccattgaatcgacgatctaccctgacttccgttcaaaggaattaagagaagcctataaaacggccgacccggtcgaagtggccaaacgcgttctctccgtcggtggggaatatgcgaactggctcaacaaagcgattgaaatcaacggctttgaagacgatcttgaagatctggaagaagaagcaaaaaactaa

SEQ ID NO: 1256 - DNA, 3783 bp, Bacillus licheniformis
atggcaaaactgacggcacgttttgaacttgaagaccgggtgtctaagaagctgcggaggattcagaagggttttgcgattttagaaaagagagcagaacgattgaaccggcaaatcaaaattaacattaaaacggaagatcaagctttttttcggcttaaaaaactgaacaattacctgatgagaaagttcattcactccgtaaatattggagtgaatataaatgaccaggcatccgctcaactaatagaaatacaaagaagattaaaaagaattccgccagaaacaaccgttaagttaactttagcagacaatgtctcgcaaaagttaactaaaattaaaaggatgctctctaagcgtgaatatttcttatcaatctctgctgaagaccgtgtaacattaactgttaaaaaaataatcggctatcttaaaaacaatttgaaaaaaggttattcagttcagttatatgtacttgataaagtaacgaaaacagcaagcagaattgcctcgctcctaaaaaaactagagaaaacgtacattgtcacaattgatttaaacgacaaggcgaccaacaaaatcaaaaacaaaaaagtttcaggagaaacatcagaagtcaaacacgataaaaagggatctttctttgaacaaggaaaagacttgttaggcgaatggtggaaaaagtcaggatggccttggataaaggatactgggaaggaaattggcaaagcatttgtagatcgatttaaagatagactgatggaaaaattgaacaatgatatttttgacaaagtcattgataaaatcttagggcctcagtcaacaaaaggttctcagtcaaaatcaagcggaccaggccatggacaatgctgctgctgtttatatccgcagaaagatcctccgaattcagccggaaataggcaaaatgtctctgtttcaggttcaagtgaagagcataaaggctggaatctaaaaagcttatcaaggggaattcttccagccgcaaagatactcttctatttaaaaagtttaaggcccaacaaagagcccggtaaacttgcaaaattattagagcccttaaaaccaatgattgaaaaattaaagccgctaggtaaaaaactaagtccgctaggcaaacttttgccgcttacagatctaatcggcatcaacaaagataacgcaggcgaaaaaattggttctgtaggcggccgtatgttaggaacttttggtggagaagctgccggaatggcgatcggaggattggttggaggacctccgggtgcaatgattggaggagtagtgggcggctttgcaggcgggatgggcggtgaaaaggcaggcggttccctcggtaaaatgtttgacacttcccaattgaaggaagatctcatgaacacgctgtttaatggagactggtggagcgaacagtgggattcccttagtcaaaccgctacaaatacatttttaaatggagactggtggggagaaaaatggggatctcttaaagaaacagccacaaatacgtttttaaacggaaactggtgggctgaacaagccggctatctttatggtactttggaagctgcatttttagggccgttaagtaatgtttggggaaccattgcaggaacgatcagcgagacgatttttaacggagactggtggagcgaaaaatggaacaatgcagtaacatgggcgcagaatacgtgggacggagctgtctctgtttgggaatccattacaggaaccattaaagacaccgtttttaatggagactggtggagcgaaaaatggaacaatgcagtaacatgggcgcagaatacgtgggacggagccgtctctgtttgggaatccattacaggaaccattaaagacaccgtttttaatggagactggtggggtgaacaatgggacaacgcagtgacatgggcgcagaatgcgtgggacggagccgtctctgtttgggaatccattacaggaaccattaaagacactgttttcaatggagactggtggtctaaccaatggaatagcgctttggaaaggggcaagagtattttcgaaggcgcgaaaagctgggtcggagaaaaagttgaatattttcagaaaggtcgggaaagagcccataaggatcatggatttgaaggctatgccacaggcggctacatcacaaaaccgaccatctcctggatcggtgaagccggaaatgaattcgtcatccctacggaaaacaaccggggacgcgggaagatgctgcttgcccaggccgctaccaagctcggcatgcgcgttgttgacgacatgggggccgcggcgggagacgggggagcttcttctccggtttcaagcaccgcttcgtattcggcttctgtgtcgcctgctgtcggtgtcgggagtatagcagcagaggcgcaggctttcggccgggaattcaccggcggttttgacaaggggatcggctcaaacgctccttcccttgatcaatggaagcaaaaaaacatcagcaagccgtttagcagcctgccggcagaatcgtctaactacggaaaacagacggttgccgggttcgcttccgggcaaaatgcttccgcgaccggaaccggcggttttcttcaagcaaaagtaaatgcgccttatcaaacaacggtgaaaacgtcctcttcctggggtgcaaatacagtcaaaaactttgcaaccgggcaaaatgcaacaccgaccgggacgtcgcagtatgttgataaaaatatcaacaagccgttccttgattcgaaacagtcggctgcaggctgggggtcaggaatggtcggacactttatcagcggcatgaatggaaaaggcagcgaagtttctcaagctgcaaaaaacttggcgaaaaaagttgaaaaagcgttccgcgaagaactagatattcattctccgtcccgggttatgatgagtctcgggcgtttcgcgtcggtcgggattgtcaaaggtttaagctctgtcgatgtcaaaagttttgcggaaaaacaagcaggctcactggcagctgcgttttccggaatcggagccgtcggcggaaatgtaaagtcgtggctgatgcaggcgatcatggctaccggttcgccggtgtcgtggcttcagccgctttctgttattgctcaaaaggaatccggcggaaatccgcgcgcctataacggctgggacattaacgccaagcggggggacccgagcagaggcttgatgcagacgatcggccaaacgtttaatgcttacaaaggaaaaggaatgaatgatattttcaatcctgttcacaacgcggtagcggccatcaactacatcaaatcgcgatacgggtcgccatttaacactccggggattaaaagcatggcaagaggcggagcttataaaggctatgccaacggcggcctgattacgagcgagcagatcgcccgcgtgggtgaaggcggcaaacgcgaatggatcattcccgaagaacgcggcatccgcggcagatatctgcttcagcgggctgcaggcgcgctcgggatggaagtgcaagaccccgctgaagggtccggttccatatcaagtgctcaggcggctgcagccaccacgggcgggacccgatcccggcagcctgctgaaaatggcgccaaagaagtcaacatctatattaccggggacaatcattaccacagtgagcgcgaccaggaaacattgattgcgaaaatcaagcgcgctcttgtcgatgagcttgaacgggatattcatattgggacgaaaggaagcgtagcttatgactaa

SEQ ID NO: 1257 - DNA, 657 bp, Bacillus licheniformis
atgactaaatccgtgtacgaattttggctgacgcaaggaaaggaaaagctgcgcctccctgtgcttccagagcagcttgacgtcagcaataatcttgcgaacgaatctgtaaaggtgtcaaagttcggcgaggtgacgtttatcaatgaaccgggagcgaagacgatttcattttcgtctcattttccgaaaaagtattctccgctctcggaatacaaagggtttctttcgccggagaacgcgattcttaaaatcgagaaatggatgaaagcaaaaaaaccggttcaatttctcgtgacgggaacgaagatcaatttcacatgcagcattgaaaacttttcgcatcgcgagggtgaaaaggatatcggcgaccgggattttgatctcacattgaaagagtaccaaacagcatcaccccggaagattaaacaaaaaaagaaaacgaagaaaaaacggccgtccaaactggctccaaaaatgtacaccgtcaaaaaaggcgatacgctctggcacatcgcaggccgtttttacggaaacagccaggaatggcggaaaatttggaatgcgaacaagcaggcgatgatcaaacgaagcaagcgaaacatcaaacagccgggacattggatttttccggggcaaaagctgaaaataccataa

SEQ ID NO: 1258 - DNA, 981 bp, Bacillus licheniformis
atgatcgaattatttgtcataaaagaaagcgaatggtatgaacttgtcaccgaaagcgtcacattggaaggagaaaggtaccaggcgcctcgttcgatcgaagcgtcgattgtgatcaagcagggaagccacaaatattacagcgtgcaggaaggcgataccgttttatttaaatggaaaggaaaagaactgtttcgcggaattgtgttcagcagggtgccgaaagaatatacgcttacgtttaaagcgtacgacatgcttcagtacttggtgaaaaaccaggatgtctatgtattctcgaacaaaacggccgctgacattgtcaaacgaattgcgaacgactttcaaattcccaaaggttcgattgcaaacaccggacatacgattaaatcgctcgtctttaaagacaatacgagcctgtatgacattattttaaaagcgctgcgggagacaaaaaagcaaaccggaaaaaactatcagctgtatgccgaaaaaggaaagctgtgtttacgagcgtggcccgaaccggaggatatctgggttttggaaacgggtgtgaacattacggattacgcttacagcacgtcaatcgatgaaacggcaacccgggtgaaactgagaaagcagaaagataacaaaacctataccgcatccgcaagcgatgaagccggtatgaaaagattcggcgttctccagtacacagaaacggtttcggatgatattaacgaggcgcagctccgcgaccgggcgaagaagatacaggctgaaaagaaaggcgtcaaaaaagagctgaaaagcatacaggcaatcggcataccggaagttcaaagcggactgccggtttatatatcgattccggaagcgggcattaaagaaacctattgggttgataaggataaacacgattttacaggaacaaaacatgtgatgacgattgatgtcgtcgctaaaaacaccatacctgaaggagcgtcttcatga

SEQ ID NO: 1259 - DNA, 309 bp, Bacillus licheniformis
atgaaattaagcgatgcgataaaagagctggctcttggagccgtaaacgctgaatcgcctgtcgatgtcatgccggctgaagtcgtgtccgcgtctccgctcaagctgaagctccgcaatcatgataaattggtgatcccctccgacttattggtggtggccaggcatttgacagagcatacggaacagatccgaattgacggagaagacaaaacgattcgcttttacaatcaattgcatgccggcgaccacgtgatgattgcggctatgcctggagggcagtctttttttgtaatagacagagtgtag

SEQ ID NO: 1260 - DNA, 426 bp, Bacillus licheniformis
atggctctttcgccggaagtatcttttgaagatatcgaggatgacagcgatgtgattgagacttcaaaaacgtacaaaattgattttgaaacaggcaggatgacgggtgatatgatttcggggctggaagccgtggaacaaatggtttgtatggcgctgagaaccgagcgctacgcatacgccgtttacagccataatatcggaaatgaactgcaggaggttctttcagatcatgaaacgaccgacgcttataaagaaatggagataccgagattgatcgaggaagccctcatatacgatgaccgaatttcggcggtgaccgacttcgagattgagcgtcaaggcgatgccttccacgtgtccttttcggttgaaaccgatgaagggacattggaaatcgaggaggtgattggggaagatgtttga

SEQ ID NO: 1261 - DNA, 1044 bp, Bacillus licheniformis
atgtttgaagaccagacatttgaagagatcatggaacgcatgcttgagcgggtttcagatgagattgacaaacgtgaaaacagcgtcatttggaatgcgcttgccccggcagccgccgagctggcgctttcttatatttggcttgatcaagtgctgaatttggtttatgcggatacggctgaaggcgaatatttggacagaagggcggctgaggccggtcttgagcgctatcgggcgtcaaaagccatatggtctgcggcatttacggatggagtatcggttccccccggaacccgtttctttctggaagatttatattttaccatgctcgaagacggcaagctggaatgtgaaacagccgggacaaaaggaaacgccaatttttcggggcggcctttgcttccgctcgataccattcccgggcttgaaaaagcggttatgggaagccttgaaattcccggccgcgacgaggagacggatgaatccctgtatgaaaggtatttaatccgcgtccgtagggaagcggtcagcgcgaatcagctgcattacaaacaatgggccgaagaagtggacggcgtaggcaaagcgaaggtctttccgctgtggaatggcgagggaaccgtaaaggttgtcattacaaacgcgaaaatggagccagccacagacgcattaatcgaaagagtcaagcagtatatcgatcccgatccgggcaaaggggaaggtatggcgccgatcggagcttataccgcggttgaaagcgcggtatggaaagacgtgagcatatctgcaaaaatcatacctgaatcaggccggacgatcggtgaggccaaacaggaaattgcagaaaaaatcactgaattatttaaagaaatggcttttaaagaaagcgtcatccgtctctcgcagatcaacaacatgatctatgaatcgtcctctgtcagcgactattcggaagtcttcatcaacggggaagcgaaaaatctgcagttgacagaaacggaaattccaaagctggggcaggtgaccatcattgagcaagattga

SEQ ID NO: 1262 - DNA, 921 bp, Bacillus licheniformis
ttgagcaagattgatgaaatggcttttcacctgccgccatacttgatggaaatccgggaaattcaagaaattataacggctgaagcgcctgaatttgagaggcaaaatcaagagattttcgatatgacggaccagcttttcgtcacgacggccacatgggggctggacaggtgggaaaagattttgaatgtcagacgcgaggcttcggacggcgtcgatattcgaagggcccgtctgttaaccaagatgtccaatattccgccgattacaagccgctcgatcgagcgcgcggttaatgcttttttaaaacagccgtccgcatccgtcagactgacggccggacggtatcattttttgctgagtgtaaacggagaggatctgcagtttataccttcaatcattcaaaccgtcaatcatatgaagcccgcccatttggcttatacattccggggcgggtttcattatgaatgtcggccgccgaaaagcgttcatgacaggctcgttttaagaagcaaaaacggctttttcggtacgataccggtctatttggacggacagtatctgcttgatgatgcattctacttgaacggttttcgagaaatcgacggactgccccgcaggtttaaacagcagctcacactgcgccacaagaagcggcaatacattcggtccgcctccagctttacgataaagacggccgctgaaaaccggcggaaacagcaaacaaaagctggcatgaaaaccggcattaccaatcaaaacaaaaaggtccaatccttcaaaatcagctgcaaatgcgaacatgaatttaagcaagcaggcgcgcttgaaatgagagagaagtggtggacgctaaacggcgcatttttgctcgacggtacaaagcagctggcagcagcggcgcaaaaaatcgcattgtaa

SEQ ID NO: 1263 - DNA, 387 bp, Bacillus licheniformis
atggcacaacaattaacagtgacaacgctttatgcgagacagcaaatggcaaaagcacgggctgagggcggcaagctcaccaaaatcacaaaaatggctttcggaaacggaggtacaaacgataaaggcgaacccgttcctctgcagggcaacgaacaggccctgaaaaacgaacttctgcaaaaggatatcgacggctttgcctttatggagccggcgaaagtccgttatacatgtacattgggagaaagcgaactcgcaggggaaacgatcaacgagctcgcccttgtcgatgaagccggaaaattcacagcggtcagaacgatgacagacaagcagaaagacggcgacatcgagttcgtctttgaaatcgacgacatttattaa

SEQ ID NO: 1264 - DNA, 1206 bp, Bacillus licheniformis
gtggacatccaaaaaccgagacgctttgaaacaacagaccgcgcccatgccgacttgttcaacgaagcgatagatcagctgaatgtaaacgatgaacggattgcaaagcgggctgaggaagctgaagaaagggctaaaacgtatactgatgcccatgctaacgaccattcgattcacatcaccgacaaagagagggaaaaatggagcgcggggcagttatataaaataaccgaaaataacggaaaagtcttttacagaggcagttcagaaacaacagattttaacactttgacagaaaccggcatgtatctcatctataatgaaggaatcaactcgccaccttcatcaaatcggatatttttgcttgtcatgagtttcggcaataccttggttcaggcagcttatgaatcgtacaaagggacacagtcgtattttagattcagaaaatccgattcaacaacatggacgccatggcagacccaggaaacgaccagtggagcacaggccaaggttgatgctcatgaacaaaatacgaatctccatgtgaatgaagatgaacgggaaaaatggaacaatgcacagttatataaaattactgataataatggaacgcgcacaaaactgccggatggaacggatttattaacgctgccgacaggtttttattatgctatgggccatgttgttcaaaacaaccctgtagaaaacgacagctcctggtttaattacgatgtaattgaaactggcgctggaagaaagaccatccatgcgtggcggagctatgataatactttatggcatggaacagttcacacagatggacagtttcgagaatggaaaagagtagtcacaaacgccgatttaaacgttgcttggcagactccaacgttgacaaatggatggaaacagtatgggtcgcacaaagtccggttttgtaaaaatatgcttggagaagtcgaaattatcggatcaataacgggcgggacgattggctttgatattcctgcgtttacgctgcctgaggggttccgcccgattcaagcgatgtactttataggtgttgcatcaagtataggtactgggtcaataccgcaaatccaccggacactgatcgatactgacggaagggtatgcattcaatccagttcaaatacagtaaatccaaacgagtttattactttcgggtttaagtttagagctgcatag

SEQ ID NO: 1265 - DNA, 960 bp, Bacillus licheniformis
ttggacatccaaaaaccgagatctttcagaacgacggacagagcccatgccgatttgtttaatcaggttatcgaccagctgaatgcaaatgatgagtcgattgcacagtttgccgccgaagctgaacaacgttcaactgcctatacagatgcacacatttcgaacaaaggtaacccgcatggtgtaacaaaatcccaggtcggtctgggggaagtgatcaataaaagacaggccacaaaagatgagtttgacttgcatcataacgatcaaacacggcatgttactgaagatgagagaaataaatggaatggaagtcaaatttttaatattaccggggacaatggacaagcaaaggtatatataagcgccgaagatgactttcaaacgatcctacctcagtataccggactgatacattttacggcagcctcaggagctataaacggaccaggtgcggccgttcgagggatttggacttgcaacgctttaggtaactatggtcaagcgatcgcgtttgacaatgcaaatagaacctatcggaaaacaatagccgggggcaactggactgactggacagaattaatttccgcggagagtctcgaggcaaagttggcgaacttaacttggcactttccaacgcttttaaacgaatgggttaattatgcggacagcactaaagttcgttatacaaaagatgccacaggtacggtatttgttgaaggtgcaatagcaaaagggaaaattggttttaatatacctgcattcgtattgccgaaaggatatcggccgtcccgcgcttttcagtttgtaggtgtagcatctcaattgggcatgtccaatactccgcagtatcataggctgcaagtgagtgttgatggtaatgtcgtgatcgaaaactgctcaaatacagtaaatccaaatgaatatatcagtttaggatttagttttaaggccgcataa

SEQ ID NO: 1266 - DNA, 270 bp, Bacillus licheniformis
atgccggaagcaccagaactggatatattccaaaaagaagttcaggagatgaaagctgatcaaaaatcactcgaacagcgcgtcagtacactcgaaagaacatcagaccgccacgatcagcaaatcatctcgattaacgaaaagctgaacaaaatcgaagagaatacaacctggattaagcgcagcatcacaggcgcgataattacagcggtcagcaccggcatcatcggcggcgcgatcgctgttttttataatttattgcagaaataa

SEQ ID NO: 1267 - DNA, 264 bp, Bacillus licheniformis
atgaaacatatcgacaaaggcacggtcgtcaggacggtgcttctttttattgcgctggtcaatcagacgttgatcatgtttggaaagccggttttgccggtcgctgaagatcagattcatacattggcggatgccctgtattcggccggatctgcggcttttacgatcgctgcatcgctcgttgcctggtataagaacaactatgtgacgagcaaagggaaaatgcaaaaagaagttttacagaaaaaaggtttaacgaaataa

SEQ ID NO: 1268 - DNA, 1065 bp, Bacillus licheniformis
ttggtcaaagtaatcaataactttgtaaaagtcaatcaatacacccgtcccgggctgaagcttgcggcagtcaaaggcatcgtcatgcattggacggcgacgcccggggcttcggcattgaatgagcgaaattatttcaatggcacatgcattgccgacaagcgttatgcgtcggctcattattttgtcgaccgccatgaggcgcagcatattattcccgatcatgaagtcgcatatcatgcgcatgatcaaaaccgctgctatgtcagctttctgaagccgaatgccaataccacggctctcggggtcgaaatgtgcgtggaaaaagacggtaccatccatgaagagacgattcgcaatgcggcagagcttgtagcggatttgtgcaagacatacggtttgtccgcagatcggattgtccgccattacgatgtcactaacaaaggctgtccaaccccgtgggtgagagatgccggccaattgtcagctttccgtaaaagagtagattcccttttggggaggaaaaccgtttccgtatcggctgcctccaccagccagacaagttcatcgtcgggcattatcctcaaaaaaggaatgtcaggctctcatgtgaaaaagctgcaaacacgcttggtcgcggccggtttttcgctgcctaaatacggcgcggacggaagctatggagacgagacggtgcatgcggttgtttctttgcaaaagaaagcgggaattaaagccgacggcatttacggtccgtcaactgaaaaagccctctcggccgctgaagcgtcagcagccggcaagagcaagacgtggacccttcccgacggcatttataaggtgaaaaacccgctgatgaagggaacggccgtcacacaaatccagacagcccttgccgctctttattactaccctgataaaggggccaaaaacaacgggatcgacggatattacggaatgaagacggcaaatgcggtgaaacgttttcagctgatgtacggtttgggagcggacgggatatacggaccgaagacaaaagcgaaaatgttgtcccttttgaaataa

SEQ ID NO: 1269 - DNA, 678 bp, Bacillus licheniformis
atgaaaatgaaacaattaaacccgcgttctgtcagagatcaaatctatcaggtgctgaaggaagaaatcatgaagtttcggcttgttccgggtgagcagatatcggaaaaagagatttcagaacggtatgaagtcagccgcactccggtcagagaggcttttttgcagctgtcgaaggaagggcttctcgaagtctatccgcagaaaggaacccgcgtgtcgctgatcgatcttgacctggtggaggaagcgaggtttatgcgggaaaaactggaaaaggctgtagctgaactggcgtgtgaggacttcccgcaggaagctatgtttaagctggagcagaatgtgaagatgcaggaattatcgatcgcacagaaaaattatgaaagtttgtttgaattagatgaagcgtttcatcagacgatttttgaaggctgcggaaaagcgaatgtctgggctgcgattcagcagatgaacgttcccttccaaagaatccgctttttaaggcttgccgccgattttaactggaacaccatccatcagcagcacgcggcattaacagaagcgattcgaacaaaacagaaggcaaaagccaaggaaatcgccgaagagcatttgcagctggtcatcgtcgataaacagatgctcattgatgagtttcccggttatttcaaaaagtaa

SEQ ID NO: 1270 - DNA, 1017 bp, Bacillus licheniformis
gtgaaagctgcggtgatgacgaagccttattcgattgaatttcacgacataccgcgtcccgaaccggccagcggtgaagtccttgtcaagataaaggctgccgggatttgcggaagtgatgtgcatttttacgacggctcaaatccatatgcacagtaccctcagatctttggacatgagcttgcaggcatcattgaaaaaacgggggccggcgtgagggggcgatccgcaggcgaacgggtcgtaattgaaccggcgatcccgtgcggaggctgctacccttgtcggaaagggaggacaaacgcctgtatgaacatcgatatgatcgggtcggttcgcagaggagggttcgctgattttatcattgttccagaaacgcatgtccatccgattcctgagcaaatggattttgcaaccgctgctttgtgcgagccgttttcaatcggagcgcaggcggttcggcgggcagatattcaaacaggcgaaacgattgtcatattgggaatgggtccgatcgggttaacgattttggcgcaggtaaaaaagcgcttcgacgttcgtgtgatcgctgtcgatcctgtaagggaaaggcttgagcttgccgaggcattcggggcggatgccgttattcagcctggtgaagaggatgcagagcaaatgattctgaagctgacaggcggagaaggagcggggattgtgttcgaagcggccgggattcccgcgacgattgagcaatccgttcgtttggcggccgccgccgggcgcattgtcattgtcggcttaacggggaggaatgtgacgattccgggtcttcttctcacaaagaaagatattgaaatttatggaacaaaacacagcgtcaatcaatttcccggcgtcattcaatttttgaatgaaaaccctgaaatagcccgggcttttgtcactgagatcatgccttttatggaaatagaagaggcgttgaaaaaagcgaaaaactgtccccatcaggtcacaaagatcattttatcttattga

SEQ ID NO: 1271 - DNA, 1098 bp, Bacillus licheniformis
atgaaaatggttttcagatggtatggagaaggaaacgactccgtcacccttgagcagatcaggcagattcccggtgtggagggaatcgtttgggcgcttcatcatcagccgccgggtgaagagtggccattggaagaaattttagaagtgaagcggcagtgtgaacagcacggttttcacattgaagttgttgaaagcgttaacatccatgaggatataaagcttgggctgccgacgagagatctgtatattgaaaaatacaagcgaacgattgaaaatttggccaaagccggcgtaaaagtgatctgctataattttatgcctgtatttgactggctgcggaccgatttgtacaaaaaggctccagacggttccaccgctttgttctatgagcacgcaaaggtgcacacaatcgacccttttgcgcttgtcgatcaaatcgccaagcatcccgaattcacgatgcccggctgggaaccggagcggcttgagcatctgacaaggctgtttgaagcctatcaaaatgtgacggaggaggatctgtggagccatcttcactattttcttgaacgcatcattccaaccgccgcacgctgcggaatcaaaatggcgatccatcccgatgatccgccgtggccggttttcggactcccgcgcatcatgacttcaggagaaagcatcgggcggctgctacagcttgtcgatcatccggcgaatggcgtgacactgtgcagcggttcattgggcgccaaccccgaaaatgatatttccgccatgatccatgcgtatgccgaccggattccatttgcccatatccgaaacgtcaaagtctacgaaaacggcgattttatcgaaacatcgcacagaacaaaagatggcacagttgacatttgcgggattgtcaaagcctatcatgaaacaggtttttcaggctatgtgcgtccggatcacggccgccacatttgggatgaaaagtgcaggcccggctacggtctgtatgacagggcgctcggtatcatgtatttatggggcatatgggattcgctcaatagagaaaaacaggaggcttcaaaatgcttgaaatccatgaaaatttag

SEQ ID NO: 1272 - DNA, 849 bp, Bacillus licheniformis
atgcttgaaatccatgaaaatttagcggggaaaactgcggtcatcacaggcggcagcggggtgctttgcggtgcgatggcgagagagctcggccggcagggtatgaatgttgccattcttaatcgaaccgttgaaaaaggggaactcgtggccgaagctgtccgaaaagccggcggcgcagcgattgcagttgagtgtgatgtcatcagccaacggagcgttgaacaggcgaaacgcgttgtggccgaccgattcggcggctgtgatctattggtgaacggagccggcggcaatcaccccaatggcacgacatcagatgaaacattcaactccgagcacatcttccaggacaacatcaagacgttatttgatctgaactgcgatgatgtcggttctgttctcaatttaaacttcctcggttctttcattccaacacagcaatttgcaaaaatgatgctgaatcaaaaaggggcgtccgtgatcaatatttcttcaatgagcgctcaaaccccgatgacgaaagtgcctgcatacagcgcggcgaaagcgggcatcgacaattttacgaaatggctggccgtctatctggccgaaacgggaatcagggtcaacgccattgccccgggatttttcctaaccaatcaaaatgaaaggcttcttcttgatcaaaacggcgaatttacagatagagcaaagaagatcatctctcacaccccgatgaggcgtttcggcaaaccggaagatttgctggggacgctgctttggctggcggatgagaagatgtccggatttgttaccggcataacagtgccggtagatggcggatttacggcttatgccggtgtctaa

SEQ ID NO: 1273 - DNA, 1014 bp, Bacillus licheniformis
atgaagcagattgtgtgtgaaaagccttatcgttttaaaatgacggatgtgaaaatgccggaactaaaggatggggaagcattggtccgcatcaaacggatcggaatatgcgggacggattttcacgcttattgcggaagacagccatttttctcttatccaagagtgctcggacacgaactgtccggtgaaattgtcagcatcgataattccggcggaacgctcaagccgggcgatcaagtgtcaattattccttatttggaatgcggggcatgcatcgcctgccggaacggacgccccaactgctgcgtcaatctgaacgtcctcggtgtccatacagacgggggaatgcgggaatacataaacgtcccggcagaccacctgctaaaaacagaaggattgacgctcagcgaagctgctgttgttgaatgtttaagcatcggcgcccacgctgcagaaagggcaaatatcaaaaaaggggaaacggtgcttgttgttggagcggggcccatcgggctcagcgtgatgaaattcgcaaaattgaagggtgcaaaagtcatcgcgatggatgtcagaaaagagcgcctcacatttagccgcagatgggctgaagccgatgaagtcgtattagggggagaacatgcggctgatgagatcaaacggttgacgaacggcgactttccgacggctgtctttgatgcgacagggcaccctgcatcgatgaacagcgcttatcagtacgccgcacacgggggacggctgatctatgtcggacttgtcaacgaccatctggctatgcccgatcctgaaatccacatgcgggagctgacgattttatccagccgcaacgcattaagaagagattttgagacggtgatgaaagccatcatggatggcggagcggatgcgaaccggtttgtgaacggacagatggcgtttcacgatgttgttgacggatttcaatcagcgcttgctccggaaaccaatcctgtgaaagtgttgatccatctgtaa

SEQ ID NO: 1274 - DNA, 1272 bp, Bacillus licheniformis
atgttttcaaacggccgcgggtttgtcatcgtgatgctttttttggcgggagtgattaattatttggatcgttcggcattgtctgtcgccgctccttttattcaggaagatttgaacatacgtccggcgcagatgggcatgctgttcagcagttttttcatcggatatgccgtctttaattttatcggcggctgggcatcagacaaatacggagcgaaacatacgctgtcggctgcaatggtcgtatggtcggttttcagcggcgctattgcactgacatataatttcgtttcactgtttatcatccgcgtcattttcggcatgggggaaggtccgctgtcagcggcaacgagcaagtcggtcaacaattggtttccgcaaaaagaaagggcaagagcgctcggcatgacaatgtgcggaacgccgctcggcggagccgtttcaggtccgatcgtcggattgatcgcgatccattgggggtggaaggcttcctttgtgttgatcatgatcatcgggcttgtttggacttgcttctggatgaaattcatgaaagataagccggctgattccggcagtttgtctcctgaaaaggaagcgcgtccgaaaaaggataccggcatcccgctgtctttttatttgaagcagccgaccgtgctgtttacggcgttcgcgttcttttcctacaactatattttgttctttttcttaacatggtttccgagctatttaacgacagcccgggggctgagcattcacgatatgagcgttgcaacgattataccgtgggttgtcggatttctcggtcttgcgcttgggggatttatttcagattatctgttcaagctgacgggcaaacagatgttttccagaaaagccgtgcttgtgtgctgccttttggctgcagcggtatgcattggatttgccgggcttgtcactaccgcgtttggagctgttgcacttgtcgcattatcggttttctttttgtatttgaccggcatcacatactgggcgattatacaggatatcgttcatccggacagggtcgggggcgtgagcggattcatgcattttcttgccaatacatccggcattatcggtccgacggttacagggtacatcgtcgagtacaccggagctttcacaagcgcctttttgcttgcgggagggctggcggtggcaggttctatttgcgtcgctttgtttgtgaaaccgatacgttctgaaaggctgcctcaatctgtaggagaaggcggacaggggcatcctttatga

SEQ ID NO: 1275 - DNA, 174 bp, Bacillus licheniformis
atggagcctgcttttcagcaagaccaggaaagcgtaaaaaagcgcctcgcctttaaaatgtttaaaaggcaatccaaaaccaatatcgcgaaatacgaagtcagcccctataccgaacggattttccggcaaaacgaacggctgatcggcgagtataaaagaaaaaaagcttaa

SEQ ID NO: 1276 - DNA, 747 bp, Bacillus licheniformis
atgctgctattttatcaattccttgtttggcttattgttttggcgctggctctgtacgtagctgccgtgtggcgttttgaaaaacagctcgccgaaaaaacggtcgccatcagaaaaacgtggtaccttctttatgtcatcggcgccgtgatatattggacgcacgatccgcagtcaattttcacaaacccgcttcattacctgatcgttgccgtttttttcacgttgacagacgcttttattttcttaaatgcctactttaaaaagctcggcagctctgaactcgcgacagatacaagaatgcttctcgaagaaaacaacgacctcctccacacgtatcaaaacaggctgaaaacgtttcaatacctattgaaaaacgaaccgatccacatctattatggaaatatagaagcgtatgcagaaggcatcgaaaagctcatcaaacggtttgccgaaaaaatgaatatatccgctgcactttgcgaatataattcagaagaaagcaaggatcatttgcttgagcatatggaaaaccggttcgatgttcaagaaaagcttgaccgcaaagacgtttattatgaagaaaacggaaaaatggtcctcattcctttttccatccacgattttgactatgtcatgaagttaacctcagaagaccttgtcacagaatttgattatctcctgtttacttctttaacaagcatctatgatcttctgctaccaaacgaagaggaaggtgacgactga

SEQ ID NO: 1277 - DNA, 999 bp, Bacillus licheniformis
atggatcttttatttgtattaaccatattgattgtcatctttgctttggcatttgactttatcaacggctttcatgatacggcaaatgcgatcgccacctcggtatcgacaaaagcgttaaaaccaaggcatgccattattatggccgctgtcatgaacttcgccggcgccatgacgttcacaggcgtagccaaaacaattacaagcgacatcgccgaccctttcaagcttgaaaacggatcggtcgtgatccttgccgctcttatcgccggcattacatggaacctagtgacctggtatttcgggattcccagcagctcatcccatgcgatcatcggagcgattgccggagctgtcatcgcatcggaaggatttgccgcgattaaataccacggatttattaaaattattgaagcacttatattatcgcccattttggcgtttgttttaggatatttgatctacagcatcgtcaaagtcatttttaagaacagcaatctggcaaaaacgaataagcggtttcggcgcgttcaaatcgcgacagctgccattcagtcctatacgcacggcacgaacgatgcacagaaagcgatgggtatcattacgatggctttaatcgcgggtaacttgcacagtacaaccgacatcccgttctgggtgcagtttgcatgcgccatggccatgggactcggaacatctgtcggcggctggaaaatcatcaaaaccgtcggcggaaaaatcatgaagatccgtcccgtcaacggtgtctctgcagatttgacgggagccctcatcatctttggcgcgacgatcgtccatttgcctgtcagcacgacacacgtcatttcttcatccattttaggcgtgggcgcttcccaccgggtgaaaggcgtaaactggggcaccgcaaagcggatgctgatcacttgggtcattacccttcccatttcggcaaccatcggtgcatttgcctatttcatacttgatttattcttttaa

SEQ ID NO: 1278 - DNA, 618 bp, Bacillus licheniformis
atgttgaaaagaaaaaaagacaagttttccgtgcttttgacggaaattgcaaaaaatttagatgaaacagctgagtattttgttaactataaagtgacgaatcagacaacccttaaagaattcgcggataccttaaaagagtatgagacaaaaggagataactatgtacatacgatgattaaggagctgaacaaagcatttatcacgccgattgaacgcgaagacatccttcagcttacaaacagcctcgatgatgtactcgacggcatcgagcacttttcagccatgatggaaatattctcgatcacatcttcagatgagcatattgacaaattcagcggctatatcagagaatgcgcaaaagaaattctggtgacgatcgaattgctggcggaaaatcgcctgaaagaaattcagccgcacgccattaaaattaaagaatacgaacataactgcgataacctgcaccgcaaatcgctgaaaaatcttttcggtaaagagacagatccgattaaagtgatccagtacagagaaatctatgagacgcttgaagaaatcgcagattcatgccaaagtgtagcaaacaatttagaaaccatcataatgaaaaatgcgtaa

SEQ ID NO: 1279 - DNA, 1674 bp, Bacillus licheniformis
atgagcgggggagatggtgataaagtcgccgtcgggaaagacggtatggtggctacggcccatccgcttgcatcaaaaatcggagccgaagttttgaaaaagggcgggaatgccattgatgcagctattgcgatccagtacgcactgaatgtaacagagccgatgatgtctggaatcggcggcggcggtttcatgatggtctacgacggcgagacgaaggaaacgtcgatcatcaacagcagggagcgtgctccggagggagccaagcctgacatgtttttggatgaagacggaaaggtgattccgttttcagaaaggtcgagacacggaaatgcggtcggtgtgccgggaacgctgaaagggcttgaagcagcgcataagaagtggggaacaaagaaaatggaagacttgatttcgccttctataaagcttgcagaggaagggttcccaatcgactcggttttggctgacgcgataaaggatcatcaggacaagctgagcaaaacggccgcaaaggatattttccttccggacggtgaacctttgaaagaaggcgatatccttgtacaaaaggatttggccaaaacgtttaaattgatacggaaagaagggtcaaaagccttttatgatggggaaatcggccgggcgattgcagatgtcgtgcaggatttcgggggttcaatgacacctgatgacctgtcccgctacgaggtcacaacagataagcccatctggggcgagtaccacggctatgatattgcaagcatgcctcctccaagctcaggcggagtgttcatgctgcagatgctgaaattgattgatgattttcatttatcgcaatacgatccaaagtcgtttgaaaaatatcatctgctcgcggaaacgatgcatctctcctatgcggacagggctgcatatgcgggcgatccggaatttgtcgatgttccgctcagagggctgctcgatcccgattatattaaggagcggcaaaagctgatcagccttgattcgatgaaccgcgatgtgaaagagggcgatccgtggaaatatgaggaaggcgagccgaattatgagatcgtgcctcagcctgaagataaaacgatcggggagacgacgcattttaccgtcacggatcagtggggcaatgttgtctcttatacgacaacgattgaacagctttttggaacggggattttagtgcccgggtacggactgtttttgaacaatgaactgaccgattttgatgcgattccaggcggcgccaacgaagtgcagccgaataaaaggccgctttcaagcatgacgccgacgatcgtattcaaagatgaaaaaccggtgctgactgtcggttcccctggcggaacgacgatcattgcttccgttttccagacgatcttgaattattttgagtacggcatgagccttcaggatgcgattgaagagccgaggatctatacgaacagcctgacttcgtaccgctatgaatccggaatgccggaggatgtcagacggaagctcaatgacttcggccacaaattcggctcgaatccggttgatatcggcaatgtccaaagcattttcattgaccgggagaacaaaacgtttatgggggttgccgattcaagcagaaacggaacggcggttggggtcaacattaagacatcggctaaatag

SEQ ID NO: 1280 - DNA, 645 bp, Bacillus licheniformis
atgattcacacgttggcaaatggattttaccgcttttgcgagtgggtgatgcggcttgcctatttgaatctgctgtggatcggctttacgctggcgggagcggtcatcttcggtttagcgccggcgaccgccgcgatgttcgctgtgactagacagtggacgctgggaaaaacggatgtcccggtgtttcagacgttttttcgggcgtttaaaaagaaatgggccaaatcaagcgttctcggtttgatattgggtctggtcggcttattgctgtttgttgattttcagattgcggccgtctattttcacgatcagccagtgtttttaagcctgttcatcagtttgtttatcatttatgccatcatcctcttatacgcttttccaattgatgtccactacgatttaaaacggattgcagtgctgaaatacagcttcatcatcggcttttcccgtccgctcacctcgtttttcatgctgatcagcgcgtttggcatgattctgctcgctttatttcatgtcacatttcttctgtttttcagcggcagcgctttaagcttcattttgacgaagctttcgtttcaggcattccgtgcaatcgacgggcgccggacagacaagcaggctgccgccccacgcttgaaatga

SEQ ID NO: 1281 - DNA, 1737 bp, Bacillus licheniformis
gtgaaccggtatcagcatttaaaaattaaagatcaattgtttattttgatttcactgatcatggccgtttcgctcatcctgatcttgagcggcattcaatacgcgttccgggtatatgaccagcagatttacaggaagtcgtcacaggtgctgatgctatcatcaaaaagcattgaagatgaattgaaaaagattgaggatgtgtcatatcaaatcaccactgacgcagacatccaagcgaacctcctgaaagccggccgcggccagaacaaatacggacgctaccggataaaaagcaaaatttgggataagctggccgaatataccggctctaagcggtacattaaatcgattcatttgtttgatgcttccggcaccgagtactccgcaggggcgaatttaaccgaagcattgcgggagcaaaagaatgcactgatcgaaaaagcgtcgcgccaaaaaggcagcaacatgtgggagcccatgccgggtgaaaccggcgagctgttatccgtccgggaaatccgctcctatgagcgtttaaaccttgaccacctgggaacagtggtgattgtcgccgatttaaaacgggtgatcggcgatcttccgaaagactggggggaaggcgcgggcaagattgcgatgtcggacgggcgggagctgtttttttctgaaatgcctttcagccaaaccgatggcctccgattgtcttctcatgctgaaaacggatatgacattgtggaggaaaacggccagcggtttttcgtttcatatgtcaaatcagcgtataagaattggacatattggagcctgatcccctttgacgctatgttttcgaaaatttctgcgatgaagacgatcctgatttccctttttatccttttttttctgattgcggttctctttggaagaaaaatggccaggggcattacgagcccgattgagaagctggtggcggccatgaaaaatgtccaaaacggcgattttaaactggcgccgctcactcgcgctcctttagaccggcaggatgaagtcagcgtcttaaaccgcaatttctttacaatggttgaacggatcaatgaactgattgccgagaactacaagaagcagctgatgctgaaagagacggaattcaaagcgcttcaagcgcaaatcaacccccactttttatacaacacgctcgagtcgatcaactggcttgcaaaaacgaaccggcagccgcaaatttcaaagatgacggaatctctagggtttttgctcagaaatgccatcaatatgaaaaccgacgtgctgacgatcgaggaagaagctgaaatcgtgcgccactattttacgattcagcggtttcgctttgaggagcggctcgtttttgagctcgacattgagccggctgtgaaaaaatgccgcgtacctaagcttgttctccagcctttggctgaaaacgcgattacatattgccttgagcccttcattgaaccttgccatattcaaatcaaagcatataaaaaagaagagcttgtctatttaacggttgccgacaacggccccggcatggatgaagactttttggaaaaggcgagaaaggagcttgtccggacaaccgggagaggaatcgggctgcaaaatatcgacgagcgcattcagctgatgtttggcaaagggtatggcttgacgatttcaagcgaaaagaataagggaaccgtgatgatgattaaaataccatttcaaagcggggtgtga

SEQ ID NO: 1282 - DNA, 1167 bp, Bacillus licheniformis
atgtataaagtgctgttggcggacgatgaacggattattcttgacggcatctccagcatgatcgagtggaattcgttcgggacgtctttgatcggggccgcacagaacgggattgatgcttaccgcctgattatggaaaagcggccggacattgtgatcagcgatattaaaatgcctgggatgggagggctcgaactgatcgaaaaagtgtcccgcgaccacccgtcaatccggtttattttgctgacgggcttcggccagtttgaatatgcaaaaaaagcgatgtcatacggagtcaggcattatttgctcaaaccctgcaatgagagccatattacagattcgcttcaaagcgtgatcggcgagctgaaaaaagaggaatcggcgcaaaaagtgaaaaccgatctggagatgatgaagccgcatcttatgaagcagatgttaaaagagctgatcaccggaggcggcatcgaggatgaagcgtgcctgcgctttttttcagagcaaaaggccatcaggctgatcctgttttccgtccgggacggggaggataaagattatgcacaaggcgttgaatccattgcggatgaggtgctgaacggtgctgtcatcgcctcggcccgggttcagcaattgcttgtctgtgcagtagacggaacattggcttctgctgtgcttgaggaaaaaatgaaaagcgtccaagagctttcacgccgcctgctccgatttgaaccagaagcatcactcagcgaaagcggcaatatcagcgaagcctccgcgatgtacgaaaaggcatatagaaagatcgtccaagatgaaggggagacatcggttttaatcggaaggatgcttgatctcatcgaaaaggaggcctcaaatccgaagctttcgctaaagtgggcagcccgcaacatgctgtatatgaatccggattatctcggcaagctgtttaaacaggaaaccggtgagaagttttcaagctatgtcgcaaaggtgcgcatcgaaaaagcgatcgcgaagatgaagaagtctaaaaacacggccatcggcacgctggcagaggaactggggtttggccacaatccaaaatacttcagccttgtctttaaaaaatacacgggactcaccccgtcagaatttcgaaaaaaagaagacaacacgttttaa

SEQ ID NO: 1283 - DNA, 1296 bp, Bacillus licheniformis
atgagaagatttgtgtttgtctctttgtgcattttgctgacgctcggcctgttcggatgcagttcaaacactgaagaggcggccggtgcggacggcaaaaagaaggttaccttaagggtcgcatggtggggcggacagcctcggcatgattatacatcaaaaatcattgagctgtatgaaaaggaacatccgcatgtcaaaatcgaagcggagtttgcgaattgggacgattattggaaaaagcttgccccgatgtccgcggcagggcagctgcccgatgtgattcaaatggatatggcgtatttatcccaatacggcaagaaaggccagcttgaagatctgactccgtatgtcaaagacgggacgatcaataccgaatcgattgatgaaaagacgatcaaaggcggaaaaatcggtgatcagctatacggcttcccgctcggtgtgaatgtactgtcggtgattaccaatgacgacttgctaaaagaagcgggcgtcgagattgacgatggcagctggacgtggaccgattttgaaaacctggcgctagaggtcgaagagaagacgggacaatacggttcaaacggcatgcatccgcccgatgtctttttcccgtactacctcaggacgaagggcgagcgcttctataaagaggacggcacaggccttgcttattcagacgacaagctgtttgtcgattacttcaagcggcaggtgaagctcgtcgatgaaaaagcttcgccgacgcctgatgaaagcgcgcaggtgaaggggatggaagacgattttatcgtcaaaggccgaaccgctgcaacatggaattattcaaatcagtttgcggcgttcgcgcagcttaccgatgcgcccctgtcattaaagctgcctcctgaacaggcgaaggaaaaggcgctgtttttaaggccgagcatgctgttttcaattccgaaaagctccgaacagaaaaaagaagcggctgcatttatcgacttctttattaacaatgaaaaagccaatgccctgatcaaaggagaaagaggcgtaccggtctcctccaaaatagcggaaacagtgaagtcagaactgagcgaagaggagaaaaagattttcgaatatgtcgaacgggctacggagtacgcgggagaagcggaaccgcctgagccgatcagcagcgccgaagtcatcaagctgctaaaagacacgtcagaccaaattttgtttaaaaagatcacgcctgaagaaggagccgcgaagttcagaaaagaagcggacgccatactgaaaagaaatcaacaatga

SEQ ID NO: 1284 - DNA, 900 bp, Bacillus licheniformis
gtgaagcgaaaaaaaagaattgacaatttggcgggttatgcctttatttccccgtttattatcggatttttgtgctttaccgtcattccgatgggagcctcgctgtttctgtcttttacaagctacgatctgttcaccccgcccaaatgggtcggctttgacaactataaggcgatgctgaccgatgatgaaaaatactggggttcgctgaaagttacgttttattacgtgctcgccggtgtgccgctgcgcctcgcgtttgcgcttttcatcgcggtgattttgaacagagccgaaaagggtgtgggcatttaccggacgctcttttatctcccgtccatcatcggcggcagcgtggcggttgcgattatgtggcgcaatgtatttggcaatgacggtgtcatcaatgggcttttgttcttccttggttttgacaagaagattttttggtatcaggacccgacaagcgcattgtggaccttgattcttttgtctgtgtggcagttcggctcttccatgctgatctttcttgccggattgaaaaatattccgccgatgtatcaggaagcggcaagcgttgatggtgcaaacaggtttcagcggttttttctcattacgctcccgcttctcagcccgatcatcttttttaatttggtgatgcagaccatttcagccttcatgacctttacgccggcctacattatttcaaaaggggaaggcggtccgcttgacgggacgcttctgtattccctctatttgttccagcgggcgttcaactttttccaaatgggctacgcttcggctatggcatgggtgatgctgatcctgatcggccttgtcacattcatattgttcaaaacttcatccttatgggtgcattacgaatcgaaggaggggtag

SEQ ID NO: 1285 - DNA, 894 bp, Bacillus licheniformis
gtggagccggtaaaagatatttcggggcgggccgcgcctgccccgcttcctgcgggaaatagaaagaaaagagccgggcgtctcgtgtttcatatcacgacggccggtcttgcgatcatccttttgtatcccgttatctggctgatcgcaagctcgtttaaagaaagtgcgagcatattcgccacatcccactcgctcattccggaccccttgatcctgtccaattatacggagggctggaaagggatcgccggacagccgttcatcacattcattaaaaattcgcttatcattgtcggcctttcgacggccggcgcggtcttgtcctcggcgttcatcgcttacggattcgcgcggattccgtttaaagggaaggcgttttggtttagctgcatgatggtgacgatgatgctgccgcacgaggtgctgatgattccgcagtacatcatttttgcaaagctggattggctgaattcattcaagccgatcgttgttccccaatttttcgggcacgcgttttttatctttctgatgattcagttcatcaggacgatcccggtagaactcgatgaagcggcaaagattgacggctgcagccgtctcggcatctttttcagaattattttgccattgatcgcaccggcgctcgcgacgtccgccatcttctcgttttactggaagtgggaggaactgatcaatccgcttctttacttgaacaagccggagctttacccggtttctctggcattaaagctgtttttagatacggaaacggcgtctaactggggggcgatgtttgcgatgtcagtcgtctcactcgtcccggtgatcctcgtgtttttcgtttttcaaaaatcgatcgtccaaggaatcagcatgagcggattaaaataa

SEQ ID NO: 1286 - DNA, 1035 bp, Bacillus licheniformis
atgacaaagcttgtttttgatgaagaaaaactcaatcaagtgatcgacagaatcgttaagcggacatttgagatggatttcgaatgggattggccgggcggcgtcgcgttttacggcgtggctgaggcgtatgaagcaaccgaaaatgaagaatacctcgagcttttgaaaaactggacggatgaaaagcttgaagacggattgcctaagctgtcgatcaacggagtatccatcggccataccctcatatcgctctaccaggcgacaggagatgaccgttatctggacgccgcccggcaaatggcggactatgtgctccacgaagcgcctcggttcgcagacggggttttgcagcacaccgtcaactcagagaaacatgtattccctgaacaggcatgggtcgatacgatgatgatggcgggcttgttccttctccgaatcggaaagcttgtcggcagcgaggaatattttgaagacgggctgagccagtatcacggccatgaagaatttttgcaggatatggagaccaatctttattatcacgcatgggaccatgtggccaaaaacaacctgtcaggcatattttggggaaggggaaacggatgggcagctttaacgatggcaaaagcgctccctttaatcgatgttacgcatccgtcttatatgatcattgacggttcgctccgggacttgctgagcgcgcttgtcaggcttcagcatccctcaggtttatggcacaccgtactgacggacccggattcataccttgaagtgtcaggctctgccgggattgcatccggtttgctgtcaagaggctcgctataccacaaatccgttcagaaggcgctctcagccattacggatgcggtcgcgcctgacggaagggtggagcgcgtttctgcgggtacagcagtgatgcgggatgcgcagggttacaaagacgttccgtataaacggattcaaggctggggacaggggcttgccctgacctttttggcagatgtcgtccgctccaagtcgcgcgcgttccaatag

SEQ ID NO: 1287 - DNA, 2283 bp, Bacillus licheniformis
atgaaaaagctgcatcaaagatatgtttcacggcgtaaagggagtttttttaaaaaaagctttgtgatgatcctgctgattgcgtgtattcccggcttattgacgggtgcaggagtctatttgttttcggctgcgaaaattgaaaaagagctccaacatctgcacgagaaccaggtgaaacgccaaatcagccaaatcgatgacaagctggaagggcttgagatcatgctctcccagcttgcatatgatccgcgcctgatgaacggtctggccgatgccgatctgcaaacggattttcaaacgacgtacaagctctcaaaatcgctgtttttgcttcaggatcaaaatccgctcattcacaaggttgaactgttcattcaagggaaggagccgattctcttaaatccagaatacaacggactgaccgaccggaaaatcttgaaggcttatcattcgctgcttgaaggcggtcaaaacgtctattggaaagacatgagcggcgcttcatccggaatggcccttgtccataaaattccgggaggcatcttagaaccgttcggcgcgctgattttgacgcttgacgaaagagaattgggccggttgcttgagagcctttcgccgtattcaaagggaacagcgctcctttttcatcataatcagaagcctgtttcttggagcaatcgcggcaaaaccaactttgaaagcgccttaaaagaaaggcttgagaaacaaaaaaatccacagggctcctttgttatggattggagcggaggtgcgtattccgtttcatacggacgaatggacagattgaaccaggaatggacctatgtttcggcttcaccgatgtcggccattacggctccggtgctgtttttatcgaagctcatcgcgtcggtcagcatcgccgggatcgttcttgccttcattctggcatggtatgcgtcacacaaaatttattcacctgtcgcaaggctgatcaagctctgctccggagagggaaaggcggcctattttccggatgaatttcattggctcgagaagcgctgggaagacctatctgaggaaagcggcagactgaaaaaggaactgccccatgctgcaaacgttttttttcagcgccttctgagcggatactttgcagatgaatcagagaggaatttgagagatcgtctgaaaaggtggggctgggaagcaaaagacaatgtgtttaccatcatcgatgtccagctgacgggactctacgaaggaaacggatcttttacaaaaaaggatgaaagtctggcgggctttctgttgggaaacattacgcgcgaactggctggaaggacattcaaccatatttatatgacagatgtccgttcgctatcgcttgcggtgctgctggcgagcggccggaatacagccttcaaggaagaaatcgcccaatttgtgcgtgagctgacagatgtgatctacagcatatccaaactgcacgtcacagtgacggtatcaaaaaccgctgacaagttaaaagacattcccggcatttatgaagaggtgaaagaaggcaggcattacagacagttcgaaaacgccagccaggtgatcgatttaagccggcgggaagacatgcctcccgctgaatcatactatccgttcgctcttgaaaaagaggtagtcagggcgttgcggcttgaagaaagggatgaagtcgaaagaaggatcaggctgtttatccgggagctgtccgaaaaaggaaaaacggaaatccgcatccagccgggcatgatgcagctgttcgcaaagatccaagaagagatctttcattccggccttcacccctatgaattgttcagccgaaaaaacctgcttcaggagctttcggagctgagggagccggaaagggctgtcggctggatgatggagcgttgcataagcccttatcttaaagagatggaaggaaggaaaaacagacagcaaaaacggcttgtcgaacaggtgcttgagatgattcatcaggattatatgaacgatatctcgcttgaaagctgcgctgatcgggccgggacgaattcgtataccctgagcaaagctttcaaacaagtaaccggcatcaattttatcgactatgttacccggctcagaatcgaaaaagcgaaagagctgcttcttgagacgaataaaaaaatccatgacgtttctgaagaggtcggctacagacacagctatttcaaccggattttcaagaagcaggtcggcattccgccgagccgctacaggcagattcatcaggaatcttcgtga

SEQ ID NO: 1288 - DNA, 717 bp, Bacillus licheniformis
atgaaacgaacagacaaaaaaccgaaagtgacagtatatttggccggggactcgaccgtcgcagactgtcccccgcatgaagcgccgatggccggctgggggcagatgcttccgctgtttttctcagatgaggctgcggtcgtgaatatggcaaaaggcggggccagttcgaacagcttcattgatgaaggccggctcgatgacattacggagcggcttgcgcctggtgattatgtgttgatccagttcggccacaacgatcaaaaaccgtacggaacagacccttatacaacctatcaggagcatcttgtccgctatgtggaagcggttcgcgaaaaacaagcgacaccggttttgatcacttccgcagagcgcagacgttttgatcaaaacggaaagcccgccgacacactcggggattttccgaaagcgatgaaggcgctcgctgacagcttcgacgttccgctgatcgatttatggtccaaaacaaaagcgctctatgaatctctcggaatcgaaggttcaaaacggctgtttgtccactttcagcctcatgagcaccctcattatccaaatggaatcgaagacaatacccatttttccgaagcaggggcccgtcaagtcgccaggctggtgacagaaggaatcagagagcttggtctgcctctatcggcttatctgctttgtgaaaggagcgatttccgtgccggagtgtaa

SEQ ID NO: 1289 - DNA, 693 bp, Bacillus licheniformis
gtgccggagtgtaatggaagagaaggaagcctgatttatcaaaaccctttatcttctcctgaagatctccgcggctgggtgatggaagggaaaggaatcgttcgttttcagaacggccgcctgcatatggagaacgaacttgacgctgagcaatatggggacgatgctcattttgtttactggtgccctgagacattccctgatggaattgttgtgaagtgggatttctaccctgtgcgggagcctggcttatgcatgatattttttgcagccgccggcatgaatggcgaagatttatttgacgggcggctggcggagaggacggggaaatatccgcaatatcattccggggacatcaacacattgcacctgtcgtatttcagacataagcatgctgatgaaagagcattccgaacatgcaacctcaggaaaagccgcggctttcacctcgtctgtgaaggagctgatccgcttccgcccgctgcagacgctttgcctccctaccggatgaagctcataaaggacggggcatacgttcgtttttcaatcaacgagctgcccattttggaatggacggatgacggcaggcgtttcggccctgtttacggcgcaggaaagatcggcttcagacaaatggctccgctggaagcagcctacgccaactttgaagtgcgcaggctgctgcgcggctga

SEQ ID NO: 1290 - DNA, 612 bp, Bacillus licheniformis
atgcgggataaaggcgtaatggcgatgatgtacggcgcgtgtgaagcgatcatgaaaatcgcctggctgaacgggatctgggttttattcacgctgggaggaggcattgttttcggctgggcgccgagcacggctgcgatgttcacggtcgtgcgcaagtggctgctcggccggacggacgcaccgctgttcaaaacgttttatcaaacgtataaaaaagagtttttcaaagcaaacggacttgggctcatcctcattaccgccggaacaattttattcgtaaactatcaatttttccgcgtccgtgcggatttattttcgatcatgatcagctatgccacactggtggccgggctcatctatctcgtggttttcatttatatttttccgctttacgttcatgttcagctgccgtttgtccgctatttttcacaggctgcgctgatcggtctcgttcgccctttgacgacggccggaatggctgctgctggttgcttggtcgtgtatgtgctgttgacggttccgggtctgatcccattttatggtgtcagtttgtttgctcttgtatcgatgtttatcgcacatcgctgttttttgcgtctggaaggctag

SEQ ID NO: 1291 - DNA, 1869 bp, Bacillus licheniformis
atgaaaaaaggaaagaaaaggtggaagaacctgttggccgcgtcatctcttttattaatcacgctagtgaccggcttctcggagcaagctgaggcagacgggcggacggctgcgcaggcaaggcaaatggaatcgcttaacagggggcttgtcgctgttaaaacggggaacggtgtctttgtcagctggcggcttctgggaaccgagccgtcttctgtttcatttaatgtgtatcgaaacggaaagaagctgaacggttctccgattacatcgagcacaaactatcaggatgcaggcggggatttgaacgccgtttaccaggtgcgcgccgttttgaacggcagggagcaggctccttctgaatccgtcggcgtattgaataaacaatataaatctgttccgctgcaaaaaccggccggaggaaaaacgcctgatggggtgtcatacacatacagcgccaatgatgcgagcgtaggcgaccttgatggagacggccaatatgaaatcattctcaagtgggatccttccaattcaaaggataattcacaggacggatacacgggagatgtgctgattgacgcatacaagcttgacggcaccatgatgtggagaatcaaccttggcaaaaatattcgcgccggcgcccattatacgcagtttctcgtctatgactttgacggcgatggaaaagcggaaatcgccatgaagacggcagacgggacgaaggacggcaaagggaaggtgatcggcaatgcaaacgccgattaccgcaatgcccaaggccgaattttgtcagggcctgagtatttgacggtttttaaaggcgatacaggcgctgagcttacaacggtcaactacgaacctgcccggggaaatgtagccgattggggagacagctacggcaacagggttgaccgctttctggccggtgtcgcataccttgacggggagcggccgagttttgtcatggcacgcggttattacacgagaacagtgctagtcgcttacaacttcagaggcggaaagctgaccaagctgtggacgttcgattcggatgctcccggaaatggcgcctatgccggtcaaggcaaccacagtttgagcgtcgccgacgttgacggagatggaaaggacgagatcatatacggagcgatggctgtcgatcatgacggaaaaggcctctactcaaccggctggggacatggggatgccatgcatacagggaacctggacccgtcaaggcctggactggaagtcttccaagtccatgaaaacagcaattctccttatggcttgtccttccgcgatgcgaaaacaggaaagatcatctggggagttcacgcaggtaaagatgtcggacgcggaatggccgctgatatcgatccgcgctacgaaggagcggaagtatgggcgaacggcagtctttatacggcaaaaggcgtaaaaatcggaaacacattgccttcatcaacgaacttcggcatctggtgggacggcgatctccaaagagagcttctggacagcaacagaattgataaatgggattatcaaaattcgcgaaccgtcaacttgctgacagcgtccggagcttcggcaaataacggaacaaaagcgacgccgtccctgcaggcggacattctcggagactggcgcgaagaagtggtctggcgagcggaggacagcagcgaactgcgcatctacacgacgacagacgtgacggagcaccgcatgtatacgctgatgcatgatgcagtctatcgcctcggtatcgcctggcagaatgtcggctacaaccagcctccgcacaccggcttttatttaggcgaaggcatgcagacaccggagaagccgaacatttatacacgctga

SEQ ID NO: 1292 - DNA, 309 bp, Bacillus licheniformis
gtgaacgagtcctccgtgtatcaaaatggtgctggctacggattttctcaggcaggaagcgctgtgtgcaaaaagacgcaaaaaaaagaagcgctcaaaaaagactattgtatcgtgaaccggacggcttttctggcagatctctcccccggcaaataccgcgtgaccgtttttgcatcatccagcggtgaattgaagctttatgccgaaggagaaaaaatggggacgatcccggccggagcaaagggaagctcagccgaaaaagcgttcaccgtttcggtggaagacgggcgcctcgatctggagtga

SEQ ID NO: 1293 - DNA, 1119 bp, Bacillus licheniformis
gtgtatcagttcgatttcggtgacgggcctcttgcttcgggttttattccggtaggcgctgcttcggcctatacccctctaaaaggctacggatttgacgacgcggcaaaggtgtcctgcacggaccgaggtacggccgacccgcttcgttcagacttctgcattccggatgggacggcgtttactgtcgatttgcctgacggtcaatatcaagtccaaatcataaccggagatgcgcgggcaaagacgaacatggacgtacgggcaaacggcatgctccagctgtattcgtttggagcggaagcgggcggatacaacgaaaaaacgtttccgattcatatttccggcggccgtctttcgatccaagccttaacggcgagaacaatgccgcgccttaatgcgttggtcattacgaagacggcttatcatgtgacggatgacaacacgacggtctttctggcgggcgattccacggtctccgattatgagcccggctatgcgccgatggcaggctgggggcaatttttaggcggctatttctcggatgaaatcgtcatcgacaaccaggcgaaacgcgcgagaagcgcgaaaagttttgtggatgaacggtcgctggctacgattttgaaccggatgaaacggggcgactatttgttgattcagttcggcattaatgacgcagggcaagatcctgcccgccatacagatccgtatacgacatttcaggaatacttgagaacatatattaacaaagcccgcgaaaaaggaggacgtcatgtgctcgtcacttctcaaagcaaacgtacctatgatgaaaagggcgttttctacaacagcatcggagaatatccgaacgcaatgagacagctgggacgggaaatgaacgttccggtgatcgatttaaacaaaaaaagcattgaatattacaacgagatcggcgttgaagcgactaaaaacgtatttatgtttctggaaccgggagaaagcccgaattatccggaaggcatccaggacagggtgcattttcacgagttcggcgccaaccaattggcaaggctcgtcacaggagaaatctccgatttgaatatatatccgctgaaacactcgctcaagaaataa

SEQ ID NO: 1294 - DNA, 1887 bp, Bacillus licheniformis
atgggagaaaaggacagacatgcagcagctgatcgcgttcgtccggtgaaaacggcggcaaaaccgaagcaaatggaacacttaaaccgcggccttgtggcggtaaaaacaaaaaagggggtttttctcagctggcggctcttaggaaccgatccggaagaaaccgcttttaatctataccgcaacggacaaagaatcaattcaacacccatttcatcatcgaccaactttcttgataaacacggaaatggaaaatcgctttattatgtgtccaaggttctcggagataaggaagtcgagacgtcgcccaaaacagctgtctggcagaagccttacttggaagttccgttaaacaagcctgacggcgggacaactcctgacggcgcaccgtatacgtacagtgcaaatgacgcgagcatcggagatctcgacggcgatggagaatacgaaattgtgctcaaatgggacccgtcaaattcgaaagataacgcgcacaacggctataccggagaagtcatcatcgatgcctataagcttgacgggacattcatgtggagggttcatctcgggaagaacatccgcgcgggcgcccattatacccaattgatggtctatgatcttgacggcgacgggaaagcggaaattgctatgaagacggctgacggaacagttgacggaaccggccgggtgatcggcgatcaggctgccgattacagaaatgaaggtgggcgaattctggccggccctgaatatttgtcgatttttcacggggaaacgggaagggaattggcaaccgtggattacgatccgccgcgcggaaggcttgaggactggggagatggatacggcaaccgcatggatcggtttttggcaggcatcgcctatttggacggcgaaaggccgagccttgtcatggcccgcggctattacacaagaacggtgctagtcgcttacaacttccgagacggcaagctgaccaagctgtggacgtttgacagcgacaagcccggaaatgaaggctatgccgggcagggaaaccatagtctgagcgtcgctgatgtcgacggtgacgggaaagatgagatcatctacggcgcgatggccgttgatcatgacggaacagggctttatacgacagggcttggacacggtgatgccatgcacgtgagcgatcttgacccggaccggccggggctggaagtctttcaggtgcatgaagatccgcgccttccgtacggcctctcatttcgcgatgcgggtacaggggaaattctctggggagtgccggccgatacagatgttgggcggggaatagccgcgcatatcgatccccgctataaaggagcgcttgtctgggcgatcgatccaccgggcaatgaaggaaaatcgtacggcctctatacgagtaagggagaaaagctcagcgatgccgctccggcttcggccaattttgcgatttggtgggacggcgatcttctccgcgagctgcttgaccacgattggaaagaacccgcaggcatccccaaaattgataaatgggactatcacagcggcaggctggtcaatctgctcaccgctgacggaacgctgtctaacaattggacgaaagggacgccagtgcttcaggccaatttgttcggcgattggcgcgaagatgtcgtgttccgcacagtccgaagcgatgctctgcgaatttacacaacgaccgagccgactgaacaccgtttctatacgttcatgcacgatcccgtctaccgcctgggggtagcctggcaaaatgtcgcttacaatcagccgcctcatcccgggttttatgtgggaaccggaatggacaagccgccccggccgaatatttataccgttccttgtaagagaaatgaagaatga

SEQ ID NO: 1295 - DNA, 993 bp, Bacillus licheniformis
atggggtatcaggcgagtgatgtacgctatgaaaatatgaaatacaacctctgcgggcattcaggattaaaactgcctgctttgtctttagggctttggcacaatttcggagaagcggcttccttgcaaaatgccaaagcgctgttaagaaaagcatttgacctgggtatcacccactttgacttggcgaataattacggtccgccgcccggttctgccgaagaaacattcggaaaagcgctgaaaaccgattttgccggctaccgcgatgaaatggtcatcagcacgaaagccggctatacgatgtggcccggaccatacggcgattggggatcaaaaaagtatctcgtggcgagccttgatcaaagtttaaaacgaatgggcatcgattatgtcgatatattttattcacaccgccctgacccccatacaccgctggaagagacgatgggagcgctcgcccacatcgtcaggcaaggaaaagctttatatgtcggtttgtcgaactacagtgctgaacagaccgaaaaggcggctgatattttgcaagaatacgggattccgctcctcatccatcagcccaaatattcaatgttccacagagaaccggaaaaaggcctgctgcaagtgctgcagaaaaaaggagccggggcgatcgcgtttacacctcttgcccaagggcttttaacaacgaaatatttgacagggattcccgccgggtcaagagccgctgatgcgaacagtccgtttttgcaggccgagggcatcacagaagacgtgctcggcaaggtccgcaagctgaatcaagtggctgccgaacgcggccagtctcttccgcaaatggcgatagcctggctattaaaagacccgcgcgtcacctcggtgctgatcggcgcgagcaaaaccgaacagatcgaagaaaatgccgcggcgcttaagtccgctcgattctcagctgaagaactcgacacaattgataaaattctttcataa

SEQ ID NO: 1296 - DNA, 645 bp, Bacillus licheniformis
atgacaatcagcatctatttggccggcgattcgaccgtgcagcattataaggctgattcgcctcagggaggctggggcgaatttctccagtcttatttatccggaaatgtacaggtgatcaaccgggcaatcgggggccggagttcaaaaacgttcgttgaagaaggaagacttgcatctattttggatgtgatcaaacaggatgattggctgttcgttcagatggggcacaatgatgcgtcgaaagacaaaccagaacgctatacagagccgtatacgacgtataaacaatacttgaaaatgtacgttgacggcgcgcgtcaaaaaggggcatcgccgcttctcatcacacctgtcgcaaggctccattacaaagacggcgtctttttaaacgatttcccggactactgcattgcgatgaagcaggtcgcaagcgaagaaaacgtccgcttgatcgatttaatggacaaaagccttcagcattttgcggaaaaaggatacagcgaagtatttaaatattttatgatctcggaaaatgtcaacgactatacacattttacgaaaaaaggggcccgggaaatggcgaagctcgtctcggagggcattcgagagcttgggctgccgtttgtcaaagagacggtatga

SEQ ID NO: 1297 - DNA, 1992 bp, Bacillus licheniformis
atgaacggaaagctgtaccatggcgcttgcttttatcccgaattgtgggatgaggatgtgctggatgaagatatcaggatgatggagcgaatcgggatcaatgttgtcagaatcggggagtttgcctggtcaaggatggagcctgaaaaaggaaggatcgatgtcggattttttgcagacgtcatccgaaagctccgcgacaacaaaattgaaacggtcatgtgcacgccgactgcgacgccgccgatctggctgacccacgggcacccggaaagaatgcatgtgaatgaaaaaggggagacgatgggacacggttcgaggcagcatgcctgcacaaaccatccctatttcagagagcgggcccggctgatcatcaaacatatcgccaaagagatcggagaactgccgggattgatcggatggcagcttgacaatgaattcaaatgccatgtcgcagaatgcatatgtgaaacgtgccgcacattatggcacaaatggctggaagaccgctatcagacgattgaccgtctgaatgaggcatggggtacgggcgtatggagcgaaacgtatcagtgcttcgagcaagtcccgcagcccggaccgaccccgtttttgcataattcttctttaaggacaatgtatcagctgttttcgatggacaagatttctgaatttgcgcgtgaacaggctgaggtgatcagagcatactccgatgccccgatcacccataatagcagcgtcatgttcggcgttgatcatgaagaccttttcaagagccttgattttgcctcgtttgatacgtacgccagccaggaaaacagtcaagcctttttgtttaattgtgatttatggagaaacatcaaaaaaggacggccgttttggattatggagacgagcccttcctacagcgcttcgcttgaaagctatgcggcgcctcatcaaaacggctatttgaaagctgaagcggtttcttcttatgctcttggcggagccgcgttctgctattggctgtggcgccagcagagagccgggtctgaacagccgcacggatcagtgctcagcgcatggggggagcctgatgtgggatatgaaaatgtgctcgaagccgagcgggcaagacgagaggttgaacacatcatgctggctacggctcctttgcaggctgaaacagctgtcgtctattcggaccgtgcgaaggtgtttttgaaaacggagcctcatcggggtcttcattacagaacgctgatcaccgagttttatgaccgattattaaagatgggcattcacagggatgtcattcttgaagggagcccgctggacggctacaaactgctgtttacgccgtttattcattatcttccccctgcttttatcaaaaaagccgaagcatttgcacaaagcggcggcatttggattgcgggtccgctgacgggcggaagaacagagcaccatacgattcacactgattgcggattggggcctttagaaaaatgttctggtgttaaaacgctgtttacattcccgatggatgagcggaactcaagcggaacggcgtttggcgtaaaggcgccgctgagcttgtggagcgctgtttttgaagccggcggcaccaaggctgtcgggatgattgagaaaggcccggcgtcaggcaaagcgttcatcacggaacacaaatgcggaaaaggcaaaatcgtcatgctcgggtcgatgccggcaggcgaagcgggggacatcatgatgaaaaagctgatcagccattatgccgaagaagcgggcgttgagcagaaaaccgatgtcactcccggaacagtcgtcgcgccccggaaaggagcagacggtcttgtctgggtcgtgatcaatatggacggcaaaggaggcgcagtgacacttgacggcaacggaaccgatcttttatccggcaggcccgtaaccggacgcgtaacactcggcccgcacgactaccgcgtgattttgttatcagagaataaatga

SEQ ID NO: 1298 - DNA, 2592 bp, Bacillus licheniformis
gtgaaagcacaggctgaactaaaatggctgaatagagcgcctgcttcgttcggcggggtgacttggggagtgccttgggcaaaaggagtgctgcaaaaaggggagacggccgtcatcgcttcggaaaacgccccgtatttgcaaacatggccgcttgcatattggcctgacggctcgattaaatggacgggccatgccgcagtattcccagaagaaagcggacgccgatttacattgcaaaaaggaaagcccggcgcgccgaaaaccgtcgtccgtgtcagcgagcagaaagacgaaatcacggtgaatacgggcgcgatagtctgcaagctcggaaagtcggggccggcactgatccgttcgatttccatttccggggaaatgatggcgaaagaaggacggctcatcgctttaaaagaaaaaagaagcggttcagatacacaaagcatgtattatattgaacggtttgagagcttggtcaaacgtgcggcaatcgaacaaaacggtccggtcaagacagtcatcaagattgaaggcgtccaccgcggcggaggcatcgatgtttggctcccttttaccgtcaggctttctttctatgccggtgtcccgtccatccggatcgtgcacacgatcttcatcgactgtaacgcagaaacggaatggatcaaaggactcggtttagagatgagcgcggttttgagcggagcgccaagaaacaggcatattcgctatgcagccgacggaggaatttacggagaggcttctcagctgcttgtgacgagaagatttaatgaaacaaacgggttctatgaacgacagatagccggacagcctgtcccggaagagtcggaagtcgtgcgtgatgcagagaaaaacgccgtctggaacgatttcaagctcattcaggattcccctgttcactggcgcttaaaaaagcgaaccggcaaagactgcgcctgggtggacgcgattcatggggggagagcgaaagggctgatgtatgcaggcggggaaaatggcggcatcgcgctcggcctcagaaacttctttgaaaaatatccatcatcgcttgaagcgcaaggtcttgccggcggcgaaacaaaattgacggcatggttctggccccctgaagctgaagcgatggacttccgccattattcaaaaggcactcacgttgaaagcgcatatgaagggtttgccgaaatgaggtcgacggctgtcggcattgccaatacgagcgaagtcaacctcgcctgtttttcaaatccgccgagtaatgaagagctgaacagagcggcggacgaatggcaaaatcccccattgcttatttgtgagcctgactattattatgacacccgcgctttgggtgtttggagcctgaaagataaacggcgcccgctctcagctgcgcttgaagatcagctggacgaggctctcaagttttacatgaacgaagtcgaacagcggggctggtacggctattggcattacggtgatgtgatgcatacgtacgatgccgtccggcatgtatggcggtatgacctgggcggctatgcatggcaaaacacggaactcgtaccgaacctctggctttggcagtctttttttagatccgggagggaagacatcttcagaatggcagaagcgatgactcgtcacactagcgaaatcgactgctaccatttcggggattataaaggcctcggttcaaggcacaatgtcctccattggggctgcggctgcaaggaagcgagaatcagcatggccggcctccacaagccttattattttttgacggcggatgagagaacgggggaagtgttaaccgaggtgaaagatgccgatcgagcgcttgagatgcttgatccgatgagagcctattatccggaaaaagagttccctgcccacgcgagagttggccccgactgggcggcgttctgttccaattggctgacggaatgggagcggaccggtgatgaagcgtaccttgataaaatcaaccggggaatcggccggctcaaagcgctgcctcttcgtctgctgtccgggccgactttcggatacgatcctaaagcttcagatctgcttcatatgggtgacgggaatcatggcggctatcatatggtcatcgcctttggcgccccgcaaacatggatggagcttgcagaactgctggaggataacgaatggaaggagatgctcggcgaattcggcgaattttatttgctggctgatgaagaaaagcgcaagaggagcggcgggaagcttcacgatgatttatttcactggccgatgttctccgctgccatggccgcttatgctgcgaggcttcaccaagaccggaagcttgccgaaaaagcatggcggctgttgctggacgaaaaacaaagccatacaccgctgccgatcgctccaaaacaagtccatgcgtggaacacgatcacggaaatcccttgggtcacgacaaactgcgtctcacaatggtgcctcaacacaatagccgtgctggagctgctcaaggatatgccgcctgatcaggacatgcaagaaaagatcatcaaagcaatgaaagatcatcccgctcgcgtgtga

SEQ ID NO: 1299 - DNA, 1524 bp, Bacillus licheniformis
atggcaagactgaagctgaagggaaacaagtggctcgctgcacccgctgtctttttgctccttatcgggtgcagtgcaaatgagacgtcgaatcaagacgggaaaggaaaagagaaggatgccattcatattatggctccgctcctctcgccggaaagtccgggagaaaacagtccgtctttaaaagcgctcgaaaaatacacgaaaaaacaaattaaagtgacatgggttccgaactcttcctataatgataaattcaacatcgtcatggcctcgggggatttgccgcaagccattgtcgtcacggacaagtcgccgggttttatcaagtctgtcaaatcaggcgcgttctgggagctttcaccttatttaaaagactacccgaaccttggaaaggccgatgagaaagtgatgaagaacagttccattaacggcgagatttacggcatttacagggcgagggacctcatccgcgcttcgattatcatcagaacggactggctcgaaaatgtcggcctggagatgccgaaaacaatcgacgaattttacgacgtactgaaagcgtttaaagaaaaagaccccgacggaaacggaaaggacgatacgtacggcatggtagtcccgaaatggatggggctaggcaacgggagcccatgggatattatgcagacatggttcggtgctccaaaccgctacggagtagacgaaaaaggggaactcattccggacttcacaacagaagaatatatggaagcgctgcgttttttcaaaaagctgtatgatgaggggctgatcaataaagacttcgccgtaatggattcagcgaagtggaacgatccggtcgtcaaagggaaagctggtgtgatcgtcgataccggttcgcgggcatcgcagatacaaagcgcaatggaggaagccgatcccggaaacaaggatgtgatcgatgtcatcggaacggtcaaaggcccgaaaggaacgtatacattcccgacatcaggatacgccggaatgattgccatcccgaaagcgagcgtcaaaacggaaaaagaactaaaagaagtgctcggcttcttggacaaaatgaacgatgaagaggcacagatcattgccaataacggcgtaaaagggcgcaactataagcttgaaaacggtgcgtacacgtcccttgaaaaaaacaacaaaaaactgctttacgagcacgagggtcttgcgcagttcagcatgggcattccggaacaaagatactatgtggaaaagcaagaatcaaagctgtttaaacaccgtgaacagattcgcaaagaaggggagaaaatcgccgtattcaacccggcagaatcgctcgtttcagatgtatacacccaaaaaggggcacagcttgacaacatcatcctcgatgccaaaacacagtttatcatcggcgacatcgatgaaaaaggctttcaagacgccgttgagctttggtataaaagcgggggcgaagatttgatgaaagaactgaacaaacgctacaaggagactaaatag

SEQ ID NO: 1300 - DNA, 954 bp, Bacillus licheniformis
atggaaatcaccgcaaaaacagggaagcccgctgttaagacagaaaagaaaccgactgggctagaggccgtaaaacgggataaatggctttatcttctgcttgttcccggtgttttatattttctcatatttaaatattggccgatgtggggcgtattaatcgccttcaaggattattcgccttatctcggattttggcagagcgaatgggtcggattcgagtattttaaagatttctttatgaatcctgacttcttccgtctgctccgaaacacgcttatgctggccgctctcgatttgatctttgcatttccggccccgctcattgtcgctcttttactgaatgaactgcggcacgccatctataaacggtgcattcagacgtttatatatgttccgcatttcgtctcatggacgatcgtcgtcagcataacgtttgtctttttcacggttgatacgggcgtgatgaataaagtgctgcaaagcataacgggccgagagattgcgtttctctcagatcccgaatggttcaggccgatgattgtgctgcaaagcatatggaaggagacgggctggggaacgatcctgtttctggcggcgctcgcttcggttgaccaagagcagtatgaagcggcagtgatggacggtgcaggaaggttgaggagaatgtggcacattacccttccggccatcagaagcacgatcgtcgtgcttctcatcttaagaatcggcagctttttgaacatcggcttcgaacagatttttttaatgaccaattccttaaaccggagcgtagctgaaatcttcgacacatatgtctatgttgtcggaatcacgcagggcgcatacagctacagtacggcagtcggtcttttcaaatcggttgtcgggatcatcctgatattctgcgccaactatatcgcgaaaaagtttgaccaggacggtctgttttaa

SEQ ID NO: 1301 - DNA, 885 bp, Bacillus licheniformis
atgtccggtgcggaaacgatccataacacaaaagcgggccgggtgttcgattggtttaatgtgatctttctcggctgctgcggactgataaccgtcttgccttttctgtatattatcgcggggtcatttgcgacggaggccgagctggcggaaaggagcttctttatctttcccgagacgttctcgcttgacgcgtaccgctatattttttcaacgccgacatttatcaggagcatgggggtgtctgtgcttataacggtcgtgggaacgatcgtccagctcttttttacatttacgatggcctatcctcttgcaaaacggcacatcaagggaaggaatctgcttttgaatctcgtcatttttgcgatgcttttcagcggaggaatgattccgacgtatatcgtcgtcaaatcactgggactgctcgattcctattgggcgctgattttgccgatggcgatcaacccgttcaatctcattattattaaaaacttttttcagcagcttccgaaagagcttgaggagtcggccaagattgacggctgttcagaaatcggcgtgttcttaaggatcgcactgccgctgtctaagccgattattgcgacttttgcgctgttttatgcggtcggcatttggaacgactttttccatgctttgctgtacatcaatgacagtgcgaaatggccgctgcaaatggtgctgcgccaagtgacgattctttcggatctgacggggacgacgaatgatatgatggaaacggtgccgcctgaacaatcgatcaaactggccgtcatcgtcattgcgacgcttccgattttagccgtgtacccgtttttgcagaagcattttgccaaaggcattctgatcgggtctgtgaagggataa

SEQ ID NO: 1302 - DNA, 1329 bp, Bacillus licheniformis
atgaatgcagaagcaaacggactaaaaaaagagataggcttgttatttgcgctatctcttgtgattggaacgatcatcggttccggcgtgtttatgaagcccggcagcgtgctttcctattccggaaacgcacaaatcgctcttttcgcctggcttctcggcggaatcttgacgcttgccggcgggctgaccatcgctgaactgggcgcacagattccgaaaacaggcggtctttacacatatcttgaagaaatttacggcgagttctggggcttcttatgcggctgggtgcagatcatcatctacggaccggccatcatcggcgcacttggattatatttcggctcgcttgtggccaacttgttttcctgggataaatcctggactgcactcatcggcatcatcaccgtcgcctttttatgcatcgtcaacatcgtcggaacaaaatacggcggagcggttcagacgatcacaacgatcggaaagctgattcccattgtatgtatcattgtgttcggtctatggcagggcgatgaatatattttcagttcggtcacggagagcatcgccagccaaaacttcggggcggcggtattggcgacgctattcgcgtatgacggctggatccttcttgcagcactcggcggagaaatgaagaatccggaaaaagtgcttccgaaagcgatgacaggcggcatactgatcgtcactgcctgctatctgttcattaacttggcgctgcttcacattcttcctgccgatcagattgtcaagctcggcgaaaatgcgacaagcacagccgcgaccatgctgttcgggccgctcggcggcaagctgatatccatcggaattatcgtcagcatcttcggctgcttaaacggaaaggttctgtcttttccgcgcgtgatctttgcgatggctgagaaaaaacagctgcctttctcccgctggatctcgcatgttcatccggcattccatacgccttggatcgcagtcatcgtccagatgattatcgctgtcattttaatgatcatcagcaatcctgaaaagctgtcagaggtttcgatttttatgatttacatcttctatgtcatggcgtttttcgcggtatttattttgcggagacggaagaacggccaaggaagatcttacagcgtgccgctctatccttacctgcctgtagcggcgattctcgggtcattgtttgtccttgtcagcacgctcatcacagacttctacagctgcctgtggtcgatcttgatcggtctcgtcggtctcccggtttatttttggatgaaaaaaagaaataaaaacggctcagctgcctga

SEQ ID NO: 1303 - DNA, 954 bp, Bacillus licheniformis
atgaacgtaaatggcattcaccacgtatctgctttaacagcaaacgcccagcataacctggatttctatgtcaaagggcttggcatgaaactgataaagaaatcggtcaatcaggacgatccgaccatgtaccacttgttttacggggatgaagtcgcgtctccgggttcggatttgacatttttcgagattccgatgcttgcccggagacgggaagggacgaactgtatttcggccgtatcacttcgggttcccggtgaacaagcactcgaattttgggagaagcggcttcatgagctcggcacagagatttgcggcatcgagacgcgtgcggggcggagcattctccgctttttagatcatgaaggacagaacatgatgtttgtagctgatgaaaagggaaaagaccatggagtgcctgtgaaaaacggcgtcattcctgaggatgctgcaatcagggggctcggcccggtcgaactgactgtcagggacgccggtccgacggcggcggtgctgaccgatattctcggctttcataaaatcggtgaggaacaggctgacgaatccggccaaacgcttcacatatttgaatcgggtgaaggaggagcaggcacggaggtgcatgtgaaacagtcagatgacggcagaagagagcgtcccggaagaggaagcgtccatcatgtcgctttccgcgtcaaagatgaagaagaacttaagcagtggcatgagataatcagtgagaacggcttttcgaattcagggattgtggaacgctattattttaaggcgctgtatttcagagaaccgaacggcatactttttgaactgtcgactgacggtcctggctttgccgttgatgaatcaattgatgagctcggccaaagccttgcccttccgccgtatctcgagcatcggcggaaagagattgaagcgcggctgaaaccgatccgataa

SEQ ID NO: 1304 - DNA, 363 bp, Bacillus licheniformis
atgaatactgtcagccaagaaatccaagatttgtccattaaatctttggaatcaacttttaataaactaacaaatgcttataaaagcacgacagaaaaaggttcaaacacaactcttgtcaaaaagagactaaacgcagtgaaaattggtttagaaagcctaaaaggtacttggtatggagaagatttcggctataacgaagaaatcatattgactactaaaaaagttttaaaaggtatcattccatctattgaaaaacaaatagcaaaagcaaaagaaggcagtcctcaaaaaacattaaatgagcgtcgcctgactgcactaaaactggcaatcgaatctttggagaaccgtcttatataa

SEQ ID NO: 1305 - DNA, 1302 bp, Bacillus licheniformis
atgatggaatataatagagaagatcagcttgaaacaaaaaacgaactcatcgtctccgatcaaaagcccgaccaggcgataaaaaaagcagaacagcaaaagcggagactctcgtggatgacgccgattctcagcggcatcatcggaggaagcctcgttctcggcgtcacgacataccagcatagcaaagacgaaacggccaatacatccgtccagacgcaaacaaacgagacgtcgaactcatcggcttcttccactaaagcgaataccgaaaaattgtccagcaccaattcgtccgacatttctacaatggttgaaaatgtatctcccgccatcgtcggtatttcaaactatcaaaaacaaacagagagcggtatgttcggttttgaaagcaacagcagcagctcaagcgaacaagaaacaggcacaggctcaggtgtcatctataaaaaagcaaacggcaaagcatacattattacaaataaccacgttgtcgaaggcgcgtctaaactgacggtttccctgtccaacggcaaagaagtggaaggtaaattgctgggcagcgattcgttgacagaccttgccgttgttgaaatttccgctgatcacgtggaaaaagtcgcctctttcggcgattcgtcaagcttgaaagcaggcgaatcggtgatcgctattggaaacccgctcggcaaagatctgtcccgcacggtgacacaaggcatcatcagcggtgttgatcggaccgtttccgtagatacatccgcaggccaaaccgagatgaacgtcattcaaaccgacgcggccatcaaccccggcaacagcggaggcgcccttttgaatacaaagggtgaagtgatcggcatcaacagcatgaaaatcagtgaaagcggagtagaaggcatcggatttgcgattccaagcaatgatgtcaaaccgattgcagaagagctgatgtctaaaggaaaaattgagcgcccgttcatcggaatcggcatgatggatcttgagcaggtgccggaaaactatcaaacaggcaccctcggattaagcggcagccagttaaacaaaggcgtctacatccgccaggtcgcttcaggctccccagctgaaaaagcgggccttaaagagaacgatgtcatcgtcagctttaacggaaaagaaaccgatacaggaagcgcgctgcgcaaccttctttacaacgatgcaaaaatcggggatacggtaaaggttaccctcattcgaaacggcaaaaccatgacaaaacaaatcacccttgaccagaaagaatccgcatcatcttaa

SEQ ID NO: 1306 - DNA, 813 bp, Bacillus licheniformis
ttgaacaagattggatttatcggatacggaagcatggcacagatgattgcggtgaaactgctagatcaggggaaaatcagggatgacatggtggtcgtcagctcaaggaatgacgggaaaacagaggagctgaaaaagctttatccgaatgtcgcctgtcaatcagctgatgagctcgccaaacagtgcggcctgatcttcatctgtgtaccgccgatggcggtaaaagaaacgcttgaaaaaatacagccgtttcttcaggaggatgtccacatcgtttcgattgccgcgggggtcgagcttgaccggcttcacgactggacaagcggacaggtgacgagatacattccgacactcacatctgaagccgggatcggcgtttcgcttgttgtccacggcgagcgggtcgctgaggcggacaaaagccggctggaagaatatctttccgccttcagcacagtcaaacagatcaatgagagagatattgacgctgcgagcaatttaacaagctcttcaccggggttcatcgcttcgatttttgaagaatttgctcaagccgccgtcagaaacagcagcctcacgaaagaagaagcgtttcaatttctgattcattcattgctgggaacaggcaagctgttaatggaaaaagacatgacgtttgctcaaacgcttgatcgggtggcgacaaaaggcggcataaccgcagaaggtgcggaagtcattcaagatgccatgccggaagtctttgacgagctgtttgccagaacgatgaagaaatatgaagtcatcaaagacgctgtccgccggcagtga

SEQ ID NO: 1307 - DNA, 825 bp, Bacillus licheniformis
gtgaagctgtatatgtctgttgatatggaggggatttccgggcttccggatgatacgttcgtcgattcaagcaagccgaactatgagagaggccggaagatcatgacggacgaggccaatcatgtgattgacgaagcgttcaaaaatggatgcagagaggtgattgttaatgacagccactctaaaatgaacaacctgttaattgagaggctccatcctgaagcgcggcttatttcgggagatgtcaagccgttttcgatggttcaggggcttgatgatacatacgacggagccgtgttcgtcggctaccatgcgagagcgtcgatgagaggcgtgatgtcgcacagcatgattttcggcgtcagacatttttacatcaacgatcaggcggtcggcgagctggggttcaacgcctatgttgccggttattacggcgtcccggtcatcatggctgccggtgacagcgaggcggcagctgaggcggaggagctgattccgaacgtaacgacagcagccgtcaaagaaacggtctcccgttcggcggtcaaatgtctgacgccggagaaagcggggcggctattaagagaacggatggcatatgcgattcaaaaccgcggtcaagtcaagccgctcacacctccggacaggccggtgctgcggatagaatttgccaattacggccaagccgagtgggccagtctgatgccgggtgctgaaatcgaaccgcaaacgacgactgtccgctatcaagcgaaagacattcttgaagcctatcaagcgatgcttgtcatgaccgagcttgcgatgagaacgacattctcctag

SEQ ID NO: 1308 - DNA, 927 bp, Bacillus licheniformis
atggcgggttacatcatgaagcggctgctgtggatgctggcaaccattttggtgatcacgacattgacctttgtgatgatgaaagtgattccgggctctcccttcaatgaagaaagaaatacgaacgaagcggttcagcgcaaccttgaggcttactatcagctggatgagcctctctttgttcaatatttgtactatgtaaagtcgatcgttacctttgatttcgggccgtcgatcaagcagccttcgcaaagcgtgaacgacttgctgtcaagaggatttcccgtttcgtttgagctggggatgacggcgcttattgtggcggtcatttccggaatcgcactcggaatctttgctgcgctgcggcaaaacggcatcatcgactatatagcgatgaccattgccgtactcggcatttcggttcccaactttattatggcaaccttgctgatacagcaatttgccgttaattggaacatattccctccgtcgacatggacgagcccgcttcatatggtgcttccgactgcggctttggcgatggggccgctggcgattatcgcaaggctgacccgatccagcatgatcgaagtgctgacgcaggattatatccgaacagcccgggctaaagggctttccccttttaaaattgtcatgaagcacgccctgaaaaacgcccttatgcctgttgtaacgattctcgggacgcttaccgctgcgattttaacggggagcttcgtcatcgaaaaaatctttgcgattccgggcatgggaaaatattttgttgaaagcatcaactcccgcgattaccccgtgattatgggcaccaccgttttttacagcatcatcctcatcatcatgttgtttctcgttgacatggcctacggaatactggatccgcgtattaaactgcataagaaagggtga

SEQ ID NO: 1309 - DNA, 960 bp, Bacillus licheniformis
atgagccttccagtccgcacagaaaaagaagcgtcttcaggcagtgatatccctgttgaatggtttgccccgctgaaacagaagcaggatgagcgtgaatccgtcgcaaggccgagtctgtcatattggcagaacgcctggcggattttaaggaaaaacaagctggcgatggcgggattgggcgtgttaatcttcctgttcttcatggctgctctcggaccggttctttctccgcacagcgtcacccagcagacgctatccgagcaaaacctgcctccgtcgacggagcattggttcggaactgatgagctcggacgcgatgtgtttacaagaacgtggtacggagcgaggatttctctgtttgtcggtgttatggcggctttgatcgattttgcaatcggcgtcatctacggcggcatcgccggctataaaggcggcaaaacagaccacgccatgatgcgggtcatcgaagtgctgcacggactgccttatttattggtcgtcattcttctcatggtcatgatggggcctggactcgggacgatcctcgtcgcgctgactgtcaccggctgggtcggcatggcgcggatcgtcagggggcaggttttgaaggtgaagcatgatgagcatgttctcgcatccaaaaccttcggagcgaaaacggtaaggatcatcaggcggaatctgcttcctaacatgatgggagcgatcatcgtccagatgaccttgacggtgccgtcggccatttttgccgaggcatttctcagtttcctcggtttgggcattcaagccccgtttgcgagctggggtgtcatggcgaacgacggccttccggtgatcttgtcgggacactggtggcggctgttttttcccgctttctttatttcattaactatgttcgcctttaatgttgttggagacggactgcaggatgcgttagatccgaagctgaggaggtaa

SEQ ID NO: 1310 - DNA, 999 bp, Bacillus licheniformis
ttgcggaaaaaagtattggaagtcgagaatttgcatgtttcatttacgacatacggcggaacggtcaaagccgtccgcggcgtgagctttgagttatatgagggggagacgtttgcgattgtcggcgagtcgggatgcggaaaaagcgtgacatcgcaaagcatcatgcggcttttgccgaagttttcggcaacggtcacagacggtgcgatccgctttaagggaaaagacttgcgccacctgtccgaaaaagagatgagaaagatcagaggagccgaaatctcaatgatcttccaggatccgatgacggccctgaatccgaccttgaccgtcggagaccagctggcagaagcgctgttggaacatcggcccgtgtctaaaacagacgctcgaaaagcagtcatttcgatgcttgagctcgtcgggatcccgaatccgaaagagcgtttgaggcagtatccgcaccaattcagcggagggatgaggcagcggatcgtaatcgccatggcgctcatctgcgaaccggagattttgattgcggatgaaccgacgaccgcgcttgatgtcaccattcaggcgcaaattcttgagctttttaaagacattcagcggaaaaccggggtatccatcattttaatcacccatgatttgggcgtagtcgcacagacggcagacagaatcgccgtgatgtacgcagggaaaatagctgaaacgggagcgaggagggatattttttaccgtccgcagcacccgtatacaaaaggcttgctgcactccgttccgaggcttgaccttgaagatgcagacctcgttccgattgacggaacaccgccggatttgttttctccgcctgaaggatgtccgtttacggcgcgctgttcccgcgcaatggaagtgtgcggcaaaatccatcctgccgttacagaagtctcggcgggtcatcgagtgtgctgctggcttcaggatgaaagggcaaaaagggctctgctgacaacataa

SEQ ID NO: 1311 - DNA, 1626 bp, Bacillus licheniformis
atgaaaaggctgacgagcgtgttggcttccgcatttgcggtcatcctgctgttcggatgtacggcaaatgaacaggcggggcaggaaacgaagaagaaagcgaaagaaacggctggagaacaggttctgaggctgaacaacgaaaatgaaccgacatcttttgatccgccgatcggctttaataatgtctcatggcaggcgctgaacaatctgatggaaggtttgacaagacttggcgcagaccatgagcccgaagcggcgtccgccgaaaagtggaacatttccgacgacgggaagacatatacttttacaatccgtgatgatgccaaatggtcaaacggagaccctttaaccgccggggattttgaatatgcgtggaagcgtctgctcgatccgaaaacgggctcctctgccgcgtttttaggctactttatcgaaggcggtgaggcctttaacagcggaaaaggttcaaaagatgatgtcaaagtcaaagcggtggatgaaaagacgcttaaggtgacgcttgaaagtccgcagcagtcgtttttaagcattgtagccaatccggcctttttcccggttcctcagaaaatcgccgaagacaatccgaaatggcatgaagaagcagccacattcgtcggcaacggtccgtttaagctggcagaatggaagcacgatgaaagctttacgatggtaaagagcgatacgtattgggaccgggatactgtgaagcttgataaagtgacatgggcgatggtcgatgaccgaaataccgactaccaaatgttcgagtcgaatgaacttgatacggcttatgtcccggctgaaatgagcgagaagctgatgggctctgatgaggtgaaggtgtttgatcaggcgggtctttatttttacaggttcaatgtcaataaagagccgttccagaatgaaaaaatcagaaaagcgtttgcgatggccgtcgatcagcaggaaatcgtcgattacgtcacgaaaaacggtgaaaaaccggcacgcggatttgtgtctccgggaatcaaagggccgaacggcaaggattttcgcgaggaaggcggcgatttgctcaaatataacgccgatgaagcgaaacagctgctcgaaaaaggcatgaaggaggaaaactacgaaaagctgcccgccgttaccttgacatacagcacaaaaccggagcataaaaaaatggcggaagcggttcagcaaaaactgaaaagtacgctcggcgtcgatgtgaagctcgccaatatggaatggaacacattccttgaagaacagaaggcgctcaagttccagttttcccaaagctcttttctggctgattatgcggatcctatcaacttcctggaaagctttcaaacgggtaacgcaatgaacagaaccggctggggcaattcagagtatgacgagctgatcaaggcggcgaaaaatgaagctgatgaagaaaagcgcactgagctgctgcatcaggctgaagaactgctgtttgaagggatgccgatcataccgatccacttctataatcaagtccatttggaaaaggagaatgtgaaaggcatcgtccgtcatcctgtcggctacattgaactgaaatgggccgaaaaaacgtcatga

SEQ ID NO: 1312 - DNA, 924 bp, Bacillus licheniformis
ttgaatattgcgcctcaaagattaatgaagggagatacggttggtgtgattgcgccggccagtccgcccgttcctgaaaagcttgaccgggccgtccggtttttaaaagagcttggacttgaagtcaaagtgggacgctcagccgccgaaagacacggctatttggcggggagcgatgaagagcgtctgggggatctgcacgacatgtttgaagaccgttcggttaaggctgtcatctgtgcctgcggaggttacggaacggcacggattgccgggaaaattgactaccggctcatcaaaagccgcccgaaaattttttggggctattcagatatcacttttttacatacagcgatcaggcaaaataccggacttattacatttcacggaccgatgctcagttctgacatcggcaaagatgacgtgcatccgcttacccgccgctcctttcagcagctgtttcaaaaaatgacgctctcttatacagaggaactgtcgcctttggaaacgctcgtacacggcgcggcggaaggggagctcgtcggcggaaacctcgctcttctggtgacgacgctaggtacgccttatgaaattgatacgaaaggaaagcttttgtttatcgaggatgtcgatgaagagccttatcgaatcgaccggatgctgaatcaattaaaaatggccgggaaattatcggacgccgccggcatcctgctgtgcgattttcataactgcatcccgaaaaaacgcgataagtcgctcacattaaaagaggttttccaagattatatcgcctctgaaggaaaaccggcgctgtccggctttaaaatcggccattgttcaccgaatatcgccgtaccggtaggagtgaaagccgtccttgacgccggcaaaaaacggctcaccatcgaaccgggaatttcttaa

SEQ ID NO: 1313 - DNA, 1098 bp, Bacillus licheniformis
atgaagattgccgagattacgacaaaccgcatcgccgttccgctgaaaaaaccttttaaaacagcgcttcgaaccgtccgcaccgcagaagccgtcattgtcaaagtaacggctgaaaacgggatgacaggctggggagaagcgcctccgactgctgttattaccggtgagacgcttgacagtattgagggggcagtcaacacgattctcgcacccgccctcaccgggtgcaacttgcgaatggctgaggcgatatttcatgatatcgacaagctgattgttggaaatacaagcgcaaaggccgctgtagaaacagccgtctacgattgcttggcgcagctttgcggtcttcccctgtatcaattgctgggcggatacagacgggagatcgagacggattttaccgtcagcgtcaatgacccggaagaaatggggaaagacgcggcccgctatgtacaggaagggtttcgcacgctcaaaattaaggttggaaaaaacgacatggcaacagacctcgaacggatcagggaaatccgcaaacaagcgggtcccgctgtccgaatccgcgtggacgccaatcaaggctggacggcgaaacaggcggtcaaagccattcggaaaatggaggatgaggggctttcgatcgagcttgtcgaacagccggtccaccggctcgatctcgaaggcttgaaacaggtgacagatgccgtcgatacgccgattatggcggacgaaagcgtgtttaccccaagggatgcttttcacgtgctgaaaacgagaagcgccgatctcatcaatattaaactgatgaaggcaggcggcatccgccaggcgctgaaaatcaacgccatggcagaagcgtgcggagtggaatgcatggccggaagcatgatcgagacaaggctcggcatcacagcggccgtccacttcgcagcaagccagaaaaatgtgacaaaattcgattttgatgcgccgctcatgctgaaggaggatatcgttgaaggcggcatccgctatcatgcaggaacgatcacgataccggatgctcccggactcggaatcacgaaagtctgccatgaggggggagaggacaaatga

SEQ ID NO: 1314 - DNA, 888 bp, Bacillus licheniformis
atgagcctttatacgacagccgtctcagtcgccaatgtctggaccagtccggaagcgccgcgcacaattgaccggatgatgctgtcaaaccctgtacatgtgagaagctggcttgacgaattgtcctacgaggagcgccttgagctatgtacggcaaaccttgttcaaacgcaagtgcttttcggcgaagatgtccaacttataaaggagcggggagactgggcgttcgtcatcattccgggacagccgtctgcaaaagacaaacgcggctacccgggctggattccaaaggactgcctggtcgaaaaaagcccggcgaagtctgagacaagcgccgttattcaaaaaccgacggctttcttatatgatgacaagaaaacgaaagttattgagctgagctttctcaccaagctgcccgtcttgtcttccggcggcgtctggtttgaggtcgatacaccgcttggccgcaaatggctgaaaaaagaagatgcggatctcgaaacacctgtaaaaggcagcggagacgatatcgttcaaaccggtcaggcgtttttgaacctgccctatctttggggagggatgagcgggtttggctacgactgctcaggatttgtcttcaatatgctgaaggcgaacggccgctccgcgccgcgcgatgccggcgaccaggcgaaaggcggaaaagaggtatccttcagcagcccgaagcggggcgatttactgtttttcgcatatgaagaaggcagaggacgggttcaccacgtcggcatttactgcggaaacggagagatgcttcactctccaaaaacgggcaaatcgatcgaggtcatatctcttaaaggtacaatttatgaaaaagagctgtgtgccatcaggcgctatttttaa

SEQ ID NO: 1315 - DNA, 1014 bp, Bacillus licheniformis
atgcaaaccggcgctttattgaaagtcagccgtctgaaaatgcactttgacgccggaaggggcaaaacggtcaaagcggtcgacggcatttcatttgatattaaagaaggagagacgttcgggctcgtcggagaatcgggctgcggcaagtcgacatccggaagagtgctgatgcgtctttatcagccgacagaaggcgaggttacatatcgggggaaaaacatccaccatttgagcgatgatgaatcattccagtacaaccgcaaaattcaaatgatttttcaagacccgtatgcttcattaaatccgaggttaaccgtcagggagattatgacagaacctatggaaatccacggcctctacggagggaaaaaggcgcgtcttgaaaaggcggacgagcttctggaagcagtcggtctgcacaaaagctttgccaatcgctatcctcatgaattcagcggcggacagaggcaaagaatcggcatcgccagagcgcttgcgcttgaacctgaattcatcgtcgccgatgagccgatatcggcacttgacgtctccgtgcaagcgcaggtcgtcaaccttttaaaaaagctgcaaaaggaaaaagggctcacgtttttatttatcgcccacgatctttccatggtgaagcacatcagcgaccggatcggcgtcatgtatctcgggcacatggtcgagatcaccgacagcggccggctttatcaagaacctctgcatccttacacccaggcgcttttatcagctatcccgattcccgatccggatgtggaagacaagcggagacgaatcatactgaaaggcgagctgccaagtccgatcgatccgccgagcggctgcgttttcagaacgaggtgtcctgccgcgatggacatttgcgccgccaaaaagccgatgttaaaagaagccgacgacggtcattttgtcgcctgccatctgtatgacggagacgcaaggaaagaggaggccggcttgaaggtgacgctgcaggcgaggtga

SEQ ID NO: 1316 - DNA, 888 bp, Bacillus licheniformis
atggactcagcattatcgaaaaaaaaccgcggggcgggctgtacaagcgaatacgacgtcttaaaaaaagtggtgttatgcagaccggagtatatggagattgcagaagtgatcaatgaaacacagaagtattttcaaaaggataatatcgataaaacgctggccgtccgccagcataatacattgataaaagaattggagagccggggtattgaagtcgtgattctgcctgctttaagccaatttccggaacaggttttcacgcgcgatatcgggtttacgatcggaggcactgtgttttccgcgcagctttcagccgacatccgccagggcgaagaaaatgtcctgcaggaatggctggcaaaagaacaaatctcctggaccgcatttaatgaaggctatcaaatcgaaggcggcgacatcctcgtcgaccaaaataccatatatgccggcatcagccacagaacgacgttctcggccgtccaagagctgaagcgcaggcttccctcttatgaagtcataccggttccgtttgaagaaacgttccttcatctggattgcgtcttcaacattctttcgccgacagaagcgcttgtctatccaaaagccttaggagaaagagaatacgacgtcttgaaaaagcgctatgagatgatcgaaattacggatgatgaacagttccaactcggtacaaacgttctgtccatcggcaataaaaccgtgatcagcctgcctgttaaccgccacgtgaatcaggagctcagaaaaaggggctatacggtcatcgaaatcgacttatccgagatcataaaatcaggcggatcattcagatgctgtactctgccgattgagcgtacttccactgaatgttacaaaggcggcgcctga

SEQ ID NO: 1317 - DNA, 519 bp, Bacillus licheniformis
atgaatggacctgaaaagagatactgcaaagaatcaaaagttgtcaaaacaagcagggtatttccgcttgatacgaacaatcacaacaccttgttcggcggcaagctgatgagctatatcgacgatatcgcttcgatttcggcagcgagacactcgaggtgtgaaaccgtgacagcttcaatggattccgtcgattttctcgaaccgatccgccaggaggattcagtctgccttgaatcttatgtgacatgggtcggcagaacgtcaatggaggtattcgtcaaagtcattaaagagcatttgctgacaggcgaacgaaagcttgcggcgacatcctttttaacctttgtggcgcttgatcaggacggcaatcctcaggccgttccccaagttgtaccgcagtctgaagaagaaatcatgctgcacgagaccgcccggcagcgcgccgaagaacggaaaaaccatcgcaaacacagcaaagcgctggcccaggcgctggctgttgacaaaccttggtaa

SEQ ID NO: 1318 - DNA, 744 bp, Bacillus licheniformis
ttgggtgaaatgcttgaatttgtatggacttttttagccaagcctgctttagtgttctctatagcttatattcttttccgaatcgcagggaagaaagccgtttcgcaaatgacgaacttcgaccttttgctgacatttgcgattggaacgatcatcagcgaaccgattcttacttctaaaatttcaatgtccatttattacgcgcttacctttctgatcttctatttgttgattgaaaagctgtcattacacaataaatggcgatggtttcttgtcgtcagtccgaccgtgctgatccgaaacggcaatattgataaaggaggattaaaaagagagcggctgactgtcaatgaactgctcggcaaattgcgcgaaaaaggctatgccgacccaaaagatatcgacctcgccctgattgaagaatcgggccagatcagcgtgattcccaaatcggaagcaaggcctgtacagccgcgggacctcaacttggagacgaagcggaatttcgtgccgattccgctcattttagacggcgaaattatcgaacacaatttaaaatacttgaaaaaaacgaaagaatggctgtttcaaaaattagaggataaagggattgagcaagcgatgctgccaaccattacgctcggcaccttgaacgaaaaaaatgaaattataattgatacggaagatcccggcagcccgttaacccatgacccgtatctctataaaccggggcaagaccattaa

SEQ ID NO: 1319 - DNA, 1308 bp, Bacillus licheniformis
atgaaaaggttttttagtgtaataattttaggcgccctgctgctgctcgggacatctgcgccaatcgaagcggcagactacggacgcgacgtcctcggctcaaaagacggctggggcgcttatggaaaaggaacgaccggaggcgctgacgcttcttctgatcaggtatatacggtcaaaaaccgcaagcagcttgttgaggcattagggggagacaataaaaagaacagcgaaaatgatacgccgaagatcatctatgtgaagggaacaatcaatcttagtgttgatgatgacaacaatcctttaggctatgaagattataaagaccccgaatattcgatcgaagcgtatctcaaagcttatgatccgaagaaatgggggaaaaaggagccgacaggaaagcttgaagaggcaaggctccgctcgaaagataatcaaaaggaacgggtcttgatcagagtcggttcgaacacaacgattatcgggctcggagatgatgcgaaaatcgtcggcggaggcctttatgtcaaaaacgcggaaaacgtcattatccgcaatatcgaattcgaaaacgcgtacgatttcttccctggctgggatccgacggatgggagcagcggtaactggaattcagaatatgacaacctgctgatcgaaatgtccaaaaatatttggatcgaccactgctcattcaatgacggagatcagcctgatgagctgactgaaacgcatttcgggcgcgaattccagcatcacgacggactgcttgatatcaaaaagcagtcggatttcattacggtgtcatacagcatattttcaggacattctaaaaacacgattatcggatcaagcgacagctacaaagcagacaacgggcatttaagggtgacattccaccacaatctctacgaaaatataaaagagcgggcaccgcgcgtccgctacggaaaagtgcacatttacaacaactattttaaaagcacgaaagacagctacaattattcatggggcgtaggctattcttcaaaaatttatgctgaggacaactactttgacctgccggaaggaacgaagcctcaaaaactgatgaaggtctttaaaggtgacgctttatatgaaaaagatacgatcgtaaacaaccaaaaaagcgtcgcaaaaattgatgttgtcagcacatacaacaaagcaaacaatgcgtctattaaaaaatcggccggctggaagccgacgctgtttgaaaaaatcgacgacgcagaagatgtcccggcaatcgttgaagcgcacgcaggcgcaggaaaactgaagtaa

SEQ ID NO: 1320 - DNA, 333 bp, Bacillus licheniformis
atgagttcaacgcaaatgctgaaagggattttagaaggatgtctgcttgccgttatatcagaaggggagatatacggctatgaaatgacaaaggtgcttgcgggatacggtttttcggatatcagcgaaggaagcatctatccgattctcctccgcatgcaaaaggaaaaatgggtggagaccgaactaaaacggtcggcgagcggcccgaagagaaaatattacagacttacaccccttggagaagcggagcttcaatcgttcatcgaccgttggaaagcattatccgggaacgtcaatgcactgctcgaaaaaaaactgaaggagaagtga

SEQ ID NO: 1321 - DNA, 750 bp, Bacillus licheniformis
gtgctatcaaaggacatgcaaaacgtattggacgagatgagaatctacttaatgtcttcaggaaaaagcgacaaagaaatcgaaggaatcatgaatgagctaaccgttcatgcctgggaaggagaaaaggacggaaaaaccgtccggcaaatttttggggattctcccaagtcatatgttcaagcgctgtcaaaagagctttcatcaaggccaggggagatcgccaagttgttctttgccattttaatcggcgcaatatcctattttatattcagcgacgccgtgaacgacagcctcgattattctgtctatacgctggcaggctatccgctttatattttgctggcagcggctatgttgccgcttttgggccggattacagcatttaaagggaagaatacggccttcatgtatacgatggtgtacgccgctttgacgttttttccgattttggccattatttttattgaccggcaattcgggacaccggttttttcgtttgatgggggaagccgctggctgattatggccctgtcgtttcttgtgatcgtatgtttgtctttcaggttgaaagccggagccttgtccatattgccgctgcttttagccggaacgcattttttgtttcagtatatgaactgggattcagcaggagccatgatggcagaaacttatattccctatatcgggctgcttctcgtcatgtttattgaaacaaagcgtgccagaaatacggctcaatatgaatga

SEQ ID NO: 1322 - DNA, 501 bp, Bacillus licheniformis
atggatatgatgtggggctatgtactcgtctttattttggctgcgattccgtggtttgaagtgatcggtgtcgtgccgctagcgatcattgccgggcttaaacctgttccgtccgctattatcgcgctattcggaaatctattaaccgtactgctgcttatttttttaattgacaaagtgaaggtatggctagaaagaagacgcggggagcggagagcggagacggataagttctcaaaaaggaaaagcagggcgaaaaaaatatggctgacctacggcattccgggcctttctttcgtcgggcctttctttatcggctcccacttaaccgcgtttatgtgcatgggctttggggccaagcgcagacaaacggcgctgtggatgacggggagtctcgcagtatggacaacggcgtcggctgtcgctgcctactatggtttcagtttcctcgctcctgaaaatgaagggctgctgaaaaatatctttaaacaggaggagtga

SEQ ID NO: 1323 - DNA, 522 bp, Bacillus licheniformis
atgccgtttttgaaagatttatctccagatgaagagatggcgccgacagtcgggctgcttttttcggcggtcaatgaaaacatcgaacggctgaaatcaatcgtctccggcatcagccgggaagagctggaatataagggtgagcatggcgacaaaaacagcatcgcccagctgatctatcatttaatcaatgtcgatgtccgctgggtttacaggctgaaggaaagcgaaattccaagagagctggaagagaaatacggaccgatgacggatgaaaacggacgtttgccggaggtgacaggcgtccctttgaccgtgttaatcgagtggcatgaagaggtgctggagatgttgaaacacaccgctaaaggcttttcggaaaaagacttgctgaagaaggttccgtatgagggagggttttcgacgatccgctgggggatctggcatatgtctgatcataaccgctatcaccaggcgcatattcaggcttgcttaaaagagttccgcatgcaaaacagttga

SEQ ID NO: 1324 - DNA, 330 bp, Bacillus licheniformis
atgagatggggcagtgtcatacttgcagccttgtttgaaattggctgggtcatggggctgaaacacgccgattcggcacttgaatggatctgcacggcggccgccgtcgtgatgagcttctatatactggtgaaagcgggggagaagctgccggtcggaaccgtgtatgccgtatttaccggtctcgggacggcgggaacggtcgtctgcgaaatcgccttgttcaatgagccggcaaatatcgccaagcttgctctgatcggtgttttgctatgcggcgtgatcggtttgaagcttgtaacaaatgaagagaaaggggaggcgtcataa

SEQ ID NO: 1325 - DNA, 135 bp, Bacillus licheniformis
gtgtggacagggatcggcacggtcggaggtgcgcttgtcggcatcctgttttacggagagccgaaagacggaaaacgcatctttttcatcgcgctcattttgggatctgccgtcgggctgaaacttattagctag

SEQ ID NO: 1326 - DNA, 903 bp, Bacillus licheniformis
atgaacgcatatatgaaacagcagttatcgcaatatcaggaaatcaataacgataaggcccgccttctggtcagctgtccggatcagcctggaatcgtcgccgccgtttcttcatttttatttgagaacggtgcgaatattattgaatcgaaccagtatacgacagaccctgaaggaggccggttctttctgcggattgagtttgaagttcaaggcatccgcgaaaagatcgaacagatgaaagcggcattcgcctctgtggcggagtccttccaaatgacgtggagcatgaatttggcgagcgaactgaaacgcgtcgctatcttcgtttcaaaagagcttcactgcctgcatgaactgctatgggaatggcagagcggcaatttgatggcggagattgcagcggttatcagcaatcatgaagatgcaagagaaactgttgaatccctgaatattccgttcctttacatgaaagcgaacaaagacattcgtcaggaagtggaaaaacagcagctgaaatggcttgaagagtatcgtgcggatgtcatcgttctcgcccgatatatgcagattttaacgcctgattttgtctcggctcatccgaacaaaatcataaatattcaccactccttcctgccggcttttatcggggcgaatccgtataaacgggcatatgaaagaggcgttaaactgatcggagcaacatcgcattatgtgacaaacgaattggatgaagggccgatcatcgaacaggatatcgaacgggtcgaccacagagacaatgtggaagcattgaaaaacatcggccgaacgattgagagaagcgttttggcaagagcggtcaaatggcacttggaagaccggattatcgtgcatggaaacaagacgatcgtctttaattaa

SEQ ID NO: 1327 - DNA, 1098 bp, Bacillus licheniformis
gtgaaaaaacaacggattgtcattaaaatcggaagcagttcattaaccaactcgaagggcagcatcgatgaggagaagatcaatgaccatgttcgggcgatagctgctctgaaaaaagaaggccatgaagtcatcttcatttcgtcgggggctgtcgctgcgggatttttacagctcggctatcccgcaaggcctgtgacgctaaagggaaaacaggctgcagcggccgtcggccagagcttgttaatgcaaacatacatcgagcattttgcagaccacgatatcaagcctgcgcagatcttattgacgagaaacgattttgccaaacgggagcgctatcgaaatgcatatgcgaccgttatggaactgattgaacgggggcttgtcccgattattaatgaaaatgattcggtatctgttgaagaattgacgtttggggacaacgacatgctttccgcccttgtaagcggactgattcatgccgacaaactcatcattttaacggatattaacggcctctatgactcgaatccggctgaacatcccgatgcccgccgttttgattacattcccgaaattacggacgaacttttgggctgcgccgcttccgccggatcaaaagtcgggacgggcgggatgaagtcgaagcttttggcggcaaaaaccgctctttcactcggcgtcaatgttttcataggcgccggagagggagatgataagctgatccagattttaaaaggaaacggggacggcacctatatcggccaatccgacctgtcttccgtcaacaatcataggcagtggatcgcctttcattcacctgtttcagggaagattaccgttgatgaaggggctgagctggcgattaccgaaaacggcgggagcctgctgccggccggcgtaacagcgatatccggagattttccgaaaggggcggttgtcgaagtttacggaccgaacggcttggccgggaaaggccaaacgctgtactccgccgcagagcttgaagaggtaaaagggaagcgaagcgatgagttccatcatgaagaagggatagaagtcatccatcgaaatgattgggtaagcattaaagaataa

SEQ ID NO: 1328 - DNA, 1248 bp, Bacillus licheniformis
atgagcgaagtgattgaaaaagcaaaaaaggccaaagtcgcaaaggaagaactggttcatcagccgactgaaaggaaaaatgaggcgctttcctttatcgccgaggccatccgctttaagcaggatgagatattggcagaaaacgagaaagatatcgtccgcggcaaagaaaaaggcttttcgcctgcgctgcttgaccgccttgccttaacgccggagaggctgaatgatatagcagacgccgtcatgctgctcacaaagcttgaagaccctgtgggggaaacgcttgaaacgatccgcaaagacaacgggcttttcattgaaaatgtcagggtcccgctcggagtcgtcggaatgatctatgaggctcgtccgaatgtaacggtcgacgccgcaaccctttgtttgaaaacgggaaatgccgtcatcctgcggggcagttcgtcagccatcaacagcaataaagcgctcgtccgcgtgatcagggaagcgctcgaacgctcggcgcttccagaggatgccgttcagctcattgaagatacaagcaaagaaacggcaaaacagctgttcactttaaacgacggcttggatgtgctcatcccgagaggagggaaaaacctcatcgatatggtggtgcgggaatccacagtgcctgtgcttgaaacaggcgcggggaactgccacatattcattgatgaatcggctcagccagacatggctgagcaggttgtaatcaatgccaaaacgcagcgcccttctgtctgcaatgcgattgaaacggtgctcatccataaaggctgggcggaagagcatacgaaagcgcttcttcaaaagcttgaagaagcgggcgttgaaatcaggggagacgaagccgtatgcacgatgctgccttctgcggttccagctcgcgagaccgactggggaaccgagtttcttgcgccggttgtcagcatcaaaaccgttgccggaatcgatgaagccatccggcacatcagacagtacggcacacgtcattcggaagcgattctgactgaaaatcaggaaaacgcccggtatttcttaacgtctgttgacgctgcagctgtttaccacaatgcttcaacacgttttacagacggctttgaattcggctacggcgccgaaatcggcatcagcacgcaaaagcttcacgcacgggggccgatgggccttaaagcgctgacttcttctaaatatatcattaaaggaaacggacaaatccggatatga

SEQ ID NO: 1329 - DNA, 423 bp, Bacillus licheniformis
atgaaaccgctatttacctcgcaagccactgccaatggtggcagagacggacaagtcacctcatctgaccgcgtccttgagctggagctggccatgccgggaacgccaaaagccaaggaaaacgaaaatgccaccaacccggagcagctgtttgccgccggatacgcggcatgctttgacagcgcattgcaattgaccgcccaaaaggcgcgtcttcgaatggagacagaggtgacggcgaacgtcagccttctgaaagatgaagcagatggaggctataagctcagtgtcacactgcaagtaaaaggaaccggcgttgaacagagggagctcgaaaaactcgtccatcaagctcataccgtttgcccgtattcaaaagcaatttccggaaatgttgatgtcaaccttgaagtgatttcttaa

SEQ ID NO: 1330 - DNA, 453 bp, Bacillus licheniformis
atggcaaacgaatttgaacatatgaggcttgacagacagctttgctttctcctttatgcaagctcgcgtgaaatgacgaagctttacaagcctctgcttgatgaactcaatattacgtatccgcagtacctcgcgctccttttattatgggaacacggggaattaagcgtcaaaacaatgggcaagctcctttatctcgattccggcacactgacgccgatgctgaagagaatggagcagcacgggcttttaacaagagagcggtcacctgaagatgaacggtctgtaattgtcagactgacagcaggcggccaggcactccaagaaaaagcaagcagcattccgcagcacatgatcgcccagaccgatctgtcggctggcgaactgaaaaacttgaagcaaacgcttgaatcccttcttgcttcattgacgaaaaaaacagatgtgctgtaa

SEQ ID NO: 1331 - DNA, 414 bp, Bacillus licheniformis
atgactgcattgtttacagcaaaagtcacggcaaaaggcggaagatccggacatgtcaaatcagatgacggggttttggaccataacattgtcatgccaaatgaaaaaaaagaaggcgaatcagggacaaatcctgaacagctctttgcggcgggatacgcggcgtgcttcggcggcgcattggaacatgtcgcaaaacaaaaaggcattgacatcgattctgaggtcgaaggccatgtgagcttgctgaaggatgagagtgacggcggttttaaaatcggcgtcaagctgatcgtcacagcaggcggggtagaaaaagaaaaagcgaaagagctggtcgaagccgctcatgacttttgcccttattcaaaagcgacgagaggaaatatcgacgtcaatcttgaagtaaaataa

SEQ ID NO: 1332 - DNA, 666 bp, Bacillus licheniformis
atggcatatcttaaaaaagcgcttgtgttctccgtgctttctctcgctattgtccttgcaggatgcggaaccggagcggcggagaagaacaacggcaatcaatccccggctgatacggccaagcagaaagcacctgatttgaaaacatattcccttgacaaaaatatccggtctgaagaagattttgatttgataggcaagtatgttcatgctgaagatgaccaaatcacgctcgaaataaaggataaggaactgattgttccgaaaagcagccgctttcacagcgaagaagaccatgatgacttaatcgggaagcttgtgaaggtagaggtggatggaaaaacgcaagaagcggaagaagccgagcttatgccgcagtcaaaagccgaccaaaatggcgtatatgaggaggagaaagacggcagccgaaaaatcatcgccacgtttgtcagcgagtcggagcaaaacattacaatcaaaacaaaagcaggggaaaaaacttatcagaaaacagccgattttgagagggatgtcgccgaagcacctgaaaaactgaaagggaaaattgtcaggcttgaaattgaaaaggatggaaaagcagaaagccttgatttggaatcggaagatcaaaagcttgaatggtatgagccgtctgcttcaaaataa

SEQ ID NO: 1333 - DNA, 471 bp, Bacillus licheniformis
atgaatcatgaagcatttttgcagcgcgccatcgaccttgcggtggagagcgtgaaaagcggcacaggcggaccttttggcgctgtgatagtcaaagacggccaaattatcgccgagggaaaaaacaatgtcacaacaagcaatgatccaaccgcgcacgcggaagtaacggctattcggctcgcctgtgaagcacttggcgattatcagctgaacgactgcattctttatacaagctgtgaaccgtgccccatgtgcctgggagccatctactgggcgagaccgaaggaagtttacttcgccgctcagcattcggatgccgcatcggccggttttgacgactcttttatttatgaagaaatcaccaaaacgaaaagcgaacggaaaattcctttttataaaatggaccttcaagcaaagcttgaaccttttctcacatgggaaaagaccgatcaaaaagtggaatattaa

SEQ ID NO: 1334 - DNA, 633 bp, Bacillus licheniformis
ttgcttacattgtatattgcaagacacggtcagacggaatggaatattgaaaaaagaatgcaaggctgggaagactccaatttaacggctttgggactggcaaacgcaaatgccctcggcgaacggctgaaagatgttcaattccaagccgcatattccagtccaagcggccgggccgttgattctgcgcgggctatgctgcagaaccgcagcattccctttataacagacgacagattaaaagaaatctcgatcggccgctgggaagggaaaacgtatgatgagatcaaacaaagtgatcctgacttgctggaagcgtattttaatacgcctgaaacatatatgcccgatgaaagcgagagcttttacgattttgaaaggcgggtcagtcaggcgtatcaattcattctccgccgccatcgggaaggcaatgtcctcattgtcagccattccgtgtttatattgatgctcttgaatcttataaaaaagaggccggtcggtgaactatggaactcaagctatgttcatgacacagctcttgcggttgtaacggtttccgaggatggaagcgccgcgattgaaagagaaggagacggtgaacatagagtagaagcaaagaatgccacctggtag

SEQ ID NO: 1335 - DNA, 714 bp, Bacillus licheniformis
atgacgatccggctgaacatcaatgatctgcacgccctcgcccgccaatttcgttattcccaccagcgaatcagcgatttaatacgccttttgaaccgtcattttcatgttcttttctccagcgtgaaaacagcaagaacatgcggcatcgatcaggcgcaatccgaaatggaacatgaactcaaaggatttttacacacgctcgatgatttgcagcatctcctgcactttacagaaatccgcatgaaaaagaccgatcagatgcttgcggagaagctctttcacagcggcgggcatttggccggctacctgccgatcatgtcttctttggctgcagccaaatgttcccctggcagctataaactgaccgcaccgccgctgtctgaaccgctcgctctcatgaagcagatcaaacaaaacggtctgtcaggactcattacaaaaaaacgagccgcagcatatattcagtttgatgaagagggacagcagcagctgtggtcggcgcgccgcatgatcagccgcacaatcgccgacaacctttgcattctggcatatcagcaaatcgcaaaaggcccgctttctcttacagtcttacttttcggaaaaaaagcggaagcagatgcggcagatgtcaaaaccgtttgtctttcaaaaaacaaaacgattaccgccgacacgcttcacagcttcagtgccaaaatatattccggctag

SEQ ID NO: 1336 - DNA, 315 bp, Bacillus licheniformis
gtgattgacgatggaatagcgttagaacgaaaaatcaagcgaaaaatatatcaggaagacattcactctcttcagctatacgtaaaagatgtgaatgccgccattgatgagctgaggcaggaaagttcttctattttaaaagcacaccaaacgtatatcaacggatggcgcggacaggcgcgcgaaatgtatgacgcgcttttggacgatctcgaccgggcggaatcgcgcgtgtatgacaagctgaggaccattaaagagcaggcggacgaagaaattgaacggcttcagctgaaagccgaggagctgatatga

SEQ ID NO: 1337 - DNA, 2289 bp, Bacillus licheniformis
atgactaatgtaaaaacgagcagcttgggctttccaagaatcggcttgaacagagaatggaaaaaatcgcttgaggcttattggaaaggaaacacggaccgcgagacctttttgaaagaaatggatgaacaatttttagcagcgctccagactcagcttgatcagcaaatcgatatcataccggtttccgactttacaatgtacgaccatgttcttgacacggcggtgatgttcaactggattccagatcgattcaaggatataaacgatccgttagatacttatttcgcaatggcgagaggcacgaaagatgctgtatcgagtgaaatgacaaaatggtttaatacaaactaccattatattgtgcctgaatatgaaaaaggtgcacaataccgcgtgacgagaaacaaaccgcttcaagattaccaaagagcaaaagcagcattgggaacagaaacgaagcccgtcatactcggcctttacactttcgtagcccttgcaaaaggctatgaacaacaggatattaaagatatttataaccaaatgacacctctttacatccaggttttgaaagagcttgagcaggaaggcgtcaaatgggtgcaaattgacgagcctgctcttgtgacggcttcacctgaagaagcggctgctgtcaaagaaatctatcagacgattacagaagaagtctctgaactgaacatccttctgcaaacctactttgactcggttgatgcttatgaagagctgatatcgtttcctgtcgcaggaattggtcttgattttgttcatgataaagggaaaaacttcgaacacctgaaagcgcacggttttcctaaagacaaagtccttgccgccggcattttagacggacgcaacatttggaaagccaatctcgaagagcgcctcgacctgacgcttgaactgatccagagagcgggtgttgacgaagtctggattcagccttcaaacagcctgcttcatgtccctgtcgcaaaacacccgggcgaacatcttgccgacgatctcttgaacggtttatctttcgcaaaagagaaacttctggagcttacactgctgaagaacggacttgtttccggaaaagcggccatccaagcggaaatcgatgaagcgcacggacaccttcaagatctcaaacagtacggtgcagcgacaaattcggcctttgccgaagaaagaggcaagctgactgaggaagactttaaacgcccgacagcttttgaagaaaggctgcggattcaaaatgactctctcggacttcccctattgccgacaacaacgatcggcagcttcccgcagacggcggatgtgcggagcgcgcggcaaaaatggcggaaaaaagaatggtccgacgagcagtatgaagcatttattcaggaagaaacaaagaaatggattgatattcaggaagatctcggacttgacgttctcgttcacggagaattcgaacggacagacatggttgagtatttcggcgaaaagctcggaggattcgcctttactaaatacgcctgggttcagtcatacggttcccgctgcgtccggccgccggtcatctacggagatgtcgagtttaaagagccgatgacggtaaaagaaacggtttacgcccaatccttgacctcgaagaaagtcaagggcatgctgacagggcctgttaccattttaaactggtcctttgcccgctatgacctgccgagaaaagagatcgccttccaaatcgcctgcgccctccgcaaagaggttgaagcgcttgaaaaagcaggaattcaaatcattcaggtcgatgaacctgccttgagagaaggcctgccgcttaaagaacgggattgggacgagtatctcaaatgggctgcagaagcgttcagactgtccacttcatctgtggaagatacgacgcaaatccatacgcatatgtgctacagcaactttgaagatatcgtagacgcgatcgaagatcttgacgcagacgtcattacgatcgagcacagcagaagccacggcggatttcttgattatctggaacagcacccttacctgaaagggcttggtcttggcgtatatgatattcacagccctcgcgtcccttccagcgatgaaatgctcacgatcatagaagacgcgctgaaagtctgcccggctgatcgcttctgggtaaaccctgactgcggtttaaaaacgagacagccagaggaaacgatcgcagcgcttaagaatatggttgaagcagccaaacaagcaagaggcaaactggctcagactgtttaa

SEQ ID NO: 1338 - DNA, 954 bp, Bacillus licheniformis
atgcaaatgcgattaattccttatgtcactgacacaaagctgatggacgtgaatgaactgccggaaggaatcgatgcgattaaggcaccggagctgtggtcacaaggttttaaaggaaaagatatcactgtcgcagtgcttgatacaggctgtgacgcaacccatccagatttggcggaccgaatcatcggaggcagaaacttcactgatgatgacaacggaaaagaagatcagtttcatgattataatggacatggcacccatgtggcgggtacgattgccgcaaacgatcaaaacggaggcatttccggcgtagcacccgaagcgaacctattaatcgtcaaggtgctcggcggtgaagacggcagcggggattatgaatggatcatcaacgggatcaactacgccgttgagcaaaaagccgacattatttcaatgtcgctcggcggtcctgccgacgttccggagttgaaggaagcggtgacaaacgccgtgaagagcggagtgctcgtcgtctgcgccgcaggaaacgaaggcgacggcaatgaccgtacagaggagtactcataccctgctgcatacaacgaagtcatcgccgtcggatccgtgtcattgacgcgtgagtcttccgaattttcaaatgcgaacaaagaaattgaccttgttgcacctggagaagaaatcctctctacattgcccgaccatcaatacggaaagctgacgggaacatcgatggctacaccgcacgtcagcggcgcgctcgctctcatcaagtcagctgaagaagaggcgtttaaacggaaactgacagaacccgaactgtatgctcagttaatccgccgcacccttcctcttgattactcaaaagcgctgatcggcaacggattcttatatttgtcagcgccggaggtactggcggaaaaagccggcgaagcaaaacttctttccctttaa

SEQ ID NO: 1339 - DNA, 156 bp, Bacillus licheniformis
gtgaaagaacaagaagacgaaaaaagagacgaattatcaattgagcaggcggagtttgtgccgcatccaaaatatgaaggagaatacgcgcttttactgcacgaaaactatcacctgctgtcaaaggacgaccttgagcaggaaagcgaaaaataa

SEQ ID NO: 1340 - DNA, 1356 bp, Bacillus licheniformis
atggtaaaaaacatgacatatgatgaactgattttacgcattattattttgctgagagacggaaaacgaaaagagttccaaagccttttagaagaactgcagccttatgatatggcgattctgtttaaggaaatgcccgaaaagcaccgcggccggtatctgtcttttttaacggtagaagacatcaccgatctcatgggcgaacttgacagagaagagcagctagtcgttctgaacaaggtcggcaaagaaaaggcgatccatgtgatgaataaaatggacaacgacgaccttgccgcgctcttcgaggaaatggaccctgagctgaaagaccagcttctatccagcatggaagcggaagaatccgaagcggtccgagttttgatgaactacccgcctgaaacagcgggaagaattatgacaaaccgctatgtctggattccgcagcattacacggtaaaagaagcggtcgtcaagctgaaaagctttgcggaaatcgcggagtccatcaactatttatacgtcatcaacgaacaaaaacagcttgtcggggttatctcataccgtgatctcattttggcagaacccgatgagaaggttcaggaattaatgtttacaagggtcatatcggcggacgctcttcaagatcaggaagaagtcgcaaggctcatcgagcggtacgactttctggcgattcccgttgtagaaaaaaatcatgagcttgtcgggatcgtaacggttgatgacattatcgacatcgtcatccaggaagcgaatgaagactatgaaaaattcgcagcatcaggtaaggcgatcacgtttgatacaaaatcgtatgtcgccgcataccgccgtctgccgtggctgatcttgcttttgttcatcggtttgatctctggcagcatcatgagctattttgaagacacgctgcagcaggttgtcgcattggccttttttatgccgatgatcgcgggaatgacgggtaacactggaacacagtccctcgctgtcgtcatcagagggctgtcaaaagaagagctcaataaaaaaacgattttccgcttgattttccgggagcttagagccgggattattattggcatcgtgtgtgcgatcgtgattacgggaatcgcgatagtatggcaggggaatctgctgctcggatttgtggtagggacttcgctttttgccactctgatcatcggaacgatggcgggaacgatcgtcccgatcatccttcacaagtgcaatgtcgaccctgcgattgcatcgggtccgctgattacaacattaaatgacattttgtcgctgttgatctacttcggtattgcaactgcattcattcattcgctgtaa

SEQ ID NO: 1341 - DNA, 408 bp, Bacillus licheniformis
atgagaaggattgcagctgtgctgatttgtttagccgttgcaatgattgttgccggctgtcagaatgaagatgaaggaaaagacaggcggctcgtcgcagttgagaatatgcttgaggcgatattggacgatgatttatcaaagatgaagcgcttgtacgtggagggcgcaaacccttctccggaaacaatcttgaaagacaagcagaaatggggaatttccgggcttcatgctgatgattttcaaatttctgaagcgagcatccatgtgtttcatgccgcttacaagatggaaaataccggtcagcccggaacgattgcgtttcggatacgcaatgatcccgataaaggcgttatgattgatttcattggatacataaaggaagcgaaaaagcaggaaaacaggtga

SEQ ID NO: 1342 - DNA, 1140 bp, Bacillus licheniformis
atggcttcatttcagcagtacaaaaccaaaacgggctataaatggctttttaaaatgggagttggtatcgatcccaaaacaggcaataggaaaacaacaacacgccgaggctttaagaccaaaaaagaagctgtcgcagccgctgcggaattccagaaggaaatcgataataatgctcttgcccgaaatgacattacttttgaggatgtctttaaagaatggtgggatgttcattccaaaacgataaagcgcagcaccagatatagaaagctatcgaatttcaaaaagcatatcctgccgcacttcgggaaattaaaaataaaagacatcacaagagcatattgtcaaaaggtgataaatctgatagctcaggatattgattctgttcaaaatgtaaaaattcaagctaaccttgtatttaaatatgctctaaggatggaatacatcacaaaaaatccaatggaattcgttgtgatccccaaaaaagaagagaattttttatcgcaggaagaagagaaacggaacttttgggaaaaggacgaaatcaaaacctttctcgaaaaagcgcattctcaactcgccccacaagattatgtcatgttttatgttcttattttcactggtatgcgcaaaggggaacttattgccttggaatggaaagacgttgatttaaaagagaaaacaataaacatcaaacaaacaatgttttttgaaaacggtaaagaagtcatccaaacaacgaaaaaatatcattccaagcgaattatcacaattgatgatcaaacagcccaaatacttaaaaaatggcgcacacaacaaaaagaaatgctcttgtctaatggaatcacctcagaagctaaatatgtccttatacggggcgatatgcgtcctctaaggcttgcatatccaaacgaccttttaaaccgtatgatcactaaaaataagcttcacagaatcacaattcacggttttaggcattctcacgcatcaatcctttttgaagcaggcgcatccataaaagaagtacaagcccgtttaggtcacaaagaaattcaaacgactatgaacatctatacacatgtcacgaaaaccgcaaaagcaaaaacggccgaaacatttaaaaagtacatggaattatga

SEQ ID NO: 1343 - DNA, 480 bp, Bacillus licheniformis
ttggtgtatacaaaaagtcatttagaagattggattgaaaacttgtacagaagcatcagtatcattacaccagagcaaattgatttcgagcgtatagctgagttgttaggcataagtgtttattttaagcctatcccaagttgttctttcaagtataatgacgtgtatacgattatattagatagccggaaaacccgtttcgagcagtgggacgactttgctcatgaactatgccacctttacagacatgaaggagataaaaaaacaatgccaaagttttggtcagattatcaggagagacaagccaattacttctcatatcacttttgcatccccacttttatgcttcatggaatgaaaattccacaaaatcatttttttgacgctcacctcatttctaagatgtttaaagtcactgaaccatttgcgaaagtacgccttaacatgtactttaacaaaattcatcttattgttagttaa

SEQ ID NO: 1344 - DNA, 348 bp, Bacillus licheniformis
atgaaaagaactactgaatttgttttaggtctaataggcggaattttcggttttattggtgcctttttggcgttaattgtcggcggactcgatgcctcttttaattcatctggcacaagcgatattattggtttaggttggggtgctatcttcctctcaatccttggaattatcgcttcggtgattgttagaaaaaaagctaaattaggtggaattttgcttattatttctggtatcggtggcctgatttgcattttcttattctacttacttcccgctattcttctaattatctcgggagttatgggacttgctagaagagataaaacaacgacgacggcagcataa

SEQ ID NO: 1345 - DNA, 522 bp, Bacillus licheniformis
ttgaaaaaatttttagttttatttttatctttcggcctcgctctggccttagccgcctgcagctcaactgatgacgtatcaacaggaacagaggattcaaaagacaaaaagacagaagagaagaaagatgatggttctaaaaaagttgatgcaagtagtcaaaagactgatgctttagggatgaaagttaatttaggagacgttaaaattatgaaagataaagttaacgtcggtatcaacattgaaaacacaactagcaaagtcctcaacttctatcctgatcaaggtaatgcagtagtcggagacatgcaattatcagccaatatgtttttgactgatggcgaagttggtggagaagttcaaggtggcgttaaacaggacggggtgctggagtttgccgtaccagaaggaaaagagcttgatatcaataacattaaagaaatcaagttgaattttggtgatgtaaccactgaagactttatgaataacaaagcagtatcattcactgtgccagttaagtaa

SEQ ID NO: 1346 - DNA, 267 bp, Bacillus licheniformis
gtggaaaataaagaatttgaaataatcttgaaagagattcaggcaattaatagccgcctaaccaaccttgaaagaaatgtcgcgaccaaagatgacatcaaaacattgagtgacaaaatcgattttcagcataccgaaaacatcaattcggataaccttctacttgatgagattagcgcccttgaagaaggcgtcatctatgttaatcgcaaagtagctgatgctgaattcgagattcacacattgaaaacccgtatacaccagtga

SEQ ID NO: 1347 - DNA, 369 bp, Bacillus licheniformis
atgaaattcggagatcgacttagagaactcaggaaaatgaggccgaatctttctcaaaaaaaattaggggaacatttaggtcttgcagaaagcacaattagtatgtatgagcaaaatagaagagaaccggaatatgaaattctaattaaaatagctgattatttcgatgtttcaattgactacttacttcgaggcactgatccgaaggttcaagataaaatctttgaagacgaagcaaagaggattctaaatgaccctaaaaccttcatcgcggctcgtgatggagaaattacacaggagattttagatgctgcccttgaaatcattacggagcaactgaaagaaggcgggaaaaagaaatctgactaa

SEQ ID NO: 1348 - DNA, 237 bp, Bacillus licheniformis
ttgaataaaaaggttattggtgcaaagttgatgaaactaagaggcgataaaacccggtctttagttgcaaatgagcttgaaataagcgaaagtacattagctatgtatgaatcgggtcaccgcacacctcgtgatgaaataaaggttcgtatagcaaattattacaaaaaaacagtgcaagaaattttttttgaagatcaacttcacgaattgcacggtaaatcccacacagcgtag

SEQ ID NO: 1349 - DNA, 327 bp, Bacillus licheniformis
ttggctaatctcggtatctcacttgataacttaccgaacgaaacggttttcgagattgttaaagcgctttgcgaaaaagcttatcagcaaggcgtggaggacggtgcaaaaaaatatacgtatcctccaatattaaaaaacactcatttgcaagagattttccaaatcaaatcggcagcggtgacaagactaaccggaatcgagtctttcccgaaattgaaaaccattcaagctagatatccgcgtgatctcgtttttgaatggatcaaacaaaactcaacttgggtcgaagaaaacacaaactattttcagaaaggtgtgtcttaa

SEQ ID NO: 1350 - DNA, 735 bp, Bacillus licheniformis
atgaatcaattaatgaactctgaaatcaaaatgacaagtttagatttagcagaattaacaggcaaagaacacaaacacattatgcgcgacattcgagaagaaattaataaattaggaaaagaattaggtgagtccatttttggactgtcctcttataaaactctacagaacaaagaattaccttgttacacattcggcagaaaaggtgccatgcaattagctttaaaatacgatgccacaacaagatttaaagttattgaaagaattgaacaattagaaaaacaacaacagccaaaaacgccgttggaagttttacaaggaaccatcaaccaactggtcgagcaagacaaacgaatgaatcaactagaaggtcaagtgaacaatatttcgaacatcgtatccatgaacaatgtcggctggcgtgaaaaggtaaatgtcatcttaaaaagaatcgcgaaaaactggaccggtgtcgagccataccgaagcgtcatgaatcttagttatgagcgtttggaacagcgggcaggctgtaaactcgacatccgtttgaacaatcgaaaagaacgcgcgctatcgcaaggcatgtccaaaacttatgtaaagaaaatcaacaaattagacgtgatcgcagaggaaaagcgcttagttgaaatctacatccaaatagtcaaggaaatggctattcaattcaaagtaaacatcaatgactttaaacttgatgaagttgtttaa

SEQ ID NO: 1351 - DNA, 519 bp, Bacillus licheniformis
atgccggaaatagtgtctaaatcactggcgcatctacttgaaacgaagaacatgacaaacgggcaactcgcccttgatctaaacgtttcggagtcgatggtcagcaaaatgaaaaacggaacaagaaaaatgccgtgggatgtggcggaaacgtcactaaagaaattcgatcaaccatttttcgcaatgggaatcatgaacaaattcagcgatggttgctcgccgcccgtcttcactggtgaatcagtcgagcaacatcgactggcttttgaagagatcatggtcacacaggcgacagaagccatccagacacttgcagatgtgagttttgttaagaatccgaagctgatctctttggaagaaagggagcgcattaaagtggtcataaaggaacttctggacgtggaggcatgggctaaaaacttagcggccttattggcgaaggaatacaacatttcactcaaagagtgctacaaaaaagcaactatcacatggaaggcgaaagggtggctcgaatga

SEQ ID NO: 1352 - DNA, 279 bp, Bacillus licheniformis
atgaatttaaaccattttttgaagtctgacagggagaaggcggaacgactttacaagtcattgcaatttctcgtttcagaactattggcggatgccgtcaaagagggtgattttgatgggtgtatagaacttgcgggtagcatagtcgatcacagcagagacttaaagaaaatgcagcaccctgaaaaagtagtggaactacacgaaatcgcgtcagagttcgccaaaagagggctgaacgttgtgcctgttaaaccgccagcaagagggattcactaa

SEQ ID NO: 1353 - DNA, 189 bp, Bacillus licheniformis
atgaatcacagaaaatatgaattggcatcttcctttttacgaaatgccaagaacatgaattactcagaacaggatattaaaggagcgattcgactgctgtatgaagaggtttcttcggaagaaaaggtgatgttaagtctatacaaatacctaatggcacggaaaggagcggatggaaatgaacattga

SEQ ID NO: 1354 - DNA, 105 bp, Bacillus licheniformis
atgaacattgaacacccaattatcacagaaatcaaccgttacggctatccaaaggattatttgcggtatgaagaagaggaagaaaacgaagacgacgaggcataa

SEQ ID NO: 1355 - DNA, 804 bp, Bacillus licheniformis
atggataagatcggcgaaagtcctttagaggataacgaaagcgaggcggcaaggctcgggaatctattggaggacatcgtagcccaggaattcagccggaggaaagggctgaaagtgaagaagcggaacgccattttacaacatgagaaatacccgtattttttggcgaatgttgaccgcctgattgtcggccggaaggaaggtcttgagtgcaagacggcgacagtttacaagcgtgatgaatggacggcagacagcgtgcccgatgcgtattttgttcaatgccaatggtacatgagtgtaaccgggttcaaaaaatggcatttggccgcccttatattaggggatgttgtgaacccttggcgattccatgagatcgagcgcgacgatgaattgatacggatcatggaagaaaaggcggcttatttctggaatgaacacgtttctaaaagagtgccgccgccgtttgacgggtcgcaatcatcaaaggatttactggcggccatgtacccggagcatgtcgaggattcggttgatctgccgggatactttgatagcaagattgaagaatacgagcggacgaaagagaagatcaacgaactgacagagaagaagcaggccattgaaaacgagatcaaagggattctcggtgaaaggaaacacggttttgttgctgacaaaaaagtcacttggtcgaggttcccggttgaacgctttgacaaagaaaaattcaagagagaacaccctgacatctacaggcagtatgtgaaagagggtaacggttcaagattttcaatccggtaa

SEQ ID NO: 1356 - DNA, 822 bp, Bacillus licheniformis
atgacacaagcagagaaattgaaaaacgacatagcgaagcaggagcaaagaaacgaggttgctcaagatgataaaccaaaaacaattcttgatgcaatgatgaaacataaagaatcgtttgaaatggctttgcctaaacacttggacgccgacaggctgattcgtttagcggttacagagttcaggaaaaacccaatgcttaaagaatgcacgcctgagtctttgcttggagccgttatgcaagcggcgcaagttggattagaaccggacgcgctggggtcggcctatcttgtgccttattacaacaagaacaagaacgttaaagaagttcaattgcagatcggatataagggcttgatcgaattagtcagaagatcaggccaagtaacaagcattgtagcaaatgaagtctatgaaaatgatgaatttgatttcgaatacgggataaacgaaaagttataccataagccgacgatggatgcagaccgcgggaaactcaaatgtttctatgcttatgcccgatttaaagacggcggccatgcttttacagtcatgagcgttgaacaaattaatcagattcgcgataaattcagcaagtcgcaaaagaacggaaagcattttggcccttgggctgatcattatgagtcaatggcaaaaaagacggttatcaagcagcttgtcaaatacatgccgataagcgtcgaaattcagaatcaaataacgagggacgaaacggtgcattcaagcttcaaagaagaaccaaaaccgatttacgcgtttgaagaatcgccagacattatcgacgcacccatagaaaattaa

SEQ ID NO: 1357 - DNA, 708 bp, Bacillus licheniformis
gtggatatgcaaggtatggggtgtgttgtcctcccccgtcttccctttaaagatgaacgtgacgagataatttacgatcatttgtttaaaagggcggaatacaggcaaggcaaagagcttgatataggtcaaacaattatcaagatcacacaccttgccgagaggttcaactggtctgctgttcaaataaagtactctctggatcgaatggctaggcagggatatttaaagatcgacaggctacctcaaaaacgcggcttcattgtaaccatcgttaactatgcagagtatacgcgtttcgaaaattataaaaagaaaaaagcaccggtatcagatccaacggaaggaaaggaggaagacaagaatatgaagacaaacccatttcagttttttgaggacgaagggttcggcttattatcctcatttttggcggatatgcttaaaggtctgatagacgattacggtgaggaaaaggtgcttgatgccatgaaagaggctgttaagcgaaatgcccgcaatatggcttatgtccagcgcctcctacaatcaaatgaacttaaaagcaaggagtggggaaatgactatcaagcaaaaaaagcaagaaaacaaagcgatcagtataaacacggcatttcaaaaggtgatgcaaagccttcgggaaaaatcagcccacttttcggccccggacgcatccggagaaaaggctga

SEQ ID NO: 1358 - DNA, 981 bp, Bacillus licheniformis
atgactatcaagcaaaaaaagcaagaaaacaaagcgatcagtataaacacggcatttcaaaaggtgatgcaaagccttcgggaaaaatcagcccacttttcggccccggacgcatccggagaaaaggctgagtacgaatgtgaaacctgtaaagatcatggcattgtgttttatcgggttcataaagatacgaaatggaattatgacgaacggttaaagcaacttgtgccagaggaaatggtgccggaagatgattttctttctggaaaggtttgtccgccggaaaaggcaggggaatggaaggatacctattccaaacaatgcgactgtgtacggcgaaagagaatagcccgacttatggcagccagtggcattacagaagaatttgaaaagcttatattcggcaattttaaaacggaggggaaaccaaaattgataaaggatgcatatgattgcgctgttgaatacttcaaggattttgaaaaaatcaggggggatcgttcaaacagtatcgctttgcttggtcaacccggcagcggcaaaactcatctgcttacagccattatgaataatctcatcaagaagaagtccgtccactgtttgtatttcccgtatgtagaaggcatgggggatctgaaaaaggactttgatcaattggaaaccaagcttgatgcgatgcggaaagtcgaagtgcttttcattgatgacttgttcaagcctgtatatgtaaccactagtgaagggcgtatcaagaaaccacgggcgaccgaatggcagattgaacaaattcagtccatcgtaaattatcgttacctgaatcatctgccgttacttgtttcttcagaacttacaacagatgagttgctggacattgatgaagctctcggctcccgaatccatcaaatgtgccgggattatacggtaatcatcaagggggacatgatgttgctgaatcatagattgtcagatttaagtgattag

SEQ ID NO: 1359 - DNA, 213 bp, Bacillus licheniformis
gtgaaactgaaacctattactatcaatgatgatcttagttttactggaacgatggagaaaggcaaagtccgcgttattgtggtggatgggaacaacgggacggcgcacgcaatggacgccccggaacacggaaaatcaattattcaaacggtaaaaggcacatttaaacgtgttgattttgaaataggtctaaaagtcgagaaagacgattga

SEQ ID NO: 1360 - DNA, 189 bp, Bacillus licheniformis
atgacaattaatttaaaagtgatacaggagaagccgaaagggctttctgtggatgatatacaggatggattcttccttgttaaaggtgacaatgcgtgggtgatcagaagccacgctagagacttctctttaatcgatttaggaacttttgaaatatatgccaaaaacggatttagaggatttcattaa

SEQ ID NO: 1361 - DNA, 117 bp, Bacillus licheniformis
gtggagagattaaggagggagcggcaaatgaaaaatatcaaaagactcatcgtccggctgatcgggcggaaaaagaaggaacagaaaaaagtgtttgaatggtgggatttgatatga

SEQ ID NO: 1362 - DNA, 210 bp, Bacillus licheniformis
atgagaatcatcaaaaaagaagtcaattcacagtacggcggactattcaaaaaggtatttattcgaaaaatggttaaggaaaacgaccgcgaattgatccaagaaacaagcacgacctacatcgtgggtatcccggttagatcggtgacggaaacgcgaccgccgagtttgaaagacgcttttaagcaggcgtggggatcggcgaaatga

SEQ ID NO: 1363 - DNA, 450 bp, Bacillus licheniformis
atggacattatcaagattcgttacacatttaggcataaaggtagcggcaacattgaaatgaaaaggtacaacatcgggcaattggaagaaagagcagccgccaagctgtctccagtcttctcagatgaatatgaattgatcagccgggatttatacaccggattgaaggataatactgaccgcgagatttacgagggggacattattcattgcgtgcactggttctttgatggaaacgaaatagaagaacactttactgcttcagttggatttcgggatggatcatttactttggagaatattaatagccgttattattcagattatacatttgaagaaaacgggaaaggtatttgctggattggggatataaattactgtgatgaagattatgaaatcatcggcaatatctatcaaaatcctgatttattattggaggcgacggaatga

SEQ ID NO: 1364 - DNA, 456 bp, Bacillus licheniformis
atgagagagcgaaaatatcgggcatttgtaaagcagtgtaacaaaatgatttattccgaaaattcttacccgaaagggaacagcgattatagattcgtagcgtcagaagatcataaaaaaggtttaggggttgaatatttcacaaatcggacggagtatgtcaatcaatacggcggggtggtcctcttgcctgattggagagttttcacagatgaagaggcaccggtcacagaatacaccggattgaaggacgaaaccggccgggagatttgggagggtgatatccggaaagactctctcggtagaattttcaaggttgttttttacgacgatctagccgcattttatggggaacatcccggtgggttaattcagtgtcttgccgattgtgggccggattcggaatatctcggaacagtctatgaaaatcccggtctattggaggcggcggaatga

SEQ ID NO: 1365 - DNA, 423 bp, Bacillus licheniformis
atgatcacccttaacataccagtcgaaccaatgggagccgtccggatgaccgggcgcgggaaattcgtgaataaaaacgcacagcggtatttagcttataaggatttcataaagctgcacgcacagaagcagatgaaaggacagcagctttataccggtcctactgtagtaaaggtgcttttctccatgccgattccaaaaagttggtcaaagaaaaagcaacaggaggccatttcaacggtacacatcaaaaagccggacatcgacaatttagtaaaaggtgttttcgacgctctgaataaaacagcgtggcatgatgataaccaagttttcatggtcataggagccaaagtttacggaaaagaacccgggatcgaggttcaaataatggggctggcagaatgggaaaatttaagcgcctga

SEQ ID NO: 1366 - DNA, 207 bp, Bacillus licheniformis
atgggaaaatttaagcgcctgatcatccgttataaaaaccaatacgggcggactgtggggcatgacaccctttggaagggtttagatagcctcatagagttaaaacgtcgctacggctttttaaacgaagatttggagcatgtcgagattgacggcgaggaatgcgatttaaaaaaggtaagggctgcgcttgagaagcgcgggtaa

SEQ ID NO: 1367 - DNA, 285 bp, Bacillus licheniformis
atgcaaaagatgctgaatagaacggtacttgtcggaagattaacaagagatcctgacctaagatatgtcggggatggtaaaccggtagtcagctttaccattgcagtcaatcggacatttaaaaaccagaacggagaaacggaagcggactttatcaactgtgtcgcatggttgcagcacgctcaggaagaggttattgatttagcggtataccttgaggcggctatacaaaaattcgatgaattagagaagaaatttgatgaattagagagggagaaggcatga

SEQ ID NO: 1368 - DNA, 438 bp, Bacillus licheniformis
atgaaaaaactattcaaaaccattgttacactgtcactcttgatttctggaacgcttttattctcacaatctgcggcggctgtttggtcgccgtggcaaaaggaagcattcggccatacagcgaggattttcaccgacgacacgaattactattcaggagcaaaaacagttgactggcgggcggaaaagaagggttctggaacgctttactacacggctggcgtctataaaaaacgttcgggcggcggcttaactgatacaaaccttgtgcagcggggatactttaagcactcaacaccgttaaagtctttcagtgtcaacgagattcgcaagcgcaccgggaaaggatcatatgtcattcagatcgattgctacacagacgcgaagaaaaacaactatgtcgggacgtttgaatccaagacgttttatatcaagtaa

SEQ ID NO: 1369 - DNA, 417 bp, Bacillus licheniformis
atgcaatttatcgaattgacgttaatcggccaagccgggaaggagaaacgcgggcagatgaataaagaacagtttacatttgaaatggaattgaagggcggacttaatggcgagaaatcggacgagaaaaaacgtttggaaaaaataaaagagtcttactcaaattgcgtcgatatggctttgtctgaaggtgaaacgttgccctattacgatatagaagtagctgatatgaattttcttatcgaacaggctgaaaaggggctgaccgtgacgaggagcgccgggaatttacgcgctttacatgaatgtgtaacagccatgcaaaaaatcaaattcatatgccgaagggcgaaaaaaacctacatcgaggaaaaggacatcgatgacattttgaaaatacttgaagggaaagtatga

SEQ ID NO: 1370 - DNA, 456 bp, Bacillus licheniformis
atgtataaaaaagagattgaaaaactgatcagtagttatcactggatggcaaaagaggttcagagattgcaaagggtgctttacggttctgacatccctatgcgaagctggggtgtcgctcaatatgggttagaagctgccatgccaaagggaagccccggcaagagtcaggccgagctgagggatatggacataagagaggaacgtctatacaagcgtctagaatacttcgaagaacgtgtatacgcgattgaggcggcagcaagaacgatcgaaggggaacagcataaagtgatttatgattgcatgatggaagggatgagctatcgagccattggccttcatcttggcatatcgcgggaaaccgtcaggcggatgaaagacgagatcatcaaccagttgtgccaaaattgccgaattgtgcagttgttgaatccgaaaaaatccgtcgtgtaa

SEQ ID NO: 1371 - DNA, 231 bp, Bacillus licheniformis
atggggaaggttacaggggtgtatccggggcctaacaacgggctgatcagatggatcgaggaaaactttggagagatcgacggatacgcggcaacgttcaagatgaaagacggtacaacgatgacgatttacgacgcattaacgccagtcgaagccgtcgggatggccgagatcggtaaaaacgtgattcaggaagcaattaacgaggatgaatttgtctcgagaccataa

SEQ ID NO: 1372 - DNA, 708 bp, Bacillus licheniformis
atggctgaaaaacacatccaagcacaaaaagattacgtcaaaggaatgaaatacaaagaccttgccgaaaaatacggggtgtcagtgaacaccatcaaatcgtggaaacagcggcacggttggaaaagaaaaaaaggtgcacccattgaaaaaggtgtgcacacaaaaaaaccgggtgcgccaaagggaaatataaacgcactcgggaacaacggcggggcaccaaagggaaaccaaaacgcgaagattcacggattttattctaagtttctcccggaggaaacgcttgaaatcatggaagagattcaggaacgttcgcctgctgatatgatatgggatcaaattcaaatacaatacgcggccattatacgggcgcaacgcatcatgtttgtgcaggataaggacgatatggcaaaagagctgaagaaaacgaaagaatcggatttatcttccgaagaggagtttgaaatacaattcgcatgggatcgtcacgcaaccttcctgaacgctcaatcacgggctatgggcgagcttaggagcttgataaagcaatttgacgcactggcccatgaagaggacgagagacggcttaaacttgatcaaatgcgcttgaacatcgataagacgaaagccgaaatcgagcgactgaacgacgatgaaaacgactcaacatttgaaattatcatcaaggataaaggtgaaagatga

SEQ ID NO: 1373 - DNA, 1275 bp, Bacillus licheniformis
atggaaaaagaagtgaatccccgttttagggactttctttttgattggtcgcagaagttttattttctcgttggcggttacggatcatccaagagctatcatgttgctctcaagctgattttgaagatgctacaggaaaagcggacagccttagtcgtccgtgaggtctacgacacccacagggattcgaccttttccctgctcgaagaaatcattaccgacttagggcttgaccataaaatccggtgtgtcagctcaccaatgcaaatacgattcccaaacggcagcaagatcatttttaaagggatggacaagccggcaaaactaaaatcgatcaataatgtatcaattgtatgggttgaagagtgttcagaagtgaaatatgacggatttaaggagctgctggggcgcttgcgacatccgactttaaaattacacatgattctgtccacgaaccctgtcagcaaagggaactggtcgtataagcacttttttaaggatgaagccaatcagttttttgtccttgacgacgacgagctttacaaaaagaaaacgatcataaaaaacaacacctattatcatcactcaacggctgatgataatttatttttgcctgaaagctacatcgagcagctggaagacctaaaaagccacgatccagacctttaccgcattgcccggaaaggtcgttttggcgttaacggaaagcttgtcctgccgcagttcgaagtgatggagcacgaaaaggttatgaatgcgatcagagcaatcgacaggccgatcttaaaaaacggtatggactttggtttcgttgattcatataacgccttggttcgcatggcgatcgaccacaatcaaaagattctatatatctactggcagtattacaaaaacgatacgacagacgacaaaacagcggaagacctgaaagaccttaaacgcgttctgatcaaagctgatagcgcggagcctaagacaattcgattcttccggcaacaggggttccgtatgaaggccgcaaagaaattccaaggctcacgactgcaatacaccaagaaggtgaagcggttcaaaaagattatctgctccgatcaatgccctgacgttattagggagctgaaagatttgactttcgcagtggataaagacggaaacgtcattgaagacgaattcaacatcgatccacatactttctcggccatctggtacggcttagatgattatgaggtatcaagtctcaaggggcacggggtaacaaggaggtttagagattga

SEQ ID NO: 1374 - DNA, 1416 bp, Bacillus licheniformis
ttgataaaattcttagatcaaattagaacaaagggcatatcgggggaattgatttctcagattatcgaagagcataaagatgaccatgaccgcatgaagaaattgtacgaccgatacaaggcggaacctgccggcgtgccaattcttcaacgtaaagccgtggattatgaagactttgagacaggtcgcatcaagcggattgatcataaggtaaacaacaagctgaataactctttcgactcggaaattgtagataccaaagtcggctatcttttcggccatccaatcgcttatgaggtggatgacaaatcaaagtccgggaatgtttcagcgatcaaacagttgattgaggatttcactttgagaaatcacgttcctgacgaggacagcgaatgggggaagatggctgcaatttgcggttatggcgcccgccttgcttacgtggataaggaagggaaagagcgcattaaaaacatcgacccttgggaagtcgttttcataaccgatggcaatattcacgaaccggaatacgcattgcgctattacgagacttgcgacggacagctaaaagccgaattttacgattctaccgatattcactattacagcacgaaggacagcgcagtgtttgaagaagaccgcatacaaccgcacatgttcaaaggctgccctctattcggattagccaacaataaagagttaaaaggcgatgctgaaaaggtattgtctcttattgatgcctatgaccggacaatctcggacgccagcaacgagatcgagcagtaccggcttgcgtatcttgtcttgaaaggactaggggcagatgatgaaaccttagaaaagttgaaagaaaccggggttctacagctgctagaagagaatgacgaggtcagttatctcacgaaggacattaacgacgccattatcgagaaccatttaaacaggctggaaaaagatattctccgtttcgctaaatctgtgaattttacagacgaatcattcgccggcaatgtttcaggcgtggctatgaaatttaaactgatggcacttgagaataaaagtatcacgatggaacgaaaaatgacagcagccctccgatatcaatttaaaatccttttttctgcatgggggacaaaagggaaagcgagcgaagacgactatttaaaggtttggttcggcttcacgcgtaatcttccggtaaaccttcttgaagaatctcaaatcgccgggggtcttaaaggtctggtcagtgaagaaacgcggctttcattgctgtcatttgtggatgatgttcagtatgagattgacaagatgaaagaagaacaggacgaatatacgcggcatttaagcccgttagatgacagcgaagataaggcgccgcaggacggtgagccagacgatgaagaatcagaatga

SEQ ID NO: 1375 - DNA, 918 bp, Bacillus licheniformis
atgaagaatcagaatgaaatagataaataccttgacgaaatgatcgaaaaggctgaaagaaagatcgatcaactgtttgccagacgtatgaaagagatcaaaaaccaaatcgccgcaatgtatgacaagtacagcaaagacggcgagctttcatacaccgaattgaataagtacaaccgtttcagaaaagaaatggagcgcatggcggccgagattcacaaggattatcgagagcttttgaaaatgatcaatgacttaatggaaaaacaatacgttgagaattacctgagatcagcctatctttacgagtttgaagcacaagtaaagatgggctttactattcctacggtcgcagttattgccgcggcgttggcgaacccaatcgaaaagttacaactgccgaatgttcttgaagcggctcgtgatgaaatcataaacaatatcagtattgaagttgctcaaagccttctggctggtgaaagctacaccaaaatggcaaagcgtattgaaaatcgcgtcaattttagccgtgcaaaagcccgcagagtggctcggacggaagctcatagggttcaaatagcagggaggcttaaaagcgctgagaaggccgcagaaaaggctgatatgaaaaaattgtgggacagtacgctggatacaagaacaagaattgcgcaccggaagctcgacgggaaggtcgtgcccttcaacggcgtgtttaaatcgatatacggaggcgtcgggaaggctcccggacacatgcacaacccgaaagacgacataaattgccgttgttcgatcattttccttgtgaacggccagaaaccagagagaaggatatccagaatcaacggcaaaaacgtcgtcattccatacatgacctatgaagagtggaaaaaacaacttgaaaaggcggggtga

SEQ ID NO: 1376 - DNA, 147 bp, Bacillus licheniformis
gtgccaaaactaactgttatattgggcggagaagtcatttgcagacataacggcatggttcatgttgctgttacgtttgatgggtcattatcgagcatttttgttgtgagtgaagcggattatgaaagggtgttcccgaatggctaa

SEQ ID NO: 1377 - DNA, 330 bp, Bacillus licheniformis
atggctaaattagagattaaattgacggaagaagcgcggaaaaggaaagaagagaatcccctgtcaagtgtcgggctgaaattttccgattatgatgttttaatagacggccacgagccaacgcatttgaccgacttaaagctttctatgagagtaggagagcttaatgaagctacagtcacatttgtagttgacgaaattgacgttgacgccgattttttagcggctctcgaagcgaagatcgaagccgacaaggtagcggcggcatcacccgaagaaacgacagaagacacgacagacgcagatcattcggacgaggggagcgaataa

SEQ ID NO: 1378 - DNA, 645 bp, Bacillus licheniformis
atgccgaagtacattaaaaagcctgttgaggttgaggcgtttatatttgccgtagatgatacacctgagtggtttttagaaaaaacaaaaaatagttattgtgaatttcactatgactcgaatggcgtcagatgcatcctcccaacgtcggaaggttcagtaatgattatccgtgcaggagattttgtcataaagggcgtcgagggcgaaatctacccgtgtgaatcgagtatttttgaaaagacatatgatcgtgtagaccccttgaaaaaagcccgcaaaatggcggagctgtccggaatgcttacgaaaaacggctttgatttcaccgagaaaaaaagcgaaattgacaataacgaaatggcgcgcggtaaattagaatcgttaaaacgtgcctttgaagaggggaggataaagtcgtcatcggttacgaatttcccgatcaaagacaactacggacaatggcaatacggggaagcagaatataccttccgtgttgagccttcggcaatagctaaagaatttgtcagggaagtgctgtctgaaaagcctgtgacgatgtcccttgacggcgaggaagtagggaaagcgtgtttcaaagaagtttcaaaggtaatgaagcggcagaatatgaggtcgaaataa

SEQ ID NO: 1379 - DNA, 582 bp, Bacillus licheniformis
atgaatttagaagaagtcaaacagtttcttgatgcaaataaagagaacgaagatgtaaaggcttatctggaagaactttctgccgtgtcagccgacaaggtgaaaggttttctggaaacagatgaggggcaaaagttgatccgtcctaaattggatcagcacttcaccaaaagccttgaaacatggaaagccaacaatcttgatgaacttgttgatgccaaggtgaaagagctgtatccggaagaaaccgaggaacaaaagcgcatccggaaactcgagcaagagcttgagaagcagcaaagagaagccaagcgcgaaaagctcatgaacacggcgatttcttacgcatctgaaaaggggctgccaactgatcttgttgcttacttccttggggatgacgaagaaacgacaaaaagcaatcttggcacccttgaagaaaaattcagtgcttttgttaacaaagcagtcgaagacaaattcagagcaaacggcagggatgtggagccgggcggcggcggttctggctccggtgaaaatttaaacattggttcgcttgcagaacaagcaagcatccgaaaataa

SEQ ID NO: 1380 - DNA, 921 bp, Bacillus licheniformis
atgagttttgatccgaataacgtattgatgcaagatgcagtcaaaggaaaagtaccatctgatcaaggaacattagtattaaaagactttatgacacaatcagcagtcacaaaactagcaaaatatgaagaaatggataaaaccgagaagacattcacttatcttgcgtctggccccggggcttactgggttggcgaaggtgagagaatcaaaacttctaaggctacatggttagaagcgaaaatgacctctaaaaaactcggggtcattgtcccagtcacaaaagagtttttgaattactccgtgaaagacttctttactcaaatgcggccagcaatcgcggaagcattcgctattaaatttgaccaagcagcactttttggcattgattcaccattcggaaaaggcacttctgtattcgaaagagcagaagcagcaggaaacactgttgttttgaactctctaggcaacctttacgatgagttaaacgcagtcatggcactcactgaggacaatgacaaagacgtgaacggctttactactacacgtcgtttcaaacaaaaactacgcggcactaaggacggcaacgggctgcctatttttaatgatgcaagaggcggcgcgacatcagaggcattaggtttgccgattggctatgtcgattctaagtcttgggattatacaaaagcacatctattggctgccgattgggattttacccgttacggaattcctcaaggtatggaataccatatttcgcaagatgcaactttaacaacggttgtcgatgaaaataacaatcctatcaacttgtttgagcgtgatatgtttgctctccgagtgactcaacaagtcggatttatgacactttctgacgaagcattcgcagctcttactccggaagcagaagcgggggcgtaa

SEQ ID NO: 1381 - DNA, 339 bp, Bacillus licheniformis
atgagtttcacatcgaaaaactacagaacaagcggcggcgataagtgggttatcggtggagaactagaagtcaaagcgggcgcgaaggtatccggcatgcccgcaggcaccccggggccggacagtatcacttccgaaatgatcggagaaggacaggtcagaaaccgaaatatcggtgatgggtctgtaaatagccgtaatatcgggaatggcagcgttcaaaataatcacattcaagctaaggcggtcacgctggacaaaatgggcgatgatgtaacggccaaatttacagatatcgaaaaccgcctcaaagcactggaaggctcaggaggttcttaa

SEQ ID NO: 1382 - DNA, 270 bp, Bacillus licheniformis
ttgaaaatcacagacggttctatagttttgagcgtgtcagataaggcgtatagggttgtctatgcgccttttggctttgaaagggtagaagagtccgaagaagttgctcaggagactgacgcgccatttgatctttttgaaatgagcaaagagcaactgaccaaagtaaacaaaagcgacatcataacctttttggagcaacaggaatttgaatttgatccaaacgccaaaaaggacgaactgatcaaagtcgttttgggtgaagaatag

SEQ ID NO: 1383 - DNA, 309 bp, Bacillus licheniformis
atggacgtccagactatcaaaacaatgcttgggataactacagataggcacgatgcctatttgaaagaggttatccctctttttattgatttcgcaaaggattactgcaataacaggtttcttgttgacggcgcggaaaatctgccggcgggcgtaaagctgtttgtcgcaaaggcgatcgagtttaatatggcgccatcgaatttgagtgcccgcagcatgggggatgtttcttactcctatgaaacggagctgccggaatccgtcttgaggcatctgaaaccttacagaaggctgagggttgtctga

SEQ ID NO: 1384 - DNA, 339 bp, Bacillus licheniformis
atgtacgaagagtttccgcacacaatcacattccaaaagttcgaacagatacccaatggcggaggcggctttaaaaaagattgggtggacgcgattaccgactgcgaggcatttgtcgattcgctgaccggaaaagaatactatcaagcccagcagcttgagaacccggtcgaatacaacgtctattttccctatcgggaagacgttaaaaacgacatgcggatcatttggaaagaccgaaatgacagggttttggtcattcagtccccgcctatcgatcaaggcggccaaggtgaaatcttgtgctttaaatgccgttcaggggagaacattcgctga

SEQ ID NO: 1385 - DNA, 351 bp, Bacillus licheniformis
gtgcatgatcgagtgaagcggatcattgctgaaactgcggaaattattgctggtcaagcggtggccgcggcgccagtagatgacggaaaccttaaaaattcgatagaggtcaattactctcatggtggtttcaaggcgaaaatcaccgtcggggcttcttatgccgtttacgttgaatttggcacgggcatatacgccgaagatggaacgggccgcaaaacgccttgggtgtactttgacgagaaattagggcgatatgtgttcacacgcggaatgcgcgcgcaaccgttctttttccctgctgtggaagcgggcgcccgttatttcgaaaggaagatgaaccggcgatga

SEQ ID NO: 1386 - DNA, 414 bp, Bacillus licheniformis
atgattattcaaaataaactagcttcctggaaccttcaaaaagcgatatacaacaggttatcgacggatgcggcgcttaatgaagtgataaagggcgtttttgacaatccgaataaagacacacctttcccgtatgtgtccatcggggaagacacgtcaacgccattcgaaaccaaagtgacatttggcgaaaacatcacaactgttatacatgcgtggagccgggcagaggacggcaggcgcgaggcaaaggaaatcctttctctcgtcatgcaggccctgacaaaagaacctttagaggtggaggggttcaaaccccttcaactcagttttttgcaatcacaagtgatcacggatattgacgggatcacacaacacggaattttgagaatccgaatttatatcaataattaa

SEQ ID NO: 1387 - DNA, 546 bp, Bacillus licheniformis
atggcggtatcaggtaaaccgactaccggtaaaagtatcatttatattgtacaagctgcaaatgcgccacttggatcagatgcgttaatcgtagggaaccagacagaaggaacatggacaagggaacaagaaacggttgacgagcaaacaaaactaggccgtatcgttggatacggggcgaaaagtgagacattcgaactttctttatacgcacaacgaaaagatggcggacaagaagccttagaatggacttatgataatgaatccgagttgaaagtttggcgtgtagacaccagccaaaagaacgacaacggaaaatatgattgccgtttcggctggacgattatcgaaaacattgagtttagtgagccgacagacggattcgtcgaagcaagtacatcattgccggttcttgttcgtacagtgccgggagaaattgaattgccagacgactttatccaatcagctaatgaaattctattcgaaaaaccgggcgagactacaggcggattcgagaaaagaaagcagcccacttctactccctga

SEQ ID NO: 1388 - DNA, 339 bp, Bacillus licheniformis
atgaaattctattcgaaaaaccgggcgagactacaggcggattcgagaaaagaaagcagcccacttctactccctgaggcgccccaaaatctacagtatacagctacaactaatagcgtgaccgtggattggaaggctgtagatggggcgacttcatacaaggtatacaggggatcggaaaaagtattctacaaagaagtgacagaaccaaaatgcacgctcacagacattacgccggatactaagctcacagtgaatgtgacggccgttaacgaggtgggagaatcgcctatgagtcagatagaaacacgtacagagccagaaacaagtggctcataa

SEQ ID NO: 1389 - DNA, 498 bp, Bacillus licheniformis
atgccaacattagaaatcgaaggaaaacaatatgaagcacgctgtgatttcaaattcgaaaggacagcggaagaaaaatataacgaaaaagacgagagcggaaacaaacaaggcggcttacgaaatgtatatctcggcctacttgagcaacgcagttcactttacttaatccggttctgggattgtgcactttctcacttgaaagataaaaagccatctgttgaaaaaatcgaagaagcgctcgcgaaagttattgaggatgaaggcgcaaaaggtgccgaaagactttacaaagaagcgtttcaggcggtggatcaatccggttttttcgcagttcaagtaaagagaatctggcaagacttcgacgttctcaagaaggagatcaaacagagagtcggggagacggaagcggaattcctgaaacggaagcaggagcgcgaggacgccaaggaaatgatggcggaactcgaaaaactaaggaaagagatgaacaagtaa

SEQ ID NO: 1390 - DNA, 189 bp, Bacillus licheniformis
ttgaataaaaaagggcgtgtgacccctaaaaagatgtttgacgctgacaaagcccggaagatggtggccaacgaggaagacggctggcgcaatgcgcggagccttggcgttaaccctaatgccctaaaacgcgcgacagatgcccttaaaacgatcacccttccggatttcaataagaaagggggttaa

SEQ ID NO: 1391 - DNA, 3063 bp, Bacillus licheniformis
atgatcgaacgcctcacagcgattgtcgatgcggaaataggcaaatttaagcgcaaaatgggcgaagttaaggcgttagcccgaagcatcccgaatagaatcagcgtaactgttaaagaaaattttaaagaggccgagcggcggctgggcgttttcgaaaacaggatggcgcggcttagcagggtgataaacgactttcagactgtgtttggaaacgcctttagcggcatgaaaatgtcgatattcccggctcttgtgccggcgatagcgtcattaacggcggctttggggtcattagggccggtcatcggcgtggcttccggcggccttatggggctagcgagttcattcgggacagcggcggcaggtgccggagcgtttggagctttagccatttccaatattagcggggttttcaaagcgtcttccgacctggcgaagctccagcaaaagctggacgaaacaacagacctgaaagagcgtgccaagatcatggagaagatcaaggcgattcaggaaagtcttggcgcagaagaacggaaggcgctcgacaccttggaggacttcaaagcaaactggcgcgagatagctcaagaaacgcaaaaaccgatcttgaagacattcacaaactctttgaatagcttcaaatccgttcttaacacactgcggccgatgtttaaatctgtcgcggcggctggccttgaactatccgagagcttccaaaagtctttgaatgctcccgatgtacagaagtttttcgattatatgaataaaaacgcaggcccgcaattcgccacgacagtaaaaacgatggggaactacttgcgcggctttttgaatttgctggttgcttttggaccattggggcaacaaatgtcacaaagtatgttgaaatcgtccgaagcattcgcgaaatggacggcaagtctctcaggctcagataaatttaagtcgtttatccaatacgttcagcaaaacggccctaagctgctgacgatccttaaaaacatcggatcgggattaatcggaatgtttacagcgttcgcgccgatgagtgcggacatgctgaccggtcttgtaaatcttacagcgcgctttaaagaatggggaaacagcctgagcgaatcgaaaggcttccaagaatttatcaattacgtgcgacaaaacacaccgacagtgctgtcactgatcgggcaactaagggacttgattgttaacttaggtgtcggcatggctccgttgggttcgcaaatcctgcaaatggtcacagggttcttgaaattcactaattcgatgatggaaacaaaccctattatcggtcaaatgatcggttatctcattacattcggcggcctgttcagagcgttaacgcctttaactgtcgctttttcagcagcttttaaatggaaagatgcaataagcacggtgaaaaaattagggacggcgataaagtggattggctcagtcattgggatggtcggaaaagcatttttgaccaatcctattttaatggttgtggcagccattgcggcagcggcttatctgatcatcacgaactggaaaccgatatccgagttctttgtgaatttgtgggaaggaatcaaaacaaacgcgatagcggcgtggaattcaatatctgagttcttttccggcctttggtctggaatagtcgaacttgcgtcaacagcatggggcagcctgacgtcgttcttctcaagattatggtcaggaatcaccacgacagcacaagcagcatggactggattcatgaatttagtaaagccaatttgggacggaattgtcgcggttttcggcccgacttttaacgtcatagtcacaacgttgtcaaacatctggaacacggtatctagcacggtatcgtccgtgtggaatacgatcaaaacaacgctgatcggcgtcgtcacgagcattgtggacggtgtgaaaaatcatttttcgattttgtcccaaactctttccggcatctggaacggaattactagcatcgcaaaaggcgcatggcaagtcttaaaaaatgcgatcctcggcccggttctgcttgtcatcgaccttgtgcaaggcgattttaaaggattcgcaaaccatttaaagcaaatctggacaaacatcagcaacggggcaaagcaaatctggaacgggatcaaaacggttgtgtcatcactcgttaaaggtttagtcaacgctgttaaaaattattggaatacagccaagactgtaacgacaacaatctttaacgggatcaaaagcgtccttagctcaatctggaacggtataaaaaataccgtggtgaatctcgccaaagggctgtggaacgcagtcaaaaccacttggaacacgttcaagactgtaacgacaaccatttttaatgcagtcaaaaccgtcctgacaaccgtctggaatgcggcgaagtcagtcgtcataaatgcggcaaaaaacatctggtcgagcgtcaggaataacttcaacaacatgaagaatgttgttacaaccgtcatgaagaatgtcaaaaccacgatccaaaacctttggaataacgccgttaaattcttgaaggggatcgatctgaaacagatcggaaagaacatcattcaaggattgattaacggtatcggaagtatggcaaatgccgtctggcggaaagtcggcgacatcgcggacggggttaagaagaaaatcaccggattactcaacattcactcgccatcacgatggatgcgcgatcatgtcggaaaaatgattccggctggtgtggctgttggtatcgataaagcgggcggccttgtagaaaaagctactcagaaactggcgcagctcaccatgtttacgccagatcaaacgacattcgcctatgacacagccctcagcagtggcacattaaacgatgtccgcggtcagatcgaggcagaggtcagtgatttcgaaatttcagaccgtccgatcattattgaaatggacggccgagaagtcggtcggggcacgtacaaatacgtgaaagagttccagagccgtgaagacggaaggaggacgaccataaaccgatga

SEQ ID NO: 1392 - DNA, 804 bp, Bacillus licheniformis
atgatcgattacaaaaagatactgacaacggcaatagatgacgcattcggccaaacgattcaagaagtagactattggatcaaattcaacggttacaccctgacggatcactttttcgtgatcaacgacagggggcgcggcattgttggcagggaactgaatttagtttccttgccgggtgtcgatggcgctaaattaaagggcgtaagatacacggaacgcactatcgagattgacaccttatttatagcggccaacgatgcggaattacgaaagatattagaagaaataaattatatccttgcgacagacaaggaagaagcgttgatcttttcagatgagccagaccgaacatattacgccgtattcagtacagcgcaagagagtgaagggcaaaacggcgtctataaagtgacactgacatttgtatgcccgaaccccgaaaaggaagcggctgaaacggttgtcacaactgaaacaaatagccctacagtggtaaaaaacgatgggaaaagggcggttacaccgactattacatgcgttttcgagtcggacgcatctacctatgaaattcagttgttgaaagaagacgaaacaatcgaaaagcggataaaagtaaatttcaacttcattaaaggggacacccttgtaattgattttgaaaagagaaaagtgatcatcaacggcaaagtaaacatgaatgcgctgcttatgctctcaagatggtttaatatcccggtcggagaaatcaccgtgaacacaacacacaaaagcagtatttcatttaacaaggcgtatatgtaa

SEQ ID NO: 1393 - DNA, 3519 bp, Bacillus licheniformis
atggccgatatgtggattttggacgacaaggacaaaaaacaaacaatcatatcaagcgaagcaaaagaagcatgtcgtttctatgatgcgccatttcgagaagaactgaatgtcggttcttctttttcttttgtcgcggacgcagatcacgaggatagcgttcatataaaaccggagaatcaggtcgttttcgaggacaggagaggaagaaaacgcaatttcgttataaaagagctggaagacgccgacgacggcgcgaatgcccgcattagggcctattgtgagccggcactgtcagagctatacgatgagtttgtgaccgacatcaggccgcaaaatagaacagcccagtacgttcttgaccgtattcttgagggtacaaggtggcgcgcgaatgttccggtcgatcttggcttgcattcaacgaatttttatcgcatcagtgtcatggaagccatcaaccagatattgcagatatggggcggcgagtattatgacgaagttgttttcgatgaaaatgacaatatcgttgatcgagtgatccatattctgccccgacgcggccaagataccgggaagcgtgcggaaatcgataaagacattcaggaaatcaccagaacggtactgagttacccggtaacagccctgtacggttacggcgcaagccttgaaaccgaaggcggcggcaacacccgttatattgatttctcggatgtcgaatgggtcaaagcgaacggcgacccggtagacaaaccaaaagggcaagaatgggtcggcgatcctgaccttttggagaagttcggccgaataatgtatgacggtcagacgaagcggcaccggttccagaaatggcaagacgacagcatcgaagacccggccgaattgcttagaaaaacatatgaagcgcttatcaatcatgaaatggtgcaagtcaattattctctaaagctggaactgcttgaatacatttcgggttatgagcatgaggcggttgatcttggcgatacaatgatcgcaattgacgacaattttcgacaccctatcgaggttcaaactagagtcattgcaatagaatacgatctatctgatcccgtgaatacggcacaggtagaaatggggcaatttttagacctgtattcaaccgaaaagcggatcaaagagcttgaaacgacaattgacacgaatcgcggcaaatgggacaacggcggcgacccgataatcggcgacgggagctttcctgataaagtgccgcctgttccgtcaaatattaaagtcgaatccttattccaaggggtttcgatcacatgggactataatccaagttcatatatagcggcatatcagattttcgcatcgccgaataaaggatttacgcctttggatgaaaatttgattttcagcggtaaattaagcggatacgagcatacgccgggcgttgatcaagtttggtattatcgaatgcgaacgatcaatacacacggcacgccaagcccatttacgcaagagttcacaggcgttaccagaaggattttgactgatgacatcgttttcggggcggttacggccgaaaaacttgccaatctatcagtcacggccgaaaaactttcacagaaattcgatgaatccaacattttgccgggttcagtattgcgtccgggtgaattaggtaacgtcaacggtgcatcatggagcgtgaaagaaggggaattcaacgaagtaactgtcactagaaaagcggacgatacgcgggccgggtttggttttagtgctttctatagatcaaccctgaggctgactaagggtgaaaaatatacattatcattcgaggttaaaaggaataacactcttaatatcaattttatttatttaaaagatgacagtggacaatatcaattggatgcacccgattttaacgacattagctctttcccttccgatgaatttgtaagggttgactatgtttttcagtcaccgatcacaaccgaaacagcccggctgtggttaggaggtaataaagtcggagacgaaaacccttccgtcacctatagaaaaattcaaattcgaaaaggcgatgtaagaaaagaattcgccttcagtccatacgacgtgatgctgactgaacaagcagtttcatcggccttaattgcgaaagcggccatccaatcggcccacatccaagaggcggccattacgacggcggccatcgcaaacggagccattacacgagcaaagctgggaacggctatcattggaacggctcagatcgaagacggggccatcacaaacgcgaaaatcgccaacctttcagccgacaagatcaacgccgggacgatcaaggggattacaattgaaggttcattgattcggggggctagaatcgagccgttatcgtcatccagtgcttacgaatcttacattgaagcaaacaagatttaccagcttagaaaaactagatatggtggttatcaagatcgatatgaagaactcgatatatcctccggtagtatcattcaagattatggcaataggcttgatgatgattcgcacgaatctttgaacaaagttgagatttcaaaagggaaagttgctctttcaagcgggaaaacattttctactggcactacatccagaatggaaatattctctcaacttgggactagcgataacggactgtacggcggcaattttatcactatgtatagaaatgacgaaaaagttttcgaacttcgacaggatagttggacagaccctgacactaatgtaatcatgccgcaaatgtcaatcagagcggagaaagtggatttcgtttcattctttgaagacgtttccgtttatagtgaaaagagtatataccattctgcagaaagaagtgtcgccttattttccaaagatggtccggtaactgtctacgcaaaggacggcatgaaacttaataggggaagcaacggcgaatatacaacatcgataactgctgatgatgctttaaagatcgcatctaaaggaacaatcacgctggaagatacagaatttaacggcgcaagtttatatcttggaacagacagcagaggcccgcgtatttggtcgtattcaattaataaaagaacaaccacagcggcggcaaacctccatatggaccagtacggaacctttcataaggtgacatcatcccaaaaatacaaaattaacatagaggaatttccgaacgatagagtggaaaatattttaaaactaaatcctaaaacatggtttgataaaaaagctgtggaagcatatgcagaaattttagagagcggacaagaagatgacgaaaacaagccatatttcgagcgaatcccgggattaattgccgaagaggtattcgaagccggtctaaaagaatttgtttttttcggaaagccggacgaaaacggaaaccgtgaaattgaaggaattatgtatgatcggctgttcgctttactcatccctattgtcagagacctgaaaacccggatcgaaaatatagaaagcacgttaaattaa

SEQ ID NO: 1394 - DNA, 294 bp, Bacillus licheniformis
gtgagaacgggaggattaaggggcatggcgcaaacaaacgaattggacgtcttcaagcatgagattaccgagctgaaagccgatcataaaacgcttgaacagcgagtcatcacgttggaaagggcgtctgatcggcatgaccaacagattatgtcgatcaatgataagctcaacaagattgaggaaaacacaacttggatcaagcgcagcataacaggcgcgatcatcacagcggtgtgtacactggtgatctccgggattgcggcgcttttcattaattttattcaaaaataa

SEQ ID NO: 1395 - DNA, 264 bp, Bacillus licheniformis
atgacaacattcgacaaaggcacggtcgtccggacggtgcttctttttattgcattggtaaaccagacattgatcatgttcggaaaagcagctttgcctatcagcgaggaccaggtgaatacgttggccgacgctttgtatttggccggttccacggcattcaccatcattacgtctgtggtcgcttggttcaaaaataactatgtcactggcaaaggaaagcagcaaaaagaagttctaaaacaaaaagggttaacgaaatga

SEQ ID NO: 1396 - DNA, 954 bp, Bacillus licheniformis
atgggaatcaaaggaatcgacgtatcacactggcaaggtaatatcaattggaagaaagttgcgggggacggtattaaattcgcttttatcaaagcaacagaagggacaacattacaggacaataaatttgtaacgaatatttcaggtgctaacgctgtggggattaaaacgggagcctaccactttgcaagattcggttccaagtcagaagcattggcagaggccaggttctttttgtcagttgcaaataaggtccatctcacgtatccgcttgtgcttgatcttgaagttaatcagcggaatgtcagtaaatcagttttgacagatgcagcagtggcctttttacgggaagttgaaaaagctggttacttcgccatgatatacagcggtaagtctttccttgagaattgccttgacgaatccaagctgaagccatttgcattatgggttgctcgttataacaacacacttggccgtcatgcagatatctggcagtattctgattgtggaagggtcgccggtatttctgggaatgttgatatgaatatttgttatcgtgacgggttacgggctcaggtagccgtgacaactgaaaaagctgctactgtaaaacctgtttcaaacaaaaagccagttaaaacggagacagtttacacagtcaaaaaaggggacacgctttcggaaatcgcacagaaaaacaacacgaccgttaaagctctccaaaatttgaataacattaaagatgcgaataagatttacgttggccagaaattaaagattagcggcagtccttcaacagcatcgaataaaaagcaatattacaccattaaatccggtgacactttgtctgggatctcgaaaaggtttaatacatccattaagacgctgcaagcttggaatggtatcaagaatgccaacaagatttacgctggtcagaaaattcgtgttagataa

SEQ ID NO: 1397 - DNA, 594 bp, Bacillus licheniformis
atgtattatgttcctcatatgtatccatatcaatattcttatccttattatgttaatgtgccaatgtacaactgtagaagacagtcagttcaccggactgttcctagtgaagtagagcatgcaaacaaattaagttctgttcgctcatccaaaggtagtaacagcattttgttaaaggattatggaccagaagcgtttgtggttaatatcaatgaagctacgaagcaaaataatacgtaccgtaccgctttatggacaggaactcatttgcaagtcaccttaatgagtctcaatgttggagaagatattggtttggaaatgcaccctaacgttgatcaattcttacgtgttgaacaaggtcagggaatcgttcaaatgggcaagaataaagaccatttaaatttcaaaagaaatgtctatgatgattctgcaatcataatacccgctggaacatggcacaatctaaccaatacaggtagaatcccgctaaaactatactccatatatgctcctcctaaccatccatttggtactgttcatgttactaaaggagatgcattagcttcagaagaagaatacggtcatggcaattga

SEQ ID NO: 1398 - DNA, 906 bp, Bacillus licheniformis
gtgtacccttatcctgtttataatccttatataaggaatagtgatgattttcgtatgcctcccgacagaaaactaattaatgacattcacaaggcaattaacggagagcatagcgccattctctgctataagcaaatagccgaaaatgcccccacagaagatataagaaaacaaatacttgaaattagacaagatgagcaacgacattttgaagagtttagcagaattttcactaacctgacaggcaaaaagccaatccccataatcatagaagaatgccctaaaaagtatagaacaagtctagagtctgcttttaaagatgagcaggagacagtcgatttttatttagatttagcagaccgaatacaaaatcagtcaattaaaaaggtttttcagcgtgcagcagctgatgaacaaaatcatgctgtatggttcttattttttttaaatacatcgtctacacaacaaacacgtcaagttaattatggggcaaaaggagcgttaaattccggtaggctcaccttacctcaaatgcttacctttgccattcaggatgagtacttagctcaagcaagatacaatgaaattctaagaaacttcggggatattcgaacctttgtccaaattaaagaagccgaattacggcatatcaatgcattactttctctttttgaacgataccaagtacagatacctaaagacacctctcaattatatgtcactacaccagtaacccttaaggatgcatatgcttctggggtacaaggagaaattgataatatcgccatgtataacaagtttctaacttttgatcttccagcagatgcaagaacagtttttactcaattacgcaacgcatcactaaatcatttagaggctttccgaagaggtcttgagagaaattaa

SEQ ID NO: 1399 - DNA, 711 bp, Bacillus licheniformis
atgagtgaacatattgaagtaatccttcgatcgattcttgcctttggtattttattggtaggatcaagattgttgggaaaacaaacaatttcacaaatgaatatctttgattttattgcatcaattacattaggcgctattactgcaaatctggcttttaatacctctcttaaaattcatcacatggtactggctttttttatatttgtttttgtgatcttagccactgcgtatatatccctttggagtcaaaaaggccgcaaattttttgccggtgatccaactgttgtgattcaaaatggaaaagttcttgaacacaacatgcgaaaaatgcgttatacaattgattatttgaatcaacaacttagagaaaagaatgtattcaaaatcgaagaagtactctatgccattgttgaaacaaatgggaccttaacagtattaaaaaaaccacaattccgaaatgtgacaaaaaaggatttgtgggttgccactacgccagaaggaaaactcccgattgaattaatcatggatgggaaaatgaagaatgaaaacttgaaagataatcaactcactcaggcatggttacaatctgagatgaaaaagcgtggtctatccacagatgaagttttttatgcagtattatcacctgatggaaatatctatatagatacatatgaagatcatatacattcttcttttgataaagaataa

SEQ ID NO: 1400 - DNA, 333 bp, Bacillus licheniformis
atgacagtcgaagatctttcttataaagataaaaaagtgatttcaattggcattgtcagcgagctgacgggtctgtcggtcaggcagatccgctattacgaagaacgcaagctgatctatccgcagcgctctacaagaggcacgcgcaaatattcctttgctgacgtcgaacggctgatggaaatcgcaaacaagcgggaagacggtgttcagaccgcagaaatcctcaaagatatgcgcaaaaaagaacaaaggctaaaaaacgaccagcagctcagaaagaaaatgctcgaaggccagcttaacgctcattttaaatacaaaaaccgttaa

SEQ ID NO: 1401 - DNA, 156 bp, Bacillus licheniformis
atgaaggaacacaaagcagtcttactcgccaaagaaatcgttgccttagacaataagagagacgaattgctcgagacattgatgaaccttgccggcaaggatgcgtttccgctgctgagggcggtgcagaacggcttttatcaaaagtcctcttaa

SEQ ID NO: 1402 - DNA, 180 bp, Bacillus licheniformis
atgagcagattgttaaaaaacgctttggaaaaggaaagaaaccattacttgaaaaaactgatctcactcggtgagcataatcgggaagttttgcagaggatgacgattacggagctcagaaatgaatatttttattttttccggaaaaataaagcccgtgttcaaaatcggccattttga

SEQ ID NO: 1403 - DNA, 462 bp, Bacillus licheniformis
atgagactttcgtttaatgaggaagaagttcaccgtgctatgtcgctgtacaaggtttttgccagggcttttaaaagcgtttcagaacatagtattcgggacagcaaggaacacggctttaatcctacagaatttgctgtattggagcttttgtatacgaggggagcccaaaagctgcagcaaatcggctcgaggctgctccttgtaagcgggaacgtaacctatgtgatcgacaaactggaaaaaaacggtttcatcaaacgagagcaggacccgaaagataaacggtctgtctatgcgaatttgacggagaagggaaaggcatatctcgatgagatttatccgatccactccctgagaattgcgagggctttttcaggcttgacaaaggaggaacaggagcagctgatggtccttctgaaaaaagccggaatccacagccagcacctattgtttcgctga

SEQ ID NO: 1404 - DNA, 1851 bp, Bacillus licheniformis
atgggaattacgatgcagcctgtattgactacatcagctccctcaggcggcaattggcggtatgaagtcaaatatgacgggtatcggggtcttttaaagattgctgcgaccggcgaagtttcgctcatcagcagaaactcacagccgctcgaaaacacatttccggaaatttcggaatttgcaaaaagcatgatcgaaactctcaaagaacacttgccgatcacgattgacggggaaattgtgtcgttgacaaaccgttttcgttcccgatttgaatatgtccaaaaaaggggtttgagcaaaaaggccgagttgattgcacaagcagccgcaaagaaaccgtgccagtacttggcttttgatttactggtttttaacggagaaagtttaacctcgctcccctataccgaacgaaaacgcatgcttttcgacctgatgaaagagctcggcctgccgatggctcccgatccgatggctcacgctcgaattcaatacatccctgacacttctgatttccacgacctttggaaggctgttaaaaggtttgacggcgagggaattgtcgcgaagaaaaaagacagccgctgggctgaaaataaaaaaacggccgaatggctcaaactcaaaaactacaaaaaagctgctgtatttatgacaggctacaacatggcaaaccgttatttgacaatcgccgtctatgaccgcggccaaatcaaggaagtcggttcggtttcccacggactcggagaacaggaaagaaacgccattctttcgatcgtcaagcaatacggaaccgaaacaaaacccggtgaatataccattgatccgtcgatttgcatgacggtccattacttaacgattcattacgggacattgcgcgaggtgtcgtttgtttcatttgaatttgacatggcatgggaaaattgcacttacaaccgcctgctgcttcattcaagaaacgtccatcccgatttgcagctgacaagccttgataaagtcatctttcctaaaagcgataaaacaaaagcggattacatcggataccttaatgaaatcggcgattttctgcttccgtttctcgacaatcgggcgcttaccgttatccgttatccgcacggttccggcggagagtctttttttcaaaaaaacaagcccgactacgcacccgaatttatcacgtccattcgggatgacgagcacgagcatatcatctgcagcgattattcggttctgctgtggcttgccaatcagcttgcgttggagttccatatcccttttcaaacggtggatacggcccatccgaccgaaatcgttttcgatcttgatccgccttcaaagtcggagtttccgctggccgtcagagccgcgaaagagctgcaccgtttatttgatcagctcggcctcttatcttttccaaagctgtcgggaaataaagggatacaaatctatattccgatttcaaaaaacgcctttacttatgaagaaacccgccttttcacaagctttgcggcttcttattgcgtctcgctttttcccgatctgttcacaaccgaacgcctgatcaaaaacaggggcggaaagctctatattgactatgtgcagcatgccccgggaaaaacgatcatctgcccgtattccacaagaggcaatgagcttggcacagtggccgcaccgctgttttgggatgaagtccattcagacttgtcacccttaaattttacgatggaggctgtcgtcaaacgcacaaaggaactcggatgccctttcgaaagcttcttcagacagccccaggacaaacagatcaaagctattctcgatcacttaaaagaaaacaaccgttcggaaaactga

SEQ ID NO: 1405 - DNA, 864 bp, Bacillus licheniformis
atgtggaaaggctctatcagctttggccttgtcaatatccccattaaactgtttgcagcgacagaggataaggatattaaattaaggtcgcttcataaagaatgccgcgccccgattcagtatgaaaaaaagtgcacaaactgccatcaggaaatcgcgcccgacgacatcgtcaagggctacgaatatgttaaaggcaaatacgtcgtcttatcggacgatgagctgaagcagctcaaagaagagcaggaagacaaggccgtcgaaattgttgattttgtgcagctaaaggaaatcgatcccatctatttcaaccgttcatatttcgtcggaccgggagataacggtgtaaaagcgtactcacttttgcgcgaagcgctcagaaaaacagaaaagatcgggatcgcccatatgaccatccgctcaaaaaaacagctcgccattcttcgcgtctacgaaaactgcattttaatggagtccatccactaccctgatgaggtccgaaacgcagcccacgtacccggtgttccggaagaaaccgcagtcaacgaaaaagagctgcaaaccgcgatttcattaatagacgagctgacaacgacatttgcgcctgaacaatatgaagatacgtacagaatcgcgctgatggataaaatcaaagagaaaatcgaccataatgaaggtgtcacgccaaatgccggggccgccgctccgcgcgaggatgtaatcgatctcgtgagcgctctccaagccagcatcgaacggacaaaagggcctgaccgggaagcggcgaaagcgcctgcagcaaaaggaacagctgagaaaaagaaaaaaacgtcgcgcaaaaaagcttcagaggcaaaataa

SEQ ID NO: 1406 - DNA, 1653 bp, Bacillus licheniformis
gtgacagaagttcttggtgaatataatggatggctcgtcctattatcctatttcactgcagttttggcagcttatacagcccttgatttatctgaacgggtcgtacatacaaaaggcaggaaaaatatcggatggcttttggccggttccctcacgatggggcttggcatctggtctatgcactttatcgggatggtgtcatttcagacagcagaagaaatgaaatacgatttgaaattcgtcttgttgtcgattgttgccgctttcgcaggctcgctcatctcattttatgtggtgaatgaaaaaaaaccgacgaatggaagactggcggccgggtcccttgcaatgggatgcgcaattgcctccatgcattttatcgggatggaagcaatggaaaatatgacaatcgtctatcatcccgttctttatgccgcctcttttgcaatcgccatttttgcctccttcgctgccttaaaactgtcagttgtattcgccaaaaaaaccggttcttttcggatattgttcattaaaatcggaagcgcgcttttaatgggcggagcgatttccggcatgcactatacaggaatgtcagcagctacgcttttcatggctgacagcgttgacacaggctatgaaggaatcgataccgttgaactgggcattatgatcgtgcttgtcagcctgatgcttcaatgcttcttgattttcggcgccttcaatgacaaacgcctgctgcttcatatcgaaaaagtcaaagataacgaggagcggttccagtccttgatcaaccacaacattgatccgatctatgttttttcgcttgaaggcaagctgctttccgccaattcatcgggatacagccttcttgaaaaaatgggaattgaacccgagcgcctgtcttccgtttttcggcaggaggatcatgacaggctgctcggctggttccttcaagtccaaaatgaaaaacaggccatcaaccgcgatacggcaatcgcgatagctgaaaagcgctttgatttaaatgtgacgctgataccggtgtatgtcagaaagcagcttgacagcatttatgtcatatgcaaagatatgacaaaccagcgtgaagcagaacgcaaaatccatagaatggcccactatgacgcgttgacggatttgccaaacagaaggtatgcagtcgaccgtctggcaaatgttctaaagcggcaggagacagggacggccgtgttgtttttggatttaaaccgtttcaaagtgtttaatgacgccctaggccacgacgtcggggacctgctgctggtggctgctgcacagcgtttggcgcactgtgtgcccaatgaaggctttatcgcccggctgggcggcgatgaatttatcattgtcgctcctttacaagggatcgatcagctgaccaggcaattgatcagtcagtttgaaacgccttttcgcattaaagagcatcgcctcaaaacatccgtcagcatcggaatcgccgtttctccggacgatggaacagacggcgatgagctgatgagaaaagccgacatggctatgtacgccgcaaagcacaagagcgtaagcagatatcggtacttctcgtcttccctcgccagaaagaacagaccgtctttccagaaggaaatcgagctgaactaa

SEQ ID NO: 1407 - DNA, 612 bp, Bacillus licheniformis
atggctgaggcatttaaaagcctctcgtatttaggcattttcctggcgctgtgcatcgaattcgtgccggctgagatcgttctgccgcttgccggatactgggtgtatcaaggagatatgtcgatgttcggggtcgttgcagcaggttcactgggaggtgtcgcaggccctctgacgctttactggctcgggaggtacggggggcggccgtttttggaacgctacggcaaatacttctttatcaagcctgaagcgcttgaaaaatcggacaggttttttgaaaagcacggcgggtttgtcgcattcagcggccgttttatacctggaatcagaacgctgatttccattccgtgcggactcgcgaaaatgaatgtgtgggtattttgtatttatacattcctcgcgatcacgccgattacgttcgtctatgtctatttaggcttttacctcggcgaaaactggagcaaggtcggcagcctattggacggataccttcttccggtcggcatcgggttcatcgttttgttcgttctttacctttggttgaagggcaggcggaacaaaatcaaatcgcaaagcgtttcagcctttataaataaaaataaggattga

SEQ ID NO: 1408 - DNA, 768 bp, Bacillus licheniformis
atggatgcagcattattacttgaatatggttgggttcttctcatcctagtcgggctggaaggcattttggccgcggacaatgccctcgtcatggcggtcatggttaaacacttgcctgaaaaagacagaaaaaaagcgctcttctacgggttggccggcgcgtttgtgatgaggttcggcgctttgtttgcgatctctttccttgtcaatgtctggcagttgcaggcgatcggcgccgtttatctgctttacatttccgtccatcatattttgaaaacccacgttttcaaaaaggacgaaaaagtgaaggagacgaagcaaagcggtttttggccgacggttatcaaagttgaactggcagacatcgcttttgccgtcgactcgattttagctgcggttgcgctggctgtcacacttccggcgacaaacctgccgcaaatcggcgggcttgacggcggacagttcatggtaattttagccggcgggatcatcggattgattattatgcgctttgctgcaagtcaatttgtgaacttgttaaagaaacgtccgagcctggaaacggctgcttttctgattgtcggctgggttggtgtgaaactgacgctctatacgctcgcacacccgcaaatcaatatcgtctctgaacattttattcattcaggtacttggaagttcatcttctgggcggtgctgatcgccattgcgctcgggggatggtttatgacaaatccgaacaaacacgagaataaagctgctgaggagtaa

SEQ ID NO: 1409 - DNA, 756 bp, Bacillus licheniformis
gtgaaaccagtgcttagccttttgtttaagacaggaaaaaggaaacaatcattagaagagtctgtaataagcatacaaaaaggaaatcagcagttgcaaaacgagcttatcgatcaatataagccttttgtggctaaaacggtttcatccgtgtgcaaacgatatatagatgaaaaagatgatgaattcagcatcggcttgattgcattcaatgaagccattgaaaaatattcttcagataaaggaaattctctgcttgcatttgcagagctgatcattaagcgcaaagtcattgattatatcagaaaagaagcgagaaatgcccagaacatcaatatggacatgcaagaaggagaagaacaggaatcctcccaaagcatgattgaagcggagctttccattcatgaattcaaccgcatgctcgaacaggagcaaaggcgggaggagattctccattttaaagaaaggcttaaaagttttggcctgtctttttccgatttgctggagcattccccgaaacatacggatgcaaggcaaaacgccatcaaagtggcatatacgcttgtcgaacatgaagaattaaaaaagatcttgtttgaaaagaagcagcttcccgtcaaacagcttgaaaagcttgtggctgtcagcagaaaaaccgtagagagaaaccgcaaatatatcatcgctatggcgatcattataacgggcgattatgtttaccttaaagattatctaaaaggggtgctcaattcatga

SEQ ID NO: 1410 - DNA, 1098 bp, Bacillus licheniformis
atgagaagaggaattattgtagaaaaaaataaaaaattcgtcacattgctaacccctgacggacaatttttaaaagcaaagagcacagaggaagattatgaaatcggtcaggaaattgcttttcccgcggagacgagaatgtcgagaaggcgtgcgggcttttttgatctgctttcgctccgtccgctgaaagccggcgttttttcaatcgccgcgatcatgctgctcgctttcatgatcatccctgatgttttaaacaataaagcatacgcctacatgacgatcgatatcaacccaagctttgaattgacgctcaacaaaaactgtgaagttatcgatttggtgccgctgaacgaggatgggaaggccttaatggatagtataaaaaattgggaaaagtctgactttaaagaagtgatcagtgaaattgtcgaagacagcgataagagcggttatgtcaccgaatcaaaagaagtgcttatcgccacagtatacgaaaacaatgaagatgacacgtataaggcgacggtaaaaagcgaaatcgatgatgtagcgaaaaaatacgagcagcagaattataagatggaagcggtggaatcagaccttgatacgcgtgcaaaagcccaaaaagaaggcatctcaacaggccgttatatccgttcccacaaagatgaattagaagacaaaaacaaagatgatgacaatgaaaataaaaaagatgatcaaaatcaggaagaaaacacaggagaaaaggagaaagctgtgaaagaagaagatcagccggaacagcatacggatgataaagaagcagatacggaagatcatccggacggcgaaaaaccttcagatgaagatcagtctcaacctgatcaagaaatggaaaaagaaaaggagtcaaattccctaataccaaaaaccctcaggaacataaccataatgacaaagacggtcagcagacggaggaaggaacgccaaaaagcggttccggttcaaatcaagagagctctaaatcacctccttaccaaaaggagaaaaagccttctgaccaaacgaataaacaagaatatccgccgagcgggcccggcgaataatccatag

SEQ ID NO: 1411 - DNA, 198 bp, Bacillus licheniformis
atggcaagaacgaataagctcctcgttcccggggcagagcaggttttagaccagttcaaatacgaaatcgcccaagagttcggcgtccagctcggctcggactcggtcgctcgctcaaacggatctgtaggcggggaaatgacaaaacgacttgtacagcaggcacaagctcaattgaatgggcataatgacaaataa

SEQ ID NO: 1412 - DNA, 720 bp, Bacillus licheniformis
atgaaaccttttaaactgactcgcctggaaatggccaaactgatgtacgctttaaaagggcagctggatgtcagtccgctagcgattcttttgagatcggccgatttggcgcccgatgagccggaagacaatttggacatccccgaattcattgcccggtacgaacggaaaaaacaaaaaacggaacacggactttccacaaatgaaattgttgaacttggaaatttgtgcgaactgacatccttaaaatcgacagccatccaaaactggatcaaacgcgatataaaagatttgatggggcatccggaactcggcaaaaaatattccatcgaccaagccgtcatccttctcattgtacgagacttaaaatcggtttatgacttcgaaacgatccgtccgatcttaacaacgatttttaatacgattacagaccgctccgatgatgtagtgagtccgctgcgcttttatgaagggtatgcgcgggtccttgatcatgtgtaccagatcaaagactatacgctcaataaatcggcgcttgaaaaaatcgtcattgagcagactggacagctccgcgatttttataaagatctggccgatcccgaatggaacaaagcgagagacatcaccgcagtcactgtgctgtccgtcatcgcttcgcacattcaggcgaccgcacattccatgattgacagcgtcttcttaaaatatgaaatgaaataa

SEQ ID NO: 1413 - DNA, 894 bp, Bacillus licheniformis
atgggaaaaagaatctttctctttcttttatcgaacatcttagtcattacgacgatcggtatcgtgctttcgattatcggttcgctgacaggggtaggcacgtatttcacggctaacggcggcatcgatattgttgcgcttctcgtatttagtgcagttgtcggttttgtcggctcctttatgtcgctcttgatgtcaagatggatggcgaaaatggcgatgggcgttcaggtgctgaatcctgataagcaaacgctcagctatgaagaacagcagctcgttgaccgggtatataagctgtcccgcgctgccggactgacaaagatgcctgaagtcggcatctacaattcacgcgaagtgaatgcctttgcgaccgggccgtctaaaaaccgctcgcttgtcgctgtatcgacgggccttcttcaggaaatggatgacgacgcagtggaaggcgtacttgcccacgaagtggcgcatattgcaaacggcgatatggtgacgatgacgctccttcaaggaatcgtcaatacgttcgttgttttcttcgcaaggattgcggcatgggctgtttcacgcgttgtccgtgaagagctggcgccgatcgttcactttatcgcggtcatcgtattccaaattgtgttctctattctcggaagccttgtcgtgtttgcgtactcccgccaccgcgaatatcatgcggatagaggaggagcagaccttgcaggcaaggataagatgattcacgcgctccgctcgcttgagcagtacacttcaagagtcaaagaagaacaggcatctgttgcaactttaaaaatcaacgggaaaaagcatacatcgcttttctcaacacaccctgatttaagcgacagaatccgccgtctggaagcaaaataa

SEQ ID NO: 1414 - DNA, 1350 bp, Bacillus licheniformis
atgaaggttttattgagaaaactactgcgcgtgctgtctcctgtacagctgatcgcgctctattattttttagcggtgacagtttcggttgttttattgagtctgcccgttgcacacaaaaataatgttgaatggtcttttatcgacgccctttttaccgcggtgagcgcagtgagtgtaaccggtttgacggttgttgatacagccgatacattcagcacggccggaatttggattttggcgtttgttctgcaatttggcgggatcggcgtgatggctttgggtacattcgtctggctgattttcggcaagcggatcggtttgaaagagcgccgtctgattatgaccgatcaaaatcaatccaacttatcgggcctcgtcaagctgatgaagcacgtgctcggcttaatcctgctgatcgagctgtttggcgggctgattctcggcacttatttcttaaagtactttgagacacctggagaagcctttatgcacggattttttacaagcatcagtgcaacgaccaacggaggtttcgacattacaggcaactcgctgattccgtttcagcatgattatttcgttcagtttatcgtgatgatgctgatcattcttggagcgatcggttttccggtcctcatcgaggtaaaggattttctgctcagcaaagagcgtaaattctctttcagcctgtttactaaattgacatcagtaacttttttccttttagtaattggaggtgcgatcggcatatttgccatggaagcgcgctttgctttttcagggaaatcgtggcacgaggtatttttcttttctctgtttcagtcgacgacgaccaggagcggcggactcgcgacgatcgatatcagccaattcacgcatacgaccattttgtttatgtgtatgcttatgtttatcggcgcttcgccaagctctgtcggagggggcatccggacaacgacctttgccttaaacctgttggccctgttccacttcgcgaggggaaataaatcggtgaaggttttcaaaagggaactgcaccaagcggacttgatgaaatcattgattgtaacgctgatggcggttattcttgttttcgtctcgacactcattttgacagtgacagaaaagcattctttgcttgaactgctgtttgaagtgtgttcggccttcggtacgacgggcttgtcgatgggcatcaccccagatttgagcacgattggcaaaagcgtcatcatccttctgatgttcattggccgaatcggcattgtcacgctgctttatttattcggcagaaaagaaatcgaagcgaattaccattacccgaaggaaaggatcattatcggataa

SEQ ID NO: 1415 - DNA, 2001 bp, Bacillus licheniformis
atgaaaaagagagtcatccatttgtttatagccgccggatttctattgctcgccggagcctgttctaacgagccgacagcaaaagaaagcatggaccaatatgtagacaaatggaacgagcaaaaatttgaagaaatgtatgaacagctgtcggctgaagcgcaaaaatcgatttcaaaagacgatttcatcaagcgtaatcaatctatttatgaacagattggagtttccgatttgaaggtttcaaccgtcgacaacgatgaagatgaaaaaaataaagagaaaaatgattcggtgacgataccgtataaagtcagcatgaagacattggccggtccggtttcttttcaaggcaaggcaaagcttgtcaaagaaaaaaaagacggagacacttcatggaaggtcaactggaaccaatcctttattttttcacagctgaagaaaggggagaccatccggattaccgccaaggagccaactagaggcatcatttatgacagaaacggaaaggcgctcgctacgaatgcgacagtgcctgaaatcggcgtcgttccggggcagctcggagatgataaagacggtgtcatcaaaaagctcgcgaacatgcttgatatggaaaaagaagacatagaaaaacagctgtccgcaagctgggtgacggacgattcattcgttcccctgaaaaaagtgaagcctggcagcaccgagcttctcaaaaaagcgacctctctccccggggttttgaagcaggatacgcagtcaagatactatccttacggtgaaaaagccgcacatcttaccggttacatacggccgattaccgaagaggaattaaaacagaataaagaaggctacagcgagcattcactgctcggaatcgtcggtctcgaacatatttatgaaaaagagctcagaggagaaatcggctggacgatttcgatccctgaatcaggcgcgacggttgcgtcaaaggatgcaaaagacggaaaagacatccacaccacgatcgacattaagaaacaggaagaactgtacagccagttaaaagatgactccggcgctgccgttgctttagaaccgcagactggagaaacgctggcgcttgtcagcgcgccttcatatgatccgaacgggtttttgttcggctggaaaaaaggagaatgggaaaagctcaacaaagatgcgtctgcgccattcacctctaaatttaataaaacttatgctccgggttcaacgatcaaaccgatcaccgcttcaatcggtctgaaaaatgatgcgatcaaagcggatgaacctaagaagatcgaagggaaggaatggcagaaagattcgtcatggggcggatataaagtcacacgggtttccgatcgactaagcgacgtcaacttggaaaacgcgctgatcacatccgacaacatttatttcgcccagactgcccttgatacaggcaaggatcaatttgtcgaaggcctgaaatcattcggctttgaggaaaagcttgattatgaattcccgacgaagtcttcctccatatcaaacgaaggaatcgactcggatattctccttgccgattcaggatacggacaggggcaaatgctgatgtcgccgatacaccttgcggcaagctatacgcctttcttgaatgacggtaatctgatcaagccgcacctgatcaaaaaggacggcgaagagaaagaaatatggcataaaaacgtactgcccacaggcggagcagaagcgattacaaaagggttaaaaggcgttgtagaagacccgcgcggctcggcttacaagccggttgtcaaagggcttacgatcgcagggaaaacgggaacggccgaactgaaaacgaaaaaagacgaaaaaggcaaagaaaacggctggttcaccgcctatgattacaaaaacaaaaaccttttaatcacgatgatgatcgaggatgtttcagaccgcggcggcagctcatacgtcgttaataaagtgaaaaaagtgtttaaataa

SEQ ID NO: 1416 - DNA, 195 bp, Bacillus licheniformis
atggatgaaacgactaaagaaaggaatgtcattatgaaaagaaaagttgccaggaatgaagcggctcttaacaataaaacgcctgctgaaagcatgcatgatcatcaatacatgacccaatatgacgccgaaaacggagacaggggagccaaccgcaactcgaaacacgggaagcagggagaatcgcaccaatga

SEQ ID NO: 1417 - DNA, 189 bp, Bacillus licheniformis
atgaaaaaacaccaaaaaagcaaggatatgcaaaaccataaaaaaccgatgaatcccgatgtgcttcaggaggaattttcgaacgaactgggcgatgtcaacgcctttaaatttatcgatgtgatcgagaacaataaaaagaagaacaaaaaggcggacggacagaagcgggataaagataaagaatga

SEQ ID NO: 1418 - DNA, 1026 bp, Bacillus licheniformis
atggcgaattcacgcgacagctatttcgacaacgcaaaattcctattgatttttctcgtcgtcttcggacatataatcaggtcctatattcatgacaatgatgcactgcttcatatttataaatttatttacacgtttcatatgcctgcttttattctcatatcaggctattttgcaaaagggttcaatcggcccggatatgtcaaaaaaatcgcctggaagctgatcgttccctatttgattttccagggaatctatacgctgttttattcctttatcgatgatcaaagcttaactgccgcaaatccgtttgaaccgcaatggtcgctttggtttttgctgagcttgtttttttggaatctcctgttgtttccgttcacaaaactgccggcgaaatgggcgtttgccgcaagctttgcgattgccgttcttgtcgggtatatcgacatgatcagcaacacgctcagcctgtcccgcacgtttgttttctttccggtctttttggcgggctattatttgcaaaaagaccattttaaaatgctgaaaggctggaaaggaaagcaagcggctctagccgttttagcagcaacgttcgttttctacttttttgcagacttcgattactcctggctgttcggttccaagccttattcggaattcggcgatgtcgggataaaaagcgggttaaaccgggtggcgcttctcgttataacatttgcctcaaccttcgcgttcatggcgctggtgcctgaaaggcggtatttctttaccctctggggaacgcgcacattctatgtctacctgctgcacggctttatcatcaagtcgttcagaaagacgggcgcggaagaatggcttgccgattatcagagtctgacgctattgttcatcgccacggcaattttaaccttctgcttatcaagcggatttgtgaaaacggtcgcccagccgttcatcgaattaaaaatgacgaatttaataaggctgttgaaaaaagacaacggatataacccttatttaaaataa

SEQ ID NO: 1419 - DNA, 2211 bp, Bacillus licheniformis
atggaggaaactcttgatttgaatgaatccttaaatctgcaaaaccagctgaacagactgaggaaagaaaacgccaagctgaaagcggatttgtatcagtatgagctgctgtttaacgggacgctggacgctatttttatattggataaacagatgaacatcattaaggcgaatgatgccgcctgcaagatcctgcaaagccaaaaaaagaatttgctgaaccggtcggcgctcgacttcctgcacgccgttccgccggatgaactaaaccagaacattcaccgcttcttggagcggggatatgcgaaaaaagaagtggccatcaggcttgacaacggatctgtcaaatatatcgaatttaccgcaagcaaaggaatcggtgaggactgcttttttgtcgtcatgagagacatttcgtctaaaaaaatattggagcgggagcgcaccatcaatgaaaagctgtttaaagatttgtttcaccgcgcggttgaaggaatcgtcatctttgataaacaaggctgtttcatcgatgcaaaccattcgttttgccagagcttcgaaattgaaaaatcagagctctcaaaactgaagctgtctcaattcgtatcgcctgaaaacaaggggcggctcgataaaatctggaacgctcttttcagaagagggaaggcaaaaggggagcttcctgtccgcctcagatcaggagaagacaggctgtttgagctgacgataacctcgaatattttaaatggcttttacatgtcgattatgagggatattaccgaaaagcgctcaatggaaaaacagctgtttaagagcgaagaacgctttagggaagtctttgaaaatgcgatggatgccatcattctgatgaataacgacggccgcatcgtcaaagcgaaccagtcggcctgcaaaatcttcgaactgccgatggaccagctgctcaacaagaagatgactgattttatagatcgaaccgatcagcggtatcatgccattcaaaagcagtacgatcaaaaaggggaaatccgggcggaactgctgtttcgtatggcaaacggacaatataaggagcttgagttcacatcaaaacggattatgttcgacagccaggacttaaccattttgagaaatgtcagcgacagaaaacgaatggaacaagaattgcgggaaagcgaattgaagttcagaaaagtattcaacggatcaatggacggaatcgttcttttcaacaaccagtacgatattatcgatgcgaacccccttgccggaaaaattctcagcatccctcttgaacagctgaaaacgtccaatcttcttgatgtcatctccggctatcacatcgaaaacgcggcttctcccgctaaaacgatttcctttgaagaaatggacaatgatatcccattcctgctgagcgaccaaaaacggatacttgaattttcatttaagcgaaacatcattcaaaatatgaatctggcgatgctcagagacgtgacggaacgaaaagagcttgaagagcggctccgcaagtctgataccctccatgtcgtcggagaactcgcagccggaattgctcatgaaatccgcaacccgatgacggcattaaaaggatttatccagctgctgaaaggcagcatccaaaatgaggatcacgcgctttactttaatgtcatcacatcagagctcaaaaggattgaatccattattacggagtttctcatccttgcaaaaccgcaggcgattatgtatgaagaaaaaaacatcgtcaaaatcatgcaggacacaatggatctgctgcatgcgcaggcaaaccttgacaacgtccagatgcatctgaagtgcgaagacggcattccgctgatctactgcgagccgaatcagctgaagcaggtatttatcaacattttgaaaaatgcgatcgaagtaatgcccgacggaggcaatgtatatgtgtcgatcaaaccgaaaggagacgaccatatcattgtctcgcttgctgacgaaggaatcggcatgacagaagacaaattgaagaggctcggcgaacctttttacacgacaaaagaacggggcactggactcgggctgatggtcagttataaaattattgaagaacataaaggaaaaatcgaagttgaaagtgaagaagggagaggcacgacattccacctgactctcccgatcagacagcagcatgaggaggaggcttaa

SEQ ID NO: 1420 - DNA, 498 bp, Bacillus licheniformis
gtgggcttttatattgaaatgacctcgccttttggacaagcctacatcgtcgaggaaaataaccatattacacatttgctatttgaaaaagaagaactaaaacagcttcaacaagacggcctggagcttcgcccggccgaaacggaattgttgaaggaggcaaagcgccagctcgaagaatatttccagggggagcggaaaacgttcacccttcctctccgccaggatggaaccccgtttcagaaaaaggtgtgggaggcgctgcagtcgatcccgtacggtgaatcacggagctatttagacatcgcatgcgccgtcgggaatccgaaagcggtgcgcgcaatcggccaagccaataaaagaaatgcgctgccgattttgatcccgtgccaccgtgtcatcggcaaaaatcgttcattgacggggtattccggaaatgaaacggataaaaaagcggtgctgctcgacatcgaaaatattgcgtataaaggaaaataa

SEQ ID NO: 1421 - DNA, 114 bp, Bacillus licheniformis
gtgaaaacaaaccgcccgaaaaaaatagcaggatacgcggaattgttcgtcaagctgcacgttttgaccgaagagcaaaagaaagacatcatcaaatcgattaaaatccgctaa

SEQ ID NO: 1422 - DNA, 1062 bp, Bacillus licheniformis
atgccggaacaatttgcggtgccccgttctgtcgaatgggaagaaacatcggtaaaaatcctgaaccagcaaaagcttcccgaaaagacggagtacctgcatctcacaactaaagaagacatctatgatgcgatccaaacgctaaaagtgaggggagcgcctgccatcggcataacagccgccttcggactcgccctttgcgcacaaagcatcgatacatctgatgtttccgcttttctgcgggagctccgcaaaatcaaagatgaactcaatcaggcaaggccgacagccgtcaatttatcctgggccctcaatcggctgttaaaaagcgcagagggcgcaaaatcggtcaatgaggcaaaaacaaacctcgtccacgaagcgattcagatccaggttgaagacgaagaaacatgccggcagatcggacagaatgctctgcatttgttcaaatcgggcgacagcatcatgaccatctgcaacgccggctcgatcgcgacaagcaggtacggaacggccctttccccgttttaccttgccaaaacaaaggatctcgaccttcatatttacgcctgtgaaacaaggcctgttcttcagggggcgcgcctgacggcgtgggagcttatgcagggggggattgacgtgacgctgattacagacagcatggctgcccatacgatgaaggaaaagaacatttcagccgtcattgtcggagcggacaggatcgcaagaaacggagatacagccaataaaatcggaacgttcggcttggcaatcctcgccaaagcctttcaaatcccgttttttatcgctgctcccctgtcaacttttgatgtctcgatttcatgcggcgacgacattccgattgaagaacgcgatccggatgaagtcagacggataaacggaacgcaaatagcgccgcaagaggtgcctgtgttcaatcctgcttttgatatcacgccgcacgatttaatctctggaatcatcacggaaaaagggattatcacagatagatttgaagaagaaatcgaagcgctgttttccgctgaagcccttacttag

SEQ ID NO: 1423 - DNA, 1197 bp, Bacillus licheniformis
atgaccgtaacaaaaaccgcagcatacgaaactttgactgaaagctccgcggccgcgcttgccgtccgtctcgggctttttccaagcaaaagcaccctgacatgccgagagatcggggacggaaacctgaatctggtcttccgcgtttatgacaaagagcagcaaagaggattggtcatcaagcaggcggtgccttatgcaaaagtcgtcggcgaaagctggccgctgacgcttgacagggcaagaatcgaaagcagtgcgctgatccgccaggctgagcacgttccgcaccttgttccgaaagtgtactattctgacaccgagcttgccgtcaccgtattggaagacctttctcacttggaaatcgccagaaacggactgattgacgggaaggattacccgcatctgtcggaagatatcggagaattccttggaaaaacgcatttttactcatcagaatatgcgcttgacccaacggttaaagagcggcttgtgaagcagtttacgaatccggatctgtgcgatattacagaaagccttgtgttcacagaccctttctttgaccatgagacgaacgatttcgaagaagagcttcgcgatgaagcagaagttctttggggcaatgaagcgctaaaaattgaagcggcaaaactgaagcagcgctttttatcagcggaggaaacgctgatccacggagacctgcatacaggcagcattttcgccggtgaagatggcgaaacgaaaatcatcgaccctgagtttgcgtttttcggcccgatcgggtttgacatcggacagtttatcgccaacctgctgttaaacgcgctttctcgcgaagaaaacaggcgggctcctttataccgccatgttgagaccgtctggaatacgttcagccggacattcagcgaagcatgggaaaacgatgctgttgagacttgcaaacatgagaatgggcgccttgagtcagtcctgagacaggcgtttgaagacgcagcaggcttcgccggctgcgaaatgatccgccggacgatcggcctcgcccatgttgcggaccttgatacaatcgttccattttcccggagaatcagccaaaaaaagctcgcccttaaaataggcgcagcattcatagaaaaacgcagcggtttccggacgccaaaagacatgattgaagcgtttcgaaacgcgcttaaggagtga

SEQ ID NO: 1424 - DNA, 780 bp, Bacillus licheniformis
gtgaagctgacaatttcatgcctgcaattcgatatcgcgtacggcaatccttctgaaaatttcaaaaaagcggagcagctgatcgagcaggaaagccggaaggcggatatccttctccttcctgagctgtggacgacgggttatgatttaaaaaatctcggctccatcgcggatgaagaaggcaggcaaacgaagagatggctgcaggaaacggcaaaagcaaaccgcatccatatcgtatgcggctcagtcgcagtcaagaaaaaaagcggtgtgtacaatatcatgtacatcgcagacaaaaacggacatttgatcaaagaatacagcaaagctcacctttttcagctgatggacgaacacctctatttgtcagcgggctcaggcgacgggcgcttcgagcttgaagggatgccggctgcggggttcatctgctacgacatccgtttcccggaatggatcagaaaacatacgagcgaaggtgcgggcatcatctttgtatcggcggagtggccgctcgcccgcctcgatcactggcaaagccttttaaaagccagagcgattgaaaatcagtgctttgtcgcagcctgcaatcgttcgggaaaagacccggcaaacgaatttgcgggccacagcacagtcattgatccgctcggccgcacccttgctgaagcaggacgcggagaagcggtcatcagggccgaaatcgacctaagggacattgaaaaagcgcgggggcaaattccggtttttgaggacattcgcaaagatttatattaa

SEQ ID NO: 1425 - DNA, 1191 bp, Bacillus licheniformis
atgaaatttgagcattcagatgtactgaagcagctgccggagcagtttttcgcttccttggtcaaaaaggtgaatgaaaaaattgccgccggccatgatgtcatcaatctcggtcaggggaatccggatcagccgacaccggaacatatcgttgatacaatggcgcaagccgtccgcaaccctgaaaaccaccggtattcttcctttcgcggcagccgttcactcaaggaggcggcggccgcgttctatcaaagggaatacggcgtagagctcgatcctgaacgcgaagtcgctgtattgttcggcggaaaagccggtcttgtcgaacttccgcaatgtttgttaaatccgggggatacagtgctcgttcccgatcccggctatcccgactactggtcgggcgttgaactggcaagagcgaacatggaaacgatgccgcttacagcggacaatcagtttctgcctgactacagccggattcccaaggaagtgaaagaaaaagcgaagctcatgtatttaaattatccgaacaacccgaccggtgcccaagccacatctgcttttttcgaagagaccgtccggtttgccaagtcgaacggaatttgcgtcgtccatgattttgcctacggcgcgatcggctacgacggcaagaggcctgtcagctttctcgaaacggcgggagcaaaagacgcaggaatcgaaatttacacgctttccaaaacgtataatatggctggatggcgggtcgggtttgcagtcggcaacgcctctgtgatcgaagcgctgaacctttaccaggaccatatgtatgtcagcctctttaaagcagtccaagacgccgcggcggccgcgctcctatcagatcaagcgtgtgtccaggagcaaaatgagcgctacgaaaaaaggcggaatgcatggatccgcgcggtccgcgatatcggctggcatgcggatgctccgcaaggatcttttttcgcctggatgcctgttcccgacggctatacatctgaggctttttccgatctgcttctcgaaaaagcgaatgtcgtcaccgcgcccggcatcggcttcggcaaacacggggaaggctatgtgagagtcggcctcttgacaagcgaagagcggctccgggaagcggcttcgcgtattgccgagctgaatatattcaaaaagaccggccacagtcattga

SEQ ID NO: 1426 - DNA, 1218 bp, Bacillus licheniformis
atgagtgaacttttggcaacatatatcttggccgatccaggctgtgacgcagaaaagcgggccgagcaaatcgcgatcgggctgacggtcggatcgtggacagatctgccgctcttaaagcaggagcagctgaaaaagcataaaggacgcgtcgtcaacgtcgaagaaacagaaagcgagctgggggaaaaacaggcaacggtcaccatcgcctatccggaagccaattttacaaacgacattcccgctgtgctgacgaccgtttttggaaagctgtctctcgacggaaaaatcaaattggcggatttggagttttcgcggtcttttaagcaatctttgccgggtccaaaattcggcgtatacgggatccggaaaaaaatcggcgaatttgaaaggccgctgttgatgagcatttttaaaggcgtcatcggccgcgatatggaagacttgaaggaacagctgaggcagcaggctcttggcggagtggatttgatcaaggacgatgaaatcctattcgaaacaggcagtgccccctttgaaaaacgaatcacggaaggaaaaaaagtgcttgaggaagcctttgaagaaacagggcgcaaaacgctgtatgccgtcaacctgacgggcaggacaatggagctgaaagcgaaagcgagaaaagcagccgagctcggagctgatgttttgctgcttaatgtgtttgcctacgggctcgatgttttgcaaagctttgcagaagacgatgacatcccgctgccgattatggcgcacccggcagtaagcggcgcacttacttcatcgccgcattacggtttttcccattcgctcttgctcggcaaactgaaccggtatgcgggtgccgatttcagcctgttcccttctccgtacggaagcgtcgctctgccgaagcgagatgcgcttgccatatacgatgaatgcacgaaggaagacgtctttaaaccgacattcgcggtgccgtcggccggcattcaccccggcatggtcccgctcttgatgaaagactttggcattgaccacatcatcaatgcaggcggggggattcacggccatccaaacggggcggcaggcggaggaagagcgtttcgggcggtcattgatgccgtcttagaagcggagcctgtcgaagagaaagcaaagcgctctcccgatttgaagctcgcccttgaaaaatggggaagggttgaggtctctgtatga

SEQ ID NO: 1427 - DNA, 1284 bp, Bacillus licheniformis
atgagaaagccgcttatcatttgcgattttgacggaacgatcacaacaaacgacaacatcatcagcattatgaaacaatttgctccagaagaatggaccgctctaaaagacggggttctgtccaaggacatatcgattcgggacggagtcggcagaatgtttaatttgcttccggccagcctgaaagaagacattacggcatatgtactgaaacaagccgagacccgccccggatttaaagaatttgtttctttcctggatgagaagggtcttccgttttacgttgtgagcggagggatggattttttcgtctatcctctgcttgaaggaattgtcggaaaggaccgcatttattgcaacgaggccgctttcaccagccgcaatatcgagatccgctggccgtatccgtgtgacggcggctgcggaaatgactgcggctgctgcaagccttccatcatccgccggctgaaaggccgggacgatttcgttgtcatgatcggggactctgttacagatgttgaagctgccaaatgttccgatttatgcatcgcgcgcgactatttgctgcgggaatgtgaagagctcggcttgaagcatgcggcattcggcgatttccgcgatgtaaggcgaatactcgaagagaccgcggaggtgaaagaatggatgtctgagcaaaaacggcaggaactagccgaggtaaaaaaagagcttgcggaaagggattggttcccggcgacaagcggtaatctgtcaatcaaagtatcagaagacccgctgcggtttctcatcacagcaagcggaaaagataaaagaaaagagaccgaggaggattttctcctggcggacgaagaggggaggccggcggagaccggacacgcgctgaagccgtcggcggagacgctgctgcacacctatgtctatcaacacacaaacgccggctgctgtcttcacgtccacacggttgacaacaatgtcatctcagagctttatgcaaaagaaaagcaagtgacattcaggggccaggaaatcataaaggcgctcggactttgggaggagcacgcggaggtcacggtcccgattatcgaaaacagcgctcatattcctgatttggcggcggattttgccgggcacctttcaggcgattcaggcgcagtgctgattcgcagccacggcattactgtctggggaaaaacggcatttgaggcaaagcggatgcttgaagcatatgaattcttgttcagctggcatttaaagctgaaagctttgcaggcttatcacgtttaa

SEQ ID NO: 1428 - DNA, 540 bp, Bacillus licheniformis
atggcgacaattcggatccatgatgaacaaaacacgagcattgaaaaccaggaagaagtagaacaatttctaaagcggcaggaggtcatttatgaaaagtgggatatcacaaaactgccggccggtttaaaggaaaaatacgatttgaccgatgaagagaaacaggagattttagacgtctttgccgctgaaatcaaagacatttcagaacgccgcggctataaagcgagcgatgtcatctcgctttccgaccaaaatccgaaactcgatgagcttttgaaaaacttcaaacaggagcatcatcatacagacgatgaagtcaggtttatcgtcagcggccacggcatctttgcgatagaaggaaaagacggcacattttttgatgtccttttaaatccgggggatttgatctctgttcctgaaaacacccgccattatttcacgcttcaggaagaccggaaagtcgtggctgtcagaatctttgtgacgacagagggctgggtgccgatttatgaaaaagagaatgtgaaccagtcataa

SEQ ID NO: 1429 - DNA, 465 bp, Bacillus licheniformis
atggaaaacaataaaatcctcggcatcaatcatctcttgttttcggtctctgacctgtccgtctctatttcattctatgaaaaggtgtttgatgccaagtggctcgtaaaagccgagaaaaccgcttattttgacctgaacggcatctggctcgcattcaacgaagagaaagacattaaaagacaggaaatccacgactcttacacccatatcgcgttttcgatccaacaggaagatttgccgttctgggaaaagaaattacacgatttaggcgttaatgtgctgaagggcagaaaacggcatgaaggagacagagattcaatttatttctcagatccagacggccataagttcgagcttcacacaggctctgtatttgaccgtcttcaatactatcaaaatgaaaaaccgcatctttcatttcatgaaggccacatcaaggctctttatgacagaaacaaataa

SEQ ID NO: 1430 - DNA, 330 bp, Bacillus licheniformis
atgcgccaaatgatgaaaaaaccagtttcaaagctccgaaccgtctttgccgtgaaagaagcatattcaggcctcttattgtttttcagggcatttagagcctggagaaagggagactaccccttattcccgaaaaaaacaattttgctggccgcgctggcatttatctatgtgctgtcaccgatcgatttgatccccgatgttctcgcaggcgtcggctggcttgatgatgcggctgtgctcgcttttctcttcaggcaaatcaccaaagagctggacgggtttgaaacacatctaacagggagagtaaattacaatggaaaacaataa

SEQ ID NO: 1431 - DNA, 243 bp, Bacillus licheniformis
atgcaaaggtatattgaaaaagaagcattgctcgtttccatcagcaagaagcggcaaatgatggttgaagccgctgaaatctatggatatacaggggatgaaacgatcaggcggagccaggagctggatcaattaatttatgaatatcaaaaattgtctatgaatgaaaacgcgccagacaatctgctgcaagattttttaggctgcatcgactgtctgcccgttgaaaaatatacggcatag

SEQ ID NO: 1432 - DNA, 1512 bp, Bacillus licheniformis
atgcgcaatttgaaaagtatatggaagaaaatcaggctttatttgatcttggtgatgatccccgccttcattataagcttttttgtatacgaacaagaacgagaaaatatcactgaaaagcaccgtcagactgcgactctcatgctcaatattcaccgcaaccaaatcaattacctgatcggcgaaacagaagcaaggctcagctcccttgccacggccctcaaccaccctgttaatgagcagcatatcaaacgaatcctgacggaaacgtataaaaaagaaccgcgtttttcggctttataccttttaaatgaagacggcgatgtcatggtgagcacgtctcccgccaaagaaaaaaaggcgctttcttacaagagcattctgcaaaaagcggaaaaatcaaagaaatccgtgatcacagacgatatacatacagtgtcggacgggctggagctgaatatttttactccggtctttgacagcgaagggagaacaacaaattttctgctcgcttcgatccgcgtcgattatctgaaaaatatcatgaacgtcttgagccctgagctttatatcaaaattctcaatcagaagaatcagatcgtctttacggcaggccattctcctcctgagaagccggacggcggtaccgtcgacgcttttttggaccagatcgactggaagcttgaagtctatccggaaccggtccagcttgatgaaatcgttcacagtcttctgctgtcatttttgagtattttcattctgctgaatattatgttcctcctgctccagtatgtcctgctgaagcggcggaccaagcaggagcgcgcccaaaatgaagcgcagaagctcgaattaatcggcaccttggcggcgagcaccgctcatgaaatcagaaacccgctgacaggcatcagcggctttatccagctccttcaaaaaaaatatcaatcaaaagaagatcaaatgtatttctcaatcatcgaccaggaaatccggaggatcaaccagattgtcagcgagtttctcgtgctcggaaagccgacggcagagcagtggcagctcaactccatgaatgaaatgattgacgagatcatgccgattattcattctgaggcaaatttatataatgtggaagtggaatttcaagactgcggagaagatccggcttatgtgtattgtaaaaaggatcatattaagcaggttgtcttgaacgtcgccaaaaatgctcttgaatcgatgaaaaacggcggaaagctggtcattcaaatcgaacatgatcaagagaaggcgcaaattattgtgaaggatatcggagaaggcattccacaagaaatgatggaaagtattttccagccttttgttacatcaaaagaaaaaggaaccggactcggccttgtcgtgtgcaagcgcatcatttccatgtacgggggaaccattcatatcgaaagcgaacggcataaaggaacgactgtaacgattacgctgccgacttcaaaggaacaggacgactga

SEQ ID NO: 1433 - DNA, 378 bp, Bacillus licheniformis
atgaataaacatattcatcatcatggtctgaatccaaccgagtttgccgttttagaactcctctatcataaaggggatcagccccttcagcaaataggggataagattcttctggcgagcgggagtattacatatgtggttgacaagcttgagcaaaagcagctgatcacgagaagagcctgtacgacagaccgcagggtgacctatgcgcaaattacagataaaggcaccgagctcctcgagaagatttttccgggtcatgcagaagagctgcacaacatgatcagcgtattaagcgatgaggagaaagaagcctgcatcgaaatgctgaaaaaagtcggactgaatgcaagaaatatttataagggcaaagagtaa

SEQ ID NO: 1434 - DNA, 780 bp, Bacillus licheniformis
atggctagaaaaaagaagcacaaaaaagaccatgaagaacacgtggatgagtcttggctcatcccatatgcagacttgctgacactgcttttggccctgttcatcgtactgtttgccatgagctcgatcgacgccaagaagttcgatatgctgtcaaaatcatttaatgccgtatttaccggcggaacaggaatgatggattattccagcttcaccgagccgaaaacgagcacaaccgaagatggaaaaagccctgaccaggcaaaagatctctccgaagctcaaaaagaaaaagacaagcagtcgctgaaaaaaattcaggagcaggtcaaccggtttattaaagagaagaatcttcaaaaacaggtcaatacgaagctgacagacgagggcctcctcctttccatcgaggataatatctttttcgattccggaaaagcggagatccgccagcaggacattccgctggccaaggaagtatccgaccttctcgtattgaacccgccccgcaatatcgtaatcagcgggcatacggacaatgtgccgattcgaaattctcaatttaaatcaaattggcatttaagcgtgatgcgggctgtcaatttcatggggcttttaatcgaaaatccaaagcttgacgccaagatcttcagcgcgaaaggctacggggaatttaaaccgatcgcttcaaatgacaccgaagaaggaagaagaaaaaacagacgcgttgaaatccttatcctgccgatcggccaggaaaatctgaataaaaaagaataa

SEQ ID NO: 1435 - DNA, 804 bp, Bacillus licheniformis
atggacaaaacatcgttaattggaatcatcttagctatcatcggagtaggtgtcggcatggtcatgaaaggtgtcagcccttccgttctcgtcaatcccgcggcatggctgatcatccttgtcgggacaatcgcagcagttgtgatcgcttttccaatccgcgagctcaaaaaggttcccaaactcttcggcatcttgttcaaagagaagaagatgatcgaaatcaacgaactgatcccgatgttttccgagtgggcgcaaatcgcaagacgcgaaggacttctcgctttggaagcaaatttgaatgagatcgatgatgaatttttgaaaaacggcatgagcatggcggttgacggtcaaagtgccgattttatcagggacgttttaactgaagaagttgaagcaatggaagaaaggcatcaagtcggagcgggtatttttacccaggcaggcacatatgcgccgacactcggcgttttgggcgctgttgtcggactgatcgccgcacttgcggatatgagcgacacagaagcgcttggacatgcgatcagcgccgcctttgtcgccacccttctcgggatcttcaccggatatgtactatggcatccttttgccaataaattaaagcggaaatccaaacaggaagtcaaagtccgcgaagttatgattgaaggcatcctttcgatcttggaaggccaggctccaaaagtcattgaacaaaagcttttgatgtacgtttctccaagcgaacgctccagcatcgtcatcccagatggagacaaaggggacagcagcaatggctag

SEQ ID NO: 1436 - DNA, 2097 bp, Bacillus licheniformis
atgcgttgtcaacattgtcaaaaaaatgaggcgacgattcgcctaaacatgcaaatcaactttacaaaaaaacaaatggatttatgtgaagactgctataaagagctgactcagccttctatgttttcaggaaatcacttttttggcggcggaggttctttcttcagccagccatcacaagcgcagacgcaaaccgctgccaaaaaaggcttgctcgatgaacttgccgtcaatttaacaaatgcagcaaagaccggcttgatcgatccggtgatcggccgcgatgatgaagtagcccgtgtgatcgagatcttaaaccgcagaaataaaaacaatccggtcttaatcggtgaaccgggcgtcggtaaaacagccgtcgctgaaggacttgctctcaaaatcgccgaaggcgatgttccaaataaattgaaaaacaaagagctctacctgcttgatgtcgcttccctcgtggcaaacaccggcatcagagggcaatttgaagaaagaatgaaacagctgatgaaagagctgaaagaacgcaaaaacgcaatcttgtttattgacgaaattcaccttcttgtcggggccggctctgcagaaggctccatggatgcgggcaacattttaaaacctgcacttgccagaggcgagctgcaagttatcggcgctacgacgttgaaggaatatcgccaaattgaaaaagatgcggcgttagagcggcgctttcagccgatcatggtgcacgaaccgacaattgagcaggccgcagcgattttaaacgggctcaaggaaaaatacgaagcatatcacgatgtgacttacacggatgaagcgatcaaagcctgcgtcattctgtcaagccgctatattcaggaccgccatcttcccgataaggcgatcgaccttttggatgaagccggttcaaaagcgaacttgaaaatcgacacggtcagcggtgaacaagcttcccaacgcctgcaagaaatcgaagcggaaaaagccaaagcgcttcaagaagaaaactacgagcttgcagcaaaactccgcgacgaagaagaagcgctgcataaaaaaatggaaagccatgaggaagaaaaacgggcaacagttgaagcggaagacattcaagcgatcatcgaacaaaaaaccggcattccggtcggcaagcttcagcacgacgatcagaagaaaatgaaagagcttgaagcacacctttcaagccgcgtgatcggtcaaaaagaagcggtgaaaaaagtggcaaaagccgtcagaagaagccgcgccggcctgaaatcaaaaaacaggcctgtcggttcattcctgttcgtcggcccgacaggtgtcggtaaaacagaactttctaaaaggcttgcggaagaactgttcggcacgaaggatgccatcatccgcctcgatatgagcgaatacatggaaaaacacgccgtatcaaagctgatcggttcgcctcctggatatgtcggccacgaagaagccggacagcttaccgaaaaagtccggaggaacccgtacagcatcgttttgctcgatgaaatcgaaaaagcccatcccgatgtccagcacatgttcctgcaaatcatggaagacggacgtctgacagacagccaagggcggacggtcagctttaaagataccgtcattattatgacaagcaatgccggtgtatctgaaaagcggacaaccgtcggttttaaccgggaagagcaagtaatgggcgaacaatcaatgatcgattcattaagcggctactttaagccggaattcctgaacagatttgacagcatcatcgaattccagccgctcgaaaaagaagatctggtcaagatcgccgccctcttgctgaaagagcttgaagaaacgttaaaagagcaaaacatgacgctcgaagtttcagatgaggcaaaagaaaaaatcgctgaaatcggataccatccggcctttggcgcccgcccattaagaagaaccattcaaacagcggtcgaagatcaaatgaccgatctgctgcttgaagaagaacacatcaaaggttttgcggttatcgttgaaaacgatgaaatccgggtgaaaacaaccagataa

SEQ ID NO: 1437 - DNA, 1035 bp, Bacillus licheniformis
atgagtcaatcacaaggatcagcctttcagctggcatttgtttatgtaggaacggttgtcggagccggatttgcaactggaagagaaatcgtcgagttttttttaagattcggctggccgggattggccggaattttgatcagcggactgatgtttacgtttctcggtgcaaaaatgatgctgattgcggtcagaatcaatgccaagtcttatcaggagctgaataaatatttattcggccatacgcttgggaaatttgtcaatgtcttcatgctcgtggttttgctcggcgtgacgtccgtcatgctgtccggagcgggggcgatatttgaagaacagctcggcttttcaaaccaagcggggatgattgcgacgattgccttgagtctgtttgtcatgatgaagggcgttaaagggatattcggcgtcaatgtcattgtcgttccgctgctgcttctgttcacagttgtcgtcctgtttgactcgtttattttcagagggccggagatacacaatttggcggcattttcggcaaaccccgattggattttatccgctgtctcgtacggcgcttttaatttgtcgctcgcacaggctgttctcgtgccgatcgcttctgaactgaaatccgaacgcctgattataaaaggagcattaatcggaggggttctgcttacccttgtgttggtcgcaagctttctgtctctttcaacattgcctgatgcccttttatatgaagtcccgatggcacaggtcgtattcatagtccagcattctgtccatatcatctatctgtttatcattttcggggaagtcttcacatcagtcatcggcaatttatacggtcttgaaaagcagattaatgaatatattcatataaaaagcctgtatgtgtttatcttcatcctgctgacaatctacttgacgggacaaatcggctacggaaagctgatatcgaccatttatcctttgttcggccagctgagcctcgtctttattttctttctgatcgtcaaaagggtgcctgagcgatga

SEQ ID NO: 1438 - DNA, 660 bp, Bacillus licheniformis
atgaaacaggaaaaagcgatcgtcgtattcagcggcggtcaggacagtacgacttgcctattgtgggcgcttcggcaatttcaggaggtggaggcggtcacgtttcaatataatcagcggcacaagcaggaaatcgaagtcgcgaaaaagatcgctgcaaagcttggcgtcaagcatcaccttcttgatatggaactgttaaatcagctcgcgccgaatgctttgacaagggatgatatcgagattgaggcgaaagaaggcgagcttccgtccacttttgttccgggacgcaacctcgtgtttttatcgttcgcttcgatcctggcctaccaggtcggcgcgcggcacatcattacaggcgtatgcgagacagacttcagcgggtatccggattgccgtgatgagttcgtcaaatcctgcaatgtcactgtcaacttggcgatggagcgcccgtttgtcatccatacgccgcttatgtggctgaacaaggcggaaacgtgggagctcgccgatgagcttgatgcgcttgatttcgtgaaaaacgagacgctgacgtgctacaacggaatcattgccgacggctgcggcgaatgcccggcctgcaagcttcgcgcaaacggctacaatgaatatatgaaaatgaaaaaggagcgagcttaa

SEQ ID NO: 1439 - DNA, 441 bp, Bacillus licheniformis
gtgcttacacaaatttatccgcaaccaagccatccttactcttttgaattaaataaagatatgcaaatgtcagctgcacattttattccgagagaggatgcaggcgcatgcagcagagtccatgggcatacgtatacaatcaatattacgattgccggggatgagttgaatgcatcaggtttccttgtcaacttcagcaccattaaaaaattgatccacggagaatacgatcatacgcttttaaatgatcatcaggaattttcaggtgaaagcgcggatcggatcccttcgacagaagtcgtggccaaaacgatttacgataaagtagaggcttatttgaaagatctcaacaaccgtccgcattgcgtccaggtgtttgtcagggaaacgccgacaagctatgtcgtgtaccgtccgaaaccgggtgttcagcatggctaa

SEQ ID NO: 1440 - DNA, 732 bp, Bacillus licheniformis
atggctaagccgattcccgtacttgaaattttcggtccgacggttcagggagaggggatggtcatcggccaaaagacgatgtttgtcagaacagccggctgtgactattcgtgcagctggtgcgattcagcttttacctgggacggttcggcgaaaaaagacatcaaatggatgaccgcggaagaagtgtacgaatctcttaaagacatcggcggaaacgcattctcgcacgttacgatttcaggaggcaacccggcgcttttaaaacagctggacggactgatttcccttttaaaagaaaacggtatacggacagcgcttgagacgcaaggaacgttttatcaagactggtttaccggaatcgatgatttaacaatttcgccaaagccgccgagctccaatatgaaaaccgattttaacaggcttgatcatattgttgacaggctgaaggaacacggccgggcggctgcggcaagtttgaaggtcgtcattttcacggcggacgaccttcaatttgcaaaacaagttcaccagcgttatcccgatatcccgttttttcttcaggtcggaaatgatgacgttcatacagaagaccaagagcggctcgtcgaacggctgctccaaaaatatgaacagctggtagaagcggtcacgcgcgaccctgaattgaaccgcgtccgcgttctcccgcagctccacaccctgatctggggaaacaaacggggtgtttga

SEQ ID NO: 1441 - DNA, 498 bp, Bacillus licheniformis
atgacgacaagaaaagattcagaactggaaggcgtaacccttcttggaaatcaaggcaccaattatttgtttgactattctccggaagtgcttgagtctttcccgaataaacacgaaaacagggactatttcgtgaaattcaactgccctgaattcacatcgctgtgcccgaaaaccggacagcccgattttgccacgatctacatcagctacatccctgataaaaaaatggtagaaagcaagtctttgaaactgtatctcttcagtttccgaaaccacggcgattttcacgaagactgcatgaacatcatcatgaacgatttaattgagctgatggacccgcgctatatcgaagtctggggcaaattcacgccgaggggcggaatctcgatcgatccgtacaccaactacggcaagcccggcacaaagtatgaaaaaatggccgagtatcggatgatgaaccatgatctgtatccggagacgattgataatcggtga

SEQ ID NO: 1442 - DNA, 1059 bp, Bacillus licheniformis
atgtatatgcgggggagacgaagaccggcgattaaacatagtgagaaaaatacatacgaaagtaagactctgtctgatgtgtgtaaacaaatttgtaacgtaaaaatgtctgaaggacttacgaaagaaacaattgatcgctatcgccgggtttgtgagagtgtggaagaattcgcggaaattaaaggactgtccaccagtgttgaatctatagatgtcgagtttgcgaggcagtacatgacctatatactgcacgagaagaaaacgtttaagggacaccgttataaaccagaaagtgtgaaaactccagggtgttctccgaaatatgcaaatgaccacctgaaaactatgagagcagtttttactttctgtataaaggaaaatatgatttcggaaaatccatttcaaaaaataaataaagtcaagcagccggaacctgtaattcaaatattatctgtagaggagatgaagcagcttttaaaaacaccgaataagcgaaagttctctgagtttagagattacgtggttatgatgtgtttaattaactctatgtgtagaatcggagaaatcgtcactttagagatcgaaaatataaattttgagttgagctacattattcttgaagctcaaaaaacaaaaacgagaaaaggccgtatgattccattagataaaaatacaatgcagctgcttaaaaagttattgttaagaaatacgcgatttaagcctagcaagtatgtcttcattacggaggaagggacaagattaacgaccgacaattttagaaaacggcttgcggattacgctcatcaggcaggaataaataaaagagtccatccgcatttatttagacacaccgcggcgagcatgtttttgcaggcaggaggggatcttaggcacctccagacgatcatcggccataaagatttacgtatggtattacgatatactcatctgtcgttagaatccctcgcaaggcaacagagtgaatattcgctaataaaccaagtggtagatgggttaaataagccaaggaagacaaaaagaaaatacggaaggtag

SEQ ID NO: 1443 - DNA, 717 bp, Bacillus licheniformis
gtgactcaaaagaaaaaaattttctcggtagaagaaagtcttcctgatctctctggaatgtttaataatatctcggcatcgccaaacccaaagcaaattacaattgaaaaagcacttacaattattctccgacagatggaagtaagcgggaatagggagcggacaattagcgattaccatcttcatgtatcacattttaaggaatcagaagaattaacatatctacatgaaattacatataagtcgattcattcatggcttggaaacatggatgtcagtgcacaaacaaggctcacgcgtttgaaatgtctcaaagcatttttatcgcgttgtttcgataatggatggttcgaatcgaagttttggaagaacgtaaaggtgaaggtcgacaataaagttaaagagggggcgacggatcaggaaatcaaaatcttactttcgttattagatttaaccgactttgtacagctacgtgatgcgacagcattgcttcttatgtataaaacaggtatgcgtgtagggacgctcgcaaacttaaaagaagaacatgtcgattttaatggagaattacttcggttaagtggtgaaatcgttaaaaatcgagaacctttactactgccctttgatgagactctcgctcaacttctctctgtactggtgaataaaaacgccgaaatccgccgagcatataagaaggacaataaatttgttttttaa

SEQ ID NO: 1444 - DNA, 333 bp, Bacillus licheniformis
atggaaaatttcaacaaactggcttcactcaacaacttaaacggagatcaagaagataccctcttcatacggcgcaaccagcttcaaatgctgaaaacgggcatgagagtaacggccgcaactaagcttgaaggcattaaaacgacactaagaccgaagtttaaaataggcgatatacaaaaagaaatgaacagcgtttattcatcgcttctctacagcttcgaaggaaaagcgcaagaggcgcttgctcaacgaatcagccaaagcgcccagcagcttattaacacggagaaagacggagagagctttgtgaacggatttaagacgagatag

SEQ ID NO: 1445 - DNA, 1440 bp, Bacillus licheniformis
ttgagtaagaagattaagaagtccaatcttacggatgagacttattatcgtataagccaacgttcttacaactacgattatctcagaaaaaaattaaaaaacaaagagtacatacggataaattcatctgtttccggagccacctactggtatgttgataaaattaaaacagacgaagacaccgggttagatgcggccgttctatcccaggccgaaaataaaaacggcaagtgggtgaaatccgaccaccccaaaaacgtcgttgtagcttttgcgggaactgatccggggaaggacccgttaagtgacgtagagcaagcagacattaatcatatcgtcttaggaaacgatccgaaagataaaacacaatatgtcgtcaagaaagatgcgaaagatatgtctaagacgttcggtagatatattggttcgatggaacaaactgccatgcttgagtccggagattataaattaattacaaaaacatcgcaaatcgatcaagccgatcaacttgtgcgggaagttaaacaaaagtataaaggcacctcgacagttatttcaaccaccggacactcgctcggcggcgcagaggctgaatacagcgcggtcaacaatgatatctatgccgtcgcgtttaatagcccctcaatcgttcacctgcattctgatgaaaaacagaaagaaattaataacggagattataactcttatgtaaaatctatcattaatccggatgatatggtcggtgccggttggtgggacgaattcgatcgccacaatgggactaccatctacacaaaagacccttctattgcaacggctaatcgcgaagaaagacttgacggcaataaactccaacaggttggaagaaaccttctgtatttcgctaatacactaatctttcaaaatccggatacacatgggataaataagtcgaatttctctttcgacgaaaacggcaacgttcaaaatatagagggcgatgaactcgtttatgacaaaaatttaaaagcgatgctcccaccggaagttgcctccggaagtggcgcaattaaagtaacacccgaagttgccaagcagctcgcgcaaaaagtaaatgcgatcatcgatgacttgcggacgatgaaacgggaagccgaaaacgcttatcaggaacacgacgccgagatcaacgacctgaagcacgatacctaccgtcaggtcggccacggtttatacgacaagctgacactcgaggatgtaaacaatacgctgaaaaacctggcgcagtcgtttgacaaaaaaggcaatccgctattttacgatgttcatgccgaaaaagcgtacatcgcctcattaaaaaatacgatttcagatttagaagacatcagcgggtacctggcgcagattgcaaaagattttaaatcgaaagataaaatgctggcaaattggcttaaactttag

SEQ ID NO: 1446 - DNA, 258 bp, Bacillus licheniformis
atgaagcatcagtatgatgtgaaaaaagaagaaactgttctttttgagaaggcgaaaactaagatgactgaatatctacataatgagtacaaaggtattgatactattacttattatgatgattactttattgatccaaccggtgctatcaccgttgaaggatatttgaacggtgataaatctaaagagttcgacggtttatatgatccggcgagtgataagataggaagctcgtctgtagatgcagaagaaaaatag

SEQ ID NO: 1447 - DNA, 810 bp, Bacillus licheniformis
ttgtttatttggcccatgctgcttgagtccgcaaaggagccgtttaactcggacgactatatcacggaaaccaaattcgacggcatccgtctgatcgcgtccaggaataacggtttaatccgcctctacacacgccacaacaacgaagtcaccgctaaatttccggaactattaacgctcgacataccggatgaaactattttagacggcgagcttatcgtacctggatcgacaggcgccggcgattttgaggccgtcatggaacgattccagtcgcggaaaagtttttatccgatagtattttgcgtttttgatgtcctgcggatagaaggcgtttcagttacgtctaagccgctaagtgaacgaaaagaattgctggccggtctaaaactcgatcatcctaacgttaaaatagtcgagggcgtgcgcggccatgctacggattatttcgaattagtccgcgaaaataagatcgagggcatcgttatgaagcaggcaaacgctccgtatgcggaaaataagcggtcagatcgctggctgaagatcgttaactacgaatatactgacgttctgatatcaggactccgcaaggaagacaatgcgctgcttctttcgtacctggacggccagtatgccggcattatggagtttatgccgtatgatgcgcggcggaagtttcatgcggagcggctaatcgtagaagaaacggagaaatacgcctacatcgagccaattgggtgccgcgtcaagcaccggttcaagacgaaaaacggtttgttgcggattccttcgttccatgaatggcgttga

SEQ ID NO: 1448 - DNA, 339 bp, Bacillus licheniformis
atgacgatgaataaaacgaagctcttaacggccatcctcggcctatcactcgcaggcaacgcggctctcggaatctacgccgccaaactaaacgaagatgtcgatattgcttatcgcgtggctgacgacatggccgccgaagctgaggacgcccaggaaacgatcgagcgcgaatatattgtcgaagataaagactacgcggtatcagcggacgacggcggcttctctttcgatccacaagccacagacgcaaagccaggcgatcggatcatcgtgacttttacgaaggatcagtacgaaaatggcagcggatttaaggcgattaaggttatcgaataa

SEQ ID NO: 1449 - DNA, 201 bp, Bacillus licheniformis
atgacgctttatataaaacgcttgtggtcggacacaccgccgctgaagccgcagcagaccgaccagcttctcgatctataccaacgccctgttgcgacgtttaaagacgccggcaaagcgtatcagatcggcttcaatacggcgcttacgtgtctcggctatttaatcgcaaacaaatacggaggtaatgacgatgaataa

SEQ ID NO: 1450 - DNA, 288 bp, Bacillus licheniformis
gtggcgaaatacaagaaaaagccggttgtagttgaggcgtttaaatatggcgcaccatggccggattggttccacgacaaagtaacgagtaatgacgttattacacatgcggcgtatgaaagcggaagcccgtttgaacgaaataccggtctttggtgcgaaattaaaacgctagaaggcgttatgatcgctaaagaaggcgactatattattcgcggagtagaaggcgagctgtacccgtgtaaaccggatattttcgaaaagacttacgaaagagttgacgaataa

SEQ ID NO: 1451 - DNA, 261 bp, Bacillus licheniformis
atggcggaatcaaagcgcgaatcaatcggcaaaattaaaatcgacttggatgtgtccgacgcgataaccggactcaaggcggtccaacgcgaggcaaaggcggcgactaaggcgttggctgaattgcgggaagaacaggcgaagggtcatctagcagggcggttatatatcggcgaggagtatattgcgcctccggtctatgtcgacggtaagaagatcgaagaggctagtacgaaaatcttccggaagggggagcgctga

SEQ ID NO: 1452 - DNA, 375 bp, Bacillus licheniformis
atgtgcggtaaaataaccgttaaacttaccgcaggcgatgaatacgacgaacagctcgatcaattgcgccaagcctttttcgctctgtccgacggccctgaacaagaagagtggcgactcgctctcgttgtaggaaggaccgttagcgaagccaaaacgatatggaaacgggtgaaaacgaactatccgagctataagtacacgcaatttgtatcgcgtaatccttacgtactggacggtataaacccggaatacgttgcgctatttatgctgccaggttgcgcagataatccgattgtaaacgatccaatgtttcggtgggttatcgataatgcatacgaagttacttgcgttgaggagggcgatggtgtatga

SEQ ID NO: 1453 - DNA, 189 bp, Bacillus licheniformis
gtgaacggattattttactgctactcaacaacgctgatgcacttcttaaaggcgaatggccgccgctataaatttacgaagctgcatccgcgaactaataaccggatgtgggtattcgaaagagacgccgactttggcgctttgcttgacgaatacgacgcccgaaaggcgaatgcgaaggcgcagtga

SEQ ID NO: 1454 - DNA, 615 bp, Bacillus licheniformis
atggagtatagattaaacctggctaagtttagtatcttagaaacactcgagaaggcggcagttgaccgtgagttggtttacgttagagccggacaaaggtgtttaggaaagaccaccgcgcttattgagtttgctcgtaagcatgactgcgaaatcatggttcaccgcaacatgttgggctactacaaaacagagcatccagatgttaaggttagatctcatctaagcgagaagtgggttactccgagtgataggtttgtgtgcgatgaaggtgtacctcaggatgcaatcgacgaattgaaacgaggcggcaaccttatcaccggattcgtaagagtgaaggattcttttagggacggattgtatgaccaattaatacgtgagaatacaccgaacttactaacgatagaactcacggatgaacaatcgataccacgcgtcatatacaaaggcgaagaaattaccggtcgtattgcggtagacttcgagtggcgtactaaagacgcagaccaatgcggctctacttattaccgtatcaaacacactaaggatagcacaggcgctccggttgtagagacgaaggaacttgcggtaggcgaacgagcttatgaatag

SEQ ID NO: 1455 - DNA, 339 bp, Bacillus licheniformis
atgagtaactactatgacaaacataagcgcgatcccgaagcacgtgctttctataagtctacagcctgggctaagtgccgagccttagtgctcaagcgcgaccatcacctgtgtcaagactgtctcgcaaataaaacgatcactaaagcagagactgtacaccacataaaggagctgcgagaataccctgaattagctttagatgcatcaaatttggtcagcctttgcaattcctgccacaacaaacgccatccggagaaggggcagaaaagtgccaaaacagagaagaaacagagaaaaatcagggttgtaaagacagaggctaaccccgaattatag

SEQ ID NO: 1456 - DNA, 324 bp, Bacillus licheniformis
atggcggtaccgacagcgaaaaaaatccgggaatacctcggagacaggtataaagaatcggatgaagaactgatcgaactctacgttgacactcataagttttaccgccgactaaaaaaggaagtagccgagaaccctttaatgatgcggcatacgaacaaagcaggcgcggagaaccttgtcaaaaatccgttagcgattgagcttacgaagacggtgacgacgttaaacaatcttctgaaatcgctcgatcttacgccggctcaaagaaaagaattaaacgcgggcggtgaagaaaatgacgacggtttcgatcagctctaa

SEQ ID NO: 1457 - DNA, 1782 bp, Bacillus licheniformis
atgacgacggtttcgatcagctctaacccgacagacatcgaaaaatggtataaaaactggctaaaaacgcaaaaaatagccggatttatacgcgaaaaaccggcggaaaagttgcttacaacatggtatgcggaaaaagtagtctccggggagataatcgcaagtaagaaaaatattctcgcttgtaaacgacatcttcgcgatttaaaacgcgcaggaacagacgaatttccatacgtttttaacgaagaaaaagggcatcgccccatacagtttatcgagaagttttgtaaaccgtctcaaggacaatacaacagtttgacgcttcaaccgtggcaacattttgtgatcggatcactgtacggttgggttcatcgcgataccggccttcggagattccgtgaaggccttgtttttgttgcgcggaagaacggaaaaacaacgaaaatcagcggtttagccaattttgcgataacaaaggacgacgaaccgggcgctcgggcctacgtcttagcaaactcgaagcaacaagcgggtgttttattcgaggaaagtcgtgcaatggttcagaagtcgccggtacttcggaagcgtctgcgcgagaatcaaaaaggcatctaccatgacgcgtccatgagtcagatcgaggcacgggcgtctgatagcgaaaagttagacggtttgaatacgcacctcggcatattcgatgagatacacgaattcaaagattcaaaattgatcagcgtaatcaagaactcaagggcagctcgacggcagccgttgatcatctacatcacgacggccggctatcaactcgacgggcctctcgtcgaatattacgaaattgcttccgatgttttggacggatctaacgttcaggagcggaatttttactttatggccgaattagacgacatttctgaggtggaaaacccggaaatgtggatcaaagcgaaccctaacattggggtaacgatggatattccgtcaatgattcaggacttcaatgcggaccgtcacgtccctcgtgaatacaacgactggctggtcaaacggtttaatatcttcgtggataacggagaggaaagcttcatagacttcgaagtcatcaagagcaataacggacatgtcgatccggaatcgttgcgtggtatgagatgcattggcggcttcgacttatcacaaacggaagactttacaagcgcgtgtctggagtttttgctgccggataatcgcgtttttgttatgtctcattcgtgggtaccggcggcaaaagtacaaaaagataacgaaaaaatcgactaccgtgggtttgaagccgacggttttttgacgattatacccggaaattacgttcagtacgagtacgtttacgactggttcgttgaaatgtcgcgtaaatatcagatcgataagatcacgtttgacccagcgaatgcgatgcgattggttcacgatcttcaaaactacggatttcaaaccgaagttgtgcgacaagggtacattactctgagtgacccgttaaagcatatcaaagaattattgcttgacggaaacgtcgtttacaacgaaaacaagcttttcacatggtatctaaacaacgtcaagctcgtcgaagatcggaacggtaactggttgccgactaaacaaacgaggtaccggaaaatcgatggctttgcggcttttctgaacgcacatacacaggtttatctcgatatgacgaagccggttgagggcggaagcgtcggatttatctcaattagcgatctattaaacggttag

SEQ ID NO: 1458 - DNA, 1299 bp, Bacillus licheniformis
ttgggcttttggagcaatgttcggaacttttttcgcaagccatccgatgtcaaggcagaaacgagaagggatctaacacactggtatattcctcgagctactattctaggaaattacggagaacatgcgctggctgacaacgaaacagttttctcggctgtgtcgcgattatcaaacacgatgtcaagcctaccgatcaaggcgtataaaaattatcaaccgattgagtctcaggcttccgagcttctgacatacgcgccgaatcataacatgacatccgggcaatttatcggccttttggagacgcatcgggccgtatatggcaatgcttacgcaataaaacggtacggaatgcgttatgaagtcgttggattagaggttttggatccttcgagagtgcagccggtgattgaagagactactcgggatctttggtacgagattttaggagacaacggaaattatttcgttcacaacatggacatgattcacgttaaaaatacgtcggtagacggtctaaaaggaatctcaccgctaaaggttctgcggaacgccctcgactttgatcgagatgtccggcttttcagtctagaacaaatggatggagcaaagatatcattcattttggaattagcgaaccaactcgacgatacgcgcaaagaaaagatgttagagaactttaaaagtttctataaagacaacggcggcctcttaattcaggaaccaggggtaaaaatccgcgaattaaagaaggaattcatcgatacaaaggcgtttgaggtcgaaaaagtgacacgttcaagagtcgcgcaggcctttaatattccgttgtacatgcttggcgagacacagggcagcgtctccaatatggagcaactttatatcgattatgtacaaggaacgctaatgcctatcgcaactcagtacgaaaaagaattcaaccggaagctgctgactgaaaaggagcgcaagtccggttattattttaagtttagtatgaacgcgttattgcgcggagacatgcagacccgcggtaatttctatcaacaaggcatccggagcggctggtttaagccgaatgaggtgcgtgcatgggaggatttgccgccagaagagggcggagacacgctttatttaagcaaagatttatttccaatcgaccaggttgcgcaacagaaaatcacatcggctgatgccccgacgcctccatcgttagaaattaacgaagatgataacgaggactcgaaaggaggtgaggacgataaagaagttctgggaaatcaaagcggcgaagaatga

SEQ ID NO: 1459 - DNA, 747 bp, Bacillus licheniformis
gtgaggacgataaagaagttctgggaaatcaaagcggcgaagaatgacgctaaaacaggcgagatttacatttacagtgaaatcagttcggcccagttctggggggacgaagtgactacgcaaactttcaaggaggatttagacggacttggcgaagtatctgcgctaaatatctatattaattcgccaggcggctctgttttcgaagggaattcgatctacaacatcataaagcggcacaaagcccacgttaacgtctacgtcgacgggctggcggcctctatcgcaagtgtcatcgcaatgtccggtgacgctatttttatgcctgcaaacgcgatgatgatgattcataatccgtggactgttgcgcaaggcaatgcggaagaactccgcaaacaagccgacgacatggatcgtattcgcgaaagtcttatcgaggcatatctcggaaaagcaggcgaaaaactcaatcgtgatcgtttgatcgaacttatggacgcagaaacgtggctgacggcgcaagaatgtctcgaattagggctgtgtgattctatcgaagctcctagcgctgcggttgcgaaagtggatacgcagttatttgcgaagtaccggaacactccggaatcgcttcttaatcagacgaaagaggacgaaaagcaggcggaaaaagagcgcctgttccgtgagcagcttatcgcggaagcacaaacgaatttactaaaacttcaaaacgggggaatcatttaa

SEQ ID NO: 1460 - DNA, 1155 bp, Bacillus licheniformis
atggaactatttgatctgaaggcaaacttaaacactgtaggaacacaattagcatcggttgaaaaggaaatcatgaacaaagcggctgaccctaacgcttctatcgatgaagtacggtctctaaaacaaaaaagagacgatcttaaagagcgtatggacatcctgcaaaatcaacacgatactttagagcgggaacaaaaagctaaaattcaagcaagtcttgaaaaagcaaaagcaggcgcgtctgctggacttaacagcgaagatccaaaggttaagaaaatttctgctaaagcaggcttaatccgtgcaacaatgagaaaagaggtaccggctcctgaagtacgtgctgcgctaggagataataacggaacaggtggggagaaactccttcctaaaacagtttccgaagaacttattcacgaaccttttgtaaagaatccgttgcgtgaactttcaacgtatacaagtgtaacaaatctcgaaatccctaaagttgatttttcccttgacgatgatgatttcatccaagatttacagactgctaaagaacttgaagtagacggagatgtggttactttcggacgccgcaaattcaaagttatggcgaaaatctccgaaactattttggcggctactgatactgatctggtcgctacagttgagcgcgctttacaatccggcctagctgcaaaagagaaaaaagtttctttcgcagtaacaccgaaacagggagaagaggaaatgtccttctacgctgccggaattaagcaagtcactgcggaagataaatataaagcgatcaaaaaagctattgcggatcttccagaagacttccgtgaaaacgcaaaagtaatgatgacatacgcagactatctcgaaatcattgaaactttggctaatggaagtgcaactctttacggtgcacaaccggaacaaatcatcggtaaaccagttgaattctgtgatgctgcggttgatcctatcgtcggtgacttccgttactctcacttcaactacgatccggcaatcacttacgaaagcgacaaagacgttaaaactggcgaaaatgtatttgttcttactgcgtattttgatcacaaaatcaaactgaaatctgcattccgtatcgctaaagtagacactactccctaa

SEQ ID NO: 1461 - DNA, 498 bp, Bacillus licheniformis
gtgtccctcagttgggatgccgtagcctttgttgggggaatcaaagaatacgaaatctttagggacggggtttccgtcgggacccgcgttggcacgtcgtttaatgagagtggtttaaagccggaaactacgtataaataccaagttcgggcgatctcaatggcgggaaatccatcggagctgagtgacgagctttccgttacaacagagccgacgcctgttcctgatccggaaagcatcagcgtcagtccatcgtctaagacattaaacgtaggtgagacgcagcaaattaccgcaacagtatcgcctagtggggctgatcagggcgtaacatatacgtcaagcaacacgtcaatcgcaacggtgactagttccggtaaggtaactgcggttgcagctggttctgctacgattactgtaaaatcgaaagtgaagacaacagttaagaataccgtatcgatcactgtcgtcgacccggcgccgtctggcggtgagtaa

SEQ ID NO: 1462 - DNA, 240 bp, Bacillus licheniformis
atggatatatctctggatgaggtaaaagaatatctgcgtattgatggagatgaggaggattcccttatctccttttttatttccgcagcgaagacgcatcttgaaaacgccggtgtaaccgacaaggaatctgaattatataaattggccgtcctcatatacgtcacagacgcgtatgaaaatagatcaacggcattgagtggaaataaagtagctggaatcgtattgcaactgaggtga

SEQ ID NO: 1463 - DNA, 336 bp, Bacillus licheniformis
gtgaaaacaggcgattttaacaagcgaatcacatttcttcggtttaccgaaacgacaaacggtgagggattcgaaataaaggaatggttaccggttgcgaccgtctggtcagcggttaagacggtccaggggcgtgaattttaccaggctggcgcagtacaggcggacagaacagcacgatttgttattcggtattcaaaacggatgaagtcgcttcttagaaatgacttgcgcatttcatacgcgggaaggacgttcgaaatagaaagctttataaatgacgatgaacgtaacgtcacctttacgttagtgacgaaggaggtcggaatcaaatga

SEQ ID NO: 1464 - DNA, 324 bp, Bacillus licheniformis
atggcgactttaaaggatattggcgtacctgttcgatttattacgtattcgggcgacgaggacacgtacattctcttttatgtttataccgtatctgacgcactttcaatggaggatgaagaaactttcgctaatcactatgttcagattagtatcttcacaaaagacccgacaaaatattcagaattagaaaaagaggtaaagagccggctcaaacgagctggcttttttcgttcaaacgagcaggacctttatgaaaacgaaactgagctttttcacaaagtcttgcgttatgggacgacactaaatacggaagaggagtga

SEQ ID NO: 1465 - DNA, 582 bp, Bacillus licheniformis
atggcaaaaggcgtacgcgtaggtttaaaaaatatacactttgcgaaaattctaacggaagatgagaacggagttacttacgatactccggttaaaatcggaaatgcgatcgaagcaagtatcacaccgaacacaaacagcgaaactctatatgctgatgacggcccttcagaagttgaatcttcgttgggagaaacggaagttgaaatcggtatcgatcaattatcaactactgcacaggcgttgttgctcggtcacactattcttagcgatggtgtactagagaagaaagaaacggatatcgcaccgtacggagcgttgctttttgagtcagctactactggagggaaatctaaactttacgcgctatataaagggagattccagccgcaagaggagtcttttgcaactaaaggagatagcccagaattccaaacagactcaatttctggcgtatttgtacgtcgcgatcacgacaaggtttggcaacgtagcgtatttacgggagatgagggcgtgaaagcagaggttattgaaaactggtttaagaaagtttacgaaccaacaacttctactccctga

SEQ ID NO: 1466 - DNA, 315 bp, Bacillus licheniformis
ttgaaaactggtttaagaaagtttacgaaccaacaacttctactccctgatgcgccccagaatctacggtacgacagtacgacagattctattacagttgaatgggatcccgtagatggggcgacttcatacaacgtttacagaggcgcagacaagaaattcgctgaaaacgtgacgcaacctaagtatgtaacaaccggcatgagtccggatactaaactcacaattaacgtaacggctgctaatgagtccggcgagtctcctatgagcgaaattgtgacacaaacgaagatgaaaatagaaacggagagctaa

SEQ ID NO: 1467 - DNA, 336 bp, Bacillus licheniformis
atgcaaatcacattaatgattgatggtgaagagaaggtatttcaagcacctttcgtaaaggggcgtatgttgcgggaagctattaaactttcgaagtcgagcaactttgatgatttggatgttgaagatttggacgcattggtaggttacgtagtccgagtttatgacgaacaattcgatatcgatcaattttatgatgggatttcttctgaaaaactaattcctacaattacggaaacaatccaacaagtcgttggaactgtagctgttccaaatgaacaagttggcgagaacaaagaaactgaagcgcaggcaatcggtgaggtaaaaaactaa

SEQ ID NO: 1468 - DNA, 5301 bp, Bacillus licheniformis
ttggcgactgaatcagtcggatctatacgcgttagtttaggtctagacaacattgacttctctcgcggcctccaggacgttaacagaaaattaaaggtactaaactcggaattcaaagcagcaatggctggcgctggccgattcgataacagcctggattcattgcgtaataagaccgacatattaaatcggactttacaaacgcaaaaggcaaaacttaacgagttgaagcggcaatatgaagagagcgtaaggacgacgggaaggtattcggcacaatccgaaaagctcctcgcccagtataatcgaactgttgcagcggttcggaaaactgaggatcagttagaccttcttaaccgtaaaatgagagagcagagcaacggcttcagtcaattaggcgctaaaattagcgcaagcattaagacgatcgatacgaagttgcgcgtattggattcgtcatttgaggccgcatcagccggcgtaagggatttcggttctactaccgagcaactacgacaaaaatcggaacatcttacgcaatcgatctcgttacaagagcagcgacttaaaaacatccgccgactgtatctcgaagctaaacgcgcaaaaggcgaagatgctcaggcgactcaagaattacgcgttcaaatgaatcaagcgacggcacaacttcgaacaactcaagccgaactggccgcaacgaaccgacagatccaatcgaacacgggccgttggaacgagctcggcaaccggatgggtgaagtcggggaccggatgcgggacgttgggggtcgaatgcaatctgcgggatctgaaatcgcgatgtcattcggcgtagcgacagcggctttaggcggaggtcttgcggtttcaacgaaaaaagcgatggacttcgagcagcagatgtcgagcgtgaaggcggtcatgaatccggcagaagccaaccaatacagcgctgcccttacggaattagccattaaactcggtgctgatacgaaatacagtgcgcttgaggctgcgcaaggtatggaagaactcgtaaaggccggtgtatctacgaaggacatactgaatggcgcacttaagggcgcgctatcgcttgcgacagcgggagaattagagcttgcggatgcggcggaaattgcgtcgactgcactgaatgcgtttaaagacgataacattagcgttgcacaggcagcagatattctcgcaggggccgcaaactcttctgcaacaacggttggagagatgcggtatggtcttcaaatgacatccgcagtagcagccggtatgggactgtcttttaaagacacggctactacactagccctcttcgcacagaatggacttaaaggatcagatgcaggtacttcgatgaaaacgatgttaagtcgtttagtacctatgacaaaagctcagtacgagacaatgcacgatcttggtctagtcacccttgatacttccgaagcttttaaacgtatggctgataaaggcttcaaaccagcgagtaaaaatatcggcgatatatacgaggcacttaacaagtatgttgaaaagacgacaggagcgaagcaagggaccgaaaagttcgagaaggcctttgacaaagccactcggagtcttggaatcatggacaataaatttttcgatgctaacggaaatattcggagtatgacagaaatatctggagagctttctaaggcgcttgacggtttgtccgcaaaagataaacaagaagccctttacaatattttcggtagtgacgctattcgaggcgcgttgattcttggtaaggaaggaagtaaaggcttcgataaaatggcggctgcaatggataaaattaaggccgataatgttgctgctgaaaaaatgaataaccttaagggtaaaatcgaagagctttccggtgccgtagaaactgcacaaatttcatttggtaatgcgctaaccccagctatctctgcactcgtttctgtgcttcagagcgcgacggactggtttaatggtctatctaaaggaatgcaatcgttcgtagctatttctttagcggttacaactgtaattatgggcattgttgcagcgttaggttttttaatgctaggtgtcggccaaatgatatctggactcgggactgtaagcggtcttttaaaaggtttgataaaaagtgaaaagttcataaaggttataggtgttgcattcggagcacttacgagtccgatcggccttacggttcttggcataaccgcggtaggagcagctcttgtaatcgcgtacaaaaagtctgagaaattccgtaattttgtaaacggcgcttttgaatcagtcagaaacgtgacggttacggcattcagcagtatttcggcagtggtaggcgacacatttaattttatacaaaaagcttcggtagccgggtgggagagattttctgacggcgtctccgttattgttccggcagtacgaaagcgatttgctaacgtggttaattcaataggtgaattcgtttcaaacatcggatcgtcgatcgcagatagattcggttccggactagcggatagaaccggctccgcagtagatttattcattcagaatttaagggctgcgttttcgagcgtgggcggaatcatatcgattttagcgccaaccgtgactgcgttagggctggcgatggccggagtttccggatctattggttttgtcatcacctctcttgttagtctagccggttttttattccgactatatcaaacaaacgaagagtttagagcgtctgtacagaacgcctggtcacagattatgtcggtgatcggtaacgttgtagttgcgattcagccaatcataaatcaatttatcgggtatttttcggatattgcagcagagcttgcacctgaattcgcgaaaacgggcgaagtcataatgtccagcattagttcgttaggaccaacgtttactgagctcggaaatgcttttggggaattgtggacaacgttaggtcaatcattctctgaaattgcggttcagatagcgccggtaatccaggaattaggcgtgactttcgcggcgtttctaccgcaagttgtaactttggttggacagttgattcagacatgggcatctttccaagtccaattcgcacaacttattatgcaagtcgcatcggtactattgccaatgttagctcaagcatttacatctttgcttccgctgattttacaaatcgtatcgtctgtacttccaatagtgctacagttgattcagtcccttgttccagtagtaaccactattgcgactaccttgttaccaattttgctacaggcgtttcagtcaattttcccgccagtactggcgataattcagtctgtagtgcctatcgtcgctaatctgttaacatcagttgctcaaatcttgagtcagttggctgtaaccttgctaccactcattctgcaagttgttcaggctgttttccctgttgtaacaagcatcattcagattgccatgcaggtagccgtaacggttttacagttagtggcaactataattcgtactgttcttatcccagcgatccaattcgtgctgaaaattgtgcaagtcgtgttccctgtagttgttagtgtaatccaaaacgcactcaatatcgtgatcaacgtagttaagtttttcactgcgctactaaaaggcaattggagtgcggtctggaatgcgatacttgggattctgaaaagtatttggaacataatcaccgcagtaatccgaggagctgtaaatgtagtcctcacactcttttctggattggtcaatggggcagttagcgcctggaatttcttgaaggacagaacagtaggtttgttcaaatcaatcgggaaatttgcggccgacacgttccacaacatgatcgagggagcaaaggcgctaccaggtgaaattggtgacggaataaaaaatatggccggcagagctctatccggagttaaatctctaggaaatacgatgatcggcggacttgaaggaattatcaatggcttgacgcaaaaagggattaacaagctactcgatacattcggggtggataaaaaactccggatccctaaactcgaaattccgaggttcgctaaaggtacgccagcaggtgggcacaaaggcggtcttgctatcttaggagatggaggcggtccggagttattccgtacaccttccggtttcacaggtttaagccctggaaccgacacgctctttaatctgccaaaggggacgcaagtcttgccgcataaagaaacacgcgaggtactatcttctggaatccccgcattcaggaaaggtacgaagaacaaaagtttcttcgattctgctatcgatgttggaaaatccgctgttgatgcgggtaaagctgccgtaaacagtgttaaggatttcgcttttgatgcgtgggaatacgtaagcaatccgtcaaaacttatcgctaaaacgatagaaagtctcggactgaagttgccggatatttccggagctttcgggacaattgcgaaaggtgccttcggtaaagtcaaagattccgccgtcagctttatgaaaaagaaactcgctgactttggtggagctttcggaagtggcgataaagcgtccggaaacgttaagcaatggattcgggcggcgatggctaaaacgaattcgccagcttcttggttcgctccactcgttacaattgcgatgaaagagtccggaggccgtacgggtccgtctacaattaatcgttgggactcgaactggagacgtggtacaccgtcaatgggacttatgcaaacgatcaaaccaacgtttgatgcgtataagcttccgggcatgggcgatatcatgaatccggtgcacaacgcggttgcggctatacgttatatcaaatctcgctatggaagcccgtttaatactccaggcatcagatcgatggagaaaggcggtccgtacaaaggatataaaatcggcgatattgtgacgcaaaagcagctcgcctggattgcggaagaaggtccagaagcgattattccgttgcaaaaccataggcagcgggcgcagcaattatggacggcggcaggaagagaaatcggtatggatccgtctggtggaagtaacgaagaagaactcgcgttgttgcgtggacagaacgcgctactcagacagacgaacacattgctaacggggattctacgcaaagatccgagtgtagttgtcgatacggcagcactaacggacagtgtagaaaaaggtcaggcacaaaacatcggattcaataagctgctgtggggtgatcggtaa

SEQ ID NO: 1469 - DNA, 822 bp, Bacillus licheniformis
atggcgtatcttacgattataaaaaacggtgaaaccattgatcaccgtaaatacggcttaaagcttttgagttttcgcaaggaatcgctaacacaccgaactaactttgaagaaataggaggcaggcatggcgcaatagatacgggaacgactttcggtgagcgaaaacttaaagcgacgtttttaatgcaaggcgtagaccatcttgattatcagttgatgatcgatgaggtctacgctttatttgcgtgcgaagattcaatcgaattaatagattcgagacagcccggtaaagtatggacagtaaaaccaagtagcacatttgagcctgacgatttaaacccgaggagcggtaaatttgagatcgaatttacgtctccgttaccgttcgcgagttcgtatggttctactcttgatccgttcacattcggcgaagaagtttggcaaatcgggcaagggctgattccttcagatagcctagtttacagacatcgaactactcgattcagtattttcaatgctggaaatgtagaggttgatccttgccttgaaatgccgttgaatatcgtttataaaggcgcatcctcaaatttttcgatcaaaaacaaaacgaccgggcagacgatttcatataacgggacctctaagtcgaccgattctataaaactcgaagggctgcgccatctgaagaacggtattagcatttacggaaataccaatcgcggatacgtttcattaaagccaggatggaatgacttcgaacttaccggcacatctggaagtttcgaaattacatttgattttttctttttctataagtag

SEQ ID NO: 1470 - DNA, 1527 bp, Bacillus licheniformis
gtgaaaacgatagcaattagagacgtaacaggtattatggagccgttaccgggattttcggtagtacgaacagatggtagcgacgggcagagatcaataaaattaaacggctataaaacaactaataaccagtacggctaccagtttgtaaaaaacgaaaatacagttgtctacgatgacgaagagtacatcatcaaaacacatcgcgaaagaacgtaccggaaaggcgtcggagttgaggcaacggccattcatcgcatctttgacgacttgaggaacaattacatttacgatgagaagacgggcacgctccgattggatgcgatgctctcttttgcattggagggaagcggctacacattcgaaattgatacgacggatttaccagcgtcagtcagagttgaaaattttggatggaataactctctcgctcttttccgagacattctcgaaaagttcggtgcagagttcgactacaaaggtaagaaaatctatgtcgctaaaaaattcggcatccaaagagacgaaccttttctgcgttataggttcaacgtaaaggatccggaaaaagaaattgatacaagcagtttcgcaacgtatattcgaggttacggaaagaaagacgataaaggaaactatttgtttgccgagtacacaagtcctttagccaaaatatacggtattaagcacgctgacccggttaaagatgagcggtacacagacaaagatagtcttctcgcagcaatgaaaaagcaactcaacgataacatcgatatttctcttacctttacagccattgaacttgaaagtatggggctcagggatattaaaaagggtgattatgtttggtgtgtgattgaaccatttgacttaaatgttcaattacgagctgtaagcagagaagattactcggatgaaaccaagtcacctacgtttacttttgggactattacgaaaaaagcttcggatattatcgcgagctttaatacgacaaaaaaagcggttgacaaggttatcgacacgtctaccggaaaaataaaagactctgcaattgacacgacgggcctcacaacgaaatccgagtttcagtcgcacgtagataacaagatagtgcacataacagcggaggaaagagctgcttggaatgcggcttcaaattcaatcggtgatttaacttttatcacctggagcacgccaactcttaaaaatggttggattcagtatacggcgaataccgaaagctatccgattcaatacggaaaggatgcgatagggacggtcaatatcagaggagctgtttcgtcaggggtagtcggatcttcaactccagtctttactttgcccgctggttttagaccgccgtttcctcacctttttatcggtgtttcatctgtcgcaacagacggtacgcctcaatattttcgtgggattataaagacgaacggagatgtttgcattgagaatatctcaaacaaagatactcccaatcagtttatcggtatctatacgcaatttaaagcgatttaa

SEQ ID NO: 1471 - DNA, 1980 bp, Bacillus licheniformis
ttgggaaagttctattataaaaaagccacaacaagcgggtttgatcgccaatatataaaagaccaaaatcaaaacctagatgacataggtaaggacatccgagaagttgacacaaaaataaatgatcataaaaaagccaaaaacgcccatacatccgaacaaatatcgcacgaaagcggactaaatgtcggacaggaaatcgaagtaacgaaggcgcgctttagaaatctcgtcctaaatgtcgacggaaccaacgttaaagaagtcgtcgatgcccgtgtcggccgggacgggacgatttatccgacgctcagggatcgtttagacgccgacggacagacggttgatgacataaaggacgatcttatcacgagaatcagctttaaaaatgcacttagttatggcgcagatcctacggggaaaacaccgtcagcggatgcgattcaaagcgcgctggacgaaatccacagcgaaggtggtggttggctcgtcattcctggcggtacttatctgatcgataaacgcatgatcatttacgaaaacacacgcgttacaatggcggctgattgcgtgctgcttcgaggatggtctggcggattctttgcaaacggtaagcccaccgataatttctccggatattccggaagaggtaacatcgtcattgagggcggtatgttagatgggaattacctgaagatcgaaacatataaaacgaatgcgatggacagcgttattatcggtcacgcgaaaaatatcgttatcgataacgtaacgtttaaagacgtaattaccgaccacgcaatcgatgcgaacggatgtaacggccttcgaatcacaaattgcagatttaccggatttatcgatactagcggaacacgtcctttttctgaagcgattcagctcggagagtttacgaaaggcggcgtcaacattttcggtgccttcgacagcacgccgaacactaacgtctatattgcgcataactacttcggaaagtccgatcttttaggcggttggggatgcgctgtcggaaaccactacgctgtatacgacgtgttccagacgaacataacgatattcgacaatacgattgaggattgcgggtttgctggcattcgtacatttaaatggggcgaagttaaaattattaacaacgtcttcagacggaatcgggagtgcgtccggatttcgcaagtttccggcggaatcgagagctctaaaaatgcctctggcgtacagatgaatcgcccacaaaacgctcaaaacattctaatccaagggaatgacttctacgagtatacggtctgcggagtagttacctacgggcagatttacaataaggaagctgcttggagcgatggtatccggatcttcggaaactactttaaactgcgggagaaagatatcggcagctacggcaatgagcaggcgattcagataatctacggaaggaacgtcttcatctccgataacaggattttcggagggcgtaggggcatctggctcgagggttgttttaatacgttcatctcgaacaattatatatcatgtgtagatacggaagcagtttacgttgcgaaaagccgcgatacatcttcgactatcacaaaatctacacatttatcgatagacgggaacgaaattaacacgatcgggcgaaacgggatctacgtccagaactgcgataattttgatgtgcggaacaacaacatattcaatacgaatatcgaacaaggatcaaaagatcgcggaggtgttttcgtagaaaaggcttacgatggacgtatcgaaggtaaccgaatccgaggtgtagagaaaatattcgccatcttagtccagtctaccgcaactgaagtgaacgtgtttaacacgaagggaactggtcgcgtcatcgttcaaggtgattcgaatcttaacgggtattacggcacaacacagaatgattatataagaaaaatcagcacgaagagcagcagctaa

SEQ ID NO: 1472 - DNA, 1551 bp, Bacillus licheniformis
atgatatataaagattccgaagtccatttcaatataagctcgcaaattaaacgaagtgtttccgcgaacattcaatttagtacgcaggacatcaatacggcaaagctaacgatcagcttaacgaaggacggcgtgccgttgccgataagccaagcgactcacggtaagttgtttatgcggtttgcggacggaagcaagttctacgttaatacggaagttcaagacgcgctcgggggcgttattttttatgtcttgacgccggatcaagttacgcattacggaacggtgcaggccgagctttacgttaattatgacaacggccagaaattgagcgtccataaattttcgtttgaaatcgatcgagcactcgtcgaccaggatatcgccccggtggccgaatattatgttgacgatttcgaatcgctaaaggccgtcattcaagaaatggcggacgatgccgaacaggttctcgctgagttacagaagaaattcgaaaatctcgataacattgagacgaaagaaggcgctcaggaaaaagcagacgtcgcagaggctggtgctaaagcttataccgataagcatgcggctaaaattgataatccgcacaaggtaacgaaagctcaggtcggcctctcaaacgttgataacgtcaagcaagcgtctaaatccgattttgacaatcatgtcggcaatacagcgaaccctcacgcagtcacgaaagcacaagtcgggctgtcggatgtagacaacgttaagcaggcgagcaaggccgaatttgatacgcacaacagcgacaacactcgccatattactgcggatgaacggacgaaatgggatggcggccaattgcgcaagctgacagacgacagcggcaaacggacacaggtcgcagacggtgcggatctgctgacgttgtccaccggattttattttgcgacaggaaatgccgttcagaataacccgacgacaaatgacagcgcgcagtttacttacgacgttatcgaatccgatcagggccggaagacgatctatgcgtggaggaccacggacaatacgctgtggcacgcgacagttattccggataccgcgtttaaaggatggaagcgagttatcactgacgacgattttcggaagaaaacattcgtagatacgtacgattttgataactctgcatttacggcaactgagggcgtggttacaaagataaagttcggagctgcccgggctgacgaccaatcagaatatgaccaaacaaagtctgagattaccttgaaaaacagcggtttgtatctggtcagattgtatatttcagcaacagccatcccatctaattcggacatcggatttatttgctatgtcaatgatgcgcaatatcaaacgatgggctactggtacccttcaaaaagtacacaaacgaatgtagtattcttacagcagaagtttaatagcggtgataaagttacctttcatattttccctaaagtgaccggtagcactccttcatcagtcagtgttaagtctgcgtttttaacgatgtctcaaataagatag

SEQ ID NO: 1473 - DNA, 297 bp, Bacillus licheniformis
atgaacctagcacttgctgttaaatatttattcccggatgcgattatcggtgaggactttatcataagagacgatggggatgggcgcggtcagtatattgagacttggcggataagcgctccgcaaccaagcgaaaaagaacttcaagaagcatgggaaaattacttggaaaacccagttacagatgatccacaactttcatatacatcccagcagcttttaaagttaggccgtgagatgtcttcactgaaacttgaaattctcgcgcttaaaggagagatgactaatggatcttaa

SEQ ID NO: 1474 - DNA, 177 bp, Bacillus licheniformis
atggatcttaatttttgggtgtacgctctttattataattgggctgatactcctatggttaagcaagcactacaatacaatgacgtaacaattgaggagttaagagacggtgtagatcaaggatatgttacgcctgagcaattccaagaaataactggcgagaagtacattgcctag

SEQ ID NO: 1475 - DNA, 828 bp, Bacillus licheniformis
atgagaaaattattttttatatcgctagttattatgctttttcttagtgtgaatgttgggtgtagcaacgtcgatgctacaacaagcaaatcgatagagtattcacctcttataatcgcacatagaggagcttcggagctggagcctgaacatacaatcagatcttattcgagagcaattaaggacgggaccgatttcattgagatcgatctaagggtgacgaaagacggaaaactagtcgcttttcacgatgaagacgtgtcccgtacaacagatggaaagggagacattgaagatttatcgttaaaccatgtcaaggaattgcgaactgaaaaagatcaacaggtcttaactcttgaagagattatcaagaaatacggggattcaacgaagtattatatagagactcgcgaagattctaaaggccgtttggttatggagaagaaactgatcgatatactcaatcgctataatttacttgaaaataatcaagtaatcattcagtcgtttagcgcgaaaagtttgaaacaagttagaaaactcaacaaagaagttcccatcgtacaacttgtgcagacttgggatgcggagaaactgtccgaaagaattaaagactataaaaaatacgcgtatgcgattggaattagttctcagacgctgtctgacaaggaagtgaaaatgattcatgacgagaatatggaggtccatacgttcttccgtgtcgagttagagaaagaggaaacaaagcgaatgattgaactaaaagtcgacggtatgttcgctaataacccggcctatttaaataaattactcgatggatcaaagtaa

SEQ ID NO: 1476 - DNA, 204 bp, Bacillus licheniformis
ttgggcgagctggacgtaatcaaatactttttaacgcaagggccgttcgcggtcctttttacgtggctgctaatttacgtaatgaaatcgaatcgtgaacgtgaatcgcggctacaggatctactcgataaattcagcgataaatacgacgtcattatcgacaagctcgatagactcgaagagaaatttcgcggaagagaataa

SEQ ID NO: 1477 - DNA, 936 bp, Bacillus licheniformis
atggcgatttcagtcaagaaaaacctcgtcgcgtcaagtaagtattccgttaagtgtccgtattcaatggatgcgaagtacatcacgtttcacaatacggcgaacgacgcttcagcagcgaatgaaattgcgtacatgatccgcaataacaaccaagtatcgtatcactttgcggtagacgataaagaggtcgttcaggggattccgacaaaccgtaacgcatggcattgcggagacgaaaacggacccggcaaccgttcatctatcggcgtcgaggtttgctattcgaaatcaggcggcgctaagtataaagcggccgaaaaacttgcgattaaattcatcgctcagctattaacagagcgcggctggggcgttgatcgcgttaagaagcatcaggattggagcggaaaatactgcccgcaccgtgtactcgatgaggggcgttggggtgcggtaaaagcggccatcgctgcggaattgaaagcgctcggaggaaagtcgtctagccctgcgaaatcagcaccgaaagcatccggtaagacgtataccgtaaagaaaggcgacacgctttcggaaatcgcggttaaaacaggcgttagtgtggcgaaactccagtcctataacggtattaaaaatccgaataaaatcatggtcggtcaggtgctgaagcttacgggcagcgttagttccaaaccgtcctctagcggtaagaaatacgtatatcttccggcatctgccgactcatggcgcatctatccgactaacaaagcgccggtcaaggggaacgagtgcggatttctgcgtccgaagaaatttggcggccttaaatacgaaatccttgcgaatccccaaacggacgtctatacgatcaaaacggatcagttcggaaaagtgaatatctacgcggcgaaatcaaccggcgcaactattaagtaa

SEQ ID NO: 1478 - DNA, 258 bp, Bacillus licheniformis
atggaagaagtattattatttgcgactgtgttggcgcccatcctaacggcgcttgttcaacttgttaagaaaacgattaacatgccgaccaatgttgtgcctgcggttagcttcgttttaggaatcgcactcggagccgtggcctatccgtttacggacctcgaactagtattgcggttgtgggccggcggttttgcgggactggctgcgacgggtcttttcgagatcggcgcaaaacgtgaaggaacgaccaagtaa

SEQ ID NO: 1479 - DNA, 357 bp, Bacillus licheniformis
atgaagaagatactgttatcgctcctgttaatcccgttgttagctttaacagcttgtaattcagtcgattcttctaaaaacacagaagacgagaaaatagctgatactaaaaaagaagaaactttcgaagcgacagagaagaatataaagcttcttgttgcagacgagctgaaagaaaaaggcattgaagacaccgataagttggactcattcgaaatttttgatgatgtcaataaagataataagccgattaaaaccgtacttatcacattaaacggaaatgataaccttacaaaaaacatgataaagaaaagcatgcttaaagagggagaaaaaactgttccctcggatatttga

SEQ ID NO: 1480 - DNA, 204 bp, Bacillus licheniformis
atgcgtcttcgtctgaaagaactgctcgaggagcacggatatgaacaaaaagaaatcgcagaggaattggagttatcaactcgcgctgtgagtgaattatgttcggggaaaaccaaaaggtacccaaaagaaacgcttgaaaaaataattgataagtttaatatcacagatatgaatgaattgtttgaggttcacgaggattaa

SEQ ID NO: 1481 - DNA, 819 bp, Bacillus licheniformis
atgcattatttagcggaacaccaaacgttcgcttcgacggccgaactcaacgcggcagtctacgaacacatcaagcgcaatacatacgaattaaatgacacggaccggctgacgctgaagacgattgctcgttacgcagtcaaattcgccggcgcagcgcatctcaaagcggagacactcgcggacctgatcggaaagtccgtcaagacagcgcgtcgtgccgtcaacaaactcgcatcactttcgatcatccagaaggtcgcgacaacacggaaaataaacggcggccacggcgccaatatcatcgtcattcttccggtcggaagcagagtcgaggacatgcaattgtccgaagatgaccagtcgacaatgaccacgcgtggggatgccgaaaagccatcagagccaacggatgaatcgcctaaaactacgaatgaaccatcggattctataaatctttcaaaaaatcacgtaatagatacggtgccggcctgcggtcttaaaaatgcgttaccaagcgaaatctactccgcaatggcgcgctacttcgaagcagacgaaatttataaatactacggaatcttattgcgggctaaggcaagcgtagatccaacgctgatactcgaagaacatccgcagccattcgttgaagcgtggcatgcagcgattctgaaacgaaaacagcagaaaattagacgctttgacgactacctatacgctagcttccgacaagccgcatggacagtaaaagcccgtgaaaatcgcgttaaaaacgttgggctattggcggagttcgaaacgttcctccaagcggaatag

SEQ ID NO: 1482 - DNA, 330 bp, Bacillus licheniformis
atgacattacgcgatagagggacgatgaaatggacgtctatattcttgccggagcacatcgctagtctccggaaacttaaatccgaaattgatcacgcatatgagcggaagccatcgattgatccggagcagtggtcggactttgaatcgaagatacaatacgcgtacaggaccggacaggattgcgagatccgttactggcgtaattgggtcgcggagagggtgagcggcgtgattgaatccgttgatccggtcggagggacattgcggattgaaggcgttgacataccgttcagggagatcgtgtgggttgcgttggaggacgtgtga

SEQ ID NO: 1483 - DNA, 1146 bp, Bacillus licheniformis
atgacagtgattaagaaagacgataaaaccggaaaatattattttgtatattctggcggggttcacccgataactggtgctagaattcaaaaaagaaggcaaggaatgtcgagtctacgagaggcgaaagaggttttaaagcaggtcataatagaggtggataaggaaaaaaattctcataaccctaataaaagcgtgtttagtaccttcgctgaaaaatggtttgaatcgaaaaaggttagacttcgatcaagtacaatcgtcaattaccgcgagcagcttgattacaacatacttccatatctaggaacgtttaaaattaaagacatcactgaggaagtcttgcagcattatattaatcgacttcacaatgaacggaaacttgctccggcaaccatccggacagctttcggtgttgtcgccgaagtcttaaagaaagcttcccgaaaaggagcgttcgacctcgccatccttgacgatgtaaaccttcctcccgaaaatcgcatttctaaagtatggaacgagtcgaatgtacaagcgtttttggatgctcgcaaccgtatcgtgtcactaactcgttactttatcggaatggtattatccgttattacaggcatgcgaatgggggaggttctcggattgcggtggtccgatatagacttcgaaaagggttatttaacaattcgacaaactctcgctaagatagacgacgaaggtaattacggattagttcccgaggtcaaaactgcggcgggcttcaggaccgtccatttaccgaaattctttatcgaatacttaatcgaacataagaaaatggtccagcgcgaaaaagaaattctcggcgaggactacatcgactatgatctcgtagtgtgtacgaagcacggtaagtgggtacatccgaataactatcgacgggcatttactcggttaattgcgcagcttgagctcccgaaaatccctccgaagaatttgcgacatactcacgcgacgtatttaatcagtatcggaatcagtccgaagattgttcaggagcgtttaggccacgcacatatcaaaacgacgctcggaacgtacagtcatgttttgccttcgatgcaggcggaattagtcggaaaattggacgatttagtcgcgaaagtgtga

SEQ ID NO: 1484 - DNA, 198 bp, Bacillus licheniformis
atgaacatcatcatgaacgatttaattgagctgatggacccgcgctacatcgaagtctggggcaaattcacgccgaggggcggaatctcgatcgacccgtacaccaactacggcaagcccggcacaaagtatgaaaaaatggccgagtatcggatgatgaaccatgatctgtatccggagacgattgataatcggtga

SEQ ID NO: 1485 - DNA, 1238 bp, Bacillus licheniformis
gtgaaacagttaataccctcgtcaaaagtcggagtgaaaatccacgaatggtataaaatgataagagagtttagcgtaccggatgcagaggctttaaaagaagaagtagagaaggaaattaatcaaatggaagaagatcaggacttactcctttactatcagttgatgtgttttagacatcaattaatgttagaatatttagaacctactaacaaaagaaaacaaggacaatcaataaacaaattgttggcccaaatcgaggagcctcgaagagatttaaatggcctccttagttactactcatttttctttaggggcatgtatgaatttgagaaaaaacagtacatcaaagcaatagagttttatcgaaacgcagaaaaacagttggctctcattacgatgttatagaacaagccgagtttcactttaaaatggctgaagcatactacatcatgaaacagacacatgtatcatatattaagggcctttaaaatatacaataatcatgaactctacacagtccgtaaaatccaatgtttatttgttatcgcgggtaactatgacgatttaatgcgccatgacaaagccttaccccacctggaaaatgcacttgaattagcgatagagatcgacaataaaaggctcattagttctgcctattttaatatagccgactgtcatgaatgtatgggagacattgatgcagcagttgaatatgctgaaaaagccgtagagattaatctaaaagaagaatataacaacctaccacaatcattatattactctactcaacttctttttaagcagaaaaactacgagcgcgcaatcgagatatttcttattggttagacaaacagctcgaaaattcaacgataccctattcacttctctatttgaatatcttgaggcgttatatatctattctgtgaataaagaagagattttagaggtatttaaatacttggaggagaataaaatatttgcatacatagaagagctttcgcttgaagtctctaaccaataccttgaaagaaaagaccatagaaactcaatcgagttccttcaaaaaatgatgtatgggcaaacaaaaattaaaaaaggggagtgtctctatgagtattaaaaagctcgttattcccattttagccgccgcgttattaacgatgggtattagcgttgtttcagcaaccgaccagtctgacggcgtatatcaaatcgctacccgtaagcaaacgtaa

SEQ ID NO: 1486 - DNA, 792 bp, Bacillus licheniformis
atgagagcactaaaacaactcgttcgttttggttgggagcagtccttgtcatgtgtatttcctgtcgttatttttgcctctttggctgttacacaaatcatacctcttcccttcctgccgcggtatgacttgctgctcatcatctgtgttctcatgcaatggtggatggtgcgttccggtcttgaaacacgggatgaattaaaagtaatcacattgttccacattattggacttgctcttgagcttttcaaggtgcaaatgggctcctggtcttatccggaggaaggttactccaaaatctttggggtgcctttgtatagcggctttatgtacgcaagtgtagccagttatctttgccaggcttggaggaggctcaaggttgaactggttaagtggccgccgttttacgtcgttgtaccgctggccgctgcgatttatttaaattttttcctccatcatttttggattgacgtccgcttttggttatctggacttgtgataattgtcttttggaaatcatgggtcatatacgaggttaatgggattcgttaccgtatgccgctcgcactttcttttgtgctcatcggattttttatatggatagccgaaaatatcgcaacgttttttggggcctggacatatccaaaccaaaccagtacgtggagtctcgttcatgtagggaaagtgagttcatggctcttattagtgattgtcagctttctaatcgtagccacgttaaaacaggtgaaggggaaagattccactagagtggatgctggtcaatttttataa

SEQ ID NO: 1487 - DNA, 222 bp, Bacillus licheniformis
atggcaattataatcaatatcgatgtgatgctggctaaaaggaaaatgagtgtaacagaactttctgagaaggttggaatcacaatggcgaatctttctatattgaaaaatggaaaggcaaaggccattcgattatcaactttagaggcaatttgtaaggcgttagaatgtcagcccggagatattttggaataccgaagtgatgaagacacccaggattaa

SEQ ID NO: 1488 - DNA, 483 bp, Bacillus licheniformis
atgaaacggggatcaactctctttttaaagatagctgttattcttattggaatcccagttcttgctttgtgcatattttttgtgccggaaatagcgaattttgcagccgaattgtatccgggtatttcttatttgaaatatctcgtatatgccgatttgtatgcagcggcgatacctttttattttgctctgtatcaagcctttaaacttttaagctatattgaccagaataaagctttctcagaattatctgtacgggctttaaagaatataaaatactgtgcaatcaccatcagtattttatttgcggcaggcatgccgctcttctatcttatcgcagagatggacgacgctccagggatcatactgatcgggttggtccttatttttgcttcaatggttatcgcagtctttgccgctgttctccaaaggctattgcaagaagcgattgatataaaatcagaaaatgatttaacagtctga

SEQ ID NO: 1489 - DNA, 246 bp, Bacillus licheniformis
atgctgaaaacgggcatgagagtaacagccgcaactaagcttgaaggcattaaaacgacgctaagaccgaagtttaaaatagacgatatacaaaaagaaatgaacagcgtttattcatcgcttctctacagcttcgaaggaaaagcgcagcaggcgcttgctcagcgaatcagtcaaagcgcccagcagcttattgcgacagagaaggatggagaaagttttgtgaatggatttaagacaagatga

SEQ ID NO: 1490 - DNA, 330 bp, Bacillus licheniformis
ttgcggacgatgaaacgggaagccgaaaacgcttatcaggaacacgacgccgagatcaatgacctgaagcacgatacctaccgtcaagtcggccacggtttatacgacaagctgacactcgaggatgtaaacaatacgctgaaaaacctggcgcagtcgtttgacaaaaaaggcaatccgctattttacgatgttcatgccgaaaaagcttacatcgcctcattaaaggacacgatttcagatttagaagacatcagcggatacctggcgcagattgcaaaagattttaaatcgaaagataaaatgctggcaaattggcttaaactttag

SEQ ID NO: 1491 - DNA, 1116 bp, Bacillus licheniformis
atgtacctgaataaaaagagcgatattcctaaattaacagataaagagtattattttcttagccaaaacacatatagtaccgataaaatgaaagaagcattcaaggaaagaacacctatagagagtaaatcaaataaggctttttttgttgataaaattaaaagggactctgacactggacttgatgcgtatgtttttgttcaagcaaagaaaaaggacggtaaatgggttaaacctaacgcaccagaaaacgtcgtcgtggccttcgctggaacaaatcctaaagaacagttttttcaagatgttattgatgcagacggcggtaacgttgttatgggtcttgatccgaaaaagaaatcgcaatacataatcgaaaaagatgcgaaggatacatcaaaaacaataggaaaatacaacgcaaccccctcacaagacgcgatgcttagcaccggtaaatacaaattaattacgaaaacgtcccaaatcgggcaagctgatgatctggtacgggaagttaaacaaaagtataaaggcacctcgacggttatttcaaccaccggacactctcttggcggcgcagaggctgaatacagcgctgtgaacaatgatatatacgcagtcgcattcaacaatccttccgtcgttaaattgcattctgaagaaaagcaaaaggagatccgaagcggcaaatatgactcgtctgtaaaagcgattgtcaatccggatgatatgactggttccggctggtggaatgagtacgaacgacacgcaggcagaacaatatataccaaagacccctctacttcgcgtgtggaacgacaaatacgactagatccgaagtatagcggcggtatatttggcacagtgtttaatgtcgctgtagactacattgctaccacagcaatgggaatgccggatacacacggcctcaacaaaggcaactttaccttcgacgaaaacggcaacgttcaaaatatagagggcgatgaactcgtttatgacaaaaatttaaaagcgatgcttccaccggaagttgcatccggaagtggcgcaattaaagtaacgcccgaagttgccaagcagctcgcgcaaaaagtaaatgcttgcggacgatga

SEQ ID NO: 1492 - DNA, 345 bp, Bacillus licheniformis
atgaaaaaatacataattatccttcttgctctggtcattataacatctggaggaatatttatgaagcaacaaaataataacagagaaaaagaagagctttataatttagctaaggaaagaatgacagactttattaaaacgaattataaggacattaagtcaattgattattatgatgactacgaagtgaatccaatgggcggaattgatattaaagggtatctaaatgatgataagaaaaagaaaatatggggtatttacgataaggcaaatgacgaagttgggtccttcacagtcgatgctgaaagaaagcccgaatataaagataaaatttgcgattattaa

SEQ ID NO: 1493 - DNA, 855 bp, Bacillus licheniformis
ttgaaatataaaaaagcagcagcacttggaattggtttacttttatttataggcggatgtcagaagagcggggaagctgaaatcagcgtccaagattacacaggacaggattttcatattcatagtaaaggttatcagaaggaaaccgctgagatcgcagaagcgcatcgagatgaagttgaaaaaacggtaaaagattattttttggatcaatatagaacgaaggtaaaagtccataacattgtcggagggcatgggtttgttactgtgtatgccgaatcagtcggaaacttgcatttctacacaagcgcaaaaattgaaattgatttggacaagaaagaggtgcaggctgacgcgatcagctcatcggagtgggacgtaaaagactcgattacaagcgcgatatatgcgttggcttttgaagaagaatttgccgctctagattactatttagagaagctggcagaagaagagccggttgtaggtaaaacgcaggcagccgttgataacacaagcggtatgggatatcagacgccttattatgctgtttctttaaatgctgattggaaggatgacctttattcagcctatttagaaaacccaaaaagaagcaaaaaagactggcaagagaaattggaagatgaagaaatcaccccaaaatcatgtgatatcaatatacggttatatatgaataaaccaaatacaagaccggacgagcgcatttataatcaagttgtccaggatatcgaggacatggaagagctggccccggggacttacaccatttacttgagtgacaatagaatcaacaaaaacctaggatataattcaagaaaaagcacgcttggccgataa

SEQ ID NO: 1494 - DNA, 189 bp, Bacillus licheniformis
ttgaaaattgcaaaagtcgggaacgtcatcgaatttaaaaacggactcaccggaatcgtagaaaaagtaaacgaaaactctgtgatcgtcgatgtcacgattatggaaaactacagagacttggaactggactccttaaccgtcgtcaatcataaaaactataaaattattaaagactccctgcattaa

SEQ ID NO: 1495 - DNA, 195 bp, Bacillus licheniformis
ttgacagagcaaaatgccatcgatcagatcgagcaattaaggtcagggagcattcatgagctccgtgtgaaaaaagaggattttctttctttcagagccatcttaacaaagcaggaagattttaagcattttcgcggcattgcccagcatggcggagatattatatttcaatatatgaaagaggcaagaagctga

SEQ ID NO: 1496 - DNA, 612 bp, Bacillus licheniformis
atgaaatcgaaatttgctgctctagctgcgtttttaatctgcatgctgccggcggcaagaatcgagcatgctcaagctgtcatgttgttctcgaaaaaagataaacaggaaatggaacggctgatggaaagccttaaacaagaagaaaatcctgctttttcccaattgacagatgagaaaagcttcattgaagccgcgcatctgtcagctgaagaggaggaggaaatagaagaagctgaagaagagacgactgatcttacacataaagaaaaagatcttttatcaaggcttgtacacgccgaagcgaaaggcgagtcatttgaaggaaaagtggctgtcgccaatgtcgtcctgaatcgggtgaaagacagccgatttcctgacagcgtaaaaagcgtgatctatcaaagaaacgcttttgagcccgttctaaacggcagcatcgagaaaaaagcagaccgcgaatcagtggaagctgtggaagaagcggtagatcaaaataaaaaagaaacagaagctttatttttctataatcccgacatcgcttctgatgactggattaaaacgagaaaagtcgtgaagcgcatcggcaatcatgtctttgcgatctag

SEQ ID NO: 1497 - DNA, 1341 bp, Bacillus licheniformis
atgaaccgttttgtaaaaggaatcgttcttctttcgctagctgctttttttgcagaatgtcttgaattcgtcatcaacatgattcttgcacgggagcttggcgagcatggcatggggctctacatgagtgttttgccttccatttttttggtcgtggtgattgcgagccttgagctgcccgtatcaatatcgaagtttatcgccgagtccaacccgaagctgcacgaaagcatgctgaaacatgcattgcggatgactgcggtctgcacggttttctccacggcagccgcagtgatcattcttccatttattccggtttttgattcttaccaccctctaatcagaggacttgtgatcgggatgattcctacggttgcattcacatcgatcgcgagaggctacttcatgggcgttcagcaaatgggtaaaatcgcaacggcgaatgccttgaaaaaaatctttcagctcatcggcttgtttttattttttcaatggtattcctttgaattggatacttctcttctcatttcattgtttgtcctcgttgcaagtgaagtggtcgtgtttgtttatttgttttcgcagtttgttttggtcaggcgtgccgctcaaaaagggcagcagatccacttgcggagaaacgatgttttaaaacgcctgctcactgtttcgatcccgacgacggggctgcgcgtgtttcatgctgtgacaaatgccgtcgaaccttttttggtgaaggggacgctgcttgccgctggcgtatcaagaacatcggccatcgaccagttcggcatgctttcgggagttgcgatgacaatcggcttttttccggcttttatcgcccattcactgatggtcgtcatgatcccgagcatttctgaaagctacgcttacgggcaatacgaaagagtgatcaaacggattaaacaggcgatctttattacgctgttttacggcataccgtccgtcatggtgatgtatcactttgcagagccgctgacccatttatttttcgattcggtcaaggcgtcgttttaccttaaaatgttgtggccgtattttttattccacttttttgcgatgccttttcaggcctgtttaatcggaatggggttggccaaagatgctttttatcataacgtttgggccagtgtcttatcgtttttgatgatgtatgttctcgggtccatgcagactttgcagatgacggggatcattcttgcgatgaataccggtatgattttgctgacggcgctgcattatgtgacgatttgcaaggagctgggcgtcacgctttttttgacaaacaaatcccgatctccgagaattgaaagccgctga

SEQ ID NO: 1498 - DNA, 492 bp, Bacillus licheniformis
atgcgaagaatcagtctcatttacccgctcatcctgctgttttttaccgggttattcgtatttcagccgcaggcatctgcaaaacaagcttcgccggcagtcatgcagatgaacacggtcgaaggtcagcgcgtcgtcattcccgccgaaggccagaagacgatcgttcatttttggacgacctggtgcccgccatgccgtgaagagcttccgcgattccaatcctactatgaaagcaagcaatccggcgtcaagctcgtgaccgttaatttactgaatgccgaaaagaacgaacagaaggtaaaacagtttattaaagcaaacaagctgacatttccgatcgtttttgacaaaaagggtgagatgatgaaagcatataaagtcatgacaattcctacgacttttttctttaatgaaaaaggagagctggagaaaacgtttgtcggccccattactgtagaacagatgaaggaatgggcagggaaaagctga

SEQ ID NO: 1499 - DNA, 1908 bp, Bacillus licheniformis
atgcaattagagatcgggaagcaatcgcagcaaaaccgtcacacgttgcaatttgaaaattggaggcagcacggggaattgatagctgcgcttttgtcgggtttgttgattcttgcaggctggctgttgtccggcaatgaaacattgtccgttgttctgtttattttagctttttgtatcggcggctttgctaaagcgaaagaaggtatacaagaaacgctgtcggaaaaaacgctgaatgttgaactcttgatgatttttgcggcggtcgggtctgcgctgatcggctactgggctgaaggggccgtgttaatttttatcttttctctcagcggagcgcttgaaacgtatacattaaataaaagcaaacgcgatttgacttcactgatgaaattggagccggaggaagccgttttgcttgaaaaagaaggaacaagaaccgtggcggcagccgatcttcaggcgggcgacctcattcttgtgaagcctggagaacgcattgcggcagacggagaaatcgaaaccggaaaaacgagtatcgacgaatcggctctaacgggcgaatccatcccagccgaaaaaacactcggagacgcggtttttgcgggtacggtcaatttgagcggatcgctcacggtccgtgtcacaaaggcaaatgaagattcgttgttcaaaaagatcattcggctcgttgagtctgcgcaaaacagcgtttcaccgtcgcaggcgttcattgagcgatttgaaaatatttacgttaaaggggttttgcttgctgtcggactgctgctctttctgccgcattttttgcttggctggagctggagcgagacattttacagagcgatggtgttcatggtcgtcgcttcgccgtgcgcccttgtcgcttcaatcatgcctgccgcgctgtcgctgatatcaaatggcgcaagaaacggcctgcttgtcaaaggcagcgtctttcttgaaaagcttggcaacagcaaaatcgttgcattggataaaacgggaacgattacgaacggaaagcccggcgtggaggatatgcttttagctgcagatatcgaggagcgcgaatgcttggaggctgctgctgcgattgagaagcagtcaggccatccgcttgccaaagcgattgtcgagtatgcagaagcaaaaggcatcaagccggccgcgaatgtgtcgattgaggagacgtcagggtttggcgttcaggctcgatacaatggagagacatggctgatcggcaaagccggttttgtcggggaagaggcagccgggcaatttctcacggcggctgttcaggagcttgccaagcagggaaaaacaattgtgttcatgaaaaaaggcgaagaaatcgcggggtgttttgcattaaaagaccaaatcagaccggaatcaaaagcggtggtcgaagagctgaacgcgctttgcgttcagacggcgatgctgacaggggaccagcctgaaaccgcagcggtcatcgcacgagaagcgggcttgaaaatcgtacattcagaatgccttcctgacagaaaagtagaggaagcgaaaaagctgcacaaaacatacagaacactcgttatggcgggagacagaatcaatgatgcaccggtcctagccgccgttgatgtggggcatccagtgcggggaggaacagatgtcgcactggaaacggctgacgtcgttttaatgaaaaacgaattgacaggactgaccaaaatgattcggctctcccggaaaatgaatacgatcattaaacaaaacgtcattttctcgcttgctgtgatctgtcttttaatctgcagcaactttcttcaaattcttgatctgccgctcggtgtcatcgggcatgaaggcagcacgctgcttgtgattttaaacggtctcagactgctgaaatcctaa

SEQ ID NO: 1500 - DNA, 1095 bp, Bacillus licheniformis
atggaaagaattgaacaaatctcttcctggctgaaagaaaaaaacatatcttcggcttttattcattcaaaagaaaacgtattttatcttaccggcttttatacagaaccgcatgaacggctgatgggcgtttttatttttcaagatgaagagccgttttttgtttgtccgcaaatggaggccggtcaggcgagagcagccggctgggcgtatgagatcatcggatacggggatcatcaaaacccttgggaactcatatcctcagcgcttcaaaagcgaaacggccaatgtttaaaagtggcggttgaaaaagaaacgcttgctctttcgcgcgccgaaatgctgcaggcggtcacaaacggtgcggagcttgtctctgcagaagaaaggctgaaccaaatccgcgtcatcaaagacgaaaaagaaatcagcatcctccgcgaagcggccaagcttgccgattacggggtcgaagcaggagccgccgcattaaaagaggggatagcggaaatcgatgtcgtcgctaaaatcgagtatgagctgaagaaaaaaggagtccaggggatgtcgttttccacaatggtcctttttggagaaaaatcgggacagccgcacggaaaccccggcagccggacgctcaagccgggcgatttcgtcctctttgatttaggtgtaatcattgacggatactgctctgatattacaaggacgctcgtgtatcaaaatgtgagcgaaaaacaaaaagaaatatataatacggtgcttcaagccgaaacggaggcgcttaagatgagcaaacccggtgtgagaatcggcgatcttgatttaaaagcgcgcggcatcatcgaaaaagcgggctacggcgattactttccgcaccgcctagggcacgggctcgggatttcgcctcatgaatacccgtccatgagccataacaatgacgaacttttgaaacaaggcatggtatacacgattgaacccggcatctatgtgccggaaatcggaggcgttcgcatcgaggatgatgtacttgttacagccgatggagcagaagcgctgacaaagtatccaaaagagctgactgtcatttcataa

SEQ ID NO: 1501 - DNA, 726 bp, Bacillus licheniformis
gtgaaaaaattagggtttgtactgtttatgtcgatgtttgcttttgtcagtgtagtaccggcagctgaggcgaaagtcattgatcatgacaaagtgcaaggcttcagcgaagtgacccctgtgacggtttcccaaaaagcggccaaacgttttcagccttatttgaaggttgcgagcggctgcgtgccttttccggcagttgacgcacaaggcaacacaagcggaggtctggagcctaccggagcgcccgaaggccactgcagcaaaagcgtgggacaagtgtactcacgatccgcatggtataatggagtttgggcgattatgtatgcatggtattttcctaaagattcacctctgcctttaaaagcattcggccatcgacatgattgggaaggtatcgtcgtatggatcgacaatccggcaaatcaaaatccaaaagtgctttccatcgcttattctcaacacggtaaatttcaaaaaacagcgccaaacaacaatattatggaaggcgatcatccgaagatccgctatgatgctcctcaaccgccgatcaaccacagcctatatgtggacagtgcaaagggcggcacccagcctctcatcgggtgggaagatttgacgcctgccgcaagaaacgcattgaacacaacggatttcggaagcgcaaacgttcctttcaatgatcacaatttcacgaataacctaggaaaagcatggtttagataa

SEQ ID NO: 1502 - DNA, 972 bp, Bacillus licheniformis
atggcaaatatcagggaaatagctgaagcggcaggggtttccatcacgactgtttcgagggttctcaacggccacccgtatgtcaaagaagaaaagcgtcaaaaagttcttgagacgattgaacgcctcgaatatgcaaggaatatgcatgccgttcatttatccaaaggcttttccaacatgataggcgttgtgctgccgaccatcagccttccttatttcggcgagctgctggaaggaatcgctgaagaagctgcgaaggaaggcgttcacttttcgctttaccaaacaaattatcaattggaaaaagaaatttttgcattggagcagctgaaacaaagacaggtggacggcctgattttctgttcaaaagcgatgtccgatgaagcgcttttggactggcgtgaaaccggcccgttcatcctgtgccaggactcaggcgagcagcactttgcaacggtcagcattccgcataaagaagcattcagacttggattggattttttaattgaaaaagggcacacaaaaatcgcgattggtttggcaaggaaaaacggcatgaacagccattttcgcctcaaggcatacaaggaagctttggccgcgatcggggagccttaccgggaagagtgggtatttgagcggtcgctgacaattaccgacgggcaaaaactgttctccgaatggaaagggatggaggagaagccgacggctgtttttgtcgcaaacgaccaagtatcagccggtatttttcttgaagcgcagcggcatcaagtggatattcccggaagcctcgctattttaagctgtgacaaccagccgatcagcgaagtgctcggcatttcaacaattgaaatcaatataaaggaaatggggaagcgcgcgtttcgccttctgcaaaaaagaatcggcggcgccgggccggaaaaactgactgttccttacaagctgatcaaaagggcgactgtgtaa

SEQ ID NO: 1503 - DNA, 846 bp, Bacillus licheniformis
gtgaacagatcctttaccgttgaaaaggtactcaacaacaacgttttaatcgctctccatgatgattacagagaagttgtcttgattggcaaaggaatcggttttggtaaaaagcgcggagatcttatcgaacatgagaactacgaaaaaatgtttatcctggaaaatgataaggaacaatcgcagtataagaagctcctcacttatgtcgatgaaaaaatggttgatatcgccaatgatgtcatctaccatatcgcgcaaaaaatcggccagccgctgaacgaacacattcatgtcgccctgacggaccatatcgcatttgcagttaagcgtctagaaaagggatttgatatgaaaaatccgtttttgcttgagacggaatcgctttatccgaaggaatacgaagtcgccaaggaagccgtcgatatgattaatgaaaaatccgacattcagctgcctgaaggtgaaatcgggttcatcgcgcttcatatccacagtgcgatgacaaaccgcccgctttctgaagtcaatcagcattcacaactgatctccaggcttgtccaggtcatcgaagattcattccagatgcaagtcaacagggaaagcgtgaactatttgcggctgatcaggcacttgcgctttacgattgacaggataaaacgggacgagccgattcaggaaccggaaaaattaatgttgttgttgaaaacggaatatccgctgtgttacaatactgcttggaagatgatcaagatcttgcagcaagcgctcaagaaaccggttcatgaggcagaagccgtttatttgacattgcatttgtaccgtttgactaataaaatttcataa

SEQ ID NO: 1504 - DNA, 1662 bp, Bacillus licheniformis
atgtttaaatcgctatttggcgttctgcaaaaaattggacgagcgctgatgcttcctgttgccatcctgccggctgcagggattctgctcgcgcttggtaatgccatgcaaaatccgcagatgacaaaagtcgcaccattcttaacgaacagcaccgttcagcttgttgcgaaagtgatggaaagttcaggtgacgttgtgttcaccaacttggcgctccttttcgctgtcggggttgccatcggtttggctaacggcgacggcgttgccggaatcgctgctattatcggatatcttgttatgaatgtcacgatgagtgcagtgctccttcaaaacggttcaattccaagcgatgcagttgaaagagcacagttctttactcaaaaccatccggaatacacgacaatgctcgggataccgacattggcaacgggagtattcgggggtattattgtcggtgtcctggccgcagccatgtacaatcgattctacacaatcgagcttccgcaatatttaggattctttgccggaaagcgctttgttccgattattacatctatttgtgcattgctgctgggacttgttatgctgtttatctggccgccaattcaaggcgcactgaacagcttttcaacgaacctgcttgcagccaatgaagcggtcgcagctctcatcttcggaatgattgagcgggctctgattccgttcggtctgcaccatattttctactcgccgttctggtatgagttcttcagctatacgaaccaggcgggagaaattgtccgcggtgaccaaagaattttcatggcgcaaatcaaagacggcgtcgaattgacagcgggtacatttatgaccggtaagtatccgttcatgatgttcggtcttcctgcggcagcgcttgccatttatcatgaagcaaaaccgcagaacaaaaagcttgttgccggtattatggggtcagcagccttaacatcattcttaacagggatcactgagccgatcgaattctcattcctgttcgtcgcaccgattctgtttgcgattcactgtgtgtttgccggcctgtcattcatgatgatggacatcttgaatgttaagatcgggatgacgttctccggcggtttgatcgactacttcctgttcggaattctgccgaaccgtacagcttggtggcttgtcattcctgtcggtttagtcctggctgtcatctactacttcggattcagatttgccatccgcaagttcaacttgaaaacgcctggacgcgaagatgcagctgcagaacccgctgatgaaggcaaagaagcagcaggagatcttccttatcaaattcttgaagcgatgggtgaccaggaaaatatcaagcaccttgacgcttgtatcacaagacttcgcgtaacagtcaacgatcagaagaaagttgacaaagagcgcttgaaaaaactcggcgcttccggcgtgctggaagtcggcaataacatccaagcgatattcggaccaagatccgacaatttaaaatcacaaatgcaagacattatgtcaggccggacgcctcgtcctgaaaaagcgacctgcgagggacgctgtcgaggaattggtgagctctcaaatcaggaagaatcgtcactggtcatgagcctctcgtcaaaacgaatcaggtga

SEQ ID NO: 1505 - DNA, 267 bp, Bacillus licheniformis
atggcacaaaaaacgtttaaagtaactgcagattctggaatccacgctcgtccagcgactgttcttgtacaaacagcaagcaaatatgatgcagatattaatttggaatataacggaaaaacagtaaaccttaaatctattatgggcgttatgtcactaggtattgccaaaggtgctgaaatcacgatttctgcttccggcgctgatgaaaatgatgctctttccgcacttgaagaaacaatgaaaagcgaaggtttaggcgaataa

SEQ ID NO: 1506 - DNA, 1719 bp, Bacillus licheniformis
atgcttgaattaaaaggaataggcgcttcagccggtattgcgattgcaaaagcatatcggcttgaggagcctgatctaacggttgaaaagaaaaacatctctgattctgatgcggaagtaaatcgttttgaagacgccatcgagcgttctaagaaagagcttgaaaccattaaaaaccatgctttgaaagagcttggcgaagataaagcggaaatcttttctgcacatttgttagtattaagcgatcctgaactgttaaacccgattaaagacaaaatcaaatctgattctgtcaatgcggaattcgctttaaaagaaacggccgacatgttcgtcaccatgttcgagtcgatggacaatgaatatatgaaagaacgcgccgcggacatccgcgatgtcaccaagcgtgtcacagggcatcttctcggcgttgagattccgaatccgagcctgatttccgaagaagtcatcatcgtggccgaagacttgacaccgtctgatacagcgcaattaaaccgcaactttgtaaaagggtttacaacagatatcggcggacggacgtcccactctgccatcatggcgcgctcgcttgaaattccggccgttgtcggcacaaaagcggcaacgaaaggcatccaaaacggcgtaacagttatcgttgacggcatcaatggcgatgtcatcgttgatccttcccaggaaacaatcagcgaatacgaagaaaagcatcaagccttcctggcgcaaaaagccgaatgggcaaagcttgtcaacgaaccgactgtaacgagcgacggccatcacgtggaacttgccgctaatatcggtacacctgatgatgtaaaaggcgttttggaaaatggaggagaagcagtcggcctttaccgaactgagttcctttacatgggcagagaccagcttccgacagaagaggagcaatttgatgcctataaaaccgttcttgagcgtatggaaggcaaatccgttgtcgttcgtactcttgatatcggcggagacaaagagcttccatatttagaactgccaaaagaaatgaatcctttcttaggatacagagcgatccgtctttgccttgatgagcaagagattttcagaacgcagcttcgtgcgctgcttcgggcaagtacatatggaaacttaaaaattatgttccctatgatcgcgactgtaaacgaatttaaagcagcgaaagcgattcttttagaagaaaaagaaaagctgaaagctgaaggccaacaagtttccgacgacattgaagtcggtatgatggttgaaatcccttcaacagcggtcatcgctgatcaatttgctaaagaagtcgatttcttcagcatcggaacgaatgacctgattcaatacacgatggctgctgaccggatgaatgagcgggtatcttatctttaccagccatacaatcctgcgattctccgcctgatcacgcttgtcattgaagcggctcataaagaaggaaaatgggtcggcatgtgcggcgaaatggcgggagatgaaattgcgatcccgatcctgctgggtcttggattggacgagttctcaatgagtgcgacgtcaatcctgccggcaagaacgcaaatcagcaagctttctaaaaaagagacagaatcgttcaaagagcaaattctgtctatgagcacaacagaagaggttgtacaattcgtaaaagaaaccttcaacctggcataa

SEQ ID NO: 1507 - DNA, 234 bp, Bacillus licheniformis
atgcctaggcagccattcaaactgggagatgaggtgtatgtcatttaccggaatccgcatgcagcgaatgtggcgcatataaaggaagctgaagtcgttgatcatccgcttcacgaaggcgaactggcattgtttatgtatgatacatatcacgcctttgccgaagatgatgccgttttttcttcatatgaagaggcggaacggctttaccgtgaattatttgacgggatatga

SEQ ID NO: 1508 - DNA, 1044 bp, Bacillus licheniformis
atgtgtctgtttccaatggtaaaaccgtttgttccccaactcgtctatattgaaccgagagccctggaatatccgcttggaaaagagctgagggataaattttcaaacatgggacttgagatcagggaaacaacttcacacaaccaggtgaggaatatcccgggggaaggccacctgcaaaaatacagaaatgcgaaatccactttggtgatcggcgtcagaaaaacattgaagttcgattcgtcaaaaccgtccgcagaatacgcgatcccgtttgcaacagggtgtatgggtcactgtcattactgctacctgcaaacgacaatgggcagcaagccgtatatcagaacgtacgtcaatgtggaggaaatacttgagcaggcggatcaatatataaaagaaagggctcccgaagatacgcggtttgaagcttcctgcacatccgatatcgtcggaattgaccatttgacacatacgttaaaacgcgccattgagcatttcggtcaaaccgaccatggtaagctgcgtttcgtgacaaaatttcatcatgtcgaccatttgctcgatgccaagcacaacggaaaaacgcgcttccgcttcagcgtgaatgccgaatatgtcattaaaagctttgaacccggcacatccccgttggataaacggatcgaagccgccgtgaaagtagcggaagcgggctatccgctcggttttatcatcgctccgatttatattcatgacggctggcaggaaggctacagagttctgctggaaaagctcgatcgtgcgctgccgcagcatgcgaggcgcgacatcacctttgaaatgatccagcatagattcacgaagccggcaaagagagtcattgaaaaaaactatccaaagacaaagctcgaactggatgaagaaaaacggcgctataaatggggcagatacgggattggcaaatacatttatcagaaggatgaagaagcagagcttcgcagcgcccttgaatcgtatatcgacaactattttcccgaagcaaaaatcgaatatttcacataa

SEQ ID NO: 1509 - DNA, 669 bp, Bacillus licheniformis
ttggcgatctataaacagttttacgtcgataacggcacttcttatcagcaggtggacatccgcaattacagcaaaaaagatattcccggtttgattgctctccaaagagaatgctttccgcctccgtttccggaagaccttctgtggaatgaagagcagctccattcccatattgaacgatttcccgatggagcgctttgcgcagtttccgaaggccgcatcatcggttcgatgacagcgctcatggctgattttgatccgcatcatccgcaccacagctgggatgaagtgacggacaacgggtatatcggcacacatcaaaacgatggaaactccctttatgtcgtcgatatttccgtgtcccccgactatcgaaaactcggcatcggaatgcggctgatgcaatccatgtatgaactgacggtctttaaagggctcaagcgtctcattggcggcggacggattccccattatcacaagtcggctgaagaaatgacgcccgaacagtatgttcaagctgtattggacggggaaaagcgcgatccagtgctctcgttcctgcttcattgcggacgctctccagtttgtgtgattcccggctacattgaagatgaggaatcgcttgattatgcggtgttaatggagtggaaaaatccttttttaacataa

SEQ ID NO: 1510 - DNA, 1968 bp, Bacillus licheniformis
ttgtttaaaaaactgcatgtcaaaattgccggatttgttgccgtcctgctggttttgacggttatcgtcctacagttctcgacaacacatttgttgaaatcgatgcttgaagatgaggcaaaagaatcaacgtccagcctcctcggttcaattaaaagaaatattgagcttcaattagaacactacgagatttctttgaatcgtataagtgatggagaaatggctcactcattcttaaaagacggggataataaaattataaaaatcgtcaatgatgaattaaaacaattaaaagaaaaaaatgagtatgtcaatttagcttatatcggcacaaaaaagaaggaaatgtttacatttccgaaaacgacctttgatgatgattataatccggctgaaaggccatggtatacgtcagctgcaaaaacacccgacaaagtcgtttggacggaaccttacaaagatgcggtttccggagatatgacagttactgcggcaaaagccatcgtcgtcaataataaagttgaaggcgttgtcagtatagacttgtcattgaattcattgaacaaaattatcgaaaatcaaaagatgccttatgacggctacgcatttattttggaccaaaacgggacaatgctcgcccacccgtcaaaacagggcgacgatatatcgaatgataaaacatatcgggacatcccgtcatcaaaagacggaatcaaagtaggcaaagatactgtgatcgcttatcagactgtcggcggtacgggctggaaagtcggtacgcagttcgacacggcgaagctgatgtgggtcgcgcaggaaatgaacaaaatggtcattatcgtttcaatcattgctctggcagcggcgatcattttaagctatttcgttgccaaaacgatcacaggcccgattaagcagctgattgccaaaacaaaagcagtcgctggcggcgatttgacggtccaaacagcagctgcctcaaaagatgaaatcggtatattgacaaaagactttaacaagatggtcgaacatatgaaagaaatgattgtgcaagtcagatcatcgtccggaaaagtatcggatacgaccgatcaattaagcgctgtttcagaagagacggtttctgcgagcgatgaaatcgccaaagcaatcgaagaagtggcgacaggcgcgactgaacaggcggctgaggtcgaaaatgtcaatgaacaatccgaacggctgtctgtcaaaattaaagaaatcgaacatcatgccgacagcatcaagaaactttcgagaacatcagaagaagcaagctatacaggaatcgatgccctcgggcagctgcttgcaaagtcaaatgaagcaaactcggagacaaagaaagtggaacatatgctattccagcttgaagaaaaaacgaaaaacattgaagacgttgttacagccatctcggcgatctctgatcagacaaacctgcttgctctgaacgccagcattgaagcggcccgtgccggagaaagcggacgcggttttgcggtagttgcagaagaggtgagaaagcttgctgaacaatcggcggtttcttcacagcacatcagtgaaacggtcaaacagattcagatggaaacgaaagaagccgtttcagcgatgacagaagcaagcaagatgaatgaagtgcaaaatggaatgattcacgaaacaggtgaagcgctcagcaaaattactgctgaaatgcaggcgctcgtcaactcaattgaccacatttattctgaaatctcggatatgagcggagagcagcaaaaaatgtccgattcgattcagagcatttcagccatttcccagcagtctgccgcggctgcggaagaggtcagcgcttcggccaacgagcagctgacagcgctggaaagcatcgcaaaatcggctgaagcgctgagcgaggccaaccaagaattattaaatgcgatcaataagtttaacgtgtaa

SEQ ID NO: 1511 - DNA, 795 bp, Bacillus licheniformis
gtgatcattgtggacttaaagatgaatggcaaaacagcgcttgtggctgcaagcagcaaaggacttggcaatgcgatcgccaaagccattgcgaaagaaggggcaaatgtcatgctgtccgggagacacgaagcggacttgaaaaaagccgcggaagagctgaacggactcggcggcggcaccgtctcttatcaagtatgcgatcttgcagacgccgacgggatcaaagcgctcgttcaaaagaccgctgacacatttggaacgatcgatatgcttgtcaacaatgtcggaggaccgaagggcggcagcctgcttgatctgacagacgatgactggacctcatcatttgaattgcatctgctcagctatgtccgtttaatccgcgaagcttttccatatctcaaaaaggatgggggacgcatcgttaatatcgcttcatcatcagtcaaacagccgattccgggcttgctgctttccaacacgtttcgaatgggaatcgtcggtctgacaaaatcgattgccgaagagttggccgaacaccgcattttgatcaacacgctcgcccccggaagaatcgcgacggaccgcgtggcagagcttgatcggctgaaagccgagaaaacaggcctttccgagcagcaggtgaaagaaagctatgagaaagaaattccgctcggctcctacggaaaacctgacgactttgcacagtatgcaagctttcttttatcagagtgcaatacatatatgactggacaaacgctgctgatcgacggcggaatggtaaaagcaatttaa

SEQ ID NO: 1512 - DNA, 873 bp, Bacillus licheniformis
atgaaaaaaacggtcggatttatcggactcggtgtaatgggaaacagcatggcctcgcacattttagccgcgggctatcccgtcagcgcctatacgagaacgaaacacaaagcggacagcctcgtggaaaaaggggcggaatggaaatcatccgtcaaagcactggcgcagtcgtctgatgtgatcatcacaatggtcggctacccaaaagacgttgaagaggtttactttggaagcgaaggcattattgaaaatgccaaaaaaggttcctaccttatcgatatgacgacttccaaaccttcgcttgccaaacaaatcgagactgccgcaaaagagaaaggactttacgctttggatgctccggtttcaggcggggacgtcggcgcgaggaacggcacgctcgctatcatggtcggaggagaacggaaagcttatgatgaatgctacccgctcttttcgatcatgggtgaaaacatccagtatcaggggccggccggaagcggccagcatacgaaaatgtgcaaccagattgcgattgccgcagggatgatcggcgtcgcagaagcgatggcctacgccgaaaaatccggactcgatcccgacaacgtgctgaaaagcattacgaccggcgctgcgggaagctggtcgctctcaaatctagcgcctagaatgctgaaaggcgactttgaaccgggtttttacgtcaaacactttgttaaagacatgggcatcgcgcttgaagaggcggagctgatgggcgagaaaatgccggggctcgagcttgcgaaaagcctttacgacacccttgttgaaaaaggcgaagaaaacagcggcacccaaagtctgtacaagctttggacagaatacaaataa

SEQ ID NO: 1513 - DNA, 723 bp, Bacillus licheniformis
atgaaaaaagcttttcttttatcagcagcagctgcagcaacgctcttcacattcagcggcgttcagcacgcagacgctaaagagcagcagcaagtacaagtcaaaaccgttcattccataaatgtaactgatctcgcgggcaaactgaatatccaaaacatgaaccagctttctaaagctgaccaagaaaaaattcagtccctgcttcattcttatatgaaacaagcaactcaacagcctaaagcttctgcaccgaaggcttctgctcctaaagcttcaaagcctgcggcttcaaaagagcagacttcacagcaaaagcaaaatacagcgcctgcatcttcttctgtaagcgcgtatgaaaaagaagttgttgaactgacgaatgcagaaagaaagaaacaagggctaaaacctcttacattggatgaaaagctgagcaaggttgcccgcacgaaatctcaagatatgaaagataacaactattttgatcacaacagcccgacttacggttctccatttgacatgatgaagaaattcggcatcacataccgcactgccggagaaaacatcgcaaaaggccaaaaaacgcctcaagaagtcgtcaaagcttggatgaacagtgaaggccacagaaaaaacattatgaatcctaacttcacgcatatcggtgtcggatatgtgaaggacggcaactactggactcagcagttcatcggaaaataa

SEQ ID NO: 1514 - DNA, 2109 bp, Bacillus licheniformis
gtgacagaatctcaacatgatccggctgaaatcaaaaagagcaggcgttcgcgtttatggcggatcaacctgtacttctttgcggtgttcactttgttcgctgcgctgattgtcaagctgggcctcgtgcaaatcgtcaatggagaggcgtatgagcaggaagcttcgaaaaccgaggcgaaaattgcgtcatacccggcaccgcggggtaaaatgtatgacagatacgggcgggtggttgtcgacaaccaaagcgttcccgcgatcacatatacgatgatgactagcacaaaaacggaggaaaaaatcagcacagccaaaaaactcgcagaattgatcgatatcgatacttcgtttctgaaagagagagatctgaaagattactggcttgccagacacccgaaaaaagctgctgcacttctgaaagacagcgagaaaaccctcaagtctgatcaaacatacaagcttcaggtggaccgcgttccggcggaagagatcaaagcgctggaaaaggacaaagatgagcttaaagtcgcagcgattttcagaagattttctggcggctatgcgtatgagccgcaaatcgtcaaggcgatgagcccgaaaaccgcggggaaaaacgatgcgcagctccttgatgagaaggcttctaaacagatgccggccaacgatttgacgtatgaggaagtctcacgcgtttccgagcatcttgaggaactgcccggcgtcgacgtcatcatggactggaccaggaaatatccttatgaaaaaacgctctactccattttcggaggcgtcacaacgcctgaacaagggcttatcaaggaccgggaagacttttacctgacaaggggatatgcccggaatgacagagtgggaaaaagctatctcgagtatcaatatgaagaatatttaaatccgaaaaaagcgaaagtccaatataccgaaaaccgttcaggaaaggttatcagccaggaaacggttgatgaaggaagacgcggctacgatctgcagctgacgttcgacatggagctccaaaagaaagtcgaagaggctatcgaagaggagcttaataaattccgcggctcaaactacatgctggacagagcgttcgtcgtcatgatggacccgaataacggagacattctgtccatggccggaaagcggatcgtcgacggcaaaatcaccgactatgcaatcggcgcgtttacaacccagtacgaaatgggatcggcggtcaaaggcgcgaccgtgcttgccggctatcaggacggcatgccgcatgggcagagttatttagaccaagagctgagcttcgcagggggagttaaaaaaggttcctacagaggaaacactatcggttgggctaatgaagttagagcgctggaaaaaagttcaaacgtttatatgttctatgtggcaatgagaatggcaggaattacgtatgtaccgaacggcccgcttccggcgaacctagaggacttaaagaaaatgaggtattacttcaatcaatttggccttggggtaaaaacaggcatcgacttgccgcaggagtcggccgggatgcagacaaacccaaaaatagtcgggggtctcctcctcgatgaagcgatcggccagtttgacacgtacacgcctttgcagctcgcccaatatgtttcaacgatcgccaacggcggatacaggttgcagccgagagtcgtgaaaagcattcaccagccagaaagcgaaaaactcggtccggtcattgaagagcgctctgccaatgtgctgaatcgtatcaacaattctcaaagcgacatcgccatcgtcaagcaaggatttaaacgagtaacccagacgggaactgcagccggcgcattcggttcgcttgacgtatcaggcaaaaccggaacggcgcagacgcaatactacggcacaaaccgaaactggtgggggactaggacttacaatatcacctttgccggctattacccgtcggaaaatccgcaggtcgccttcagcgttgtcgtcccgaatgtcgacgacaaaacgaagatgaacaaaaacatcgccgccaaaatcgtcaaagcctatgtcgatctgcaaaaaaaatacagcaaagattag

SEQ ID NO: 1515 - DNA, 1812 bp, Bacillus licheniformis
atggaacaaaaaacaaaacgttttgagcaatataagcctcatatgaatttacaggcagtcctgtcagctaacggccgttttatatacatatctgcaaattgcaaagagctcttaagctacgagcagaatgaactgatcggtacgtatttgaaggactatttacacgaagacgatctttttctggtagaaagctatttttacaatgagcatcatttgctgccctgcaccttcagatttgtgaaaaaagactacacgatgatctggatcgaagcatcgatcgatttcgtgacgacccatgttggagaaaaagaacgcgaaattgtactcaaaatgaaagtgtttgaagaccgtccctctaagaaaagcagctccataaaagaggaagacgctccggaagaagcctccaggctgccggcaaaagaggaattcgaagccatgatcgaaggcttgccaaaccctctgtgcatcagcgttcaaggggaaatagtctacgtaaatgacgccatggtcaacctgctcggagccgagcataaacggcaaattatcggaaagtattcctacgattttatcgagaaagagtaccatgacatcgtcaaaaaccgcattaagcggatgcagcagggacttgatgtcggaatgatcgagcaaacgtggcataagctcgacggcacgcagattcacctcgaagtcaaggcggcgccgaccatttatcaaaaccagaaagcggagctgcttcttctcattgacatttcatcgagaaaaaaatttcagaccattttgcaaaaaagcagggagcgatatcagctcttgattcaaaactcaatcgatacgatagccgtgattcataaaggaagatgggtctttatgaatgaatcgggcattcgtctgtttgaagcaaagacgtatgaggatttaatcggcaaagatatttacgaacacctgcacccatgcgatcacgaagatgtcaaagcgaggctgaaacggatcacagaccgccaatccgaatctgaaatcataaaacagacgtggtatacatttgaaaaaaggctcatctatacagaaatggtttgcatccctacgacatttttcggggaaacggcggttcaggtgattttaagggacatttctgaacgcaagcagaccgaagagctgatggtccgttcggaaaagctgtcgattgccggacagcttgcagccgggatcgcccatgaaatccgcaatccgctcaccgcgatcaaagggtttttgcagctgatgaagccgacaatggaagaaaatgaacattattttaatattatcttttccgagttaagcagaatcgaattgatcttgagcgagcttctcatgctggcaaagccgcagcaaaacgcattgaaagaaaagcttgatctgatcaggctgatccgcgaagtgacggcgcttttagaaacgcaggccaacttaaacggcattttgatcaatacgatcctcacagacgacaaaatttacattaaaggggatcaaaatcaattaaagcaagtgtttatcaacctaatcaaaaacgccgtcgaatccatgccaaacggcgggacggttcatttgacggtcagagaaaccgacgattcggtcgtcgtcgaggtggaggacgaaggagaagggatacctgaacatgtcctgaagcggatcggcgagccgtttttgacgacgaaggaaaaaggaacaggcctcggtttgatggtcaccttcaatatcatcgaaaatcacaacggaaccatcgaagtcgacagcaaagcagaaaaaggcacgacatttaagattctatttccaaaataa

SEQ ID NO: 1516 - DNA, 1170 bp, Bacillus licheniformis
atggaacatttgcttaatccaaatgtaaaagaaatcgaaatctcagggatccgcaagttctcaaaccttgtatcccagtacgaaaacgtaatctctttaacaatcggccagcctgatttcttcaccccccaccatgtcaaacaggccgccaaaaaagcgatagatgagaatcaaacatcctacactcacaacgccggatatcctgagctgaggcaggctgtacagctttatatgaagaaaaaagccgatttaaattatgaagcggaaagcgagattattgtgacaacaggcgccagccaggctatcgattcggcattccgcacgattttatctccgggcgatgaagtcattcttccggggccggtataccccggctatgagccgatcatcaaaatgtgcggagcgtctccattgatcattgacaccacgtcccacggctttaagctgacagcaaaattgatcgaggaagcgctgacgccgaagacaaaatgtgttgttcttccatatccgtcgaatccgacgggaatgacgctgtccgaagaagagctgaaggacatcgcctcccttttaaaaggccgaaacgtctttgtgctctcagatgaaatatacagcgaactcacttttgacagaccgcaccactcgatcgcaactgtgctaagggaccagacgatcgtcatcggcgggctttccaaatcccacagcatgacgggctggagaatcgggtttttgttcgcaccgaaggaaatcgcaaagcatattttaaaagtccatcaatacaacgtatcttgcgcttcatcgatttctcaaaaagctgctctggaagccgtcaccaacgggtttgatgacgctctgatcatgcgcgagcagtataaaaaacggctggactacgtgtacgacagacttgtgacgatgggcctcgatgtgattaaaccgtcgggagcattctacattttcccgtccatcaaatcgtttggaatgtcttcctttgacttctgcatgtcgcttcttgaagaagaggggcttgcgatcgtgccgggcagctcgttttctgaatacggggaaggctatgtgaggatctcttacgcatattctcctgatacgctaagggaaggtcttgaccggctggagtcctttgttttcaataagaggcaatcgatacagactacgtaa

SEQ ID NO: 1517 - DNA, 156 bp, Bacillus licheniformis
atgggaacaattgtagcgattaaaaatcatgaaatgaccattttagaagaggtcagccgggccgtttacacagaaatgctcaaggaagcttcagacagtgaagaacaaatatatatttcgtggaaagaagattttgactccgattacggctactaa

SEQ ID NO: 1518 - DNA, 525 bp, Bacillus licheniformis
ttggaattggaattagacaaacacgaaactgctcctgaaaggagcgagtatgccggaatcggcgcgcgttttgtagcttccctgctcgacggattgattctcgggattcccgcatatattttcacgtacgttttaacagcgacgttgatgttgggaaattcggatatcatgctcatgatggagactgatcccgagtatttgagcgatcaggaagtctttacgtttatcatcagtatgttcaaaaccgtagcgatcgttggaagtattacttttattgtgtattttctttattacacgctgatggaatcatccaaatggcaagggacgctaggcaagaaaatcatgaacgttcaggtggcgaaggcagaaggcggaagaatctcattcggccgtgcagccggaaggtttctggccaaaagctttctatctccgattttgatgatcggctacattatggccttttttacagaaaggcgccaggcgcttcatgatatgttggcaggaaccattgtcgtaaaaaaataa

SEQ ID NO: 1519 - DNA, 1254 bp, Bacillus licheniformis
ttgacgctgccgattctttcttgggcgttatacgattttgcaaataccattttttcatcaaatattgtgacgatcttttttcctttttatttgcaggaggcagtcggcgaaaatgccagcatgaatcaggtggcaagcacttttatctcctattcgaacgcagccgcaagctttctgcttgtcattttcacgcctttattcggagtgctgatcgaccgaacgggcagaaagaaaaaatacatcggcctgtttacgatgatttgtgtttcatgcaccattttaatgggggtttttgccggggcttcgtttcagaaggacatatacgggcttccgctatccttgatccttgtcgtcatcatgtttgtgaccgcaaagtttttctatcattcaagcttggtgttctatgatacgattttggctgacttggggacaaaagaagaaatcccgctcttatcaggtttcggaattgcaatcgggtatatcggcactttagccgggttaacggtataccttcttgtcggcaaccaggattttcaccgcgcattcatcccgtcggctctcttgtttctgtttttttcacttccgtatctgctcttcacgaaagagaaaagaaaaccggaaccgaaagaaaagaaatcgtttttcagcggatactgggaaattgtgcagacattcaaagacattcgtctatataagccggtcttcttattcatgatcgcctactttttcctgaatgatgcgcttgctacagcaatagccatgatggcggtttattcaaaaacggtcatcggttttacgaccggacaattcgttttgctttaccttgtttctactgtatcaagcatcatcggttcatttctgctcggctttgtgacgaaaagaatcggcgccaagcacgcggtcagccttgtcgccgccattatgatcaccgctttgacgattggagcatgcacgacgtcaacgctcttgttttggattgcggggagcttgttcggcatttcgcttggaggcacatgggtcgcatcaaggacactgattatcgagctgacgccagaacataaaagaggcgaatttttcggattgtttgctttgtcggggaaaatctcttccattttcggtccggtcctctacggatcgattactttgctgttcagggatctcgggaacatggccagccgaatggctttcggatctttagtgttattggcggcgatcggcctgatcattcatcaaaatgttaaggcaaaagcttga

SEQ ID NO: 1520 - DNA, 918 bp, Bacillus licheniformis
gtgtcttcaaaccaacaggaaattttattaagttcgggaaccaatgaattagaaatcgtgaagttcgaggttggtctcaacattttcggcataaatgtcatgaaagtcagagaaatcattcagccggttgaaattacgaaagtgcctcattcgcataagcatatggagggcatgattacattgcgcggggaaattcttcccgtcattgatttattctctttctttggcgttgagcacggtgatgacgagcatcaagaaaaatacattgtgacggaatttaacaagcggaaaatcgtctttcacactggagcggtttcacagattcaccgggtgtcatgggaagaaattgagaagccgactgctttgaatcaagggatggaccgtcaccttaccggcatcattaagctcgacggcaccatgattttcctgccagattacgaaaaaatcatttttgatcttgagtctgagtcaggtatggacccttatcaaatgaaaaatgaaaaattcgatcagagacggactgacaaaaagctgatcattgtcgaggactctccgctcctcttgcggctattggtggaaaagctgaatgaagcgggatacaacaacatcgtgtcttttgaaaacggaaaagacgcttacgagcacgcgcttcaattgatggaagacggcacagctcttcacgaaaaagtcgatctgatgatcacggatattgaaatgccgcagatggatggacaccggctcacaaagctgctaaaagataacccgctgagtacggagctgccgatcttgattttctcttctttgattacagacgatcttcgccataaaggggaacaagtcggagccgatgaacaaatcagcaagccagagctcaatgaactgatcgaaaagcttgataaatatattttcaagaactaa

SEQ ID NO: 1521 - DNA, 462 bp, Bacillus licheniformis
atggacgaccataatcatacgaaagaattaaaaccgacagttgaaaacctttcaaaagcgatttatacagttaaccgccatgcgaaaaccgcgactaatcccaaatacctgtatcttctgaaaaagaaagctttgcaaaagctgcttaatgaaggaaaaggtaaaaaggtaggcctgcatttttcgaaaaatccaagattcagccagcagcagtcagatgtgctgatatctctcggagactacttttttcacatgcctccaacaaaagaagacttcgcaaaccttccacacttaggtacattaaatcattcgtatcggaaccctaaagctcatatgtccttgaatatagcgaaacagcttcttcaaaactacacgggaatcaaagaaaaaccgctcgtcacaaaccggaagcgtccagcctcaaaacccgtcttcaagaagcttggcgaaagctatttttaa

SEQ ID NO: 1522 - DNA, 1302 bp, Bacillus licheniformis
atggatctttttaaaaatcgtaatttcgtccgactttttttcgcagctttcgcttctcaaatgggaacgacagtcggaaatatggctttcgcctttttcttgctcgaccggttcagcagccagccggcctatacgacaatcgccgagctgatgtattccttgccgacggttttcgtattctttatcgtcggggtggtcgctgaccgttttgaccgcaagaaagtcgcggaaaactgtgattggatcagagcgggactgactgtcgttcttttctttgtattgtatcttcaaattataccgcttgtgtttttagtcctatttatcagaagcgcggttacaaaatttttctacccggccgaagcaagtttggtccaggccattttaagaaaggaccagtatgcaaaggctgcaggactgaaccagatgcttttcagcctgtttctattgttcggcgtaggaattggagcatttatgtacaagacgatcggcttgcatggagcaatcgctcttgattttgtgagctttatcgtctccggctttttaatccgttcctgcgatataccgcttgcagcgcggaagccgaacggaaataaaggctggaaaaacatgaccgtcaaagattcgatgcgcgattttaaggaaggcatcgtttatatattaaaaaataaattgcttgcctctcttgtattcggatattttattttcgggcttgtaagcggcggactttcggttctgccgatgtttaaaatgaagtatgagctgtcccctgacagttatgagtggcatacttccctcttcacaatcgtactgggcatcggacttttgactgggattgccgtcgccgccctgctcgaaaaaaaagtgaagccggcatacatgatgtcagtcccgatttttatcgcgggtgcctttatcatcctgcttggctctacagatcaattgcccgtatactactcggctgcatttcttgccgggatatgcatcgggccgatcaacacagctcttggcggctggattcccaaaatcgtccatccaaggctgatgggaagggtcagcgggtggaccgatccgctgacaatgctggcgcaatcctcagcgcttggcatgatcgctgtcctattcccgggaatcatcgccgatgtggattatatatattacggcttggcgggaattattctgctggcggcgctgtactactttatcgccctgcttaaattaagcgccgagagtgcggaaatcgacgttcaagcggcgctgaagaggcaaaaaaatactatagcgaaaatgaactctgttttataa

SEQ ID NO: 1523 - DNA, 498 bp, Bacillus licheniformis
ttgctgatgtaccaagtcaaacccggagaaacccttgaaagcatcgccgccgatttcagaacgacccggcaggcgttgctgcaggcgaatcctggcttaaacggcggccaagtgtccgcgggccagtcgattatcattcccggcatcagaaatccggacacaattccataccggattgccgtgtctctcaacggaagaacgctcagattgtatgagcgagacagacttgtaaaaacatatccgattgccgtcggaaaaatcctcacacagacgccgagaggcgaatttgtcatcgtcaaccggcagccaaatccgggcggcccgttcggcgcctactggctgagcctgtcaaaacagcactacggcatccatggaacgaataacccttcgtcaattggcaaagctgtttcaaggggatgtatccgcatgcacaatcgggatgttctggaacttgcttctatcgtacccaacggaacccgagtgtccattacaccttag

SEQ ID NO: 1524 - DNA, 828 bp, Bacillus licheniformis
atgaaaaatccgtccagaagacaatttttaaaaggcttcttaggccttgccgcagcagggctctttaccgctgccggcggcttgggctatgcgcgctatctcgaaccgcacatgcttgaaacaaactttattcccattcggcatcggctcattcctaaagggtttgatcagtttcggatcgttcagttcagcgatacccacttaagcgaatactttacagcagacgagctttcaaatgttgtcagccaagtgaacgccctctccccggatcttatcgtattcagcggggatttaatagataaaccgcatcgctaccgggaacacgagcgtgctgtaagcgccttaaaaaagctttcagccccctatggaaagcttgctatattcgggaaccatgatcacggaggctatggaacaaaagtctatcagacgctcatggcatcggccggttttcgggtgctgcgaaacgatttgctgaagcttgaattgatagacggaagcgtaattgagatcgcttcactcgatgatttgatgctcggcagacctgactacgaaggcatcctgtcaaagctgagcaaaaaagccttttcgattttgctcgtccatgagcctgatgccgctttaacggcaaatcaataccccgtcaatctgcaaatatccggacacacccacgcgcggacaaattcagattcctgtattcggtcctttgattacgcctccgtacgtagacgtttatacgcaaggaatgtatgcaacagccggaatgaaaatttatgtcatttgaggaatcggcacgagcaggctgccgctccgctttctgtcaaagcctga

SEQ ID NO: 1525 - DNA, 765 bp, Bacillus licheniformis
atggacagaaaagttgtaatcgtgaccggcgggtcgagcggaatgggaaaagcgatcgccaaaaagcaggctgaagaaggatggaatgtgatgattacgggcagaacacaagaaacgctcgaagcggccaaagaagaaattgaaacttttgccgggcaggtggccgtatgccggatggatgtccggtctgttgaagatgtggaacagatgatcacagaggcggcaggacggtttggcacgatcgacgctttggttaacaatgccgcaggcaactttatctgcccggctgaaaaactatcggtcaacggctggaaggcggtcatcgatatcgtgctgaacggcacattttattgcagccaagcagccggccgctactggatcaaggaaaagaaacgcggccagattttaaatatggtcgcgacgtatgcatggggcgccggtgccggtgtcgttcactccgcggcggcaaaagcaggcgttctgtcgctgacaaggacgcttgccgtcgagtggggaagtgcatacgggattaggtgcaacgccattgcgcccggtccgatcgagaggacgggcggagccgaaaaattatttgaatcggaagaagccgcgcacgcgacaatcaaaagcgttccgctcaaaaggctgggcacccctgaagaaatcgcgggactcgccgcatttttgctttctgagcaggcgggatatgtcaacggggagtgtgtgacgatggacggaggtcaatggctgaatccccgtccgttttag

SEQ ID NO: 1526 - DNA, 1221 bp, Bacillus licheniformis
atgttggatccactcgatattttaacgaacattgaagatgtcattccatactatcagccgatcttcagtgctgaagaacaaaaggtgatcggctatgaagtgctggggcgcatcaaggtagaaactgaagtgaagagcctcgggccgtttttttctgatccgacaattccggaagaatacaagaaagaggttgatctcaaggtgatccgccaggcgctcgatcattttctggacagcgggcgcgacctgctcatcttcgtcaatcaagatgcaaatgtgctgatgatggatcacggcgaatcgttcctcgacctgttgatggaatatcaggataaagggctcgagctcagccgtttcgttatcgaaatcacggagcaaaagtttgaaggggatattgaacagcttcatcatttgctgacctattaccgtacatacggaattaaagtcgctgttgataatatcggtaaggaaagcagcaatctcgacagaatcgctcttctttctccggatctgttaaagatcgaccttcagccgctcaagctgtcttctccttcgccttcctatgaatatgtgctttacagcatatctctccttgccagaaaaatcggagccgcattgctttatgaagatattgaagcgagctttcagctgcaatacgcatggagaaacgggggccgatatttccaggggcagtatcttgagctgccgaaggataaatttatcgaacgggatgtattaaaggaccggctgcaggccgagtttcatcaattcatcacgcatgagaagaagaagctaaccattctgtacgatcactccgagcagttttacaaacgggttcatcagcttgtcacatcgctaaagaaaacggctcagtcagacgatgaatttctcttcaatctcggaaaagaactgacagattgcagctttagaatttacatgtgcgatgaagacggtattcagctgacgaaaaacgtgtttaagcatgacggagcatggatatttcagcctgagtacatcggcaaaaattggagctggcgcccttattttctcgagaatatcatgaggatgagaacgatgagaaaagggtttttcagcgatttgtacagcgatatcgaaacgggggaaatgatcagaacgttttcctatccgatggatgaagaattgtatctgttcattgacctgtcctactcatatttatacgaacaagacggattaatttaa

SEQ ID NO: 1527 - DNA, 627 bp, Bacillus licheniformis
atgaagaacgtttggtcatccttactgtgcgcgcttctggctgcggctcttgtattcttctgcgcggattttgccaaagccggagaaaaaccgacaagagcatcgttatttgagacccttcaatccgtatcggacgtccattttcagctgaccgaaaaggaaagaacgaaaacagacatgatatccctcttggaaccttatatggagcacgccatggcagtgaagtatgtagaggcgaacgcctttcctgaacaagcggggtggattttttacgggacagacgcgcctgaagttgcaatccctttcttcagctatggcggagacacaaaagtggcggggaaagacggaagctataccgtatatgaatttgttggagatcaaaacgacggccctgtttcatatcaaaaaaattatcagacggtgacgctgaagaataccggcggcagcttcaaagtaacggatatcggccaatctgatacaaaaccggctggagaagaaataatgtccaaacaaccggatgaaaaagaaacaagctcgaattttgcggataaaggggaaggagaccaggctgcatttccgctttttgccaccgatgttaactggacattggccggaattttcagctag

SEQ ID NO: 1528 - DNA, 243 bp, Bacillus licheniformis
atgtcacaattaatgggtatcatcacgagactgcagagcctgcaagagactgcggaggctgccggagaaccgacgcagcgcaattttgaagtgaacggagaaaaaatttgcagcgtaaaatattttgaaaaaaaccaaacgtttgagctgacagtttatcaaaaaggagataagcctaccacatttccgtttgacaacatcgatatgatttcaatcgaaatctttgaactgcttcagcaatag

SEQ ID NO: 1529 - DNA, 519 bp, Bacillus licheniformis
atggctgattcttttcttttttacaatctttctgaagatcaaatgacatttcctgaagtgatcgggagactaaagtcgttcatacgccaagatccgagggcaagctatctgctgtccgtcggaacagactcgcagatccatcagaattgcacaaaatttatcacagctatccatttgcaccgcaaaggcaaaggagcgtggggctgtctgaaaaacacggttgtcaacagaccgatacatagcctcagggagaaaatatcgcttgaaacagcttacagccaagagattgccgcatatcttttaaatgattattttaatgaaatcatggatctgcttcttccgtttacagacgagggagcagatttaacccttgaagttcatttggatatcggaaaaaaaggaatgacaaaggatttaattcaggaaatgacaggacgaatcacttcgatggggatctgcgccaaaattaaacctgactcctatacagcttcaagctatgcaaaccggtacacaaaataa

SEQ ID NO: 1530 - DNA, 180 bp, Bacillus licheniformis
atggaacgcttttcagaagaagagagaaaactgttgctgaacgtacttttggaccatgagtatgccgtagagctactaagcagtgagatcaatgatatagaaactggtacaaaaaatgtggatagcctgacatataagaaactggttaccttatatgaccgtgtccggtctgaaaattag

SEQ ID NO: 1531 - DNA, 444 bp, Bacillus licheniformis
atgattagtttgcaatcagatgaacttcttgaaacgacagtaggtcagtttatgatcgatgctgataaagtagcccatgttcaagtcggaaacaatctggaacatgcccttctcgttttgacgaaaaccggatataccgcgatccctgtacttgatgcttctttccgtttgcacggattaatcggaacgaatatgatcatggataaaatcttcggcttggaacgaatcgaatttgagaagcttgataagattcatgttgaagaagtcatgctgacggacatcccccgcttaaaaattgatgatccgattttaaaaggattcggactcgtcatcaacaacgcgtttgtatgtgtcgaaaatgaagagcaggttttcgaaggcatttttacaaggcgtgtcgtattaaaacagctgaataagcatttgaggacgttgaataaatag

SEQ ID NO: 1532 - DNA, 876 bp, Bacillus licheniformis
atgcagcttcaagagcttcacatgcttgtcgttctggcggaagaattaaatatgcggaaagcggctgaacgtctgtttgtttcccagccggcattatcccagcggctgcagaccatcgagaaatcatggggaacgaaaatttttttaagatcgcaaaaagggctgactgtcacgtctgccggagaaaaaattatccagtttgcaaaagatgtaacattggaacaggaaaaagtgagagagaatatagatgagctggagggcgagatacacggtacgctcaaattggcggccgcttcgattatcgggcagcattggcttccgaacgttctgaaaacctacgttaaacaatatccgaacgtcaaaatctccctcgtcaccggctggagcagcgaaatgctgaaaagcctctacgaagaccatgttcatattggcattatcaggggaaacccggaatggaaaggccctaagcactacttgatgcgggacgaattgtaccttgtcgatacagagatccgaaacattgaggacattgccaaaacggaacggccgttcatccagttcaaaagcgacagcacgtactatcaggaaattcagcactggtggcaccaaaagttcaaaacatcgccgaaacaaaccattattgtcgaccaaattgaaacatgcaaacagatggctttccacggaatcggttatgcgatccttccatcggtgacgcttcacggaagcgggagccatgttcaccaaatccctttgcttgatgctaaaggaaaagcaatcggcagagatacgtggctgctcggttatgagccggctttccagctgaagcaagtacaggcgtttgtagaagttgtgaaagaatgtacggcaatggaataa

SEQ ID NO: 1533 - DNA, 480 bp, Bacillus licheniformis
ttgtctaaagcattgattgcatatgccagcatgtccggcaacacggaggatatcgctatgatcattaaagatacattgcgagagtacggttttgatgtcaccattcaggaaatggatgatgtcgataccgactcattggctgaatatgatcttcttttaatcggcacctacacatggggggacggggatcttccttatgaagcggaatcgttttacgaagaggtctcttcgcttgaccttaaaggaaagaaagcggcatgcttcggatccggcgattatgcatacccccgattttgcgaagcggtcaacacgttttacaccatgcttgaacgaaccggcgccgacctttatcaagagacactgaaaatagagcttgctcctgaaacagatgaagatgccgagtgctgcaaggaatttgccgaaggctttataagatgggcagaacagcaaaaacggcgggctgagatccatgtttcataa

SEQ ID NO: 1534 - DNA, 894 bp, Bacillus licheniformis
atgtttcataaaggtgcgacggccgtcgcttcggcaaagcattccggttactttgtcgccgtcaagcgggaaggcatttttcactattcacttgagcaaggctggaaaaggctctttcaattaaaaagcaaaatttgttccatcacctatatcggcgattatttattcggcgcaggggagagaggaacgattatcagatcgtctgaccaaggggcaacctggtcaatctcaagctttccgacaaacgccacgatttggtcgatcacggggagaacggacggctttgtgtgtgcgcatgggaagcattgcatttacatatccgacgatttcggcgtctcatggaaagtcgtcaagccgttttccggtttgagtcatccgcccgttatccgctctctgtgcctccatgaagagcgcctttacatcgggacgcagattcatgaagtgcacggcggtgtttgggcatacgatttggcatcagaatcggcttttatgatcaaaaaagaaaccggccgcatgaccgcctcgatgatcgcatttgaaggcgaatggctggtatgtgcgatgggatccaaaaaagggaatcacggtgccgtcgatttggtcaacattcacacaaatgatgaaatacaaatcaggcggggccttgttgagaatgaagaatcattcctggatgtgtccgaagacaacggaatcatctatgtcacatcggctcaggaccgagacggcttttcaagaatctatcagcttgatttctttgagagggagctgaaatggtttgacacgataaaagggcatgggttcagggtggccaaccaaaaggagaacttcttttgcgcaggtctttatgaatgcaaatttgtcaggccttatgaacagcctgctgcagcccactga

SEQ ID NO: 1535 - DNA, 453 bp, Bacillus licheniformis
atggggaaagttttgctggtttatgcaagcatgtctggaaatacagaggcgatggccgatttaatcgagaagggccttcttgagggcggggccgaagtggaccgtcatgaagcgatggatgtagatgcggcgctctttaacgattatcagcacatgatatttggcgcctatacttggggcgacggagaacttccggatgagtttttggatatttacgacgatatggaagggatggatttcataggcaagacgtttgccgttttcggatccggagatacttcttacgagcatttttgcggtgccgtcgacattcttgaagataaaatcaaggagctcggcgggaacgtggtgcttccgtccgtcaaaatcgaaatgaatccggaggatgaagaagaaggcatgctgctccaattcggcagggattttgcaaagaaatgtgaagtgccggcatag

SEQ ID NO: 1536 - DNA, 711 bp, Bacillus licheniformis
atgaaaatgatggatgcaaatgagattatctcatttattcaaaatagtaagaaatcgacacctgttaaagtgtatgtgaaaggcgaccttgaaggaattgacttcggcgcttcagccaagccttttattacaggcaatacaggggttgtattcggagaatgggcggagattcaagctgcgctcgaagccaacaaaggcaaaattgaagactatgtcatcgaaaacgaccgccgcaattcggcgattccaacgctcgatttaaaaaatattaaagcgcgcatcgagccgggtgcgatcatccgcgatcaagtggaaatcggcgataatgccgtcatcatgatgggggcttccatcaacatcggctctgtgatcggagaaggaacgatgatcgatatgaatgtcgtgctgggcggacgagctaccgtcggcaaaaactgccacatcggagcgggatccgtgcttgcgggtgtcattgagcctccttcagcaaaacctgtcgttattgaagacgatgtcgtcatcggtgcaaacgccgtcgtacttgaaggcgtgactgtcggaaaaggagccgttgttgctgccggcgcgatcgttgtggaagatgttgagccttacacagtagtcgccggaacacctgcgaaaaaaatcaaagacatcgatgaaaaaactaaaggcaaaacagaaatcaaacaggaattgcgccagctttaa

SEQ ID NO: 1537 - DNA, 1125 bp, Bacillus licheniformis
atgaaattggacgaattagcagcgattcgcagagatctgcaccaaattcctgaactcggttttcaggaatataagacacaggcttatcttttgaaccacttagcaaagcatccggaaggacggattgaaattgaaaagtggagaaccggactgtttgtaaaggttaaagggacggcccctgaaaagattttggcgtacagggcggatatggacgggctctctattcgggaagataccggatattctttttcttccgttcatcaggacaggatgcatgcgtgcgggcatgatttccacatgacgattgccctcggcatcatcgatcatttcgtccgccacccggttaaacaagatctgctgtttttgttccagccggctgaggaaggaccgggcggcgctgagccgatgcttgaaagcgacttgtttaaaaagtgggagccgagcatgatcacagcgctgcacatcgcgcctgaactcccggtcggaacgatcggaacgaaaagcgggctgctctttgccaatacgtcggagctcgtaatcgaacttgaaggaaagggcgggcatgccgcatatccccaccttgcagaagatatggtggtcgcggccagttcgctcgttacgcaaatgcagtcgatcgtagccaggaatgtcgatccgctggacagtgctgttattaccatcgggacgattacaggcggatcggcacaaaacatcatcgctcaggaagcaaggcttgaagggacgatcaggacgctgtccccagcgtcaatggaacaggtgaagaaaaggatcgaggccatggttcggggcctggaaacggcttatcaatgcagcggtaaagtcagctatcctgcagcatattatcaggtctgcaattcaagcgatttagtcgaagactttatgcagttcgtttctgaaaacggccttgcagaggtcgtccgttcaaaagaagcgatgacaggggaggacttcggctatatgctgaaaaagtatccgggcttcatgttttggctcggcgtcgattcaccttacgggcttcaccacgccaagctgcagccgaaagaggaagcgcttgaaacggcagtccgcgtcatgacggcttatttctcttccaaagccaattag

SEQ ID NO: 1538 - DNA, 246 bp, Bacillus licheniformis
atgtcgaaaaaaatcggaatcgaacaatctctttctgatgtcgaggctgctttgaaggaaaaagggtatgaggttgtaacgatgaaaaccgaagacgatgcaaaaggctgcgactgctgcgtcgtcactggtctggacactgatatgctcgggatttcagatacgatgaccggagcatctgtcatacaggcgacgggtttaactgccgatgaaatctgtcagcaggttgagcaaaaacttcagtaa

SEQ ID NO: 1539 - DNA, 543 bp, Bacillus licheniformis
atggcagaacgcatggtaggtaaacaagcgccgcgctttgaaatggaagcggttcttgcaaacaaagaattcggaaaagtaagccttgaagaaaacatgaaaaatgataagtggacggttctattcttctatccaatggacttcactttcgtgtgtccgacagaaattacagcaatgtctgaccgctatgacgagtttgaagaccttgatgcagaagttatcggcgtatcaactgacaccatccacactcacttggcatggattaacacggaccgcaaagataacggtctcggccagctgaaatatccgcttgctgccgacacaaaccatgaagtatctcgtgaatacggcgtactgattgaagaagaaggtgtagcgcttcgcggattgttcatcattaatccagaaggcgaacttcaatatcaaacagtgttccataacaatatcggccgtgatgtagacgaaacattgcgcgtgcttcaagcgctgcaaacaggcggtctttgccctgcaaactggaaaccgggacaagcaaccctttaa

SEQ ID NO: 1540 - DNA, 459 bp, Bacillus licheniformis
atgaaattacgtcagccgatgccggaactgaccggcgcaaaagagtggttaaacggagaagtgacaaaagagcagcttataggagaaaagccgacattaattcatttttggtccatcagctgccacttgtgcaaagaggcgatgccccaggtcaatgaattccgcgaccgctacagcgataaactaaacgtggtggccgtgcatatgccgcgttcagaagacgatttagacttgaataaaatcaaagaagttgccgctgaacatgatatcactcagcctatttttgttgacagcgaccataagctgactgacgcttttgagaatgaatatgtccctgcttattacgtgtttgacaaaacaggccagcttcgccattttcaagctggaggcagcggaatgaaaatgctcgaaaaacgtgtgaaccgcgttcttgccgaaacagaacagtctgctgaataa

SEQ ID NO: 1541 - DNA, 591 bp, Bacillus licheniformis
atgtttaacgagagggaagcattgcgtttaagattagagcagctgaacgaggctgaagttaaggtgattagggagtatcaaattgagcgggataacatatatgcaaagctgcgtgaattggatcgtccatccagctttaatgatacaaaaaaagattttcgcccggagcgtaaaactgaatctctccctgttttagctgaattggctgcacaggagatgaagagctaccagcaacagcagcaacagcagccgcaagcatctcaaaagaaccagcagcagacttctccgcaaacctcctcactgcctgccggaattccagatggaacgacaaggcgcagaaggggtacagcacgtccaggctcaaaagctgcaaaattgcgtgaagcggcgattaaaacattaaaacgccataatgcggccatcaaaagctccgaacttcaaaaagaaatcgaaaaagagagcggacttgagatccctaatatgacaacctttatgcaaagcctgattaaaatgtacccggaagtcaaaaaaccataccgcggtcaatatatattagagggtgagatttctactgagacagagcagcaatag

SEQ ID NO: 1542 - DNA, 957 bp, Bacillus licheniformis
atgaaaaaaacatcgggttcgctgccttattttcaagatttatcacaggaaaacctttttttaaaagctgagctggcaagatcacatcaattgatacacgagcttgaagcaagctattttcaccagaaaaatcataagctcagccgggaaaacgcagcaatgaaacagcagcttcagcagctgtcattcgaactggagcggatttcggcaaacaaggaagacaagtcggccgaaacgctcaaccggataaaaagcgaattgctgagtaaaatcgtcgttcttcaggagcttcttcaaaaagaaacctatgcaagaaaacaagagatagaagaaaagcaccgccttcatttaacaaatgtaaaagccgaagaagagaaaaaaagcttacatagccaaatagaatacgaaaagcttcatgcagaaagagaaaaaacgctgagggaaaaaaaggaacaggagctcaaaaacgctgcatacgaaaatgcccgcctgaaagatgaacttcatgctaaaagtcttcagctcaaacaaatcgaaactgatgttgcggtattaaaagagcgggtgacggaaacgaaaagccggcttttggaggctgaaaaaacaaaagaagcgctgttttatgaaacgattctctcttataaaaggcaactcgatgaaagtgataagtggatcgcttctcattttgccgatattgatgcatttcagcagacggagaaggcgcttgaacaaaacgaggaggtttttgaacggacagaacagatcgaggcggtgcttcaaactgttacagagcaagttgatcagctccaacaacaattgagcgccattcaacaaaatgatacgaaaatggatcaaaaaataacagaatggaaaaaacaggcgaaagaagaaacacccccgcaaaaatgggtctatcaaattaaacgcaaagacaaagaaacaaaacctttaaattaa

SEQ ID NO: 1543 - DNA, 405 bp, Bacillus licheniformis
gtgctggaagatatcgaaccgtacagagggaaagggccgcttgccggtatgtacacagccatggagcgggcggaaggggaatgctatattttttcggcctgtgacaccccgcttgtccggcaggagaccatatcggctttaaaacggcagttgaccccggcggatgacgccgtcgtgcctgtcgcagacggaagggcgcagccgcttgttgccgtctaccacagaagggtaaaatccgtcctccatgaacagcttcagcagaacgaactgaagatcagcagttttctcgaccgcattcgcgtcaagtacattgaagcagatgcggttggtgcagagccgtgggaatttataaatgtcaataaaaagtcggatttagaagaaatagagccgttctttccgggatga

SEQ ID NO: 1544 - DNA, 1083 bp, Bacillus licheniformis
gtgtttttcaaagaacagcagacggaaaaatggtatgatatagaaaaggaagtaaaggggatcatcctgatgcatgaacggtattcaagacaaatcagatatcaaaacatcggacaggcgggtcaggacagaatcaggcagagccatgttttgatcgtcggggccggggcgcttggcacgtcagccgctgaagggcttgtgcgcgcaggcatcggcgcactgtctattatagaccgcgattatgtggaatggagcaacttgcaaaggcagcagctctacacagagaaagacgcggaggaaaggcttccgaaagcggcggctgcaaaagaacgtctttccgagatcaacagcggtgttgagcttcgtacatatgttgcagacggcacagttgaaacactcagaccgctgatcgaagaggcggatgccgtcattgatgcaacggataactttgagacccgcatgatcatcaatgaccttgcgcaggagacgggtactccgtgggtttacggcgcttgtgtcagcagtcagggcatgtatatgacgattattccccaaaaaacgccatgccttgcctgcctgtttgaagatgttccgattggcggggctacatgcgatacgtcggggattatttcgccggccgttcaaatggtgtcggcttatcagcaagctgaaattttaaaaatcttaactggacagcaagaagcgcttcaaactgcttttgtcacgtttgatttatgggcgaacacccattatcgcatgcagatcggccgcaatgagaaatgtccttcgtgcggagaaacgccggtttatcctttcctcagcaacatgagccaaaagaaagccgacgtgctgtgcggaagagagaccgtccaaattcgcagcgaaatgttaaaacggctgcctaaagaggagctcatgaaaaagctttcggtcatcggaaaagtggatgcgaatgattatttgctgcatgtacaatatgaggcgttcagaatcgttattttcaacgatggaagagcccttgttcacggcacaaatgatataaaagaagccaactccatattggcgagagtcatcggaatgtaa

SEQ ID NO: 1545 - DNA, 1293 bp, Bacillus licheniformis
atgattgaaaaaagaacgcccattccagtttttgaagccgctgcgcgtgtctctcagcaccagaagctgggagatgcagagtggattcaccttgaggagagtctccatagatttttagccgaagatgtcaaggctgatcacgatgtacccgcttttgaccgttcgccatacgacggctttgctgtccgagcatgcgatacagccggtgcttcgggggaaaatccgctgcaattcgaggtggttgatcacattggagccggggccgtatcggataaaaagctgggttcttttcaagccgtcagaattatgacgggagcgcagattccggagggcgctgatgcggtagtcatgcttgagctgacaaaaaccttctcggaagacggcaaaaactatatggtgttgaagcgctcactacagccgggagaaaatatatcaaaaaccggagaagatgcgagaaaaggatcagttcttgtgaaaaaaggaacccggataacgccgggtgttgtcgctttgcttgcaacattcggatatgcagcggttcctgcagtcaaaaagcctgtggtaggcatcattgccaccgggacggagcttctgaatgtcagcgatcctcttgttcccggaaaaatccgcaacagcaatgcaggcatggcggccgctcaggttgaagaatcaggcggaaaacccctttatttaggaaagatttctgatcaatttgacgaaagctttgcagcggtggaaaaagctttggacaaggtggattttctgattacgaccggaggggtatccgtaggggactttgattttctgccggcaatttacgaaaagctcggtgccgaggtcctgtttaataaagtggcgatgcgtcccggaagtgtaacgacggtcgctcaattaaacggcaaattgctgtttgggctgtccgggaacccgtcagcctgcttcgttggatttgagcttttcgtcaagccgtccctgcgcacctggctgcatcatccgaagccgtattctttatgtgcagaagcggttttagccaaggattttccaaaacctaacccgtttacgaggtttgtccgctcgtttgtatccattcaagacggcgcgcttcaggcggagcctgtcggtctggataaatcgagcgccgtaacgtctcttgcagatgccaatgcgctgatggttttgccgggcggaacgagaggctttgaagccggggcaagagtgcatgttcttttataccgggatgagaacggaagtgaacagctgtggccgcacattttccaatcctccagatcgtag

SEQ ID NO: 1546 - DNA, 528 bp, Bacillus licheniformis
gtggccgcacattttccaatcctccagatcgtagggtaccaaaacagcggcaaaacgacgttcgttgaaaaattggcgggaaagctcgatcagctaggagtcaatgttggctgtctgaaacaccacggacatggaggagaaccggacgcttttgccgaagggaaggattccgaccgcttttttcgggctggagcggctgcgtccggcgtagaaggtgcgggcgtttttcagcttacggcgcgcggcgagtggacgcttgatcaactgattgccgcttacggcgttttagcagttgagtgtctcctcatcgaaggatttaaacatgcgccatatcaaaaagttgtcatggtcagaaacgaagcggactgccggctcctgaaggaattggacggcatcatcgccgtcatttaccagcagagcgagccgaaaacagatgttccatcctttcatattgaagacccgggtgccctggcttttattctgaatcatctaaaggaggaaggcgtttgtctgaacgatttatcataa

SEQ ID NO: 1547 - DNA, 495 bp, Bacillus licheniformis
ttgtctgaacgatttatcataacaaaagacccgattgtcatcgaagatgtcgtcaaaaaagttgaaagaagggaagccggtgccgtcacgacgtttatcggaacagtgagagaatggaccaacggaaaaaagaccctctatctcgaatatgaagcttatgttccaatggcggtcagcatgctcgctcagatcggcaaagaaatcaatgaaaaatggcccggcacagctgcagccattacccatcgcatcggcaggctggacatttctgacgcggccgttgtcatcgccgtgtcgtcgcctcaccggaaagcggcgtatgaagcgaatgaatatgctatcgaaagaataaagcaaatcgtcccgatttggaaaaaagaacattgggaggacggcgagacttggatcggcgaccagcttgagacaactgaatacccggaagggaaaccggatattgaagaggcggcttccggcagagaaagaggtgctgaccattga

SEQ ID NO: 1548 - DNA, 234 bp, Bacillus licheniformis
ttgattaaaattttgctgtttgcccagcttgcggaacaagcgggtgcgcagagtatcgatatagatgaagaaaagacgacaacagacgagattagacagtttttaaaagaaacgtacaatcttcaggggacggaccgggcgatgatcgctgtgaacgaagtgtacagaagaggaaacagtgaggtcgagtcgggagatacggttgcttttattcccccggtcagcggaggatga

SEQ ID NO: 1549 - DNA, 378 bp, Bacillus licheniformis
atgtcgaaaagagaggctttaaaaaaacggcttctcctcttaggtgaattggaacaaaaaatctggaaggacttccggaaagaacgcgaagggatttatgcaaggttgggagaacttgacagacaaatccagcgacatagacgttccaataaagagtattatgcagcacattgcgtagacattattaaacagcaaaaaggagaaattgtaacgacaaaagaactgaaaatgaaactgaaggaaagaaccaattttaacgttcaccgtattagtgagctttatgacctgattcaaaaattagaaccaaacatttcgaaagaacggcgcggctgttttctttatatagagaacggttctaaaaaaaacgtcggtcggtga

SEQ ID NO: 1550 - DNA, 1758 bp, Bacillus licheniformis
atggagtcccttaaaaaactaaaagatttttattggccttataaaaaaatgtttttatggtcgattgcgtcgatgcttctaatgacggcgattaccgttgtttatccgattattctgcaaatgacaattgatgaagtaattctcggcggaaaatacggtttggtcatatggatcagcctcgggttcatcgctgtcatggcggcgaagggcgcagccactttttttcatcagtatctcggagatatgttcggaattcgctctgtctaccggttaagaaaagagctgtatgcgaaattgcagcgtctgccgttcaaatattacgacagcgctaaaacgggagatttaatgtcaaggcttacggcggacgtcgaaggcatcagattctttttatctttcggctttgctgaggcgattcgatttatcctgcttgtcactttcagtctgtctgtcatgttttcttattctgtgccgctgactctggttacgattgcttctctgccgtttttaggagcggccgtctaccggtttgataaaaaagtgcatcccgcttttcggaacataagaaaatcattcgcccgtttaaatacgaaggttcaggaaaatatcagcggcatgaacaccgttaaatctttatcaaaagaagattttgagattcaaaactttactcattcaaatgaccattttcgaactaaaaatttaaacgcttcgtttatcatgtcgaagttctttccgctgatggagtttatcggcaatatctgcctcgtggctctgctgtcgttcggcggctggctcgtgatgcagaacagcttaaaaccgggtgagcttgtcgcttttttcagtctcgtcaattacttgatgtggccgatcatgaacctcggttatgtcatcaacctgttttcacaagcgaaagcatcgggagagcggctgctggaaattcttgatgccgaggaggaaatcaccgataccgaacaggcggtgaaaagcggcagactgaacggcgatgtcgcattcagcgatgtttcccttcaatatacaaaagaaaatgcggaagcattgcatggggtgtcttttcaggctgagcgcggcaaaacaattgggttaatcggcgcgacggggtcaggcaagagcagcatcattcaactgctgagccgcttttatgaaccgacatccggccggatcacgatcgacggcaaaccgcttgaacactactcattaaagatgctgcgctccaatatcggcgtcgttccgcaggaatcgtttttattttcctcaacgatcaggtcaaatatatcgtatggaaagcctgatgcatcgatggatgagattatcgaaagcgcgaaaagagcccaggctcacgattttatcatggagcttccgaatcaatatgatacgatgctcggcgagagggggctcgggctgtccggtggccaaaaacagcggattgcgattgcgagagcgatttgtatgaacccgggcattctcatcctggatgattcgacgagtgccgttgacatggaaacggagcaccgcattcaacttgcattgcgggaagtgatgcgggatcggacgactttcatcatcgctcacagaatctcatccttaaagcatgccgacgaaatccttgttctcgataaaggcgtagtcaaggaaagggggacacacgaacaattaatggaagcaaacggtttatacaaacggatttttgatttgcagtataaagatcaaaatgtgttgaatgagccgcattttgcaggatag

SEQ ID NO: 1551 - DNA, 1821 bp, Bacillus licheniformis
atggaaaaccaggcgaaaaaacaaacgttgatgaaccggtttttttatacttcagaccaaatcattgaaaagccttttaactgggcgcagatgtggaggctgcttaaatatttaaagccctaccgaaaaaatttgctgccgctgtcgtttttaacggtcatgatctcggcggcgatccggctggcggtgccgattttgatcggcgtctatgcgctcgaccaagcgatcgcaggccgggatatgaatcttcttgtgattctgatctccgtcatcagtgggttgtatcttgtcaattatgttagcaatgtgctgagaatccgctggatgaacaagcttggccagcatgtcatatatgatctcagacagcatttgtttacgcatgttcagcggctgtcgcaccgctttttcgacgagcgttcggcaggttcaatccttgtccggatcatgaatgacatcaattctttgcaggaactgtttacgagcggagtcatcaatttattgatggatattttgcttctttttggaattgtcgtcattctgttctcgctcagtcctgagctgaccatcgccattatggtgacgctgcctgtgatgttcttcatttctactaatctcagaaggaaaatccggcgatcctggcaaaaggtgcgcttaaagcagtccaagctgaattcccatttgaacgaaagcattcaaggcatccgggtcactcaggcatttactcaggaaaaagagaatatgatgtattttgaaggcgtcaacagtgagaactttgaagcctggcgggaagcgacgaaaaaaaatgcgactttccgtccgcttgtagaaatgacaaacgctgtcgggacggccattttaatctggtacggctcaagcttgatcatcaatgaaacgatcacgatcggtgtatttgtatcgttcgccttctatctcggaatgttctgggagccgatttcaaggctcggccaagtctacaaccagctgttgatggggatggcttcgtcagagcggatctttgaatttctggatgaaaagccgagcgttgcagacaaggaagatgcggtcaaaataaaagaattaaaaggccggatcgaatttgaacaggtggaattttcttatgacgggaaccgcaaggcgctgcacagcatttcatttgagatacctgcgggatcatcgcttgcgcttgtcggacatacaggatcagggaagacgacgatcgcaaatctgatcagcaggttttacgatgcaacaggcggggctgtcaaagtggacggtataccgattaccgatatctcgctttccgatcttcgttcgcaaatcagcatcgtgctgcaggacacgtttattttttccggaacgattatggaaaatattcgttttggccgtccgaacgccgccgatgaagaagtgatcgaagcagcaaaagctgtcggagccgattcgtttatttcagcgcttccgaatggatacgccacagaagtggaagaacgcggcaatgtattatcggcaggtgagcggcagctcatttcatttgcgagggcgcttctggcagatcctcgtattctaatccttgatgaagcaaccgcaagcattgacacagaaacggaagtcaaaatccaggctgccttgaaaacactgctccatggcagaacggctattatgatcgctcacaggctttcaacgataagggatgcggataaaatcctggttcttgaccacggccggaaaatagaagaaggaaatcaccaggaattgatcgggaaacgtggaatgtattatgagctggtaaaagcgcagtatcaaatgtttcagcgaaactaa

SEQ ID NO: 1552 - DNA, 681 bp, Bacillus licheniformis
atggaaacgaatttagaaactgaaaaagtaaagaatccatcattgctcggattgattacccggcccggagaacagttcgagagaatgagagaaaagccggctttctggtttccgcttgtcattgttttaatcttgtcggttgcgggagcgtatatgctcagcgaaaaaacggcgttgtctaccgatttgtcggaaatgccggatgctgaagcatttcaagctgctatgaagggaatcggcatcatcggcgggatcttcggctttgtgattgccttgctgatcagcgctttaatttattggctgattgtcaaaatcggaagaggaacaaccaattttgttcacatgttttcgctgtctgtttttacatattttattgcggctatcggacaattcataggcggactagtgatctattattcaaatatcgatcccacgatcgtcgtcacgtctttaaacggcatcatcccggcagacgagccgctcaaatcggtattgggtgtatttgatattttcacgatctggtcgctctcattggttgccctgggtctccaaaaggttgggggcatctccaaaaaagcggcttggaccggtgtgatcattttatttgtgatctccattctgctcgctttaataggcggtatggcgatcaatttcttcgattcatttgaaggagcaatgtaa

SEQ ID NO: 1553 - DNA, 1137 bp, Bacillus licheniformis
atgaaaaaaatatggatcggcatcgtcattgttggggctgctgcgctttttatcggactcaacctctaccgctcggttcaaacgagcggaggggctgaagaagcggttcaaaccgtgaaattggaagaaaaagagatttcttctgaagtcatggttccggggacccttcagtttgcaaacgaacaatacgaatattttgaacctgaaaaaggagaaattgccgacatcaaagtaaaagaaggcgataaggtgaaaaaaggagatgtgcttttcacctatacaaatgaagaaattcgcctggaaaaggagcaaaacgctttatccattcaatcgaaggatctccagcttgaacaggttaagcgaaaaatcagcagcctaaaaagcaaggaagacgagctgaaggctgagctcggagcggaaaaagccaagaggcaaattgatgaagaacggtcacagcttgaaatggaagaaaaatcgctccagcttgaactgaaacaagccgacctgcaaaaggaaacgctcgagaagaaatcggcagcgctgcaagtgaaaagcggcattgacgggacggttattaccgttgacaaacaagccgctgcaaagcaatcggatattcaaaagccggttatacatataggtaacgaggacaagcttgtcgttaaaggcgtgctctcagagtatgacacattgaaagtgaaaaagggacagaacgtgaccatcacgtcggatgtcatccaaaataaagagtggcgtggaagggtatcacaagtcggattggttcccaaagaagaggcgtctgcaggtgttgcgggaacaaaggagcaagctgttcaatatccgtttgaagtcaaaataaaaggggagcgtcctaaagcaaagtccggctttaacatgattctcaaaatccagacggacaaaagaatcgttcaggctcttcctgaagatgccgtcaagcaggatggtgatcaatcatacgtgtttgccgtaagagacggcaaggcaaaacggatcaatgtcaaaaccggtgagaaagcagacggcctcgttgaaattaccggcggtctgacaaacaaggacccggttatcgcaaacccggccgaggatatgaaaagcggaacggaagtgaagcttcaatga

SEQ ID NO: 1554 - DNA, 693 bp, Bacillus licheniformis
atgattgagctttccaaagtgaaaaaaagctaccaaatcggaggagaaaccattgatgttctcagggagatcgatatgaaaatcgagccgggagaatatctgtccatcatggggccgtccggttcgggaaaatcgacgatcatgaacattatcggctgccttgaccgcccgacatcgggtatttacaggctggacggcgaggatatttcatcatacggcgaaagggagcttgccggtgtcagaaaccgtttaatcggttttgtttttcagcagtttcagcttctgccgcgcttgaatgccataaaaaatgtggagcttccgatgatttacggcggcgttccaagaaaggagcggcgggagcgggctgaacgggcgctcgaaaaagtcgggctcaaggacagaatgcgccatatgccgaacgagctttccggcgggcaaaaacagcgtgtagccatcgctagagcgatcgtcaatgaaccgaaactgatattggctgatgaaccgaccggagcgctcgatacgaaaacaagccgggacatcatggagcaattcaccgaattgaatgaggaaggaacgacggtggtgctcgtcacacacgaacctgaaattgcggactatacaagccggaccatcatggtgagggacggtgtgatcgtctcgccggaaacagagcggagggggacggtgcaatga

SEQ ID NO: 1555 - DNA, 1194 bp, Bacillus licheniformis
atgaatctcatcgaaaacttgagaatggctttaagttccatcctttcccataaactgcgatcgattttaacaatgcttggaatcattattggtgtaggctccgttattgtcgttgttgcagcggggcaaggaggagagcagatgctcaagcagacgatcagcggacccggcaacacggtcgaaatctattatcagcccagcaatgaagaattaaccgccaatccgaacgcctacttagacgccggcttcaccgaagaagacatcagaagcttaaagtcactcgaaggcgtgaaacatgtcgttgcgaaaacaaccgagtccatgaatgcccgcttccgggatgaaaatacggatgccgctgtaaacggcattaatgacggatatatcagcatcaattcgatggaaatcgaaaagggaagagaattttcagaagaggattaccttgctggaagcagggtcgccattatttcgccgaagcttgcggaagaactgttttctcagcagtcgcctctcggccgtgtcgtatggataaatagccagcctgttgaaatcatcggcgtattgaaagaagaaaccgggctgcttgcattggggatgaatgagatgtatgttccattttcaatgttaaaatcgtccttcggcatcagcgactatgactctgtctccgttcaagctgagtctgccgacgatctgcaggccgtcgggaagcgggctgcagcggccgtcaacaagaatcacggcacttcggactcgtacgaagtgatgaacatggaggccatagcggccggaatcagccagattacaacaattatgacgatgttcatcggttcaattgcaggcatttctttactcgttggggggatcggcgtcatgaatattatgctggtgtcggtcactgaacggacgagggaaatcgggattcgaaaatcgcttggtgcaacaagaggccagattctgatgcaatttttaatagaatcgtctttaattacactgatcggcggggtgtttggcatcggccttggatacggcggtgcagccctcgtatcgttttttgccgggtggccgccgctcgtttcctggcaggtggtcctcggaggcgtcctgttcagcatggcgatcgggattatctttggactcatcccggccaataaagcggcccgccttcatccgattgatgcattgaggtatgagtaa

SEQ ID NO: 1556 - DNA, 753 bp, Bacillus licheniformis
ttgactcccgaacggcatcagctgattattgacgagattgaaaagcatgatgtcgtgaaaatccagtacttaatgaatttaacgaacgcatctgagtcaacgatcagaagagatttgtcgacgctggaagcccgcggatatttaaagcgtgttcatggaggggcatcaaggctttccgatattcgtacggagcctgacatgctagagaaatcatccaaaaaccttcatgaaaagcgaaaaatcgctcaagaagcggcctcacttcttgaagaaggcgattgtatttaccttgatgccggaacgaccacattgcaaatgatcgattttatcaatccagagatggatattatcgtggttacaaatggagtcatgcacattgaggcactaggtaaaaaaggcattactttttatttattaggcgggtatgtgaagtataaaaccggagcgatcgtaggcggttcggctttatcagccatcagccaataccggtttgacaaaagcttcatcggcgtcaacggcattcataaggaagcggggttcacgactccggatcctgaagaagcgcttttgaaaacaaaagctgtcaaccaggcgaaaaaagcatttattttagctgacgtttccaagtttggggaaatttcattttctgcctttgccggtttagacgaagcaactatcattacagcaggatctgcaaaacattcatttgataactatcaagaaaaaactgtcgtaaaggtagtgaaaacatga

SEQ ID NO: 1557 - DNA, 912 bp, Bacillus licheniformis
atgatatacactgtaactctcaacccatcggtcgactatattgttcacgttgaagaattttctgtaggcgggctgaatcgttcagtctatgacacgaaatatcccggaggcaaaggaatcaatgtctcacgcgtactgaacagacaccatgtaccttcaaaagttctcggttttatcggcggttttaccgggggatatatcaaatcatttctcgaagaagagaagcttgaaacggcttttcatgaggtgaatggcgacacgcgcatcaatgtcaaattgaagaccggggatgagacggaaatcaacgggcaggggccggtcatcagcgaagaagatttcgcggcctttttagaccagttttcagcgatgaaagaaggggacattgttgtactggcgggcagcattccttcatcattgccgcaggacacatatgaaaagattgcggaaaaatgcaaagagcaaaatgtccgggttgtcgttgatatttcgggtgaggcccttttaaaagcagcagaaatgaagccgcttttaatgaaaccgaaccatcacgagctcggagaaatgtttggaacaactatcacctcggccgaagaagcggtgccttacggaaagaaactcgttgaacgcggggctgaaaacgcgatcgtttccatggctggagaaggcgcacttttatgtacaaaagacggtgtctaccatgccaacgtacctaaaggaaagctcgtaaactcagtcggtgcgggggattcagtggttgcaggctttctcgcaggcattgaaaaacagcttggcatcaaagaagcttttcgcttaggagtcgcttcaggaagcgcaactgccttttcagaggagctgggaacggaagagctcgttcacaagctgcttccggaagttcaagtcaaagcgatataa

SEQ ID NO: 1558 - DNA, 1896 bp, Bacillus licheniformis
atgaaaataactgagctactaacaaagcatacgatcaagttaaaccttgagagcagccagaaagaaaacgttatcgaagaactcgtcagcgttttggatcaggctggcaagttgaatgataaagaaggctacaaagaagctgtgatcaaccgcgagaaacaaagctctaccggtatcggcgaaggcatcgccatcccgcatgcgaaaacggcaagcgtcaaagagcctgcgatcgcgttcggccgttcaaaaggcggcgtcgattatgaatcccttgacggccagccaagccatctcgttttcatgatcgccgctacagacggtgcaaataacactcacctcgaagcattgtcaagactgtcgactttgcttatgagggaggagattcgcaaacagctgcttgaagcttcatctgaagacgaaatcatcgacatcatcaatcagcatgataaagatgatgatgaagaagaagagcaggccgaagaggctcctgcaccatcagcaaaaggaaaaatccttgcggttacagcatgcccgacagggatcgcccacacgttcatggctgcggatgctttgaaagaaaaagcgaaagagcttggggttgatatcaaagttgaaacgaacggttcaagcggtattaaaaatggtctgacggcccaggaaatcgaagatgccgttgcgatcattgtcgccgccgacaagcaggttgaaatggaacgctttcaaggcaagcatgtcattgaagtacctgtaacagcaggtatcagacgtccgcaagagctgattgagcaggcgctgaaacaagacgcgcctatctatcagggtaaaggcggcggtgcaaccgcttctgaagacggagctgccaaaggaaaaggcggcggtttctacaaacacttgatgagcggtgtcagcaacatgctgccgttcgtcgtcgggggcgggatcttagttgcgatttcgttcttctggggaattaacgcgaccaagccgggagatccgacttataatgagttcgctgctgtattaaataatattggcggaacgaatgcacttggattaattgtcgctgtattggccggatttatcgcgatgagcattgcagatcgtccgggatttgcgcctggtatggtcggcggtttcatggcgacacaagctggcgcaggtttcttaggcggcctgattgccggtttcttagctggttatattgttgtcctgttgaaaaaagtgttcgctggtctgccgcaagtgcttgacggtttaaaacctgtgctgctctacccgctgtttggaatattcttgaccggaatcattatgcaatatgttgtcaatacgcctgtcaagtacattatggacggcatgacacattggcttgaaggtcttggaacaggaaaccttgtcgtaatgggtattgttttaggcggtatgatggcgattgatatgggcggtccgatcaacaaagcggcctttacattcggtatcgcaatgattgaagctggaaactttgggcctcacgcagccatcatggcaggcggtatggtgcctccgcttggaattgcccttgcaacgactttctttaaaaataaattctcaaaacgggatcgcgaagccggaattaccaactacgtgatgggcttgtcatttattactgaaggtgcgattccttttgcggcagcagatccggcacgcgtcattcctgcttgtatcatcgggtcagcagttgccggcggtctgtctcaatttttccatgtcacactgcaagcgccgcatggcggaatattcgttctcttctttacgacgaatcatgcgctgctgtatctcctcagcatcttgatcggtgcggttgtgacagctttgattctcggcgttttgaaaaagccggttccaactgaaaaataa

SEQ ID NO: 1559 - DNA, 561 bp, Bacillus licheniformis
ttgactgaagaaaaatccaccaataagaaaaactctctctttgaatgggtaaaagccattattattgcagtcgttctggcgttattgatcagggcatttttattcgaaccgtatttagtggaaggtacgtcgatggacccgacgctgcacgacggagagcggctgttcgtctataaaacggttagatacgtaggcgaatttaagcggggagatatcgtcattatcgacggcgacgaaaagaatgtccattatgtaaagcgcttgatcggcctgccgggagataccgtgcaaatgaaagatgacacgctgtacataaacgggaagaaggtgtcggagccgtatctttcggaaaacagaaaagaggcggaagcagtcggcgtcaagctgacgggcgactttggccctgtgaaggttcccgaaggcaagtatttcgtgatgggagacaatcgccagaggtcaatggacagccggaacggcctcggactgattgataaaaaacgagtggccggaacttcgcaatttgtgtttttcccgtttaacgaaatccgaaaaacagactga

SEQ ID NO: 1560 - DNA, 270 bp, Bacillus licheniformis
atgaagcttatcactttgacggaatactgcatgtttattttttttgcaggggtctatcttgccataaccggctttacagcacgggatctggggctttacatcgggattgccatgatttacgtgttcgttcatatcgcggcgaaacgaatgctgtcaaaacggggaaaagaagccgcggaaatcagaatcttgtacagcgttcttctgattatggcctctgtgttcgttaccgtactgtttatcgcagtgctggcatcattatccgcataa

SEQ ID NO: 1561 - DNA, 243 bp, Bacillus licheniformis
atgaaattgaaagatgaccctgatatcatcagatggattaattcgaggccgcgccaagcgcttttcgcgtcagtggccatggtgatttctacgatgtctatcgggcttttcaaagggtttgatatgtggaccgctgacttttttatattttcctgtctgctgatcggcttcggcctccttgtgggatggctccaaaagatatattataaaaaggtgatatttgaagaaaactcggatcgttag

SEQ ID NO: 1562 - DNA, 1620 bp, Bacillus licheniformis
atgatagctgttcaaaatgtcagcttgcggtttgcagaccagaagctgtttgaagatgtaaatattaagtttgcgcccggaaactgctacggattgatcggagcaaacggcgccggaaagtccacttttttaaaaatattgtctggcgaaattgagcctcagacaggcgaagtccatatgagtcctggcgaacgtcttgccgtcctgaagcagaaccactttgagtatgaagagcatgaagtgttgaaagtcgtgatcatgggacatagacgactttatgaagtcatgcaggaaaaagacgcgatttacatgaaacctgatttttcagatgaagacggaatccgcgccgcggagcttgaaggcgaattcgccgagctgaacggctgggaagccgaaggggaagccgcgatcttattaaaaggactcggcattcctgaagaacttcatacgaagaaaatggcagatttgggcggctctgaaaaggtgaaggtccttcttgcacaggccctgttcggaaaacccgacgtccttcttctcgatgagccgaccaaccacttggatattcaggcgatccaatggctagaagagtttttaatcaattttgagaatacggttatcgtcgtatcgcatgaccgccactttttaaataaagtatgtacgcatattgccgacctggattttaacaagattcaaatttatgtcggaaactatgatttctggtatgaatcaagccagcttgcgcttaaaatggctcaggaagccaataagaaaaaagaggagcagatcaaacagctccaagagttcgtcgccagattcagcgccaacgcctcaaaatcgaagcaggcgacatcgagaaaaaaactgcttgaaaaaattacgcttgacgatattaagccttcatctcgcaagtatccgtatgtacatttcgcacctgaacgcgaaattggaaacgatgtgcttgttgtcaaagacctgtcgaaaacgatcgacggcgtcaaggtgcttgactctgtcagctttatgatgaataaagaggataaaatcgcctttacaggccggaacgagctagccgctacaacgctctttaaaatccttgccggggaaatggagcctgacagcggatcgtttaaatggggcgtcactacatcccaagcgtttttcccgaaagacaacagcgagtattttgaaaacagcgatttaaaccttgtcgactggctccgccaattttcgccgcatgaccaaagtgaaagcttcctgcgcggatttttaggccggatgctgttctccggagaagaagtgctgaaaaaagcaagcgttttgtcagggggagaaaaagtccgctgcatgctgtcgaaaatgatgctgtccggcgccaatgtgctgatgcttgatgagccgacaaaccatttggacctcgagtccattacagcgctgaataacggtttaatcagctttaaaggcgccatgctgtttacatctcatgaccatcagtttgtccaaacaatcgccaaccggatcatcgagatcacgccaaacggaatcgtcgataaacaaatgagctacgacgagtttttggaagacaaaacggttcaggacaagcttgctgaactttacgcgtaa

SEQ ID NO: 1563 - DNA, 375 bp, Bacillus licheniformis
gtgtcatgccgaaaggctcttgagcaatatattcaagcaacaaacacacatgagtttgagaatgtcaaagccctccttgaccccggcgctgtgtactggttttcggatcaaacgtgctcgggctttgaggagattcagcgttattttgaaaacgcctggaagcaaatcgaaaatgaagtatacagcgccggtcatgtcagctggatcacggaaacggacgaacaggccgtctgtctttatacatacgaatggaaagggttatataggggcgaaccggttcaaggggcaggccgtgcgacaaacgtatttgtaaaggacgagtcaggacgctggaaactgaagcatgaacatttaagcagtttgcccaagcgatga

SEQ ID NO: 1564 - DNA, 1233 bp, Bacillus licheniformis
atgaattcgtttactgataaactgagcaaatatgcaaagcttgtggccgaagtcggcgtaaacgttcaaaaaggacagcaagtcgtcatcaacgcgtcaacagaagtacgcgattttgcacggctcctcgtcaaaagcgcctatcaaagaggggcgaaaaacgtgacggtccgctggcaggatgatgaggtcacaaggctgaaatacgagctggctcctgcggaagcctttgaagagttccctgaatgggaagcaaaggggcttgagacgctcgccaaagaaggcgctgcttttatttccattgtctcttcaagtcctgatcttttgaaaggcatcgattccaaaaaaatctccgcacagcagaaagccgcaggaaaagcgatgcatacatacaggcaaatgattcaatcggataaagtcagctggactgtcgtcgcagcgccttcgccggcctgggcgaaaaaagtattccctgaggcagatgaagagacagccgtgcaaaagctatggaatgagattttcaaaacgacccgcgttgaccgtgaagatcccgttcaagcgtggaaagatcacgatcaaaccttgcgcgataaagtaagcgtcttaaacgacaagcattatcacgcccttcattaccaagcaaagggaacagatttgacgatcgagcttcccgagaagcatctgtgggtcggcgccggaagcacaaacgaaaacggcgtcgagttcatggccaatatgccgacagaggaagtattcactgctccgaaaaaagacggggtgaacggcaccgtttcaagcacgaagccgttaagctatggcggcaatttaatcgacggctttacactgacatttaaaaacggacggattacggatgtcaaagctggacaaggcgaagaaattttaaaagagctgatcgaaacggatgagggttcacactacttaggcgaaattgcgcttgttgcccacgattcgccgatttccaagtccaatattctgttttacaacacactgtttgatgaaaatgcctcaaaccacctcgcgatcggcagtgcatacgcattcaacatcgaaggcggaaaacagatgtcgcgcgaggagctggcgaaagaaggattaaacgaaagcatcacacatgttgactttatgatcggttcaggagaaatgaatatagacggaatcactgctgacggaaaaagagagccgatattcagaaacggcaactgggcgatataa

SEQ ID NO: 1565 - DNA, 165 bp, Bacillus licheniformis
gtgaggaatggagaaacgataaggaggaagaccatgcttagagatatgggaagacgcctggccatcaccgttattttaagcggtattattctcggggggatgagcatctcccttgcaaacatgccaagctcgccccccggccaaacggccaaaatcaaccgttaa

SEQ ID NO: 1566 - DNA, 1008 bp, Bacillus licheniformis
atgtttcaaacaaccgagatcggaattgatctaggcacagctaacatattggtttacagcaaaaacaaaggaatcattttaaatgagccttccgtcgtcgccgtggacacggaaacaaagagcgtattggcggtcggcacagaagccaaaaacatgatcggaaaaacgccgggaaaaatcgtcgcggtcaggccgatgaaagacggagtcatcgccgattatgacatgacgacagacctcttgaagcagattatgaaaaaagccggaaagaacatcggctttacgttcagaaagccgagcgtcgtcgtctgcacgccgtccggctcaaccgctgttgaaaggcgcgcgatcagcgatgctgtcaaaaactgcggagccaaacaagtccatttgatagaggagcctgtcgccgccgccatcggcgcagatctgcctgtcgatgaacctgtcgcaaacgttgtcgtcgatatcggcggcggcacgacagaagtggcgatcatttcattcggaggcgttgtctcgtgccactcgatccggatcggcggtgatcagcttgatgaagacatcgtgtcattcgtcagaaaaaaatacaacctgctgattggtgaacggacggccgaagaagtcaaaattgagatcggctacgcattgattgaccatgagacgaaaacgatggaagtcagaggacgcgaccttgttacaggcctgccgaaaacgattaccctggaatcgaaagaaattcagaaggcgatgcgcgaatcgctcctgcatattatcgaagccatcagagcgacgctagaagactgtcctccggagctgagcggagacattgtcgaccggggcgtgattttgaccggaggaggcgcgcttttgaacggcatcaaagaatggctgtcacaggaaatcgttgtgcccgtgcatgttgctgcaaatccgcttgaatctgtcgctatcggaacgggtcgttctctcgaagtgatcgataaattgcaaaaagcggctaaataa

SEQ ID NO: 1567 - DNA, 270 bp, Bacillus licheniformis
gtgagaaaagtagacgaactcggcaggatcgtgatgccgattgaattgagaagagctttggatatctcgatcaaggacagcatcgaattctttgtcgaccaagataaaatcgtcctgaaaaaatataaaccgcacggtgtgtgtctgatgaccggtgaaatcacttctgaaaaccgcgagtatggaaacgggaaaattacgctcagtcctgaaggggccgaattgcttttggaagaaatcaaagctgccttaaacggagtgaaagcataa

SEQ ID NO: 1568 - DNA, 1338 bp, Bacillus licheniformis
atgaaaagatatcaaggacgaatcattgcaaccgtgctggcaatgacttttatcatgttttggaattttttattctatggggtgttgggaaataaaatcaattggacggttgatctgctgtttacgctggtgacattaatcagcgtttggtggctcacactttatatcgatgagtcaaatcagcttgtctataaattgaaggaaagcgaaaagaaatataaagagctttcctcagaaaccaaccgcataatggataatcttcaggaaatcgtctttcaaacggaccggataggatacattacatttctgaatcaggcgtggacaaccctgaccggatacagtgtcgaagagagccttggaacgatgtacaacgattattttgaccatgaagaacggatctcgaatcacctgatcgcccagttgaagaacaaggagcccgaaggcaggatcgaggtgctctaccatcgcaaagacgggagcaagttctggggcgaagttcactataaactttattataaaaacggtcaatttacgggcagcttggggacgctgactgatgtgacagaacggaaaaaagcggagatggaactgtttaagtcgaatcagcggctggccatgcagtctcaaaagctggcgatggccgggcagctcgcagcggggatcgctcacgaagtcaggaacccgctgacatctgtaaacggatttttgcagctgatgaaagcggaatatcctgaccggaaagattactttgacattattttctcagagattaaacgaatcgattctgtgctcggagaactgcttgtgctggccaaaccgcaccaggttcaatttaaaaagatcaaaatcaattcggttcttcagcaagtggcaacgcttcttgagacgaacgccgtgctttcccacattaagatcgaaaaagcgtttcagcacggggaggagtgggaaataaacggtgatgaaaatcaaatcaaacaggtattcatcaatttaattaaaaacgggatagaagcgatgcctgacggcggtaaaattacgatttcctcaaaggcagaaggagactgtgtgaaaatcagcatcaaagacgaaggcgggggcatttcccaagccgacttggcaaagctcggggagcctttcttctcaacgaaagaagaagggacaggtcttgggctgacaatttgcctgaatatcatcggcgcccacaacggagaaatgaaaatcgacagcaaattgggcgagggaagcacattccacattttgcttccggtcgataaaggtgcggcgtccgaagagaacgacattcagcaaggatgctgcagccgcgcaactataaaataa

SEQ ID NO: 1569 - DNA, 663 bp, Bacillus licheniformis
atgaaaaaagaatttgcagtaattggactcggccggttcggcggcagcatttgcaaagcattgagtgaagaagggcttgaagtaatggcgatcgacagagatgaagatcgcgtaaacgaatacgccaaaattgcaacacatgctgtgataggagacactacagacgaatctgtgctgaaaaaccttggactgcgcaattttgaccatgtcattgtagcgatcggggagaacattcaagcgagcattttgacaacgctgatcttaaaagagcttggtgtgaaaatgattaccgtaaaagctcaaaacgattatcatgaaaaagtattatccaaaatcggagcggaccggatcgttcacccggagcgtgaaatgggaaaaaggatcgcccacaacatcgtctccaacaatgtgcttgattatctggaactttctgatgaacacagccttgtcgaaatcgcagcgaacggcaaactggccggaaatacactgcttgaccttgatatccgggccagatacggaattaatattgttgcgatcaagcggggaaaggaagtcatcgtatctccgcttgccactgaagaaattcagaaagacgatattttaatcgtcatcggctcaaatcctgacattgagagatttgaaaaaaaagtctttcaacattaa

SEQ ID NO: 1570 - DNA, 1722 bp, Bacillus licheniformis
ttggacaaagagatgttcattcgccggcttggcgccgccagtcatcgcaaaaaagcggaaactgtaattaaaaacggaaaaatcatggatgtttttaatcaggaatggttggagacggacattgccatcacagacggggccatcgtcggcttgggcgaatatgaggggggaaatatcattgacgctgagggacaaatgatcgttcccggctttatcgacggtcatgtccatattgagtcctcgatggtgacgccgcccgaattcgctaaagcggtgattccccacggtgtgacaaccgttgtcaccgatccccacgaaatcgcgaatgtctcaggtgtgaagggtcttgagttcatgttggagcaggctgagatgaccaggctgaacatttattttatgctcccttcttgtgtgcctgcggcaccattcgaaaaatcgggtgcgattttgaacgccgcggatttacatcctttttacagccgcgaagaggtgctcgggcttgcggaagtgatggactatgtggccgttgaagctggagagccggatatggtgcaaaagctcattgatgccgataaagcgggcaagcggatcgacgggcatctggccggcttgtcagccgggtttgtcaatgtctacagagcggcgggcgtgcttacagaccatgaggtcacaacacctgaagaggcgcttgaacgagtgagaagagggatgtacgtcatgctgagagaaggttctgcggcaaagaatacgcgtcatgttttacctgcggtcaacgagaaaaatgtgagacgcttctttttctgtacggatgataagcatctggacgaactggtcgatgaaggaagcattaactaccaggtcaagcttgccattcaagaggggcttgacccgtttctcgcatatcaaatgggcagcctgaatgcagcggaatgcttcgggttaaagacgaagggagcggtcgccccgggttatgacgcagatcttcttttcatcagcgattttgagaacgtgagcattacaaagacgatgattaacggcgtgatctggagcgggacagagcaaagccaatcgacgggcggcaaagcggcatccggtctgcttcaatctgtgcatctgtctgatttacatgagaacgatctgcaaattccgatcgttcaagagaatgaaatcagggttattgacattatccccaatcagctcgaaacaaagctgtccctggccaagccgaaaagcggagctttttttcagccggatctggaaagcgatctgttgaaaattgcagtggttgagcgccatcgcggcgttaaagaaatcggactcggcgtagtcagaggcttcggtttaaaagaaggcgccatcgcgacaaccatttctcatgattcccacaatttaatcgctgtcggtacaaatgatcaagacattttaaaagcgattgaacgcctcggagaaatcggaggaggcctcaccattgccaaaggagggaaggagcttcaatccgtcgcactgccgatcgccggcctcttgtcggacaaaccgcttgagacggtcaacgaaagcttgaaatctctccacgcggcaataacagagacaggattttcaggagcgtttaatccttttctgacgctttcttttttagcgcttccggtcattcccgacattaaaatgacaacggaaggattgtttgatgttaaagcgttcaggcatatcccggttcaaccataa

SEQ ID NO: 1571 - DNA, 1668 bp, Bacillus licheniformis
atgaaatttgttaaaaatgaccaaacggctgtatttgcccttggaggacttggggaaatcggcaaaaacacgtacggggtccagttccaggacgagatcgtgctcatcgatgcggggattaagtttccggaagacgagcttctcggaatcgactatgtcatccctgactacacttatttagtcaaaaacgaagaaaaaatcaaaggtctttttattacgcacggacacgaagaccacatcggcggaattccgtacctgctcaaacaggtgaacattccggtttacggcggacagctcgccatcggccttctcaggaagaagcttgaagagcacggtttgcttcgccaaacaaagcttcatatcattgaagaagacgatatcgtcaaattcagaaaaacgtcggtttcttttttcaggacgacccacagcattccggactcatacgggattgtcgtaaaaacaccgcaaggaaacatcgtacataccggtgactttaaattcgattttacaccggtgggcgaacccgccaacttgacaaagatggccgaaatcggaaaagaaggcgtgctttgcctgctgtcagacagcacaaacagtgaaatccctgatttcacgatgtcagagcgcaaagtcggagaaagcattgatgatattttcggaaaagtcgaaggcgggatcatcttcgcaacctttgcgtcaaacatccaccgcctgcagcaggtgatcgaagcggctgttgcaaacggacggaaggttgccgtatttgggcgaagcatggagtcggcgatcgaaatcggccaaacgctcggatatattaagtgtccgaaaaacactttcgttgaagcgaatgaaatcaacaggctccctgccgggaaagtgacgattctctgtaccggaagccaaggcgaaccgatggctgctctatctcgaattgcaaacggcacacaccggcaaatctccatcaatcccggggatacggtcgtattttcatcatctccgatcccgggcaatacgatcagcgtcagccgcacgattaaccagctttaccgggcgggtgccgatgtcatccacggagctgtgactaacattcacacctcgggacacggcggacaggaagagcaaaaactgatgctccgcctcatcaagccaaagtttttcatgccgattcacggtgaatacagaatgcagaaaatgcatgtcaaactggcgacagactgcggaattcctgaggaaaactgctttattatggacaacggggaagtgcttgctttgacaagcgaagaagcctcagttgcgggtaaaatcccgtcaggcaatgtttatattgacggaagcggcatcggcgacatcggcaatatcgtgcttcgcgaccgccggattctttccgaagaagggctcgtcattgtcgttgtcagcatcaacatgaaagaattcaaagtgtccgcagggcctgacttaatttccagaggatttgtctatatgagagaatccggtgatttaatcaatgatgcccaggaactgattgcaggacaccttaaaaaagtgatggagcgcaaaacgacacagtggtctgaaattaagaacgagattacagacacgcttgctcctttcctctatgaaaaaacaaaacgccggccgatgatccttccgattattatggaagtctaa

SEQ ID NO: 1572 - DNA, 210 bp, Bacillus licheniformis
atgatctataaggtattttatcaagcaagcaatgacgaagtacctgttcgtgaaaaaacagattcaatttttgtggaagctcaatctgaacgtgaagtcagatctaaattaaaaccatacaactacaatattgagtttatacagcaagttgaaggcgcttttttagaatatgaaaagcaaagcgaaaattttaaagtattggagttatga

SEQ ID NO: 1573 - DNA, 777 bp, Bacillus licheniformis
atggataaaaagctgattttctttgatattgacggaacgatttatgatcacaataaacgcattcccgccaccgcaaaacaggccgtctccgatttgaaagcgcacggccatcatgttttcatcgcgtcaggccgtgcgccgtttatggtcaggcctgttcttgaagaactgggcatcgattcttttgtctcttataacggacaatatgtcgtttttgaaggagaggtcatttataaaaatcccattgccgagcagtcgttagaagcgctgcttgcgcattcggacagctgcggccaccccctcgtcttcatgggggaagaggggatgcgctctacaactgccgcccatccgttcgtcgatgaagggatcggcagcttaaaagtcaatccgccggaagaggatcgtacctactttaagggcagggacattttccaggtcctcttgttctgcacgcaagacgaggaagagcggtacagccggtttaaagagtttgatctcgtccgctggcacgagcgctccacagatgtgctgccttcaggcggatcgaaagcggaaggaatcaaaaaagtcattgaaaaacttccgttcgacagagaggatacttatgcgttcggggacggtctgaacgacctgcagatgatcgaatttgcgggaaccggagtagcgatgggcaacgctgtgcccgagctgaaaaaaatagccgactttatcacaaagcccgtcgatgaagacggcattcaatacgcggtggaagcgctcggacttttgaaatcataa

SEQ ID NO: 1574 - DNA, 555 bp, Bacillus licheniformis
ttgatcacaatggaaaacattgtccgcgacggtcatcctgctttgagaaccgtcgccgaagaagttcaattgccagcaagcgaagaagaaatcaaacagctgagcgaaatgatcgagtttgtcaaaaacagccaggaccccgaaatcgctaaaaagtacaaccttcgtcctggtgtcggtctagccgctccgcaaattaatatcaataaacgaatgatcgccgttcatgccgaaagcgaagacgggacactatacagctatgcgcttttcaatccgaagatcgtcagccactctgttcaaagatgctatttgacaagcggcgagggctgcctgtccgtcgacgagccgattcccggatatgttccgcgctatgaacggatccgagtcaaaggaacgacgcttgaaggcgaaaacatcgacatccgcttaaaaggatatccggcgatcgtattccagcatgagatcgatcatttgaacggcattatgttttacgaccacatcgacaaagaaaacccgctgaaacaacctgaaaatgcaacgcctgtaggcaggtaa

SEQ ID NO: 1575 - DNA, 132 bp, Bacillus licheniformis
atgtacggttattgctgccctggatacgggtacggcggcggttatggatacggctacggccgcacattcgctttgatcgtcgttctctttattttgctgattattgtaggggccgcttatttaggctgctag

SEQ ID NO: 1576 - DNA, 669 bp, Bacillus licheniformis
gtgaaattttcaaatatgcgggtgcccgcaggcatcgtcgttttttgcacggctgcatttgtattaacaggctgtctctggaaggatcctgtcgagtcgtttcacggctcgctggagaagatcgtggaattggaagagccttttaaacaagagcagggttcacttaaaagtcttgaaaaagccgaatcgaagctttacgaggaaatgatcaggctcaatatggatgattttgaccggatcgctgcgctctccgacaaagcgctgaagacagccggcaaacgcgagaagcacttgaattctgagaaagaaagcatagatgaagcaaagcaggagtttgaagcaaataaagcgtcggcagaaaaaatcgatgatcagaaggtcaggaaaaaggctgagaacgctgcatcttatatggaaaagcgctacaaagcatacgactctctttatggcgcctatcaaaacgcaatcggccttgacaaagagctgtacaagctgctcaaaaataaagggcttaaactggatgaccttgaggagcagctgaaaaaaatcaatcaatcgtatgacaaagtgctgaaagaaagcaagcatttcaatgagtatacaaaggactacaacaaagccagaaaagatttttacaaggctgcggggtttgagatgaaagagggctga

SEQ ID NO: 1577 - DNA, 1116 bp, Bacillus licheniformis
atggctgcaaaaacgaaaaaagcaatcgttgatagcaaaaagcaattcgatgccattaaaaagcagttcgaaacgtttcaaattttgaatgaagaaggcgaagtcgttaatgaagcggcaatgccggatctatctgatgatcaattaaaagaattaatgcgccgcatggtgtatacacgcattttggatcagcgttctatttctttgaacagacaaggccgccttggcttctacgcgccgactgccggtcaggaagcttctcaaattgctacgcatttcgcgcttgaaaaagaagacttcgttcttccgggctaccgtgatgttccgcagctgatctggcacggacttccgctttatcaagcattcttgttctctcgcggacacttccgcggcaaccaaatgcctgacgatgtcaatgcgctttcaccgcaaattattattggtgcgcaatacatccaaacggctggcgttgcactcggcttgaaaaaacgcggcaaacaggctgtggcgatcacctatactggagacggcggtgcttcccaaggtgacttctacgaaggaatcaactttgccggtgcgtataaagctccagctattttcgttgttcaaaacaaccgctatgcgatttcaacacctgttgaaaagcaatcagcagctcaaacaatcgcccaaaaagctgcggctgcaggtatcgtcggcgttcaagtagacggaatggatgcccttgctgtatacgctgcgacacgcgaagcacgcgagcgcgctgtaaacggcgaaggccctaccctgatcgaaacgctttgcttccgttacggtcctcatactatggccggtgacgatccgacaaaataccgtacaaaagaaatcgagaatgagtgggagcagaaagatccgcttgtccgtttccgcaagttcttggaaaacaaaggcctttggtctgaagaagaagaaaacaaggtaattgaagaagcgaaagaagaaatcaagcaggcgatcaaaaaagctgacgaagagccgaagcaaaaagtgaccgacctgatcgacattatgtatgaagagcttccttacaaccttgtagaacaaaaggaaatttataaagagaaggagtcgaagtaa

SEQ ID NO: 1578 - DNA, 978 bp, Bacillus licheniformis
atggcgcaaatgacaatgattcaagcaatcactgatgcgttacgcacagaactgaaaaatgacgaaaatgtcttagttttcggagaagacgtcggtgttaacggcggcgtgttccgtgcgactgaaggattgcaaaaagagtttggtgaggatcgcgtatttgacactcctcttgctgaatctggtatcggcggccttgcactcggcttaggcttacaaggcttccgtcctgtaatggaaattcaatttttcggctttgtgtatgaagtgatggactctgtttccggacaaatggcacggatgcgctaccgttccggcggtcgctggaattctccggtgacaatccgttctccgttcggcggcggtgttcatacgcctgaacttcacgcggacagcttggaaggactcgttgcacagcagcctggacttaaagtcgttattccttcaactccgtacgatgctaaaggacttttaatctctgcgatccgcgataacgatccggttgtcttccttgagcacatgaaactttaccgttcattccgccaggaagttcctgaagaggaatacacaattgaaatcggcaaagccgatgtgaaacgcgaaggaaaagacctttccatcatcacatacggagcgatggttcacgagtcattaaaagcggcggaagagcttgaaaaagaaggcgtatctgctgaggttgtcgaccttcgcacagtcagcccgcttgacattgacacgatcatcgcgtctgtagaaaaaacaggccgcgcaatcgtcgttcaagaggcgcaaaaacaggctggagtagctgcaaacgttgttgccgaaatcaacgaccgcgcgattttgagcctcgaagctccagtgcttcgcgtcactgctcctgatactgtattcgcattctctcaagctgaaagcgtatggcttccaaaccataaagacgtgcttgaaactgcgaaaaaagtattggaattttaa

SEQ ID NO: 1579 - DNA, 1293 bp, Bacillus licheniformis
gtggcatttgaatttaaacttccggatatcggggaaggaatccacgaaggcgaaatcgtgaaatggttcgtcaagccaaacgacgaggtaaacgaagatgacgttttggcagaggtacaaaacgataaagcagttgtagaaattccttcacctgttaaaggaaaagtattagaattaaaagttgaagagggaacagtcgcaaccgttgggcagacgatcatcacatttgatgcaccaggttacgaagatcttcaattcaaaggcgacgaatcaggcgaagcgaaagcggaagaagctgaaaaacaagaaactgatgcacctgcagaagcagcggaagcaaacgagcaagcggatgcagatccgaataagcgcgtcattgcaatgccatctgttcgcaagtatgcccgcgaaaaaggcgttgatatcgtgaatgtttcaggttccggcaaaaacggccgcgttctgaaagaagatatcgacagcttcttaaacggaggaactgccggagacgctaaggctgctcaagctgaagagaaagcagaacctgctgcacagcaacctgcagctgcggttcaagtgcctgaaggcgaattccctgaaactcgcgagaaaatgagcggaatccgcaaagccattgcaaaagctatggtcaactcaaaacataccgctccacacgttacattaatggacgaagtcgatgtgacaaaccttgtcgctcaccgcaagcagtttaaacaagttgcggctgatcaaggaattaagctgacttacctgccttacgtggtaaaagctttgacatcagctctgaaaaaatatccagtcctgaatacatcaattgacgacaatacagatgaagtgattcagaagcactactacaacatcggtattgcggcagacactgaaaaaggcctgcttgtgccggttgttaaaaatgcggaccgcaaagcgatttttgagatttcaaacgaaatcaacgagcttgcgacaaaagcacgcgaaggcaaacttgctcctgctgaaatgaaaggcgcttcttgcacaattacgaatatcggctctgccggcggtcaatggttcacaccggttatcaaccatccggaagttgcgatccttggaatcggccgcatcgctgagaaagctgtcgttcgtgacggcgaaatcgtcgctgcacctgttctggctctttctctaagctttgaccaccgtatgatcgacggcgcaactgcacaaaacgcgttgaatcacatcaagcgtttgctgaacgatccacaattaattttaatggaggcgtaa

SEQ ID NO: 1580 - DNA, 1413 bp, Bacillus licheniformis
atggtagtaggagatttccctattgaaacagatactcttgtcattggtgcgggacctggcggctatgtagctgccatccgcgctgctcagcttggacaaaaagtaacaatcgtcgaaaaaggcaatcttggaggcgtatgtctgaatgtcggatgtatcccttcaaaagcgcttatcaatgcaggccaccgctatgagaatgcgaagcattctgaagagatggggatcactgctgaaaacgtaaaagttgactttacaaaggttcaagaatggaaagcctctgtcgttaataagcttaccggcggtgttgaaggccttctgaaaggaaacaaagtcgacatcgtaaaaggcgaagcatactttgtagacagcaattctgtacgcgtgatggatgagaactcagctcagacttacacgttcaaaaatgcgatcattgcaacaggttctcgccctatcgaattgccaaacttcaaatatagcgaccgcgtactgaattcaacaggcgcacttgcactgaaagaaattcctaagaagctcgttgtcatcggcggcggctacatcggaacagagctcggtactgcatatgcaaacttcggtactgaagttgtcattcttgaaggcggagaagaaatccttccaggatttgagaagcaaatgagctctcttgtgaaacgcaacctgaagaaaaaaggcaacgttgaaatccatacaaaagcaatggctaaaggcgtagaagaaaaagctgacggcgtaaccgttacgttcgaagtgaaaggcgaagagcaaacgatcgatgcggactacgtacttgtcactgtcggccgcgttgcaaacacggacgagctcggacttgaacaagtcggcgtcgaaatgacggaccgcggcatcatcaaaacggacaaacaatgccgtacaaacattccgaacatctatgcgatcggtgacatcatcgaaggtcctccgcttgcgcataaagcttcttatgaaggtaaaattgctgctgaagcgattgccggagaagctgcggaaatcgactatcttggaattcctgcggtcgtattctctgagcctgaacttgcatctgtaggctacactgaagcacaggctaaagaagaaggtctttcagtgactgcagccaaattcccgtttgcagcaaacggacgtgcgctgtcattaaacgaaactgacggtttccttaaacttgtaacacgcaaagaagacggcttagtcatcggtgcacaaatcgccggagcaagcgcttctgacatgatttctgagctgagcttggcaatcgaagcaggaatgactgctgaagatatcgcaatgacaatccacgctcaccctacattgggagaaatcacaatggaagctgcagaagttgccatcggcatgccgatccacgttgtaaaataa

SEQ ID NO: 1581 - DNA, 861 bp, Bacillus licheniformis; identical to SEQ ID NO: 484

SEQ ID NO: 1582 - DNA, 333 bp, Bacillus licheniformis; identical to SEQ ID NO: 485

SEQ ID NO: 1583 - DNA, 303 bp, Bacillus licheniformis
atgcctgaccagcagcatcaaagcaccaatcaccgccacctcaagctcatctttttttccgatgacgagcatatggagcaggaagtggcttattatgatgcgcttttggatttaaaaaaagaatttcccgaacaggtttcaagtatggaaatttcacatgataaaggcgagtggaaaaaagaggttaaagtctttccaagcttgctgcttgttaatgataagaaagtactggttaaaattgaaggaaaaataaaagataaagataaaattgtaaggcttcttcaaaaggaattgaaacattaa

SEQ ID NO: 1584 - DNA, 120 bp, Bacillus licheniformis
atgggcacgatcgtttgtcaagactgcaatgaaaccattcagcattttgaagatgagaaagtgacgatactttacggaacgtgcggacagtgcaactgccatcttaaagaggaagaatag

SEQ ID NO: 1585 - DNA, 1491 bp, Bacillus licheniformis
atgaaggtgggaaaacaattgttgcagcacgaaacacccctatataccggattaaaaaaacacgccggcaaaaacccgatccagttccatataccggggcacaaaaaaggctctgggatggaccctgaattcagggagtttatcggagaaaatgcattaagcatagatttaatcaacatcgagcctctcgacgatctgcacgcgccgaaaggaataatcaaacaggcgcaggatctggcggctgaagcattcggagccgactacacgttcttttccgtccagggaacgagcggcgccatcatgacgatggtcatggccgtatgcggacccggagacaaaatcatcgtcccgagaaatgttcataaatcggtgatgtcagcgatcgtcttctcaggcgccgtaccgatcttcatccatccggaaatcgacgatgagctggggatttcacacgggatcacccctgaatcagcgaaaaaagcgctgcttgagcatcctgacgcaaaaggactgctcgtcatcaacccgacttatttcggcatagctgcagacttaaaaagcatcgtcgagctggctcattcttttcatgtcccggtgctagttgacgaggcgcacggcgttcatatccacttccatgaagatctgcctctttcggcaatgcaggccggagcggatatggcggcgacgagcgttcataagctcggaggatcccttacacaaagttcgattctcaatatgaaagaaggtctggtttcaaaggaaagggtgcaatcgattttaagcatgctgacgacgacatcgacctcctatctattgctcgcttcgcttgatgtcgccagaaaacgcttagccacagagggacacgaactgatcgaacaaacgattaagctcgccaacgaaacaagggaacgcatcaataatatcaacgggatttcatgcgtcgggagggaaatcctcggctccaaagcggcttttgactatgatccgaccaaattgatcatatctgtgaaagacctcggcctgaccggtcatgatgtggaaaaatggctgcgcgagtcatgccaaatcgaagtggagctttctgacttatacaacatcctgtgcatttttacaccgggagaccggaaagaggatgcagatgcgttaattaaaggattaaccgagattgctcaacaggccgcttcatctgcggaaaacagacgcaagcctgaagtgcttctgccaaacattccggcgcttgcgatgacaccgcgtgacgctttttacgcaaacacggagatcattccgttcaaaaaagcagctggcagaatgattgccgagtttgttatggtttatccgccagggataccgatcttcattccgggcgagatcattaccgaggataatatcaactacatcgaaaagaacctggaagctgggctgcctgttcagggaccggaagatgacaccctccatatgatccgcgttattaaagaacagcaggcaatcctgtaa

SEQ ID NO: 1586 - DNA, 276 bp, Bacillus licheniformis
atggaagaagggtaccaatatccgatgaatgaagactggagcacagaggaagcgatagacgtcatatcgttttttcaggcggttgagctcgcttatgaaaaaggcgtagagcgagacgtgctgatgagtgcttaccgccgctttaaagaaatagttccgggaaaagcggaggaaaaaaagctgtgcagccagtttgaagaagcgagcgactactctccgtatcaagcagtcaaaaaagcaaaggaacaaacggaagatacgaaaattaaaatgtaa

SEQ ID NO: 1587 - DNA, 636 bp, Bacillus licheniformis
atgagcagtctgcgttttactgaagaggattttcgtacatttacaatagaaggtttagatgcgcggatgagcgttctgaaagacacagtgcgcccgaaacttcaagggctcggcgatcattttgcgcctgttctgtccgctttgacaggagacgaaatgtttgtccacgtcgccaagcacgcgcgccgctcagtcaatccgccggacgacagctgggttgctttcgcaaacaataagcgcggctataaaaagctgccgcatttccaaattggtttatgggaaacccacgttttcgtatggtttgcattgatctatgagtcccctctcaagcaggaatacggccagctgtttaagaagcatctgccggatattgagagcagcattccaagtcgctttttctggtcggccgatcatacgaaaccggatgccaagagacagtctgagatgaatgaaaaagatctggaaaacctgtttgaacggctcgtcaacgtgaagaaagcagaagcgctttgcggtattcagctttctaaagacgaggtgctgcatatgagtgaagaggcgtttctatccgaaatcgaagcggcttttgaaaagctcgccttcctttaccgcctgacgcagaaagtatcggtataa

SEQ ID NO: 1588 - DNA, 189 bp, Bacillus licheniformis
atgaaaccaatagtaaaacaaggattgaaagaggaaaaagacaatcgggccgctgtttggaggcttgaggtcgattatgaacttgcaacgctttttgaagctatggaaaaaaaggatgaaacccaaatcgagttgagcaagcgcaaactggaacgactcagaaaagaatggatcagattacatggttga

SEQ ID NO: 1589 - DNA, 795 bp, Bacillus licheniformis
atgacaaactggaaggaaatcgatcgcctggcgaaaagctgggtgaaagaagctggtcagagaattaagcaatcaatgaaagaaaagatgacgattgaaacgaaatcgaatccaaatgaccttgtcacaaacattgacaaggaaacagagcgttttttcattgaaaaaattcaatcggtttttccggatcatcatattcttggcgaagaaggccaaggggacaagctcacatctttggacggcgtcgtttggatcatcgatccgatcgatggtacgatgaactttattcatcaaaaacgcaattttgcgatttcaatcggcatttttgaaaacggaaaaggcaaaatcggcttgatttatgatgtgactcacgatgagctttatcatgcttttcaaggcgaaggtgcttacatgaacaatacaaagctcggcaagatgaaagaagtgccgcttgaggaatcgattctggccatcaatgcgacatggatcaccgagaacagacggatcgatccaagcgtattatccccgcttgtcaggcgcgtcagagggacccgttcatacggttcagcggctttggaactcgcttatgtagcggcaggcagaatggatgtgtatgtgacgatgaggctcgctccttgggattacgctgccggctgcattctgcttgacgaggtcggcggaacatatacaaccattgacgggaaaccgctcaattttcttgaaaaccacagcatcgtagccggcaatccggcagctcaccgggcgattttcgacgaatatttgccgcatgaatag

SEQ ID NO: 1590 - DNA, 468 bp, Bacillus licheniformis
atgaatagcaggtctttctcttcttctgatctcgccttttttgaagagctggccgaagcgagccccgggtgggtgaaggaagagcttgacggaaacagcctggaacgctatatgagtgcttatgcgatgtataacggtgaatggctcgtgtgggaagacgggggactgccggcggctctcagctttcatctcgaatgggcgccttctaatggcaagccttggctcggaacgcttcttgtccatcccgatttccgcaaaaaaggccgggcaaaagaagtgatcaaaacgatcggaaaacgcttgagagaaaaggggcataaagcgttgtttgcggcagtgccttatgagaaagacgaatggttgaacatgctggcccgttcaggatttgaacagctgaaaacggaaaaagatgaaaagggaaaacgatatttgatcatggttttgccccttcccttgtggctgcaatga

SEQ ID NO: 1591 - DNA, 1926 bp, Bacillus licheniformis
ttgatcgaactatttagtgattatgtgctccattttgaacgttattttgttttaagcagacagagcatgcttgtcattcagtggtgtgtgacaggccttgtccttttgtatgccgtgtcatttcatccaaaagtgtgcaggcggcgcctctttttttatgcaggcatcgttctcaggctgatactggttggcgccctttcgtttgaattggctcaccaaatgaaagccgctgagttttcaaacctgtacatagacgaacaagatgcgcttctgccttttatgcagtttttgctgttcggctatattttgcttgtctcttttcattatatgatgacactcgcggaaaaagggggcaaggggctgttttttgcatttgacattgcggtgatggcgatgccgcttttccaatcgctgttcagctttgccgcctatttgaaggaatttggagcggaggagcttgaagaattgccgctcgttctgttgttgattgtcggaataccgggactgatgatctgcttgttttttcagctttattggaaaagaaaccgttacgttctccttttgattttttatattgtgacgatcggcggtttcttcatcaaaaagcttggatacgaattttttccgctgaacgtatttctgacaatgatcggttttcttatgacatatcacttgctgaatgactcgagaaagcctttgttgatggtgaagcgtgttttagccgcgggcaccgccgtatttttcacgcttcacctcaatcctttttacaatttggcggatgccgcttttacaatctcacacccggaggtttcagacgtggttgatgccaattttcggcctgtttcggttaaagaagcgaagcagactgtcagctcgttttttccgacagagagctttatctatttgtcagctaccaaccaggattttcataacgtttatcatttcaaaacgaaagattacgatgcggacgttgacggctggacgggaatgatcaccaattatcacaatcaaaaaaagcctagcgggaatatcctgtccggtcaggcatatatcaagcggtcgaagcaatttctaagggaacacggccgcgaacttgacaaacaaatcaaggcaaaggtcagccgtgatgacggcgaagctactgttgaattttaccgtgaaggcgaggatcctgaattaagcacaatgtggtttacttggcggaaggagactctgatgggattccatgaggacgcgtctgtttacagcttagaaagcgtgaaccaagcccgcgtttctggtgaggatatcgagcggggagttgaagccgtctatcgtaagctgggcatacccgtctcatcttatcggctgacagatattgatttattattcccattcagcctcaactcggcatccatcaacataaagacaagtgacggaatggggatggagttccaccctgtaacaggtgcattaacggctatttcgatcaaatctgaaagcgccttgccttatcgcggacaagagcttgaaaaacgcttgctttcattatttgatcaagacatttccaatctgaaaagggtggagttagaaaaggatctgatagaatttcagaaaaaagaaagcgatgctgtgttaaatacggtctggaccatgacgaaacatgaagagggagcttatctgacggtgagaaaaaactttcaaaaagcagatgaaaaacccccctacacgtatgcagacggggaaaaagcttttcagaaagtgtctgaacgctatcaaaaagggctggtctatcataaacggacgaagcttgtaatcgtttcagacggggatcaaaagagccgttatgcgtggcttgtcatcatccagccgttcggctcaaatgaacatgacgcatacttggttgatgccgagacagatgaggtgaaacattttgatgacaaatga

SEQ ID NO: 1592 - DNA, 273 bp, Bacillus licheniformis
atgacaaatgaagaaaaaaaagcggtgtttatcgatttgtatgagctctatcaagaaagtgaactggaagaggaaacgatgatctggatgaaagagcatgagcagttttttcaggatcaggctgaagcggcagcagccggtaatagagagctccccggcatgcaaaaaacagatgatcatcagaagctccttcatatcaagatttttgtttactcgttatatggtgctttcctgctcctatcgatttggatgacggtgtggttttttttctaa

SEQ ID NO: 1593 - DNA, 516 bp, Bacillus licheniformis
atggctcacaataataaacagacgattgaagaactgtacagggaatattatcatgacatcatgtactatttgtacaggcgaacccatcagcttgagacggcgaaagacctggcgcaggatacgtttctaaaagcttttgcgggcctggagtctttcaggggccattcctcgatcaaaacatggctgtatacgatcgcacatcatacgtttatcaactggtacagaaaagataaaaaaatccaattttccgacgtggcggcctgcggcgatatggaacagcacacatttgaaatgcctgagcgccatttggcaaacgccataatgcaggaagagctgaaacatcacattgaccggctgaaagaagattaccagactgtcctcattttaagagagtttcaagagctgtcatacgaggaaatagcggaagtgctgaattggaaactgtcaaaggtaaaaaccaatcttcaccgggcccgcctggagctgaaaaaaagcttggaaggcagggaggtttaa

SEQ ID NO: 1594 - DNA, 297 bp, Bacillus licheniformis
atgaaatgccatcttgtaagagatttactgcctttatacatagaaggcgattgcagccgcaaaacggaacgtttggttgccgcacacattaagacatgcgaggattgccgggaaatgtacgacatgatgagggaacctgtcaattttcatggtgacggaggattgccaaaggaagcagaagaagcggaagaacaaaagttcaggaaagcgtattatcaaaggctgattctcaaaggggcagcgctgtttggcgggggctacttgctgatgcttttgatttacttattctttttataa

SEQ ID NO: 1595 - DNA, 189 bp, Bacillus licheniformis
gtgaaacaaatcaaatggattttcttattattcgcacttgctgcagtgatcagcatcatgatgatcggagttgcagtcgccgaaaaaagcgcagccggcgtcgcaatcgccatcgcgattctgatcgtcattatgggaagcggtttcacactgaaaaaaagaatgcgcgaaaaaggcctgcttgaatag

SEQ ID NO: 1596 - DNA, 1839 bp, Bacillus licheniformis
gtgaaacttcgagaagatcttcgcaatatcgctattatcgcccacgttgaccatggaaaaacgacgctggtggatcagctcctccatcaggccggtacattccgtgcaaatgaaaacgtggctgagcgcgccatggattccaatgatttggaaagagagcgcggcattacgattttagcgaaaaatacggcgattaattataaagatacacgcattaatattttggatactccgggacacgcagatttcggcggggaagttgaacggatcatgaaaatggtcgacggcgttctgcttgttgtcgacgcttatgaaggctgcatgccgcaaacccgctttgtgctgaaaaaagcacttgagcaaaacttgacgccgatcgttgttgtcaataagatcgaccgcgattttgcccgtccagaagaggtcgttgacgaagtgctcgatttgtttatcgagctagatgcaaatgaagaacagcttgaattcccggttgtttacgcttctgcgatcaacggcaccgcgtcagcagatccgaagcagcaggatgaaaacatggaggctttattcgaagcgattgtcaaccatattccttgtcctgtcgataaccatgaggagcctttgcagttccaggtggctctgcttgactacaatgattatgtcggccgtatcggaatcggacgcgtgttcagaggaacgatgaaggtcggacagcaagttgctttaatgaagcttgacggttctgtcaagccgttccgcgtcacgaaaatcttcggtttccagggcttgaagagagtcgagattgaagaagcgaaagccggcgaccttgtcgctgtatcaggaatggaagacatcaatgtcggagaaaccgtctgcccgattgagcatcaagaggcgcttccggttcttcgcattgacgaaccgacgcttcaaatgacgtttgcggttaacaacagtccttttgccggtcgcgaaggaaaatatgtcacggccaggaagattgaagagcggcttgaacagcagctgcagacagatgtcagccttcgagtcgatccgacgccatctcctgacgcatggatcgtgtcaggacgcggtgagctgcatttgtcgattttaatcgaaaacatgcgccgcgaaggctttgaactgcaagtatcgaagccggaagtcatcattaaagaaatcgacggcgttcgctgtgagcctgttgaacgcgtacaaatcgatgtgcctgaagagcataccggatctgtaatggaatcaatgggtgcgcgcaaaggtgaaatgatcgacatgatcaataacggaaacgggcaagtccgcctgattttcaatgtcccttcacgcggattaatcggctactcaaccgaattcctttcccttacacgcggtttcgggattttaaatcatacgtttgacagctatcagccggttgagccggggcaagtcggcgggcgccgccaaggcgtgcttgtctcaatggataccgggaaagcttcagcctacggcattcaaggcgttgaagagcgcggcgtgatttttgtcgagccgggcacagaagtatatgaaggcatgatcgtcggcgagcacaaccgtgaaaacgaccttgtcgtcaacatcaacaaaatgaagcagcagacaaacgtgcgctcagcgacgaaagatcagacggtcagcatgaaaaaaccgcgtatcatgtcgcttgaagaatcgcttgaatacttgaacgaggatgagtactgcgaagtcacacctgaatccatcagattgagaaagaaaattctcgacaaaaacgaacgcgaaaaagcagcgaaaaagaaaaagctggcaggattgtcgtaa

SEQ ID NO: 1597 - DNA, 321 bp, Bacillus licheniformis
ttgactgatgtaagtgaacggctgtcgttttttgccgctctctataaagtggaccagaatcccgaggcgggaatgtggtggctttatgccaccatcttcgtcctgtctgcggtcgtctttaaactgggtttcgccaaacggctgccgctgttgaaaacggcgatcatttacttttttctggcattaggctgtacgtttttaacttttttcggcgtttttctgccggttggagaagggctgatcgtagctgttttaatcctttcgatttataaaatccgcctgcaccgttcgaaaaaagagcagacgggggcgaatacgtag

SEQ ID NO: 1598 - DNA, 507 bp, Bacillus licheniformis
atggaacatttaacacacgccaaacaagaaatatttgacctgtacatcaggctcattcatcagcaggagcagcaagaaaccgtcatgaaagagcgcatctccgcagaaatgaaaaagatggagcgcgaattcggagctgaaatgagactcaatatgtctgacatccatacgatcagctgcattggcgaccacgaaccgatcaacgtcacctcgatttccgagaagatggaattttcaaaagcgacggtctcaaggatcaccgcaaagctgaccgaaaaagggctcgtcagcaaaacacagctcagcgataataaaaaagaaatctacttccgtttaagccataaagggagaagcatccatcaccttcaccagcgggagcacgataaaatcgaacaaagatttaaacgatttttaagccggtattcatttgatgagatcctttttgccagggctttgtttcgggacttattaacggcggattttctcgcggatacagaaaagacatag

SEQ ID NO: 1599 - DNA, 1482 bp, Bacillus licheniformis
atggattttgatgtattgattgcaggcggcggccccgtcggtctgctgacggcttccgagctggctttggccggcgtccggacctgtattgtcgaacggctgaatgagccttctccattctcaaaagcgctcacactgcatcctcgctcaatcgaaatacttgaaatgagggggcttggagaacgatttaaggaaattggcaagccgctcggttcggggcactttgcaggtctgaagactggattggatttttctgcgcttgacacgcgagccaattttacactgttcatcccccagtacgaaactgagaaggtgcttgaggaacacgcgaggaatctcggtgtctgcatccttcgcggtcatgaagttctcgctgtccgcgagcatgaagacaccgccgagcttgtcgtccagggtccggacggcctgtccttactaaccgcttcctatatcgtcggtgccgacggggccggaagtaccatccgcaagcaggcgcgcatcgctttttccggaactgatgcgaatatcaccgcaatgcttggtgatgtgtcgcttgaaaatccgccggaatcgcatttctatacttgcgtgaaccgtgaaggcggcgttgtgatcgtgcctttagacggcggcattttccgcgtcctcataacggcgccgcatatgccccaagctttgcttcacgagcccgtcacactggaagaattaaaaaaagaactcagccgcatttgcggtacggactttggaattaacagcccggtttggatgtcccgcttcggaaatgccagcaagttggcggagcattaccgttccggcagaatttttttagctggagatgccgcgcatatacattttcccgcaggtgggcaaggtttaaatgtcgggcttcaagatgcgatgaaccttggctggaagctcgcagcaaagatcaacggacggtgtcccggctggctgcttgacagttaccatcatgaaagacaccctgtcggcaaagcgctgatcgtcaatacacaaatccaaacaaagctgtttgattttacgcgtgaagggctgtacctccgtgaattgctatccggcatactcggattttcagacgtcaatcgctatctggcagaacaaattgcagcgctcagcgtgcagtatgaagcagatgaaaaaatgcctgaacatgagctgaacggtaaacgcctgcccgatattgacctgaccctttcagatggtactgtcaaacgactttacacatttcaccgcgatggacgtttcttattagcagcattcggaaaagaaccgaaggaattttccagactgcctcatgtccggctcatgcaactgaaagcgattgacggacggcctgaatggaatggcgtaaaagcagccctgatccgccccgacggccacatagcctgggctgtggacgaatccctggaaaacgcggagcaattgattgccgatggaatccgccgctggtgcggaaacgcttaa

SEQ ID NO: 1600 - DNA, 189 bp, Bacillus licheniformis
ttgtgtgacaaaatcgaaaaaatcgatgacgacacactcattgccaaacgtctccgaaaccggccgatacatacctatatgtgccatgaatgcagcgaaagaattaaaatcaaaaccgaaaaccggatgaaaaccggccgttttaagttatatccgcacagaaaagataaagagcagatcaagtcataa

SEQ ID NO: 1601 - DNA, 615 bp, Bacillus licheniformis
gtgcgaatcttttttttgatcctaattcaaaccgttatgctgctttcagcctgcggcattcaaaataatgcccgaaatgaagcaaatgagcttcccggcaacagaccgattcatgtaaaaaacagcgcccaggagccggtgaaccgcgaagacggacaagccatctcacggcgccttgtaaagatcaccgaaagcgttccgggtgtcaatgatgcgaccgccgtcgtgctaggcaggctcgccgtcgtcggaattgatgtgaaagacaatttggaacgcagcaaagtcgaatccattaagtattcggtcgctgaagctctgcagaatgacccttatggagcaaacgccgccgttgtcgcggatcccgacactgtaaaccgcctgcgggcaatgggcagagaaattcaagcgggacgtcctgtcaaagggattctcgatgagctggcagccattgtcgggcgcgtccttcctgaagtgccgaacgacgcaacagacaaccagcaaacaaatcctacaaaatccaacaacgaccagctgaatgagagaaaccaaaaacaactcgaaaagaagcagaataatcaatcgaacaaacatatgaaaaatcggcagcaataa

SEQ ID NO: 1602 - DNA, 1329 bp, Bacillus licheniformis
ttgagtaaaatttatgtgctagatacgaatgtgttattgcaggatccgaattcaatcttttcttttgaagataacgaggtcgtcatcccggctgtcgtattggaggaagtcgattcaaagaaacgttacatggatgaaattgggaggaatgcaaggcgcgtatctaaattgatagatgatttgcgtttaaaaggaaagctgtatgaaaatgttcctctccctaacggaggaagcttgagaatcgagcttaaccatcgctcttttcagcagcttcaggaaatctttatcgaaaaaactagcgacaaccggattttagccgtagcgaaaaacctcagccttgaagaagaaacgaaagaaggcggcagaccggttattcttgtcagcaaagatatgctgatccgcgtcaaagccgatgccatcgggttgatgtcagaggattttttgcacgacagggttgtcgacaatgatgatatatacagcggttatacggacgtgtacattcgctcggatcagatgaattcattttttgaacatcattatttgcagcttgacgaaatcagcgaggagccgctgtgtccgaaccagtttgtcgtcatgaaggacgcgctcggcggatcatcttctgcggttggaatcgtagatcaaagcggaaaagccgttaaaaagcttgtttttgaccaggagcaggtttggggcatccgttcccgaaacgtacagcagacgatggcgttggaacttctattaagacaagatattccgcttgtcaccctgatcggaaaagccggcacaggaaaaacactgcttgcgctggcagccggattgctgcagacagaggatctggggaattttaaaaaacttgttgtcacaaggccgatcgttcctgtcggaaaagatctcggctatcttccgggtgaaaaagaagaaaaacttcgaccgtgggtccagcctatttttgataacctggaatacttgttcaatgcaaaaaaaccgggggaacttgatgatattttggcggggatgggctccattcaagtcgaagcccttacttatataaggggcagaagcattcccgaccaattcatcatcattgatgaggcccaaaatctgaccaagcatgaagtcaaaacgcttctgacacgcgtcggggaaggcagcaaaatcgtattgatgggagataccgaacagatcgatcatccttatttggatgcgatgaacaacggcctggcctatgtagtagagcgctttaaagatcaaaaaatttccggaaacgtgaagcttttaaaaggagagcgctcccggcttgcaaggcttgcagcagacctgctgtaa

SEQ ID NO: 1603 - DNA, 483 bp, Bacillus licheniformis
atgagcattgtaacgatcacaggaaatgtaaagtatccgattacgctcgatccgagcgtctggatttttgatgaccgaaaattcgatctcgagcagttcttttcacatttcggagaggtacaggatgaagatgacgaccttgtgattgaccgggaacggcaaatcagagaaggtgctgtatcgccgccgacgctgaaatcagagaaaaagtatgaaaaggaaaaattgcttgacggcactttcggaatcaagcttgagccttttttgaaaaacgcggaggtgtcaggctccgccgtcaaatgcctcttcaaaacggaaggtgaagacgtttccgttccaattgaagaagcgggcggcatgattctctgcttcagcaacaaaggcaagccgcttggcgaagacgggcctgtacacgtttattttcccgacggttctaacaagatgaatcctgtgaaacgagtaaaagaaattcacattatttaa

SEQ ID NO: 1604 - DNA, 930 bp, Bacillus licheniformis
ttgaattgccggcataataaggagctcgaatattttgtcacagaagcgaaaaaagtgacggacaaaggaaaggttgcatcttacataccggctttggccgaattatcggaggacgatttatcggcggcggtctactttaccgacgggacttgtatatcagcgggggatgtggaaaaagcattcactctgcaaagcatatcaaaagtattgtcgcttgccctcgttctgatcgatcacggaccggaaaaagtgtttcattacgtaggacaagagccgactggcgatccgtttaactccatcatcaagcttgaaaccgtcaacccggggaagccgctgaatccgatgataaacgcaggagcattggtggtcacaagcatgattaaaggagagacgaacgctgataagatcgggagactgcttgattttattaaaaaacttgcaaacaaccggagcattaccgtttgcgggaaggtcgccgaatctgaatttgaaacctcgatggtcaacagggcgatgtgctattacatgaaagagcacggcatttttcaggctgaggttgaggatgttatggatgtatatacaaaacagtgcgccattgaaatgaacagcctggacctggcaaaaatcggctctgtttttgctttgaacggcaagcatcccgaaacgggagaacaaatcataccgaaggatatcgcgagaatttgcaagacatttatggtgacatgcggaatgtataatgccagcggcgaattcgcaatcaaaatcggaattcccgccaaaagcggggtttcagggggcatcatggggctatccccataccgtttcggcatcggcatcttcgggccttcgctcgatgaaaagggaaacagcattgccggaatccggcttttagagctattatctgcgaattacagcttaagcattttttaa

SEQ ID NO: 1605 - DNA, 282 bp, Bacillus licheniformis
ttggcgtctgagattgtagtcgaccatcgtgaaaaagcacttgctctgttaaaacgtgatgctgataaaatcttaaagctgattcaagtgcaaatggacaacttaacgatgcctcaatgtcctctttatgaagaggttttagatacacaaatgttcggactctctagagaaattgattttgctgtccgccttggattagtggatgaagaagagggtaaagaactgctttacaggctggagcgtgaattgtctgcattacatgatgcatttacaaaaaaataa

SEQ ID NO: 1606 - DNA, 1212 bp, Bacillus licheniformis
atgataaaaagaatgctcaaatcctatgattattcattaatcttcgctgtattcctgctgtgcgggttcgggctcgtcatggtgtacagttcaagcatgatcacggccgtgacaaggtacggacaaaacagcagctacttttttgacaggcagctgatgtttttggcgctcggaaccgtcatatttttatgcgcggcgctttttccgtataaggcttttgccaatcaaaaattccaaaagtttttgctgctcatttccgtcgtcgctttgttcgggctgtttgttgtcggacatgtggccgggaatgcccaaagctggttcagggtttcgaattacggcatccagccgggggagtttgtcaagctgaccgtcatcttgtatctttcttccgtctacgccaaaaagcaaagctatattgacaacttgggagccggaatcgcccctcctgcgatcatcacgctcttcatttgcgccttggtcgctgctcagccggatgtgggaacggcctttatcatcgctttaatcgcattgtgcatcattttgtgctcgggattcagcggcaaaacgctgttaaagctcgtgcttttggccgggattgtccttgtgctcgtcagcccgctcatttatttcaactgggacagcattttaacagaaggacggatgaagcggtttgaaagctatcaaaacccgtttaaagatgcgggagattcgggctttcaagtcgtcaactcctacttggcgatcggttccgggggactgttcggcctgggcctcggcgagagcgtccagaagtatgggtatctgcctgaaacgcacaccgattttattatggcgatcatcgccgaggagctcggtattttcggtgtcctttttgtcgtgctgctgctttctttcatcgttttaaaagggttttatatagcgaggaaatgcgatgatccgtttggaagcctgctcgcgatcggcatatcgagcatgatcgccatccagtctttcgtgaacctgggcggcatatccggcttgattcctttgacaggggtgacgcttccgtttatcagctacggagggtcatcgctcattctgctgatggcaagcgcggggatattggtgaacatcagcatgtttaatgaatattttgatcggttcaaacgaaaacagcctgtcaatactacaaaaacgaaagaaaatcaatataaaaaaagtataaatttttaa

SEQ ID NO: 1607 - DNA, 3444 bp, Bacillus licheniformis
atgtcacaacagtctattcaaaaagttcttgttgcaaacagaggggaaatcgctatccgcgtatttcgggcctgcacagaactgaatatccgtacggtagcgatctattctaaagaagacagcggatcttaccacagatacaaagccgatgaagcatacctggtcggcgaagggaaaaagccgattgacgcttatcttgatattgaaggcatcatcgagattgcaaaacgcaaccatgtggatgccatccatccaggctacggcttcctgtcggaaaacattcagtttgctaagcggtgtgaagaggaaggcatcatctttatcggaccgacctccgagcacctcgatatgtttggagacaaagtaaaagcccgcgaacaagctgaaaaagctggaattccggtcataccggggagcgacggaccagtggcggatatagcggaagtgaaacaatttgcggaaaagttcggatatccgtttatcattaaagcgtcgcttggcggcggcgggcgcggcatgcggatcgtcagggacgaatcggagctggtggagtcctataatagggcgaaatcagaggcgaaagcggcctttggcaatgatgaagtttatgtcgaaaagctgattgaaaagccgaagcacattgaagttcaagtcatcggagataaagaagggaacgtggttcacctttacgaccgcgactgctctgtgcaaaggcgtcatcaaaaggtcatcgaagtggcgccgagcgtttcgctttctgaatccctccgggaaaagatttgcgatgctgccgttaagcttgcgaagaatgttgaatatgtcaatgccggtacagtcgaatttttagttgcgaacgatgagtttttctttattgaagtgaacccgcgtgttcaggtggagcataccattacggaaatggtaacgggcgtcgatatcgttcagacgcaaatcctgatcgctgccggtctcagtctggacagcagcgaaatcagcattccgaaccaggatgcgatcacgctgcacggatatgcgatccagtcaagggttacgactgaagatccgtcaaacaatttcatgcctgacacaggcaaaatcatggcatatcgctcaggcggcggtttcggggtgaggcttgataccggaaacagttttcagggcgctgtcattacgccttattacgattcgctgcttgttaagctttcaacttgggcgctgacgtttgaacaggcggcagccaaaatggtccgcaaccttcaggaattcaggatcaggggaatcaaaacgaacattcctttccttgaaaatgtggcgaaacacgaaaagtttcttacagggcaatacgacacgtcttttatcgatacaacgccagaactttttgtctttcctaagcagagagaccgcggaacgaaaatgctgacatatatcgggaacgtaacggtcaacggcttcccgggcatcgataaaaagaagaagcccgagtttgataagccgcagatcgtcaaaacagatgtcgatcagccaatcgcaagcggaacaaaacagattcttgatgaacgcggagccgaagggctcgtcaaatgggtgaaagatcaagaggaagtgctcctcactgatacgacgttccgcgacgcccatcagtcattgcttgcgacaagagtcagaacgcatgacctgaaaaaaatcgccaatccgacggctgcgctctggccagagcttttcagtcttgaaatgtggggcggcgccacatttgatgtcgcttaccgtttcttgaaagaagatccgtggaaaaggctcgaggagctgcggaaggaaattccgaatacgatgtttcaaatgcttttgagatcttcgaatgccgtcgggtatacaaactaccctgacaacctgattaaaaagttcgtcagcgaatcggctgcggccggaatcgatgtattccgcatttttgacagcttgaactgggttaaagggatgacgctcgccattgatgcagtgcgcgagtcaggcaagcttgccgaagcggcgatctgctatacaggggacattctcgatccgaacagaagcaagtataatcttgaatattatacgtcaatggcaaaagagcttgaagctgcgggggcgcatattctcggcattaaagatatggccggcctgctgagacctcaagcggcatacgaactggtgtcggctttgaaagagacgatcgacattccgatccacttgcatacacacgacacgagcggcaacggtatttttatgtatgcgaaggcgatagaagcaggcgtcgacatcgtcgacgtagcggtcagctcgatggcgggtctgacatcacagccaagcgcaagctcgctttaccatgcgcttgaaggagataaacgccgtccgcagttcaatgtcgatgcggaagagtcgttgtctcaaaaaaaaaagtctgtcagaaaatattacagcgagtttgagagcggcatgattgcgcctcataccgaaatttacaagcatgaaatgcctggcggccaatacagcaaccttcagcagcaggctaagggagtcggcctcggcgaccgctggaatgaagtgaaagaaatgtacagccgggtcaaccacctgttcggggacatcgtaaaggttacgccgtcatctaaagtcgtcggggatatggcgctttacatggtgcaaaataacctgacggaagatgatatttacgaaaggggagaatctctcgattttcctgactcggttgtcgagctttttaaagggtatatcggtcagcctcacggcggattccctgagaaattgcaaaagctgattttaaaagggcaggagccgattacagtacgccctggagaactgcttgaaccggtttcatttgacgctataaaagcggaattcttggaaaagcatggtatggagctttccgaccaggatgctgttgcatatgcgctttatccgaaagtgtttaccgagtatgtcaagacagcggaactgtacggggatatctctgtgcttgatacaccaaccttcctctacggcatgaccctcggcgaagaaatcgaggtcgagattgaaagagggaaaacgctgatcgtcaaacttgtctctatcggggaaccgcgtccggatgcgacgagagtcgtttattttgaactgaacggccagcctcgcgaagtggtcattaaagacgaaagcattaaatcgtccgttcatcaaaaggtgaaagccgaccgttcaaacccgaatcatatcgcggcatctatgccgggaacggtaatcaagcttcttgtaagcaaaggggaccaagtgaagaagggcgatcatttgatgatcaatgaagcgatgaaaatggaaacgaccgttcaggctccgttttcaggaactgttgaaaacattcacgttacaaacggagaagccattcaaaccggcgaccttctcattgaactgaaaaaataa

SEQ ID NO: 1608 - DNA, 909 bp, Bacillus licheniformis
atgaataaagcattaaaaggcttgggaattatcacaactatcgccatgcttttcgtgctgatcggcggcgccctcgtcacaaagacgggttcaggaatgggctgcggcagatcttggccgctttgcaacggaagcatattcccggctttaacccttgaatcgattatcgaatggagccacaggtttgtcagcggcacatccggcgtccttgtgctggctctcgccatttggacatggaaaaaaatcggccatatcagagaaacgaaatttctcgcggtgatgtcggtcgtctttctcattcttcaggcgcttttgggcgctgcagcggtcgtcttcgggtcatcggccctgatcatggctttgcacttcggaatctcgcttatttcctttgcttctgtgctgcttttgacgctcctggtgtttgaagctgacagcaaacagaaatccgaatcgttttatataggaaaaaccatgcagtttcatatgataggaatcattatatacacatatgtcgtcgtttatacaggcgcatatgtccggcatacgagttcaagcctcgcgtgccttgactttccgatgtgcagcacggaaaacggctggcttcccgggaagtttcacgaatgggtgcagatgggacacagagctgcggcgcttcttctgttcgcctggatcatcgcggcagcggtacatgcagcaagacagtataaaaatcaaaaacgcatttattggggctggatgatttccctgatcctgatcatccttcaggctgcctcaggaattgcggttgtctacagcagactggatttgggttttgcactcgcccacgcattctttatttcctgcctgttcggaatcctttgctacttcctgctgcttgttgcgcgctatcgcaggcaggtgcaaaaataa

SEQ ID NO: 1609 - DNA, 927 bp, Bacillus licheniformis
atggctgaaacaagaattacagctgatacagcaatgaatggacaaatagaagagacgacagcatggaaagatttcctcgcccttatcaaagtcgggattgtttactcgaacctgataacaacttttacgggcatgtggctcgctttttacttttcaaatctgagctttctaggaaaccttgatatcgtgctgttcactttagcggggtcctcgcttattattgcaggctcatgcgtcatcaacaacttttatgaccgtgatattgaccagctcatgcagcggacgagaacaaggccgacggtgactggaaaaatccagccttcacaggcattgtggttcggcattctgctgactgcgctcggttttatcatgctgctgatgaccaatctgacagctgccggagtaggatttgtcggcgtctttacgtacgtgtttctatacacgatgtggtcaaagcgccgctataccgttaatacgatcatcggaagtgtgtcaggggctgttccacctttgatcggatggaccgctgtccaaggttccatcggagtcgaggcgtgggtgctgtttttaattatgtttatttggcagattccccactttctggcgcttgcgattaagaaaacggaggaatacagagccgcaaatataccgatgctgcctgttgtacacggttttgaagtgacgaaaaggcagatcatcatttggattgcctgcttaatgccgctgccgtttttcctgggcggactcggactgccgatcgtcattttggggacggtgcttaatatcggctggctcgtttgcggtctggtcggttacagaagcaaaaatatcatgaagtgggcaacgctcatgtttgtatattcattaaattacttgaccattttcttcgttgccatggtcgtatttacactttttaaaattggatag

SEQ ID NO: 1610 - DNA, 1068 bp, Bacillus licheniformis
atgttaaagaaatggcgtctgatgtcgctgttcactattttggcgcttgttttagcagggtgcggagaaccgtttatatcaacgctgcagccggcgggcgaggtggctgatcagcagtatttcctaatgattctcagcacgctgatcatggttgttgttgtagtagtggtaagtttcattttcgtatttgtcatcgtcaagtacagaagatctaagctcggtgatgaccacatcccgaaacaggttgaaggaaaccgcaatttagaaattttatggactgttattccgattatcctccttcttatcctggttgttcctgttgtcgcacagacctttgatcttgctgatacgaaaccgatggataagaaaaacagggatccggagaagacgctcgtcgtcaacgtgcgggcgaacctttactggtgggaattcgaatatcctgactacggcgtgattacgagccaggagctggtcgtgccgaccgatgaacgcatttacttcaagctgaaagcttccgatgtcaaacattcattctggattccttctgtcgggggcaaggttgatacgaacacagacaatgaaaacaagttctacttaacgattgattcaaaacgggcggaaaaagccggagactatttctacgggaaatgcgccgagctctgcggaccttcccacgctttaatggactttaaagttaaagcggtttcgaaggatgagttcaagaaatggatgagcgatatggaaaacaataaagcggaagcgaaaaccgatctcgctgttgaaggagaaaaggtgttcaaagagaaaaactgcctgagctgtcatgcgaccgattcaaaagaccaaagggcggaagcggccagaacggctccgaacctcgcgacttttggagacaggtcgacgatcgccggcgtgaaggaattcaacgatgaaaacttgaaagcgtggctcaaggatcctgaaagcataaaaccgggcaacaaaatgaccggcacataccctgatttgagcgacaaggaacttgatgcactgactgaatatttaaaggggttaaaaaccgaagactaa

SEQ ID NO: 1611 - DNA, 1869 bp, Bacillus licheniformis
gtgagtacgcttaagaaaaagcaaggttttggggctgtattatgggactatttaacgactgtcgatcataaaaagattgccatcctttatttgctgggcggcgggttcttctttgtgctcggcggaatcgaagcgatgctgatcagggttcagctgatgataccgaacaatgacatcatgagcggcggggtctacaatgaaatcatgacgatgcacggcacaacgatgattttcctggcggcgatgccgctgttgttcgcattgatgaacgccgtcgttccgctgcagataggcgcgcgggatgtcgcgtttccattcttgaactcgctcggcttctggctgtttcttttcggcggcatctttctgaatttaagctggtttttgggaggggcacccgatgccggctggacgtcttatgcgtcgctttcccttcattccgaagggcacgggatcgatttctatgttctcggtctgcaaattgccgggatcggtacgctgattgccgggattaactttctcgcgacgatcatcaacatgagggcgccgggcatgacatacatgaggctgccgcttttcacatggacgacattcgtcgcttcggctttgattttgttcgcgtttccgccgctgaccgtaggcattgcgctcttgatgctggaccggttgttcggaacgagctttttcaatccggaattaggcggaaatacgatcatttgggagcatctgttctggattttcggacaccctgaagtttatattctcgtactcccggcgttcggcattttttcggaaatcattccggtttttgcgagaaaaaggctgttcggctattcttcaatggtatttgcaaccgtattgatcggctttttaggcttcatggtttgggctcaccatatgtttacaacgggactcgggcctgtggcaaacgccatttttgcggtggcgacgatggccattgccgtcccgactggtattaaaatcttcaactggctgctcacggcgtggggcgggagcatcaagtttacaacgccgatgctttacgcgatatcctttatcccgacgtttgttatgggcggggtgacaggcgtcatgcttgctgccgcaccggctgactatcagttccatgacacgtactttgtcgtggcccacttccattacgtcatcatcggcggagtggtgttcgccatcctcgccggagctcattactggtggccgaaaatgttcgggaaaatgctgagcgaagcgttgggcaaaataacgtttgtactctttttcatcgggttccacctgacgttcttcatccagcattggctcggattgtggggaatgccgagacgcgtgttcacatacttgccgaatcagggatttgacatggcgaacctgatcagttcaatcggagctgtgtttatggcggctgcggtcatcatactcgtgatcaatattatcgtgacgactgccaaaggggaaaaagtcggcagcgatccttggcatgacggaagaacgcttgagtgggccgtttcttcgccgcctcctgaatacaacttcaaacagctgcctttggtcagaggccttgatgctttatggatcgaaaaaagagccggcaagcagtcaatgaccgccgcggagccgcttcaggacatccatatgccaaacggatcgattcttccgttcatcatgtcactcgggctgtttatatccgccttcggctttatgtaccggacggaatttgcctgggggctgcctgtcattctgatcgggttagggatcacgttatttatgatgcttctccggtctgtaattgatgaccacgggtaccatattcataaagaagatctgatggatgatgacgacaaaggggtgaaggcataa

SEQ ID NO: 1612 - DNA, 624 bp, Bacillus licheniformis
atgcatacagaagagaaattgacggctgaaaccttcccggcttctcctgaaaaagctacgttagaaggaaaaaataaatttatcggcttttggctatttctcgggggagagacggttcttttcgcgtctctcttcgcaacataccttgcgctgaagaattcgaatgcaggggggccgaaaacgaccgagatgttcgacatggggctggtctttcttgcgacaatgctccttttgacgagcagtttgacgagcgtgtatgcgatgtatcatatgaaaaacttcgcttttaaaaagatgcaggtttggctcggaatcaccgttctgctcggtgcaggctttctggcgcttgaaatatatgagttcacgcattacattcacgaatatgggttcaccattcaaagctcggctctcggctccgctttttatacgcttgtcggcacacacggagcacacgttaccttcgggcttctctggattctttctttgatgatcagaaatgcgggccgcggattaagcctttacaacgcgccgaagttttttgtcgcaagcctctactggcattttatcgacgttgtctgggtgtttatctttaccgttgtatacttgatggggatggtgggataa

SEQ ID NO: 1613 - DNA, 330 bp, Bacillus licheniformis
atggtgaataacgaaaacagagggaatcccaaaacagatcttgcctaccgcaaaaagaaaaacgcggaggacatgagatatcaggttatttcattcggtttgatgatcggcctgaccattgtcgcttttttaacggtcgcctcagatgccggcgtatggtttacggtgccgtttattctgctgctcgccgtcattcaggttgcgtttcagctgtattactttatgcatatgagtcagcgggggcatgaagcgccgactttgttcctttattcgggcgttttggtcgcttttgttaccgtgttggcttttgtaacgctaatctggtggtaa

SEQ ID NO: 1614 - DNA, 903 bp, Bacillus licheniformis
atgttgggcagccttgaaatattcggttttcgcgccctttggagcccctatttcctaggggctgtcgttttcataaccgccctttacttttttctgatgaaacgcttaggatcagaaggagagcgggcgtccaggaaagaaatcggtttattcctgacggcgatgattcttttatacgcgtctaagggcagtccggttgatttgctgggacatattatgttcagcgcgcatatggcgcaaatggcggttctgtatttgatcgtgccgcctctgatcatccttggcataccgccttggttttggaaaaaggtcatttttctgccgatcgtcaagccgctgttccggtttttttccaaaccattgatcgcgataatcgtgtttaacggtctattttcgatgtatcacattccattggtgtttgattttataaagacggatgccgtttatcatgccgccattaccgtgctgatctttattgcagcgtttttcatgtggtggccgctcgttcacaaggtcgaggagcttccgcagatgagcggacttttgaaactcggctacattatggctgacggcattttgctgacaccggcgtgcgcgttaatcatgttcagcgatacggctctgtattcgacatattcggatccgtcagcatgggcggaggcaatgaagctgtgcgttcctctcgatacgctgagcggaatgacgcttacaggtccggaaatgttcagcagcatgcctgttctcgaagatcagcagcttggcgcgattgtcatgaaaatcctacaggaaatcgtgtacgggacatttttggcgattatctttttcggctgggcgaggaaggaaagagccaaagacgaaaaggacctggaagaagaatcatattctccgtctacggttcattaa

SEQ ID NO: 1615 - DNA, 360 bp, Bacillus licheniformis
atgaaatttgaagaatccggaattgaaggattgactgccgaccttaaccggttagacgacatcatggaaaacgaagggttcgtaagagctggacaatgggattatgaacgcgtcacatatgaccgcaaattcgatatggtcgaaggaagattctaccttcgcgtgttcggatatgccatcgaaggtgacgtgggcgcccggcgcgcggtaatcaaactgatgacgccgcttttgggcaaatattattatccgcatggagtggaatacggcgaagacgaacattttccgccgcagctcctcaaaacaagcaagacggtgctgaattcgatcaaagaaaaggtttcagcgcttgaagtgtag

SEQ ID NO: 1616 - DNA, 447 bp, Bacillus licheniformis
ttgacacgtgtgaaagatatcatgacaaaggaaacattatattgtacggttcttgataatgtatacgaggctgccgtgaaaatgaaagacggggatgtgggagcgattccggttgtgcttgatgacggcttggaactggttgggatcgtcactgaccgggatttagtgctgcggggaatcgcagctaaaaaaccgaattcgcaaaaaattacaaatgtcatgacgactgatctcattacggtaagtgaagacgattcaattgaaaaagcggtcgatctcatgggagattatcagatcagaagggtcccggttacacggggaaaaacgcttgccggcatcattacgctcggcgatgtttcaactcacaataaatcgaaccgccaggctggcgacgcgctgacatttatatctgaaaacgaagagcggcctggagattttcttcattaa

SEQ ID NO: 1617 - DNA, 1044 bp, Bacillus licheniformis
ttgaaaaatatattaagagcggtcgtgatccttctcatcgttgcggcttcatacacgctgtttattcaatacggctcaacgcctgagaaaattgcgaaggaagacaagccgcaagtctcaaacgaagatgcaaaaaaagagaagcccttgaacattcccgattccggcctgctttcctttatcggggaatcggccgagacgatcgaaaagaaactggggaaaccggacagagtcgatccttcagcgtatgattatgaatggtgggtctataaccaagggaaaaaacagtacgttcaaatcggcttgctgggcggcaaggctgtgacattgtttgcgacaggcgacggggtgaacaccgctccgtttaaaatcggacggccgtcaagggaagttttcaaaacgacccagatcgccccgtatgtcaatgttcaatataaaggcagttcataccgttttgagttttccgaggaagatatgaatacaaggccgacggttaaagtcggagacatctatgttcagctgtacatggataaattcgaggggacgctttcaagcatcagggcatttgatgcgccgactttaatcaagcaaaggccgtatgaagttgtctacagaggcaccctgatcgagcctaaagcattgacagaatcggattggaagaaaatcgagaaagcaaatgagaagcagatttttgatataacaaacgttatccgcgcaaggcacggcctgtctgagctcacttgggatgaaggcgtatcaaaagtggcttacggccacagcagcgacatgaaagagcaccattacttctcccatgtgtcagaaacggaaggcaccctcaaagacaggcttgaaaaaggaaaagtcaattttgagcaggcgggggaaaatatcgcgctcaactatgtcgacgggcctgcggcggttgaaggctggttaaacagcgaagggcacagaaaagcgctcttaaatgccgactatacccatctcggcgtcggggtggatgagaaatattatacgcaaaactttattaaagaatggcaatag

SEQ ID NO: 1618 - DNA, 396 bp, Bacillus licheniformis
ttggcaaatcaaaacgcgcaatcatccatcaatgaatttaagcaatttataaaacggcatcctaagttgatttccgaagtccggaaacaagaaaaaagctggcaggaagtctatgaaaactgggttttgctcggggaagacgattcgatatgggatccgtacagggaagaagcttcagcggaaaaggagccggacgctggcggcaaaaacgatttcatttcgaaaatggtgacggccgttcgaaagatggatgccaatcaaatgaatgagcagatcaataaaatgagccagtctatttcttcgctgcaaagcttgctcagccagttttcgggcggaagccaaaaacagcagaaacaaagcggcggcgagcatccgttttctttccgaaaagattag

SEQ ID NO: 1619 - DNA, 240 bp, Bacillus licheniformis
atgcgtaaagaagtgcaggagtatgtgttcgccgacgaagagcgccgccggttcatccgtgagcagccggtctggtaccgcaagctttcgcggaatccgaatgatctgtcagcctttcatctcgatatgatgaatttttatgaaaaaacgattcctcacagggtcaaccagttatcgggcagcattcagatggcccagatgatgctgcaaatgtttcatgcgatgcgcactcaggattaa

SEQ ID NO: 1620 - DNA, 450 bp, Bacillus licheniformis
atgtttgccacaatggaatcgttgcggcttcaaaatgaagcatatgatttggccaacatgattcttcaatcagaggcggctgaacattacagaaaatgctacaagcgtctccgcgaagatgaagaggccggacgtattatcgcttcgtttacgaaaataaaagaacagtacgaggatgtgcagcgctttggcaagtatcatcctgattataaagagatatccaagaaaatgagggaaatcaaacgggagcttgaccttcacgatacagtagccgaatttaaaaaggcggaaaccgagctgcaatccattcttgatgaagtcagcgtggaaatcggtcatgctgtgtcaaaacatatcaaagtaccgactggaaacccttattttgataatctttcatcttgcggcggcggctgcgggtcaggcggaagctgcggctgtaaagtttcctga

SEQ ID NO: 1621 - DNA, 216 bp, Bacillus licheniformis
atgctcaggaaattcggaaatgttcattacgtttcaaagcggctgaaatatgtagtggtgtattgcaatatggaagatgccgaaagaatcatcgcaaaaatacgttcgtactcttttgtcaaacaggtggatctttcatacaaaccgtttttgaaaatggagtttgaatccaagcaggataaagcgaaagaatacgactataaagccgggctctaa

SEQ ID NO: 1622 - DNA, 567 bp, Bacillus licheniformis
atgagagtgatttctgggacgtataagggacgtgccttaaaggcggttcccggcacgtcgacaaggccgacgaccgataaagtaaaggaatccatctttaatatggtcggcccgtattttgaaggcggcaccggccttgatctgtacgcgggaagcggcggattgggcattgaagcgctgtcgcggggatttgaccgcttcatttttgtcgaccgggattttaaagcgattcaaaccgtgaaaggaaatttgaaaacgctgggcttagaaaagtgcgccgaagtgtacagaaatgacgcagaacgggctctgcatgcactggtgaaaaggggcgcaagctttgatgccgtctttttggacccgccatatcgagagcaaaagctggaagcgcttttatcgatcattgatgaagcggatatgctgactgaaagagggtttattgtggctgagcatgcgaaggaagtcatgctgccggatgcggcgggcggacttcagcttgcccggcaggaaatatacggcttaacaggcgtgaccatatacagaaagagagggaatggggatggctag

SEQ ID NO: 1623 - DNA, 495 bp, Bacillus licheniformis
atggctagcattgccgtttgtcccggaagttttgatccggtgacttttggacatttggatatcatcaggcgcggggcgaaagtgtttgataaagtttatgtatgcgttttgaacaattcttcgaagaagccgctgtttacagtggaagaacgctgtgggctgcttcgcgaagtgacgcaggatatcccgaatgtgcaagtggaatcttttcaggggcttttgattgattatgcaaagagcaagcaggcaaacgtcatcctgcgggggcttagagcggtatctgactttgaatacgagatgcagggaacctcgatgaacaaagtgctcgatgaaaatattgaaacgttttttatgatgacgaataaccaatactcgttcctcagttcaagcattgtcaaagaagtggcaaaatataaaggttcagtcgcagaactcgtgccggaagcggtcgaggctgcacttgaaaaaaagtttgcaaaaaatgagcggccgtaa

SEQ ID NO: 1624 - DNA, 1086 bp, Bacillus licheniformis
atggacatgtcaaaggtaaagacactcatgattgccgttttgctgctttcatttacagccgccgtcattacccacccgcaagaatcatttgacgcttctaaaagtggacttgccatgtggtgggaggtcgtattcccttcccttttgcctttttttattttatcagagctcttgatcgggtttggtgtcgtcaggtttgtcgggctgttgctcgagcctttcatgagaccggtgttccgcgtacccggcgtcggagggttcgtgctcgcaatgggaatggcatcgggaaacccggccggcgcaaaactgacttcaaggctgagacaggaacggcagatttcccgggtcgaagcagagcggctcgcttcattcaccaactcatctaacccgctgtttattttcggagccgttgcggtcggctttttccataatccttctcttggcgttgtgcttgcggcggcccattatttgggcaatttcgcagttggactgacgatgcgcacttacggaagaaaagaagaaaaccgcaccgccgtgcgaaagaagcttcctgtgccttcaattaaagaagccttaaaagcgctccatcaggcaagacttgaagaaaagcggccgctcggcaaacttttgagcgatgctgtcatctcctccgttcaaacgctgctaatggtgggcggcttcatcattcttttttcggtttttaataacattctttctgtgatgcacatcaccgacattctttcgcacgcgacaagaatgattttgacggctcttcaattgcccggtgattttgataagcctttattatcgggattgtttgagattacgctcggcagcaaactggtcagcgcaacggatgcggcgcttctccagcaagcggtgatcgtcagctttattttgggtttcagcggcttctgcgtccaagcgcaggttgcaggcattcttgctgaaacggatatccgctttagccgttttttatcgctcgcatcctccagggaatttatgcagcgatctttgttcttattctttggaagcctctttacacatcgttctattctccgacggagccggtcttctcctttctga

SEQ ID NO: 1625 - DNA, 1023 bp, Bacillus licheniformis
atgctgaaaaaaagaattatacgcatcgcactattgctcgttatcatcgtggccgcgctgtcatttgtgaagctgccatattacatcaccgaacctggcgaagcgaccgagctgaaccctttaattaaagtcgataacggctatcctgaaaaagggagcttttctttaatgacagttaaagtcggtcctgccaatccgcttacatatatatgggcaaaaatgcgcccttaccacgaaattcttccggaagaaaattttaaacaagaaggcgaatctgatcaggaatatatgaagcgccaactgcaaatgatgagagattcccaggaaaatgcgatgatcgccgcttataagcgggccggaaaagaagtcagctacacgtttaacggcgtatatgccatgtcggtcgtcagcggcatgcctgcagaagggaaaatacaagtcggggacaaaattaaaaaagcggacggaaaatcgttccggtcagcggagagcttcgtccgctacatcgagtcaaaaaaagccggggaccgcgtgaaaatcgtagttgaacgggataaagaagaaaaaacatatgagatgaagctgaaaacattcaaagaagatccaaagagagcggggctcggcgtctccctcatcacagaccgcaatgtcaaggtgaagccggaggtcgatatggatattgaaaacatcggcggcccttcggcagggctgatgatgtcaatggagatctataaccagctgacaaaagaagacgagacgaaaggacaccatattgctggaaccggaacgatcgacgacgaaggcaaagtcggtccgatcggcggcatcagccagaaagtcgttgcggcagacaaggcgggagccgacatcttttttgccccgaacgaaggcggaaaaaaaggatcaaactatgaagaagctgtaaaaacggcaaaagatattaaaaccgatatgaaaatcgtccctgtcgacacgatggatgatgcgattcattatttggaagataaagtgaaaaacacctga

SEQ ID NO: 1626 - DNA, 1251 bp, Bacillus licheniformis
atgaaagcggtcggccttgttgtggaatacaatccttttcataacggacatttatatcatataaaggaagcaaaatcagaaacgcggagcgaggtggcggttgccgttatgagcggctcctttttgcagcgcggcgaacccgccatcgtatcaaagtgggcgcgtacgaagatggcgctcgcatcttttgccgatgtcgtcgttgaactcccttacatattcgccgtccaaaaagcggaaacgtttgctgaaggcgccgtctcgattttaaatgaattagggtgttcttctttgtttttcggaagcgagcacggcgatattgaggcatttctcaatacagccgcacacacgatagagcacgaagacaggctcaacgaagaagccagaaagcagatagcgtttgggctgagctacccgcaagcgatggcaaaagcgttccggtctgtaacaagagaaggcggtaacatcgttgacctttcaaagccgaacaacattctcggattccattatgtgaaagccatcatgcaaaagcaattaagcatgaagcccgaaaccgtcaagcgccggtcctcaggctatcacgattcaacattccctgaagcggaccgaatcgcaagcgctacgagcatacgcaagtcgatttttgaaacgggaagccttgcggacagccgcttctaccttccaaagacaacggtcgatgagctcgatgaatacgcccggactttcggcatgtggcactcgcctgaagattatttcccctttttgaaatacagcctgcatacaatggatacagaagagctgaaagggatatacgaagtggaagaaggccttgagcaccgcgtcaaaaaagcgatccggaaagcaggctcttttaaggaatacatggagcttttgaaaacgaagcgctatacgtggacaagactgcagcgcatgaacacccatatcctcacaaaaacgaagaaagccgacgttaagcgcatgttaaacgaaacacatccggcatatatcagacttctcggaatgacaaaaaaagggcaggcctatttggctgaaaagaaaaaaagcttgagcgcaccccttattacaaagacgggatcgttttcccatccttccctccagcttgacataaaagcgggccaagtatacagcgccccgctcaaagagccggtgcggacgatgctgacagagcaggaatattccctttcgccgatcaggtatgacgaagacagccggatatttttgcgcaaataa

SEQ ID NO: 1627 - DNA, 516 bp, Bacillus licheniformis
atgaaatggacgatacatcagctgaatcaaatgccgaagaaggactttgaatttgatgaaacagttgatttaagcgaactctctcaaagctcggaaatccgcagcatttcaccggtgcgggtgaaagggcgcgcggaaatccgctcaaagcaggctgcatttgattttaccatttcaggcgagatgatcttgccttgctcaagaacgcttgttgatgttcgttatccattcagcatttctacaaaagaactgtttatatttcataagaccgaggaaatggaagatgaagacatccatattgttgaagatgacctcatcgacttgactccggtcgtgaaagaagaaatccttcttgagatccctatgcaaatcttttgtgagtctgttcaaaaagaagaaggtgctccgcaggagggcaaggattggcaggtcattacagaagatgaccggaaagaccggatcgatccgagacttgccggactcgggaagctcttaaaacaagaagatgaatcttaa

SEQ ID NO: 1628 - DNA, 174 bp, Bacillus licheniformis
atggctgtaccttttagaagaacttctaaaacgaaaaaaagacttcgtcgtacacactttaaattgcaagtgcctggtatggtagaatgcccaaactgcggtgagatgaaactttcacaccgcgtctgcaaagcatgtggatcatacaaaggaaaagacgtaaaaagcaactaa

SEQ ID NO: 1629 - DNA, 600 bp, Bacillus licheniformis
ttgacgattacaagacaggatgcatggacacaggatgaagatatattgctggctgaggtcgtattaaggcacattcgggaaggcgggacacagctttcagcctttgaagaagtgggcaaggctttaagcagaaccgcggccgcctgcggattccgctggaattcatttgtcagaaagcaataccaatcaggcattgaactggcaaagaagcagcgcaaagagctgcgcaaaaaaatcggcatccattccgcaaaccttcctggatctgtcaaaacggtttctgagagcaaggcggaaaacctgacgctcgatgatgtcatagagtacttggaaaagctgaaagaagccccggttcaaaaggactttatcgacgagaagaaaaagcttgctgaagaaatcaatgagctgaaacaagaagttgaaaagctgcgaagcgaaaatcaatcgctgaaaaaaaagcttgaattgacagaagaggattataaagcgctgattgaaatcatggagagagccagaaaaatggtcgttcttcagggagacgaacgaaacaaaaaggcgatgctccagccggagccgaatgaaaatctgggggaagcttga

SEQ ID NO: 1630 - DNA, 480 bp, Bacillus licheniformis
atggtcaaagtcgaacgtttgctgatcaactacaaaacgcttgaagaatttaaaaagttcagggagtacgggattcaagagctttccatgctggaggaccttgaaagcaacatgattgaaaacgacagcaactcaccgttttacggcatctattacggaaatcggctcgtcgcaagaatgagcctgtataaagtggatggtaaatcaaaccaatattttgaagaaggccaagattacctcgagctctggaagcttgaagttttgccggggtatcagcgaaacggctacggaacgatgcttgtggagttcgccaaatctttcggactcccgattcgcacaagtccgcgcgtcaaatcatccgatttttggaacaagatgggctttacaccggttaaatacgatatggcccgggataaaggggaaaatccgctcgtttggcatcctgcgagcgaacctagtcaaagttctgaatcagcataa

SEQ ID NO: 1631 - DNA, 882 bp, Bacillus licheniformis
gtgaaaatcggagtcatcggaggaggctcggtcggcctcctttttgcatactatttttcgttcggccacgaagtgactgtgattgcgcggagaaaggaacaggcggaagcgattgaagaaaagggaatccgccttcttgaagacgggaaagagatgaccgtgaacgccaggggcgtgactgaacttgatccggactgcgaccttctttttgttgccgtaaaggagcatcagctcggagccgttctgtctgagctggagcaggcggctcctcttgacatcatgttcctgcaaaatggaatggcgcatattcccgtgcttgaaaaatggcagacgggccaccgcatctatacgggatctgtggaacacggagctgtcagggtggatgaccgcacattccggcacacgggaaaaggggccgtaaaatggagcgcgttccgaagccaatccgccgcccggctgaaaaaagagctcgcttcggtgcatgaagcgttcccttttatttggtccgaagactggtataagcccctcgccgaaaaattgattgtcaatgcgtgcatcaatccgctgacggctcttttgcgggtgaaaaacggcgcgctgcttgaggagccgatgtatggggcctatatgaagttcgtctttgaagaagcgagccggattttggaacttgaagatcgccaggcagcgtgggaccatgttctttccgtctgccgccggacgaaaagcaacacgtcctcaatgcttgccgatgtgctggcagaaagaaaaacggaagcggatgcgatcatcggctatctgctgaagcgggcaaaagagtcaggagagcccgccccgcaccttacctttttatatcgcagcatcaaggcgcttgaaaacgaatga

SEQ ID NO: 1632 - DNA, 1494 bp, Bacillus licheniformis
ttggatgacctttcctcccggacgtatgaccgcgatgcgttagcagactatttgctcgactatcaccgcaaatttcaatcggcaaccatgaatgaaacaatcgaacgccttcgcgatccgaaaagcgtcgtcgttgtcggagggcagcaggccggccttttaacgggtcctctttacactatacataaaatcgtatcgatccttttattagcaaagcaaaaagaacaagagctgaacgttccggtcattccggtattctgggttgcgggggaagaccatgatctggaagaaatcaatcacgtctacatttctgacggcggcaaggtgaaaaagcacaagctcccgcagtcccactggaaaaaaagccaggcggcaaaaacggcgctcgatgccgagaaagctgaaaagtggctggacgggatttttgcttcatttgaagaaacggagtatacgaatgatcttctcggccatttgcgccgatgtttaaggcagtctctttcttttaccgattttttcgaatttcttgttgccgacatgtttgaacaagacggcttgatccttttgaattccggagacccgggcatcagaaaccttgaagcgcgctttttccggcagctgctggacaaaaacgatgagctgaccgactctgtcaaacggcagcaggaattgatgaaacaactgggttacacaccgattatcgaaggggccgcacaacatgcgaacattttttatgagcgcgacggcgagcggtttttaattgaaaaagaaaacggcgcgttttttataaaagagcttcatcttcagtggtctgaagcagagctttgcgatttgatctgccagaacccggaagcgttcagcaataatgtcgtaacccggccgctcatgcaggaatatcttcttccgacattggcgttcatcgccggtcccggagagatcaattattggggcgagctgaaaggcgcttttcaggtcatgggctataaaatgccgcctgtcgtaccgaggcttcaggttacattccttgaacggcacatcgaaaaaaagctggacgaacggggaatcgaactccgcgaatcgattgaaaagggagcgcgggccaaaaaagagcagtattttcaagataaggttccgagcggatttaccgattcggtcaaacaggcgaaagaaaaaatcgaaaacattcattccgcagtgcgcgccgaagccctcgaaatcgacggcagcctcggcccccttttagaaaaaaacgcgggcttcattcaagatcagctccaatttttggagaaaacagtcatcagaaggattgaagaaaaagaaaactatattttgcgtgattttgacaaaattcaaacaagcatcaaacctttagacgctccccaggagagaatttggaacatcgtgtattatttgaacaaatacggtccggatttcttggaaaaatacaaggatttgccatattcatttcaaaacatgcatcaagttgtcaaactttga

SEQ ID NO: 1633 - DNA, 465 bp, Bacillus licheniformis
gtgagttggggaacgaaagtgggggccgagatcatgtttatgggtgaataccagcatacgattgattcaaaaggccgcatgatcgttccggcgaaattcagagaaggcctcggcgagcagttcgttctgacgcgcgggcttgatcagtgcctgtttggctacccgatgtccgaatggaaactcatcgaagaaaaactgaaggcccttcctcttacgaagaaagatgcacgcgcttttacccgcttttttttctccggagccaccgaatgcgaattggacaagcagggccggatcaacattgcatcgccgctgttaaattatgcaaagcttgagaaggaatgcgtggtcatcggagtttcaaatcgaattgaattgtggagcaaagagatttgggaacaatacgtagaagagcaggaagattcatttgccgaaatagctgaaaacatgatcggatttgatatataa

SEQ ID NO: 1634 - DNA, 939 bp, Bacillus licheniformis
atgtttgagcatacaacagtattattaaaagaaacagttgatggtttaaatgtaaaagaagacggtacatatgtagactgcacattaggcggtgccggtcacagcgagtatttgctttcacagctgtctgaaaaaggcaaattggtcgcttttgaccaggatgaaaccgcactccgccatgcgaaggaaaaactggcggattatgaaggacaagtcgttttcataaaaagcaattttcggtatttaaaagaccgtctaaacgaaatcggcatcacgaaagtggacggtgttttatttgatttaggcgtctcatctcctcagctggatacacccgaaaggggcttcagctatcatcatgatgcacctcttgatatgcgaatggaccagtcggcgggcctttcggcaaaggaagtcgtcaatgaatggccttatgaggatctcgtgaaaatcttctttaaatacggagaagagaagttcagcaagcaaattgccaggaaaatcgaaaaagcaagagaacaatcgcctattgaaacaacaggccagcttgtcgatatcatcaaagaggcgattcccgcaccggcaagaagaagcggcgggcatccggctaaacggatcttccaggcgattcgaattgcggtaaacgatgagttgagggtatttgaagaagcgcttttgcaggcgattgaggtgctgaagccgggcggaagagtatcggtcatcacattccactcgctggaagaccggatctgcaaatcgacatttaaagacatgtcgtcgcctcctgaactgcctcacggactgcccgtgatccccaaggagtttgaaccgaaattaaaattagtcaacagaaagccgatcacagcttccgaagaggagcttgaacacaataaccgtgcgcgctcagcgaagctgcgcatcgcggaaaaagcacgagagtga

SEQ ID NO: 1635 - DNA, 354 bp, Bacillus licheniformis
atgagcaatttggcttataaagtagaaaaacagcaaagacagacagacagtgcagaacaatccgttatcatccggagaagagcatcgattacgctgggggaaaaggtattgattgtgcttttcgccctggctgtgctcagcgcttcactttttatgatttcaaaggcttttgccgcgtatcagaccaatattgaaattcaaaagctcgaaaagaaggttgaaacggaaagcagcagagttgatgacctcgaaaaagaagccgatatgctgaaagagccggaccgtatcatggacatcgcccggaaaaaaggccttaaattgggtgataaaaaagtgaaagacatacaggaatga

SEQ ID NO: 1636 - DNA, 2136 bp, Bacillus licheniformis
atgccgaaaaaaaataaattcatgaacagaggagcggcaatactcagcatttgttttgccctctttttctttgtcatcgtaggacggtttgcgtttattcaagcgacgggaaaagtgaacggcgaagtgcttgcgcagaaggcgaacgaacagtatgagaaaaagcggacgatcgaagcccaccgaggatcgatccttgaccggaacggaaaagtgcttgccgaagatgctacgacatataagcttgtcgcgattatgagcgaaaagatgaagcctcaatacgttaaggacaagcagctgacagctgagaagctcgcgccgatcctcggcatggatgaggggaaagtgctcgatattctaaataaaaaaggagcgtttcaggtcgaattcggatcggcgggacgggatttgacatacgcccaaaaagagaaaatcgaaaagctgaagctgccgggcatcgtgttcacccgcgatacgaagcgctactatccaaacggaatcttcgcctccaacctcatcggctattcgcagatcaacgaaaaaacgggtgaaatgcaaggcatgatgggccttgaaaaaacgctgaacgattatttgaaagaaacggacggatacatgacgtacgataccgacagaacgggctggcgcctgccgaacagcaatgaaaagattaaagcgccaaacaacggagacaacgtgtatttgacgatcgatcaaaaaatccaggcgtttttggaagacagcatgacgaccgttcaaaaagagtacaagccgaaaaagattatggcggcggttgttgatccgaaaacgggcaaagtgcttgcgatggggcaaaggccgagcttcaacccgaacgtgcgcgatgtcacgaactattacaacgaccttgtctcctacagctttgagccgggctcgacgatgaagattttcacattggcggcggccatccaagaaggcgtatataatggaggagaacaatacaagtctggatcatattcggtttctaaaaaagataagccgatcaaagaccataacggtggaaacggctggggcccgatcacttttaatgaaggtgttgaacgctcctcaaacgtcgcgtttgcgatccttgccaacgataaactcggcacggaccggttcaatcaatatttgcggaaattccatttttacgacaaaacggggattgacctgcctggggaagcgaacagcaaaatcaactttgaatatttgcgggataaagtgtcgacggcttttggacagagctctgctgtcacgccgatccagcagcttcaggccgcgacggcgatcgccaataacggaaaaatgatgaagccttatgtgatcgatcatgtcgttgattctgacaaaaacaaaacgatttatcaaaataaaccggaacaagtcggccagccgatctctgccaaaacggcaaaagaagtgcgcgagctgttgggaaaagtcgtcacatctgaaaaaggaacggggcagccgtacaagatcgaaggatttgatgtcgccggaaaaaccggtacggcgcaaattgccggagaagacggcagatatttgaccggccgcgaaaactacgtgttctccttcatgggcatggccccgaaggacgatccgcagcttctcgtttatgtggccgtgcagcagccgcaattaaaagctacggaaacaggctctgctccggtgtcaaaaattttcaatccggtgatgaaaaacagtcttcactacttaaatatcacaccgaaagagactgaaaaagaagaaaagcaggaagaaaaacagctgaaaatgcctgatttctccggcaaacgagccgaatccgccgcaaaagaggcgcaaggcagcagccttgttcccgttacgatcggcgatggcttggctgtgaaagaacagtacccgaaagcgggcgaagccgtcctgccgaaccaacgggtcttcctgaaaaccgacgggaaaatcacactcccagatatgacaggctggtcaaaacgggacgccctccgcttcggcgccatggcaggcattcatatcgaaacgagcggccagggctatgtgaagagtcaaaatgtaaaagcaggcaaagaattaaaagcaaattcagtcgtgaaagtcagattgaaaaacgaatag

SEQ ID NO: 1637 - DNA, 1935 bp, Bacillus licheniformis
ttgcgcgtttccaatgtaacggtcagaaaacgtttaatattcgttctgctttttggtgtgatcatctttttgattattgatacaaggctcggatacgttcagttcgttctcggggataaactgacgactttagcaaaagattcttggagccggaaccttccttttgagccggaaaggggcgaaatattggacaggaacggcgtcaagctggcaacaaaccaaagcgcgccatcggttttggttgttccgaagcaagttgaaaatccgatcaaaacgagcagactgctggccagcgttttgaatatgtcggaagaaaaagcgtataaacatgtcacgaaaaaaacgtcgattgaaaggatcaatcccgagggccggaagatttcccacgagaaagcaaaagaagtcagagatctcaatttgaaaggcgtatacatcgcagaagactcgatccgccattatccgttcggcagctatctgtcccatgtgctcggatttgcgggcattgacaaccagggtctgctcggccttgaagccttttatgacaaagagctgaagggcgaaaagggctatgtgaaattttattccgatgcaaaaggcaagagaatgcctggggaggcggatgactataccccgccgaaagacgggcttgatatgaagctgacgatcgattcaaaggtgcagacgatcatggagcgggaatttgatatcgcagaagcgaagtataatccggacggtatggtcggtgttgcgatgaatccgaaaaacggggagatattggcgatggtcagccggccggactttgatcccgcaaactaccaatcaatcgatcccaaagtctataaccggaacctgcctgtatggagcacatatgagccgggttctacttttaaaatcatcacgcttgccgcagctttggaggaaaacaaagtcaacctccaaaaagatcaattctatgataaaggttccgttgaagtggacggcgcgaggctgaagtgctggaagcgcggcggacacggcgcacaatcgtttcttgaagtcgtccaaaattcgtgcaacccgggatttgttgagcttggtcagcggctcggcaaagaaaaactgttcacctacattaaaagtttcggcttcggacaaaaaaccgggatcgatctgcaaggcgaaggaacaggcatcctattccctcttgaccgcgtcggccccgtagagcaggcgacaacagctttcgggcagggggtatcggtgacgccgatccagcaggtcacggccgtttctgcggctgttaacggcggaacgctgtatacgccgtatattgccaaagagtggattgatcccgtgacaaaacaaacagtgaaaaaacagacgccgatcgccaaaagaaaagtgatttctgaagagacatccaaacagatccgctacgcgctggagagcgttgtcgcccaggggacggggcggaacgcttttgtcgacggctaccgggtcggcggcaaaaccggtacggcgcaaaaagtaaaagacgggaaatatttgaaaaacaaccacatcgtctcatttatcggaacggctccttcagatgatccgagcattgtcgtctacgtcgccgtcgacaacccgaaaggaacgattcaattcgggggtacggttgcagcgccgatcgtcggaaacatcatgagagacagtcttccgcagctcggcgttaagaagcggaaagatcagatcgaacgcgaatatcaatggctggacaaaaagctgatcgaggtcccgaaccttatagggctttccgtgacagagcttgaaccattgctgatcaacctcaggctgaaggcttccggagaaggcgatgtcgtcgttcagcagtcccctaagccgggcgaaaaagtaaaagaaggatcgacgattcgcatttatcttgacagcgatgacggagcctctgattaa

SEQ ID NO: 1638 - DNA, 1467 bp, Bacillus licheniformis
atgaaattgacaaagcttcttacatatttaaaaaatgtaccttcctatgccggccaagaagaccctgatataacttcaattgagatggactccagggaagtcaagacagggagtctttttgtttgtataaaaggctatacagtcgacgggcatgactacgcccgccaagccgctgaaaaaggggccgccgccattgtggcggaaagggaagtggacgccgatgtgccggtgattatcatccgtcatacgaagagagcgcttgccgtgctgtcggacgctttttacggccagccgacaaagcagctgaggctgatcggaattacaggcacgaacggcaagacatcgacttctcacatggtggaggagatctttagaaaagccgggagccgtacaggactgatcggcacgatgtacacgaaaatccacgacgaaacgttcgaggcgaaaaatacgacgccggaaagcgtcacacttcaaaaaacgtttagaaaaatggttgatcagggtgtggatacagccgtcatggaagtatcttcacacgctctccacatgggccgggtgcacgggtgtgattacgatatcgccgcatttacaaacctgacccaggaccacctcgactaccacgagacaatggaagaatataaacatgcgaaaagtctgcttttctcgcagctcggcggatcctttaaccacgaaacaccgaagtgggccgtgctgaatgcggatgaccctgcttcagcctatttcgcccaagtgacgtcagcacatcttttgacatacggaattcaaaacgatgccgatgtcatggctgaaaatatcaaaatggctccgaaagggacaacctttgacctggtgacgccaaaaggttctgcacaagtgacgattccgcttgtcggcctgtttaacgtctacaatgttttaacggctgccgcgatcgcgattgcagcggatatcccgtttgccacgattacagaaggaattgaagggctgaaaggggtcagaggaagatttgagcttgtggacgcaggccaggacttcccggtgatcgtcgattatgcccatacccctgacagcctcgaaaatgtcttgaatacgtgcagaggcttaacggaaggaaagctgtttgtcgtcgtcggctgcggtggagaccgcgataagacgaagcgtccgaaaatggcgaagatcgccgttgaccttgctgatgaacccgtctttacagccgataacccgagaagcgaaaacccgctcgccattttaaacgatatggaggaaggcgtaaaaggagcttactatcacagcatcgtcaaccgcgagcaagcgatcttttttgcaattgcaaacgccaaaaaaggcgatgtcgtcctgattgcaggcaaaggccatgaaacttaccagcagatcggcggtcaaacctttgattttgatgacgctgaggtggccaaaagagccattcttgagctgaaataa

SEQ ID NO: 1639 - DNA, 975 bp, Bacillus licheniformis
atgctcgaacaagtaattttatttaccattatcatgggctttttaatcagcgttcttttatctccgattttcattccgtttttaagaaggctgaaattcgggcagagcatccgtgaggaaggtccgaaatcccatcagaaaaaatcgggaacgccgacgatgggcggcgtcatgatcatattgtcgattatcgcgacgaccattgttatgacgatgaaattttccgaagtcagcatgaacatgatcctcctcttgtttgttacggttggatacggtctgctcggctttctggatgattatattaaagtcgtgatgaagcgcaaccttggactcacatccaaacaaaaactgatcggtcagatcgtgattgctctcgtattctatgccgtctaccacttccaaggaatgccgactgacatccgcattccgggaacagagctgtcgtttgacttcggctggatttatccagtgctcgtcatctttatgcttgtcggcggttcaaatgccgtcaacctgactgacgggcttgacggtctgttgtcgggtacagctgccatcgcgttcggtgcgtttgcgattttggcgtggaaccagtcgcaatacgatgtcgcaattttcgcggttgccgttgtcggagcggtgttaggatttcttgtgtttaacgcgcaccccgcgaaagtctttatgggagatacagggtcgcttgccctcggcggcgcgattgtgacgatcgcgattttaacgaaactggaaatcctgcttgttatcatcggcggtgtattcgtcattgaaacgctgtccgtcattttgcaggtcatttcatttaaaacgaccggcaaacgaattttcaaaatgagccctcttcaccatcactacgagcttgtcggatggtctgagtggagagttgtcgtcactttttggacagcggggcttctgcttgccgtcttaggaatttacatcgaggtgtggttataa

SEQ ID NO: 1640 - DNA, 1356 bp, Bacillus licheniformis
gtggatactcaagatttattgcaaaatcaaaatgtgctcgtactggggctggcgaaaagcggatatgctgccgcttcgatccttcatgagaaaggcgtaaaggttgtcgtgaatgaccagctgccttttgaggaaaatgaacctgcgcggattctcgcggaaaaaggggtggaagtcgtctgcggctctcatccgacggaactgtttgatcttcattcgatcgacattctgattaaaaatccgggcatccgctatgaaaacgtgatggtcgaagaagcgctgaagcggggtatcccggtctggacggaggttgaactcgcctatcatctgacagatgctccgttcatcggcattaccggttcaaacggaaagacgacaacgacaacgcttgtttatgaaatgctgaaggccgattcgaaaaaagcgctcgttgctgggaatatcggtacggcggcaagcgaagtggccaatcaggccagcggagacgaatggatcgtgacagagctgtcgagttttcagctcatggggacttatcaattcagaccgaagattggattattattaaacgtatttgatgcccatctcgattatcaccattcgcgcaaaaattatgagcttgccaaacagcaggtctatcgaaatcaatcggaaacagacgttgccgttgtcaatttggacgatgagacagtcgtccggctcgcggagtgttcaaaagcggagaaggtgtatttttcggtccgccggacacttgagcgcggagcgtgcgtgaaagacggcgcaatcatgtttaacggcgaaccggtcatgccgctggaagacgtcgttttgccgggagagcacaatttggagaacattttggccgccctttgcatcgttaaaacagcaggcgtttccgacgcggccgtccgtaaggtgctgacgagctttacaggtgttaagcacaggatgcaatacgtcgcgacgatcaaaaacagactgttttacaatgacagcaaagcgacaaacattcttgcgacgaaaaaagcgctgtccgcctttcaaaagccggtcattttgctggcaggggggcttgaccgcggaaatgaatttgatgaactaaagccgcatatgtcttttgtaaaagcggtgatcactttcggcgagaccgcgccgaagtttgagaagctggccgaagaaatgggaatacaacaggttaaacgtgtcgataatgttgaacaagcagcaactgcggcgttcagcctgtcagacgaaggagatgtcattcttctgtccccggcctgcgcaagctgggatcagtacaaaacatttgaagaacgtggtgacatgtttgtaaacgccgtgcatatgcttaaataa

SEQ ID NO: 1641 - DNA, 1101 bp, Bacillus licheniformis
ttgcaaacaaaaaaaacgtcaccggattttttgctggttatcattacgctattgcttttaacaatcggactgattatggtatacagcgccagtgcagtatgggcgacttacaaatacgacgactcctttttctttgcgaaacggcagcttttgtttgccggcatcggggtcatcgccatgtttttcatcatgaacgtcgactactggacgtggaggacttatgcgaaaatactgatcattgtatgtttctttctgctcatcatcgtcctggttcccgggatcggcatggaacggaacgggtcgaggagctggatcggagtcggcgctttcagcattcagccgtccgagtttatgaaactcgcgatgatcgcatttttggccaagtttttatctgaaaagcaaaagaatattacgtcgtttagaaaaggctttgtgccggcgctgggcattgtcttttcagcttttctgatcatcatgatgcagcctgacctcggaacaggaaccgtgatggtcggcacatgcatcattatgatctttgtcgcgggggcgagaatttcgcacttcgtttttctcggcctgatcggactgagcggttttgtcggccttgtgctgtcggcgccgtaccggatcaaaaggatcacttcatacttgaacccttgggaggaccctttaggaagcggctttcaaatcattcagtctctttatgcggtggggcccggcgggctgttcggcctcggcctcggccagagcaggcaaaagtttttctatctgcctgagccgcagacagattttatttttgcgattttatcagaggagctcggctttatcggcggatcgctgattcttttgctcttcagcgttctattatggagaggcatcagaatcgcgctcggtgcgcccgatttatacggcagttttgtcgccgtcggcgtcatttcgatgatagcgattcaggttatgatcaatatcggagtcgtgactggtttgattcctgttacaggcattacgcttccgtttttaagctatggcggttcatcactgaccttgatgctcatggcggtcggcgtgctgctgaatgtcagcaggtattctagatactag

SEQ ID NO: 1642 - DNA, 1101 bp, Bacillus licheniformis
atgcggattgttgttagcggaggcggaacgggcggccatatttaccccgcccttgcgtttattaaagaagtgaaacggcatcacgaagatgttgagtttttatatatcggaaccgaaaaaggcctggagaaaaatatcgtcgagcgggaagggatccctttcaaagcgattgaaattacgggttttaaaagaaaactttcatttgaaaacgtcaaaaccgtcatgcgctttttaaagggtgtaaaagaatgcaaagaagaattaaaacggttcaagccggatgccgtgatcggcacgggcggctacgtgtgcggccccgtcgtatacgccgcttcaaaactggggattccgacgattatccacgaacaaaacagccttcccggactcaccaataagtttttatccaaatatgttgataaggtagcgatttgttttgatgaagcgaaaacacattttcctgcagaaaaagttgtttttacaggaaacccgagggcgtctgaagtcgtctctataaaagggggccgttccctgaccgctttgggtcttgcagagggcaaaaaaacggtccttattttcggaggcagccgcggtgccgctccgatcaatgaagcggtcattgcgatgcaaaacgaattaaaaaagcgggattaccaggttctttatgtcacaggggaagttcactatgataaagtcacagctgcgcttgaaaaagaaggcgccgctccgaatatggtcgtccagccgtttctccatcaaatgcccgagtacttaaaagcgttcgatgtcgtcgtgggccgcgcaggggcaacgacaatagcggaaatcaccgcgctcggcattccaagcgttctgattccgagtccgtatgttacggccaaccaccaggaagtaaacgcacgctcactcggggagcagaacgccgctgtcgttttaaaagaatcagagcttaatggagaccgcttaattcaggcgatcgatcatattttacaagacgaaaagacgttggaagagatgaagatccgcgcgaaatcgcttggcgtgccggacgctgcggaacgcttgtacaatgtgctgaaagaattgaaacatcatgcaaaatga

SEQ ID NO: 1643 - DNA, 912 bp, Bacillus licheniformis
atggataaggtgatacaagaattaaaagaacttgaagtcggcaaagttctggaaaacgagccgctcagcaaccatacaacgattaaaatcggaggaccggctgacgtgctggtgattccgaaagacattcaagctgtcaaagatacgatgaaggttgtcaagaagcacggcgtcaagtggacggccatcggcagaggctcgaatcttctcgttctcgatgaagggataagaggcgtcgtcatcaagctcggccagggactcgaccatatggaaatcgacggcgagcaagtgacggtcggcggcggctactctgtcgtaaggcttgcgacaggcatcagcaaaaaagggctttccggccttgaatttgccgcaggcattcctggttcggtcggcggagcggtttacatgaatgccggcgcccacggctcagatatcagcaaagtattggtgaaagcattgatcctttttgaagacggaacgatcgaatggctgacgaatgaagagatggcgttcagctaccgcacatccatccttcaaaacaagcggccgggcatttgtcttgaagccgttctccaattggagcaaaaagaacgcgatcagatcgtcgcgcagatgcagaaaaacaaagactaccgaaaagaaacgcagcctgtgtccaacccttgcgcaggcagcatcttcagaaacccgctgcctgaacatgcgggccggctagttgaagaggctggtttgaaaggccatcagatcggcggggcaaaggtttcggagatgcacggcaatttcattgtcaacgcaggcggcgcaacagcgaaagacgtccttgatttgattgcattcattcagaaaacgattaaggaaaaatacgatatcgacatgcacactgaggtcgaaattatcggagaaaaacggtaa

SEQ ID NO: 1644 - DNA, 789 bp, Bacillus licheniformis
gtgaaacccggtattgataaagaaaaagtagtgaatatagaagaacgtattcccaaaattaaagaacagcgaaagcaaaaggcaaaccgccggctgatcacctttattctgctctttttcacgatgatgctgatcatcatttacctgcagacgccgatcagcaaagtctcgaaggtagagatcaaaggaaacaaaaacgtttcaaaggaacagatcatttccctttcttcaatccataaaggacagacggaattttggagtctgagcaagcaaaaagccgcagaaaagatcgagcagaataaactgatcaaaaaagccgaaatttctaaacaactgcccaacaaaatcgccatctccatcgaagagtataaaagcattgcgtttttgcaaaaacataatgtgtactactccgtgcttgaaaacggcacggtgcttcctgaagaggtgacgccgactgacatcggaccaacccttaataactgggaggaagacgaaaagctcgttcaaatggcaaaacagctgaacaagctttccgattccgtgaaaaaatcgatttccgagatcaactatacgcctcaaaaatcaaacccttggctgatcaaactgtatatgaacgacggctatatcgtgacagcttcgctgaaaacgttcggacagaaaatgaacagctatccggcgatcgtaaaagagctgccgaaaggggaaaaaggcattatccatatggaagtcgcgacttattttgaacctctgaaaaaaacggatgaaagcaaaaagggagacggaaattga

SEQ ID NO: 1645 - DNA, 693 bp, Bacillus licheniformis
ttgaagaggcacacagtcaatctttcactcgccatgcttgtcctcggcttcctgctgtctttctcctatcaattcgccagggaaaacaaagaccatgaagaaactgctgaaaattggaaagaggaatattccctgcgcgaccggctgatttcccaagaaaagcaaaataagaagctggaacaggagctttacaaaaaacagcaggaagtacagaaaacagagacggctttgaaaaaggaaaaaaaagagtactacaatattgtggaagatgttgagaggtacagaatgttcgtcggggaaatcggcgttcagggcgaagggatcaaagtgacgctgaaagacgcttcgtacatcccagagggtgagaatgtcaacaactatatcgtccatgaaagccacattttccgcctgctcaatgagctgtggatttccggggcggccgcggtgtcgatcaacggacagcgcgtgacacatcattcctacatatcgtgcaacggccctgtcatcacggttgacggcaaccagtatccggcgccgtttgttatttcggccatcggggatgcggatgtgctgatgccggcgctgaacattgcaggagggcttgtggaccagctgagccgcgatcatatttcagtcagcatcgaaaaacaagataatatcgagatggagccccttttgaagcaaggggaatga

SEQ ID NO: 1646 - DNA, 690 bp, Bacillus licheniformis
ttgaagaaaaataatcgtttcatcagtttgagcatcttgatgctcattttcggcattatgctgtccgtgcagttcaattcgctgaaggcgccgaaggtccgcgatacgcgggacatttgggacctcagggaggacttgaaggaagaacagaaaaaacagcttgatctgatcagcgaaattgacaagtatgaaaaaatgctgaacacatacagtcatcaagaagaaacctcgcggacaaaagcgttgaatgaaacgcttcaaaacttaaaaaaacaggccggcttcacagatgtcacagggaacggaatcatcatcaccatttctcagctcttctcggaagaattgacaggggaatcgattcaaaatccccctcccgaccttctgaaaaagctgattaatgaactgaatatgtatgaagcggaagaaatatccatcaacgacagaagggttgtcaacacgacggtgatccgcgatatcaacggaacaaccaaaatagacggttatcctttggacaactatccgataacggtaaaagtcatcggcaaaaacgccgataaactatatagccgaatgaatgcttcatccctgcaggatctgttcgcgggagaaaatctggatttgcaaatcaaaaggcctgaaaaacaatcaaaatcaaagcttacgaaggttcaatgcaagttgcgccattga

SEQ ID NO: 1647 - DNA, 354 bp, Bacillus licheniformis
gtggcttccggttttaggggcttttgctccgaaattacaatcgggttcagcacgaatttcaccattccggatgagtactcaaattatttgtccctggcgattctggcatcgctcgatacgttgatcgggggaataagggcccatttggaaagtgtatacgatgaactagtttttgtgacaggctttttcttcaatattattcttgccataagtttggcttttctgggcgttcatcttggtgtagacttgtatttagtcggtatgtttgcatttggcgtgaggctttttcaaaacatcgcggtcatcagaagaatactgctcgccaaatggacggcatcgaggagaaaaaattaa

SEQ ID NO: 1648 - DNA, 1299 bp, Bacillus licheniformis
atgaacaacaatgaactttacgtcagtctagacatcggtacgtccaatattaaagtgatcgtcggtgaaatgtcagacgattctcttaacattatcggagtcggaaatgttccctcagaggggctgaaaaaaggatcaatcgttgatatagatgaaacggttcattctataaaaaaagcgtttgaacaagcagaaagaatgataggttttccgctgacccacgcgatcgtcggggttaatgggaactacatccatattcaagatacgaacggtgttgtggctgtctcaagcgagaataaagaaatccacgttgaagacgtgcgccgggtgatggaggccgctcaagtcgtttccatcccgcctgaacagctgatcgtcgatgtgattccgagacagtttatcgttgacggaagaggcgatattacagatccgaaaaagatgctcggcgtccgccttgaagtggaaggatcgctgatcacgggctctaaaacgattttacataacctgctccgctgtgtggaaagagcgggaattgaaataacggatatttgccttcagccgctggctgccggatctgtcgctttatcaaaggacgaaaaaaacctcggagtggctttaatcgacatcgggggaggatcaacaacggttgccgtatttgaggacggccaccttcttgcgacccgtgtcataccactgggaggagaaaacatcaccaaggatatttcaatcggattgcgcacctccacggacgaagctgagcgggtgaaaaagcagtttggacatgctttctacgaagaagcgtcggaagaggaaacatttgaagtcgccgtgatcgggacggaccaaaagcagacctttactcagcgggaagtggcagacattatagaagccaggcttgaagaaatctttttattcgtggcagaggaactgcggaacatgggaataaaagaattgccgggaggctttgtgcttacagggggacaggctggaatgccgggggtcctcagcctcgcacaggatgttcttcaaaataacgtcagagtggctagcccgaattatatcggtgtaagagaacctcaatacatgacaggagtcggcctcatccaattcgcttaccgcaacgcaaaaatccaaggcagaaaagtagggtttaagatgccggaacaagcggttcaggaagtcgcggcaactcatcaaaaagaagtgcagcagcgaccgaagccaaaatccaagcagcaggctcaagctgagaaaaagccgagcaaaatgaagaaaatatttaacatcttttgggaatag

SEQ ID NO: 1649 - DNA, 1134 bp, Bacillus licheniformis
atgttagagtttgaaacaaatatagacggcttagcatcgattaaagtaataggagtaggtggcggcggtaacaatgccgtcaatcggatgatcgaaaatgacgttcagggagtcgagtttatcgcagtcaacacggatgctcaggctctcaacctgtcaaaagcggaaacgaaaatgcagatcggtgcgaagctgacgcgcgggctcggcgccggagccaatccggaagtgggcaaaaaagccgcagaggaaagcaaagaacaaattgaagaagcgctgaaaggtgcagatatggtgttcgtcacagccggaatgggcggcggaacaggaacgggcgcggcacctgtcatcgcacaaatcgcaaaagatctgggcgcattgactgtcggcgttgtcacaaggccgtttacctttgaaggaagaaaaagacagcttcaggctgcaggcggtatttcagcaatgaaggaagccgtcgacaccctgatcgtcattccgaatgaccgtcttcttgaaatcgtcgataaaaacacaccgatgcttgaagcgttccgtgaagcggacaacgttctccgccaaggtgttcagggcatttcagacctgatcgcaacgcctggactgatcaaccttgactttgccgatgtcaaaacgatcatgtccaacaaaggttctgcactgatgggtatcggtgtagcgacaggcgaaaaccgcgctgcggaagccgctaaaaaagctgtttccagcccgctgcttgaaacggcgattgacggcgcccaaggcgtgctgatgaacattacaggcggcaccaacttaagcctatacgaagttcaggaagcggcggacatcgttgcagctgcatctgaccaggacgtcaacatgatctttggatctgtcatcaatgaaaacttaaaagacgagatcgtcgttacggtgatcgcgactggatttatcgaacaggatcaagattcatcaaagccgcagagacctttaaaccaaggcttaaaacagcatcatcagcctgctccgaaacgggagccgaagcgcgaggagccaagcatgccgcatcgcagcccatcacagcctgccgaggatacgcttgacatcccgactttcttaagaaaccgcaataaacgctaa

SEQ ID NO: 1650 - DNA, 1509 bp, Bacillus licheniformis
gtgaagaaaaagccattattccgcacgttcatgtgcgctgcactcatcggttcacttctcgctccggttgctgtgcaggctgatacaggcacggcagcgaagacaaaggaacaaagcaaaatatctagcgctctttataaacgttttgagaaagaaggtaaagtgacctttttaattaaaatgaaaagccaggcgaaccttcagcaagcggcaaccgcggctgaaaaacgggcgaaagcaagcgttatgaccgtgaaaaaagcaaaagagatcaaacgctcggcagtgctgacttccctgcgtacaaaagctgaaagaacacaaaaagatttgaaatcgtttttggaaaaagaagagaaaaaaggaacagctaagaaagtggaatctttctatattgtaaacggcatcgccgtgacggcgacaaaagatgttatggaaaaagcggcttcatttcctgaggttgaaaaggtgctgcccaatcaaaaaatcaagctgggcaataccgaaaaacctacagtagaatcgaaaacaaccgcggatcgcacccctgcttccaacattgagcaggttcatgcgccggatgtctggaaaaagcgctataaaggcaaaggagccgtcgtcgcttcaattgacaccggcgtagagtgggatcatccggcgttgaaaacaaagtacagaggctacaacccttctaaaccgaacagtccagacaatgagttcaactggtttgatgcggtaagcaataagaaaacgccatatgatgagttgggccacggcacacatgtgacaggcacgatggtcggctcagaagccggcggcaaaaaccagatcggtgtcgcgccgacggcgaaatggatagctgtcaaggccttttcagaggacggcggagatgaaaaatcccttttggctgcaggagaatggattttggccccgaaagatgcgaaaggaaaagcgcaccctgaaaaggctcccgatgtcgtcaacaactcttgggcaggggaacgcggactcgatgaatggtatttggatattgtcaaagcttggcgggcagctgatatcttccctgcatttgcagcgggcaatgtcagcgaattcgaaccgggcggaccgggttcagttgaaaacccgtccaactatccgcaatctttcgcgattggcgcagttgacagctcaaacgcgttagccgacttttcattgcaagggccttcgccatatgacgaaatcaagcccgatatttctgcacctggcgtcagcatccgctctgcttatccgggacataagtatgctgcaatgaacgggacatcgatggcgaccccgcatgtatccggcatcgtcgccttaatgagggaagccaatccggacctcacagtcgatgaaatcgagcgcatcctgctgaaaacggcgacgcctctgactgacaaaacgtttaaaaaatccccgaacaacggctacggatacggcttggtcaacgctttaaaagcttttgacgcagctaaaaaaactaaatga

SEQ ID NO: 1651 - DNA, 4299 bp, Bacillus licheniformis
ttgaaaagaaagctgagaaaaaaggcgttttccaccattttaagcggtttgttaatcggctcgctgttcatgcccgccgtttcagatgccgcggcaaagcccgcacttacttccatgaaagaacaagcagccgcagggaaggggaaaatttcaaaaactcttgtcaaacagttcaaaaaagaagatcaagtcacatttttgattaaactgaaagatcaagtcgatacaccaaaagtggccaaacaggcggaaaagaacgcgaagaaaaagtcgctgagcgctgctaaaacagaatatcaaaaacgctcggctgttgtttccgctttaagagtcaaagcggatgagtcgcaaagcgatctgaaacgttatttaaaaaagcaggaaaaacagggggacgtaaaaaaaatcagatcctattatattgtcaacggcatggccgtccatgcgacgaaagaggtcatggaacaagtagcggcttttccggaagtagaaaaagtgcttccgaacgaaaaaaggcagctgatcaaaccgactaaacagtctgtgaaaaaatcagcagccaaggatgaaaaagaaatcgaatggaatatcaatcgagtcgacgcaccaaaagcctggaaattgggatatgacggatcgggcacggttgtcgcgtcgattgatacgggcgtgcagtgggatcatccggccttgaaagaaaaataccgcggatatgacccgcagcatcccgatcagcctaaccacgaattcagttggtatgatgcggtttcaggcgcttctgaaccatttgacgatctggagcacggcacgcatgtaaccgggacgatggtcggctcagagcctgacggccaaaaccaaatcggcgtggcgccgggtgcgaagtggattgctgtgaaagctttttcagatgacggcggtacggacgaagaccttattgcagcaggtgaatggattttggcgccaaaagataaagacggcaacccgcaccctgaaatggcgccggatgtcgtcaataactcatggtcagggggagccgggattgatgagttttacagggatatcgtaaaagcgtggcgagctgccggcatctttcctgagttctctgcggggaacgtcgatttcgccaatccgggaggacctgcttcgattgccaatccggcaaactaccctgaagcgttcgcaaccggagcgacagacatcgataatcgcttagccgatttttcacttcaaggtccttccccgtatgatgagactaagcctgaaatatcggcgcctggtgtcaacattcgctcatctgtgcctggaagcggctatcaagacggctgggacggcacttcaatggctggcccgcatgtcgcagccgccgccgctcttatcaagcaagccgattcgtcgatcactgttgatgagaccgaaaagattttgatggaaactgcaacaccgctcacagacagcaaatttaccgaatcgccgaacaacggatacggccacggactcgtgaacgtgtttgacgcagtgtccgctgtgacagacgggttgggcagagcggaaggacaagtcggaaaagaaggcgaagacaaaagtccgccggccttaaaccatcaagagatcaccgaaatttactcaggctcggaaacgcctcttaaagctgatgtagaagacgatgtcagcatcatatcggtcaaattgagctataaaacagatgacgccgattgggagacgatcgctgccaaacaaacttccggcgactataaaaaaggaacgtacgaggcggctgtaactgtttctgaagggaaaaccctttcctacaagtggattgtcaccgatttcggaggcaacaaaacggaatccaaagtgtacgaagtcccgatttccccggctgtgacaacagggtataaacaagatttcgagaattccgccagcggctggctcacatcaggcgtgaagaattcatgggagcgcggaattcctcagtcaggcccgaacgccgcagcatcgggaaaaaacgtattcgcaacaaatctgacagggccgtatgaaagttcggctaatatgaatcttctcatgcctcctgtcagcgttccaaaaaatcaaaagctttatctcacatacaaatattggcgcgatattgaagaggactttgattacggcttcgtttacgtacagcctgaaggaaaaggtgaatggatcccggctgccgagtacagcggcaagacatcagaatggaaagacggacagatcgatttgtcggaatacgggggacagacgattaaggtcatgttcaaccttcaatctgacgacagcattgaaggtgacgggctgtacatcgatgatgtagcgcttgtcaaggaagtgaagagcgccggtacgaaaaaacgattgggcgttgaaaaacagccggccaaaatgaaggataagaaaacaaagaaacgaatgattgatccgaaaaaagcaaaaccggcagaagcccttcaggaaaaaaccgaaacgaaaaaagcagctcctgcggttcttccggtgcgcgctcaggtcagcgtgctggaaacgggcaaatcgacatattccaaccaggcaacaggcgcatacagcttggctcatgcacctggaacctatacgctgaaagcggaagcgtacggatatgaatcaaccgcccaaaccgtaaaaatcgagtccgacaagacaacaacggcagactttgttttaaaagaactaaaaaaagggacgctcaccggaacgataaaaaataaaaaaacgggcgaacccgtccggcatgcaaagttgtatatcgttgaagatgcagctgtaaaaccagtccagacggatgatgacggaagctattcattaacggcctatgaaggctcgtatacggtaaaggtctctgcaaacggatattacagcagcgagttttccgttgatttaaaaggcgatgtctcgaaagatatcgatctcgatcctttcatcggctatccgggggaaataggctatgatgacggaaccggggaaaacgcctgggctttctatgaatccggcaacgggctggcggttaaaatgacgcttgaaaacgggcaggaaaaagccatgctgaaaggcggtttgtttaaattctgggatacagaattccctgatccgggcggcactgattttgcagtagaggtctatgatgcttcgggtgaaaaaggctctccgggcaaaaaaatcgccggcccgttcaaggctgaagcgctccgcacaggcgaatggacgaccgttgatttaggtgacgaaggcatcatcgtcggaaaagacttttacctcgtatacgtccagaaagaggatctggccaactcacctggacttgctacagacgaagacggagaatattccggccgcaactggcagtatacggacggctcatggtcaaaagcgccatcagaccaaggcaactttatgatccgcgctttggtcgactatgaattgtcggtgcctgtgattacgtctcctaaagacggattcatcaccaaccaaaagaacgctgtcattgaagggacatcctcgccgaatacgaccgttcatctctttaacggggatgaagaagccggaacagcggaaacggcggcagacggcactttctcaaaagaaataccgttgaataaaggggaaaatgtcatcaccgcgaaatcgtcatcggcttccggaacgactgatgcttcagaaccggtccggatcgtccttgaccagaaaaagccgaagcttacaatcgacacgccggaaagcggctcaaaactcaataaagagaccgtcaccgtgaaaggaacagtatcagacgatcacttagaatctgttcatgtaaacggcaaaaaagcagctgttgacaatggcgaatattctgcaaggattatgcttgacaacggcaaaaatgaaatcaaagtaacggcatcggatgcggcaggcaacaaaacgaccaaaaaggtcacggtagatgtcaactttgaagcgccgcaaatcaccggcttgaaaccggccgaagatctcgagctcaaaacgggagaaaccgtgaaaatcgagtttgaaagcgccgctgatttggatgctgtctttgtgatcagaatgccgctgaccaatttcaaaaccgctgcccaaaacgtaacggagctgccgatcagagaagtctcaaaaggaaaatatgaaggatattggaccgctacttcaactgcaaaagcaaaaggagcggaaatcgaggtcatcgtcagagatgattacggcaatgaaacgagacaaacggcaaaaggcaagctgtatatcaatgaaaagctgaaataa

SEQ ID NO: 1652 - DNA, 930 bp, Bacillus licheniformis
gtggaaatctatttagatgcgatatggctgttaaacttttgttttgacttgctgcttttaatgatgaccgcatttattttaaagcgaagggttaaaaagcggaggctgatcctaggggcatttgtcgcgtcaagcatcgttctgtttatgtttacacctttttcaccgtacgtccttcatcctgccggcaaactgtcgttttcggttgtgatcgttcttgtggcatttggttttaagcggttccggttttttttgcagaatttgttttctttttattttgccacttttttaatgggaggagggattatcggagcgcattctttgcttgaaacggattcgatcatggaaaacggcgtctttatgacgaattggtccggttttggagaccccgtcagctggctgtttgtctgtgtgggttttgcggctgtatggctgttttcaaaaaagcgttttgaagatgctgaagcgaagaaaattcaatacgaagaacgcgtccgcctagaggcctgcattggtgaacatacgcttcatttcaccggattgattgactccggaaaccagctctacgatccaatcacaaaaacgcccgtcatgatcgtcaatattgaaaaattgaaagttgtattgggagaagaggcaagtgtgaccatcaaggaaatgagcccgcttgatgccgtcgggaaactggatgaagcactgccgtatatcgggcggatccgcctgattccgtaccgcggggtcggccatcagcatcagtttctgctctgcttaaagccggatcatgtgctcgtttgtacggaaagagaagtgattgaagcgccgaaatgcctgattggcatcagcacatcaccgctttccgctgacggcgaatttgacgccatcgtccatccgaaaatgctggccggaaacccggtcaaacacgtttcttaa

SEQ ID NO: 1653 - DNA, 720 bp, Bacillus licheniformis
atgaaaaaactaaaattaaggttaacctatctatggtacaaacttttaatgaaactggggctgaaaagcgacgaaatttattatatcggcggaagcgaggcgcttcccccgccattgtcaaaagatgaagagcaggtgcttctccataagctgcctgacggtgatcaggcggcacgagcgattttgattgaacgaaatctcagactggtcgtgtacatcgcgagaaaatttgaaaatacaggaatcaatatcgaggatttaatctccatcggcacgatcgggctcatcaaagcggtgaatacgtttaatcccgagaaaaaaatcaaactggctacatatgcttccagatgcattgaaaatgaaattttgatgtatttaagaagaaacaataaaatccgttcagaggtatcattcgacgaaccgctgaacatcgattgggacggaaatgagctgcttctctcagatgtgctcggaacagaaaacgacattattacaaaagacatcgaagcaaacgttgacaagaagctgctgaaaaaagcgcttgaacagctcaatgacagagaaaaacagatcatggagctccgtttcgggcttgtcggaggggaagaaaaaacacaaaaagacgttgccgatatgctcgggatctcccagtcatatatttcccgacttgaaaaaagaattattaaaaggctccgaaaagaattcaacaagatggtttaa

SEQ ID NO: 1654 - DNA, 780 bp, Bacillus licheniformis
gtgtcgaggaataaagttgaaatctgcggggttgatacatcaaaactgcccgtactgaagaacgaagagatgagaaagttattcaagcaaatgcaggatgaaggagacacaacagcgagagaaaagcttgttaacggcaatttgcgccttgtcttaagcgtcattcaaaggtttaacaacagaggagaatatgttgatgacttattccaagtcggctgcatcggactaatgaaatcaattgataattttgacctgagccacaatgttaagttttcaacatatgctgtaccaatgatcatcggagaaatccgcagatatttgcgcgataacaacccgatccgcgtctcacggtcactcagggatatcgcgtacaaggcgctgcaagtgagagaacggctgatcagtgagacaagcagggagccgactgctcaggagatcgctaaagagcttgaagtgtcccatgaagaaatcgtttttgcgcttgacgccattcaagatcctgtatctttgtttgagccgatttacaatgacggaggagatccgatttatgtcatggatcaaatcagcgatgagcgcaacaaggattcgcaatggatcgaagagctcgccttaaaagaaggcatgagacggctgaatgaacgggaaaaaatgatcctcagaaaacgcttcttccaaggcaagacgcaaatggaagtcgctgatgagatcggaatctcccaagcccaggtctcaaggctggaaaaagccgccattaaacaaatgaataagaacattcactaa

SEQ ID NO: 1655 - DNA, 798 bp, Bacillus licheniformis
gtggttctgcagcttgagcatgcttcactaaaacgaaacggagagtggatattaaaggatattgattggacggtggaaaagggggagcactgggcgttatacggattgaacggagccggcaaaaccgcactgctcaatatgctgtgcgcttattattttccgacaataggaaaagtcaccgtgttagggcgcgaattcggaaaaacggagcttggcgagaagcttcggcgaaaaatcggccttgtttcagccgccctgcagcagaagctttatcctgaagacagtgcatttgaaattgttttaagcggcgccttcgcttcgatcggcctttatgaatcgccttcacagtctgtcagagagaaagcggtcgccctcttggaggaattcggctccatccgctatgcggacaggagatatgaaacgctctcccagggagaaaagcaaaaggtgctgatcgcaagggccttgatggccgatcctgagctgctgattctcgacgaacctgtcaccggtctagattttatcgcgagggagcaggtgctggatacggttgaacaaattgccaagaaagacagtgcgccgtccatgctttacgttactcaccatgcagaagaaattctccccgctttcagccaaaccctgctgttaaaaaaaggggaagtgtttgcgttgggaaagacaagagagatgatgtccggcgaggttctgtccgaatttttcgatatgcccgtccaggcggtatggacggaagatcggccgtacttgtccaagaaaaaaactgcaaacctcaatgtttaa

SEQ ID NO: 1656 - DNA, 826 bp, Bacillus licheniformis
atgtttcagtgcccgctatgcgccgcgaacatggcgatcagcgagttaaaaagccttatatgttcaaacagacatacgtttgatatcgcaaaaggagggtatgtcaatgtcgcgacgcattctccttccgttaagatttatttgaagccagaagaatgttagcagccgccggcttttttgaaccgatgagaggcgcgttgacagaccgtcttaaacaagccggcctgccgttttgcaattttgtcaggatcctcgatgccggctgcggggaaggttcgcatttgacgcgaatcgctgaaacgctagaagcgcgtttcggaacgcctgtccttggagtcgggctggatttggcgaaagccgggattgtatcggcggctaagcaagaaagagaggcgatctggtgtgtcgccgatctggctgccgcaccgtttcggaatcgttcattcgacgcgatcctcaatatattgtcgccttctaattacgcggaattcgagcggctgttatcggatgacggcatcgttttgaaagtgattccgagaagcggccatctgaaagaactgaggagatttttgtacgacggctcggacaaacaagcctatacgagcgaggatacggctgagcgcttcgcgtctcattttgatctgatcgacagaacggagatcgcctacagcaaacgtttagaccgaatccagctcccgccgctcatcaagatgacgcctttatcatggcgcgcgcaaaaggagcggatcaatgcctttctaaagaaggaatccgctgttatgaccgtccatctcgatattttagccggcaggaaaaaaacgaaata

SEQ ID NO: 1657 - DNA, 240 bp, Bacillus licheniformis
gtggacatgatgaatatttctgatttccagataaaagatgtcgttaacgtatcaaacggaaaaaagctcggcagcatcggcgatatcgatataaatgtaacgacaggcaaaatacaggcgatcgtcatcggaggaacggggaaagttttcggatttttcggaaaagaagaggaaatcgtcattccgtggcgaaatattgttaaaattggagaagatgtgattcttgtgcgtttaagctga

SEQ ID NO: 1658 - DNA, 864 bp, Bacillus licheniformis
atgtttgtcgaaaggctgatcaccatgaatacatataacccctttcgtcttgatgctccgtcaatgcttttgattgaggaatggaatcagacggcggaaaccggcggagccgtcacagccggatttacgacaaaaaacggcggagaaagcgaaccgccttttcactcattgaatacagggctgcacgttcaggatcatgaacagcatgtcatcaataacagaaaaaaggttgccgacatcctaaaaacagatctgcacgactgggtatttgctgatcagacgcatgaagaccggattcataaagtgacggatggcgatcgcgccagcggcgctttccgatacgatacggcgctgaaggctacggacggactttatacagacaggccaaacctgtttttggcgctttgctttgccgactgcgttcccgtttatttttacgatccggtccgctcgctggtcggcatcgctcacgcgggctggaaaggcaccgcacttgggatcgccgccagcatggttgacatgtggatcaggcgggaagggtcgaatcccgcagacatccgtgccgtgatcgggcctgcgatcggttcgtgctgctacactgtcgacgatcatgtaatagacaaaatcagaaatcttcctcttcagcaagaagacaaagcctttttgacgataaaagaaggggagtaccgtctcgaattaaaagaagtgaacaggcagctgcttgtacacgccggaattccaaacggccagatcgaagtgagttccctttgtacgagctgcgagcgttcactgtttttctcccatcggagagaccggggaaaaaccggacggatgatgtccttcatcggattaaaggaggtatag

SEQ ID NO: 1659 - DNA, 540 bp, Bacillus licheniformis
ttgggtgaaaaccgtgataccgggctgcttcacaagctcgacgttctgaaagacagcgaaccggtatggcattttatcggaaccctgcagacgagaaaggtaaaagcaatcatcgatcatgtctcatatatccattctttagacaggctttcactggccgatgaaattcaaaagagggcaaaaaaaccgattgactgttttgtccaggtcaacacatcccttgaaccttcaaaacacggcatggcaaaagaagaagttcttccttttgtaaaaaaactgtctggatacgaaaacattcggatcgcgggattaatgacgatggctccttttacggatgatgagaaggcaatcagaagctgttttcgcttgctgagagagctgcgcgacgaggtgcggggccttgatcaatggaacgctccgtgcagcgagctttcgatgggtatgtctaacgactatgcgatcgcagtcgaggaaggcgcgacattcgtcagaatcggatcttccttagtcggaaatgaaactggaggtggacaatcatga

SEQ ID NO: 1660 - DNA, 453 bp, Bacillus licheniformis
atgagtttgaaaaacaaatttaaaaactttttttccttggatgatgaggaatacgaatacgagtatattgaaacagacagggaggaaatccctgaagagcatgaatcaaaagacagaaccgcctaccagtctaaagcggctgggaagcagaatgtcgtaagtttgcaaagcgttcagaaatcttctaaagtagtgttaagtgagcctcgggtgtacgcggaagcccaggaaatcgcagaccatatcaaaaaccgacgcgccgtcgtcgtgaacctgcagcgcatccagcacgatcaggcgaaaagaatcgttgatttcttgagcggaactgtatatgctctcggcggcgatattcagcggatcggagcggacatctttttatgcacgcctgagaacgtcgatgtttccggcacgatttccgagctcatagaagaagaacatcagaggtggtaa

SEQ ID NO: 1661 - DNA, 270 bp, Bacillus licheniformis
atgatcctactttatcaaattttaagcacgcttttaaccgtctattcttttgcgctcattatttacatttttatgtcttgggtgcctaatgcaagggaatcttcattcggccgggtgcttgcttcactttgcgagccttatctcgaaccgttcagaaggatcattcctccgctcgggatgattgatatttctccgattgtggcgattttcgtcctgaaattcgcagatgcagggcttcttgcggttttcagaatgctcggcgctttttaa

SEQ ID NO: 1662 - DNA, 777 bp, Bacillus licheniformis
atgagcgatatttaccagcatttcagaaaagacgaagagccgtttatcgaccaggctcttgagtggaaaagaatcgtagcggaacagtaccggatgaagctgaccgattttttggatccgcgggaacaggtgatcctgcagtctgtcatcggtcagtcggacgaagtgaggcttgaatttttcggggggttccctgaggctgaacgaaagcgggctgtgctgttccccgaatatgccgagccgtctgccgaagattttcagcttcaagcctgggaagtcatctacccgcaaaaatttgcctccatcgagcatcgcgagcttctcggctcattgatgggcatcggattgaagcgccaaaagttcggcgatctgatcttttcggacggaacatggcagtttatctgttcggaagaagtcgctgattttgttttcacccagctgacacaaatcggcaaggtgaaagtttcccttgaaaaaattccgctttcaaagcttaaagtaccggagcaggatgtcgaaataagggatgatacggtttcatctttgaggcttgatgcgatttgctcggcaatgagcaggcaatcccggcagaaagcacaggttcttgtgaaaaacggcctcgtgaaagtgaactggaaagtcatcgaagacccttcatatgcactggctgaaggggatatggtttcgatccggggatttggccgcttcagaatgaaaaacattgacggcaaaacgaagaagggcaaatggagattgacgtttgaaaaacaaaaatga

SEQ ID NO: 1663 - DNA, 495 bp, Bacillus licheniformis
atgcctttgacgccaaatgacattcataataaaacatttacgaaagcgttccgcggctatgatgaagatgaagtgaacgaattcctggcccaggtgaggaaggattatgagatcattctgcgcaaaaaaaatgagcttgaaacaaaggtgaacgagcttgacgagcgtctcggccatttttcgaccatcgaagagacgttgaataaatcgatccttgtcgcacaggaagcggcagaagacgtaaagcgcaattccgagaaagaagcgaagctcatcatccgtgaagctgagaaaaacgctgatcggatcattaatgagtctctttcaaaatcgagaaagatcgcgatggaaatcgaagagctgaaaaagcagtcaaaagtgttcagaacccgtttccaaatgctgatcgaagcgcagcttgacctgttgaaaaacgatgactgggatcatttgcttgaatacgaagtagacgcagtaatggatgaaaaggaatag

SEQ ID NO: 1664 - DNA, 2769 bp, Bacillus licheniformis
atggattataaagacacgctcttaatgccgaaaacagattttccgatgagaggaaacctgccgaaccgcgaacctgaaatccaggggaaatgggaggatatggacatttacagcctcgttcagaaacgtaccgaaggccggccgatgttcgtgcttcatgacggaccgccgtatgcgaacggcgatattcatatggggcatgcgcttaacaaagtactgaaggatttcatcgtccgttcgagatcgatgagcggctatcatgcgccgtacgttccgggctgggacacacacggcctgccgattgaaacagcgctcacgaagaacaaaaaagtgaagcgcaaagaaatgacagttgccgaattccgcaaactttgcgaagaatatgcatggcagcaaatcgaaggccaaaaagcgcaatttaagcggctcggtgtcagaggagattgggaaaatccatacgtgacgcttaagcctgagtttgaagcgcagcaaattaaagtattcggcgaaatggcgaaaaaaggctatatttacaaagggaagaagccggtttactggtctccttcaagtgagtctgctctggctgaagcggaaatcgagtaccatgataaacgctctccgtctatctatgttgcatttgatgtaaaggatggaaaaggcgtattaacaaacggcgaaaagattgtcatctggacgacaacgccgtggacaatcccggccaacctcggcatcgccgtacatcctgaactggagtacagcgtcgttgctgccggcggcgcgcgctacgtgatggcaagcgcattgattgaaagcgtggcaaaagcgatcggctttgaagatcatgaagtcgttcagactgttaaaggtaaagatttggaacatatcgtcgcagttcatcctctatacggcagagattcgcttgtgatgctcggcgaacacgtaacaacagatgccggtacaggctgcgttcataccgctccaggacacggggaagacgactttatcatcggtcaaaaatacgggcttgacgtgctttgtccggttgatgaaaaaggacatatgacgagcgaagcccctggttttgaaggactgttttacgatcaggccaacaagccgattacagaacagctcgaagaaaaaggcgctttgctgaagcttgatttcatcactcactcctatccgcacgactggagaacgaaaaaaccgactattttccgtgcaaccgcccaatggttcgcttccatcaaagactttagagacgagcttcttgaagcggttaaaaaaactaaatgggtgcctgaatggggcgagacacgcctctacaatatgatccgcgaccgcggcgactggtgtatttcaagacagcgcgcatggggcgtgccgattccggtattttatgcggaaaacggggagccgatcatcacggacgaaacgatcaaccacgtttctgaactattcagggagcacggttcgaacatttggtttgaaaaagaagcgaatgaactgcttccggaaggctttactcaccctggaagcccgaacggcaagtttacaaaagagcaggacatcatggacgtctggtttgattcaggttcgtctcatcaggccgtactggaagagcgcgaagatcttgtaagacctgccgacttgtatctggaaggatctgaccaataccgcggctggtttaactcatcgatttcgacagcggttgccgtaacaggcaaagcaccttataaaggcgtgctttcgcacggttttgctcttgacggagaaggccgcaaaatgagtaaatcactcggcaatgtcgttgttcctgcaaaaatcatgaaccagttcggggcagatattttaaggctgtgggttgcgtctgtcgactatcaggcagatgtccgcgtgtctgacgcgatcttaaagcaagtcgcagaagtgtaccggaagatccgcaacacgttccgcttccttcacggaaacattgctgattttgacccggcgaaagatgcaatcgctgtggaagatctgagagaagtcgatcagtacattttgatcaaactgaacagcctcattgaaaaagtcaaaaaagcgtatgaagaatacgattttgcggtcatttaccatgctgtccacaacttctgtgcgatcgagctcagctcattctatatggactttgctaaagacgtcgtttatattgaacacgccgatcataaagaccgccgcagcatgcagaccgttttttacgaaacgctgcttgcgcttgtcaagctgatcgcgccgattctgccgcatactgcggacgaaatgtggagccacttcacattcgtatcggaaaaaagcgtgcagcttacagatatgccggaaacaagagacattccgaatgcaaaagagacggaagagaagttcgacagcttcatgaagctgcgcgacgatgttcttaaagcgcttgaaacagcacggaatgaaaagatcatcggaaaatcttcggttgccagcttgacgctgtatccgaatgaagaagctaaagcgctgctttcttcaatcaaggaagacgtcaaacagctgttcatcgtgtcggagcttgccatcggcggaacggaagccgatgcgcctgaggatgcgcagtcgtttgaaacaggaaaaatcgtcgttgctcaggcagaaggcgagacttgcgagcggtgccgcatggtttccaaagaaatcggcgaggatcccgatcatccggaactctgccctcgctgtgctggaattgtgaagacgtattatcaaaattaa

SEQ ID NO: 1665 - DNA, 366 bp, Bacillus licheniformis
gtgaacgagcagctggcggcaattcataccgaacttcttcaaatgaaggaagagttggaagcaaggctttttgaatactccttttttcagcaggattctcagggcatcagttcgtatcagcaggcaacacttatgtatcatgtaaaagaagagcttcaggacgtgcttttggccctttcaaaaatcgaaaacggaacatacggcatttgcgaagaaacaaatcaggctattccgctggcaaagatgactattctgccgacggcgcgcactgcgaacgattttttatatcatgcccaatttgaaaaaaagacgcttcctatttgggctgagacggatgaaacgttcaaccgggcgctctactcataa

SEQ ID NO: 1666 - DNA, 462 bp, Bacillus licheniformis
gtgccttattacataattgcgctgctcattatcggtatcgatcaatttacaaaatggctggtcgtcagcaaaatggagtacggtgaaagcatccccgtcatcgatggcttctttcagattacgtcgcacaggaatacaggtgcggcatggggcattttggccgggcagatgtggtttttttacatcattacgacggtggtgatcatcggcattgtatactacattcaaaaacatgcaaaaggacaaatcctgctcggaatcgctctcggtttgatgcttggcggtgctgtcggcaatttcatcgaccgcgtgttcagacaagaagttgtcgattttatccacgtgacgatcgtcaattatcactatccgattttcaacattgccgattcatctttatgtatcggagtcctgctcttatttatacaaatgctgttagacggaaagaagaagaaggagctgtaa

SEQ ID NO: 1667 - DNA, 915 bp, Bacillus licheniformis
atggagcattatgatatgaccgttcatgaagaacataaaggtgaacggattgacaagtacttgaccgcagttgaagcggattggtcgcggactcaagtacagcagtggattaaagaagaccgtgtgctggttaacggaaatgcggtgaaagccaattataaagttcaggaaggggatgcggtgtcagtccaggttcccgaaccggaaccgctggatgtcacggctgaaccgatggatcttgatatttattatgaggaccaggacgtactggtcgtcaacaagccgcggggaatggtcgttcatccggctcccggccatttgacagggacgctagtcaatggtttgatggcgcattgtgacgacctgtcaggcatcaacggcgtgatgagaccggggatcgtccaccggattgataaggacacttcaggcctgttgatggttgccaaaaacgacatggcgcatgagtcgctcgtgaaccagcttgtcaacaaaacagtaacgagaaaatacaccgcgctcgtccacggcgtcatcccgcatgaccacgggacgatcgacgcgccgatcggcagggataaaaaagacaggcagagtatgacggttacaagggaaaacggaaagcatgccgtcactcattttgaagtaatcgaacggttcgacgattttactgtcgttgaatgccagcttgaaacggggagaacccatcaaattcgcgtgcatatgaaatatatcggctttcctctcgcgggagatccgaaatacggaccgaaaaagacggtcgatttcaacggccaggtgctgcatgcgggcgtattggggtttgaccatccgcgtacgggagaatatgttgaatttgaggcgcctctgcctgacgacatgaaaaacctcctcgacaaaattcgaaataaacgttga

SEQ ID NO: 1668 - DNA, 549 bp, Bacillus licheniformis
atgcaagagcaggaaaaggctgttgtgcttgacgaacaggcgatcagaagggcgctgacaagaatcgcccacgaaatgattgaacgaaacaaaggaatgaacaactgtatccttgtcggaatcaaaacgagaggcatctatctggccaaacggcttgccgaacggattgagcaaatcgaaggaaacaaagtcaccgtaggagagctggacatcaccctttaccgggatgatctctccaaaaaaacgtccaataaagagccgcttgtcaaaggagcggacattccggcggacatcaccgatcaaaaggtgatcctcgtcgatgacgtgctttacacgggacggacggtcagagcggccatggatgcgctcgtcgatgtcgggcggccttcatccatccagcttgcggtgcttgtcgaccgcggccacagagagctgccgatcagagccgactttatcgggaaaaacatcccgacgtcgaaaaccgaaaaggtcatggttcaattggaggaagttgacggacgcgaccttgcggcgatttataaaaagtga

SEQ ID NO: 1669 - DNA, 1305 bp, Bacillus licheniformis
atgagtcagaaaaaagtgaaccttggtgtcagagaagtaccaaaacctttgaattggatatctttcagcctgcagcatctgtttgccatgttcggagcgacgatccttgtgccgaagcttgtaggcttaagcccgggcgtggccctcattacaagcgggcttggaacgcttgcgtatctcttgattacaaaaggacagatcccggcttacttaggttcatcctttgcatttattgccccgattatcgcggcaaaagccgccggaggccctggcgcggccatgatcggcgcatttatggcaggcatcgcctacgggctgatcgcccttctcatccagcagcttggaacggactggctgatgaggcttctgccgcctgttgtcgtcggtccggtcattatcgtcatcggactcgggctggcaagcacggctgtcaatatggccatgtatgaagattcgggagcaaaagtgctcgtctacagcgccaagcattttggcgtcgcaggattcacactcgcgctcaccataatctgcgcgattttcttgagaggatttttcagcctgattcctgtcttgatcggaattatcggcggatacttgttcgccctgacccagggaatcgtcgacttccagatggttcttgacgccaaatggtttgctgttccggacttcgtgcttccgtttgtcgactatacgccgagcgcggcggctgtcggaatcggaatcgccatggtgcccgtcgctttcgtgacaatgtcagaacatatcggacaccaaatggtattaagcaaggtcgtcggccaggattttattaagaagcccgggcttcaccgctcgattttcggcgacagcgtcgcaacgatgcttgcatcatgcatcggcggacccccgacaacgacttacggagaaaacatcggcgtactcgccatcacaagagtattcagcgtatttgtcatcggcggagcggctgtcattgcactgtgcttcggatttatcggcaaaatttcggccctgatcagctctgtcccttccgcagtcatgggaggcgtttccttcctgctgttcggtatcatcgcatccagcggactgcgcatgctgatcgataataaaattgacttggaaaacaagcgaaacctgatcatctcatccgtcattctcgtcatcggagtgggcggcgcatttatcaagatctcagggtttgagctgtcaagcatggcgcttgcggcgatcgtcggagtggttttaaaccttgtcctgcctgaatcaaagggagatcaggacggaattgaaatagaagagcatatttaa

SEQ ID NO: 1670 - DNA, 921 bp, Bacillus licheniformis
atgaaacacttgaccgcaatgaatgagcttagtcttgaggatattcacgagctgattgaagaggcgagagagctgaaaaaaggcaagtccgattccgttctctccggaaagttcgctgccaacctgttttttgaaccgagcacaagaacgcgcttcagcttcgaagtggctgaaaagaaactcggcatgaatgtgttgaacctggacggtgtttcaacgagcgtacaaaaaggagaatcgttgtacgataccgtcaagaccctcgaatccatcggcgctgatgtatgtgtgatcagacactctcatgatcattattacgatgaactcatcggacatgtcggcattccggtgatcaatgccggagacggctgcggtcagcatcccactcagtctttgctcgatttgatgacgattcacgaggaatggggcagatttgccggactgacggtatccatacacggagatatcaagcacagcagagtggcaaggtccaatgccgaagtgctgacaagactcggagcaaaggttcttttctcaggtccagacgaatggcgggatgaagacaatccatacgggacatatgtgtcgcctgacgaagcggttgcacattcggatgtcgtgatgcttctccggattcagcacgaacggcatgagaaaaaggcggcagaacgcgattatctcgaaacattcggattgtcgctcaagcgggcggagctcttgaaaaaagacgcggtcatcatgcaccccgcacctgtcaaccgaggcgtcgagattgacagtgcactggtcgaatccggccggtcgaggatttttaaacaaatggaaaacggagtatatatcagaatggcggttttaaaaagagcgcttctaaacggcgaaaacaaaaaaaggggagatcaggcttatgtcttatttaattaa

SEQ ID NO: 1671 - DNA, 1287 bp, Bacillus licheniformis
atgtcttatttaattaaaaacggcttcatgctcgacgaaaaaggcgaaaaagtacagcgcgatatcagggttgaaggcgatgcaatcagcgagatcggaagccttgaggccgcttcgggggaaacggtcatcgatgcggatggacttttcgtctcgccagggcttgttgaccttcacgttcacttcagagagccgggcggcgagaagaaagaaacgatcgaaacaggtgcaaaagccgcagcgagaggcgggtttacaactgtcgccgcaatgccgaatacccggcctgtccccgatacgaaagagcagatggagtggcttgtcaaccgcattgacgaaacggcatcagtgagagtgctgccgtatgcttcaatcaccatcaggcaaacaggtcgggaaatgaccgatttcgaagggctgaaagacgccggcgcgttcgcgtttaccgatgacggcgtcggcgttcaaacggcggggatgatgtatgaagcgatgaaaaaagcggcttcgattaataaagcgatcgtcgctcactgtgaagacaattcactgatctacggcggcagtgtacacgatggggaatttgccaaagccaacggtttaaacgggattccttcggtgtgcgaagcggttcacatcgcaagggatgtgcttcttgccgaagcggcaggctgccattaccacgtctgtcatatcagcacgaaggaatcggtcagggtcgtccgcgacgccaaaaaagcgggaatccgcgtgacggcggaagtgacgccgcaccatctgctcctttcagacagcgacattcccggccttgatacgaattataaaatgaatccgccgcttagaagtccggaagacagggaagcgctccttgaggggcttagagacggaacaattgattttatcgcaacggatcatgccccgcatacagaagaagaaaaacaacagacaatgagccttgcgccttttggaattgtcggcttggagacggcttttccgctcctttacacgcactttgtcaaaacaggcaaatggacgctgaaacagctgcacgattatatgacggtcaaaccttgcgaggcgttcgggctgccgtacgggaagcttgaagccggacggtccgcggatattacgctcattgatcttgaacgcgaagaaaaaattgataaaagcacctttctttctaaagggaaaaacacgccgtttgacggcatcagctgcttcggctggccggctatgacaatggcaaagggaaaactcgtttaccaagaggggagacttgtaaaatga

SEQ ID NO: 1672 - DNA, 1095 bp, Bacillus licheniformis
atgaaaagacgtcttatattagaaaacggaacgatttttgaaggggaagcattcggcagcctggaaaacaccatgggagaagtcgtcttcaacacggggatgacaggctatcaggaaatcctctcagacccgtcatactgcggacaaattgtcaccctgacctaccctttgatcgggaactacgggatcaacagagacgactttgaatccatcaccccttatgtaaaagggtttatcgtaaaggaattatgtcaacttccatcaaactggcgctctgcttatacacttgatgaatatttaaaaatgaaaaacatcccgggactctcagggatagacacgagaaagctgacaagaatgatcagaacggcaggtacgctgaaaggggtatttgccggccctgaagaagatgctggggctttggttcaaaagctgaaagaaacgaaccttccgaccgatcaggtcagccaagtatcaacaaaaacggcatatccgagccctgggagagggaagcgaatcgtgctcgtcgatttcggaatgaaacacggcatcttaagggagctgaacaagcgcaaatgcgatgtgatcgtcgttccccacaatataacggcagaagaagtgatgcagctgaagcctgacggcgtaatgctgtcaaacggacccggagatccaacggacgtaccggaagcgattgcgatgatccaaaacattctcggcaaggttccgctgttcggcatctgtctcggccatcagctgtttgccctcgcctgtggagcaaagacggagaaaatgaagttcggacaccgcggttccaaccatccggttaaagagcttgaaaccggcagagtatcaattacggctcaaaaccacggctataccgtatcgtctgttgaaaacacgccgcttgaagtgacccatgtggcgataaacgacgacacaatcgaagggcttaaacataaacacgaaccggcttttacggttcaataccatcctgaagcttcaccggggccggaagacgcaaaccatttatttgatcaatttttagacatgattgaaaccacagagaaagaaggggaagcggtatgcctaaacgcgtag

SEQ ID NO: 1673 - DNA, 3213 bp, Bacillus licheniformis
atgcctaaacgcgtagatatcaaaaagattttggtgatcggatcggggccgattattatcgggcaggcggcggaatttgattatgcaggcacacaggcctgcctcgctttaaaagaagaaggctatgaagttattctcgtcaactcgaatccggcgacgatcatgacggatacggaaatggccgaccgcgtgtatatcgaaccgctgacgcttgaattcttaacacggatcatccgcaaagagcggccggacgccatattgccgacattgggcgggcagacgggcctcaacttggcggtcgaactgtcagagcacggcatcttggctgagtgcggcgtcgaagtgctcggcacgaaattgtcggcgatccaaaaagcggaggaccgcgatttgttcagaagcttgatgaatgagttgaatgagcctgttccggaaagcgagatcatccactcgctcggcgaagcgcgcgagtttgtcgagcgcatcggtttccccgtcatcgtcaggccggcatacacgcttggcggaacaggcggaggcatctgctcaaacgaagacgagctgaaggaaatcgttgaaaacggcttaaaaatgagcccggttcatcaatgcctgcttgaaaagagcatcgccggctacaaagaaatcgagtatgaagtcatgagagactcgagcgaccatgcgatcgtcgtctgcaatatggaaaacatcgatccggtcgggattcataccggggacagcatcgttgtagcaccgagccaaacgctgagcgaccgcgaataccaaatgcttcgcaatgtctcgctgaaaatcatccgcgcgcttgaaatcgaaggcggctgtaatgttcagctggcgcttgacccggacagctttcagtactacatcatcgaggttaacccgcgggtcagccgttcttctgcgcttgcctcaaaagcgacgggctatccaatcgcaaagcttgccgcaaaaatcgctgtcggtttgtctcttgacgaaatgatgaatcctgttacaggaaaaacgtacgcgtctttcgaacctgcactcgactatgttgtgtcaaaaataccgcgctggccgtttgacaaatttgaatcagcaaaccgcaggctcggcacgcagatgaaagcgacaggcgaagtgatggcgatcggaagaacgtgggaggaatctctcctgaaagcggtccgttctcttgaagcggatgtctaccatctggaactgaaagatgccggtgagatctcgaatgaagtgcttgaaaaacggattaaaaaagcgggagacgaacggctcttttacctggccgaagcgttcagaagaggatacacagtcagcgacctccacgaattttcggcaattgacctgttcttcctccacaagcttgagggaatcatccgctttgaagagaagctgaaagccggacgcggcgacctcggccttttaaaagaagcgaaagagctcggcttttcagaccgctttatcagccttctctgggagatgcctgaacgaaagctttatgatcttagaaaagaagcaggcatcacgcctgtttataaaatggttgatacatgcgcggccgaatttgaatcggagacgccgtatttctacagcacgtatgaagaagaaaacgaatcggtcagaacggacaaaaacagcgtcatcgttcttggctccggtccgatccggatcggccagggggtcgaattcgactatgcgaccgtgcattcggtctgggcgattaaagaagccggctatgaagccattattatcaacaacaatcctgagacggtttcaacagacttcagcatatccgacaagctctactttgagccgcttactgttgaagatgtcatgcatatcatcgatttggagcagccgaaaggcgtcgtcgttcagtttggcggacagactgcgatcaaccttgccgacgagctcgcagaaaggggcgtcgccattctcggaacatcccttgaagatttggaccgcgccgaggaccgcgacaagttcgaacagacgcttgaaatgctgcaggtaccccagccgcttggaaaaacggcgacatctgtggaaggcgccgttgaaatcgcagccaatatcggctatccggtgcttgtccgcccatcgtatgtactcggcggacgtgcgatggagatcgtctaccatgaagcagagcttctccattatatggaaaatgcagtaaaaatcaatccgcagcaccctgtcctgatcgataaatatttgaccggaaaagaaatagaagtggatgccatttctgacggtgaaacggtcgtcattccggggattatggagcacatcgaacgggcgggcgtccactcgggggattcgattgccgtttacccgccgcaatccctttcagaggacatcaagaaaaagcttgaagcatacacgattaagctagcaaagggcttaaacatcgtcggcctgctcaacattcagtttgtcctttcaaaagatgaggtttacgtccttgaagtcaacccgagatcgagccgaacggtgccgtttctcagcaaaatcaccggcattccgatggccaatctcgcaacaaaggtgattctcggagggaagcttgccgatatgggctatacagaaggcctccaaaaagagcaggaaggcgtatatgtgaaagtgccggtcttctcgtttgcgaagcttagaagagtggatatcacgctcggaccggaaatgaaatcgaccggggaagtcatgggcaaagacagcacattggaaaaagcgctatataaaggactgatcgcttcaggcattcaaattccgaactacggctctgttctcctgacagttgctgataaagataaagaggaagggctgttgatcgccaagcggttccatgcgatcggctataaaatcttggctacggaaggaacggcaggctatttaagagatgcatccgtacctgttaaaaccgtcgggaaaatcggcgaagaaggtacaaatctccttgatgtcattcgaaacggggaggcgcagttcgtcgtcaatacgctgacaaaagggaagcagccggcaagggacggcttcagaatcagacgcgaatccgttgaaaacggcgttgcctgcctgacatcccttgatacggcggaagcgattttgcgggtgcttgaaagcatgagcttccgcgccgatcatatgccggcgattaaaatcgcccaaaaggcggccgtcagatga

SEQ ID NO: 1674 - DNA, 771 bp, Bacillus licheniformis
atgagaaaagggtatatgacagtccgttcaaacaagtgcatcgcggatcatatttatcaaatggtgcttgaaggggagattgccgaagtttgcggcgctcccggccagttccttcacatcaaggtctcagactccctcacgccgcttttgaggcggccgatcagcatcgctgatatcaacaaagccgcccggcaggtgaccatcatctttcgcaaagatggggaaggaacgagactcctttctttaaaacaggaaggagatcagctcgatgttctcggtccgctcggcaacggttttccggctgaatcgcttgaacaggggaaaacggctcttctcgtcggaggagggatcggtgttccgccgctttacgagctgagcaaacagctgacaaacagaggggtgcacgcgatccatgtgttaggatttgcttctgcaaaagatgtcttttacgaacaggaattcagccgtttcggccgggtgtatgtggcaaccgcagacggcacccgcggttcaaagggatttgttacagatgtcattgaaaacgaggggcttcagtttgactgcataatggcctgcggaccgacgccgatgctgaaagctttaaaacagcgctatccggataaagaggtatatctgtcaatggaggagcgcatgggatgcgggatcggcgcttgctttgcctgtgtctgccatacggaagaaagcgaaacgtcttatgtgaaggtatgccttgacggtcctgttttcaaagcccaggaggtgctgttatga

SEQ ID NO: 1675 - DNA, 936 bp, Bacillus licheniformis
atgcttgaaatcaatttgccgggccttcaattgaaaaatccgatcatgccggcctcaggctgcttcggattcgggagagaatttgcgaacttttacgatctttcgcgtctcggtgcgatcatgattaaagcgacgacgagcgagccgcgcttcgggaatccgacgccgcgcgtcgccgagacgcaagccggcatgcttaatgccatcggcctgcaaaatccgggtttaaaggctgtcatggaacgcgaattgccgtggctcgaacagttcgatacaccgattatcgccaatgtcgccggctcgcagatcgaggattatgttgaggtggctgaagaaatcagcaaagcgccaaacgttcatgcgctcgagctgaatatttcctgtcccaatgtgaaaaccggaggcatcgccttcggcacgcagccggaaatggccggcgagctgacgaaagcggtgaaagaggttgcgagcgtccccgtctatgtgaagctgtcgccgaacgtcgcgaacattaccgacatcgctcttgccatagaagaagcgggagcggacggtttgacgatgatcaacacgctgatcgggatgcggctcgacttaaaaacgggaaagccgattttggcgaacaaaaccggcggattatcaggacctgccgttaaaccggtggccatcagaatggtgcatgaagtcagccaaaaggtcagcattccgatcatcggcatgggcggcgtccagtcagccgaagatgtgcttgagtttttgctggcgggtgcgagcgcagtcgccgtcggcacggcaaacttcgttaatccgtttgcttgtcccgacatcatcgacgatttgccgcgcgttttagaaaaatacggataccgttcgttgaacgagtgtatcggaaggagctggaaggatgaacaatacgccgcccatcatcgcgcttga

SEQ ID NO: 1676 - DNA, 720 bp, Bacillus licheniformis
atgaacaatacgccgcccatcatcgcgcttgattttgcatcagcacaggaaacatatgcgtttttggaccggtttcaaggagaagagctgttcgttaaggtgggcatggagcttttttatcaggaaggacctgccatccttgaaaatctgcaggagcgcggctgccgcattttcctcgatctaaagtgccacgacattccaacgaccgtatacaaggcgatgaaaaggctggcgggatttggcgtcagtcttgtcaatgtgcacgcagcaggcggaaagcaaatgatggagtcggcgcttgaaggccttgaagcggggactccggcaggccaaaaacgcccttcattaattgccgtgactcagctgacaagcacgtcctcagaaatgcttcagcgtgagctcctgattgaaacgccgcttctcgatacagttgtccactacagccggctggctgaagaaagcggtcttgacggcgtcgtctgctccgttcatgaagccgaacacatttaccgggctgtgtctgtagattttctgaccgtgacacccggaattcgcatggcagatgacaaaaacaacgaccaggtccgggtggcgacgcctggctacgcaagggaaaaaggcgtgtcggcgatcgttgtcggccgttcgattacccaggcggaagatcctgtgtcagcctacagaagaataggacatgagtgggagggaaccaaggcatga

SEQ ID NO: 1677 - DNA, 630 bp, Bacillus licheniformis
atgaaaacagacattgcaaaccatttattaaaaatcaaagcggttttcctgcgcccgaacgaaccgtttacatgggcgagcggcattctgtcgcccatctactgcgacaaccgtttgacgctttcatatccggaagtaagagatgatatcgcttcagggcttgccggactgattcaagacaaatttcccggagccgagatgatcgccggtacagcgaccgcgggaatccctcatgccgcgcttgccgctgacaggctgagcctgccgatgtgctacgtcagaagcaaaccgaaggcgcacggcaaaggaaaccaaattgaaggggccgttgtaaaaggacagaaagtcgttgtgatcgaagatttaatttcaacgggaggaagcgttcttgaagccgccgccgccctcacagaggcgggatgtgaagtgctcggcgtcgccgccattttcacttacgggcttccaaaagccgccgccgccttcagcgaagcaggcgttgaataccacacgctgactgattacgatacgctgaccgaggctgcgcttgccggtggatatattactgaacaggatgccgccaaactgaaagaatggaaagcggatcctgaaagcaagtcttggatgaactga

SEQ ID NO: 1678 - DNA, 144 bp, Bacillus licheniformis
gtgaagacagatgaacagcttgaaaaggtgatcatcaaaatgaaagacatgctgaaagacatgaattacggatcgatcacattcgttgttcaggacggcaaagtcattcaaatcgaaaaaaatgaaaaaataagattgaaatag

SEQ ID NO: 1679 - DNA, 531 bp, Bacillus licheniformis
gtgaaaaaagatgcagttatcgtttttcttgatacagggcttcattttaaagaaacgtatgaaacgatcgacgccgtcaaagaacgatatccaggccttcagattatcatgaaaaaaccggagcttaccgtcgaagagcaggcgaaagaatatggggacgaactatggaagaccgctccgaattcctgctgcgaaatgaggaaggtcatccctctccgcgagacgctttcaggctacccggcgtggctgtctggtctgcgccgcgagcaatcgcccggacggagcaaaacgaattttttgaacaaagatgaaaaattcaagtctatcaaagtttgtccgctcattcattggacgtggaaggatatttggagatatgtgacaaagcacgatctcccatacaatccgcttcatgatcaaggctatccgagcatcggctgcgctccgtgcacctctccggcctttacaatggatgatcttcgatccggccgctggaacggatcggctaaaacagaatgcggattacacgagtaa

SEQ ID NO: 1680 - DNA, 1065 bp, Bacillus licheniformis
atggaacttgccgccattttatttagcatgttttttgcgatgaatatcggagcgagcggtgcagctgcttcaatggggatcgcctatggatctgaagctgtcaaaaagaagtttcacgccctcctgatctgtgcagcgggcgttctctcgggcgctgtcatcggcggaggaaacgtcgtgaaaacgatcagttcaggcatcattcccgaacgggtgatttcgcttgaaatcgtctgcattattatcggatcagcggcgctgtcgctctttatcgcaaatgtactcggcattccgctttcgacaagtgaagtgacagtcggatctgttgtcggagtaggtgtcgcataccaggttttgtatgtcaaatctttgcttgtcatcgtctcattttgggtcattgtaccaatcgtcgcttttgcatttacatttgcgatggcaaaaatcatgaaaaaaacgatcaaacgtccagcctcgggaaaaaaagcaaaggttttggcggtcattctattgatcacagggttttttgaagccttctcagcgggcatgaacaatgtcgcaaacgctgtcggacctctggtggcggcgcatgttttgacagtcggggaaggaacgctctacggcgggctgtttgtcgcgctgggcgcccttttactgggcaggcgcgttcttgaaacaaacggcaaaaagattacgaggttttcaaaaggagagggaatcatcctttccggaacgggggccgggcttgtcattaccagttcaattttcggtttaccggttccgcttgcgcaagtcacatcatcttctattatagggatgggaatggcaaaaaacggcggcaacgtctttcataaacaagtggtcaaaacgatgctgaaagtatgggtcgtctcgccgttcctttcattaagcctatcttatatgctggtcagccttttattaaaaggagactactacgctcttattgttgtcacaagcgttctgctggcatctgtcggaacgatcagcctgatgagagcggtcaaaaaagagcacagctccgtccatgaacaaggcggaggaatttaa

SEQ ID NO: 1681 - DNA, 1137 bp, Bacillus licheniformis
atgagtttagcaccacacggcggtgtattggttaaccgcgtcaatgaagcatacgattttcaacatatcgcacatgaaattgagcttgatgtaatggctttttcagatttggagctgatcggaatcggtgcgtacagcccgctccaaggctttatgacagagaaagactatctgtccgttttcgaaaatatgagactatcaagcggcgaagtatggacgcttccgatcactctgcctgttgacgagcaaaaagctttaagcttaaaagcgggtgacaccgtccgccttacctataatggggaaacctacggcgtcattgagatcgaagatatctatacgccggacaagaaaacggaagccgtcaatatctataaaaccgacgaactcgaacatccgggcgtcaaaaaattgtttgaccgcggcagcgtttatgtgggcgggccgatcacgctcattaagcggagtgtaaaacaattcccggcgcacacattcgaacctcttgaaacaagaaaaaaattcgcggaactcggctggaaaacgatcgtcggattccagacgagaaatccggttcacagagcgcacgaatacattcaaaaaacggcgctcgagacggtagacggccttttcctcaatccgctcgtcggggaaacaaaatcagacgatattccggctgatgtccgcatggaaagctatcaggtgctgcttgacggctactatccgaaagaccgcgtcttcctcggcgtttttccggcggcgatgcgctatgcggggccgaaggaagcgatcttccatgcccttgtgagaaagaactacggatgcacgcactttatcgtcggaagagaccatgccggagtcggcgattactacggcacatatgaagcgcaggagctgttcgatcagttcgcgccggaagaaatcggcattacgccgctgaaattcgaacacagcttctactgcaatgtctgcggttcaatggctacggcgaaaacgtgccctcacggcaaagaacatcatgtcattttatccggcacaaaggtgagggcgatgctgagaagcggcgagttcccgccgagcacattcagccgtcccgaagttattcaaacattaatcaaaggcttagcggccggggtttcttaa

SEQ ID NO: 1682 - DNA, 594 bp, Bacillus licheniformis
ttggtaaataaagatattgtctggcatgaagcgtccattacaaaacgggaatatcatgagaaaaatcaacataaaagctcaatcatttggctgacgggcttaagcggttcaggaaaatcaacgattgccaacgccgctgcgcgtgagttgtttgcacaaggctaccaggtcacggtgcttgacggcgacaacgtcaggcacgggctgaacaaggacctcgggttttccgatgaagaccggaaggaaaacatccgccggatcggcgaggttgcgaagctctttgtcgaacaggggacgatcgtcattacggcgttcatttctccttttaaagaagatcgcgggcttgtcagacagcttgtcgaggaagatgagtttcacgaagtctatgtgaaatgcgatttggcgacgtgtgaagagcgcgacccgaaaggcttgtacaaaaaagcgagaaacggagaaattccatttttcacagggatcgattcgccttatgaagagcctgaaacgcctgagcttgttcttgatacaggcgcacataaccgggaagagtgcaaaaaccagctcgtccaatacgtgaaagatcaaacgaaataa

SEQ ID NO: 1683 - DNA, 774 bp, Bacillus licheniformis
atggggaaagtatatatcgttggggcaggtcctggagaccccgatttactgacgatcaaagctttaaaagccatccagacagccgatgtcattttgtatgacaggcttgtgaataaacagattttacagcacgccaaggagggagcggatctcatctactgcggaaagcttccggactaccacatgatgaagcaggaaacgatcaatcattttctcgtcaagtatgcgaaaaaagggaaaaccgttgtcagactgaaaggcggcgatcctttcgtattcggcagaggcggcgaggaagcgcaaaccctcgctgagcacggggttgcttttgaaatcgtgccgggaatcacctcgggaatagctgccgctgcttatgcgggcattccggtgacacaccgggaagcgagttcaaacgttgctttcgtgacaggccattatcaaaaagaagaaaactttgaagagaagtggaaagcgttagccacagggatcgatacgcttgtcatttatatggggattaaaaacgtgaagcaaattgaaaggcttctgatcgaaaacggcagagacccgtcaacgccagccgctttcatccattggggaacgacagacaaacaaaaaacggtgctttgcacggttgaaacgcttgccggtacagtcgaaagcgaaaagattgaaaacccgagcctgattgtcatcggggatgtcgttcaattcagctcgcagttaagctggtttgaacctgagctgaaagatccggcattaagcgaggcgctttaa

SEQ ID NO: 1684 - DNA, 786 bp, Bacillus licheniformis
atgaaacaagcgattttatatatcggccatggaagccgtctgaaaagagcccaaacagaagcagccgcttttttggagagctgcaaagaaaacatgtccgcccccattcaggaaatatcttttttggaattggcggcaccggatatcgaaaccggctttaaagcgtgtgtggaaaagggggcgacgcatatcgcggccgtgccgcttctcctcttgacagccgcacatgccaaaagggacatccctgaagagcttgcccgtgcttcctcacagtacccttccgtcagcgtcgcttacggaaagccgatcggcgtcgatcaggaagtcgtcaaagcggtttttacaaggatcgaagaaacggggacgccatatgaacatgcaagagtcgtgttgatcggaaggggaagctctgatccggatgtcaaacgggatgtttatgatatttgcgaacggctgagagacctcacaccagtggatgaggtcattccctgctttatgacagcctgtgagccgcactacctggatgtgtttaaacagcttaaagaacgggacggaaaaacgacattcatcgttccgtatctgctgttcaccggtatgctgatgaacgagattgaaagggaaaccgcaaagctgaaagaaacgaatccgaatgtcgtgctgacggattacctcggcttccacccccatgtaaaaaacgcctttttgcaccgcgtagaggaagcggttatcaacaaagccggccgctttgattttacaggagcatcagatgctgccgctgcacattaa

SEQ ID NO: 1685 - DNA, 495 bp, Bacillus licheniformis
atgctgccgctgcacattaacatgaaaggcaaagccgcagtcattgcgggcggggggaagattgcggcgcggcggctgaaaacggtgctggcagaaggtgcatccgcgaccgtcatcagccctgaagcatcagaagagatgctcggattgattaacgaacacggcatcgaatggaagaagaaaaaggcggaacccggtgatttcaagaatgcatttctgatcattcttgcgaccgatgaccatgaggcaaacaagcgtctcgccgcatcggcagctcctgagcagctcgtcaatgttgcgagtgaagcggagctgggaaatgtatatgttccaaaaataatcaacagaggaaacataaccatatccgtctcaacaaacggagccagcccgcgccacacgatcaggctggccggacagatcgatgatttgatcgatgatgagctcgtccaagagatcgacgagcttttccgaaaaagaagaggcctgaacccttga

SEQ ID NO: 1686 - DNA, 1713 bp, Bacillus licheniformis
atgtcttttgacggcatttttacatacggaatgatcgaggaattaaatgaggcgattcgaggcggacggatcgcaaaaatccaccagccgtttaagcacgagctagtgtttcatatcagggcaaacgggaagaaccgcaaattgctgctctccgcccatccgagttatgcgcgggtacacctgacaaacgaaacctacgacaacccgagcacccctccgatgttctgcatgctcctccgcaaacatctggaaggcggctttatcgaccaagtcgagcaaatcggcatggacagaatgatggtctttcatatcaggagccggaacgaaatcggcgacacgctgacaagaaagctgatggtcgaaatcatgggcaggcacagcaacatcgtgttaacagacggagaaaaagacgtcatcatcgacagtttgaagcatctgtcacctgcgatgaacagctaccgcaccgtgctcccgggatacgattacattctccctcccgcgcagaacaaattgtctccgcttgaagcggagactgaagatattctccgccatctgaatttccaggaaggcaaacttgacaggcagatcgtcgataccttctccggcgtctcgcctctgtttgcgaaggaagccgtctttcgcgcgggtctagccaacagggcgacactgccaaacgtcttgacggagatgttcagcgaaatcaaaagccggcgttttcagccccagcttgtcaccacagaagacggaaaagaatatttttaccttcttgagctgacccatataaaaggagacaacaggccctttcatacgctgagcgaacttcttgaccgctactatttcggaaaagcggagcgtgaccgcgtcaaacagcaggctcacgatttagagcgtttcgcggcaaacgaaaagaaaaagaacgaaaataaaatcaaaaagctgaaaaaaacgcttgagcagtccgaacacgcgcaagactatcagctgtacggagagctgttgacagcgaacctgtaccagctgaaaaaaggggacaaagaggcgaaggtcatcaactactatgatgaaaacggcggagaaatcacgattccgctcaatcctaataaaacgccttctgaaaatgcacaaagctattttacaaaatatcaaaaagcgaaaaattcggtagaagtcgtgaaggagcagatcaaattggcagaagaggaaatcgcttatttcgaccagctgattcagcagctttcatctgcctcaccgaaagatataaccgaaattcgcgaagagctcgccgaaggaaaatacttgcgggccaagcagcaagggggccagaagaaacagaaaaaacaggcgccgacgctcgaagcatatgagtccagctcaggagaaacgattctcgtcggcaaaaacaacaagcagaacgaatatttaacgatgaagcttgccgcccgcgaccacatctggcttcacacaaaagatattccggggtcgcacgtcgtcattcaatcgaccgatccggacgagcaaaccattctggaagcggcgcagatcgctgcatattacagcaaagcgaaaaactccgcttcggttcccgtcgactatacaaaaatacgccacgtcaaaaaaccgaatggcgcaaaaccggggtttgtcacctacgacagccagcaaaccgtttttgtaacacctgatgaagacttgatcatcaagctgaaaaaataa

SEQ ID NO: 1687 - DNA, 2673 bp, Bacillus licheniformis
atgaaatggcacgagatgggacaaaccgaattgttaaatataacaaaaacgtccatcgacaaaggtctaacagaaaaagaggccggaaagcggctggaaagacacggaacaaacgaacttcaggaaggggaaaaaacatcggcggtcgcattgtttttttctcaattcaaagatttcatggttcttgttttgcttgcggccacgttgatttcgggtttcctcggcgaatacattgacgccatcgcgatcatcgcgatcatctttgttaacggcattctcggattctttcaggagaggcgggcggaaaggtcgctcgaggctttgaaagaactgtcagctcctcaagtggctgtgctccgggaggggaattgggtgaaaattccttccaaagagcttgtcccgggagatgttgtccgttttgcaagcggagacagaatcggcgccgatctcagacttgtcgagacaaagagccttgaaatagaagaatcggcccttacaggtgaatcgctccccgtgtccaaacaggcagatgcttttcaggcgtcagatgtatcgctgggcgatctgaagaatatggctttcatgggaacgcttgtcacaagggggagcggaatcggcgtcgtcatcggtacgggtatgaactctgcgatggggaaaatcgccgatatgcttgaatctgccgggaatacggcgaccccgctgcaaagaaggcttgaagagctcggcaaaattttgattgtcgccgctttgttcctgacactgcttgtcgttgctgccggcgtcattcaggggcatgatttatacagcatgtttttagcgggagtttcccttgccgtcgctgccatacctgaagggctgcctgccattgtcacggtcgctctgtctctcggcgtgcagcggatgatcaggcaaaagtcgatcgtcaggaagctgcccgcggttgagacgctcggctgcgcgtccattatttgctccgataaaaccgggacgatgacgcagaacaaaatgacggtcacccatgtctggtcaggcgggaagatatggaacgtgtcagggatcggctatgagcctgaaggctctttcagcatgaacgggcgcgatgtgcaagcaaagcatcataaaccgctccagcaggtactattgttcggcgcattatgcaattcatcttcgattatcgaaaaagacggggagtttcgtcttgatggcgatcccaccgaaggggctttgctgacggcggctcgaaaagcaggctttacggacaaatatgttgatgaacattttaaaatcatcgaggagtttccgtttgattcaacgcggaaaatgatgtctgtcattgtggaagacaagagcggcaagcgctttgtcattacaaagggcgcgccggatgtattgatgaagcgttcgtcgcatacgctgacagaagaaaagcgagaaatcttcacaaaggaaaggctcgctgaaacaagcgcggcgctggaaactcttgcgtcacaggcgctgagaacgattgccgtcgcgtataaaccgatcaaagatacagaaaatcccccgctcgaaaaagcggagtcaggcttaactttcatcgggctgttagggatgatcgatccgccgcggcccgaagtgaaaacagcgattaaagaatgccgggaagcggggatcaaaacggtcatgatcaccggggaccatgtgataacggcgacggcgattgcaaaagatctcggattgctgcctccgcgcggaaaggtcatggacggccagatgctgaacgaactctcgcaggaagaattggcggaaattgttgacgatgtttacgtatttgcaagggtgtcgcccgaacataagctgaagatcgtgaccgcctaccaggaaaacggccacatcgtcgccatgacgggagacggagtcaatgatgcccctgcgattaaacaggcggatatcggcatatcgatggggattacgggaacggatgtcgccaaggaggcgtcctcactcatccttgtcgatgataattttgcaacgattaaatcggccatcaaggaaggacgcaatatctatgaaaatattagaaagttcatcagatacttgctcgcatccaatgtcggcgaaattttggtcatgctgtttgcaatgctgctcgctctgccgctgccgcttgtcccgatacagattctgtgggtcaaccttgtaacggacggcctgcctgccatggcgctcggcatggatcagcctgaggacgatgtgatgcagagaaagccgcggagtccgaaagaaggcgtgtttgcaagggggctcggctggaaggtcgtatcgcgcggattcttaatcggaatcgcgacactcggggcgtttatgttcatttataaccgcaatccagaagcgcttgagtatgcacagacggttgcatttgcaacgctcgtccttgcgcagctgatccacgtgttcgactgccgaagcgagcggtccatctttgaccgcaatccgtttgaaaacatttatttgctcggtgcagtgctgtcttcgattcttttgatgcttgtcgttatttattatccgccgctgcagccgatttttcatacggttccgattttaatggcagactggctcctgattgtcggaatgtcggcgattccaacttttttactggccgggtcacttttgacaagaaaaaaatag

SEQ ID NO: 1688 - DNA, 864 bp, Bacillus licheniformis
atgaccggtttcggcagcgcgagcaaaacgaaggatgggctgacagcagctgttgagctgaaatctgtcaactatcggtttaaagaagtaaacgcccgcatgccaagacctttgctctatttagaagacaaaataaagcaaacgatttttaaacatatacaaagggggcggctggagctgtttgtttccgttgacgacgaggctctggtcacccggaaaatccaggttgactggccgctgcttgaagagtaccagaaagccgcgcgcgaaatgaaagaccgctgcgggctttctggagacatcacgcttcaagacgcctttcagtttgagcatgtcatccaagttgaagaagagccaatccaaaatgacaagcttgaagaggttcttctggaagcggtcgaggctgccgttctagaattgtgcagcatgcgcgaagcggaagggctgaggctgaaggacgactgccttcagcatattgaaaggcttgaaaagctgacagacgacatcgcagagcttgctcccaaggtcgtcgaccactatcgggaacgccttgaggcgcggcttgaagaatggtcaacagacggtctcgatgaaagccgcctgctgacggaagtcgcactgtttgcagaccgttcggatatcacggaagaagtgacgaggctgaaaagccatttccgccagttccgcgatatttgcaaagcgggaggagccgcggggagaaagctcgatttcctcgtccaggagctcaaccgtgaagcgaacacgatcggttcaaaagcgaatgatcaccagatcacaaaacatgtggtcgaaatgaaaagctctattgaaaaaataaaagaacaagtgcaaaatatagaatag

SEQ ID NO: 1689 - DNA, 270 bp, Bacillus licheniformis
atgacgattaaactgatcaatatcggctttggaaatatcatatccgcgaatcggctgatctcgattgtgagtcctgagtccgcgcctattaagcggatgatccaggatgccagagaccgcggcatgcttatagatgctacatatggaagaagaacccgtgcggttgtcattatggacagtgaccatatcatcttatctgccgtccagcctgagacagtagcacaaaggctttccgttaaagaagaaattatggatgaagggcagggataa

SEQ ID NO: 1690 - DNA, 639 bp, Bacillus licheniformis
atgaagggcagggataagagctttatgaaagaaagaggtttgttaatcgttctctccggcccttccggcgtcggaaaaggaacagtcaggcaggcgctgtttgctcaggaggacacaaaatttgaatattcgatttcggtgacgacaagaaaaccgcgtcaaggcgaaagagacggcgtcgactacttttttaagacgcgcgaagagttcgaagagatgatcgagaacaacaagctgctcgaatgggccgaatatgtcggcaactattacggaacacccgttgactacgtcgaacagacgcttgaaagcggaagggacgtttttcttgaaatcgaagtccagggtgcgctgcaagtcagaaaggcatttcctgaaggcttgtttatctttttggcgcctccgagcctcgccgaattgaaaaaccggattgtcacaagagggacagaaacagaagccacgatcgaaaaccggatgaaagcggcgaaggaagaaatcgaactgatggacgcctatgactatgttgtcgaaaatgacagcattgagcttgcgtgcgaaagaatcaaagcaatcgttctcgccgaacatttacggcgcgaccgagttgctccaagatataagaaaatgctggaggttgaataa

SEQ ID NO: 1691 - DNA, 201 bp, Bacillus licheniformis
atgctagatccgtcaattgactctttaatgaacaaactggattcaaaatacacgctcgttaccgtatccgcacggcgcgcccgcgaaatgcagatgaacaaagacgcgcagatcgaaaatccgaagtcgcataaatttgtaggcaaagcattggaagaaattgatgccggactgcttacattcgaaaaggaaaatcgctaa

SEQ ID NO: 1692 - DNA, 1218 bp, Bacillus licheniformis
atgctgaaaaatcgcaacatcctgctgggagtaagcggaggaatcgcggtatacaaagcggccgccttaacgagcaagctcgtgcaggcaggagccaatgtgaaagtcatcatgacaaaatccgcctgtgaatttgtgtctccgctcacctttcaggcgctttcgcgcaatgaagtatataccaatacgttcgaagaaccgaatccccgtgtcatcgcccatatcgatgccgcagattgggcggatctcgtgatcgttgctccggctacggccaatgtgatcggaaaactcgcctcaggcatcgctgacgacatgctgacgacgacgcttttggcgacgacagcgccggtgtggatcgctccggcgatgaacgttcatatgtacgaccacccggccgttcagcggaacatcagcgttctttacaaagacggctaccggtttatcgaaccgagtgaaggctaccttgcgtgcggctatatcggcaaaggcagactggaagagcctgagcggatcgtccagttggcagagtcgtatttttcaagcgaaaaaagcggtttgcttgaaggaaagcgcgtcgtaattacagcggggccgacaagagaacaagtcgatcccgtccgctttttctccaaccgttcgacagggaaaatgggctatgctttcgctgaggaagcggcacgaatgggagcgcacgtgacgctgattgcaggcccgacatcgcttgatgatcccgcaggggtcgacgtgattcatgttcagtccgcagaagatatgtatcaagcggctctgtctgttttcgatgagagcgacatcgtcattaaaacagcagctgtcgctgattacaggccaaaacatgtccacgatcaaaaaatgaagaaaaaggacggcggcctcgtcattgagcttgaacggacgaaggatattttaaaagcgctgggagagcggaaaacaaagcaaatcttggtcggctttgcagccgaaacgcagcacgtcgaagactatgccaaacaaaagctggagacgaaaaatctcgatatgattgtcgctaacaatatcacggctgaaggcgccggttttggaacggaaaccaacatcgtgacggtgtttcatcgagactgcaaaaagacggcgcatcctctaatgtcaaagcgggaggttgccgccgcagtcttgaaggaagccgctgagcttgccggacggagcgggacgtcttcatga

SEQ ID NO: 1693 - DNA, 2418 bp, Bacillus licheniformis
atgaacttcgctgaagtgatcgtcgatgttacaacgaaaaatatcgacagaccgtttgattaccgcatccccgacaaattcaaaggtatgattaaaaaagggatgcgcgtgatcgttccgttcggcgcccgcaaaatccagggatttgtcaccagcgtgaaagaatcgtcggagcttgccggccgttcggttaaggatatcgaggatatccttgatctggcgcccgttttgacggaggagctgcttgagctgtcagactggctgacagaaaaaacactttcttttaaaattacggctttgcaggcgatgctccccgcggctatgaaagcaaaatacggcaaagaaatcaaggtgatcggcgataaaccgcttcccgaaccgctaaaaaccttgttctcgcaaaaagagacgctttcttattccgatataaatgaccacggaacattaaagctgattcagcgccaggttcaagaaggcaatcttgaagtggcgtataaagtaaagcagaaaacaaacaaaaaaatgcggagaatgatcgcccccctttgcgcgaaagaacatttaaaagaagcgcttgccggcctctctccgcaagctgtcaaacaaaaagcgatccttcagtttttcatcgaccgcaaagagggcggcgctgttccggcaaaggatctgatcgacaaaacggggggctcttccgcgtccttgaaagcgctcatcgacaaggggctgttaaaggaaagcgaagaggaggtttacagggatccttatcaggacagaatgttcaaaaaaaccgaaccgcttccgctgactgaagagcaggcgcaggcctacgaggcgatagcggatgcaatcgaagaaaagcggcacgatgtgtttcttcttcacggagtgaccggaagcggaaaaacggaagtctatctgcaatcgatcgaaaaggtgctggaagccggcaaagaagcgatcgttctcgttccggaaatttccctgacgccgcagatggtcaaccgctttaaagggcgctttggctcgcaggtagccgtactgcacagcgggctttcaacaggagaaaaatatgatgaatggcggaaaatccaccgcaaagaagtccggcttgtcgtcggggcgcgctcggcgattttcgcgccgtttgaaaatctcggcatgattataattgatgaagagcacgaaacatcgtacaagcaggaggagatgccgagataccatgcgaaagaagcggcgattcaaagggccaaataccaccggtgtccggtcgtgctcggcagtgcgacgccgacgctcgaatcgttcgcgagggcgaaaaaaggcgtgtacaagcttctttctctcaagcaccgcgtcaatcaccaagtcatgcccgacgtgtctctcgtcgatatgagagaggaactgcgcagcggaaaccgctcgatgttttccaaagacttaatggccgggcttgaggaaactcttgaaaaaggagagcaggccgttctgtttttaaacaaaagaggctattcctcatttgtcatgtgcagggactgcggatatgtcatccagtgtcctcattgtgaaatttcattgacgtaccacaggtatggacagcgtctgaagtgccattactgcggctatgaaaccggcatgccgtcaagctgccccgaatgcggaagcgagcatatccgctactttggtacaggcacacagcgggtcgaagaagaattgacgaaggttctgccggctgcaagggtgatccgcatggatgtcgatacaacctcaagaaagggagcgcatgaaaagctgctcacatcctttggcagaggcgaagccgatatcctgcttggaacgcagatgatcgccaaagggctcgatttcgaaaacgtcacgctcgtcggtgtcttgagcgcggatacgatgcttcacatccccgatttcagagccgctgaaaaaacgttccagctgatgacgcaggtgagcggaagagcggggcgccacgaaaagccgggcaaggtgatcattcagacgtacacaccgtcccattacagcattcagctcacaaaaacgcatgattatgaaacattcttccggcaggagatgctgcacagaagggaacaggcctatcctccatattattatttggcgctggtcagcgtatcgcacgaggaagtgacgaaggcggcactcgtgactgaaaaaatcgccacctatttaaaaaagaacatttcaagcgaggcgaagattctcggccctgtcgcatctccgatcgccaggatcaaagatagatatcgctatcaatgcgtgataaaatacaaacaggaaaaccagcttacatcgttgcttaaaaacattatggatcattacaaacgagacattgaacaaaagcaattggcgatttcgatcgacatgaatccatatatgatgatgtaa

SEQ ID NO: 1694 - DNA, 483 bp, Bacillus licheniformis
ttggcagtaaaaccgatcgtaacgtatccggcggaggttcttgagacccctgccgaacccgttgcgtcttttgataaatcattaaagaaactactcgacaatatgtatgatacgatgcttgagctggacggagtcggactggccgctccgcaaatcggcgtttcaaaaagagcggcagtcgtcgatatcggcgatgacacgggaagaattgaactggtcaacccggaggtcatcgaagagagcggtgaacaaacgggtcctgaaggctgtttgagctttcctgatctatacggtgaagtgaagcgttccgattatgtaaaggtcaaggcgttcgaccgccgcgggaaaccgtttacgattgaagctgagggctttttggcgcgtgcgctgctgcacgaaatcgaccatttggacggtattttattcacatcaaaagtaacgcgctattatgatgcggaagaacttgaggaaatggaaggatga

SEQ ID NO: 1695 - DNA, 951 bp, Bacillus licheniformis
atgacaaggatcgtttttatgggaacgccggatttttccgtcccggtgctcggcacattgattgatgacggctatgaggtagtgggtgtcgtcacccagcctgaccgcccgaaaggcagaaaaaaggtgatgactccgccgcctgtcaaggaggaagcgctgcgccgcggcattcccgtgctccagcctgagaaagtgagggaagaagcggaaacggacaagattttggcgcttgaacccgatttaatcgtaacggcggcattcggacagatcctgccgaaaaagctcctcgattatccgaaatacggctgtatcaatgtccatgcctctcttctgccggagctgcgcggaggagccccgatccattacgccattctggaaggcaaagagaaaacaggcgtgacgatcatgtacatggtcgaaaaattggatgcaggcgatatgctcgccaaggttgaagttgacatcgaagaaacagataatgtcggcacgctccacgataagctgagcaaggccggagctgcgcttctttccgaaacggttccgagaatcattgacggttcggtaaccccggaaaaacaggatgaacagaaagcgacatacgcgccgaacattaaacgcgagcaggaactgatcgactggtctaagcccggcgaagtcctgtacaaccaagtcagaggcttgaatccttggcctgtcgcatacacggtcttaaacggccagacgctgaaagtatgggccgcgaaaaaatgccaagccttaaaacaggcagagccgggggagatcgtcaccgttgaaaaagacggcattgtcgtcgcaaccggaaatgacaccgcgttaaaattaacggaagtgcagcctgccggcaaaaaaagaatgaaggctgaagattttgtcaggggagcgggtcttcaagccggaatgaaattgggtcatgacgatgaaaaataa

SEQ ID NO: 1696 - DNA, 1353 bp, Bacillus licheniformis
atgacgatgaaaaataatgtgagagaagtcgcgcttgatgcactgattaagcttgaccagaatcaggcatacagcaatcttttgcttcagtctgccatgaaagcgaacgatttaagcgacaaagacagaggccttttgacagaactcgtttacggcacccttcagaataagctggcgcttgattatatgctgaagccgtttattaaaaagccggaaaaggtgaaagactgggtcatccatctgttgagaatgtcgctgtatcagatggaatacctggagaaaatccctgaccgggccgctctttttgaagccgttgaaatcgctaaaagacgcgggcataaaggaatatcttcatttgttaacggtgttctgcgctccgttcagagggaaggagtgccttcctttgcggatattgccgatccgattgaacgccttgcggttgagacaagccatccggagtggcttgtcagagaatggacggatgcctacgggttcgaagcggcagaacaaatctgccggattcatatgatcccgccgaagcagacgatccgcgtcaacaggctgaaaaacgaccgggatacgcttctttcccgtctgaatgaagcggggattgaggcggaagaaggcgacttgtccaaagacgctgtcaaactgctgaaaggaacgattgcgtccactccttttttcaaagaaggcgaagtcaccatacaagatgaaagctcaatgctagtagcgagagcccttggacctgagcggggagaaacagtgctggatgcatgcgcagctccgggaggaaaatccactcatatcggcgaactgctcgaagatacgggaaaggtcgtctccctggaccttcatcagcataaagtaaagctgatcaaagaagcggcaggccggattggactttccaacattgaagcaagagcgctggatgccagaaaagccggagaagtcttcgaaccggaacagttcgaccggatcctcgtcgatgccccgtgttcgggattcggcgtcatccgcagaaaaccggatctcaaatacagcaaaacgcccgaagacagcgcgcgtctcgccgggattcagcttgcgattttaaacgaaatcgcacctttattgaaaacaggcgggacattggtttacagcacatgcacaatggacccgaccgaaaatgaacaagtcatgcatgcttttttggaagaacacgacgaatttgaagcggaccccaccctcgccgagcggctgcccgaaaaagcggcgccgtatgtcaaggatggaagcattcaaatccttccccactactttggaacggacggcttctttatttgcagcatgagaaagaagggatcacaataa

SEQ ID NO: 1697 - DNA, 1086 bp, Bacillus licheniformis
atggaatcgaaacaaaaagtaagaaaagaattgcggacagaaagaccgtccatctattcttttgaaatagaagaactgaaaagctggctatcggaaaacggcgagaagccattccgcgccgcgcaaatattcgaatggctatacgaaaagagagtcacgtcatttgaaaagatgacaaacctttcaaaagagctgcggacaaagctgaatgagcatttcgtattaacgacgctgaaaacggccgtcaaacagacttcccaagatggaacaatgaagtttttattcgagcttcatgacggctacacgatcgagaccgtattaatgcggcacgaatatggcaattctgtttgtgtaacgacacaggtgggctgccggatcggctgtacgttctgcgcatcgaccctcggcggcttaaagcggaacctggaagccggagagatcgtcgcacaggttgtcaaagtgcagcaggcgcttgatgaaacagatgaacgcgtcagctcaatcgtcattatgggaatcggcgagccgttcgataattttcaggaaatgcttgcgttcttgaaaatcgtcaaccatgataaaggactgaatatcggagcgcgccatatcaccgtatcaacgagcgggatcattccgaaaatctacgagtttgcagacgaaaagctgcagatcaactttgcgatttctctgcacgcgccgaacactgagatcagaagccggctgatgccgatcaacagagcctacaagctgcccgatctgatgaaagcggtcgattactacattaagaaaaccggcagaagggttacgtttgaatacgggcttttcggcggtgtcaacgatcaggttgaacacgcggaagagctggctgaattgctaaaaggaatcaaatgccacgtcaacttgattccggtcaactatgtacctgaacgagactatgtcagaacaccgaaagaacagattttcgcctttgaaaaaacattaaagtctcatggagtaaatgtcacgatcagaagagagcaaggccatgatattgacgctgcctgcggacagcttcgtgcaaaggagcgccaggaagagacgaggtga

SEQ ID NO: 1698 - DNA, 765 bp, Bacillus licheniformis
ttgaaaacagccttaaaaacggacaggggaaaaatacgccagcacaatgaagacgatgccggcattttcacagaaaaaaacggactggtattagctgttgtctgcgatggaatgggaggtcatctggccggcgatgtcgccagcaggatggccgtctcagcccttcgtgatatttgggaggaaaccgaagaagtcccggcttcgccggctgaaagcgaagcgtggctgaaagagcagatttcagccgtcaaccaaaaacttttcgaccattcgagggcccacgaagagtgccagggaatggggacaacggtcgtctgcgctttatacacgggaaaaacgctgacggtcgcccatatcggagacagccgctgctatctcctgcaaggcggaagtttcatacagctgacggaagatcactcgcttgtcaatgaactcgtgcggactggggggatttcgaaggaggatgctgaacaccatccgcggaaaaacgtgctcacaaaagcgctcggcacagatcccgaagtgaaggtagaagcccacacatttgaaatcgaaccgggtgatcaagtgctattatgttctgacgggctgacgaataaagtggatgatgagacactgaaggatatgctcacgactctttcttctgcggaggagaaagcggatcagctcgttcagctggccaatgacaacggcggcgaagacaatatcaccgtcgcgctattggaacttccttctcaaattgaagaaggtgaagacaagtgttaa

SEQ ID NO: 1699 - DNA, 1974 bp, Bacillus licheniformis
gtgttaatcggcagacggatcagcggacgttacgaaatcctgcgcgccatcggcggcggggggatggcgaacgtttatttagcgctggacatcatcctcgaccgtgaagtcgcgattaaagtgctgcggtttgacttcgttcacgatgccgattttatcaggcggttcagacgggaagcgcagtccgctgcaagcctcgaccacccgaatatcgtcagcatttatgatgtcggagaagaagatgacatctattatatcgtgatggagtatgtcgaggggatgaccctgaaagaatacataaatcgaacaggcccacttcatccgaaagaagcggtccaaatcatggagcagatcgtatccgccatcgcacatgcccatgataaccagattgtccaccgggatattaagccccacaacattttgatcgaccatatgggccacattaaagtgactgatttcggcatcgccatggcgctcagctcgacgaccatcacgcacaccaactcggttttgggctctgtccattatttgtcgcccgaacaggcgagaggcggattatcgacgaaaaaatccgatatctactcgctcggcatcgtgcttttcgagctgctgacggcgcgtatgccgtttgaaggagaatcggcggtcagcatcgcgctgaaacatctccaatcagaaacgccgtcggtgaaaagatggaacccggccgtgccgcaaagcatagaaaacgtcgtcctgaaagcgatggcaaaagatccattccatcgctatgaagcggccgaagagatggaaaacgatttgaaaacggctttcgacccggaccggctcaacgaaaagcgcttcacgattccatccgatgatgagatgacgaaagcagttccgatcatcaagaatctgccggaaaacgggagcagctcgcaatccggcggcggagaagaggaagcggctccattatcaaaaaaagaaaagaagaagcaggcaaaagcaaacaagaagaaaaaaagaaagaaatggccgcttatattgctgacggtgtttttcgttctggctgcgtcagccgtcttggctttaacggtgtttccgtcgctctttattccgaaagatgtggccgttcccgatgttgccggccttgaatatgaagaagccgtcatcaagcttgaagacgaaggatttgaagttgatccgaatgctgaagacattgccgacgataaaattgaagaagggctgatcgtgaagacggaccctgcagccggcgatatcgtgaaggaaggttcaactgtcaagctatataaaagctcaggcaaagagaaaactgaagtcgatgatgtggtcggccagaaagtcgatgccgccaagaagcttcttgagcaaaaaggctttaaaaacatcaagacagaagaagtgcacgatgaagaagaagcgggaaccatcatcgaacaggaccctgcagccggaaccgaaatcgttgccgccgacgacgaggtcaaattaacggtcagcctcggtccggaagccattactttaagggatttaaaaacatacagcaaacaggcggcttcgggctatttggacgaccatcagcttgtccttgtcgaaaaggaggcgcattctgaagacgtgccggaaggtcaggtcattaaacaaaagccggaggcgggggcatcagtcaagccgggagacaaagtcgaggtcacgttttcgctcggacctaaacaaaagcccgtcaaaacggtgaccgagaaaattgatattccttatgaaccgggagcggcgggcgaagaacaaaacgtccaaatttcgatcgatgatgaagaacacagcatttctgacgtctacgaaaatttcaaaatcacagcgccggcagagcggacgatcaaattcaggattgcgcccggccaaaaagggtattatcaagtaacgatcaacgataaagtagtcaggtcaaaaacgattgaatatcctgaggatgaataa

SEQ ID NO: 1700 - DNA, 885 bp, Bacillus licheniformis
atgcctgagggcaaaatcattaaagcattaagtggattttactatgtattggatggcgatcaggtcattcagtgcagaggaagaggggttttcagaaaaaataaagtaacccctctcgtcggcgacgatgttgtctaccaagccgataacgataaggaaggctacattctcgagattaaagacagattcaatgaattggtcagacctccgatcagcaacgtggatcaggcggttctcgtgttttcggcaaaggagccgacattcagcacgtcgcttttggatcgttttttagtgctggttgaggcgggtgatattaggccgatcatatgcatcacgaaaatggaccttgtggatgatgacgcgctgaaagagcagattcatcaatatgccgaagactaccggaacatcgggtacagcgtctatttgacatcaatgaaaagcggaagaggcatcgaagacatcatcccccattttcaggataaaatcaccgtattcgccggccagtccggcgtgggcaagtcttcgcttttaaatgcgatcagccctgaccttgaactgaaaaccgccgggatttccgcccacttgggaaggggaaaacatacgacgcgccatgtggagctgatcgatataaacggcgggctcgtcgcggacaccccgggcttcagctcgcttgagtttgccggtattgaagctgaagatttagggcagacatttttggaaatcggcgaaaagagcgccgaatgcaagttccgcggatgcctgcatataaaagaaccgaactgcgccgtcaaacgcgccgtggaaaacggtgaaatcgcccagtatcgctacaaccattatgttgaatttttaacagagatcaaagatagaaagccgaggtattaa

SEQ ID NO: 1701 - DNA, 657 bp, Bacillus licheniformis
atggtatatgttgctccttctattctttcagccgattttgcccgtctaggggaggaaattcgagatgttgaacaaggcggcgccgatttcatccacatcgatgtgatggacggccatttcgttcccaacctgaccatcgggccgcttgtagtggaagccgtccgcccgatcactgagcttccgctcgacgttcatttaatgatcgaagcgcctgaccgctatatacctgcttttgcaaaagcgggcgccgatattttgtccgtccatgttgaagcatgcccgcaccttcacaggacgatccagctcatcaaagagcaaggggtcaaagcgggagtcgtcttgaatccgcatacccctgtgcagcagatcgagcatgtgcttgaagaccttgatctcgtattattgatgacggtgaatccgggcttcggcggacagtcgtttatttcctcggtcctgccgaaaatcaggcaggtcaaggagatggctgagcaaaaaggacttgccgatctgctgattgaagtggacggtggcgtcaacaaaaatacggcaagacagtgtattgaagcgggagcgaacctgcttgtcgcaggatctgccgtttataacgaaaaagaccgcaaaaaagccatttccgatataaaaggtgcgcttgggtaa

SEQ ID NO: 1702 - DNA, 645 bp, Bacillus licheniformis
atgaaaacgatcaatattgtagcgggaggccccgatcatcttattcccgacttgctgcagtatcaggccggggatgcgctttgggtcggggttgacagaggcgctgtcacccttttggatgcggggatcgtgcctgatgaagcattcggggattttgacagcatcacagacgagcaaaaaaaagcgattgaaaaggccgctccccgcctccatatttatcaggcggaaaaagatcagacggatttggaccttgcgttgagctgggctgtcggacagcgtccttcatttattagaatgttcggcatttcgggaggcagagcagaccattttctcgggaatctgcaccttctttataccgcgatgaagcaaaacgtcaagaccgtcatgatcgaccgccaaaatacgatcagcatgcatcccccaggctcctataccgtcatgcatgatcaaacaaaaccgtatatttcattcctgccgtttgcggagacggtaaaaaacctttctctcgaaggatttaagtattctttaaataagtgtcatattgctctcggttcgacactatgtattagtaacgaactcatccattcacaaggtgctttttcgttttcagaaggcatattaataatgataagaagcactgattaa

SEQ ID NO: 1703 - DNA, 81 bp, Bacillus licheniformis
atgaaattttacaccatcaaattaccgaagtttttagggggaatcgtccgggcgatgcttggctcgtttcgcaaagactaa

SEQ ID NO: 1704 - DNA, 189 bp, Bacillus licheniformis
atggcacgtaaatgcgttattacaggcagaaaatcacgttctggcaactctcgttctcacgcgatgaacgcttctaaacgcacatggggcgctaacgttcaaaaagtgcgcatccttgtgaacggcaagcctaaaaaagtatatgtatctgctcgagctttgaaatctggaaaagttgagcgtgtataa

SEQ ID NO: 1705 - DNA, 363 bp, Bacillus licheniformis
gtgtccattgaattccgaacaaaatacggacagattgatatatcaaacgaagtggtcgccatggttgcaggaggcgcagcgatcgactgctacgggatcgtaggtatggcatccaagaaccaaattaaagacggactgactgaaatcctcagaaaagaaaactttgcaagaggcgtcatcgtccgccaggaagaggatcgtattcatattgacatgtacatcattgtcagctacggaacaaaaatttcagaagtggcacataatgttcaaacaaaagtcaaatatacgctcgaccatacagtgggtcttgcagtggattccgtaaatatttacgttcaaggagtacgagtgacgaacccgtag

SEQ ID NO: 1706 - DNA, 1671 bp, Bacillus licheniformis
gtgtctatacgaaatctggatggaaaagcttttgcagatatgattctgtacggcgcacaccatctgtctcaaaacgcaaatgtagttgatgcgttaaacgtatttccggttccggacggagatacgggaacgaacatgaatctgtcgatgacatccggtgcgaaagaagtggagcaaatcgacaccgccaatatcggcaaagtggcacaaagcctgtcaagggggcttctgatgggggcgcggggaaactcgggcgtcattttatcccagctgttcagaggctttggcaaatcgattgaacagaaatcggaaattaacgcgaaagaatttgccgccgcgttccaggccggagtggacaccgcctacaaggccgtcatgaaaccggtcgaaggcacgatcttgacggttgccaaagatgccgcaaaaaaagcagtgctcgccgctcaaactgaaaccaatatcatcaaggtgatggaagctgtcgtaaatgaagcggaggcttctttggagcggacgcctgagctgcttccggttttaaaggaagtcggtgtcgtcgacagcggcggaaaagggcttctttacgtgtatgaagggtttctcgcttctttaaagggagaaaagctttctgataaagcggcagctcttccgtcattggatgaccttgtcagcgccgagcaccataaaaacgctcaaagccacatgaatactgaagacatcgaattcggctactgcacggagtttatggtaaagctcgacagcggtaaaagaaactttaatgaagttgcgttccgccaggatttaagccgcttcggtgattcgcttctcgtcgtctcagacgaaaatatcgccaaggtgcacatccatgccgaatatccaggggaagtcatgacttacgcgcaaaaatacggcagcttaatcaacatgaaaatcgaaaatatgagagaacagcacagcgcgattctcagccagaacaaacaggagacagcaccggcagaaaaagcgccggcagataaacagccgtacggcatcgtcacagtggccatgggtgaagggattgccgagcttttcgaaagcatcggcgccacaaaggtcatagaaggcggccagacgatgaatccgagcacggaagacatcgttcaggcgataaaagacgccaatgcggacacggtcgtgattctgccgaataattcaaacattgtcatggcggcgaaccaggccgcggatgttgccggacaacatgtaattgtcatcccgacgaagaccgttcctcaaggaatggccgcactgctcgcattcaacccggccctttcagcggacgagaatgaagccgctatgctcggtgcgatcggcgaggtgaaaagcggacagatcacctatgcggtcagagacacaaacattgacggcatcgatattaaaaaaggcgattttatgggcatattaaacgggaaaatcgttgagacggcgtcagaccagttaacagcagcgaaaaagctgatcgcaggcatgatcgatgaagacagcgaaatcgtcaccgtgatcaaaggggaagacgccccggaagaagaggccgaagaactcgcagcctacatcagcgagacgtacgaagacgtcgaagtagaagtgcacgacggaaaacagccgctgtattcctacattctggctgtcgaataa

SEQ ID NO: 1707 - DNA, 663 bp, Bacillus licheniformis
atgaagtacagaagtgtgtttgatattatcgggcccgtcatgatcggaccgtcaagttctcatacggccggcgcggccagaatcggcagagtcgccagaagcgtgtttgggagggagccgaaacaaattattgtatcgctctacggttcttttgccgaaacgtataaaggacatggaacagatgttgcgatcatcggcggccttttggattttgatacatttgatgaaagaatcaaagattcgatccgtctagccgaagaaaagggaatcgccatcgagttccgggaagaagaagcggtaccgaagcatcccaatacagcccgcatcctcatctctgatgatgaaggctcccttgaactcgcaggcatctcaatcggcggagggaaaatcgagatcattgagctgaacggcttcgaactcagattatcgggtaatcaccccgctattttagtcgtccataacgaccgctacggaacgattgcaggcgtagccaatgtgcttgcgaagttcgcaatcaacatcggccatatggaagttgcccgcaaagacgtcggccaggaagcgctcatgacgattgaggtcgatcaaacgattgatccggctgtttttgatgaattgagagcgctgccgaacatcattgaggtgacccagatcgctgactaa

SEQ ID NO: 1708 - DNA, 903 bp, Bacillus licheniformis
atgtttcgaaatgtgaaagaattaattcaactgacaaaggaaaagaacgtgtccatctctgaaatcatgatcacacaggagatcgaggtgacaggccggacgcgggaagatatattcaagcagatggaagccaacttggctgtcatggaagacgctgttcaaaaaggcattgagggcgtcgtatcgcactccggattgacgggcggagacgccgttaagcttcaggcctaccttaaatcgggcaaagggctgtcaggggatgtcatccttgacgctgtcagcaaagcggtagcgacaaatgaagtcaacgctgcgatgggaacgatttgcgcaacgccgacagccggatcggccggcgttgtcccggggacgctctttgcggtaaaagagaaacttcacccgacgaaagagcagatggtccgctttttatttacatcgggagcgttcggattcgtcgttgccaacaatgcgagcatttcgggagccgccggaggctgtcaggctgaagtcggatcggcctcgggcatggcggctgccgccatcgtcgaaatggcgggcggaacccctgaacagtgcgccgaagcgatggccatcgctttaaaaaacgtactcggtctagtctgcgatcctgtcgcagggctcgttgaggtgccgtgtgtgaagcggaacgcgatgggcgcagccaatgcgatggtcgcggctgatatggcgcttgccggcattacaagccgcattccatgcgatgaagtgatcgatgcgatgtacaaaatcggacagacgatgccgacggcactgagggaaacaggccggggcggtcttgccgcaacaccgacgggcaaagaattggagaaaaaaatattcggaggagcgtcagctgcacgtggaacacaatctgcaacttag

SEQ ID NO: 1709 - DNA, 2049 bp, Bacillus licheniformis
gtggaacacaatctgcaacttagtatatctgttataaaaggcgtcgggacggaaacggaaaaaacgttgaacgagctcggaatctatacggttctcgatcttttaaactacttcccgtaccgatatgacgattatgaattgcgcgatttggaagatgtggcacacgatgaacgagtgacggtggaagggaaggttcacagcgagccttctcttgcctattacgggaaaaagcggagccgtctcacgttccggcttttggtcgggaactatttgatcacagcggtttgctttaacaggccttatttgaaaaaaaagcttgcgatcggctcgattgttaccgtaaccggaaaatgggacaagcacagacaatccgtgatggtgcaagagctgaaaaacgggccgcaccagggtgatcagtcgattgaacccgtatactccgtcaaagaaaacatcaccgtaaagacgatgaggaaattgattcaggaagctgtccgcagccatttgccgtttgccgaagatcctcttccggaaaagcttcggaccgcctacaaacttctgtcttaccaggaggcggtaaaggcgatgcacaagcccgagtcgagggaagctttaaagcatgcgcggcgccgttttgtatatgaggaatttttgctgtttcagctgaaaatgcaggctttgcgaaagttcgagcgggaagcgtccgacggaatcagccacacctttcggctcgaagacgtcaattcgtttgtcaaaagccttccgtttcctttgacaaacgcgcaggcgaaagcgctcgacgacatattaagggacatggcttcagggtataaaatgaatcggcttttgcaaggagacgtcggttcaggcaaaacagccgtcgccgcgattgcgctatacgcctcgctgctttccggattccagggggcgatgatggtgccgaccgaaatactggcggaacagcacgccgattcgcttgtatccctctttgagcagcacgacgtcaatgtggcgcttttaacaagctctgtgaaagggaaaaggagaagagagcttttagaaagattaaaagaaggagaaattgatattttggtggggacgcacgcccttattcaggacgatgtccactttaaacagctcgggctcgtgatcaccgatgaacagcaccgcttcggcgtcgagcaaagaaaaaaactgagaagcaaagggaaagatcccgatgtcttgtttatgacggcgacgccgattccgagaacactggcgatcacggttttcggggaaatggatgtgtccgtcatcgatgaaatgccggctgggcgaaagcggatcgagacgtattgggtaaagcacgacatgctcgaacggattctcgcgtttatcgataaagaactgaaaaaaggcagacaggcgtatgtgatctgtcccttgattgaagagtcggacaagctcgacgttcaaaatgcaattgatgtgcacagcatgctgactcatgccttcaggggaagatggcagatcggtctcatgcacggaaagctgtcaaatgacgagaaagaacaggtaatgaggcagttcagcaaaaacgaatgccagattctcgtttccacaaccgtcgttgaagtcggggtaaacgttccgaatgcgacggtcatgctgatctatgatgccgaccggttcggtctttcccagctgcatcagcttcgcggccgggtcggacggggcgatcaccagtcgtattgcatcctgatggcagacccgaaatctgagacgggaaaagagcgcatgagcatcatgtctgagacgacggacggctttgagctttctgaaaaagatcttgaactcagagggcccggggactttttcggcaagaaacagagcgggatgccggagtttaaagtcgccgacatggttcacgactaccgcgcgctggaaacggcaagaagagacgctgcagaacttgtctcttcaaaagcgttctggacggatgccgaatataaaagcctgcgggaacacttgcaaaacagcggggttatggacggagagaagctgagctga

SEQ ID NO: 1710 - DNA, 567 bp, Bacillus licheniformis
atgagaaaaagtaagagagaacgccaagaattgctgcagcagacgattcgtacgaccccgtttattacggacgaggagttagcggagaaatttaacgtcagcattcagacgattcgcttggaccgtttggaactttccatacctgaactgagagaaagaatcaaaagtgttgccgagaagtctcttgaagatgaagtcaagtcattgccgcttgacgaggtcatcggcgagatcattgatttggagctggatgagcacgcgatttcaattcttgagatcagaagggagcatgttttcagccgaaatcaaatcgccagggggcaccatttgtttgcccaggccaactcgctcgccgtcgccctcatcgacgatgagctcgcattgacggccaaagcggacatccgctttacaaggcaggtcaagcaaggcgaacgggtcgttgcaaaagcgaaagtcgtgaagcttgataaagataaaggcagaacggttgttgaagtgaacagctatgttgccgaagagcctgtgttttcaggcgaatttgtcatgtatcgttcaaaacaatcatag

SEQ ID NO: 1711 - DNA, 993 bp, Bacillus licheniformis
atgaaaattgctgtagatgccatgggaggagacaatgctcccaaagcggttattgaaggcgtgatgaaagcggtcgaagattttgaagacctcgagatcacgctgatcggcgaccgggaaaaaatagccgcccatttaacagaacacgggcggatcaccgtcaaacacgcggaagaagtcatcgaagcgacagacgagccagtcagagccgtcagaagaaagaagaattcatcgatggttctgatggccggagaagtcgccgaaggcagggctgatgcctgcatttccgccggaaacaccggagcgcttatgacggccgggctctttatcgtcggccggattgaagggattgaaaggcctgcgttggcaccgacattgccgaccgtctccggagacggctttctccttcttgatgtcggagcgaatgtggacgccaagcccgaacatctcgttcaatacgccattatgggatctgtttacggagaacaggtgctgggcgtcaaaaatccgcgcatcggacttttgaacgtcggaaccgaagataaaaaaggaaatgagcttgccaagcagacctttcaaaaattgaaggaaaccgatttgaatttcatcggcaatgtggaagcccgcgatatgctggacggagtcgctgatgtcatcgtcacagacggctttaccggtaacgttgccttgaaaacggtcgagggcgcggcgctgtccatttttaaaatgctgagaacgacgctgacttcgagcttcacggcgaagctcgccgcttctgcactgaagccgaagctgaaagaaatgaaaacgaaaatggattactctgaatacggcggagccggattgttcggcttaaaggcgcccgtcatcaaagcgcacggatcatctgacggacgcgccgtttatcacgcgatccgccaggccagagagatggtcagccaaaatgtcgcggcatttatcgaagaaaaaattcaacaaaaagcagatgaatag

SEQ ID NO: 1712 - DNA, 960 bp, Bacillus licheniformis
atgggcaagattgcttttctattcccgggccaaggttcgcagcatatcggcatgggacacgaattgtatgaaaaagaaccgaatgcgaagaagatttttgaagaagcggatcaaacgcttgaaacaaaactgagcaccctcatgtttgaaggggatgcaaaggaactgacgcttacatacaacgcgcagccaagccttttaacggcgagcatcgcagcgcttgaaaaactgaaggaatacggcattaaagccgactatgcggcaggtcacagcctcggcgaatacagcgcattggtcgctgccggcgccttgtcgtttaaagatgcggtttatgccgtcagaaagcgcggcgaattcatgaatgaagccgtgccggcgggagaaggcgcgatggcggccattctcggcatggacagccaggcgctgaaagaagtgacggacaaaatttccgaagaaggaaaccttgttcagctcgccaatttgaactgccctgggcaaatcgtcatctcgggaacagctaaaggcgtggagctcgcttcagagcttgcgaaagaaaagggcgcaaaacgcgcgattcctctcgaagtcagcgggccgttccattctgagctgatgaagccggcagctgataagcttcgtgaagttcttgatgcgtgcacgatcaacgacgcagccattccggtcgtctccaacgtaacggccgactttgtaacggataaagacgacattaagaataaactgattgaacagctgtattcccctgtacgctttgaagaaacaatcagccgcctgattgacgaaggcgtcacgaccttcattgaaatcggtcccggaaaggttttgtcagggcttgtgaagaaagtgaaccgcagagtcaaaacgattgctgtatcagacccgaacacaattgaacttgccgttcaaacgttgaaggaggaaaacgaaaatgctggaaaataa

SEQ ID NO: 1713 - DNA, 744 bp, Bacillus licheniformis
atgctggaaaataaaacagccgttgtgacaggagcctcaagaggaatcggccgcgcgatcgccctggacctggcgaaaaacggagcaaatgtcgtcgtcaactacgcgggaaatgaagcgaaagcgaacgaagtcgtagacgaaatcaaagcgctcggccgcgatgcgtttgcttttaaagcggacgtttccaatgcggatgaggttcaggcgatgatgaaggaagcggtcggacgcttcggcacgcttgacatccttgtcaacaatgcgggcattactaaagacaatctgttcatgagaatgaaagaagatgaatgggacgacgtcattaacataaacttaaaaggtgtgttcaattgttcaaaagctgtgacaagacagatgatgaaacaaagaagcggccggatcatcaatatcacctcggttgtaggcgtcgtcggtaacgccgggcaggccaactatgtcgcggctaaatcaggcgtgatcggcttgacgaaaacgctggcaaaagaactggcgtcaagaaacatcactgtgaatgcgatcgctccgggattcatttcgacggaaatgacggacaagctgacaaaagacattcaagacgaaatgctgaagcagattccgcttgcgcggttcggcgagccgtctgacatcagcagcgccgttgttttcctcgcatctgaccatgcgagctacatgaccggccagacgctgaacatcaacggcggaatggctatggtttaa

SEQ ID NO: 1714 - DNA, 234 bp, Bacillus licheniformis
atggcagacgcattagagcgtgtaacaaaaatcatcgtagaccgcctcggcgtggatgaagctgacgtcactcttgaagcttcttttaaagaggatttaggcgctgattccctggatgtagttgagcttgtcatggaacttgaagacgagtttgatatggagatttctgacgaagatgctgaaaagattgcaacagtcggtgacgctgtgaactacataaatagtaagcagtaa

SEQ ID NO: 1715 - DNA, 546 bp, Bacillus licheniformis
ttggaactgacgatttctcaatttttatacgccaaatacccggcgatgagcgagggtgatttgacgaaattgagagcggcgatcgtatgcgagccttctttggtttccctggcccatgagctttctttcggagagcttgttctattgggaaaaggagaggaaatgactggaggaagaaagcgtccggcgcttttagccgatgtgtttgaagcttttatcggtgcgctctatctggatcaggggctcgaagccgtcgtgacttttctgaaagcgtacgttttccctaaaatcgacgatggtgctttttctcatgtgatggattttaaaagccagctgcaggaatttgtacagcgcgacgggcgaggcatactggagtataaaatccttcaggaaaaaggaccggcgcacaaccgcgaatttgaagcaaatgtatcgctaaaaggagaagtacttggggtgggaagcggccgttccaaaaaagaagctgaacagcatgccgctcaagaagcgctcgcgaagctgcaaaaacaccatatgaaacaataa

SEQ ID NO: 1716 - DNA, 3561 bp, Bacillus licheniformis
atgttcctcaaacgtttagacgtgataggatttaaatcgtttgcagaacgaatttctgtagattttgtaaaaggcgtgacagccgtcgtcggcccgaacggcagcggaaaaagcaacatcaccgacgcgatccgctgggtgctcggtgaacagtccgccaaatcgctcaggggcggcaagatggaagatatcatttttgccggcagcgactcgcggaaaaagctgaaccttgccgaagtgacgctgacgcttgacaacgatgaccgctttttgccgatcgattttcacgaagtcagtgtgacgagaagagtctacagatcgggggaaagcgaatttctcatcaacaaccagccgtgccgcctgaaagatatcatcgatctttttatggattcagggcttggaaaagaagcgttttccatcatcagccaaggcaaagtcgaagagattttaagcagcaaggctgaagagcggagaagcatcttcgaagaagcggccggcgtattaaaatacaaaacgagaaagaaaaaagccgaaaacaagctgtttgagacacaggacaatttgaaccgggtcgaagacatcctccacgagctcgagggacaggtggagccgctgaaagtgcaggcatcgatcgccaaagactaccttgaaaagaaggatgagcttgaaaaaatcgaaatcgcgttaacggcgtatgacatcgaagagcttcacggaaaatgggaagcccttcagcaaaaagtcgaaaaggcgaaagacgaagaaatgtcctcttctgcggccatccaggcaaaagaagccaaaatcgaagaggcaagagacaaaattcaagcgctcgacgaatcggtcgatgagcttcagcaagtgctgcttttgacaagcgaggaactggagaagcttgaaggccggaaagaagtgctgaaggaacgcaaaaaaaacgccacgcaaaacagagctcagcttgaagaagcgatcgtccagcgcagtgaaaaagagcgaaccctgaaagagaaaatcgccgcgcagaagcttgtgtttgaaaagctcgagactgaagcaaaagagcttgcccgacaggtgaaagaaaaaaatcaggctttatccggatacagcgaaaatgtagaggaagaaatcgaacagctgaaaagcgattatttcgagctgttgaacgaacaggcttccgtccgcaacgagcttcaatttcttgaagaccaaatgacccaatctgcggcacagcagaaacggctcgcacaaaacaatgaaaaatatttaagcgagcggaaggaaatcgccgaccaaaagatgaaaaccgaacacgaattcagcctcgtggacgagcgtcttcacagccagattcaagcattcagggacgcgcaaaaaagctatgaacagaaaaaaagccagtacgaaaaaaaggaatccgccctttaccaggcttatcaatacgttcagcaggcgcgctctaaaaaggaaatgcttgaagcgatgcaggaggacttttcggggttttatcaaggcgtcaaagaagtattaaaggccaagagcgagcttccgggaattcgcggcgcgattgcagagctgttaaagacggacgagcggtatgaaacagcgatcgaaatcgcgctcggcgcaacagcacagcatgttgtcacagaagatgaagacgccgccagacgggcgattcaatatttgaaaaagcattcgttcggaagggcgaccttcctcccgctttccgtcatcaaagagcgccgcatccagccgagagacatcgagacggcgaaagaaaacccgtcgttcatcggcatcgccagcgagcttgtttcatttgatccggcctaccggagcgtcgtgcaaaatctgctcggcaccgtgctgatcaccgagcatttaaagggcgccaacgaccttgccaagcggctcggccacagataccggatcgtcacccttgaaggggatgtcgtcaatccgggcggttccatgacgggaggagctgtcaagaaaaaaagcagctcgcttctgggacgaaacagggaactggaagcccagacaaaacgcctcgccgagatggaagaaaaaaccgaattgctcgaaaaagaagtgaaagccctgaagcagaccattcaggagcttgatgccaagctacagtcacttcgggaggacggagaacgcctaagatccgagcagcaggaaatcaaaggccgtctgtacgaactcgaaatcgccgagaaaaacgtcaacagccatttggagctctatgaccaggaaaaatcggctctgcttgaaggggacgaagacaagaagtggcgtaaagaagagcttgaagaaaagctcgcatcgatcgccggcgagctgcagcgccttgattccgaaatcgaagccatgacggagcggaaacagacgcagacctcgacgaaagaagcgttgcaaagcgagctgaccgatttgaaagtggtgctggcgaaaaccgaacagtcgtgtgcaaacgaacgggaaaagctcgcaaggcttgaagaagagtatgccgagaatgcggaagcgctcaaggtggccgaagaggatctttctttcttaacgacagagatgtcctccaattcttccggtgaggaaaaacttgaagaagctgcgaaaaagaagctgaacgataaaaataaaaccgcagagctcatcgcctcaagaagagaacagcggatgaagctgcaaaaaggccttgaaaccgaagagctcgaactgaaagaaatgaagcgccagtataagcagatggccggtctcttaaaagatgaagaagtcaagctcggccgcatggaagtcgagctcgacaacctgctctctttcctgcgggaagagtacggcctttcatttgaaggggcaagggaaaaatatcctttggagctttcccctgaagaagcgaggaagcgcgtcaagctgatcaagcttgcgatcgaagagctgggaacggtgaaccttggcagcattgaggaattcgaaagggtcaatgaacgctacctcttcctttcagagcagaaagacgacctgctcgaagcgaaaaatacgctctttaaggtcatcgaggaaatggatgaggaaatgacgaagcgttttgcggaaacatttgcgcagatcagctcccattttgaagacgtcttccgggcgctgttcggcggcggaagagccgagctcaagctgacagatccgaatgacctgctccaatcgggcgtcgatattatcgcccagcctccgggcaaaaagctgcagaacctgagcctgctttccggcggggaacgggccttgacggcgatcgcgctcctgttttcgatcctcaaagtcagaccggttccgttctgcgtgctggatgaagtcgaggcggcccttgatgaagcgaacgtgttccgctttgcccaatacttgaaaaaatacagccatgaaacccagttcatcgtcatcacccaccggaaaggaacaatggaagaagccgatgttctttacggcgtgacgatgcaggaatcaggcgtttccaagctggtctcagtcaagcttgaagaaacaaaagaattagttcaataa

SEQ ID NO: 1717 - DNA, 987 bp, Bacillus licheniformis
atgagcttttttaaaaaactgaaagaaaaaatcacacagcagaccgattcggtctcaggcaaatttaaagaaggcctggcgaaaacgagaaatacgtttcaggagcgggtcaatgagcttgtctcccgctaccggaaagtggacgaggatttttttgaagagcttgaagaggttctgatcggcgctgatgtcggcgttgcgactgttatggagctgattgacgagctgaagagcgaggtcaagcgaagaaatattcaggacccgaaagaggtgcagtccgtcatttctgaaaagctcgttgaaatctatgaaggcggggagcaggaagcatcagagctccgcgtcgaagacggccgcctaaacatcattttattcgtcggcgtcaacggcgtcggcaaaacgacgacgatcggcaagcttgcccatcaattcattaaagaaggcaaaaatgtcgttcttgctgccggagatacattcagggccggcgcgatcgaccagcttgaagtgtggggagagcgcgtcggcgcgcatgtcgtcaaacaggcggaacgctcggatcctgcggctgttatctatgacgccgttcaagccgcgaaagcgcgcggcgccgatgtcctgctttgcgacacggcaggacgcctgcaaaataaagtgaacttaatgaaagagctagaaaaggtaaagcgcgtgattcagcgcgaagtgcctgatgcgcctcatgaagtgctgctcgtactggatgcgacgacagggcagaacgcaatgacacaggcgcgcgaattttccaaagcgactgatgtctcaggcatcgtgctgacgaagctcgacggaacggcaaaaggcggcatcgtcctcgccatccgccatgagctgcagattccggtcaagtttgtcgggctgggggaaaaaatggatgacctgcagccgtttgaagcagagtcatatgtatacggcctgttttccgatctgatcgagaaagaagagtag

SEQ ID NO: 1718 - DNA, 258 bp, Bacillus licheniformis
atgacgcttgaaaaaacaacgagaatgaattacttattcgatttctatcagacgttgttgacatcaaaacaaaaaagctacatgtcgctttactacttagacgatttctcccttggcgaaatagctgaagaatatcatgtctcaaggcaggcggtctatgacaatatcaaacggaccgaagccatgcttgagcaatatgaagaaaagctacttttgtttaaaaaatttcaagagcgcaaaaagattttgaagcgctga

SEQ ID NO: 1719 - DNA, 1341 bp, Bacillus licheniformis
atggcattcgaaggattagccgaccgactgcagcaaacgatctcaaaaatccgcggaaaaggaaaggtaacggagcaagacgtcaaagagatgatgcgcgaagtccgtttagcgctccttgaagcggacgtcaattttaaagtcgtgaaagattttgtgaaaaaggtaagcgaacgagctgtcggacaagacgttatgaaaagcctgacgcccggacagcaggtcattaaagtggtaaaagaagagctgacggagctgatgggcggcgaggaaagcaagattgccgctgcaaagcgtccgccgaccgtcatcatgatggtcggtctgcaaggggccggtaaaacgacgtcgaccggaaagcttgccaacctgcttcgcaaaaaacataaccgcaatccgctgctcgtggcagcagacatctaccgcccggcggcgatcaaacagctggaaacgctcggcaagcagctcgatatgccggtattttcactgggtgacaaggtcagtccggtggagattgccaagcaggccatcgaaaaggcgaaagaagatcatcacgactacgttctcatcgatacggcgggacgccttcatattgatgaagagctgatggatgagcttgagcaggtaaaagaaaccgctcagccggaagagattttccttgtcgttgactccatgacgggtcaagacgcggtcaatgttgccaaaagctttaacgaacagctcggtgtgacaggtgtcatcttgacgaagcttgacggcgatactagaggcggagcggccttgtcaatccgcgccgtgacaaacacgccgatcaaattcgccggaatgggcgaaaagcttgatgcgctggagccgtttcatcctgaacggatggcttcgcggatactcggaatgggcgatgtgctcacccttatcgagaaagcccaggccaacgtagacgaagaaaaggcgaaggaactcgagcaaaaaatgaaaaatatgagctttacgctcgacgactttttggaacagctcggacaggtccgcaatatggggccgcttgaagacctgattcaaatgatgcccggcgcaggcaaaatgaaaggcttaaaaaacgtgaaggttgatgaaaaacagctcagccatatcgaagcgatcatcaagtcgatgaccgggaaggaaaaagagcagcctgagatcatcaatgcaagcaggcgcaaacggattgctaaaggaagcgggacatccgtccaggaagtcaaccgtcttttaaagcaatttgaagaaatgaaaaaaatgatgaaacagatgacaaacatgacaaaaggcaagaaaaaagggtttaaactgcccttcatgtaa

SEQ ID NO: 1720 - DNA, 273 bp, Bacillus licheniformis
atggcagtaaaaattcgtttaaaacgtatgggagctaaaaaatctcctttctatcgtattgttgtagcagattctcgttcaccgcgtgacggccgcttcatcgaaacagtcggaacttacaacccgcttgcaaaaccagcggaagtcaaaatcgacgaagagcttgcgcttaaatggcttcaaacaggagctaaaccgtctgacacggttcgcaacctgttctcaaaagaaggcattatggaaaaattccacaacgctaaacaaagcaaataa

SEQ ID NO: 1721 - DNA, 246 bp, Bacillus licheniformis
atgagtgatctgcacttggaagagctgattgtatcactggtcaaaccgcttgtggatcacccggatgatgttcaggttttcaaagaggaaaatccagagcggattatgttccgcctgtctgtcaacagagaggataccggcaagatcatcggcaaaaaagggcgcactgcaagagcgatacgctctgtcgtatttgcggcaggcgcacagtcttctaagaaagttcaacttgagatcgcagactaa

SEQ ID NO: 1722 - DNA, 387 bp, Bacillus licheniformis
atgcaaattatccaacgtgttaccgtcatgcaggttttgactgaaaacagcaaaaaaaagctgctggcttcttttgaagaaagaaaggaaatccttgagcgcgaatgcaaccagctctattttcagctcaggaaacacgaaaaggaacaccacaatccggcggcgactgaatcatttaaaaaagaaattgaaaaacgacaggacaagattaaaatgatcgtttttcaaatcaatcaaatccacacactgccgcttggcagcgaagtaaaggaaaaagaaatcgacgctttaatggacattgaagtcggggataattggcatgatatgacggcgggaaaaacaatcgtgattaaagacgggatcgtcattgaaattcgtccgaggtga

SEQ ID NO: 1723 - DNA, 525 bp, Bacillus licheniformis
atgctgaaacaatggtttaatgtagggaaaattgttaatactcatggggtaaaaggcgaagtccgcgtcatttcaagaaccgattttcctgaggagcggtacaagcccggaaacgcgctctacttgtttctggaaggaaaagacgagcctgtccaggtgaccgtcagcgcccacaggcttcacaaacagttccaccttttgcagtttaaagaggttgaaacgctcaccgaagccgaaaaattaaagaatgccttgattaaagttcccgaagaccaattaagccagttggcggaagacgaatactactttcacgaaatcatcggctgcgatgttttctcggaagacggggatttaatcggcaaggtgaaagaaattttaacgccgggcgccgacgatgtctgggtcgtggccagaccgggaaagaaagacgcgctcatcccttatattgacgccgttgtcaaagagattaacgtagcggataaaacgatcaagattcatatcatggaaggattacttgacgaatga

SEQ ID NO: 1724 - DNA, 696 bp, Bacillus licheniformis
ttgaaaggcgtgctcggctcgtcgatcctgcaaaaagctcaggacaaggacgctgtccgttttcgcgtggtgaactttcgggcctattccgacaacaagcatcaaaccgttgacgattatccatacggcggcggagccggaatggtgctgaaaccgcagcccgtctttgacgcggtcgaaaagctgacggctgaagccggagggtctccgagaatcatcctcgtctgcccccagggtgaacgctatacccagcagaaggcggaagaactggcgcgggaagagcatttaatgttcatttgcggccattatgaagggtatgatgaacggatcagggagcacctgtctacagacgagatttcgatcggagatttcgttttgacagggggagagctgccggcgatgatgatcgcagacagcgttgtgcggcttttgccgggcgtgctcggcaaggaagaatcgcaccttgaagactctttcagcacagggcttcttgaacaccctcattacacgcggccggcagattataaaggcttgaaggtgccggacgttctgacatccgggaaccatgcgaagatcaaagaatggcggcggaaggagtctctcaggcgcacatttttaaggcgtcccgaccttctggaaaactatcctttgtcagaagaagagcgaaagtggatttctgaatggaaaaaccggtag

SEQ ID NO: 1725 - DNA, 348 bp, Bacillus licheniformis
atgcaaaaattgattgaagaaatcacaaaagaacaattgcgcactgatttgcctgcgttccgtcctggtgatactttacgtgtacacgttaaagttgtcgagggtaaccgtgagcgtatccaggtttttgaaggtgtcgtgattaagcgtcgtggtggcggaatcagcgaaactttcacagttcgtaagatttcttacggtgtcggagttgagcgtacattcccattgcacacaccgaaaatcgcgaaaatcgaagttgtccgtcatggtaaagtacgccgtgcgaaactttattacttgcgcgaacttcgtggaaaagcggctcgtattaaagaaatcagacgataa

SEQ ID NO: 1726 - DNA, 852 bp, Bacillus licheniformis
atggtgatccaatggttccccgggcatatggccaaagcgaggcgggaagtaacggaaaaactcaagctgatcgacattgtatacgaactggtcgacgccagaattccgatgtcttcaagaaacccgatgatcgaagacattttaaagaacaagccgagaatcatgctgctcaacaaggcggataaagcggactcctccgtgacaaaggcttggaagcagcactttgaaaaagacggaattcctaccctcgccatcaactcggtcaacggacaggggctcaatcaaattcttcctgcatcaaaagagctgctgaaagaaaagtttgataaaatgaaagcaaaaggtgtaaagccgcgcgcgatcagagcattgatcgtcggtattccaaacgtcggcaaatcgaccttgatcaaccggcttgcgaaaaaaaacatcgccaaaacgggcgacagacccggagtaacgactgcacagcagtgggtgaaggtcggaaaagagctggagcttctcgatacaccggggattttatggccgaagtttgaggacgagcttgtcgggctgaggctcgcggcaacaggcgcaattaaagattcgattatcaacttgcaggatgtcgccgtctacggtttgcgctttttggaagagaattaccccgaacgcttaaaaaagcgctatgacctggaggagattcctgaagaaattgcagcgctttttgatgagatcggaaaaaaacgcggctgcctcatggccggaggcgagatcaattacgacaagacgacagaagtcatcatccgcgatatccgcaccgaaaagttcggcccgctttcttttgaaaagccggaggatatgtaa

SEQ ID NO: 1727 - DNA, 768 bp, Bacillus licheniformis
gtgaaaacattaaccgtcaaagaaattaaagaacatcttcaatcggtgagcgatgaaaaggacccttttatagagcagtgcaaaaatgatgagcgaaaaagcgttcaagcgctcgtcgacgcctggctgaagaaaaatgaaaggctttcggccatgcgggaagagtggcaggcgatgacgtcttttgaacggtcgctgagagcgcggggctatcaatatatcgccggaatcgacgaggcgggcagagggcctctcgcagggccggttgtcgccgccgctgtcatcctcaaagaagattgtgaaatattagggctgacagattcgaaaaaactgtcaaagcaaaaaagagaagactattattcatacataatggaagaagccgcagcagtcggcgtcgggatcgcggacgcccatgagatcgatgagctgaatatttatgaagcctccaaagcggcgatgctgaaagcggtccaagcgctggacgtcgcaccggattatcttctgatcgacgccatgtcgcttgcggtcgatacagagcagtcatcgattattaaaggggatgccaaaagcgcctcgatagcagcaggcgcatgcatcgcaaaggtgacgagggacaggctgatggatgaatacgctgaaaagtatcctctctacgggtttgaaaagcataaaggctacggaacgaaggagcatctgaatgccctggcgaaatacggcccgtcgccgatacaccgaagatcgttcgcccctgttaaagcacatgaataa

SEQ ID NO: 1728 - DNA, 1692 bp, Bacillus licheniformis
ttgatgatgctgaacgatgtacataacagcttaagaaaacaatttgaacaagcggattctctccagcggatcagcggaacggagacggatcagaaaaggctgatgctcggcaaagtgctccgctttatcagcgagcagttcgccgaaatacaaatcggcaatacgaaatggcaggggaagcttgaggcacccctgaaagcgggcgctcattactggttttcgtatgaaaagaagccggatgaagcgacaggccgccttcaggtcgttgaagcgtttgacaaaaacccgaagaccgtgcaggatgccgcctttaagctgttgaacgggctttctctgaagcggacgaaggaagccgtctttctggtcggagcgttgctgaaggagcagcagccgatcagggaaaacgatttaagagccgccatcaagtggcttgaaaatctgccgaagtccgatgcccaaaaaggcgccgatgccgtcatgttcgctcttaaacgcgaacttcccgtccaccccggcgtgctcgattcgattatggccgtcaaaagccccgttccgctcaatgagcagattgcgagaacgcttgatatgatcgcgaacgccgctcagccatccccaggcatggaaaagctgaaacaggcgcttttgccagttttacaagcggagactgaggtgcatgccgaaaggctgattcaaaagcttgcggaacacatcagatcgctggaaaaaggagaactgcaggccgttctgccattaaagccgcaggttcagtcagaaggcggaaaacctccgcaaaaagcagacgctggcggcgcatacggacaggaagcaaaagcagcccagcacaatccgcaaatcgcagcagctaaagacgtgttcgctaaattggcggcacaagccgaaacgaacgggacgcatattgcaagagaagcggcaggcgtcatcaaagcgcttgaatcgcgcggagctctcggacaagctccggccgttctggaaggattcacgccaaaagagacggaacttttgcagcatatcatgaaagaaacagcgcctgcattgacgaataaagccgatgtattatccgttctcctcaagatcaaagatgttttaggcgtcagagatgagctctcattgttgagagcgatggaaaacggcgccgttctcaaagagcagggcctgcaatctttaaagctcgtgctgaatgaaatgaggcatgcttccgatcttccggctcctgtaaaacaggaagcggaccaaatctttcaccgtttaaacggacagctgtttttgcagaatgatcagcctgcccagagccagctttttctgtcgtaccctctgttttcaaagaacggcgtccaggatttgaacgttttcttaaaagggcagaaaaaagacgacggaaaaatcgacccttcccagtgccgcctcatgttttaccttcagttggaagcccttgaagagacggtgatcgattgtttgatccagcaaaacgtcatgacggttacaattgaaacaaagttcgatttggagtctttgattgaaccgctggtcccggctttaaaggaaaacctgaaagagctgggctacagcttgtcaggcgtctcagcaaaaaaacgggaaaacatgaagctcgctccgtttttggagtcccgttttgaacaaattacagagagcgcagtggatgtgaaaatatga

SEQ ID NO: 1729 - DNA, 282 bp, Bacillus licheniformis
atgaaggaatctgttccattaagaagagctgttgcgcttcactacgatgaaatgaaggacaaggcgccgaaggtggttgccaaagggtcgggatacacggcggagaagatcattgaagaggcgcagaaagccggtgttccgattcaggaagatgcgacgcttgtcgaattgatgcgccacttggagcttgacgaccacattcctgaagcgctttacgagatcgtcgccgagatcttttcattcgtctatacgcttgatgaaaaaatgaaaaagagggaatga

SEQ ID NO: 1730 - DNA, 1161 bp, Bacillus licheniformis
atgaatatccatgagtaccaagggaaagaagtactcagaaaatacggagtggctgttccggaaggtaaagtggcatttacagcagatgaagcggtcaaagcagcggaagcgctgtccagctcggtttatgtcgtgaaagctcaaattcacgccggcggacgcggtaaagctggcggggttaaaattgcaaaatcaaaagaagaagtcaaagcctatgcggaagaattgttgggaaagacgcttgtcactcaccagacgggtcccgacggccaacaaataaaacgcttacttattgaagaaggctgcgatatcaaaaaagaatactatgtcggcctagttctcgacagggcgacttcacgcatcgtgctgatggcctctgaagaaggcggcacggaaattgaagaagtcgctgaaaaaacaccggaaaaaatcgtcaaagaagtgatcgatccggctgtcggactgcagagctaccaggcgagaaaaatcgccttcgccatcaatattccgaaagagcttgtcggccaggccgttaagtttatgatggggctgtacaaggcgtttactgaaaaagactgttccattgctgaaatcaatccgctcgtcgtcacaggggacggaaaagtcatggcccttgacgccaagctgaactttgacagcaatgcgctatacagacaaaaagacatcttggagtacagagatctcgatgaagaagatccgaaggaaatcgaagcatccaagtatgatttaagctatatttcgctcgatggaaacatcggctgcatggtcaacggagcggggcttgcgatgtcgaccatggacattatcaagcactacggaggggaaccggccaacttccttgacgttggaggcggcgcgacagccgaaaaggtaacggaagcgttcaagatcattttgtctgatcaaaacgtcaaagggatctttgtcaatattttcggcggcatcatgaaatgcgacgtcattgcagaaggcgttgttgaagcgacaaaacaagtcggtctgacattgccgcttgtcgttcgccttgaaggcaccaatgtcgatctcggcaagaagatcctcgatgattcaggactcaatattacgtctgcggaatcaatggctgacggcgcgcagaaaatcgtatccttagtgaagtaa

SEQ ID NO: 1731 - DNA, 903 bp, Bacillus licheniformis
atgagtgtatttattaataaagacacaaaagtcattgttcaggggataacgggttcaaccgctttgtttcacacaaagcagatgcttgaatacggaacgaaaattgtcggcggagtcacaccgggcaaaggcggaacagaggtcgaaggggtgcctgtgttcaatacggtcgaagaggctgtaaagcagaccggggcaaatgcgtctgtcatttacgttcctgcggcttttgcggccgatgcgattatggaagcgacagatgctgagcttgatcttgtcatctgcattactgagcatattccggtgcttgatatggtaaaagtcaaaaggtatatggaaggcaagaaaacgagactcatcggtccgaactgcccgggagtcattacgcctgaggaatgcaaaatcgggatcatgcccggatatatccataaaaaaggccatgtcggcgttgtgtcgcgttcaggaacccttacatatgaagcggttcatcagctttccgaagcaggagtcggccagtcgacagcagtgggcatcggcggagaccccgtcaacggcacaaacttcatcgatgtgctgaaggcttttaatgaagatcctgatacacatgcggtgatcatgatcggcgaaatcggcggaacagctgaagaggaagcggctgaatgggtgaaagccaacatgaccaaacctgtcgtcggtttcatcggaggaaagacagcgcctccgggcaagcgcatggggcatgcgggcgccatcatttccggaggaaaaggcacggcggacgaaaagatcaaaacgatgaatgcctgcggaatcgaagtggctgaaacgccttctgtcatgggagaaacattgattaaagtgctgaaggaaaaaggtctttacgaaacgtgtaaaacacactga

SEQ ID NO: 1732 - DNA, 903 bp, Bacillus licheniformis
atgaacgacagcagcgagcttttgatattgctccgccttcgcggcacactctccccttctctgctgaccaagtggtggaagcaggacccttccttgtctcttacgggcgaaaaaaaccatcttttaacgaagctttcattaaaaagatcagacttgtgctccatacgaaaactggcggaacaagaactgtctaatgttaaacggctcatccgttcttacgaggcggccggcgtccgcatgaccgccatatcttcccctgattatccagccagcctgaaaaccattcatgacccgcctcccgtcctttttttaaaaggaaacaaaaaacttctccatgaacaaagaaagatcggaatcgtcggaactcgctgcccgtcattatacggaaaaagagctgcggtccagcttgtcagggagctttgcaaaaacagctggacgatcgtcagcggtcttgcaaaaggaattgacggtctcgcccatcaggagagcatccgttcaaagggaaggacaatcggcgttatcgcgggcggattcaacagcatatatccccgtgaacatcgccagctcgccggacaaatggccgaaagccacctgctggtatcagagcaccctcctcacattaaaccgcaaaaatggcattttcccatgcgaaatcggctgatcagcggattaacggaaggaatcgttgtcgtccaaggcaaggaaaagagcggatcgctcattacagcataccaagcccttgagcaggggcgggaggtgttcgccgtgccgggtccgatctttgatgccaactctttcggtccttcaaggctgatccaggaaggggcgaaactcgtattaactattgaagacattttgaacgaacttccgccttcaaacgctcaatatacagagcctgtttag

SEQ ID NO: 1733 - DNA, 2076 bp, Bacillus licheniformis
atgtccgaatacttagtcatcgtggaatcgcctgcaaaggcaaaaacgattgagcgatacttaggaaaaaaatataaagtaaaagcctcgatggggcacgtcagagatttgccgaaaagccagatgggcgttgacatcgagcagaactttgaaccaaaatacattacgatccgcgggaaaggccccgtgttgaaagaattaaaaacggccgccaaaaaggcaaaaaaagtttatctcgcagccgaccccgacagggaaggggaagcgattgcgtggcatttggcgcacagccttgatttggacctgaattccgactgccgcgtcgtatttaatgaaattacaaaagatgcgatcaaagaatcatttaagcatccgcgcatgatcaatatggatcttgtcgacgcccagcaggcgagaagaattctggaccgccttgtagggtacaaaatcagtccgatattatggaaaaaagtaaaaaaaggcttgagtgcgggacgtgtccaatctgttgcgctccgccttatcattgaccgggagaaagaaatcaacgattttataccggaagaatattggacaattgaagggtcttttctcaaaggtaaagaaacgtttgaagcgagcttcttcggaatcaacggggaaaagcaccagctgaaaagcgaagatgatgtgaagcaaatcctatcccggatcaaagggaacaaatttgaggtcaaaaaggtaacgaaaaaagaacggaagcgaaatcctgcgctcccatttacgacgtcgacgcttcagcaggaagcggcgcgcaaattgaatttccgggcaaagaaaacgatgatgatcgcccagcagctttatgaaggaatcgatctcggcaaagaaggaacggtcgggttaatcacttatatgagaacggattcaacccgtatctcgaatactgctcaagaagaagcggcatcattcatcggcgaacagtacggaaaagaatttttgggtagcaagcgaaagccggccaaaaagaatgaaaacgcccaggatgcccacgaagcgatcaggccgacctcggtgctcataaagccttccgatctgagggcggtattgggaagagaccagcttcggctatacaagctgatctgggagcgctttgtcgcaagccaaatggctccggcgacactggatacgatgagcgtcgaccttgaaaacaacaggttgacatttcgggcaaacggcagtaaagtcaagttttcaagcttcatgaaagtgtacgttgaaggcaaagacgatcagatggaagagaagaataagatgcttccggatctcgctgaaggcgataccgtgctttcaaaagacatcgagcccgaacagcacttcacacagccgcctccgcgctatacggaagcaaggctggtcaaaacgcttgaagaactgggaatcggacgtccatccacatacgcgccgacgcttgacacgatccaaaagcgcgggtatgtcgcccttgataataaacgctttattccgactgagctcggtgaaattgtgcttgacttgatcatggagtttttccctgagattattaacgttgagttcaccgccaaaatggaaaaagagcttgatgacgttgaagacggaaacattcaatgggtgcagatcatcgattccttttacaaggactttgaaaagcgtgttgaaaaagcggaagccgagatgcaggaagtggagatcgaaccggagtatgcaggtgttgactgtgaagcgtgcggacatccgatggtctataaaatgggccggtacggcaaatttatggcctgctccaattttccggactgccgcaacaccaagccgatcgtaaaagagatcggcgtcaaatgcccatcatgcaaaaccggcaacatcgtcgagcgcaaatcgaaaaaacgccgcattttttacggctgtgaccgctatcctgaatgtgaattcgtatcatgggataaaccgcttgaacggaaatgtccgaaatgcgaggacatgcttgtggagaaaaagctcaaaaaaggcgttcaagtgcagtgcgttaattgcgattataaggaagaacaacaaaagtag

SEQ ID NO: 1734 - DNA, 1305 bp, Bacillus licheniformis
atgaatcaaacagtaaatgtcatcggtgcaggacttgcaggaagcgaagcggcatggcagcttgctaagcgcggtatcaatgtccgtttatacgaaatgaggccagtcaagcaaacgccggcgcaccatacagataaatttgccgaacttgtctgcagcaactcgcttcgggcgaattcattaacgaatgctgtcggtgtattaaaggaagaaatgcgggttcttgactcggccatcatcgctgctgctgacgaatgttctgttcctgccggcggtgcgcttgccgtagacaggcatgaatttgccgcaaacgttaccgaaaaagtaaagaatcatccgaatgtgaccgtgcttcatgaagaagtcacggaaataccggaaggaccgacaatcattgcgacaggaccgctgacatcagaagcgctttccgcaaagctccgggagctgacaggcgaggactatctatacttttatgacgcggctgcgccgattgttgaaaaagacagccttgacatggataaagtctatttgaaatcccgctatgacaaaggggaggcagcgtatttgaactgtccgatgacagaagaagagtttgacaggttttatgacgcccttgtgtctgcggaaaccgttccattgaaagaatttgaaaaggaaatcttctttgaaggctgtatgccgattgaagtcatggcgaagcgcggcaaaaaaaccatgctgttcggcccgatgaagcctgtcggacttgaagacccaaaaacaggaaagcgtccgtacgccgttgtgcagctgcgccaagatgatgcagccggcacgctttacaatatcgtcggttttcaaacccacctcaaatggggcgaccaaaaagaagtgctccgcctcattccgggactggaacaggcagaaatcgtccgctacggcgtgatgcacagaaatacgttcatcaactcgccgagtctgttaaaagcgacctaccagtttaaaaagcgggacgatctgttttttgccggtcaaatgacaggtgttgaagggtatgttgaatcagcggcttcaggtcttgttgccggtataaatgcggctcggctcatccagggaaaagaacctgtcactttttcaaatgaaacagcgatcggcagcatggcccattacattacggaaacaaacaagaaaaacttccagccgatgaatgcaaacttcggcctgttcaaagaattgggtgttaaaattaaaaacaagcaggaacgaaatgaacagtatgcttcgcgcgcattggagacaattcgaaatatttcgaaaacgctatag

SEQ ID NO: 1735 - DNA, 915 bp, Bacillus licheniformis
atggcaaatgttaagaattttttaactttattcattgaatatttacaaatagaaaagaattattcaaaatatacaattgtgggttacatttcttccattgaagactttgaacgctttttacacgttcagggcataaagggttttgaagacgtgacttatccggatgtgagaattttcttgacggaagcgcatgaaaaagggctcactcgcaggacgatcagcaagaaaatttcggctctgcgtagcttctataaatttttattaagggaaaagctggtaaaagaaaacccgtttctgcttgtcagtctcccgaaacaggataagcggattccgaagtttttatatgaaaaggaacttgaagaactgtttgaggtttcggatttgagtacaccgctcggccaaagaaatcaggcgctcctggaatttctctacgcgacaggcatgcgggtaagcgaactttgcagcctgaaggaatctgatttggatctgtttttagatacggttttggtccacgggaaaggcaggaagcaaaggtatattccatttggttcattcgcccgggaggctttggatctgtatttgcaaaatggaagacgcatccttctgttaaaagcgaaagagccctgcccttttatttttttgaatcaaaggggcgggcccttaaccccgaggggggttcgttacattttgggagaactggtcaagaagacttcgggtacattacatatacatccgcatatgctccgccatacatttgccacccatttgttaaatgagggtgcggatctgaggagcgttcaggaactgcttgggcattcaaatctttcttcaacccaggtgtatacgcatgtatctaaagatatgctcagaaagacatatatgtctcatcaccctcgggcacataaagggaaataa

SEQ ID NO: 1736 - DNA, 546 bp, Bacillus licheniformis
atgtcatcttttcacgcaacgacgatatttgccgtccagcacaacggaaaaagcgcgatggcgggagacggccaggttacgttcggtcaggctgtcgtcatgaagcataccgcaagaaaggtaagaaaactcttcaacggaaaggtcattgccggttttgccggttctgttgcagacgctttcacgctctttgaaatgtttgaagcgaagcttgaagaatacaacggcaatttgcagcgggcggcagtcgagcttgcaaaagagtggcgaagcgataaagtcctcagaaagcttgaggcgatgctgatcgtcatgaatgccgacagcatgctgctcgtttccggaacaggcgaagtgattgaaccggacgacggcattttggcgatcggctcaggtggaaactacgcgcttgcagccggaagggcgctgaaacgtcatgccggcagccagcttgacgcgaaagcgattgcgagggcttcacttgaaaccgcgggcgaaatctgtgtgtatacgaacgatcagatcattgtagaagaacttgaatag

SEQ ID NO: 1737 - DNA, 1404 bp, Bacillus licheniformis
atggaaaaaaagccgctgactcctaggcagatcgtcgaaaggcttgatcaatacatcgtcggccagctcgatgcgaaaaaagcggtcgccgtggcattgaggaaccgctacagaagaagtcttcttgatgaaaaactgcgcgaagaaatcgttccgaaaaacatattgatgatgggcccgacaggtgtgggaaaaaccgagattgcaagacgaatcgcgaaactcgtcggcgctccgttcgtcaaaatcgaagcgacgaagttcacggaagtcggttatgtgggcagagatgtggagtcgatggtcagggatcttgtggaaacgtcagtccgcctcgtcaaagaggaaaaaatgaacgaagtgaaaggcatcgctgaagaaaacgcaaataaacgcctcgtccgcctgcttgtaccgggaagaaaaaaacagacaggtgcgaaaaatccttttgaaatgctgtttggcggaaatcaggatcaagaaactggtgaagcggaaaagcaagaagacgcggatatcgaaaacaaccgaaaacggattgcgcatcagcttgctctcggcgaacttgaagaccattatgtcaccgttgaggtggaggagcagcagccgtccatgtttgatatgctccaaggctcgggtatggaacagatgggcatgaacatgcaggatgcgctcagcagcctgatgccgaaaaagaaaaagcgccgcaagcttacggtcagggaagcgcgaaaagtgctgacgaatgaagaagcggcaaagctcatcgatatggacgaagctgcccaggaagctgtccagagagccgaacagtcgggaatcatctttatcgatgagatcgataaaatcgccaaaaagagcggtgcttcttcatcggcagacgtctcaagagaaggcgtgcagcgcgatattcttccgattgttgaaggatctaccgtcatgacaaagtacggtgcggtcaaaacggatcacgttctgttcattgctgcaggtgcattccacatggcgaagccttcagatctaattcctgagctgcaggggcgctttccaatacgcgttgagcttcaaaagctgagcatcgatgactttgtgaaaattttaactgagcctgacaacgctcttcttaagcagtataaggctttattgaagacggaaggtatatctcttgaattttctgacgatgctattcgtaagattgcagaagtggcttatcatgtgaaccaggacacagacaatattggggcgagaaggcttcacaccattttggaacgtcttttggaagaactgtcattcgaggctccggatgtgacgatggaagaagtggtcatcacgcctcaatatgttgaagaaaagctcggttcgatcgctaagaataaggatttaagccagtttattttataa

SEQ ID NO: 1738 - DNA, 780 bp, Bacillus licheniformis
atggctttattacaaaaaacaagaaagattaatgcaatgctgcaaaatgcggcagggaagccggttaattttaaagaaatggccgaaacgcttcgcgatgtgattgattcgaacattttcgtcgtcagccgcagaggaaagcttctcggtttctcgatcaaccagcagatcgaaaatgaccggatgaaaaaaatgcttgaagagcgccagtttcctgaagattatacaaaaagcctgttcaacattccggaaacgtcatctaaccttgacatcaacagcgaatacacagctttccctgtggaaaaccgcgatttgttccaagcgggtctgaccacggtcgttccgatcatcggaggaggcgaaagactgggcaccttgattctgtcccgccttcaggagaaattcgaggatgacgatctgatccttgccgaatatggcgccactgtcgtaggaatggaaattctcagagagaaagcggaagagatcgaagaggaagcgcgcagcaaagcggtcgttcaaatggcgatcagttcactatcttacagcgagcttgaagcaattgaacatatttttgaggagcttgacggaaatgaaggcctgcttgtcgctagtaaaattgcagaccgcgtcggcatcacccgctcggtcattgtcaacgcgctccgtaaacttgaaagcgccggtgtcattgaatcaaggtcactagggatgaaaggcacatacatcaaagtgctgaacaacaaatttttgatggagttagaaaaactaaagtctcattaa

SEQ ID NO: 1739 - DNA, 390 bp, Bacillus licheniformis
gtggatatattttcaggaacgatacatagactagagggagccttgaatcaagcgaacattaagcaaaaagtcataacgaacaatctggccaatgtagatacaccgaactacaaggcgaaaaaagtatccttcaaaaatgtgctgaatgaggagtcctcccggattaatgccataaaaacagactatagacacattgactttaaagggaatgagccaaattattcagttgtgtcgagaaagaatacaacttatcaagaaaacgggaacaatgtggacgttgatcaggaaatgagtgaaatggcgaaaaatcaaatccagtatcaagcgctggttgaaagaataagcggaaaattcaactcgctaagaaccgcgattacaggaggtaaataa

SEQ ID NO: 1740 - DNA, 453 bp, Bacillus licheniformis
atgggggtattcaatagcatcaacatttcagcttcagcgttgactgcacagagagtcagaatggataccgtttcttccaacctggcaaacatggatacgacgagagcgaagctggttgacggacagtggcagccgtatagaagaaagcttgtatcgacggctccgaaaggcgaatccttttcatccgttctccaatcatcgatgaatgcatcggcgagagtcggcgaaggggtgaaggtgaccaagataagcgaagacaaaacaccgtttaagctcgtttatgatccgacccatcccgacgcaaacgaagacggatacgtgcagatgccgaatgtcgatccgctaaaagagatggtcgatttaatgagcagcacaaggtcatatgaagccaatgtcacagcaatgaacgcgacaaaaggaatgctgatgaaagcattagaaatcggaaagtag

SEQ ID NO: 1741 - DNA, 318 bp, Bacillus licheniformis
atggttaatggaatctctccgtttggagttcaatccgtgcaggcgggaacgaatgcaacaaatcagatcaagaacaagcaggacggttcagagaaccaagtcagcttttccaacgtgctgaaagattctatcaatgctttgaatcaatctcaaaatgaatctgataaactgacaaacgcgcttgctctcggtcaggatgtcaaccttgatgaagtgatgattgcagcccagaaggcaaacattacattgacggctgcgacggaattccgcaacaaagcggttgaagcttatcaggaaatcatgagaatgcaaatgtaa

SEQ ID NO: 1742 - DNA, 1602 bp, Bacillus licheniformis
atgaatcgtaatttattgcaaattaaaacgaaaataactgatttttggaaaaacagatcaaagctgcagaagattctgctgatcggcattgtcgctctggcagtcatcctgtcaatcatcattggaattgttgcttcgtcaaataaaatggtgccgctctataaagatttgtcagctgaagaaaccggccaaatcaaacaggtgctcgatgaaaaaggtattccatctgaagttgcgactgacggttcagtcatcaaagttccggaagaaaaagtcgatgaactgaaagtcgatcttgccgcagagggccttccgaaaagcgggagcatcgattattcattctttggcgaaaatgccggttttggcatgacggacaacgaatttgacgttttgaaagtgaaagccacgcaaaccgagctatccaacctcatcaaaggaatagacgggattaaagattcgaaggttatgattaacctgccgaaggaatccgtctttgtcggagaggaaaagccggaagcatccgcttcgattgttcttcaggtgaagcccggccacacgcttgatcaaaatgaaatcaacggcctttatcatctcgtatcgaaaagcgtgccgaaccttgacccgaaaaacatcgtgatcatggatcaaaactccacatattacgatcaaacaggcaaagagtccggttcttacgccgacagctattcttcccaaagggaagtcaaggcccagatcgaaaaggacctgcaaagacaaatccaaaccatgctcggcacgatgatgggacaggataaagtggttgtatccgtcacatctgacatcgatttcacaaaagaaaacaggacggaagacctggttgaacctgtcgacaaagaaaatatggaaggaatcacggtcagcgcagagcgcgtcagtgaaacatattccggacagggagcacaagcgggaggcgtcaacggaacaggtgaaaacgatgtaacgaactatgctgaaacagaaggcggaacaggcaacggagactatgagaaaagcgaagaacgaatcaacaatgaagtcaacagaatccataaagaaatcgctgagagcccgtacaaaatcagagatctgggcgtccaggtcatggttgaaccgcctgatgcaaacaacccgcagtcactgcctgctgaaagggaggacgatattaaaaaaatcctctcaaccattgtgaaaacatcgattgacaagaactatgaagaagagcctctgacagatgaggatgttgaaaataaaatcgttgtttctgtccaatcgttcgacggcaagcagacaatcgatgaaggaacggaaacaggcggcataccgatgtgggcttacatcgcaggcggagcagcgcttgttgctgtaatcggcctcatcatctggcttgtcagaagacgtaaaaatagagatgacgaatacgaggaagaatggtatgaaacgcctcaggagccgattcgggttgctgatgtgaacaatgaaaaagagacagaagaaactgtcagacgaaaacagcttgaaaaaatggcgaaagacaagcctgaagaattcgccaaattactgcgcagctggctgaccgaggattag

SEQ ID NO: 1743 - DNA, 1017 bp, Bacillus licheniformis
atggcaaaaatgaaacaagacaggcttacaggcaaacaaaaagcggccattctcatgatatccttagggcttgatgtgtcagcttccgtttacaagcatttaacagatgaagagatcgaaaggctgacgcttgaaatatcaaatgtcagagctgtatcacctgagaaaaaagatgagattattcaggaatttcatgaaacggctattgctcaagaatatatttctcaaggcggcattcattacgccaagcaggtgcttgacaaagcgctcggcgaagacaaagccgccagcattatcaacaggctgacatcgtctcttcaagtcagaccgttcgattttgccagaaaagcggatcccgagcagattctgaactttatccagcatgagcacccgcagacgatcgcattgattctgtcttatctcgatcccgtgcaatcgggtcagatattgtcagagctgaatcaggatgtgcaggcagaggttgcaagaaggatcgctgttatggacaggacgtcgccggaaatcatcaatgaagtcgaacagattctggagcaaaagctatcgtccacattcactcaggactacacgcagaccggcggtatcgaagccgtagtcgaagtgttgaacggagttgacagaggtacggagaaaacgatccttgacgcccttgaaattcaggatcctgagcttgccgacgagattaaaaagcggatgttcgtctttgaagatatcgttacgcttgataaccgcgctattcaaagggttatccgcgatgtggaaaacgacgatctgcttctttctctcaaagtggccagcgaagaggtcaaagacatcgtcttcagcaacatgtcgcagcgtatggctgaaacatttaaagaggaaatggaattcatgggccctgtgcgtctgcgtgacgtagaagaagctcaatcgagaatcgtaagcgtcatccgaagacttgaagaagcaggtgagatcgtaatcgccagaggcggaggagatgatatcattgtctaa

SEQ ID NO: 1744 - DNA, 768 bp, Bacillus licheniformis
atgatatcattgtctaacattattaaacagcgattatcatcaataccgaaaaaagaaaggcggacgatttcattaaaggaagtcaaacttcctgagacagaaaccgaacttgataccggacaggatccggaatacctcctcgaccatgccagacaagaagccggaaaaatatacgaaaaagcgagcgctgaactcgaacaggtcagacggcaaatcgaagaggaacggtcaagctgggaaacagaacgcgaagcgctgatagaccaggcgaaacaagaaggctttcaagctggatttgaagagggaaaggccgaggcccgaagcgcttatcaagcgtatttggatgaagccaatgccatcgtccgggcggctagacgtgactatgaagaaaaaatcgaacaatcatccgaagaaattgtcgaacttgccgtgtcactggctaaaaaagtttggaatcaaaaggctgacgacaaagaagcttttacagccctcgtaaaacaggtgctgtcggaaatgaaggaattcgatgacattgccatctatgtagatccggagtactacaccgaggttcaaagccacaaaaacgaacttgagcagctcctccaatacggcgcccatatcgcgatatacgccgatgaaaaagcgccgaaaggaacgtgctatgttgaaacggctttcggaagaatcgatgcaggcatcgacactcaattgcagcagctgaaacaaaaactgctcagcctgcttgaaacggcaggtgttgtccggtga

SEQ ID NO: 1745 - DNA, 1314 bp, Bacillus licheniformis
atgctcaagcagctgcttgaatgtatagaaaccgcagattcctacaaacgatacggaaaagtcaaacaggcggtcggcctgatgattgaatccaaaggacctgaatgttcaatcggcgatgtctgcaaaatctatacaaaaggtgacgggccaaaggctattaaagctgaagttgtcggcttcaaagaccaaaatattcttctgatgccatatttggaagcggccaatattgcccccggcagcattgtcgaagcgacgggcgaatcgcttagggtcaaagtcggctccgggttgatcggacaagttgtcgatgcattcggcaatccgctcgacggcagcgtgcttccgaaaggtctggctcaagtatcgacagaccaggcgccgcctaatccgatgaaaaggccgccgatcagagaaaaaatggcggtcggcgtcagatcgatcgacagtctgctgaccgtcggaaaaggacagcgtgtcgggatattcgccggaagcggcgtcggaaaaagcacgcttatgggaatgattgcgagagagacggccgcagacttgaatgtcatcgctcttgtcggagagcggggccgggaagtcagggagttcatagagaaagatctcggcgaagaagggctgaagcgaacgatcgttgtagtggctacatctgaccagccggcgctgatgcgtctgaaagcggcctatacagcaacagcgattgccgagtacttccgcgacaaaggacaaaacgtcatgttcatgatggactcggtgacaagggtcgccatggcccagagggaaatcggcctggcgacgggcgaaccgccgacgacaaaaggttatacaccctcagtgttcgctattttacctaagctcttagaacgaacaggaacgacggaaagcgggtcaataactgctttctatacggttcttgtcgacggcgatgatatgaatgaaccgatcgccgatactgtaaggggaatcttggacggccatatcgttcttgaccgagcccttgcgaataaaggccagtttccggcagtcaacattttaaaaagcatcagcagggtgatgtcgaacatcgccgagaaagaccatatcagagcagcgaaccggttcagggaaatgctgtcaacctatcaaaactcagaggatctgatcaacataggagcctataaaaaagggtcttccagagaaattgatgaggccatacaattccaccctaagctgatcagcttcctcaagcaggaagtggatgaagcggcatcgctggaagagagcatttccttattaaagagtcttacaggaagagaggattaa

SEQ ID NO: 1746 - DNA, 444 bp, Bacillus licheniformis
atggcttattcatttaaatttcaaaagctcctcgagcttaaagaaaatgaaaaagaccaatcatttgctgaatatcagcactcagtttccgaattcgaaaaggtcgcggaaaagctgtatgaaagcatgagccaaaaagaaacgctggaaaaaaacaaggaaatcaagatgcagacggggatgagcgttcaggaaatgcggcattatcagcaatttgtcacaaatcttgaaacgacaatctaccattatcaaaagctcgtcatgatgaagagaaatgaaatgaatgaaaaacagcacgatttgacggagaaaaatatcgagctgaaaaaatttgaaaaaatgaaagaaaagcagtttgaaatgtattcgctgcaaaacaaagcaaatgagttaaaggaaatggacgatatctccattgcccagtacataactcaaggaagctag

SEQ ID NO: 1747 - DNA, 612 bp, Bacillus licheniformis
atgaccgaagaaaaaaaagccggtaaatttcagacatttttgtttgtcatcgtcattccgctgatctttttaatcgttgtagcgttcgtcggcatgtggcttttgggcgtcaattttcaggatgcagcctcaaaaattcccgtcgtaaaagagcttgtgaaaaacggcgaggatcaggacatagatcacgcaactaaacagcaggagaacaaagcagaaaagctccaaaagacgatcgatgaacaaaaaagcgaaatcgaaacgctgacgagtgacttaaaaacgagtgatcaagagattaaaaggctgaaacaaaaaatcagctcgctcgaaaaaacggaaaaagatgaaaaagagcaggataaaaagaacgccgaaggtcaaggagacggaaaagtcgtcaaaatttatgaaagcatgcaaagcaataaagctgcaaaaattttaagcgaattaaaagaggaagaggcaatcaatattttagattctttaagcaaaaagaaagtgactgagatcctctcaaaaatgtctcctgataaagcggctgtattcacagaaaagcttgtgaaaaacgaggcgaaaaacgaagcgaaaaaagaagggggggaatag

SEQ ID NO: 1748 - DNA, 1380 bp, Bacillus licheniformis
ttgaggctttttgacgcaatctcctttgatgccaaacctgcggtggacactgcacctgcaaaaacgagcaggacgccgttgggcgcgctctttcagaatgtgctccagaaggaaaacagctcactttccccttttcaaaagggagaagagccttctcaggatacgccgttggaagggcttttgcatgaactgaagcaatggctttcaaataaggaagacagctctttcaatgaagactggctgaattcccttcagcagcttgaagagctgaatgcatctccggatgaactggcattggcagaacagctgttacaacaaataaaagagctgcttgaaaaagccgccctgcctgaacaatcaggcaaaacggctgatgctaaagctttgcctgccgacgaaagcgggacagaagagccgaaaaagcccgacctgcaaattctcggccagattcagcagctgctagctgcgattgtaaatgaaaatcaaccgtcactcaaaacttcgcaaatcgcagaattattgaaacaggcgccggaatttctcgccgctcttcaaacaaaggcgggagcagaagggctgattgatgagcttaaacgtcaatttttcacgaaagatccgagccaatcgcagcttttgtccatgtcaaacaccgagctgaaaagcttgaaaagcttaatggagcagatgatgaacgcaaacgctgaaccggatcaaaaagagtggaaaatggccgaaagcgaactcaaggcaatgctcatgagcaagaaaaccgatgtttctctttctgagaagccgttgtcctttgttttgaacagaagagaaattcaaactgaaggaaagcaaggccaaaaggaacagccgattcaatcctctgtactggccaatcatcggacaggcacagcgctgatccagggtctccagccttcggcggcagaggaagcttccgctcagccgaaaagcttttcagaacaaattctcagctcatggaaacagatgaagtatacgccgttcggcaggtcgacaggcagtttcacgatccgcctgaatcctgaaaatcttggctttatcacgatcaagctcgtcaaacagcacgggatgttttcaagcaaaatcatcgcatcgacccagtcggctaaagagctgctcgaacacaatctcgcgcatcttaaacaggcgctgcccaacatgtctgtgcaaattgaccgcttcggtgttccgcttcaaaacagcgatcagactttcggacagctggcggacgatgagaaaaaccagcatcagccgaagcaagatcagcaaagtaagcaggaaaatgaggattttcaggagtttctggatgagcttatcgagactcgatcacaggacagcgaggaggagatctaa

SEQ ID NO: 1749 - DNA, 468 bp, Bacillus licheniformis
atgtctgatacttcaattgataccagaaccgccttaggaacaacaaacacgaaatcgacgacatccgattttttatccgaggcaaaaaaagccgagaaagcagggagcggctccaatcttgggaaggatgaatttttgaaactgctgatgaaacaactgcagtaccaagatcccttaaatccgatggaagaccgcgaattcattgcgcaaatggcgaccttttcaagcctagagcagctaacgaatctgaacacaacgatgtcgacgttcgtcggacttcaggacccgatgacgatgtatgtcagctggatcggaaaagaagtcacctatgaaggcgaagacagcgaagaaaaaacggcgctcgtcaaatcagttaaaagctcagacggacagtatctgcttgtccttgacgatggaaccgaagtcaatccgtggaatgtgacggcggtaagccattctgataaataa

SEQ ID NO: 1750 - DNA, 789 bp, Bacillus licheniformis
atgttacgttcactatactcaggaatcagcggcatgaaaaactttcagacaaagcttgatgtcgtcgccaacaacatctcgaatatcaatacggcaggctataagaaaagccgggttacgtttaaagatattgtcagccagcagctttccggcgcgtcgtctactgcaaaccgcggctctgtaaacggccagcaggtcggactcggtgcaacgatcggatcgatcgatatcattcacacaaacgcagcgccttcgacaacaggccgccagcttgacatgaccattacaggagacggctacttccgcgtcggatcaggagatgaagtgtactacacaagatcaggaaacttctaccgatctgatgaaggtgacctcgtcactgttgacgggctgttcgtcttaacggccaataatggaagaatcaacattccgcaagacgcgcaaagcttcagcatcgctcctgacggaaccgtttcttatgtcgatcaaaacaacgagaaccagaccgccggccagatctcgcttgcgacattcagcaacacatccggattatcaaaagctggagacaacctttaccgcgaaacattgagttcgggagatccgcaagtcgttgtacctggggaaggcggctcaggaaaaattcaaacgagtgcgcttgaaatgtcgaacgtcgacctttcagaagaattttccgaaatgattatcgcgcagcgcggcttccagtccaatgcgaaaatcattacaacctctgatgaaattcttcaggaactcgtcaatctgaagcgatag

SEQ ID NO: 1751 - DNA, 216 bp, Bacillus licheniformis
atgatcaaagttacgcgattaaacggacagccctttattctgaatgcactattcattgagcaaattgaatgttttccggatacgacaattacgctgtccaacggaaaaaagtttgttgtcaaagaagatgaagatacagttgtggatacaatcgtgtcattctatcaaaaaatccaaatactttcttgtgaccaaagaattgaggaatctgaatga

SEQ ID NO: 1752 - DNA, 432 bp, Bacillus licheniformis
atgaataaaaaacttctaggaattatgatgacgattattttggcaattgctgtgttgggaaccgctgcgttctttgtcatcaagggaagcgcaagtgaaaaagatcaaaacgcagaaccttcgatcgatgaagtggtcgaatcttcagttgaagtcgccgaaatcacgacaaacttgaaatcagacaatgtagtccgtttgtcaatcaagcttgaaaccgattcgaaagaggcgaaagaagagcttgaaaagcgggatttccaaattaaagattcagtcatctcccttttggcgaacacgaacgcagatgagcttgaaggacaaaaaggaaaagaaaaatttaaagaacagctgaaagaaaagctgaacacgaactacatgaaagagggaaaagtgaaaactgtgtacattacctcctttaatctgcagtag

SEQ ID NO: 1753 - DNA, 999 bp, Bacillus licheniformis
atggcaggagaagtgctctcccaaaatgaaatcgatgcactgctttcagcgatatcgaccggtgaaatggacgccgacgagctgaaaaaagaagagtccgttaaaaaagtaaaagtctatgactttaaacgggcgctccgcttttcaaaggatcaaatccgcagcttgaccaggattcacgataactttgcaaggctgctaacgacttatttctcagctcagttgagaacctatatccaaatctcggtcagctcggttgatcaggttccgtatgaggaattcatcagatcgattccgaatatgacgatcctcaatctgtttgaggttcgccctcttgaaggaagaatcatgatggagatcaacccgaccatcgcctatacgatgatggaccgggtgatgggcgggatcggctcgagccacaacaaaattgacagcatgacggagattgagacgaaaatcatgtccaatttattcgaaagctgtctcacgaattacaaagatgcgtgggaatccatcacggaaatcgagccggaaatgtccgattttgaagtgaatccgcagtttgtgcaaatggtatcgccgaatgagacggtcgttgtcatttcgctgaacacgcaaataggagacatcagcggggttatcaacctgtgcatcccgcacgtcgtcctggaaccgatcattcctaagctttccgttcactactggatgcaatcagacagaattgaaccaaaaccggaggaaacaaagtcgatagaaaagcggattttgacggcgcaaattccaattgtcgcagaactcggatcatcggaattaaccattgaagagtttttaaatttagaaattggagattgtatcactttggacaaatcagtagcagaacctcttactgttttggtcggagataaaccgaaatttctagcacaagccggccgaatgaatcgaaagactgcgattcaaattctagatcacgacataagaggtgaagaatatggagaataa

SEQ ID NO: 1754 - DNA, 1134 bp, Bacillus licheniformis
atggagaataacaataggttatcacaggatgaaattgatgcgctgcttaaaggcggcgatgatacggctcaagagcagccagaatcagggttgtccctgatggaacaggatacgatcggggaaatcggaaacatttcctttgggagctctgcaacagctttgtccactttattgaatcaaaaagtcgaaattacaacgccgactgtttcggtgattgaaaaaagccatttaaatgatgagttcccgcacccgtatgtttcaatcggtgtgagctatacagaaggtttttcaggaaacaatcttctcgtcatcaagcaggaagatgccgcgatcattgctgacttgatgatggggggagacgggacgaacgcagatccgtcgcttggcgaaattcatctaagcgccgttcaggaagcgatgaaccaaatgatgggttccgctgcgacatcgatgtccaccgtcttcagcaagaagatcgatatttctccgccggaagttgacctccttgatgtgaaagaaggggaagggacagagcaaattccgaaagaggacccgctcgtcaaagtatctttcagactaaaagtcggagatctgatcgattcgcatattatgcagctttatccgctgacctttgcaaaagatctgattgatgaattaacaaatcaggacggcggagaagagcctgtgaagactgaagaggtacagacgcccgtacaggaaaaaccggcgcctaatccgaattcggcacctgctcagacacagagacaggagccggcgcctaaacggcaagggacggcaaaagtttcagagcctgtgcaggtggcaccggcagagtttcaatcctttgcccctcagactgaagcgcagccgcaccttcaaaaccttgacatgctcatggatattcctttgtccgtcacggtcgagctggggaggacaaaccgcagcgtcaaagaggtgcttgaactgtcaaccggcagtatcattgagcttgacaaactcgccggtgagcctgttgacatcttggtcaaccagcgcgtcgttgctaaaggcgaagtcgtcgtcatagacgaaaacttcggcgtcagggtgacagacattttgagtcaggctgaacgaatcagcaaattacgataa

SEQ ID NO: 1755 - DNA, 363 bp, Bacillus licheniformis
atggcttacaagattttagtagttgatgatgcagcatttatgagaatgatgattaaagatattttggtgaaaaacggctttgaagtcgtcgcagaagcgcaagacggggcacaggctgttgaaaagtataaagagcattcacctgatcttgtcacaatggatatcacgatgccggaaaaagacggaatcacggctcttaaagaaatcaaggaaatcgatccgcaggcaaaaatcatcatgtgttcggcaatgggccagcaatcgatggttatcgacgccatccaggcgggagcgaaagactttatcgtcaaaccgttccaggctgaccgcgtcatggaagccatcaataaaacgctaagctaa

SEQ ID NO: 1756 - DNA, 675 bp, Bacillus licheniformis
ttgtttaagaaacctcttattttcatagccggcctttgtctatgcgcctttctcgcattgccgtacgctccggctctcgcagaggaatcgggggaccagaccgttgatcatctgtttgagcaaaaaggtgcgggcaaagagaaagaaaaagcaaaagacaaagacaaaaccgaggaaaaaagttctctaaaggaagaggcggagaccgaacccccgtctccttccgtttccatatttgattttgtgaaaatgatcggcgcgttactgttcgtcatttttctgatctatgctttggtcaaattcatgaataaacgcaaccgtttgctaaaacccttccagtatgttgaaaacatcggcgggacttcactcgggcaaaacaagtccgtacagctgattaaagtaggaaacagggtgctggtcgtcggtgtcggcgaaaatatccagctgctgaaagagatcgatgatgaaaaggaatataaagaaattctcacgcagcatgaagctgcgatgaacagcaagattgaatggcagaaatggatggatcaagtcaaagttccaggcgtgcaaaaacaaagcggcacggcatctttttccgagtcgttaaaagcacagcttgcggaactgaaacaaaatcgcgcagaaggcagaaagaaaggccaaaatcaacatgaatga

SEQ ID NO: 1757 - DNA, 666 bp, Bacillus licheniformis
atgaatgagtttatggatttatttaattcaagcgatgcggcaaatgtcagcgccagcgtccggctcttgctgcttttgacagtattttcgatcgctccgggtatcttgatcttgatgacttgtttcacaagggttgtcatcgtcctgtcctttgtccggacatcgctggcaacacagtcaatgcccccaaaccaggtgctgatcggacttgcactgttcctgacatttttcattatggggccgactttttcagagattaataaagaagcgctgacgcctttaatgaacaataaaatcaccttggatgaagcttatacaaaagcggaagccccgatcaaaacatttatgagcaagcatacaagacagaaagatctggctttatttatgaattacgcaaagatggaaacgcctgagtccatcaatgatattccgctttcaactatggttcctgcgtttgtcatctcggaattgaaaaccgcgtttcaaatgggatttatgatatttataccgtttctgattatcgatatggttgtggcaagtgttttgatgtcgatggggatgatgatgcttccgccggtcatgatttcactgccgtttaagattttgctgtttgtgcttgtagatggctggtatttaatcgttaaatctttgctgcaaagcttttag

SEQ ID NO: 1758 - DNA, 270 bp, Bacillus licheniformis
atgaattcagaatttgttatatcgatggctgaaagggctgtatacgttacattgcttatcagcgggccgcttttggcgctcgctcttctcgtcgggctgatcgtcagcgtttttcaggcaaccacccaaatacaggaacagactcttgcattcattccgaaaatcgtcgccgttttggtcggactcgtcgttttcggcccgtggatgctgtcgacgattttgtcattcgcgactgagctgttctctaatttaaaccgttttgcagggtag

SEQ ID NO: 1759 - DNA, 777 bp, Bacillus licheniformis
atgtcaataatcgaatcatttccagcctttttacttgtgtttgtcagaatcacagcattctatgtaacggtgcctctattttcttatcggacaattccggccgttcataaaataggttttgcattttttcttgcgctcgtcagttttcaagcgattgaaaagcctcctcaccttgacgttgacggaatttacatgatgttggccatgaaggaagcgctcatcggacttctgcttgggctgatcgcttacatgatgatctcagccgttcaaatcgccggatcgttcattgattttcaaatgggatttgcggtggcgaatgtgatcgatccacagacaggggcgcaaagcccgcttgtcggccagtttttatatacgatggcgctgcttctcatgctgagcctgaatgcgcatcatctcctgcttgacgggatctattacagctatcaatacattccggtcgacaagatggcgctgtcgtttggaagcgaagaatttgccgagtttatcgcaaaaagcttcaatacgatgtttattacagcatttcaattgtctgcgcctgttgtggcttgtttgtttttagtcgatctggcattggggattgtggcgagaacggtgccgcagctcaacgtgtttgtcgtcgggcttcctttgaaaatcgcgatcacctttatcatgctcatcatctgcatggccgttatgttcagcatgatgcagcacgtcttcgaatttgccattcggacaatgagagatctattaactttgcttggggtggcatga

SEQ ID NO: 1760 - DNA, 1080 bp, Bacillus licheniformis
atgaagctgacgttggatttgcaatttttcgcaggtgaaaaaacggaaaaagcgacgccgaaaaaacggcgggaaagcagaaaaaaaggtcaggttgccaaaagtgcagatgtcaatacggcggtcactcttctcatcgtgtttttatcctttttattcatcggaccttttatgagagaccgcctgctcggcctgatcgaaaagtattacaaagaattaatcacgatgaaggtgtcagtcgccaatattcccggcctgtttcaaagtgttgtgcttgaatcgggcctcattatggcaccgcttttgctgacagccgtcgtctctggggtattgagcaactatatgcaagtcgggtttttatttgcccctgaagcgatcaagcctgatttgaaaaagcttgacccgcttaatggattcaagcggatttacagcatcagggcgatcgttgaactgcttaaatcgattttaaaaatcgtgattgtcggaggcgtgacattcgccgttttatggctgaactttgacaaaattctcagaatcccggcgctgtcggctggcgaggctttgtcatatgtcggctggctcacctttttaatgggggtttccgctgcagtcgcattaatttttctcgcggtgctcgattacctctatcaaaaatttgactatgaaaaaaatattcgcatgtcaaaacaggacatcaaagacgaatacaaaaaaaccgaaggcgatcctctgatcaagtcgaagatcaagcagaagcaaaaggaaatggcgatgcgccgcatgatgcaggaagtgccaaaagcggatgtcatcatcacaaacccgacccattacgccgtcgcattgaaatacgacgaaaacaaaatggatgcgccgtttatcatcgcaaaaggggtcgatctaatggctctgaaaatcaggcagatcgccaaagaacacgatgtcatgacggtcgagaacaggcctttggcaagggcgctctatgaccaggttgagatcgaccaggccgttccggaagaattctttaaggccgtagccgaaatcctggcctatgtttacaaaacaaagcaaaaaatctag

SEQ ID NO: 1761 - DNA, 2037 bp, Bacillus licheniformis
atgtctgcaagagatttatctattttatccggcgttgtcctcattgtggcaatgcttatcataccctttccaacatggatgttgagcatcttaattatcgttaatatttctcttgcgttaatcgtgcttctcaccacaatgaacatgcaagaaccgctgcaattttcgatttttccttctttgctgctcctcttgacgctgttccgccttgggctgaatgtatcgacgacgcgttcgattctgtccaacggtgatgcgggaaaagtagtcgagacgttcgggtctttcgttgtcggcggaaacgttttggtcggtctcgttgtctttatcattttgatcattattcaatttatcgtcataacgaaaggggcggaacgggtatctgaagttgctgccagattcacgctcgacgccatgccgggaaaacagatgagcattgatgccgatttgaatgccggaatggtgaccgagcaggaagcgaaggtgcgccgtgagaaggtggcccgtgaagccgacttctatggagcgatggacggagcgagcaaattcgtgaaaggggatgcgatcgcagggatcatcatcgtccttatcaacgtcattttcggaattgtcatcggcatgctgcaaaaacaaatgagcattcaggaagccgcttcacactttacactcctgtctgtaggcgacggaatcgtatctcagctgcctgcgctcttgatctcaacggcgacgggtatcgtcgtgacaagagcggcgtcggacggaaacctcggccacgatattacaggccagctgtttgcctatccgaagcttttgtatgtcacggcgggaacgattttcctgctcgggattttcacgccgatcggcattctcctgacaggccctctggctcttcttctcgccgcaggcggctatatgctctccaaagccggtgaagagaaggaaaaagtggaggatatccttgaggaagaagctgaagtggatgaattaaaaagccccgaaagcgtcgtccatctgcttgatattgatccgatcgagtttgaattcggctacggattgattccgcttgcagatgcaaatcagggcggcgatctgttggacagaattgtcatgatcaggcgccagctcgcgcttgaactcggacttgtcattccggtcgtcagaatcagggataacatcgctcttcagccgaacgagtacaggctcaaaattaaaggaaacgaagtcgcgaaaggcgagcttctcctcgatcactttctggcgatgtctccgacaggcgaagacgatcagatcgaagggattgacacaatcgaaccgtccttcggtcttccggctaaatggataccggaatctcagaaagatcaggccgaaatgctcgggtacacggttgtcgatccggcttcagtcgtatcgacccatattacggagcaggtgaaaaagcacgcccatgagctgatcggaagacaggaaacgaaacagctgatcgaccacttgaaagaatcttatcctgtactggtcgaagaggtctcgccgaatccgctgtctgtcggtgacattcagaaagtgctggcaaaacttctgaaagaaaaagtatcgatcaggaacttggtgacaatctttgaaacgctggccgactacggaaagctgacgacggattcagatatgctgaccgagtatgtcagacaggctctggccaagcagatcaccgcccaatatgcgaaggaaaatgagacgctgaaagtggtgacttgttcgggccgcgtcgaaaaggccgtggcggaaggaattcagcagactgaacacggcaactttttatctcttgaaccaacattatccgaaaatatcattcaatctgtagcaagagaaatcgaacagctctcattgaggcaggaagtgccgatccttctatgttcgccgcctgtcagaatgtatgtcaagcagctgcttgagcgctatttccctgatctgccggttctttcctataacgaattggaagccaatgtagaagttcaaagcatcggagtggtggatattcaatga

SEQ ID NO: 1762 - DNA, 1113 bp, Bacillus licheniformis
atgaaaatcaaaaaatttgtagctggttctatgcaggaagccacaaagcaaattatacaggagctcgggaatgacgccgtaatcttgaattctaaaaaaattcaaaagagaaaatttctcggctttgtgaaaaaaaccggggttgaagtgatcgcggtcgtcgaccaggacttttccgacgcaaggaagcaagagcgtcaaaagcccgttttccgggaacaaagcccttcgcctgtcccgcagccggaccatcttgatttggcaagccaagtgaaagagctgaaagaactgctggaaatgcggcatcatgagcagcctgttgatgtgctgcctgaaccgctgaaaaaggcggaccagctcctggcaaagaaaggggtatcgccggccatccgtacgaaagcgctcggccggttgatcagcacttctttaagagacggcgaagagtggacggatgaaaagacgctggcgcacttaacagatgctttggccgatcttcttcccgataatctggaacaggacgtggcgattcattcgcaatatgtcgtgctcttcggatcgaccggagtcggcaaaacgacgacattggcaaagctcgccgcttcttctgtactggaaaagcagaaaaaaatcgcttttatcacgaccgatacgtacaggattgcagcggttgaacagctcaggacatatgccgagcttctgaatgcgccgcttgaggtgtgctacacgaaagaagagtttaaagctgcccagcaaaagttcgccgattttgaccacgtcttcattgatacggcgggccggaatttcaaagacgggcaatatgtcagggagctgaaggaaatcattccgtttgagcgtaagatacaggcgtttctcgtcatgtccgcgacgagcaagtacgaggatatgaaggagctcattaagcagttctcaagcattccgatcgatcagttgatattcacgaaagtggatgagaccgattcgttgggaagcgtcatgaatctgctcgccgaatcgagaatcggcctcggctatattacaaacggacaaaatgttccggaggatatccgctacttgtcaaacgcagcatttgtcagactgcttacggggtgttga

SEQ ID NO: 1763 - DNA, 888 bp, Bacillus licheniformis
atggatcaggcagaaagcctacgaaggcggatggggcagcgctttgccgaaccgcccgccgctatcgctcatccaaaagcgaaaacgctcgctgtcatgagcggaaaaggaggcgtcgggaagtcgaatgtatcgctgaatacggctctcgccattctggaaaaaggaaagagcgtgctgttgatcgatcttgatgtcggtatggggaacattgatattctgatcggccggcaatcgctctacacggtgatggacctcctccagcaaaaaatgccgtttgagcgcgccttgtcagccggcccgcgaggccttcaatacatttcgggcggaaccgggctggatgcaatgttcgaattgaacagggaaaactgggcgttttttctgaaggaattgacgcgggctttgacaagcttcgactatgtcatatttgacatgggagcggggctgtcaaaagatcagctgcctttcgtcctgtcagcggatgaaattctggtcgtcaccacgccggagccgacatccatcatggacgcatacagcgcgatcaagcatttggcattaaccggacgcgatcttcagctgaaagtcgttgtcaatcgctgtacaacccaaaaagacggaatttctgcttttctccgcctttccaacacggtaaacgcttttttgcagcaaaagcttgcatatgcagggccgattcctgaggatcccctggtctcaagagccgttgtggagcagcagccgtttctgataaagaatccgcgttccaagccgagcagggcggtttacctgctggccgaatcgctgcttcataacggcagaacggaaatgggcgaaaaccggtcctttatcgaaaaattatcttcattcctgaggaggggcaatacattatga

SEQ ID NO: 1764 - DNA, 1074 bp, Bacillus licheniformis
atgattcgtgttcttgtcgttgacgactctgcttttatgagaaacatgatcaccaagtttttaacatccaatcacgagattgctgtagcaggaacggcaagaaacggcgaggaagcgctccaaaaaatcaaggagctccgtccggatgtgatcacattggatattgaaatgcctgtgatgaacggaaaagaaacgttgaaaaggattatggcgagcgatccgcttccggttgtcatggtatcgagcctgacgcagcagggagcagatatcacgatcgaatgtctggagcttggggcgatcgatttcgtcgcgaagccgtcgggttcgatttcaatagatttatataaagtaagagacatgctgattgagaaggttttgacagcaggacgggtgaaactgaaaggccggcaagttccgatctcaaagcccgccatcgagacggcgaagcagccgattgtgggcggcagcgattcagtccgctttcgggctggaaaacagctcatctgcatcggtacatcgacaggggggccgagggcgctgcaaagagtgcttcccaagcttcccaaaacgttgaaggcgcctgtttttatcgttcagcacatgccaaagggctttacggcctcattagcgaacaggctgaaccacctctcagaagtaaccgtgaaggaggctgaaaacggtgagagagcgaaagacggctgggtttacattgcacccggaggaaaaaacatggcggtcggccttgaaaagggcgaattggtgatcacgctcgatgaccgcgacacagaaagccgccacaagccttctgttgactacttgtttcaatccctggcctcacttcgggagtttgaaaaaatcgccgtcattatgacggggatgggaagcgacggaacagaaggcgtaaaaggccttttgaaacatgggagcggaacggtgatcgccgaagcagccgagtcgtccgtcgttttcggaatgccgaaatcggtcattaacaacgggcttgcaaacgacatcaagcatgttgatgagattgccgcagccattatgacgtatatgaaaaaagagagggcgtga

SEQ ID NO: 1765 - DNA, 2022 bp, Bacillus licheniformis
atggatatgaatcaatatttagacgtctttattgaagaaagcagagaacatttgcaaacctgtaacgaaaaattgctcgaactcgaaaaaaatccgacagacttgcagcttgtccatgatattttcagagcggctcataccttgaaagggatgagcgcaacgatgggctatgaagacatggctcatttaacgcacagtctggaaaacgtgctggatgcgattcgaaatgaagaaatgaccatcacgtcagagtggatggacgtcatgtttgaagcgctcgatgaccttgaagcaatcgtcctttcgatcatcgaaggcggcgacggcaaaagagatgtttccgaagtctgcgccaagcttgatgtgacaggggcaaacaaggaggcggcagcagcggcagaagcgcctgaagcggcgtcttccgaaacgaaatggtcctatgacgaatttcaacgaacggtcatcgccgaagctgaggaacaaggctttaaatgtttcgaaatcaaagttgcattgaaagaggactgtctgttgaagggcgttcgggtgtacatggtatttgagcagctgaacgaggtcggcgaagtcgttaaaacgattccggaaacagaagtccttgaatcggaggattttgattccgaattcgtcatctgctttttaagcaaacacggaaaagaagagattttcaacaaaatcaacggcgtatctgaaattgaaaaaatagaagtgaccgagctgaaaaacgatttttcggcacaagaagaagcgaagcccgccgcatccgaaaaagaaaccgcaccgaaagaggcggagaaaaaaccggctaagcagccggacggcaaaaaagacgcggcgaaacctgcggcaggcggcggaacgaagacgatccgcgtcaacatcgaccgcctcgattcattaatgaacctgtttgaagagctggtcattgacagggggcgcttagagcagatcgccaaagagctagaacacagcgaattaacggaaaccgtcgaacggatgactagaatttcaggcgacctgcagtcgatcatcctcaatatgagaatggttccggtagaaacggtgttcaaccgattcccgcgcatggtccgccagctgacaaaagaattaaataaaaagatcgagctgtcgattttcggagcggaaacagagcttgacagaacggtaatagacgaaatcggcgacccgcttgtccacctcttgagaaacagccttgatcacgggatcgaggcgcctgaagtcagggtgaaaaacggtaaacctgaaaccggtcaagtccgcctgaaagcataccacagcggtaaccatgtctttatcgaggtggaggatgacggcgccggcatcaaccgcaaaaaggtgctcgaaaaagcgcttgagcgcaacgtcattactgaacgcgaagccgaaacgatcgaagatcatgaaatcgacgcgctcatttttgcgccgggattctcaaccgcagatcaaatctcggatatttcaggacgcggagtcggcttagacgttgtcaaaagcaagctggaatcgttgggcggttctgtcagcatcaaatcgagcgaaggcgaaggttcgcttttctccatccagcttccgcttacactgtcgatcatttccgtgctgttagtcaaacttgaaaatgaaacgtttgcgattccgatttcttctattatagaaacggctgtcatcgataagaaagatattcttcaaacgcacgaccgcgaagtgatcgatttcaggggccatatcgtaccggtggtttacctgaaagaacagtttaatgttgaggattcttcagatgatcttgatcagcttcacgtcatcgtcgtgaaaaaaggagacaagctgacggcatttgttgtcgactcctttatcggccagcaggaagtcgtattaaaatcactcggcgattatttaacaaacgtctttgccatttccggcgcgacgattttgggagacggacaagtagccctgatcatcgactgcaacgcccttattaaatag

SEQ ID NO: 1766 - DNA, 477 bp, Bacillus licheniformis
ttgaccacacagactaccaccggtgagaaaatgattgtgttcaaagtaaatcataaagagtatgccatctctgtatcagaagtaatgtccattgaaaaatggcagcagccaacaagggtgccgggagtggaaccgtatatttgcggcgtcattaatttgagaggtgttgtcacacctgtcatcgatttaagaaagcggattgaagcgcctggagacacgattactgatgaaacgagaatcatcatcatcacccatcaggacattgaagtcggctgggtggtggatgaggcgaacgatgtcatcacagtcgaggaagaggaaattgaatcggctcccgaaacggtaggaaaagacggcaggcaatggattaaaggcatcgtcaagcaagggtccagacttctcaatctgattgactctgaagctgttttaaaccggaagtcgagccttgccgccgcttctgaaaatgtgaagaaataa

SEQ ID NO: 1767 - DNA, 630 bp, Bacillus licheniformis
atgagcgtatttaacggaattagagaagagcatcttgatatattgcgggaagtcgggaatatcggagcgggccattccgcttccgccctggccctgttgctgaacaggaaaatcgaaatggaagtgccgtttgtcaagctgatgtcgtttgatgagcttgtcaacctattcggcggtgcagatcttcctgtcgcaagcatctttttgcgcatggaaggggattttccaggttctatgttcgtgatcatgcctttttcagaggccgagcagctgatcagggagcttgtcggcaatccggaattcgagattgacagcatgacgccgaacgatatcggagcctctgccctgcacgaactcggaaacattatggcgggatcttatttgaccgctctcgctgatttgacaaaccggcaaatgtacccgagcgtcccagaactgacgctagatatgttcggagccgtcatcagcgaagggctgatcgagctcagccaagtcggagatcaagttatcgtgatcgacaactccatttttgacgaggagcacaaccggaaagttaaagcgcatttgttccttctgccggactatgattcttttgaaaagctctttcatgcattgggtgcagcgctatga

SEQ ID NO: 1768 - DNA, 507 bp, Bacillus licheniformis
atgaaaatcttagaaaaagaaacatcgattatcagagtgggaattgccgatgtaaaaatcgtccgcactcccgacaagatcagaacatcgggtctcggttcgtgcgtcgggctcgtgctgtatgatttggaagcaaagacggccggtctcgtccacgtcatgcttccggactcttccttatccaagacgccggacatcaacgtggcaaaatacgcggacacagccgtcgaagcgacggtcaagatgctgcttgaagccggatgccgaaaatacgctttgaaagcgaaaatggccggaggagccgaaatgtttaaatttaagatgacaaatgatttgatgaaagtcgggccaagaaatgtgcttgcgattaaaaaacatctatctctcttaaacattccgattgtaagcgaggatacaggcggaaacagcggaaggacgatcgagttcgatccgcaatcagctgaacttgtcatccggacagttaaacaaggtgtaacaacgatttaa

SEQ ID NO: 1769 - DNA, 765 bp, Bacillus licheniformis
atgcaatccttgaactatgaagatcagatgctttggtcgcggtggaaagaatggaaagatcctcaggcaggcgatgatttaatccgccgctatatgccgcttgtgacatatcatgtcggccggatagccgtcggcttgcccaagtccgttcataaagacgatttggtcagccttggcatgctgggtttgtatgatgcccttgaaaaatttgatccgggaagggatttgaagtttgatacatacgcttccttcagaatcagaggcgctatcatcgacggtcttcgcaaagaagactggcttccgagaacgtcccgtgaaaaaacgaagaaagtggaagcagcgatcgaaaagctcgaacagcgttacttaagaaatgtttcgccgagcgaaatcgcagctgagctgggaatgagcgaacaagacgtcgtgaccacaatcaatgaaggtttctttgcgaacctcctttcaattgatgagaagcttcacgaccatgaagacggggagaacgtccaggtgatgataagggacgacaaaacgagcacgcctgaagaaaaaatgctcaaagacgaactgatctcccagcttgcggaaaaaataaacgagctatcagaaaaagagcagctcgtgatcagcttattctataaagaagagctgacgctgacggaaatcggacaggttttgaatttgtcgacttcccgtatttcacagattcactccaaggcgcttttgaaattgaagcatctgctggataaagtggtgcaatag

SEQ ID NO: 1770 - DNA, 513 bp, Bacillus licheniformis
atgtcaacaatattatggcttgtgagcttcacgctccacggtatattgatttatttcgtcatcattttgaatacgaggctcagcgctttcaaggcagcggagaaagagcaaaaacagcttttggaagaaaccgagaatacattgaccgcttttttgatggagttaaaagacgaaaatgaaaaactcgttcaagagattcgggcgaatgccgaaaaagagccgcaaagaccggaaacacagcctgaaattcccgctcaaacccccgtccttccggaagcggacgaatcgcgcgatctgccgcttcacatcgaagcgatgatcaatgaggtggagcaggaagaggatgagctcaatcaaaaggagcaggaagcatccatatcctatgaagaagaagctctcgcattatatgaaaaggggctctctccggaggaaatcgcaagacagctgaaaagcgggaaaacagaaatcgagcttttcttaaaatttcgcggaaagctcaaaaacgattcttga

SEQ ID NO: 1771 - DNA, 741 bp, Bacillus licheniformis
atgtcagtcatttctatgaagcaattgcttgaagctggtgttcacttcggccaccaaacgcgccgctggaacccaaaaatgaagcgttacatcttcacggagcgtaacggaatctacatcatcgatcttcaaaaaacagtcaaaaaagttgaagaagcatacaacttcacgaaaaaccttgcagctgacggaggaaaaatccttttcgtcggtacgaaaaagcaagctcaagactctgttaaagaagaagcggaacgttctggaatgtactatgtcaaccaacgctggcttggcggtacattaacaaactttgaaacgatccaaaagcgtatcaaacgccttaaagatatcgaaaaaatgcaggaaaacggcacatttgacgtacttcctaaaaaagaagtcgttcaattgaaaaaagaattagagcgtcttgaaaaattcctcggcggaatcaaagaaatgaaagagcttcctgacgcactgttcatcatcgatcctcgcaaagagcgcatcgcggttgcagaagcgcgcaaactgaacattccgatcatcggaatcgttgacacaaactgcgatcctgatgaaatcgatgttgtcatccctgcgaacgatgacgccatccgcgctgttaaattgctgacttctaaaatggcagatgccatccttgaagcaaaacaaggtgaagaatcagctgaaacagaagcgaaagaagcagaaacaactgaaacaacaactgcttaa

SEQ ID NO: 1772 - DNA, 882 bp, Bacillus licheniformis
atggccaatcctgcacaaatggtaaaagagcttcgcgaaaaaactggcgcaggcatgatggactgcaagaaagcgttaacggaaactgacggcaacatggataaagcgatcgatcttctaagagaaaaaggaatcgcaaaggctgccaaaaaagctgaccgcatcgcggctgaaggcttgactttgatcaaaaccgacggcaacacaggcgttattcttgaagtgaactctgaaacggacttcgttgcgaaaaacgaaggcttcaaggagcttttgaacgacctggctgaccacattctggctgaaaagcctgaaagcgttgaagctgctatgggtcaaaaaatggctaacggttcaactgtagaagaatacatcacaagcgcggttgctaaaatcggagaaaaaatcacgcttcgccgcttcgctgtcctgacaaaaggcgatgacgctgcattcggcgcatacctgcacatgggcggaaaaatcggcgtattgactgtccttaacggcacaactgacgaagaaacagcaagagacatcgcaatgcacgttgcagctgtaaaccctcgcttcatttcccgcgaccaagtgtcagaagaagaagcgaaccgcgagcgcgaaatcttgactcagcaggcgcttcaagaaggcaaccctgaaaacatcgtcgcaaaaatggttgaaggccgcctgaacaaatatttcgaagaaatctgcctgcttgatcaagcgttcgttaaaaacccggatgaaaaagtgaaacaggtcgttgctgcgaaaaacgcaacggttgaaacgttcgtccgctacgaagttggagaaggtatcgaaaaacgccaagaaaactttgctgaagaagttatgaaccaagtgaaaaaataa

SEQ ID NO: 1773 - DNA, 723 bp, Bacillus licheniformis
atggaaaaaccaaagtataatcgtatcgtattaaagcttagcggagaagcccttgcgggtgaacagggaaacggcatcaacccgaccgtgatccagtccatcgccaaacaggtgaaagaaatcgccgagcttgatgttgaagtggcggtcgtcgtcggcggcggcaacctgtggcgcggaaaaacgggcagcgatctcggaatggaccgcgcaacagcggactacatgggaatgcttgcaacggttatgaattcccttgcgctgcaagacagccttgaaacgctcgggattcagtcaagagttcagacatccatcgaaatgaggcaggtcgctgagccatacataagaagaaaagcgattcgccatcttgaaaagaagcgcgtcgtcatcttcgctgccggtacaggcaatccatacttctcaacggatacgacagcagcgctcagagcggctgaaatcgaagccgacgtcatcttaatggccaaaaataatgtcgacggtgtatacaatgccgatcctagaactgacgaaacagccgtaaaatatgaaaaattgtcttatctcgatgtgttgaaagacggtttggctgtcatggattcaaccgcttcttcactttgcatggataacgacatcccgctgatcgccttttctattatggaagaaggaaatattaaaagagccgttttaggcgaacaaatcggtacaatcgtaagggggaaataa

SEQ ID NO: 1774 - DNA, 558 bp, Bacillus licheniformis
gtgtcaactcaagtgatgaatgaaacaaaagaacggatgcaaaaagcgataagcgcttatcagcgcgaattggccactgtccgcgcaggacgtgcaaatccgtcattgctggacaaagtggcagttgagtattacggagcgcagacgcctttaaaccagattgcgtccattacagttccagaagcgcgcatgctcgtcatcacaccatatgacaaaacggcgctcggcgatatcggaaaagcgattcaaaaagccgacctcggtgtaactccgtcaaacgacggcaatatcatccggatcacgatccctcctctaactgaggagcgcagaaaagagcttgccaaactcgtgaaaaaatattcggaagatgccaaagtcgcggtccgcaacatccgccgcgatgcaaatgacgatctgaaaaaactagagaaaaatggtgaaatgactgaggatgaattgcgctcttcaacggaagacgtacaaaagctgacagatgaatatgtgtcaaaaattgatgagatcacaaaagataaagagaaagaaatcatggaagtttaa

SEQ ID NO: 1775 - DNA, 783 bp, Bacillus licheniformis
atgctcaatatactcaaaaattggaagaatcagcattcggctgcttccaacatggaatgttacacaaaagaaaatattttaaaaggagaaattcctgaacatatcgccattattatggacggaaacggccgctgggcaaagaagcgggcgatgccccgcatcgcgggtcatcacgaaggcatgaaagtggtcagacagacgacaaagcttgccaatgagctcggtgtcaaagcgttgacgctgtatgccttttcgacggaaaattggaagcgtccaaagcttgaggttgactttctgatgaagctgcctgaagagtttctgggaacgtatctcccggagctggtcgaagaaaatgtccgggtccgcatgacaggcgatagggaaggactgccgccccacacgatccgcgcggttgaaaaagccatccgtgatacggagaacaatgacggacttattcttaattttgcattgaattacgggggacgtgcagaaatcgtcagagccgcaaagaaaattgccgaagaagccaaaaaaggcacattgaataccgaggaaatcgacgaaaagctattttccgattatttaatgacagaaactttgcaggaccctgatttgctgattcgcacaagcggcgagatcaggctgagcaacttcatgctttggcagcttgcctacagcgaatttttatttaccgatgtattgtggcctgattttaaagacgttcacttgcttcaggctatcggagaatatcagcgtcgcgggagaaggtttggcggaatttag

SEQ ID NO: 1776 - DNA, 804 bp, Bacillus licheniformis
atgaaacagagaatattgacgggtgtgatcgcggcagcggtttttctgccgctcgtgattttcggcgagctgccgttcaccctgctagtttatgcaataggtatacttgctctatttgaacttttaagaatgaaaggcctgaagctgatcagcgctccgggtatcatcagcatgctgctgttggcggttttgctgtgtccaagccaatacgcggaagacgctgggctgggtataaccaaaggggaggtcgtctttttggcggtccttttgcttttggcatatacggtgctcagcaaaaactcgtttacttttgacgaagcggcattcgtggcgctggcagcagtttatatcggattcgggttttattactttattgaaatcagaaacatcggactcagctatgtcttttttgcgatcggcgtcgtctggtcaacagattccggcgcttattttatcggaaaggcgtttggaaagcggaagctctggcctgaaatcagccctaacaaaacggtagaaggcttttggggcggaattttgacagcggtcgttttttccgcgatttatcaggccgccacaggttttccgcacgcttatctgtttgtgctgatcattaccgtgcttttgtcaatcgtcggtcagatcggcgatttggccgagtctgcgttcaaaaggcattaccaggtgaaagactcgggccggatcctcccgggacacggcggaatgctggaccgctttgacagctttttatttgtcatgccggttctgtacttcctgcttgttctttttcagccgttcgggctatga

SEQ ID NO: 1777 - DNA, 1152 bp, Bacillus licheniformis
ttgaagaacatatgtctattgggagcgacaggctccataggagaacagacgcttgatgtcatcaaagcgcatgacgataagtttcggctgaccgccatgactttcggcaaaaacgccgaaaaagcggcagaaatcattgaaacctttaaaccgaagtatgtaggcgtcggggatgagcatacatatgaaacattaaaacagcattctttctcctacacctttaaaacagggatcggggaggaagctttaatcgaagcggccgttatcccggaagcggatatcgtcgtcaatgctctcgtcggcagcgtcggtcttcttccgactttaaaggcgatggagcataaaaaaacaattgcgcttgcaaataaggaaactctcgtgacagccggtcatatagtgaaagaacacgcccaaaaatacgatgtcccgctcctgcccgtcgacagcgaacattccgcgattttccaggcccttcagggggaaaatccgaagcatatcaaacggctgatcgtcacggcttcaggcggcagcttcagggacagaacaaggcgggaacttgaaggcgtcacagtggaagaagccctcaatcatccaaattggtcgatgggtgcaaaaatcacgatcgattcggctacaatgatgaataaaggactcgaggttattgaagcccactggctgtttgatctgccctatgaccagatcgatgtcctccttcacaaagaaagcattattcattcaatggttgaattccacgaccgcagcgtcatcgcccagcttggcacacctgatatgagagtgccgattcaatatgcgctcagccatccggaacgcctgccgtttaatgaagcaaaatccctcgatctctgggaagtcggacagctgaattttgcccaagctgattttgaaaggttccgctgcttacaattcgcttatgaatcaggtaaaataggcggtacaatgccgactgttttaaacgcggccaacgaggaagccgttgcggcatttctttcgggcaggatttcctttcttggaatagaagacatcattgaaaaggctttggaacgccatcaggtgatcgcaaagccgagccttcaagagatccgtgaagtggacaaagacgccagaaagtttgtccaaacattactcacataa

SEQ ID NO: 1778 - DNA, 1260 bp, Bacillus licheniformis
gtgaatactgtgatcgcgtttattcttatttttggaacgctcgtatttttccatgagcttggtcatctcatccttgctcaaagagccggaatactgtgccgggagtttgctatcggcttcggtccgaaaatcttttcgtttaagaaaaatgagaccgtttatacgatcaggcttcttccgatcggcggctttgtcagaatggccggcgaagatcctgagatgattgaagtgaagcccggttatacggtcgggctgttgttcgacagcgaaaacaaggtcgaaaagatcattatcaaccaaaaagaaaagtatcccgacgcattggtcattgaagtggagcaggccgacctggagcaccagatgaggattacgggctatgagcacggcaatgaagatcatctctcttcattttctgtcagtgaaacgtcctttttcatcgtagacggggaagaagtccagatcgctccttacaaccgccaatttcattcgaaaacggtttggcagcgcatcaaagcgattgctgccggaccgatcatgaactttattttggcttatgtcatactcgtgatgctcggactgatgcagggagtgccgtctgacgagccggtgctcggcaagttgatagacaacggacgggcggcggaagcaggcctccaggagggagaccgcattcaaacgatcaacggggagaacatgaggtcgtggacggatattgtcaacacggtcagagaacaccctgaaaaagaactgaaaatcgttttgatgcgcgacaatgtcaagctgacgaaatacgtaacacctgaagctgtcaaggcaggggatgaaaccgtcggcagattcggcgcttacaatcctgtgaaaacaggcgttctgacatcgatttcctacggtgcgaccgaaacggcgacagtggcccagagcatcgtcaccaatctcggaaagctcgtcacaggacaattctcaatcgacatgctggccggtcctgtcggcatttatgacatgacagaccaagtggccaagacaggcgttatcaacctgctgaagctggccgcatttttaagcatcaacctcgggatcgtcaaccttctgccaatccctgcgctggacggcggaagactgttgttcctgtttattgaagcgatccgcgggaagccgatcaaccgcgaaaaagaagcgtttgtcgtctttatcggcgtcgcatttttgatgctcctaatgcttgtcgtcacatggaacgatatccagcgcttatttctgtaa

SEQ ID NO: 1779 - DNA, 1719 bp, Bacillus licheniformis
atgagacagagcaggactttaattcctacgctccgcgaagtgccggctgatgctgaagcgaaaagccatcagcttcttctcagagcagggtttatcagacaaaacacaagcggtgtatacagctatatgcctcttgccaataaagtcattcataaaatccagagcattgtccgcgaagaaatggagaaaatcaatgccgtcgaaatgctgatgccggcgctccagcaggcggaaacttggcaggaatcgggaagatggtatacgtacggtcctgagctcatgaggctgaaagaccgccacggccgtgaatttgccctaggcgcaacacacgaagaggtcatcacaagcatcgtcagagatgaagtgaaatcgtacaagcgccttccgctgaccctttaccagatccaatcgaagttccgcgatgaaaagcgcccgcgcttcggtctgttgagaggccgggaattcatcatgaaggatgcgtattccttccattcctccgccgaaagccttgatgaaacgtacaatgatatgtatcaggcgtatacgaatgtgtttacgcgctgcggcctgaatttcagaccggtcattgcagactcaggcgcgatgggcggaaaggatacccatgaatttatggcattgtccgatgtcggtgaggatacaattgcgtattctgatcagtcttcatacgccgccaacattgaaatggctgaagtgaaggaaacagatgccggcgagcaggcagaaatgaaagagctgcaggaagtccacacaccttcggtcaaaacgatcgaagaggttgccgcatttcttggcatatccccgtcagactgcattaaatcaatgctgatgaaagcagacggacgttttgtcctcgtcttgacgagaggggatcacgaagtcaatgatgttaaggtgaaaaacctgcttcaagcagaaataatcgaattcgcgagcgccgaagaggttgcagagataacaggcactgaacccggttttgtcggaccggtggggctcgaccgcgaaatcgaaatctttgcagactttgctgtgaaggcgatggcaaacgcagcagctggagcgaataaaacagattaccattatcaaaacgtgaatatcagccgggatgcgcacaatgtgacattcgccgatctccgctttatccaggaaggagacccttcaccggatggaaaaggaacgatccgttttgcaaaaggaatcgaagtcggacaagtctttaagctcggcacccgctattctgaagcgatggacgccacataccttgatgaaaacggacgcgctcagccgatgctgatgggctgctatggaatcgggatttcccggacgctttcggccatcgttgagcagcatcatgacgataaaggcttgatctggccgctggaagtgacgccgtatgacctgcatatcctcgcgcttaatatgaaaaatgacgcgcaagttcagcttgccgaaaagctgtatgaagaatttaaagcgaacggctatgacgtactgtttgatgaccgtgccgaacgggccggcgttaaatttgcagattccgatttgatcggtctgccgatccgcatcacggtcggaaaaagagctgacgaaggcgttgtcgaagtgaagatccgcaaaaccggagaatcctttgaaatcgctgctgatgagctgtttgactttatcgaaaaacaagtcaagagcttatcttctcactcttaa

SEQ ID NO: 1780 - DNA, 4317 bp, Bacillus licheniformis
ttggaagaccagctttctgtcaacagaagacagtttcaaattcttctgcagcagctgaatgtaacggaagatacgatgatccgccaccttgaaggcggacaaatcataaagctgaccgttcataaaaacaagaagacatggcactttcactttaaattgagaaatgtgctgccttatcaaatcttcgaacggtttcacagccagctgacccgcaccttttcccatatcgcccaggtcacctgttccatcgaggcggaaaacccttcgattgacgagcagcttgttcaggattactggacgcgctgcattcaggaactcgatggtatttctccgccgatcttggcgcttttgaacgaccaaaagcccaagcttacgggaaacaaaatcctgcttaaaacgaaaacagatacagaagcgtccgctttaaaaaagaaatacagctcgctcatccagtcaagctaccgcacattcggctttcctgagctccagctggacacagaaatttttgtatcagatcaagagattcagaaattcagagagcaaaaaatggccgaagatcaagagagggcccttcaggctttaatcgaaatggagaagcaggataaggaagcacaagacgatgaagcgccggcaggccctcttcagatcggctaccagattaaagactctgaagaaatcagaacgcttgacagcatcatggatgaagagcggagaattacggtgcaaggctatgtattcgacgctgaaacaagagagctgaaaagcggcagaacgctttgcatctttaaaataaccgactatacaaacagcattcttgtcaaaatgttcgcccgcgaaaaagaagacgctgtattgatgaagtccctgaaaaaagggatgtgggtcaaggcgagaggaagcatacaaaacgatacattcgtccgcgatttggtgatgatcgccaacgatgtcaatgaaatcaaagcgaaaacccgtgaggatacagcgccagaggacgaaaaacgagtcgagctccacctccattcaccaatgagccagatggatgccgtatcaagcatcggcaagcttgtcgaacaggcgaaaaaatgggggcacccggctatcgcgctcactgaccatgccgtagtccaatcgtttccggatgcattcgcggcaagcaaaaagcatggcgtgaaaatgatctacggacttgaagccaacctcgtcgacgacggcgtgccgattgcctacaatcccgtgcaccgtctgcttgaagaggaaacatatgtcgtgttcgacgtcgagacgacggggctgtctgccgtctatgatacaatcatcgagctggccgccgttaaagtaaaaggcggggaaatcatcgaacgctttgaaaggtttgccaacccgcatcgacctttatcggctacgatcatcgagctgacggggattaccgatgatatgctgaaagatgcgcccgaagtcgaagaggtcatccgcgattttaaagaatgggtcggtgatcacacgcttgtcgctcacaatgcaagctttgacatcggcttcatcaatgtcgcctataagcgcctgctgaattcggagaaagtgcagaacccggtcattgacacgcttgagctgggccgttttctttatccggaattcaaaaaccacaggctgaatacgctttgtaaaaagtttgacatcgagctcacccagcatcacagggcgatttatgataccgaagcgacgggttatctccttgtgaaaatgctgaaagatgcggccgaaaaaaatatcctgtaccacgatcagctgaatgaaaatatggggcagtccaatgcctatcagcgttcaaggccatatcacgcgacacttttggcggttaatgagacaggcttgaaaaaccttttcaaacttgtttcgctgtcgcatatccattatttttacagggtgccgaggatcccaaggtcacagcttgaaaagtacagagaagggcttttaatcggttcggcgtgcgacaaaggcgaagtatttgaaggcatgatgcagaaatcgccggaagaagttgaagacatcgcttcattttatgactaccttgaagtcatgccgcctgaagtctaccggcacctgcttcagctcgaactcgtcagggatgaaaaagcgttaaaagaaatcatcgccaacatcacaaagctcggcgagaagctgaatatcccagtagtagcaactggaaatgtccattatctgaaccctgaggacaaaatttaccggaagattctagtttcctcgcaaggcggcgcaaatccgctcaacaggcacgagctgccgaacgttcatttccgttcgacggatgaaatgcttgaggccttttcatttttgggtgaggaaaaagcgaaagaaatcgttgtcaagaacacccgcatgatcagcgagcgaatcgaagaaatcaagccgatcaaagacgatctttacacaccgaagatcgaaggcgcagatgacgaaatccgccgcatgagctatgagaaagcaagaagcatttacggcgaggacctgcccgaaatcgtcgaaaaacggatcgaaaaagagctgaaaagcataatcggccacggattcgccgtcatctatctgatctctcataagcttgtaaaacgctcccttgatgacggctatctcgtcggttcgaggggatcggtcggttcttcccttgtcgcaacattgacggaaattaccgaggtcaacccgctgccaccgcattacgtctgtccggattgccgccattccgagtttttcaacgacggatcggtcggttcgggatttgatttgcctgacaaagactgtccgaagtgcggagcggcctacagaaaagacggccacgacattccgtttgagacgttcctggggtttaaaggggacaaggttcctgatatcgacttgaacttctcgggcgaataccagccgcatgcccacaactatacgaaagtcctgttcggagaggataacgtctaccgtgcgggaacgatcggaacagtcgccgaaaaaacggcttacgggtatgtcaaagggtatgcaaacgacaacaatttgcatatgcgcggggcggaaatcgaccgacttgtccaaggctgtacaggcgtcaagcggacgacagggcagcacccgggcggaattatcgttgtgccggattatatggatatttacgacttttcaccaatccagtttccggcggatgccacagattccgaatggaagacgacgcattttgacttccattccatccatgacaaccttctgaagcttgatattctcggacacgatgatccgacggtcatccgtatgctccaggatcttagcgggattgatccgaaaacgattccgaccgatgatcctgaagtgatgaaaattttccaagggacagagtctttaggggtaaccgaggaacagatcggctgtaaaaccggtacactcggcatccctgaattcggaacccgctttgtcagacagatgcttgaggacaccaagccgacgacattttccgagctcgtacagatttccggcctgtcacacggtacggacgtatggctcggcaacgcgcaggagctgattcacaacaatatttgtgaactgagcgaagtgatcggctgccgtgatgacattatggtgtacttaatctaccaggggcttgagccatccctcgcctttaagattatggagtttgtccgtaaaggaaagggactgacgcctgagtgggaagaagaaatgaagaataataatgttccggactggtatatcgattcctgcaaaaaaatcaaatacatgttcccgaaagcccacgctgcggcatatgttttgatggcggtcaggatcgcttattttaaagtccatcatccgctgctctactacgcagcatacttcaccgtgcgggccgacgactttgacatcgaaacgatgatcaaaggatcgacagcgatcagagccgtcatggatgatatcaactctaaaggccttgacgcttctccaaaagagaaaagtttgctcacggtgcttgagctggcgcttgaaatgtgcgaaaggggcttctctttccaaaaagtcgatttatacagatcgagcgcttcagaattcatcattgatggaaacagcttgattccgccgtttaattcaataccggggcttggaacaaacgccgccttgaatattgtcaaagcgagggaagaaggcgaatttctttccaaagaagatttgcaaaaaagaggaaaggtgtcaaaaacgatcatggaatacttggagcgccacggctgtctcgagtcgcttccagatcagaaccagctgtcattattctag

SEQ ID NO: 1781 - DNA, 1965 bp, Bacillus licheniformis
gtgaaacagaaagcatttttaaaaatgaaagcgctttgtttggcacttttagtgatcttctctatgagcatagcgtcgttttcagaaaagacccgtgcagcttctgctgaagaatatcctcataattatgctgaactgctgcaaaagtctttgttattttatgaagcacagcgctcgggaagacttccggaaaacagccggctgaattggagaggagactccgggcttgaggacggaaaagacgttggcctcgatttaacgggagggtggtatgatgccggcgaccacgtgaagttcggtctgccgatggcttattctgccgcaatcctgtcatggtcggtctatgagtaccgagatgcctacaaagaatcgggtcagcttgatgcggcgctggacaatattaaatgggcgacagactactttcttaaagcccatacggctccttatgaattgtggggccaagtcggaaatggcgctctagaccacgcatggtgggggccggccgaagtaatgccgatgaagcgccctgcctataagatcgatgccggctgtccggggtcagaccttgctggtggtacagccgcagcgctagcatcagcatcaattattttcaagccgacagattcttcttactctgaaaaattactggctcatgccaagcaattgtatgattttgccgaccgctaccgcggcaaatattcagactgcattacagacgcacagcaatattataattcgtggagcgggtataaagatgaactgacatggggagctgtctggctctacttggcaacagaagaacaacaatatttggataaagcccttgcttcggtctcagattggggcgatcccgcaaactggccttaccgctggacgctttcctgggatgacgtcacttacggagcacagctgctgctcgctcgtctgacaaacgattcccgttttgtcaaatctgtcgaacgcaatcttgattattggtcgacaggctacagtcataatggaagcatagaacggatcacgtatacgccgggcggtttggcctggcttgagcagtggggatcattgcgatacgcttcgaatgccgcttttctcgctttcgtttattccgattgggtggatacagaaaaagcgaaaagatatcgggattttgctgttcggcaaacggagtatatgctaggagataatccgcagcagcgaagctttgtcgttggatacggtaaaaatccgccgaaacatccgcatcaccgtacagcacacggttcatgggccaatcagatgaatgtgcctgaaaaccatcgccataccctatacggcgcattagtcggcggtccgggaagggacgattcgtaccgagatgacataacagattatgcgtcaaacgaagttgcgatcgattataatgccgcttttaccggcaacgtagcgaaaatgtttcagctgttcgggaaaggccatgttccgctgcctgattttccggagaaggaaacacctgaggacgaatattttgcagaggcatcaatcaacagctccggaaacagctatactgaaatccgggcgcagctcaataaccgttcgggatggccggcaaagaaaaccgatcaattgtctttccgctactacgttgacttgacggaagctgtagaagcgggatattccgccgaagatataaaagtcacagccggctataacgaaggggcctcggtatcagagctgaagccgcatgacgcttcaaagcacatttactatacagaagtcagcttcagcggggttttgatttatccaggcggtcaatccgcccataaaaaagaagtgcagttccgcctttcggcaccagacggaacgtctttttggaacccggaaaatgaccactcttatcagggtctgtcacatgcgcttctgaagacgcggtatattcctgtttatgatgatggacggctcgttttcggacatgagcccggttactag

SEQ ID NO: 1782 - DNA, 2115 bp, Bacillus licheniformis
atggataataaaacacgttttatgcagctgtatgagcaaattaaaaatccgaacaacggttatttctcacccgaaggaattccctatcactcggttgaaacgctcatatgtgaggcgcccgactacggtcatatgacgacatctgaagcgtacagctattggctgtggcttgaagcgatgtatggccggtacacacaggactggtcaaagctagaagccgcctgggacaatatggagaaatatattatcccggtcaatgaaggagacggaaacgaagaacagccgaccatgaactactacaacccctcaagtccagccacttatgctgcagaacacccctacccagatctgtacccttcagcgctgaccggacagtatccggcaggaaatgacccgctcgatgccgagcttaaagcgacatatggaagcaacgaaacgtatttaatgcattggctgttagatgttgacaactggtatggcttcggaaatcttctgaacccttcgcacactgccgtttatgtgaacacttaccagcggggcgaacaggaatccgtttgggaaacggttccgcatccgtctcaggataatcagacgttcggaaaaccgaatgaaggtttcatgagcctttttacaaaagaaaatcaggctccagcaccgcaatggcgctacaccaatgcaacggatgcagatgcgcgcgccgttcaggcgatgttctgggccaggcaatggggctacagcaatactaattatttagaaaaagctaaaaaaatgggggactttctccgttacggcatgtatgacaaatactttcaagagattggaagtgccgctgacggctcgccttcccgcggtgctggaaaaaatgcatgtcattatttaatggcgtggtacaccgcttggggaggcggattgggacagtatgcaaactgggcgtggcggatcggtgcgagccatgtgcatcaaggttatcaaaaccctgttgcctcttatgcactgtcaacggctgaaggcggattgattccaaattcatccacagcgcgaagcgattgggaaaaggcgctgaaaaggcagctagaactttacacatggctgctttcttcagaaggagccgttgccggcggcgccacgaacagctggaacggcaactacagcgcatatccgcagaatgtcagcacattttacgaaatggcctacacagaagcgcctgtatatcacgatcccccttctaacaattggttcgggatgcaagtctggccgctggaaagggtggcggaactgtattatattttcgcagagaaaggtgacaaatcgtctgaaagcttccacatggcaaagcatgtgattgaaaaatggatcgcatattcacttgattatgtgtttgtgggcgaacggccggttactgacgaagaaggctattatttaaatgatgcgggagaacgcgtccttggcggccaaaacccgcagatcgccgtacaatccgacccaggcgagttttggattccggcaaaccttgaatggagcggccagcctgatccgtggaagggatttgattcatttaccggaaatccgggactgcatgtcacgacgaagaatccttctcaagatgtcggcgttctcggcagctatattaaaacgctcgtcttctttgcggccggaacaaaagccgaaaccggcggctttaccgctcttggaaacaaagccaaaaatctggcaaaagaactgcttgatgcagcatggagtaaaaatgacggaatcggtatcgcagcagaggaagaacatgaagattatatccgctactttacgaaggaaatctactttccgaatggctggagcggcagaaacgggcagggcaataccatccctggccccaacactgtgccgtctgatccggcaaaaggcggtaacggcgtctatatcagtcatgcggagctccggccgaaaattaaaaatgatccgatgtggccttatttggaaaacaaatatcagacctcgtggaatccgaatacgggcaaatgggaaaacggactgccgacctttgtatatcaccgtttctggtctcaggtcgatatggcgacagcttatgctgagtatgaccgtttaatcggaaatgcataa

SEQ ID NO: 1783 - DNA, 1683 bp, Bacillus licheniformis
ttgagagaaaaatggttagccttatgtttaaagtcgatcattctgttcgttttgatcatgggaaccgttcttttatccgcagttccgaaagcttcgggaacaagcgggccagcaaagcaagaaaagcagagcatcatcaccccggctgatcttttggaaaacatgagccctggatggaaccttggcaacacgctggatgctgttccgacagaaggctcttggaacaatccgccggttcgcgagcatacttttgatgatattcgcgatgcggggtttaaaagcgtccggattccggtgacatgggattcccacatcggcagcgctccagagtatccgatcgataccgattggatgaaccgggtagaagaagtgacagattgggctttggaaagagagttttacgtcgtgttaaatattcaccacgattcttggctatggatcagccggatgggaaacagccagcaggagacattagataagctggggaaagtctggaagcagattgccgagcgcttcaaaaacaaaagtgaacgcctcctgtttgaaattgtcaatgagccgaccggaatgagcgcatatcaaatgaatctgcttaaccgagagatgctgaacatcatccgttcgaccggcggcaaaaacggccagcggctcgtaatcgtcggggggcttgaagataacaaagatgaattgcttcattcatttgaaccgcctgatgatgaccggattgtcctcacatatcactactattctccttgggattacgtatcaaactggtggggccggacgacttggggatcggcagccgaaatctccgagatggaggaggatatcaaaccggtttatgaaaaatttgtaagggaaggatacccggttatcatcggtgaatacggtaccctcggcgccaatgaaaagcattcaaaatggctctatcatgatacgtttgtccgccttgcccacaaatatcaaatggtcccgatgtggtgggacaacgggaatgaccagtttgaccgggctgagagacagtggcgtgatcctgttgttaaagagattgtcattcaggcgggacgcggcgttcccaatgcgatcatcaaaccggcagatctttttatcaaaaaaggtcaaagcatcagcgatcagacggtggacattcagctgaacggcaatgtgctgactggcatttatcagaaatctgaaccattaaaggaaggcagtgattatacagttgacaatgccggaaaaacggtctctattaaggcatcctgcttggcaaagctgctgaacggggcggggcagcctggggtaaaagcgcagctcacttttacgtttcataaaggagccagccaggttatggatatcattctttatgatgacccgaagcttgaaaaaagcgaattcaccatcagtcaatcggcaatcagcggtgatctcaaaatcccggcgtcactgaacggaacgaagctggccacggttaaaggagtcgtcgattctacaggaaggccggttcttgaagaagtatggtcatggacgccctacttgaactatgacgaagatttttacgaaaaagacggggatttgtatttgaaagagcgggttttaaagtatttgaaaagcgattccacctttacatttgaactgtggccgaaaggcgtggaggcggtcgtgaaggtgaaaatcacgccttga

SEQ ID NO: 1784 - DNA, 1188 bp, Bacillus licheniformis
atgatgacgaaaaagggtttattgacagtgctgatgccgtttttgcttgcactttccgccattcagtttggcaatccccggcctgcactagccgcgtctccttttgttgagacagccggaacatcgttcactttaaatgggaaagaattttattttgccgggacgaataactattattttcattataaatctaaaaaaatggtcgatgatgtgttcgaagatatgaaagcgatgaatttgaaagtgatccgcatctggggatttcttgacggccagccgcaggaaaatacagtcatgcagccaaggccgggcatatatgatgaatcaggcttttcaaagcttgactatgccatttataaagcggggcagacagggataaaactagtcatcccttttgtgaacaactgggatgatttcggcggaatgaatcaatatgtcaggtggtttcaggcggatggacatgacgccttttatactcatccggacattaaagaggcgtataaaaattatgtatcctatatgctgaaccgagtcaacacatataatggcgtcaaatataaagatgatcccgcgattatggcgtgggagcttgccaatgaaccgagggtccagtctgacaggaccggaaatacacttgtcgaatgggcggatgagatgagcgaatttattaaatccattgatcagaaccatcttgtagcggttggagatgaaggattttatcatatagaagggcaccctgattggcattacaacggcggagagggtgtggattggaaaaggctgaccgctctgaagcatattgattacggcacatatcacctctatccggatcattggggcaaaacggccgagtgggggaatcagtggatcacagaccatatttgcgatggaaaagaaatcggcaagccggtcgttttagaagagtacggctatcaggataagtccagaagggactacgtctacagaacctggcttgaactcatagaaaagcagagcggtgcgggcagccaattttggattttgaccggcattcaggatgacgggaccctttatccggactatgacggttttcggatcgtttatccgagctctgccgcttctgtcatttcagagcacgcggagcggatgaatgaaaaatcagccgcttccgaaatgcttcagactaaacgctgtcatgatttgcaataa

SEQ ID NO: 1785 - DNA, 474 bp, Bacillus licheniformis
atgagtaacaaagtgatcgataccgtcagcgaaatggtccagcctatactagacaatcttcagcttgagctcgttgacatcgaatttgtcaaggaaggccagagctggtttcttcgcgtgtttattgattcagatgacggcgtagacatcgaggaatgtgccaaggttagcgaagctcttagtgaaaagctcgatgaggctgatccgatcaagcaaaactattttcttgaagtatcgtccccgggagctgagaggcctttaaagaaagaagccgatttcatgaaggcgctcggaaaaaacgtatatattaaaacgtacgaacctattgaaggcaataaagagtttgaaggcgagctttccgcatttgacggtgaaaacgtggaggtcacggtgatgatcaaaacgcgccggaaaacgatcaatattccatatgacaaagtagccaaagcgaggctggctgtttcgttcaattaa

SEQ ID NO: 1786 - DNA, 1119 bp, Bacillus licheniformis
atgagtagtgagttgttagatgccctgactgttcttgaaaaagaaaagggaatcagtaaggacattattattgaagcaattgaagctgcgctcatttccgcttataagcggaacttcaaccaggcgcagaacgtcagggtagatttaaaccgcgacaccggttcaatccgcgttttcgcccgcaaagatgtcgtggatgaagtgtatgatccgcgccttgaaatctcgattgaagatgccgtaaacatcaatccgaactacattgtcggagatgtcgtggaaatcgaagtgacgccgaaagatttcggccgcatcgctgcccagacggcaaagcaggtcgtgacccagcgcgtccgcgaagcggagcgcggcgtcatctattctgaattcatcgaccgcgaggaagatatcatgacaggcatcgtccagcggatcgacaataagttcatctatgtctctttaggaaaaatcgaggcgcttctcccggttgcagaacagatgccgaatgaagtctacaagcctcatgaccggatcaaggtgttcattacaaaagtcgaaaaaacgacgaagggtccgcagatttacgtttcaagaactcatccaggtttattaaagcgtctctttgaaatcgaagtgccggaaatttacgatggaacggtcgagctcaaatccgtggcgagagaagcgggagaccgctcgaagatttccgtccgcacggataatcccgacatcgatcccgtcggcgcctgcgtcggaccgaagggtcagcgcgttcaggcgatcgtcaatgaattgaaaggcgagaaaattgatattgttcactggtcaaacgacccggttgaatttgtcgccaatgcgctgagcccttcaaaagtgctcgacgtcatcgtcaatgaagaggataaagcgacaacggttgtcgttcctgactatcagctgtcgctcgccatcggaaaaagaggtcaaaacgcccgcctggcagccaagctgacaagctggaagatcgatattaaaagcgaaacagatgcaagagagcttggaatttatccaagggagcttgaagaagaggagccggaagagcttttcttggaaagcgaaactccagaatcggatgaataa

SEQ ID NO: 1787 - DNA, 276 bp, Bacillus licheniformis
gtgaaaagccgaaagaagatcccgcttagaaaatgcgtcgtaacaggggaaatgaagcctaaaaaagagctcatccgcgtcgtccgttcgaaggaaggcgaagtttccgttgacccgaccggcaagaagaacggccggggagcctaccttacacttgataaagacgtcattttaactgcaaaaaagagaaacagcttagcaaatcagcttcaagcacagattgatgatcagatttttgatgaactgctggaactggcggaaaaggagaatagataa

SEQ ID NO: 1788 - DNA, 303 bp, Bacillus licheniformis
atgtcggaatcagaatggttttccttgctgggtctggcgaatcgagctcgaaaggtcgtgtccggagaagacctggttgtgaaagaaatcaggcattcgcgcgcaaagcttgttttgcttgcagacgacgcatcggctaacacggagaaaaaagtaaccgacaaatgcaggcactacgatgtaccggtgaaaaaagtcggtgatcgtgtgcttctgggccgttcaatcggcaaagaatcccgtgtggttgttgctgtcactgatcaaggttttgcgaatacgttgctccgaaagctcgattaa

SEQ ID NO: 1789 - DNA, 2151 bp, Bacillus licheniformis
atggctaaaatgagagtttatgaatatgcaaaagccataaatgtttcaagtaaggatattatcgcggcattgaaagatatgaatatcgaagtcaataaccatatggcgatgatcgaagaaaatgcgatcaaacagctcgatcaaaaattcaagaagagcgctaaacctgcgggaaataaaaaggatgccggtacaggcggacaaaagccgcagcaagaagccgcaaaactgaatgccggaagtaagccaaacaaaaatcgagacggaaagaagaataacgtgcagaatactcaatttaacaataaaaacaagaagaaaaacaacaacaacaaaaagaacaaacgcggtaaaaatcatcaatctcctcaggagaagcagttcaagccgaaaaaagaactgcctgaaaaaatcgaatttaccaactcaatgtcggtcggcgcgcttgccgaagagctcggaaaagaaccgtcagaaatcattaaaaaattaatgcttctcggcatcatggcgacgatcaaccaagatcttgacaaagataccgttgagctgatcgcttcagaatacggcgtcgaagtcgaagaagtgatcgtccatgaagaaaccgaattcgaaaaatacgaagagccggataacgaagaagacctcgaaatccgtcctcctgtcgtaacgatcatgggtcacgtcgaccacggaaaaacaacgcttctcgacagcatcagaaaaacgaaggtcgttgaaggcgaagccggaggcatcactcagcatatcggcgcttatcagatcgaggaaaacggcaagaagattaccttcctcgacactccgggccacgccgcgtttacaacgatgcgcgcacgcggtgcggaagttacggacattacgattctcgtcgtagctgcagatgacggggtcatgccgcagacggttgaagcgatcaaccatgcgaaagcggctgaagtgccgatcatcgtcgctgtcaacaaaatcgacaaaccgacggcaaaccctgaccgcgtgatgcaggagctgactgaacacggtcttgttcctgaagcatggggaggcgagacgatttttgttcctctttccgcactttcaggagagggaatcgatgagctgatcgaaatgatcctgctcgtcagcgaagtcgaggagctcaaagcaaatccgaaccgcagggcaaaaggaacggtcatcgaagccgagcttgataaaggtaaaggttctgtcgcaacgttgctcgttcaaaacggaacgcttcacgtcggagatccgatcgtcgtcgggaacactttcggacgcgttcgtgcgatggtcaatgatgtcggcagacgcgtgaaatcggcgggaccgtcaactcctgttgagatcaccgggttgaacgaagttccgaacgcaggggatcagttccttgtgttcaaagacgaaaaaacagcccgttccgtcggcgaagcgcgcgctaccaaacagcttgaagaacagcgcagcgataaagcgaagctcagccttgatgacttgtttgaacagattaaacaaggcgatgtcaaagaaattaacctcgtcgtaaaagccgatgttcaaggctctgttgaagcgctggccgcagctttgcaaaaaattgaggtcgaaggcgtcagagtcaaaatcatccacacaggcgtaggtgcgattaccgaatcagacattattttagcttctgcatcaaatgcaatcgtgatcgggtttaatgtcagacctgacggaaatgctaagagtaccgccgaagccgaaaatgtggatatccgcctccaccgcatcatttataaagtcatcgatgagatcgaagcagccatgaaaggcatgcttgatcctgagtatgaagaaaaagtgatcggcatggttgaagtccgtcaaacattcaaagtctctaaaatcggaacgattgccggaggctatgtaacggaaggtacgatcacgcgcgacagcggaatccgcttgatccgcgacggcgtcgtcatctttgaaggggaagtcgatgtgctgaaacgctttaaagatgatgtcaaagaagtttcacaaggctatgaatgtggtatcaccattaagaaatacaacgacatacgcgaaggcgatatgatcgaagcgtatgtcatgcaagaaattgaaagaaagtga

SEQ ID NO: 1790 - DNA, 279 bp, Bacillus licheniformis
gtgatcggtttcgttgaatgcgaatgcatcatttacgatgcatcatcactcaaggaaaagcgggcggtgctgaagcggatcatcacaagaatccgcgccaagttcaacgtttctgtttcagaaattgactatcaggacacttggcagcgcacaagctttggtatcgccgccgtttcttcctctcgcgtgcaaacggaaaaagagctgcagcgggtcctcgcctttattgactcttttccggaaattgaacggacgatcacgagaacagagtggttttaa

SEQ ID NO: 1791 - DNA, 354 bp, Bacillus licheniformis
atgacgatgagagctacccgtgtgggagagcagatgaaaaaagaacttggtgacattatcggcagaaagctgaaagatccgcgaatcggatttttaacagtcaccgacgtcagggtctcaggtgatttgcaaattgccaaagtgtatatttccgttttaggcgatgaaaagaaacgggaagaaacgctcaaaggcctggcaaaagcaaagggctttattcgttccgaacttggaaaccgaatcaggcttcgcaaaacacctgaaatccattttgagttcgatgaatcgatcgattacggaaaccgtatcgaaacattgattcacgagctgaacgcaaacaaagaagaatcataa

SEQ ID NO: 1792 - DNA, 930 bp, Bacillus licheniformis
atgtataacggagtccttctattacataaaccggtcggcatgacctcgcacgactgcgtcatgaagatccgcaaactgctgaaaacaaaaaaggtcggccataccggtacactggatcccgaggtgtcgggcgttctcccgatctgcgtcgggagggcaaccaaaatcgtcgagtatttgaccgaaaagtccaaaacatatgatgcagaggtcacgcttggctgttccacggagacagaggatcagacgggggaagtcacagaaaagaaacccgtcttagcgccgcctgatgaacagaccgtgcagagcgtcctgagatctcttgaaggaacgattgagcaggttccgccgatgtattcagctgtcaaggtaggcggcaaaaagctgtatgaatacgcgcgggctggaatcgaggttgaacggccgaagcggaccatcaccatccatcatatcgaactgacatccgagatccgccatgagggggataaagcccgcttccggtttgttgtgacatgttcaaaaggcacatatgtcaggaccttggcggtaaccatcggggagaagctcggatatcccgcgcatatgtccaatctggtcaggaccgcgtcaggccctttcacccttgacgaatgcttgacctttgaagacgtcgaaggcttgatcgctgacggaacattgtctgaaaagctcgtccccatcgaacgtgcgcttgatcatttgccgaaatggataattagtgatacattagctaagaaagtggaaaatggagcggtgcttgaaacgcccggcagcttttctcatttgacgagcgaagaccgcattgcggtctttacggaagcaggccggtgcacagccgtctattatccgcatccgaccaaaaccggtttgttgaagccggcaaaagtacacgtgcaaaaaagcgaacaatag

SEQ ID NO: 1793 - DNA, 960 bp, Bacillus licheniformis
ttgaagacgatacatatttcccacccacacgacttgaagcgtgaggattttccgacatcagttatggcattaggttattttgacggtgttcacctgggacatcagcaagtgattcttacagcaaaaaacaccgcggcaagagaaggggtcaaaacgtccgtgatgacctttcatccccacccttctgccgtgctcaaaaaaggccgggagccgaaggatttaatcacgcctttgcaagacaaaatcagcatcattgaagatttaggggtcgattttttatacgttgtcacatttacccctgaattcgcttctctatcacctgaggaatttatcgatcaatatatactcggctttcatgtcactcatgttgtagccggatttgactttaccttcgggaaattcggcaaaggcactatggaaaacttccaggagtatgcgaaaggccgtgttaaaagcacgtctgtcgcaaaatattccaatcaggatcaaaaggtaagctccacgaggatccgcagcgttctgggagccggtgacgtcgagtacgctgctgaactgctcggcaggccgtaccatgtgaaaggctttgtgatccacggcgataaaagaggccgcacgatcggatttccgaccgcgaatatcggccttaaagacacatacatcgtcccgccgacaggtgtgtacgccgttaaagccgaaatcggcggcgctgtctacaacggcgtctgcaatgtcggatacaagccgacgttttacgaaaaacggccgggtcagccttcaatcgaagtcaacttattcgattttgaccgtgacatatacggctccgaaatcaaggttgaatggtataagcggctgaggagcgaaaaaaaattcggcagcgttgacgagcttgtcgaacagatttctagagacaaagaagaagcgatccgcttcttcagagagcggaagccggccggaatctag

SEQ ID NO: 1794 - DNA, 270 bp, Bacillus licheniformis
atggcaattactcaagagcgtaaaacacaactcatcaatgagttcaaaacccacgaatctgacacgggatcaccggaagttcagatcgctatcctaacagatcaaatcaacaacttgaacgagcatttacgcactcacaagaaagaccatcactcacgtcgcggtcttcttaaaatggtaggtaaacgtcgtaatcttcttacgtatcttcgtaacaaagacgtaactcgttaccgtgagttgatcaacaaacttggattacgtcgataa

SEQ ID NO: 1795 - DNA, 2118 bp, Bacillus licheniformis
atgggacaagagaaacatgtcttttccatagattgggccggccgcaagctcacagtagaaaccggccagcttgcaaaacaagcaaacggagctgtcatggtgcgttatggagacactgcagtgctcagcaccgcaacggcttcaaaagaacctaaaaccgtagactttttcccgttaaccgtaaattacgaagaaagactttacgccgtcggaaagattccgggcgggtttattaaaagagagggaagaccgagcgaaaaagcgattctcgccagccggttaatcgacaggccgatccgcccgctgttcgcagacggcttccggaatgaagttcaagtcgtcagcatcgtcatgagcgttgaccaggattgttcgtcagaaatggcggcaatgtttggatcatctcttgcgctgtgcgtatccgacatcccgtttgaagggccgatcgccggagtgacggtaggccgggttgacaacaaattcatcatcaatccgacacttgaacagcttgaaaaaagcgacattcatctcgtcgtagcgggaacgaaggacgcgatcaacatggttgaagcgggagcagacgaagttccggaagagatcatgcttgaagcgatcatgttcggtcacgaggagatcaaacggctgattgccttccaggaggaaatcgtcgccgctgtcgggaaagaaaaatcagaaatcaccctgtatgagatcgattccgatctgaaagaaaaagtgcggggaatggccgaatcgaacctcttaaaagccattcaggttcatgaaaagcatgcgcgcgaggacgcgatcagcgaagtgaaaaacgaggttttggccaagtttgaagaagaggaacacgatgaagaaacgctgaaacaagtgaaagacattttgtcccagcttgttaaaaatgaagtgcgccgtctgattacggaggaaaaagttcgtcctgacggcagggctgtcgatgagatccgcccgctttcttcagaagtcggactgcttccgagaacacacggttcaggactttttacaaggggacagactcaggcgctcagcatttgtacgctcggtgcgcttggcgatgtgcagattttagacggtctcggcgtcgaagaatccaaacgctttatgcaccattacaacttcccgcagttcagcgtcggggaaacagggccgatgcgcgggccgggacgccgcgaaatcgggcacggagccctcggggaacgagcgcttgagccgattgttccgtctgaaaaagacttcccgtacaccatccgcctcgtctctgaagtgcttgaatcaaacggttccacttcccaggcgagcatttgtgcaagcacgctagcgatgatggatgcaggggtgccgattaaagccccggttgccggaatcgcgatgggtcttgtcaaatcaggtgacaactataccgtcttaaccgatattcaaggtatggaagaccatctcggggatatggactttaaagtggcgggaacgtccaaaggcgtcacagctctgcaaatggatattaagatcgaaggcttatcgagagagattttggaagaggctcttcagcaggcgaaaaaaggcagaatggagatccttgaaagcatgctgagcacattggctgaatcaagaaaagagctttctccttatgcgccgaaaatcttgacgatgtcgatcaatccggataaaatccgcgacgtcatcggaccaagcggaaaacaaatcaataagatcattgaagatacaggcgttaaaatcgatattgaacaagacggcacaatcttcatttcttctaccgatgaaagcatgaaccaaaaagcgaagaaaatcatcgaagaccttgtcagagaagttgaagtcggacagctttacttaggtaaagtgaagcggattgaaaaattcggagctttcgttgaactgttcagcggaaaagacggtcttgtccatatttcagagcttgcgctcgaacgggtaggaaaagtcgaagatgtcgtcaaaatcggcgacgagctccttgtaaaggttactgaaatcgataaacaaggacgcgtcaacttatcaagaaaagctgtactgcgtgaacagaaggaaaaagaagaacaaaaatcgtaa

SEQ ID NO: 1796 - DNA, 963 bp, Bacillus licheniformis
ttgaaaggaacgattgttcggatttccgtttttttctttcttttgctgatgtcctatcagatgatgaaccgtccgtattcacaacattacatagatgcgatgaaaaaagacgcggtcacggttgccgctcaaaaggacgatttgtaccaggagcttttgcaaaaagcgcctgaatatgaagtgaaggcccagaatgcgaaaattgatcacatatggaaagcgatgcccggctacaacggcttaaaagtaaacatcgaaaaatcgtacaaaaaaatgaaacaggccggtgaatttgatgagaaactgctcgtttatgaccaagtgaagcctgacgttcatttagaatccttaaagcctgagccgatctaccgcggacacccggataaaccgatggtatcgtttattatcaatgtcgcttggggtaatgaatatttagaagagatgcttcccgtcttacaacagcatcgtatcaaagccaccttttttctggagggcagatgggtgaagcatcaccccgagctggccaaagccatacaaaacggcgggcatgaaatcggaaaccattcatacaatcatccggatatgagcaaactgacgagagaacgtatttcagaacagctgcggatgacaaatgaacaaatacaggaaacgcttggcgtcaagccgaagtggttcgccccgccgagcggcagcttccgcaaagaggttgtggatcaggctcacaagatggggatgggaacgatcatgtggacagttgatacgatcgattggcagaaaccgcagccggccgtcttacagcaacgggtattaagcaaagtacataacggcgccatgatattaatgcatccgacagatccaactgcaaaaagtcttgccgttttgatacagaacctgcatgaaaaaggctatcaaatcggaactgtttcacagctgatgaatgaaaaaaggcttgttgaagaatag

SEQ ID NO: 1797 - DNA, 1230 bp, Bacillus licheniformis
ttgattaaacggtatacttgtcaaaatggggtaagaatcgtattcgaaaacaatcccaccgtccggtctgtggccatcggagtttggattggaaccggatcaagacatgaaacacccgaaattaacggcatttcgcactttcttgagcacatgtttttcaaggggacaaaaacgcgcactgcaagggacatcgcagagtctttcgatagaatcggcggacaggtcaacgcgtttacctcaaaggaatatacgtgctattacgccaaagtgctcgatgagcatgcaagctatgctctggaagtgctttctgacatgttctttcattcatcatttgacgaagaagaattaaaaaaagaaaaaaacgtcgtctatgaagagattaaaatgtatgaggacacacctgatgacatcgtccacgatctcttgagcaaggcgtcatacggcagccattccctcggctatccgatcctcggcacagaggaaacacttgccgaatttgacggagattcgctcagaaaatatatgaacgaatattacacgcctgaccgagtcgtcatttccatagccggaaatgtgccggaaacttttataaaagaagctgaaaagcatttcggttcatatgaagccaaaggcaaaagaaccggcatgacaaaaccggattttcaccatgagaaaatgacgcgcaaaaaggaaaccgaacaggctcacctctgcctcggcttcaacgggctggaagcaggccatccggaaatctacgatttgatcgttctcaataatattttgggaggaagcatgagcagccgcctctttcaggatgtccgcgaagataaaggtcttgcatattccgtgttcagctaccacacttcctatgaagacagcggcatgatgaccatctacgcgggaaccggcgcaaatcagcttcagctcctgtcagaaacgattcatgaaacactgcgtgcgctgaaaagcgacggtattacaccgaaagagcttgaaaacagcaaagagcaaatgaaaggcagcctgatgctcagtctcgaaagcacaaacagcaaaatgagccgcaacggcaaaaatgagcttttgctcggtaaacaccggacgcttgatgaaatcatcgaaaagttgaatgccgtcagcctcgagcgtgtgaacaatcttgccaaccggattttcaccgatgattactcatctgcattaatcagcccgtcgggtgagctgccgaaataa

SEQ ID NO: 1798 - DNA, 261 bp, Bacillus licheniformis
atgaggctgagtgaactttcgggaaaagaaatcgttgatgttaagcgggccgaacggctcggcgtactggggcagacggaccttgagatcaatgagcaggacggtcagattaccgctcttatcatcccttctgttaaatggttcggactaggaagaaaacaggggaatgacattaaggtgccctggtcgcaaattcaaaaaatcggctcggatatgatcattttggatgttccggaaagcagcgtgacaaaagaggagtaa

SEQ ID NO: 1799 - DNA, 900 bp, Bacillus licheniformis
atgttaaccggattgacgattgcaatcatcggcggcgatgcaaggcagctcgagatcatccgcaagctgacggaacaggatgcaaaggtctttttaatcggttttgatcagcttgatcacgggtttaccggagctacaaaactaaagctgaacgaacttgattttggcacaatagacagcattattctgcctgtatcgggcacatcgatggaaggaacggttgcgactgttttttccaatgaaaaagtggtgttaaaacaggaacatttagaaaaaaccaagccgcactgcgcgatttattcagggatttcaaaccaatatttagacggcatggccaaaggggcgaaccgtcgtcttatcaagctctttgaaagagacgatattgcgatttacaactcgatacctacagtcgaaggtgccattatgatggccatacagcatacagactttacgattcacggctcgaatgtaatggttctcgggctggggcggacgggaatgagcatcagccggacgttctcggcgctcggcgcacgcgtaaaagtcggagctcgcgactccgcccacctcgccagaatcatggagatgggcctcactcctttccacacaaacgaacttgcagagcatgttgaaaatatcgacatatgcatcaataccattccaagcctgattctcgataaacatgtcctctcacgaatgacacccagaacattaattctcgatttagcaacccgtcccggaggcacagattttgattttgccgaaaagcaaggcattaaagcgctgcttgctccaggacttcccgggatcgtcgcgcctaaaacggcgggacagatcattgccaatgttttgtgcaaccttttgtctgaattaacaactgaccgaaaggggctgtcataa

SEQ ID NO: 1800 - DNA, 591 bp, Bacillus licheniformis
atgtcgatcaaaggaaaaagaatcggatttggcctaacgggttcacattgtacgtatgatgccgtttttccgcagattgaagcgctgatcaacaaaggggctgaagtcagaccggtcgtgacgcatactgtcaagtcgacggatacacgctttggagaaggggaagaatgggtcagaagaatagaagagctgactggatttgaagtcattgattccattccgaaagctgagcctctcgggccgaaaacaccgctggactgcatggttgttgcgccattgacgggaaattcgatgagcaagcttgcaaacgcccagacggacagtccggttctcatggcggccaaagcgacgatgagaaactcccgtcccgtcgtcctcggcatttcaacgaatgacgcgctcggcttgaacggcgtcaacttgatgaggctgatggcggcaaaaaatgtttactttattccgttcggccaggatgacccttacaaaaagccgaattcgctcgtcgccaaaatggatcttttagtgccggcggtcgaagaagcgctctcccataaacaaatacagcctatcctggtccataatgatcaataa

SEQ ID NO: 1801 - DNA, 1041 bp, Bacillus licheniformis
ttgggcagaggattacatgtagcagtagttggtgcgacaggcgctgtaggacagcaaatgttaaaaacactagaagacaggaattttgaactggataaactgactttattatcctcaaaacgttcagcaggtacgaaactgactttcaaaggcgaagagtacacagtagaagaagctcgtcctgagagctttgaaggcgtcaacatcgcgcttttcagcgccgggggaagcgtttcgcaggcgcttgctcacgaggctgtcaaacgcggggcgatcgtcattgataatacgagcgcgttccggatggaccaaaacactccgctcgtcgtacctgaggtcaatgaggaagatttgcacaagcacaacgggattattgcaaatccgaactgttcaaccatccagatggttgttgcgctcgaaccgatccgcaaggctttcggtttaaacaaaatcatcgtatcgacttatcaggcggtgtctggagccggaaacgaagctgtaaaagagctctacgggcaaaccgaagccattttgaacgacaaaccgttcgagcctgagatcatgccggtgaagagtgatgaaaaacactaccaaatcgcatttaacgctattcctcaaatcgataaattccaggaaaacggctttacgtttgaggaaatgaaaatgataaatgaaacgaaaaaaatcatgcacatgcctgagcttcaagtttcagccacatgtgtcagactgccgattgcaacagggcattcagaatccgtctacatcgaaacagaccgtgatgatgtgacagcagaggatattaaaaatctgttaaaagaagctccaggcgtcgttctgcaggatgatccagctaaacaggtctatccgatgcctgcagatgcagtagggaaaagagacgtatttgtcggccgggtgagaaaagaccttgaccgcccgaacggtttccatctgtggatcgtttccgacaacctgctgaaaggcgcggcatggaattccgtacaaatcgcagaaagcctaaaagctttaaatttagtttaa

SEQ ID NO: 1802 - DNA, 1215 bp, Bacillus licheniformis
gtgaaaatcatcgttcaaaaattcggcggaacgtctgtaaaagatgaccgcggcagaaagcttgccttaaaccatattaaggaagcggtcaatgaaggatacaaagcggttgtcgtcgtatcggccatgggccggaaaggcgatccgtatgcgactgattcattgcttgatctgctttacggcggacaggatacaattaccgagcgtgagcaggatatgcttttatcatgcggggaaacgatttcctctgttgtgttcgccagcatgcttttggaaaacgggattaaagctgctgctttaaccggtgcgcaagcgggctttttaacagacaacaaccatacgaatgcaaagattctcgaaatgaagccggagcggcttgtcagcatgctggccgaccatgatgcggtcgtcgtcgcaggcttccaaggcgcgactgcaaaaggggatatcacaacgatcggccgcggcggaagcgatacatcggccgctgcgcttggcgcggctctggacgcggaatttatcgatatttatacagatgtcgaaggcgtcatgacagctgatccgcgcatcgttgaaaaagcgaagccgctgcctgtgattacctatacggaaatctgtaatttagcctatcagggggccaaggtgatccacccgagagccgttgaaatcgcaatgcaggcgaaagtgccgatccgcgtgcgttcaacctattcaaacgaaaccggtacgctcgtcacaagccatcacaactcgaaagccggaagcgacgtttttgagcggctcatcacaggcatcgcccatgtgaaagacgtgacacagtttaaagtcccggcaaaagaaggacaatataacgtacagactgaagtgtttaaagcgatggcgaatgcgggcatcagcgtcgatttcttcaatattacaccaagtgaaattgtctacacggtggctggaaacatgacagaccgcgcccacagcatcctgaaggaattgggctatgaaccggccgtgacgagaaattgcgcgaaagtgtcagcggttggcgcggggattatgggcgttccaggcgtcacctcaaaaatcgttaccgctttgtcagaaaaaggcattccgatcctgcagtctgctgacagccatacgacgatatgggtgctcgtgcacgagaaaaatatggcgacggccgtaaatgcgctgcatgaagtgtttgaactgtcaaaataa

SEQ ID NO: 1803 - DNA, 894 bp, Bacillus licheniformis
ttgaatcatgatgaggtgaaaaaaatgaacttcggaaatatcgcaaccgcgatggttacgccctttgacaaaaatgaaaatatcgattttcaaaaactgtcaaagctgatcgattatttactaaacaatgggacggattccctggtcgttgccggaacaaccggagaatcgccgacgctttccgaagaagaaaaggtagcgctcattcaatactctgtcaaggaagcggcaggccgtgccccaatcatcgccggcacgggaagcaacaacacgaaggcgtcgatcaagctgacgaaaaaagctgaagaagccggcgctgacgctgtcatgctcgtcactccgtactacaacaagccttctcaggaaggcatgtaccgccatttcagagcgattgcggaggaaacatcgctgcctgtcatgctttataatgtgccgggaagaacggctgcttcgctcgcaccagagacgacaatccgccttgcggagatcccgaatattatcgccattaaagaagcgagcggcgacctagatgcgataacaaaaatcgtagccgaaacccctgaggactttgcagtttattcaggagatgacagcctgacactgccggcgctgtccgtgggagcgagaggaatcgtttccgttgcatcacacatcatcggaccggaaatgcaggaaatgatcaaacattataccgaggggaacacggctcaggctgctttgatccatcaaaagctgcttccgctgatgaaagggctttttgccgcaccgaacccgtctccattaaagacggctcttcagctgaagggtcttgacgtcgggtccgtccggctccctttgattccgctaaatgaagatgaacgactccgtttaagcagcctgatgaacggcctgtaa

SEQ ID NO: 1804 - DNA, 1665 bp, Bacillus licheniformis
ttgaaaaaaaatacagaaaatattagaatcatcgccttaggaggcgtcggagagatcggaaaaaacctctatgtcattgaaatcgattcagacatattcgtggttgacgccggcctcatgcatccagaaaatgaaatgctgggtatcgatgtggtcatccctgacatttcttatttaattgaacgatctgaccgcgtaaaggcgatttttctcacacacgggcatgaagaaaacatcggcggcgtattttactgcctgaacaagctttctgtgcctgtttacggaacgaagctgacgcttgcccttttaaaggaaacgctgaagcagtacggtgtaaacaaaaagcccgatttaagagaaattcattcaaaatccgttattacatttgaatcgacaaaggtgtcattcttcaaaacaaatcacagcatcccggattccgtcggtgtcagctttaaaacatccctcggatccatcgtgtgcacaggcgattttaaatttgaccagacacctgtgttaaaccagacaagcgacatcggcgaaattgccaaaatcggcaacagcggtgtgctgtgcctgctttccgacagcgccaatgccgagaagccgggctatacgccttcagaagcactcgttggcggagagatatccgatgtgatgtacaacgccgaaaaccgcgtgattattgccgtgttcgcgtctaactttaaccggattcagcaggtgattgatgccgcgctgcaaaacggcaggaagcttgcagtttcagggaaaaatatttcggcgatactccagctggcgatgaaactcgggtatgtcacggcagatgaagatatgttcatccctgtccaagaagtcaaaaagtatccaaaaagagaagtcgcgattttgacaggggacaaccatggagagccgctcgccgcattgaccaggatcgcaaaacaagggcataagcagcttgacattgaggaaggggataccgtcctgatcgcatcctcccctatcccgggtcaggagcttgtttactccaaagcggtcgatctcttaacgagagcgggcgcccaggtcgtattcgcacaaaaacgcgtccatgtatcaggccatggctgtcaagaagagctgaagctgatgctcaacttgctgaagccgaagtatttaatccccgtaaacggtgaatacagaatgcaaaaagcgcattccaagcttgccgaagaaatcggcatgaaacggagcgacattttcctgattgaaaaaggagatgtcgtggaattccgcggacaaaacgttaaaatcggcgataaagtacactcaggcaatatattgatcgacggactcggcgtcggcgatatcggcaacatcgtgctcagagaccgccgtctgctatcccaggacggaatcttaattgttgtgattacccttgataaaaagaaaaaacatctagtttcaggacccgaaattatcacgagaggttttgtctatgtcagagaatctgaacagctgatcgttgaagcgacagagcttgtcagggaactcgtcaacgaaagcacagaaaacgccgtcgtcgaatggtccgccttaaaacagacgatgcgtgaggcattaaaccagttcctatacgaaaaaacgaaacgaaaaccaatgatcattccaatcatcatggaagtataa

SEQ ID NO: 1805 - DNA, 747 bp, Bacillus licheniformis
atggattcaaaccggatacaaaacggggacagccaaggggagcagccggctaagcaggacgcaaaagacagtctcgtcaacaaaatccagcagctcggcgaaacgacactcccgcagatggggcaggacaccaacattcactgcctgaccattatcggacaaattgaaggtcacgtccagcttcctccccaaaacaaaacaacaaagtatgaacatgtgattccccagatcgttgcagtagagcagaatcctaaaatcgaaggtctgctcatcatcttaaacacggtcggaggagacgtagaagcgggccttgcgattgcggaaatgctggcgtccctgtcaaagccgacggtctctatcgtactgggcggcggacattcaatcggagttccaatcgcagtgtcctgcgaccacagctatatcgctgaaacagctacgatgacgatccatccggtcaggctgacagggcttgtcatcggtgtgccgcagacatttgagtatctcgacaaaatgcaggaaagggtcatcaatttcgtgacaagccattccaacatatcggaagaaaaatttaaagaactgatgttttcaaaaggcaatttaacccgtgacatcgggacgaatgtcgtaggaaacgatgcggttaaatacggattaatcgatgaaaccggcggagtcggacaggcgattcaaaagctgaatgaattaatcgaacaaaacaagggcgcccaggaagggatgatccaatga

SEQ ID NO: 1806 - DNA, 216 bp, Bacillus licheniformis
atgattctgtataaaaaaatgccgcaggaaatcgtgttcgcagggcaggcggaaaactcgaacttaaaacagatcgatgtaaacggcgtgccccttttagtcgagatgaacggagaggaagcaagggtcgttcaggttctcagcacgaacccgatggattttttaaaacaagaaacggcccctgggcagacgcttaaactgacattttataaatag

SEQ ID NO: 1807 - DNA, 2346 bp, Bacillus licheniformis
atggcaaaaagaaaacgaaaatcaacaaagaaacaaaaacaaggaaaaaaacggatccatcttaaatttgaattgtacggattaatctgtatcgccatctcgattattgcggttttgcagcttggcgtagcagggcaaacgttcatttacatgttccgctttttcgccggtgaatggttcatcctttgccttctcggcctctttttaacgggcttgtctttattttggaaaaagaaaacacccagttttttgacgaggagaaaagcgggcctttactgcatcattgcaagcatgctgcttctttcacatgtccagctgtttcagcatttgaccgaaaggggaatggttcagtctccgagcgtgatccaaaatacgtgggagctgtttctgatggatgtaaaaggcgagacaggatcgcctgatcttggaggcggaatgattggagcccttttattcgcggcgtcatattttctgtttgcatctgcaggatctaaaatcatcgccgtcttcctgatcttgatcggccttcttttgattacggatcggtcgcttcaggagacgctgatcaaatggatgaccccggtcgcctccttcatgaaaaaccagtggcaggcctttttagcagatcttaaacaattgaaaaacagctcgccgaaaaagaaatccggaaaaaaacaaaagacgcagagaaaaccgaaagtgtctgaagagcctgtacaagaagcggaccttgatccagatccggttattcaatcagaaccgattatttcaagcttttccgaccgtgatgaaaagcccgaagttcaagcttacgaagctccggcggctcctgctgaacctcctgctgagcccgaaatcggtgaggaaatgcaggcctccggcgcgcccgaaatcacgtttacagagctagaaaacaaggattaccagcttccgtcgattcaattgctggatgatccgaagcacacagggcagcaggcggataaaaagaatatttacgacaatgccaggaagctggaaaggacgtttcaaagcttcggagttaaggcgaaagtcacccaggttcatctcggcccggccgtcacgaaatatgaagtctatcctgatgtgggcgtcaaagtcagcaaaattgtcaacttaagtgacgacttggctttagcgctcgcggccaaggatatccgcatcgaagccccgatccccggaaaatcggcgattggaatcgaagtgccgaatgcggaagtggcgatggtttccttgaaagaagtgcttgaatcgaaactgaatgaccggccggatgcaaagctgatgatcggcctcggccggaacatttccggagaagcggtattggcagagctgaacaaaatgccccaccttcttgttgcaggagcgaccggaagcgggaaaagcgtctgtgtcaacgggatcattacaagcattttgatgagggcaaagccccacgaagtgaagatgatgatgattgatccgaaaatggtcgagctcaatgtctacaacgggattccgcatttgctcgctcccgtcgtgacagacccgaaaaaagcatcgcaggctttgaagaaagtcgtcaacgaaatggagcggcgctacgaattgttttctcacacgggaacgagaaatatcgaagggtataacgactatattaaacggatgaatgccgcagaagaagcaaagcagccggagcttccatacatcattgtgattgtggacgagcttgccgacctgatgatggtcgcttcctctgatgttgaagactcgatcacaaggctttcgcaaatggccagggcggcgggcatccacctgatcattgcgacgcagaggccttcggtcgatgttatcacaggggtcattaaagccaacattccgtcaaggatcgctttcagcgtatcgtctcagaccgactccaggacgattcttgatatgggaggcgctgaaaaacttctcggcagaggggacatgctgtttctccctgtcggcgccaataaaccgctccgcgttcaaggtgcctttctgtcagacgaagaagttgaaaaagttgtcgatcacgtcatcagccagcaaaaagcccaataccaagaagaaatgattccagaagagacgcaggaaacggtcagcgaagtgacagacgacctttatgacgaagcggtcgcacttgtggtcagcatgcagacggcttctgtatccatgctgcaaaggagattccgcatcggctatacaagagcggcgcggcttatcgatgccatggaagagcggggaatcgtcggcccatatgaaggatcaaaaccccgtgaagttctcttgtcaaaagagcaatacgaagaactctcttcttga

SEQ ID NO: 1808 - DNA, 726 bp, Bacillus licheniformis
atgtcgataaaagctgacaatcaacggttatgtttaaaggtgattgatcggataaaagatgatattcaaaatggggtcttttgcgaaaatgaacggctcccgagtgaatttgagctgtcaaagatgcttggtgtgagcagaacggctttgcgtgaggcgcttagaatactggaagaagaaaacgtcatcatcagaaggcatggagtcggacattttgtaaatgccagaccgttatttctatcaggtattgagcagctgaacagcgtcacaaaaatgatcgagcaggcaagcatgacgccgggaaccatttttatgtcctcacaggttaccgctcccactgaagaagatatgctccggtttcaatatgcggaagaaaccgagatctttttgcttgagcgggtgagaacggcaaatggaatgccggttgtctactgtcttgataaaatacctgtggacattctcccggaaggcttttcacacgagcaggagtcgatgtttgaatggcttgagaacaaatccggcgccgtgatcagctacgctgttgccgatattgtgccaatcggatatcatgacaccatttcccaaattcttgaatgcgatcctgaaacgtctttgctgctgctcaaacagactcattatgaccaaaacgataagcccgttttatattctttaaactattttagggccgataaattcagatttcatgtcgtcagaaaacgtttttga

SEQ ID NO: 1809 - DNA, 1206 bp, Bacillus licheniformis
atgaaaagcatttttgcgctgtcttcggtcccgctcgtgatgacgctcggcaattcgatgctgattccggttttgccggtgatcgaaaaaaaattaaacatttcttcgtttcaggtgtcgttgatcatcacggtttattcaattgtggcgattgtatgcatcccgattaccggctatatgtcggaccggttcggaagaaaaaagatcatgctcccatgccttctgattgcgggagctggaggagcgttagcaggtttggcttcaacttttttcaatgatccgtttgcgatgattttagcaggtcgcgtccttcaaggaatcggctcagccggcgcagcgccgatcgtcatgccgtttatcggcgacttgttccaaaatgatgaagaaatcagcgcgggactcggagatatagagacggcaaatactgccggcaaagtattaagcccgatattaggggcttttttagcatcttgggtttggtacatgccgttttggtttatcccggtcgtgtctcttgccagcttttttctcgtcttgttttttgttcccaaaccgaaggacaaagatgatgaaaagcaaacgttaaaaaactttgcaaaaagcgtacaggaaattttcaaacgggaaggtcggtggcttgtttccacttttgtcatcggcggaattattatgtttcttttattcggagtgctcttctacctgtcggatactttggagaagaagcatcaaattgacgggattgcgaaaggagcgcttctcagcattccgctgctttttctttccgtcagttcctaccttgccggaaagctgatcggaaacgataagatcagaatgaggatctgcgtgctgatcggcatgatcctgctggctttgtcgtttgccggtttgtggtggaaccacagcttttacccgttatttttgtttatgtccatcggcggcatcggcatcggaattgcgctcccttctttggatgcgctgattaccgagggaattgaaaaagaagagcgcggcacgatatcttcgttttacaacagcatgaggtttatcggtgttgcgctcggaccgccggttttcgcctatatgatgacaaatgcggggtggctgattttcatcgtatcgcttttgtgcagtttagctgcactagcgcttgtgctgtttaatattgacccgaaagaagacgaaagtgaagcggcaaagacggtgtag

SEQ ID NO: 1810 - DNA, 1281 bp, Bacillus licheniformis
atgacataccttaacgaaataaaaggaaagcaccgcggattgacaagccacattgtcaaaacggaaaaattcaaaaccgtctcgattatttttaaaatgcttgctcctttaacaaaagaggatgtgacaaagagggcgctttttccgcatgtgcttttgcggggaacgagcacccgccccaaaacggccgaactcagatcgtatcttgatgaactttacggcacttccgtatcatgcgatctctccaaaaaaggggaaatgcatgtcatcacattcaggctcgatatcgctaacgaaaaatttttaaaggatcagacaccgcttctggaaaaagggcttgagcttttgtcagagatcattttttcgccggcgcttgaagacggggcctttctgccgctgtacgtgtctcaggaaaaacgcacactaaagcaaagaatacaggcggtctataacgacaaaatgcgctattcaaatttgaggctgattcaggagatgtgcaaagatgagccatacgcgcttcacgtcaacggagagcttgatgatgtggacggcatcacgcctcaaagcctgtatgaagcttatcaaaaagcggtcagcgaagaccagctcgacatttacgtcgttggggatgtggatgagcagcaggtggattcgtacatttccaaatactttgaagcaaacgagcgggagctgagacctgttcccgagcttgagcaaacccgcacaagggagcctcaggaagtcatcgaggatgctgatgtcaagcaagggaagctgaacatgggatttcggacgggaacgcattttacggatgacgattatccggcgcttcagctgtttaacggcttgtttggcggattttcacattccaagctgtttattaatgtcagggaaaaggccagccttgcctattatgcggcttccagaatcgaaagctttaaagggctgttgatggtgatgtcggggattgaagtcggcaattatcaaaaagccgtcgacatcatcaaggagcagtttcaggaaatgaaaaaaggcagctttacagaagaggcaatcgaccagacgaaagccgtcattaaaaaccagattcttgaaacgcttgatacaccgtacggtttagtcgaatttatttatcagcaggctgccgcccaaaccgaattttccttggaagactggctgggacgaatcgacaatgtcacaaaagaagacatcatcgaagtcggaaagaaaatcgatttggatacaacgtactttctcaaagggacggagggagcatcttga

SEQ ID NO: 1811 - DNA, 1287 bp, Bacillus licheniformis
ttgacgaaaacgatcgaatttgaacagctgaaggaaacactatattacgaaaaaatgcctggcggcctcgatgtctatgttcttccgaaagaaggatttaacaagacatatgcggtctttaccacaaaatacgggtcgattgacaatcagtttgtcccgctcggaaaagatgaaatggtccgcgtgcctgatggaatcgcacactttctcgaacataagctctttgaaaaagaagacggcgacgtttttcagcaattcagcaggcagggagcttcggcaaatgcgtttacctccttcacaagaacggcctacctgttttcaagcacgtcaaatgtggaagaaaacctggaaacgctcgtcgactttgtgcaggacccttactttacagaaaaaacggttgagaaggaaaaaggcatcatcggacaggaaatcaacatgtatgacgacaaccccgactggcgcctgtttttcggcctgatcgaaaacatgtatcaagagcaccctgtccggatcgatatcgcaggcacgatcgaaagcatctctcatattacaaaagaccttttgtacgaatgctatgagacgttctatcatccgagcaatatgctgctgtttgtcgtcggtccggccgatcccgaagcgatcattcgccaggtccgcgaaaaccagcagaaaaaaccgtatacagaccagcctgaaatcgtccggaaagaagttaaagagcctggggccgtatttaaaaaagaacaggaaattaaaatgaatgttcaaagctcaaaatgcctcgtcggtttaaaaagcgctcatccgatgaatacgggagaagccctgctgaagcatgagctgaccatcaacctcatcctcgagtgtctgtttggcaaaagctcaagcgattacgaaagaatttatgaaaaagggtatatcgatgagacattcagctatgactatactgaagaacacggatttggcttcgtctctgtcggcggagatacgcctgagcctgacaagctggccgaagagctcaaacaagtgctgttcaaagcgaaagaaacgatcacagccgaaaagctggaactggccagaaagaaaaaaatcggcaatttcctgaaatcgatgaattcgcctgagtacatcgccaaccagtttacacggtacgcttttctggagacgagtctgtttgatatcgtcaccgtactcgaatcgattacgcttgatgacgttcaccgcgtcattgaggaagaagttgaggaagacaggatcaccgtctgcaaagtcgttccaaaatcataa

SEQ ID NO: 1812 - DNA, 258 bp, Bacillus licheniformis
atgacaaaactcgctctcatcaccggcgcaagcggcggaatcgggcaaagcatcagcgaaaagcttgcgcaaaacgggtatgatcttctcctccattatcatacaaatgagaaggcggccgcttcacttgcagaaaggctgtcacatacatacggcattcacgctgaaatcattcacggcgacctgtccgaccccggaggtgcaaaaaccgtttccgcttccatcggcggacgggcgctagacggcatcgtcttttaa

SEQ ID NO: 1813 - DNA, 416 bp, Bacillus licheniformis
atggtgcagctccatgtctcaagcccgtttctattaacgagggaatctgcttccggcgatgatcaggaaaaagtccggcgctattgtagccgtcagctctatttggggtgagacaggggcgtcgtgcgaagttttatacagcatgacaaaaagcgcgcaaaatgtgtttgtcaaagcccttgcaaaagagcttgcgccgagcggcatcagagtcaacgctgtttctccgggcgctgtaaaaacaaagatgaatgagctcattttcaaaagaggaagaagagatgatcgccgatgagattccgatgggaaggctcgccgaagccgaagaggttgcagacgccgtcttgtttctgctctcggcgaaagcatcttatatcacgggtcaaattttgtcagttaatggcggctggcattgt

SEQ ID NO: 1814 - DNA, 258 bp, Bacillus licheniformis
atgtccgtactggataattgggatcagtggaaaaactttttgggcgaccgtttgaactatgcccaagaacaaggaatgtcaaaagaaaccatctcagatcttgcatatgagatcggcgattatttggccggtgaggttgattcaaaaaaccatcaagaacgagtgctcgcagacctttggagcgtggcttccgaagaagagcagcgcgccattgcgaacgtgatggttaagcttgttgaaaacaacagctcacattaa

SEQ ID NO: 1815 - DNA, 792 bp, Bacillus licheniformis
ttggcaaagctcgaatggtacttagaatatgaaatccaagtcaaccgtcccggacttctgggagatatatcctctttattggggatgctttcaattaatattgtgaccattaacggcgtcgatacacaaagaagaggcctcttgttaaaatgccgtcatatagatcagattaagcgattggaatcgattttgaacacgatggatacgattaaagtcacgaagctccgcgaaccgaagcttcgcgaccgtctcgctgtaaggcacggccgctatatccagcgggatgcagacgataaaaaaacgttccggtttgaacgcgacgagctcggcttgcttgtcgattttatggctgagctgtttaaaaaagacgggcacaagctgatcgggatcaggggaatgccccgcgtcggcaagacggaatcaattgttgcttcaagcgtctgtgcaagcaaaaggtggctttttgtttcttcgacgctgctgaagcaaacgatcagaagccagctgattgccgatgagtacagtccggaaaatgttttcattttggacggcattgtgtcgacgagaagaggatctgaacgccatttgcagctcgtcagtgagattatgcgtctgccggcgaccaaagttgtcgagcatccggacattttcgtgcaaaatacggaatatacgatggacgattttgactacatcatcgaattgcgtaacagccccgatgaggtgattacatatgagcacgctgaagaaccgcagatgtttgaccattcaggtttttccggctttgatttttaa

SEQ ID NO: 1816 - DNA, 903 bp, Bacillus licheniformis
gtgactgaactaggaaatcggctgaaagaagccagagaggaaaaagggatgtcattggacgaccttcaggcggccacaaagatccaaaaaaggtatttaacggcccttgaagaaggaaactatgatatcattccggggaaattttatgtgagggcttttatcaagcagtacgccgaagctgtcggcctcgactcggagcacttgtttgaagagtttaaaaaagatatccctaattcttacaatgatgaggtttctgagaagctttcttcaatcaagccgcagagggagcttcccaagtctgcctcaaaagcgcttgaacttttgcccaccttgcttgtggcagccggcgttatcgttgtgatcgcgatcatttacgtcattgttcaggctgtaaacggcggagggaatcagcaggctgaagggcctaaaacagaggaatcgcaaagcaagtacgacgtctcaaaagattccccgctgactaaggaaaatcaacagaacacggatgcgcagaaagacagcgctgaaggcgacaaagaaaaaaaggatcagcagtctgatgagaacgacaagctgaccattaaagcgaccgcaagcgaaggctcttccacaacctatgaagtatcaggatccgacaagctggagcttgaagtaaaggcaagcgaaaactcatgggtcagagtgcgcgacgagaaaggaagctctcttaaagaaggaatgatgaaaaaaggggaaacctttcaaaagaatataaccgatcaatcgcaaattgatttgcggatcggatatgcgccgggcgttgaaattaaaatcaacggagaagttctttcttacaagctcgatcctaagactgtgatgacacaaaacataacgattcaaaataaaaaggaggaaaagtcatcttaa

SEQ ID NO: 1817 - DNA, 582 bp, Bacillus licheniformis
atgtttaatttaccgaataaaatcacgctttctagaatcgcattaattcctgtttttatggtcatcatgcttgtgccgtttcagtggggggctgtctccttcggcagcgagtcgattccggtcacccatttgatcggcgcactgctgtttattttcgcttcggtcaccgattgggttgacggctattatgcaagaaagctgaaccttgtaacaaactttgggaaattccttgacccgcttgcagacaagctgctcgtgtcttccgctttgattattctggtgcattaccatcttgctccggcctggatggccattgtcattatcagccgggaatttgccgtaacgggactgcggctcgtccttgcgggaacgggggaagtcgtcgcagccaacatgcttggaaaagtgaaaacatgggcccagatcatcgcgatctctgcccttttgcttcacaatctcccatttgagcttgtatccttcccgttcggctctcttgctttatgggtggctgtctttttcacagtcgtatccggctgggattatttcgctaaaaactgggatgctttaaaaacatcgaactaa

SEQ ID NO: 1818 - DNA, 1251 bp, Bacillus licheniformis
atgaagttggaaagaaaagcggaaattatcgctgtcggctctgagcttctgctcggacaaatcgttaatacaaatgctcagtttatcagcaggcatttggccgaaatcggcattaacgtcttttatcacacggcggtgggagacaatccggagcgccttaaacaagtcattcagacagcgcagcaaaggtctgacttcatcattttttcgggaggcctcggaccgacgaaagacgatctgacaaaagaaacgatcgccgaagttgtcgggcgccctcttaagctcgacgatgaagccttcgaatcgattcaggattacttcaaaaaaacgaaccgggagatgtcgccgaacaaccgcaaacaggcgctgatcctcgaaggatccgatgttctgccgaaccgctttgggatggctccgggaatgctgcttgagcatgaatcgcgcttttatatgcttctgccgggacctccgaaagagctggagccgatgtttgaaaacgaagcgaagccgctgattttggaaaagctcggctcgagggaaaagatcgtgtcaagggtgctgcgcttcttcggcatcggtgaatcccagcttgaaaccgatttggaagatctcatcgatgcgcagactaatccgacaatcgctccgcttgcggcagacggggaagtcacgctcaggcttacggcaaagcatgcggatccggaggagacaaaccgcttgttaaaagaaacggaagaccgcattttggagcgggtcggagaattcttttacgggtatgatgatacatccctcgcagaagagcttgcgaaagcatgccggagcaagggtatgactctggctgctgcggaaagctttacaggcgggcttttttccagctggctgacggaaatgagcggcgcttccgaatatttcaaaggcggcgccgtctgctacacaaacgaattgaaagtgtcagcggccggcgtttcggaagacacgctgcagcgctatggtgcggtcagcgcgcaatgcgctaaagagctcgccgcaggcatcagagtcaagacaggaagcgatatcggcatcagcttcactggagtagccgggccgaatacgcaagaaggccatccggctggaaaggtgtttatcggcatctccgtgaaggaccaggctgaggaagcgttcgaatttcagttcgccggatccaggtctgcggtgcggaagcgttctgccaaatacggctgccatctgttgctgaaaatgatggaaaaataa

SEQ ID NO: 1819 - DNA, 1047 bp, Bacillus licheniformis
atgagtgatcgtcaggcagccttagatatggcgcttaaacaaatagaaaagcagtttggtaaaggttcgattatgaaactcggcgaacaaactgaaacgagaatttcaacagttccgagcggttctttagcgctcgatgcggctcttggagtgggcggatacccgcgcggccggattattgaagtatacgggcctgaaagctccggtaaaacgacggtggcgcttcatgcgattgccgaagttcagcagcagggcggacaagcggcgttcatcgacgccgaacacgcgcttgatcccgtctatgcacaaaagctgggcgtcaacattgatgagcttttgctgtcacagcctgatacgggcgagcaggcgctcgaaatcgctgaagcccttgtcagaagcggagcggtggatatcgttgtcatcgactctgtagcagcgcttgtgccgaaagctgaaatcgaaggagatatgggggattcccacgtcggtttgcaggccagactgatgtctcaggcgcttcgcaagctttccggagcgatcaataaatcgaagaccatcgcgatctttatcaaccagattcgtgaaaaagtcggtgtcatgtttggaaatcctgagacgacgccaggcggaagagcgctgaaattctactcttctgtccgccttgaagtgcgccgcgcagagcagctgaaacaaggcaacgacgtcatggggaacaagacgaaaatcaaagtcgtgaaaaacaaagtggcacctccattccggacagccgaagtggacattatgtacggggaaggaatttcaaaagaaggggaaatcatcgacctcggaacagagcttgacatcgttcaaaagagcggtgcatggtactcttatcaggaggaacgccttggacaaggccgtgaaaacgccaaacagttcctgaaagaaaacaaggatatccttttgatgattcaagagcagatccgggagcactacggtttggatactggaggcgctgctcctgcacaggaagacgaggcccaagctcaggaagaactcgagttttaa

SEQ ID NO: 1820 - DNA, 1560 bp, Bacillus licheniformis
atgagtcctttagcaattctcatctccattttgctgagcctattctgtttagttgttggctactatgttcgtaaaatcattgccgaagcaaaaatttcaggtgcgcgaaatgcagccgaacaaattcttggagacgcaaagcgggatgctgaagcgttgaaaaaagaagcccttcttgaagcaaaggacgagattcatacgcttcggatagaagctgaacaagaagttcgtgaaagacgaaatgagcttcaaaaacaagaaaaccgtttacttcaaaaggaagagaaccttgaccgaaaagatgaatcattagataaacgggaagcgatgttggagaagaaagatcattctctgaatgaacgacaacaacatattgaagagatggaaagcaaagtggatgaaatgattcgtatgcagcagtcagagttggagcgtatttcaagtctgacgcgagatgaagcgaagcaaatcattctggaacgggttgaaaacgagctttcccatgacatcgcgatcatgatgaaagaaagtgaaaatcgagcgaaagaagaggctgataaaaaggcgaaaaatattctttcattggctttacagcgctgtgcggcagatcatgtggccgagacaacggtttcagttgtcaaccttccaaatgatgagatgaaaggccgcattatcggacgtgaaggacgtaatatccgtacattggaaacattgacggggatcgatctgatcatcgacgatacgccggaagccgttatcctttcaggatttgatccgatcaggcgtgaaacagccaggatcgctcttgataaactcgttcaggatggccgcattcatcctgccagaatcgaagaaatggttgagaaatcccgccgtgaagtggatgattacatccgcgaaatgggtgaacagacgacgtttgaagttggagttcacggtcttcatcccgatttaatcaaaatcctcggccgcttgaagttcagaacgagctacggacagaatgtactgaaacattcaatggaagtggcgtttctgacaggcttgatggcttcagagctcggagaagacgtaacgctcgcaaaaagggcaggacttcttcatgatatcgggaaagcgattgaccatgaggtggaaggaagccacgttgaaatcggtgtggaactggccaccaagtataaagagcatccagttgtcatcaacagtatcgcatctcaccacggagatcaggagccgacttccatcatcgccgtgctcgtggccgcagccgatgcgctgtctgccgcaagaccaggcgcaagaagcgaaacgctcgaaaactatattcgcaggcttgaaaaactggaagaaatctccgaatcatacgaaggtgttgaaaaatcattcgcgatacaagcgggacgagaggtgcggatcatggtcaaacctgactcaatcaatgatcttgaagcccatcgtttggcgcgtgatattcgaaaacgaattgaggacgagcttgactaccctggacacatcaaggtaaccgtaatcagggaaacgagagccgttgaatacgcaaaataa

SEQ ID NO: 1821 - DNA, 798 bp, Bacillus licheniformis
atgagaattttatttattggagatgtcgtcggttcgcccggcagagacatgatcaaaacctatttgccgaagctgaagctcaaatataaaccgaatgccgtcatcgtcaacggagaaaacgccgcacacggaaaaggcattaccgaaaaaatatatcaccagctcattcaagctggagccgacgttctcacgatgggaaaccacacatgggataaaagggaaatatttgattttattgatgatgcgccgcagatcgtcagacccgccaattttcccgagggcacgcctggaaaaggcatcacatacataaaaacaaacggttcgaaggaactggctgtgatcaatttgcaaggccgcacttttctgcctgcgatcgattgcccatttcgaaaagctgatgaattaatagaagaagcgtcaaaaagaacgccgttcatctttatcgattttcatgccgaagcgacaagcgaaaagcaggcgatcggctggtatacggacggccgcgtttcagcggttgtcggaacgcacacgcatgttcagacagcggacaaccgcattcttccgaaaggcacggcatatataacagacgtggggatgactgggccttacgacggtattctcggcgtcgaccgcgagacgattatcaagcgttttaaaacgagcctgcccgtccgttttgagattgccgaaggccgcacaactctgagcggagttgtcatcgacatcgacgaacagagcaagaaagccgttaaaattgaccggatattaattaatgacgaccacatgttttttgaataa

SEQ ID NO: 1822 - DNA, 261 bp, Bacillus licheniformis
atggaaatattaaaggtttcagcaaaatcaaatccaaactcggtcgcaggtgcgctcgcaggagtcttgagggaacgaggggctgcagaaattcaagcaatcggagctggggcattaaatcaggctgttaaagcggtagcgattgcacggggatttgtagcgccgagcggagtcgatctgatttgcattccggcgtttacggacattcaaattgacggtgaagaacgaacagcgattaagctaatcgtagagcctcgctga

SEQ ID NO: 1823 - DNA, 243 bp, Bacillus licheniformis
atgaagatttttgatgcccactctgatttgctgctgaagctctggaaaaatccgaagctcaatgaatacagcgacccgtcgcttcaaacgccggtccaagcgcttttaaacggaaaggcgaaagtgcagtgtctggcgatttttctgcctgaaaccgtgccagacacaataaggcttgaaatggcgcttatgcagatccagctgtttcacgaaaaaattgcaaagtacaagcggatcaactga

SEQ ID NO: 1824 - DNA, 480 bp, Bacillus licheniformis
ttgacttcttacggggaaagactgattcgcaaggcgaacaaaaaccgggcatggacagatctctcccatttatccgaaaaaagcttttggggtgcgattgaaacggcggcgtatccgatcgcctctcattcgaatgcccgcagcctttgccctcatccgagaaatttaaaagacgatcaaatcaaagcgcttattgataagaacggcgtcatcggcttgacatttgtccctgaattcgtgagaaacggaaaaacgcctgtgatcaaagatatcctctcgcatattgaccatgtctgctctttaggaggcgagcggcatatcggattcgggtctgattttgacggcatcgaccgtgtcattccgaatcttgaagcccacaaagattacgggaatctgatcgaagcgctgcagcgctcatatacaccaagtcaagtcgacggatttctctttcaaaatttcatcagccgcatcccattttaa

SEQ ID NO: 1825 - DNA, 1041 bp, Bacillus licheniformis
ttggacggaaatatgaaagcgcttatcaagaagccgggggagccgggcgccagcttcgagctcgtcccgattccgaagatcgacaaacacgaggtcctgatcaaagtcaaagccgcatcgatttgcggaaccgatgtccatatttataattgggatgaatgggcgaaaagcagggttaaaccgccttatgtgttcggccacgaattttccggcgaagttgttcaagtgggggaaaatgtgactacggtaaaagaaggggagtatgtttcggcagaaacgcacatcgtttgcggaaagtgcctgccgtgtttgaccggaaaagagcatgtctgcaaaaaaacgctgattctcggtgtcgatacagacggctgttttgctgaatatgtcaaaatgcccgccgcaaacatttggaaaaacccggccggcatgcctgaggatctcgcttctattcaagaaccgctcggaaatgccgtgcatacggttctgacgggaatgacggctggagtgaaagtcgctgtcgtcggctgcggaccgatcggactgatggccgtggcagttgcaaaagcgtctggggcggcgcaggtgatcgccatcgataaaaatgaatacaggctcgaccttgcattgcaaatgggggcaaccgatatcatctccgttgaaaaagaagatccgctcaaaaatgtaagcgctttaacaaatggtgaaggggcggacttggtttgcgaaatgtcaggccatccgacggcaatccgccaaagtttaaaaatggcggcaaacggaggacgggttcatgtcttaagcttgcctgagcatcccgtatgcatcgacatgacaaatgatatcgtctttaaaggattgacggtccaaggaattaccggccgcaaaatgtttgaaacgtggagacaggtcagcggtctcctccaatccggcacgattcaaatcaagcctgtcatcactcaccgtttcccgatggaagagtttgaaaaaggctttgaactgatgagaaaagggcaatgcggcaaagtcgtactgataccgtag

SEQ ID NO: 1826 - DNA, 1176 bp, Bacillus licheniformis
atgaaagaattcaattttttagcttccgagcttaatacaatgaaagaaaacggaacttttcaagagctgccgatcatcgaatcaatgcaaggatcaaccgtcaaaatgaaaggaaaagacattatacagctttcatccaataactatctcgggctgacgtctcatccgcgcctccaaaaagcggccgaagaggcggtcaaacggtacggagctggaaccggatcggtccgtacaatagccggaacattcaccatgcatgatgagctcgaaaagaagcttgcttcatttaaaaacactgaagcggcactcgtattccagtccggatttaccgcaaatcaaggcattctttcaagcattctcaccaaagatgatcttgttatctcagacgaattaaaccatgcttccatcattgacggcatcagactcaccaaagcgggcaaaaaagtatatcagcatgcggacatggaagatttagaaaagattttgaaaaagtcgatgaactacagaatgcgccttatcgttacagacggcgtgttttcgatggacggagacatcgcgccgctgcccgaaatcgtccggctcgctgaacagtatgacgcatttgtcatggtcgacgacgcgcacgcgtccggcgttctcggcgaaaacgggcgcggaacggttcaccatttcgggctggacgggaaggttcacattcaagtcggcacactcagcaaggcgatcggcgtattaggaggctatgcggccggatccaaggtgctgatcgactacttaaagcataaaggaagaccgtttctcttcagtacttcccatccgccggccgtcactgcggcatgcattgaagcggtcaatgtgctgatggaggaaccttcattgattaaaaagctttgggacaataccgcgtacttcaaaaaagagcttgaaaaaatcggccttccgctgattaagagcgaaacgccgattacgccgattttgatcggtgatgaagctgaggcatgccgcttctcaaacacgctttttgagctcggtttatttgcccaggccattgtatttccgaccgtcccgaaaggcaaagcgcggatcagaacgatcatgaccgcccagcattcgaaagaagagctcgataaagcgcttgaaatcattcaaaccggcgctaaaaaagcgggtctgctttaa

SEQ ID NO: 1827 - DNA, 1530 bp, Bacillus licheniformis
atgaatgagaaacagcgcattgaaagcggacaggtcaatccatcggacaaaaaatccgagaaggattacagcaagtacttcgaagctgtttatgttccgccttcattaaaagatgcgaaaaaacgcggcaaagaagaggttaaataccataacgattttaaaatctcagagcagttcagaggcatgggcgaaggacggaagttttacatccgcacgtacggctgccagatgaatgagcacgataccgaagtgatggcagggattttcatggcgctcggctatgaaccgaccgactcgacggaagatgcaaacgtcattttgctcaacacgtgtgcgatccgggaaaacgcggaaaacaaagtgtttggcgaaatcggccatttaaaagctttgaaaaaagacaatccggatttgatcctcggagtctgcggatgtatgtcccaggaagaatcagtcgtcaaccggattttaaagaaacatccgttcgtcgatctgattttcggtacacacaatatccaccgcttgcccgaacttttgtcagaggcttatctgtcaaaagaaatggtcatcgaagtgtggtctaaagaaggcgatgtcattgaaaaccttccgaaagtccgcaccggcaaaattaaaggctgggtcaacatcatgtacggctgcgacaagttctgtacgtactgcatcgtgccgtacacaagaggaaaagaacgaagcagacgtcctgaagacatcatccaggaagtgagaaggcttgcggctgaaggctacaaagaaatcacgcttctcggacagaacgtcaacgcctacggcaaagattttgaggatatggaatacggactcggccacttgatggatgaactccgcaaaatcgacattccgcgaatccgcttcacgacaagccatccgcgcgattttgacgaccatctgatcgaggtgctcgcaaaaggcggaaaccttctggaccacatccatctgcctgtccagtccggaagctcggatgtcttgaaactgatggcgcgcaaatacgaccgggagcgctatcttgagcttgtcgccaaaattaaaaaagcgatgccgaacgcatccttaacaacggacattatcgtcggcttcccgaacgaaacagacgagcaatttgaagaaacgctctctttatacagagaggttgaatttgacagcgcctatacgttcatctactcgcctcgcgaaggaacgcctgctgccaaaatgaaagacaatgttccgatgcgcgtgaaaaaagaacggcttcagcggttaaatgaagtggtcaacgaaatttccgcgaagaaaatgaaggaatatgaggggcaggttgtcgaagtgttagtagagggtgaaagtaaaaacaaccctgatatccttgccggctatacacggaaaaacaagcttgtcaacttcaaaggaccaaaagaagcgatcggccagcttgtcaacgtgaaaatccaccaggcgaaaacttggtcgcttgacggggaaatggtaggagaagcaatcgaggtgaagtaa

SEQ ID NO: 1828 - DNA, 432 bp, Bacillus licheniformis
gtgacgctttatacgaaaaaagagattgttgcaaaagcgcgggagctcgcaaaaatgattgcagaaacggaagaagtcgactttttcaaaaaagcggaggcacagattaatgagaatgccaaaataacgggcataatcaaccaaatcaaagccctgcaaaagcaagccgtcaactttaaacattacgaaaagcacgaagcgcttaaacaaacggaagcaaagattgacgcgcttcaggaagagcttgacgagattccgatcattcaagagttcagagactcccaaatggaagtcaacgaccttcttcagcttgtcgcgcatacaatatcaaaccaagtgacaaacgagatcatcacatcgaccgggggagacctgctgaaaggcgagaccggttcaaaagtgaaaaattcatcaccgagctgttctctataa

SEQ ID NO: 1829 - DNA, 549 bp, Bacillus licheniformis
atgtctgaatacagggaaattatcactaaagcggtggtcgcgaaaggccggaaattcacccagtccactcatacaatctccccttcgcaaaagccaaccagtattttaggcggttggattatcaatcataagtatgacgctgaaaaaatcggaaaaaccgtggaaattgaagggacatatgatatcaacgtctggtattcatatgcggacaacaccaaaaccgaagttgtgacagaacgcgtttcctatgttgatgtcattaagctccggtatcgcgacaaaaattacttagatgatgaacacgaagtcattgcgaaagtgcttcagcagccgaactgccttgaagtgaccatttctccgaacggaaacaaagtggttgtacaggcggaaagagaatttttagcagaggtcgtcggcgagacgaaggtcgtcgttgaggtcaattctgattggacggaaagcgatgaagaagaagcgtgggaagaagagcttgatgaagaacttgaggatatcaatcccgagtttttggttggagatccagaagaataa

SEQ ID NO: 1830 - DNA, 2610 bp, Bacillus licheniformis
atggcaggctacacgcctatgatacagcaatatttaaagattaaggcagagtatcaggatgcctttttattttttcgtcttggcgacttttatgagatgttttttgaagatgcaaaaaaggcgtctcaggagctcgaaatcacgctgacgagcagggacggaggatcaagcgaaagaattccgatgtgcggggttccttatcattcctgctcttcgtatatcgaacagctcattaaaaaaggctataaagtcgcgatctgtgaacaggtggaggaccctaaatcggccaaaggagtcgtcaaaagggaagtcgtgcagctgatcacacccggcaccgtgatggacggcaaagggattcatgaaaatgaaaacaactttatcgcctctgtcagtaaatttcagcatacatacgggctcgctttttctgatttgacgacaggcgagaatttagtaacggctatcgaaaggcttgatgatgtcgtttccgaaatttactctgtcggagcaagggaaatcgtcgtcagccgcaaccttgacgagaaagacgtcgcaatgctgaaagagcgctgcggcgccacgatctctttcgaggatgaacaagcggatgaagtgcctggcattgtgaacggactggggtccaaagagcttgtcgatacgtttatgaggctttacgtctacttgaagcggacgcagaaaagaagcctcgaccaccttcaaaacgttcaggcctacgagctcgaagaagcgatgaaaatcgatttgtactcgaaacgcaatcttgaactgacggaaacgatccgttcgaaaaacaaaaaaggctcgcttctttggcttttggatgaaacgaaaacggccatgggagggcggctgttaaagcaatggatcgacaggccgctgatcagaaagggacagatcgaagagcgccaggaaatcgttgaaacgctgatcgcccatctgtttgagcgggaagatttgcgcgaacggctgaaggaagtatacgacctcgagcggctcgccggaagggtcgcatacggcaacgtcaacgccagagatttgatccagctgaaggaatcgctgaaacaagtcccggccatcaaacagcttgtcggctccctcgaccatccgaaagcaaaagcgcgcgccgagaaaatcgatccgtgcggcgatcttttgaatcttttggaagacgcgctatacgagaatccgcctctttcattaaaagaggggaacttaatcaaagacggctaccacgcgaaactggatgaatacagggacgcaagcaagaacggaaaagactggatcgcaaggcttgagcagcaggaacgcgagtacacgggaatccgctctttaaaagtcggctttaacaaggtgttcggctattatattgaagtgacgaaagcgaacatccatctgcttgaagaaggccgctatgaacggaagcagacgctgaccaatgcagaacgctacatcacgccggagctgaaagaaaaagaagccctgattctcgaagcggaaaacaatatttgcgagctggagtatgagctgttttccgagcttcgcagcaaggtgaaggaatatatcccgcgcttgcagcagctgggaaaaatgatgagcgagcttgatgtgctccaatgttttgcgacgatcagcgaaaaccggcactatgttaagccggagttttccgatgatgtcgttcaggtgatcgacggacggcatccggtcgtagaaaaggtgatggacagccagtcttacgttccgaacagctgtgaaatgggcaaaggcaggcagatgcttttaatcaccgggccgaatatgtccgggaaaagcacgtatatgagacagatggcgctgatctccattttggcgcagatcggctgctttgttcctgcgaaaaaagcggtgctgccgatctttgatcagatctttacgagaattggcgcagcggatgatcttatatccggacagagcacgtttatggtggaaatgcttgaagccaaaaacgcgatcgtccatgcgacgaaaaacagcttgattttatttgacgaaatcggccggggtacgtccacttacgacggaatggcgcttgcacaagcgatcatcgagtacgttcacgagcacatcggcgcgaagactttattttccactcactaccacgagctgacgtcccttgaagaaaagctggacgatttgaagaatgtccacgttcgtgcggaagaatacgaaggaaaggtcgttttccttcaccagataaaagaaggagcagcagataaaagctacggtatccatgtcgcgcagctggctgaattgcccgacggtttgatcagcagggcgaaaacgatcctgaaagaacttgaatccggcgcaaaagaagccgctccatcaacggcaccgaatatggtaaaagaggcggcggaagaagccgcggcgactgttgcagatcaaccggcccagctgtcattttttgagacggacaagccaatagaaaaagagacgaagctctccaaaaaagagcaggctgttttagccgaatttaaagcgatggatctgctcgatatgacgcctatacaagtcatgaatgaactgtacaggctgcaaaaaaaattaaagtaa

SEQ ID NO: 1831 - DNA, 1911 bp, Bacillus licheniformis
ttggcaaaaattgttcagctgcctgacgatttatcgaataaaatcgcggcgggtgaagtagtggaaaggccggcgtcggtcgtcaaagagcttgtcgaaaatgcaatcgatgcgaacagctccgtgattgaaatcgatgttgaagaagcgggtctcgcctcgattaaagtgcttgacgacggcgaagggatggacgcagaagactgcagaacggcttttttgcgtcatgccacaagcaaaatcaaagacgaaaacgacctgtttcgcgtcagaacgctcggatttcgcggagaagctttgccaagtatcgcgtctgtctcacacttaagcattaaaacgagcaccggagaaggggcaggcacccatttgacgctgcaggggggaagaatcatttccgagcaaaaagcgccaagccgcagaggaaccgaaattacggttaccaacctgtttttcaatacgccggcaaggctgaaatacatgaaaacgattcataccgagcttggcaacatcacagatgtggtcaacagaatcgcccttgcccatccggaagtttcgatcaggctgcgtcatcaagggaaaacgcttctgcagacaaacggaaacggcgatgtccgccacgtgcttgcggcgatttacggcacggcggttgccaaaaaaatgctcccgcttgaagcgagatctcttgactttgaagtgaagggctatatcgctcttcctgaaattacgcgcgcctcgcgaaattacatgtcatctgtcgtcaacggcagatacattaaaaacttcccgctcgtaaaagcgatccacgagggctaccatacgcttcttccgatcggccgccatccgatcacgttcattgaaatcaacatggacccgctccttgtggacgtcaacgtgcacccgtcaaagctggaggtcaggctgagcaaagagacggagcttcacgagctgattcgcgacgccatcaaagacgtctttaaacagcagcagctcattccaagcgtgcaggtcccgaaaaaaaccgcacctctgatcaataaaccagagcagcaaaagcttgatttcgaccaggtacgagaaccggcacctctttctgattctgatgttgaaagagagtataagccggagccttcgttttcggcgatgaaattaagctcgcttgtcaaagacccgccgccttccgctcccgtagagcgcgaagaaaacgtaatgcaggacaccgagcctgaatggcccggagctgaagagtatacgcctgaagccgcgccggccgtacaagcagaaccggaacaggcaggagagaacgtccaggacgaagagacgccaaaagaaagggtgccgatcatgtatccgatcggccaaatgcacggcacctacatacttgcccaaaatgaaaacgggctgtacatcatcgatcagcacgccgcacaggagcggatcaaatacgaatatttccgtgaaaaagtcggggaagtcgaatcggaagtccaggacctgcttgtgccgctgacattccattattcaaaaaatgaagcgctgacgatcgaccagcacttggacgatttagccaaagtcggcgtctttctcgaatcgttcggcgccggcagctatatcgtccgatgccacccgacatggtttccgaaaggggaagaaacgacgatcattgaagacatcattcagcaggtccttgatgaccgcacgatcgacatcaaaaaactgcgcgaagaagccgcaatcatgatgagctgcaaaggctccatcaaagccaatcatcacctgcgggacgacgaaatcaccgccctgctcgatgagctgcgcagaacatccgaccctttcacatgcccgcacggccggccgatcatcatccactactccacctatgagatggagaagatgtttaagcgggtaatgtaa

SEQ ID NO: 1832 - DNA, 282 bp, Bacillus licheniformis
atgcattacataacggcatgcttaaacatcatcagcgataaagaccttaatgaaataatgaaggaattcaaaacacttgaggaaaaaacgaacaaagaagaagggtgtattcaattccatgcttatccgcttgaaccgtcggagcgcaaaataatgctctgggagatttgggaaaacgaagaagctgttaaagcccatttcacgaaaaaacacacaaaagatgttcaaaatcaacaattaacagaagtagaatggttaatcaaaagcaatgtgaatgattaa

SEQ ID NO: 1833 - DNA, 528 bp, Bacillus licheniformis
atgaagggatacaaaaagctcggttctgtcgatgtcaccgatgaaatcggtacaggcaaggacttcatcggcggttcgtacatgctttattcaaacggtcaaattgtccgaaaatacatatccggcggtgaagtgaaatacgaacttgtcagtcgcataccggaaagcagagtgaagaaaagcaacattgaaaaagctcttgattgggctaaagacacagttggggaattgtccggtggttatgatggttatagagcgataacaggtgttgaccctgtgactggtgaaaaactaaccgtcactgaccgtatcctgtccggtgtttctgtcatacccgctactaaagtagtcaaggtagggaaatatgctttcaaagccactaaaggtgcgaagacggcgaaaagggtttcgaatgccgagagaagtgctaatgctacgcctaaaattaatagaaaacaagctctcaatcaggcaaaagacttagctggcaacaacctacacgtcaatggcaggttggcgatgatataa

SEQ ID NO: 1834 - DNA, 150 bp, Bacillus licheniformis
gtggttgttacccatactaacgataacagattacacgcacatgcaggtaagcctgacaaagaggcaaatcaattcaactatgactttaagaaagagagatatactaatatatacggtcctaatggagaccaccatatatactataaataa

SEQ ID NO: 1835 - DNA, 438 bp, Bacillus licheniformis
atgaatgcaaggaaatcgatgaaggaatttacttgcttagaactattagattttgaagagtttgattctccttggatagacttgttcgagccattactaaaacaatttcgaagaatagattccaaaccaacttattataaattaattggggattctaaagaaaacaatattttatggatagaaaattccctaagtttccttaaacaaaaaaaagagtggtttatcgttgttcccaaatgtttacaaccagtgtgggcaaatgttcgagttttagactattctaaagcaattcatgagctttgggaaatgtcagaacctgataatttcctaattgctgataaatctacaggaatgattgcaaaaatattttttgaagaacaacaatacgagatccatattggaaaatgtagtcttgataacattaaaaagaataactaa

SEQ ID NO: 1836 - DNA, 987 bp, Bacillus licheniformis
atgcctataactaaaaagaaaattcctgtcgctattctcactgggtacttaggcgccgggaaaaccacacttttaaatcgaatacttacagaaaagcacaatcaaaagatcgcggttattgtcaatgagtacggagaagtcgggatagacaaccagcttgtcgttgattctgaagaagaaattttggaaatgaacaacggctgtatctgttgcacggtccgcggagatttgattcgcattctgagaacgcttgtattctcaatggatcaagggaaagttgcatttgatcgcgttttaatcgaaacaacgggactggctgatcctgcccccgttgcccagacgtttttcatggatgaactgctatccgaaatatttgaagttgacagcatcgtcacggtagtagacagcaagcatgtcaccagacatctggatgatcaggatgaagcgcaagagcaaatcgcatttgctgacgtcatcatcctcaataaaacagatttagtatcgaataacgagctgaaatccttggagcaaagacttgtcaacattaatcctacggctaagaggctgtatgccagagattgcaaggtcaatttaagagatatactggggatcaatacgttcgacgtcaatcgaaaaattgaaatcgatcctcattttctagaagatcatcatcaccaccatcacgatgataaagtgtcttctatcgcttttcgggaagagaagcctcttgatttggcaaaggtggatcattggatgagttatctcgtacgggaaaaaggagaagatttattgcgttataaagggatcctttatattaaaggcgaagaatatcgaatcgtattccaagggcttcatatgctgttttcaggacgtccggaccggaagtggaacgaaaacgagaaaaaacaaagcgaacttgttttcatcggaaaggacttggacaaagaggaactggagcggcaatttaaaaattgcatcgcaaagtaa

SEQ ID NO: 1837 - DNA, 387 bp, Bacillus licheniformis
atggcgacatgggatttaagtaatatgaaacatcatatttttatctgcaacggcagcagctgcaatcgggccggagctgaggaactgactcaagtgattcggcaagaaatctcggaccgggagcttgatgatttcattcatacaacgcgcacgcggtgtaatggaaggtgtcaagataagtgcgtggccatccattacccgagaggaacttggtatagagatttaaaacctgaggatgtccccctcctgattgactcgctttgtaccaatgaagattataaagaaaaagcaagccatttgtatgacggccaacgcttcgaacgttcatccggcgtcatctccggagttccaaaagaaaaagtaatcaaagtatcgaaaaaattttaa

SEQ ID NO: 1838 - DNA, 495 bp, Bacillus licheniformis
atgcataacataaacattcgaaaagctatttctgccgatttgccatttatcttaactatttataatcagggcattgaagatcgaattgcgactctggagcaagatttaaaggaaatgagcgatatcgaaatatggtttcaggaacatcaagggcgctattctgtccttgtggccgaatcaaaaggagaaattgtaggctgggcttctttgaacccgtactcccaccgttgtgcttatcaaggtgttgccgacctttctgtctatgttgatcgtgcatgccgcggaaaaggaataggcggcctccttcttcaagctctagaaaaaacagctaaagagaatagtttttataaaatcgtcctctttacatttccctttaacgaacttgggcaaaacctatacaataaaatgggctacaggcaagttggcatctttaaaaatcaaggaattttagatggacgttttatcgatgtaatggcaatggaaaaattgctatag

SEQ ID NO: 1839 - DNA, 648 bp, Bacillus licheniformis
atgtttaaaactaagttcaagaaaacaattgggattggactcgttgccgctgcctgtttgatttccgcgtcgacggcaagcgctgcgtcgcaaaatgaaagcgatgttaaagtgaaactggacgatcagcagcggaatcaatatacggtcaaatctttccactacttaaccgttgacggaaaaaatgtggattcgccggctcaagccaacgccaaatccgtcagagatgtcaaagtaaccatggttctgcccaagcagaataagaacggcgatttgcttgcgtatggatttacgagcaaggttactttagaagcctttatcgcgaaagacaagcagaggcttgagaagcaattcaaaccttctgccagcggtccctgctgtaccgatttctatgaatataaaaataaaggcgggcagtatatttactggagagacggatttaaaaacttgccatccagctggaatgacagaatttcatcgttaagtacggcgtctccttcatcaagctattcaacgacgctgtgggagcatacttcaactcaaggatacggcaaaggcgttttgtttagacattccgattggtacggcaaaactgctaatatggcttctgattgggacaataaagcttcggccatcgatatcaagtaa

SEQ ID NO: 1840 - DNA, 111 bp, Bacillus licheniformis
atgagcggaggttacggacacggaagcggttttgctttaattgttgttctgttcattctcttaatcatcatcggcgccagctggttcggcggtggatatggaggctactaa

SEQ ID NO: 1841 - DNA, 1344 bp, Bacillus licheniformis
ttgtccggacttatcgcagcgtctttattaaagaatgccgggcatagagtgacgattgtggaagcaaatgacagagcgggagggcgtgtttttacttcccgtgcgccctttagcgaagggttgtatttcaatgccgggccgatgcgcatccccgatatccatactttaacgatggaatatattaagaagtttaatctgcctgtcaatgtgtttatcaaccgaacccccatggatattctttacgtcaacggcgtgaaaacccgtcttcatgagtttgaaaaaaatccgggcgttttaaggttccctgttgctccccatgagtagggaaaaacggcagaacagctgatgctttctgctttgcagcctatcctcaattttatcagccaagatccggcgagaaattggcgtattgttgaaaaacaatacaggaacgaatcgttaggatcttttctcaacactcatttttcaagcggttccatcgatatgattggtgtgcttttggacatggaagcgtacatgggattgtcccttgtcgaagtattgcgggaatcgattttttttacatcgccgactcgcttctatgagattacatgcggcatggacctgttgacgcaagcttttcttccgcaattaaaggggaatattttattccgtcaaaaattgatgaaaatgtctcaaactaaaaacagtgtaacagcccattgcattcaccagcagtcggcagaacattcagcggtgacaggtgacttcgcgatcgtaacaatacctttttcagcattgcgatttgtggcatttgagccgtttgaatccttttcctaccaaaagcggagagcgattcgggagcttaactatattgcggcgacaaaaataggaatcgaatttaagagcaggttttgggaaagagtcggacagcgcggcggcagatcgattaccgatttgccgattcgcttttcatactaccctagcagcataggaggacacgggcatgctgtcattttagcgagctatacgtgggctgatgaagcgctaatatgggacagtcagcctgaagaagagcggatccgctatacgctgaaaaatttagcgaaaatatatggagatatcgtgtattctgagtttgtatcaggcgcttctttcagctggacgcaaaatcctttttcagccggagcatttacagctttcgaaccagggcaggaattagagttgtatccttatattccgatgcctgaaggaagggtgtatttcgccggggaacacgcttccctcactcatgggtggatgcagggagcgattgaatcgggaatacgggcggcgtatgaagtaaatcaggcctcccgcgtataa

SEQ ID NO: 1842 - DNA, 741 bp, Bacillus licheniformis
ttgaatgctgctcgtgatcgaaacatcatgcttttgcttctctgtttgacagcaggtattgtagatgtgattgggtacttaagtatcggtcacgtatttaccgctaatatgaccgggaacatcgtactgttaggattatcaatcggcaattctcttcatgcgaccgccgtgtactcgctgatcgcactgttcggatttatcatcggcgtgattatatcagcagccattgtcggaaaacaggaaaaatcgttctggccgacaggcgtcacgattgcacttgctgtggaagcagccgtattgcttctatttgcctgcctgactttctttgaaagttcgccgcaccttttaatcttgctgttaagcattgcgatggggcttcagactacggcagccagaaagctcggcattgcagggatttccactactgtcctaacggggacgctggcaaactttttcgaagatgtgacaaaacgattcctcagtaataacaaccaaaaggtcatccataaggacgcatggcttcgcgctttgacgattgtgctctattgcctgggggctgtcattgccgcacttgctgaacctgagcatccgtttgttgtgatttggattccgatcgttatcattatcggtattattgcggtgcaggcacaaggtttcacggaaagagtgagggatgaccagataaggacggttctatacaccggcattcgtgaaccatcgattgttacatatgttttatga

SEQ ID NO: 1843 - DNA, 1470 bp, Bacillus licheniformis
ttggaacacattaatatggagcagtttattttattagcggccttattgctgattatcggtgtactgacaacgaaattttcgactaggctcggagtgcccgcccttgtattgttcttgattgtcgggatgatcatggggagcgatggtctcggaattatttattttaataatcccgagcttgcccagctgattggaattatcgcacttgtcgtcatcctttttgaaggcggtttgcaaacaaagtggtcttcggtcaaagcggtcgccgttccttcattgtcgctcgcgacgattggcgttttgctgaccacctgcgtggttgcggttgccgccaagctgatttttaatgtttcttggatggagggctttttattcggagcgattgtcggctctacagacgcagccgcgattttcgccgtattgaaaggccagaatattagagacagattgagctccactctagaagcagagtcgggtacaaatgatccgatggcgatgtttttgactttatcgctcatccagctgctgacggctgaccattcatcttatttcatgcttgttatttcatttttctggcagatgggaatgggacttttgctcggatatttactcgggcggttcgccagctttgccatcaataaaatcaacttggattcgagcggactttatccgatcttcgctcttgcttttgcgcttcttacctacagtcttacagatgtcatcggggcgagcggcttactggccgtctacattgccgcgcttgtcatcggaaatcaagatttgacttaccgacattccattttcaggtttaatgaaggctttgcctggatgatgcagattttgatgtttatcattctcggattattggtttttcctgcccaatttttatccttcgatattattttcaagggcttcttgctttccctgattttaatttttatcgcccggccggttgccgtttttctgtcgaccatcaaaatgggctttaattttaacgaaaaaatcttcttatcatgggccggattaaaaggggcagtcccgatcgttcttgcaacatttccgatgacgatggggcttgaaaacagccaattgatctttaatgtcgtattcttcgtcgttttaacatcggctttgatccaagggtcaaccatatcggtcttcgcagaaaaattgaaattgaacggaccgcagaaagtagaagcgccgcattcgctggagcttgtttccatcggcaaggcgaacgccgaaattatcgaatttgaagtcgatgaccaagcagccattaccaggcagatgctgaaagacatcagctttccaaaagatgccctgatcaatgcgatcatccgaaatggggatttggtcacgccgcatggagaaacgaaaattaaaccaggcgatattttatatatcctcgtatcgaaaaaacaaaagaaggaactgaaaaaatttttaaacagagaatttgattaa

SEQ ID NO: 1844 - DNA, 880 bp, Bacillus licheniformis
atgaaaatgatgaaaagaagcatcggcacctttgaaattgacggactgacaattgaatattcgcgagtaggtgaagggaagccgattcttgtgatgcacggaggtcattcgaattgccgcgaggaatttgggtatcgagatctttatgagagccgattctctatcatcacgccttcccgtgcagggtatggccggacatcgaaagaaatcggggacagtttggaacttgcctgctattacatatgaaactgcttgatcatttaaatatcaagaaagttcatgtggttgcggtgtcagccggcgggccaagcggaatatgttttgcatccaaatactcggaaagagtagaatccttaattttgcaaagcgctgtcacaaagcagtggctgacagcgaaggatattgaatataaagttggtcagatcatctttcggccgcctgttgaaaaggccgtatggaagctgatatcggcgcttaacaatcgatttccggaatggatctttaagaaaatgctatcctcctttactacacttcctgctgatcaggcgatgctgaaagtcacggagggagatattgaagaaatgagaaaaatgaacaacagacagcgttcaagtcgagggttcttgcttgatttaaaaaatatagacgatttatctttccatcatttgaaggagatttcttgtccggtattaattatgcattgccgatatgatcgtgttgttccagccgagcatgcttttcatgcaaaaaaactgattcctttttcagaagtctatcaggcagacagctggggtcatctcatttggctgggaacagagggtaaatctgtctcacagaaggtcatcagctttttaaaaaccacatcatcttgatcataaga

SEQ ID NO: 1845 - DNA, 312 bp, Bacillus licheniformis
atgatcatcgtcacaacagatacaatcgcaaatcaaaacattgtcgaagtcaaagggcttgtcacaagcagcatcgttcagtcgcggaatatcggaaaagatattctgtcagggttgaagtcagtcattggcggagaattaaaaaattacacccaaatgcttgaggattcgaaaaaagctgtgagggaacggctcgtgaatcaagctgaagagcttggagcaaacgcgatcgtcggtctaaggttcgaactgtctgcaggccagggaacctccgaactcatcggatatggtacggctgttgtaatcggctag

SEQ ID NO: 1846 - DNA, 651 bp, Bacillus licheniformis
atgatcagaaaactattcactatcatcatcatggcaagtatcatcgcggtcggattcgtctgcaaagattcctggctcgacgtcatcagggacggaggcgtttattcggtattattcagcatgctgcttgtggcggcctgtgtatttttcccgatcgtcccgtttgcgctcattgccggattaaacggcgccttgttcggaatcgcaaacggcgtgctgatcacgctgacggggtctatgctcggcaccatgctcttgtttttcctctcacgttacggattcagagacatggctcgcagacacttaacgaaatacccgaaaatgagcgaatatgaagcgtattttaaccaaaatgcttttacagccgtactattgggcaggctgatcccggttatcccagccgttgtcatgaatatcgtctgcggtttaagcaaggtgaaatgggctgtcttttttgcggcttcgacgcttggaaaagtccccaacgttctcgtcgtctctatcgcaggtgccaatttcagcgaaaacaagctgctctctgtcggcgtctacggcttatatatggcgatcatagcgtttgtcatctacagaaagtatccccatctgactcaaaaacataaagagacgaaacagacagggaagccttcttga

SEQ ID NO: 1847 - DNA, 1017 bp, Bacillus licheniformis
ttggtatatacagcggaacatcttgatgattatttaatggaacaagcatccaacaatcattttcacggcagcattttgctggcagattcaaacggtatactgttatcgaaaggatacggttatgccaattgtaaggacaaggtgaagaatgaaccgtctacacgctaccaaattgcctcactgacaaagcaattcacagctatagcggtcatgcagctgcaagaaaaggggctgcttcgtacagatgacccggtacaaaactatttagaaggctatccgaacggcgacagcattaccatcaaacatttattaagccatacgtccggaattcctgattttctagaggaagaattgctcgatattgagctggagcgcgcaccgttggaccaatttatcagacgttttattgacaagccgcttgaatttcggccgggacaaaggttcaattacagtaattcaggatacatactgcttacaaaaatcattgaaacgatcacaaatgaagcttatggagacgttattcaacaattgatctttgaccctttaggcatgaaaaactccggttttttctcttctccggaagatatttcgcctacagtcggatatttatgcctgaatcgtgaaatgatcaaagcgcctatcgtatacggctacggggaaagcgggctgtattcaaccgttgaagacttgtacttatgggacagggcgctttacaccgagaagcttgtctcaaaagatgctttgaaagaagccctttacagccgcgtcaaaaagcaggcttttgcagccgaaggcccttctccggcgctcattcaaaacaattcgatcggatacggatggtttattaatcatcaaaataagtataaaatatggcatgatggagaaatccacggttttatcagctcaattaaccgatacatggatgagaaaaaagtgctgattatgctcagcaattgcaacctctcaaaaactgacgagattttggcacacttagaagaagctttattgcaaatgtag

SEQ ID NO: 1848 - DNA, 1191 bp, Bacillus licheniformis
atgggacataaacatatcgcgatttttaatattccggctcacggccatattaatccaacgctagctttaacggcaagccttgtcaaacgcggttatcgggtaacatatccggtgacggatgagtttgtgaaggctgttgaggaaactggggcagagccgctcaactaccgctcaactttaaatatcgatccgcagcaaattcgggagctgatgaaaaataaaaaagatatgtcgcaggctccgctgatgtttatcaaagaaatggaggaggttcttcctcagcttgaagcgctctatgagaatgacaagccagaccttatcctttttgactttatggccatggcgggaaaactgctggctgagaagtttggaatagaggcggtccgcctttgttctacatatgcacagaacgaacattttacattcagatccatttctgaagagtttaagatcgagctgacgcctgagcaagaggatgctttgaaaaattcgaatcttccgtcatttaactttgaggatatgttcgagcctgcaaaattgaacattgtctttatgcctcgtgcttttcagccttacggcgaaacgtttgatgagcggttctcttttgttggtccttctcttgccaaacgcaagtttcaggaaaaagaaacgccgattatttcggacagcggccgtcctgtcatgctgatatctttagggacggcgttcaatgcctggccggaattttatcatatgtgcatagaagcattcagggacacgaagtggcaggttatcatggctgttggcacgacaatcgatcctgaaagctttgatgacatacctgagaacttttcgattcatcagcgcgttcctcagctggagatcctgaagaaagcggagctgttcatcacccatgggggtatgaacagtacgatggaagggttgaatgccggtgtaccgctcgttgccgttccgcaaatgcctgaacaggaaatcactgcccgccgcgtcgaagagcttgggcttggcaagcatttgcagccggaagacacaacagcagcttcactgcgggaagccgtctctcagacggatggtgacccgcatgtcctgaaacggatacaggacatgcaaaagcacattaaacaagccggaggggccgagaaagccgcagatgaaattgaggcatttttagcacccgcaggagtaaaataa

SEQ ID NO: 1849 - DNA, 1578 bp, Bacillus licheniformis
ttgtcaaatcagggcaatttcaaaaaaacgatctctctgcttgacctgattttgatcggcatgggtgcgatattcggatcggcttggctgtttgccgtcagcaatgtcgcttcaaaagccgggcccgctggaagcttttcgtggattatcggcggcgtcattatccttttaatcggcctcgtttatgccgagctgggagctgcgttgccgcggacgggcgggattatccgctatccggtgtatacccacggccaccttgtcggatatttgatttcatttatcacgattgttgcctatacaagcctgatttcgatcgaagtgacggctgtcaggcaatacgtagcctattggtttcccggtttgacgataaaaggttctgaatcgccgacgattatcggctggcttttgcagtttgcgctgctttgtttgttctttttactgaattattggagtgtcaaagcgtttgcgaaatcaaatttaattatttcggtttttaagtattttgttcctttgacaatcatcatcgtgttgatattccattttaaatcggcgaactttgcgggagaatttgcgccgtttggctttggcggggttcagacatccatttcgaccggcggggtgatgttcgcatacctcggtctacatccgatcgtttcggtcgccggcgaagtgaaaaatccgcagcggaacatcccggttgctctgctgatttgcatcattgtttcggcttgcgtctatacgatactgcaagtggtgtttatcggagccataccgactgatatgctaaatgacggatggaaagcgatcggcagggaattttctcttccgtttaaagatatcgcggtgctgctcgggatgggctggcttgccactcttgtcgttctggatgcgattttatcacccggcggaaacggcaatatttttatgaatacaacatcgcgcttggtttatgcatgggcgcggaacggcacattgttcaaaatctttgccaaggtgaataaaccaacgggaattccgcgtccgtcgttgtggctgtcgtttgcgctcgccgttttttggacgcttccgtttccgtcttgggacgcgctcgtcaatgtttgctctgttgccctgatcctctcctatgcgattgctccggtttcagcagcggcgctgaatgtgaatgccaagcagcttaaaaagcctctgcaaatcaaaggaatggctgtcatcgctcctgtctccttcatatttgcgtcgtatatcgtctattggtcagggtggaacaccgtgtcatggctgctcggatcacagcttgtgatgtttgctgtttattgcgcgtgtaaaaaatacgttccgcaggacgatgtttcgtttgcacagcagcttaaatcaagctggtggatcgtcggatattatgtgatgctcctgattttatcgtttctgggctcattcggtaacggccttggcctattgagaacgccggtcgatttaatcttgatcgcgctaggatcgattgcggtattttactgggcgaaatatacggcgctgccaaaggcagtcattgattatgatgagaaaaaagaagaaaccgtttaa

SEQ ID NO: 1850 - DNA, 300 bp, Bacillus licheniformis
atgaacgaattcatccaaaacatgacaggcatgggcgcgatgactgaacaagtcattgccaccgattttttaatctcggcaaaaaccggtgtcaaaaacattgccacagctatcacggaaacatcttctccagaagtgcgcgaaacgcttaagcagtatttaaacgacgcgattgacacccatgaacagatcacaaactatatgatttccaaagggtattaccatcctgcgaatttatctgaacaaattcagattgataccaaagctgccgaaacggctaaagatcttccgcaactgtaa

SEQ ID NO: 1851 - DNA, 207 bp, Bacillus licheniformis
ttgcgattgaataatgcgatccatgaaacattggagctgcatgagctgttaatgtttaaaaacctttgtctgacaaagtcatcaacaatgacgggaatggttcaggatcaagagcttcgcgacatcttggagcgtgatgcatcccaaacaaagcatcagatcgagcatttacaaggtctattgtcagtgagaggtgaaaccgtatga

SEQ ID NO: 1852 - DNA, 1260 bp, Bacillus licheniformis
ttgtttatttatacagtccagccgggagattcactatttgtcatcggcgccaagttcggaatttcgattgaccagatccgattggcgaatgggttgatcgcaacaaacattgtccccggacaggctcttttaataccgctttatacatataccgttcagccgggagacagttattacacgattgcccgccggacgtttgtatccgtcgaagcattgcaaaaagcaaatccgtctgtaaccccttccaatatgaggccggggataaaagtgatgattccggaattgccgaaaaaaccgatcactgctttaggatattacacactgagaaacccccggttagaccaggaattgattcataattttgccccatacgccacgtatctggcattttttgaataccacatttcaagcgacggatcgttaagcgagctgaatgattcaccggccgtacaaacggcttggagacggcgcgttcctcccctcatgacagtcaccaatctaactgaatcaggcttcagtccgtctcttgcgcaccgcgtattaaatcagcctgccgtaagaaatcgcctcatcgacaatattgtccaaacgatttccagaaaaggatatgcaggcgtcaatattgatttcgaacagattttggaggaagacagagatttattttcaggttttctccgcctgttgaaagagcggctgaagccgtccggctatgtgttgacgattgccgttccgccgaaaacaaatgaaaatatcgcctggctgaaagggtatgactatggcggaatcggtgcagtgagcgaccttatcttcatcatggcatacgactggcaccacgggacaagcgagcccggccccattgctccgatcaatgaagtccggcaaacaattcaatttgctctccgccatgtccccaaagaaaaaatcgttctcggctttccgctttacggctataactggaccctgccctatcagcccggtgccgtataccccggaatcgccaaccaagacgccgttcagctcgccatgaagcaccaggcaccgattcaatatgatacaaattctgagtccccttttttcagatacaccgatgaacagggcagacggcatgtcgtatggtttgaagacgcacgcagcatcggaaaaaaactgcagctgatcaccgaatacggacttgacggcggcggcgtctggcagctcacactcagttttccgcaaggaacatggctcttgaccaaattctttcgcgtccgaaaagtctga

SEQ ID NO: 1853 - DNA, 585 bp, Bacillus licheniformis
ttgggaaggagcaaagaatttgataccgctctcgtccttcataaagcgatggaggttttcggccaattcggctatgagggggcgtcgatgcaggagctgctcagccgcctgggaattgccaggcaaagtctgtacaatgcattcgggactaaaaggggtctgtttatcgccgcccttacaagatatctagatgataaaaatgcgcaagtgatcgccatgcttgaaagccccggatcagtgaagcaatcggttcggcagatcttccaggaaagcttaaacgttctgaaagaccccgaacgttcaaaggcatgctatatcatcaacagcgcaattgaacaaattccccgcgatccggaggttgccgaatacttcgataagcagacaaagcagttggaaaccgccttttacaaagcgcttgtccgagcacagtcacagggggaactaaagaagggcctccatgatctttcagcagttgcccgttttttgaatcaaacccggctgtcgctcacgtttcaggcgaagttaacgggggattttgatgcccttcaggatctgatcgatgtcagcctgtctattcttgattga

SEQ ID NO: 1854 - DNA, 420 bp, Bacillus licheniformis
atgacgcgtgcgataaccgatgtgatggaactgtttttgcagtcgatgcttgaaaaggatatggaaaagtggatacagctttgggatcaagatgcggtgtttgagcatccatacgcaccgccggtttttcctaaaaaaatagaaggtaagtcagcgatttacgattatataaaggattttcccgaaaaaatcgatattgtccgctttacagcgccgactattcatcaaacggcaaaatcgggctattcggctgtcgaatttgaatgtgaaggcattgtgtgtgagacgggtcttccttataaccaacagtacatcagccttgtaaaccttaaagcgggcaaaattgtccactacaaagattattggaatcctttgactgtcgtcaaatcgttcggaggacagctgcaaacctttttataa

SEQ ID NO: 1855 - DNA, 846 bp, Bacillus licheniformis
gtgggaaaaaaaatattgattaccggcggaaccggtacgacagggagccgaatcgccaaaaggctcgtgcatttgggtgccggcgtccggatcgcaagccggagaatacctgcaattaccggagcagaacatgtatattttgactggaatgatcaaacaacttacaaagacgcattaaaaaacacggactcattgtatttggttgcgcctgtcggtgtatacgaaccgtcgccaatcgtactgccttttttggaaatggcatcggcattcggcgtccgccgcattgtcctgctcagcgctgcaattattgatgaaaatggaccggttttcgggaagcttcatcacgcggtcaggcgatatgttcctgaatgggcggtgctaaagccttcatatttcatgcagaattttgaccatcagcatggcgcttcgattcgggagaaaaatgaaatcgtcaccgcatcaggcgacggcaaagtcgggtttatagatgcagacgatatcgctgaagtagctgtgcgcgcattgcttgatcaaaagccgcataatacgagccatattttgaccgggccggaagccttgagttatgccgaagccgcggcaatcatcggcagagcggcaggccgcgacatcagacatgtcaatgtcgaagtgtccgcgttgagaacaaggtatataaaggcaggattatctcccgattatgccggcttcatgtcggaattagatgagaaaatcaagaacggcaaagaaaaccgcatcacggatacagtggaacgcatcacgggaaaaaaaccgcgttcactggctgatttcgctaatgaacacaccggacgctggcgtctgttttaa

SEQ ID NO: 1856 - DNA, 306 bp, Bacillus licheniformis
atggagaatgcagaacatttacagcagacggcggttcccgaacagcatacgcatatcccccagtatcagcatcccgaaaccgccttgcaccacattaaatgtccgttgtttccccacttgaaacataagacgttgtgcacagtagcaccttttgttcattacggtttaaatgaagcccaagccacttcctatcaccatgccatggaagaagtagcggcaatggcttatttaatgggcatgggaatgaaccctcacttggcctactgtacagttgagtcatgggaaataaacgaaacattttattaa

SEQ ID NO: 1857 - DNA, 456 bp, Bacillus licheniformis
atggctaaacatcatttttaccttcaggcagactggcctggaaaacgaaacgacatcggaaggattgaaagcgggaatttaaaaaccgaaatttcgataccaaaggaaatggacggcccgggggcggggacaaaccctgacgaaatgctgctcggtgccgctgcgacttgctatatcattacacttgcagcgatgatggaaagaagcggattggaaaaagagagcctgacgatggaatccgaggccgttgtcgatgtgacaggcggggtgtttacgtacgaaaaaatcattcacagacctctgatccgcctcccgaaagaagcggcgcaaaaagaggccgaacttgccgaaagactggctaaaaaagcggagacatcatgcatgatatcaagggcggttcagggcaacgtcgccattgaattagagccgaagattgtcgtctccaaagcggattag

SEQ ID NO: 1858 - DNA, 360 bp, Bacillus licheniformis
atgaaaggcatgatctttttggcggctgccattttgtccgaagtattcggaagcacgatgctgaagctgtcagaaggctttagcgcccccctgcccgcagccggcgtgataatcggttttgcggcttcttttacatttctgagcttttcattaaaaacactgcctttatcagcggcttatgcgacttgggccggcaccggaacggccttgacagctgcaatcgggcattttatatttcaggagccatttaatctcaaaactcttattgggcttactttgatcatcggcggcgtctttctgctcaattcaaagcgcaccgaagcagcggatcaaaaggctcagctcacgatcgaaatctaa

SEQ ID NO: 1859 - DNA, 318 bp, Bacillus licheniformis
atgattgcaggctacatttttcttctgatcgccatcttgtcagaagcggcggcagccgccatgctgaaaatatctgacgggttcgcgcgctggcagccgtcggttcttgtagtaatcggctacggtctcgcattttacatgatgtcgctcacattgcaggtcattccattaagcctctcctatgcgacttggagcggagcgggcaccgttctgactgcaatcatcggcgtcttgtggtttcaagaaaagctgaaccggcgaaatatcgccggcattatctgtctcgtgtcaggcgttgtactgatcaatttgtcataa

SEQ ID NO: 1860 - DNA, 264 bp, Bacillus licheniformis
atgttagtcaggtatcattttattattggagggatttttttatgtatcatttcgaccatgctcctgtatatgacgacgacagccagcgaatcattggcaggcctttctttgggcggaccttttgggcggccgtttttcggcccgcgtccatttttcggtccgggccccttcttcggaggatttttgggcggccttactgccggagcgcttctcggcccttggggatatccgtatccgccgtatccttactatccttatttctga

SEQ ID NO: 1861 - DNA, 414 bp, Bacillus licheniformis
gtgaacgaaaacatgacgctgtatcagtcggattggtcaaaagcgcctccccatgcccacgcctacagggcgagaacaacgactgccgagggacattaccacctaattgagggtttttcccagccggcaaacgggagcaatacagatgggcacgttcatttttattccggaattacttctttcgtcgatggtcattaccataggtattatgcgattacggggccagcgattccgcgggcggacggcacgcactatcatgaaatcgagggcacgacctatttggcatattctgcggctcccccggtcagatatggcggagtcgtttatgtaagcgatggaatgaaggaaaggcaccggcatccttttaagggttacacaagagaaatcgtcggaaatgagccgattggctggtga

SEQ ID NO: 1862 - DNA, 945 bp, Bacillus licheniformis
gtgaataaaacgaagccgccggtcatcgttttgatcggaccgaccgctgtcggtaaaacaaaattaagcgtcatgctggccgagcgtttgaacgcggaaattatcagcggagactcaatgcagatttacaaaagaatggatatcggcacagcaaaaatcagagaagaggaaatgaacggggttccgcatcatctgatcgatattaaagaaccgacggaatctttctcggtagctgaatatcaggagatcgtcagacaaaaaattgcagagattgacaggcgagggaagcttccgatgattgtcgggggaaccgggctctatatccagtctgtcctttacgactattcattcacagaggaagcaggcgatcctgagttccgggcggagatggaggcgttctctgcgaagaggggggccgaatatgttcacgatcttttgaaagaacgcgatcccgaagcggcaagagccattcatccaaataataaacgaagggtcatcagggcgcttgaaatcctgcatacaacaggaaaaacgatgtccgaacatatggaaggacagcggaaagagcttttatacacgacggctctcatcggtttgacgatggagcgggaagtgctctatgacaggatcaacagccgcgttgaccagatgatggatgaggggctgctggatgaagtgaaactgctttatgatgaaaacgtaagaaactgccagtctgtccaggcgatcggctacaaagagctttatgcgcatctcgaaggcagagcgtccttggaagaggcggttgagacattgaagcggaattcgagacgctacgccaaaaggcagctgacatggtttagaaatcaaatggatgtcgcatggtttgacatgacgccccctgtcaatatcgagcagaaaaaacaggaaattttcacttacatagcaggaaagctcgaactttaa

SEQ ID NO: 1863 - DNA, 222 bp, Bacillus licheniformis
atgaaatcgataaatattcaagatcagtttttgaatcagattcggaaagaaaatacatttgtcacggtctttttactgaatggatttcagctgcgcggacaagtaaaaggatttgacaactttacagtgttgattgaatcggaaggaaagcagcagctcatatacaaacacgccatttctacgtttgcaccgcaaaaaaacgttcagctcgaactggaatag

SEQ ID NO: 1864 - DNA, 213 bp, Bacillus licheniformis
atgaaacctaagatcgtcatcaaccattgggaagagacgtgtgaagatgattcctgctatgaatacggcacaagtattctcgtaaacggaaaagagcttgtcagggaagcgtcgatcatgacggctgttcagtcggttcttaaggaactcggcatcgaagccgatattaaagaggtatgcgagaacaagtgctgtgacgcttacaaaaaataa

SEQ ID NO: 1865 - DNA, 396 bp, Bacillus licheniformis
atgattcagatcgtatttgattcaaaaacgggaaacgttcagcgctttgtggataagacgccttttcgcaataaacggaaagtcagcacagaggagtatctagacgaaccgtttgttttgatcacgtacacgacagggtttggggaagttccgaaaacgactgagatgtttcttgagaaaaacgcccatcttcttttgggagttgcggcaagcggaaacagagtgtggggagacaattttgcgaaaagcgcagaaaaaatctcgaagcagtatcaggttccgattctcggcaaatttgagctcagcgggacggccaaagacgttgaactgtttactcaggaggtagaaagagttgtcacaaaatcaagtgccaaaatggatccagttaaacaatga

SEQ ID NO: 1866 - DNA, 2103 bp, Bacillus licheniformis
ttgtcacaaaatcaagtgccaaaatggatccagttaaacaatgagatcatgatccaaaaagacgggaaattccagtttgataaagataaagaagctgtacatagttattttgtagactatatcaaccaaaatacggtatttttccatgatctgaaagagaaaatcgattacttaatcaagaatgactactatgaagaagagtttttaagccgctacacgtttgaagaaatcaaagaagtgttcaaagaggcttacgccaaaaaattcagattcccgtcctttatgagcgcttttaagttttacaatgattatgcgctgaagacaaacgacaagaaaaaaattcttgaacgctatgaagacagaatctctatcgtagctttattttttgcaaacggggataaggagaaggcgaaggaattcgtcagaatgatgatcaaccaggagtatcagccgagcacgccgacgttcttaaatgccggccgcaaacgccgcggagagctggtcagctgtttcctcttggaagtcaatgattccttgaacgacatttcgagagcgattgacatttcgatgcagctgtcaaagctcggcggaggcgtatctttaaacctttcaaaactgcgtgcgaaaggcgaagcgatcaaagatgtcgaaaacgcgacaaaaggtgtcgtcggcgtgatgaagcttcttgacaacgcattccgctacgctgaccaaatggggcaaagacaaggctcaggcgctgcgtacttaaacattttccaccgcgacatcaacgatttcctcgatacgaagaagatttcggctgacgaggatgtccgggtgaaaacattgtccatcggggttgtcattccagataaattcatcgagcttgcaagagaggataaagcggcatacgtcttctatccgcacaccgtttataaagcgtacggcgagcacctcgacgaaatggatatgaacgagatgtacgaccggcttgtggaagatccgcgcgtcaaaaaagaaaaaatccacccgcgcaagatgctcgaaaagcttgcgatgttaagatcggaatccgggtatccgtacattatgttccaggacaacgtcaacaacgtgcatgcgaacaatcatatttcaaaagttaaattttccaacctttgctcggaggttctgcaggcttcacaagtttcatcatacacagactacggtcaagaagatgagatcggccttgacatctcctgcaaccttggttcattgaacattttgaacgtcatgaaaaacaaatcgctcgagcagacagttaagcttgcaaccgattcgctgacgcacgtttctgaaacgacaaacattacaaacgcaccggctgtcaaaaaagcgaacaaagcgatgaaatccatcgggctcggagcgatgaacctgcacggattcttggcacagaacaatatcgcctacgaaagtgaggaagcgagggacttcgcgaacactttctttatgatgatgaacttctactcgattgaacgatccgccgaaatcgccaaagaaaaaggtgagacgtaccatgggtacgaaggttcagcttacgcaacgggtgaatacttcgaaaagtatgttacacaagatttctcgcctaaattcgaaaaagtggccaagctttttgaaggcatgcacatcccgacaaaagaagactggaagcagctgaaacagtttgtcaaagaacacggattgtaccacagctaccggctgtgcatcgcaccgaccggatccatttcatatgtacagtcaagcacagcatcggttatgccgatcatggagcggattgaagaaagaacatacggcaactccaagacgtattatccaatgcctggacttgcgccgagcaactggttctactataaggaagcgtatgatatggacatgttcagggttgtcgacatgatctcgacgattcagcagcacgttgaccaaggcataagctttacattgttcctgaaagatacaatgacgacacgcgatttgaaccggatcgatctttatgcccaccataaaggaatcaaaacactttactatgcaagaacgaaggatacagggcaagaaggctgcctttcttgtgtcgtttga

SEQ ID NO: 1867 - DNA, 978 bp, Bacillus licheniformis
gtgacgaaaatttacgatgcagcaaactggtcaaagcatgaagatgattttacccaaatgttttacaaccaaaatgtaaagcagttttggcttccggaagagattgcgcttaatggagatcttctgacatggaagtacttgggtaaaaatgaacaggacacatacatgaaggtgctcgcggggctgacgcttctcgatacagagcaggggaacacgggaatgccccttgttgctgagcatgtggaagggcatcagcgcaaagcggtgctgaatttcatggcgatgatggaaaacgcggtccacgccaagtcctattcaaacattttcatgacgctggccccgacagagacgatcaacgaagtctttgaatgggtcaaacaaaacaaatacctgcagaaaaaagctcagatcattgtcgggctctatgaaaaaatccgccagggcgataaaatctcgctgtttaaagcgatggtcgcatccgtttatttagaaagcttcctgttctacagcggcttctactacccgctttatttttacggacagggcaagctgatgcaaagcggcgaaatcatcaacctgatcttgcgtgatgaagcgattcacggcgtctatgtcggcctgctcgctcaggagatttacaatcagcagacgccggagaaaaaagaagagctgtatgcattttccattgatctattgaaagagctttatgaaaatgagcttgaatatacagaagacctgtacgatcaagtcggcctttcacacgacgtgaagaagttcatccgctacaatgccaacaaagcgctgatgaaccttggctttgaagcttattttgaagaagaagagatcaatccgatcgtgttgaacgggttgaatacgaaaacgaagtcacacgacttcttctcaatgaaagggaacggctacaaaaaagcaacagttgaaccgttaaaagacgacgacttttactttgacgataagtaa

SEQ ID NO: 1868 - DNA, 618 bp, Bacillus licheniformis
atgggaaaaatggacgaaatgattctcgtggtcccgcgggaaaacgtatttgcaaatgaaacgctgaccttccaaggcgtcaacagcgacggtgagacgatcgggaagatcatggcgcatattgaacgccacttcagtgaaatgagaaggggagacgccgaggaagatcctgcatttaaacagccgatcccttatgttgtcatcaaaagagaagacgaaatatttgtatatgagcggctcgaaggcggaggggaagcgcggcttcacaacaagctgtcactcggcttcggcggacacatgaactttgccgaagggcttgactttcccgatattctgaagttgaatacagaccgcgaacttgatgaagagcttctaatcgaggaatcagctaaagaaaaaatggtgacgctcggactgattaatgatgatgaaaacagcgtcgggaaagtacatatcggaatcctttcagcgcttgaattaaaaccgggcgcacacgttgaagtcaaagaaaaggagcagattgccggccgttggatgaaagccagtgatctgaaagaaaaaagcgtctatgacagacttgaatcttggtcacagtttgtcgttgatatcttagtttaa

SEQ ID NO: 1869 - DNA, 801 bp, Bacillus licheniformis
atgaaggagccataccgcatgcagctcgagtcttttcaaatgacaattttatctgatggagcatttcgggtttcaagggatttttttttggcgggaggagactccaaggaaacagaacgttatcctgaagaatttgaagcagcgctgaactttgcctgtctggagacgaacggcaaacggatactgattgatacgggatttggggaaacaggcggacaagaaagcgggcacttgcttcatcacctgaagcaggcgggaatcaagcctgactcgatagactatgtcattttgtcacacagtcatttagatcacacgggaggtcttctaaaaaacggagagcccgcttttccaaacgctgttcatctgctcagtgaagcagaatggctgtacgcaaaacaaacgccggcgtctcctcagtttcacattctctccgctgtccggccgcttctgaagctgctgacagaagacaccgaactgcttcccggactgaagctgatccatacgcccggacatacgcctggacacctgaccattgaattgcatacaaaagacggcgtctgtcagatcatcaatgatgtatttcatattccggaaagtatctccaatccgaagctgcgggtttcgcttgagcatgatcctatcgagggagaaaagacaaggagactgctggcccgacaggcttataacggacagttcctgctccacggctgtcatttcccatatcccggcttcgggctgatcgaaaagcatggctcattttttcaatggaaaccggttctatacgaaaagaaaactcgctga

SEQ ID NO: 1870 - DNA, 432 bp, Bacillus licheniformis
atgccgacactggaagagctgtatcggtccgtcattatggatcatgcaagatacaggcgaaattttcgaaaaatcgataaacacggcgtgtattacgtccattacaaaaatccaacatgcggtgatgtgatgactttgtttatcgacattaaaaatgaaaagatcgaagacgcagcttttatcggagatgggtgcagcatcagcatggcttcctcatcaatcatgactgaactgataaaaggaaagacgttaaaagaagccgggttaatgcgtgaagcgatggaaaatatgatcagaaaaggagaagagccggaagaggatctgctgggagatgccgtttccctgattggcgtccatccgttgcgggcccgtcataactgtgccctgatgccttggcaggcgctcgatcggatcaaagagaacgtttattaa

SEQ ID NO: 1871 - DNA, 465 bp, Bacillus licheniformis
atggaaaacgaaacgaatgtaaagcaggaagcaatggcgcagcttaaacggaaaggcattcgaatgacaccgcagcggctggctatctaccattattttctagccaacaggaaccaccccacaatagctgaaattcaacaatcattgagggagatatatcctgccgtcagtacagcgacgatatacaacaccatccgctattttaaacaagagggccttataaaagaaatggggtttaccgatccgcttcgttttgatttggctctagaggaacatgatcatgtcatatgcgaagtatgcgggaagatcgtcgattttcattgtccgcaactagagaaagtaaaagacattgcggcacggctgaccggatttaaagtgacacatcaccgattggaactgtacggcatctgcaacgattgccaggcgaaaagaaaatacgccgctaaagagaaaggggttagataa

SEQ ID NO: 1872 - DNA, 663 bp, Bacillus licheniformis
atgaagaataacattaaacgaatcaaacgaatttcgcttcgggaagaagtgtatcaaacgctgaagcgcgccatcgtacatttggagctaaagccggaggagcgcctgcatgaccaggagcttgcagagcagtttggcatcagccgcacacctgtcagggaggcgctcaaacgactggaagatgaaggccttgttgaagctgtcccgggatcggcaacacgtgtagcaccgttaaatcgcgaggaggctgaacacgcttttacagtcactgcggcgctgcatgcgctggctgtcagactgtcgcttccttttttaacggattccgactttgatcagctggaggcgcataacaaaacgttgcagcaagcgattcaaaaagaagacattatcgaagcaatcgaatcagatgctgcttttcatgacgtgtttttacaagcatcaaaaaacccggaaataacccgggcattggaaaggatttcttcaaaaatttaccgccttgaaatgtcgcagttttcctcgatcggcagcttgaaatctgttgaacagcatcagaacatcatcgatgcctgcagacagggggatcggaatgcggccatcaagcttgccgaggaaaactggctcagtctcggagatcgattggccggacatcaggaaaaggagtga

SEQ ID NO: 1873 - DNA, 969 bp, Bacillus licheniformis
gtgaggccgattatactgggcgtttttgcagccttcttttttgcttttacattcgttttaaacagggcgatggagcttgaagggggaagctggatctggagcgcttcgctgagatttatcttcatggcgcctcttttatttgccatcgtttggcttagggggaatgtgaaagagctttttcaggaaattaaaaaagcgccgggcatttgggtgagatggagcatcatcggcttcggtctcttttatgcgccgctctgttttgcggcggcttacggaccgggctggctgatcgcgggaacatggcaaatcacgatcatttccggttccctcttggcgccgcttttttatgaaaccgttcaaacaaaaacaggtcccgtacagataagaggcaaaattccttataaggggctcacgatgtcgttcatcattttaatcggggtggcgctgatgcaagctgagcacgcggcacagctttctttgcacgagatgctgctgtgcatcgcgccggttatattggcttcatttgcttatccgcttgggaacagaaaaatgatggaagtttgcgccgggcgcctcgatgcttatcagcgggtattggggatgacgctggcaagccttccgttttggctgatcctctcgctgtacgggctggcatcggcaggtgcgcccagccggggacaagtcattcagtcaggattggtggctgtattttccggaatatgcgcgactgtgctgttctttgccgcaacagatcttgtaaaaggggatatgcgcaaattagcggctgttgaggccacacaatcgtttgaagtgctgtttgcggccgctggtgaaattttaatcctatcgagtccgcttcccggtgccatctcatggagcggaatggctcttgtgattatcggaatggtgttgaacagccatgcatcgaatcaaaagccggcggttcaaagtaaagctgcaaaagcataa

SEQ ID NO: 1874 - DNA, 762 bp, Bacillus licheniformis
gtggtaaaaatttttatcgatcccggccatggcgggactgatccaggcgcttcagccaatggtttgcaagaaaaacagttaacattgcaaatcgccttggctttaagaaacattctcctgaatgaatatcaaaatgttacagtccagctgagccggacaagcgaccaaaccgtcagtctgacgcaacgcacgaacgccgcgaacagctggggggcggactactttctatcgattcacatcaatgccgggggcgggacaggtttcgaggattacatttatcccggcgtcggcgcacctaccaccacctatcgggatatcatgcatgaagagattttaaaagtggttgatttcagggatcgcggcaagaaaacagccaattttcacgtgctaagggaaacagcaatgccagcactgcttacggaaaatggctttgtagacaatacaagcgacgccgagaaactgaagtcatccgcgtttattcaatccattgcgagaggccacgccaacggactggcaagggcatttaacctttcaaaaaaatccacagccctttttaaagtgcaaatcggcgctttcagggacaaagccaacgccgattcacttgccgctcaagcgaaagcaaaagggtttgatgccattgtaattgacagggacagcctttacaaagtgcaaattggcgccttttcttcgaaagagaatgcagaagcgcttgttcagcaagccaaaaacgccggatttgatgctttcatttaccaggaatag

SEQ ID NO: 1875 - DNA, 483 bp, Bacillus licheniformis
atgaaaaacaaatctatgtacgtttttcttttcatgatgctcgggctttttgccggaatggcatccccgattcaaacatccattaattcagagctgagaaatgctatccactcaccttttatcgcttctctgatttcgtttttggtgggaatgctcgttcttctttttcttacatcgttcattgagcatcggcggttatttttaaacaatttacaaacagcaaaaacctttgtcacaagcagtccgtggtggctctggacaggcggaatactcggcgtcgtctttattacgtccaatattttgcttttgccgattgtcggagcgtctcttactgttgttttggctttaagcggccaaatgatcatcgccctcgtcatcgatcattttgggtggttcggaatccccaaacaccgcttgaacgtccagcgcattctaggaatcgtcctgatgatcacaggaattatgatcattcagcatttttga

SEQ ID NO: 1876 - DNA, 453 bp, Bacillus licheniformis
atgatgatcattttaatactgatagccggcattttggccggaatggccattcccgttcaaacctcaattaattcacggctgggcatgaaaatcgggtcaccttacggggcggcggccatttctttttttgtcgggacgcttctcctgctcattgtcgccttagtgacagagcgccattttttgtctatcatcggacttgttccttccattccctggtggatcctcattggaggcggatgtttaggcgttttttatttaacttcaaatattttgttgcttccgcgtcttggatcagctctgacggttgtcgtcactctgcttgggcagatgatcatggctctggcgatcgatcacttcggatggtttcacgtacccgttcatgaattaaactttcctagaatcatcggcattttattcattatttccggagttttcatcatcaaaaaatattaa

SEQ ID NO: 1877 - DNA, 186 bp, Bacillus licheniformis
ttgatttttacgatccgccatacaaaaacctttggtatcccagtcattgtaaagctcacttttgtcttttcttttgcgacctttgccattgcatcctgcacattgaaattcaaagccaatactttcctcaacagccgctttatttctacatatcatttctatatttgtataaaaaatcaagtttga

SEQ ID NO: 1878 - DNA, 204 bp, Bacillus licheniformis
gtgttcaacgaaagagaggcgctccgattaagactggagcaactgaacaatgccgagattcagatcatacgcgaactccaaagtgagcggaaagacatttattccaggctgcgggaattagatcgtcaaaaagtttcttcatcacatcataaaaaaactttattagagttagtcgatgaaactgtaaatctcttgaaaaaatag

SEQ ID NO: 1879 - DNA, 624 bp, Bacillus licheniformis
atggggaatacagacacaagagaggaattgctacatatcgcgcttgagctttttgctacgaaaggataccacgcggcaaaaatttcagatatcgtaaaacaggctggcgttgcacagggaaccttttactggcacttcaaaagcaaagaagaaatcgccaaggaaatcataggcagagggaaagataaccttctcgcagccattcatcaaggctacaggcaaacgtttgctcttgccgatgatatgatccaatccacgacagcgcttatgaaaagaatttttacgtttgcacaggagaatagaaacttaatgacatttttattagtcaagggacaaggcgccgatccggaaatcagggaggcaatcgaagaggcgctgatcagtgttgaacaggcatttaaaaagaacattcaaagggctacagaacttggaatgctaaattcctcccataacactgatctgcaggccaccatgttaacaagtcttgtgttgggcacactatcaaaatggctttttgggccaaagcatgatctgaattatgttcctaagttttcagttgatgaaatgactgaagaattggttcattttgaatttttcggactgattggccaaagggggaattaa

SEQ ID NO: 1880 - DNA, 387 bp, Bacillus licheniformis
ttgtctactattcaaaaaacaaatggagagtttgggatttttcatgaagccggtatgcaggcgaaagggtctttcactccgaattcagacggacttacaccgattgagctgttggaagcttcattaggtatgtgcatcaccatttctttgcaaaagatgtttgaaagggatggtatagaggtgctggaggatgagttttccgtttctgtttccgccgctaaagcccccgaaggcccgtcccgtgttgaaaaatgttcggttagcgttaaattgcctgagcatcttccgaccgactataaaaagaaactaatcacctctgctgaaagggcatgtacaatcggcaatacgttaaagcgaggggtaacgattgataccaatatggtgtaa

SEQ ID NO: 1881 - DNA, 1350 bp, Bacillus licheniformis
atggaaaacaacagtaaaaaaccttcctatacaaacgctgatgattttgctgttacatcagtccctgaaaataaaagaaaatcgatttttaacattacgattacaagctgtgcctggatcatctcattgtcgacgattgtgactggaggggcattaatccagggattgaattttgcacatgccgttttagcagctgtcttaggcatgctgattcttgcggtatatggcttttttcaaggagtaatgggtgcgaaatacggaatatcgactaccgttcttgcccgtctggcctttggtcgctacggatcgagcctttttggaattgtcttggcgctgacgcttggaatcggctggttcggctggcaggttgctttctttggcacgaccatttccgaaatgtttccgggtgtttggcttgcaaagcctgaggtcgccatcgtttggggcggcattttaatgatccttaccgcgtttataggatatcgcgggcttgccgctttaagctttatcgctgtacctttagtcgtcattttttccatatggggaatcataagtgctgtcaattactcaggaagctggcataacttgctgacatttcacccgacaggggatcctctgacgatatttgccggaattacaattgtcgttggaaatgctgcattgggcgcggttgtttttcctgatgtgacgagatatgcaaaaggagcggtttcaggaggaataggcgcttctgtaggttatttccttggaggagtgttctgtcttgttgcgggagcggcaatggcgattgccgcgaatgttccggatatcgggtcaacaccgaatattcctgccgctatgagcaagcttggcctgggctttttagcatttttaatcatcgtttttgcacaatggacgacaaacgataacaatttgtataccggttcgctagggcttcgcaatgttgtgaacattcctaagaaagcacttgtggcgatcatgggcgtgatcggaattatcattgcattactaggtgtccaaaatatgtttgtgccatttttaacattcttaggcttgtatgttccgccgattgcgggagtcatgatcgccgatcattggatcacagcacctgtcatcaagaaaaaacaatatcaattcggggctggaacaacttattcgaagctgaatgttgcggcgattctttcggtgatcatcggaggttttaccgcttcaaagataacgttcggcatcgggccgattaactctactatacttgcatttttgatttatatcatctttacgtttattttcacaaaattaaatctccgttacgaaatcggagaagcgacagaggaatcgtctggtttttaa

SEQ ID NO: 1882 - DNA, 2106 bp, Bacillus licheniformis
atgatgaatgaaaaaaaccaatgggtatttggaattgatgtcggcgggacgtttacagatttagtggcagtcaacaaggacggaaaaatggtttcgacgaagacgccttcaaccccagaccagtctgatggtgtcatgaacggaattaaaaaaatggctgaaatcatcggaatagacgtaaaggatctattagccaatagtccattggttgtccatggaacaacagttgccactaacgccttgctggaatataacggagcaaaggtggggcttctcacaacggaaggctttcgggacgaaatcgaattccgccgcgcgtataaagaaagcgtgttttctccgcgcttagaagctccttatcaaattgtcccaagaaggtatcgtgtggggattcctgaacgactggatcatacaggaaatgtcgtaactaagcttgatgaagaagccgtccgccgggcagtccgcgggtttatccaagagggggtcgaagccgttgctgtctgctttctgttcagcttcatgaatccttcacatgaaatccgtgtcaaagagattattcaagaggaagctcccggcatgtttgtatcgttatcgtatgaagtgctgccgcagattcgggaatttgaacgggtgagcacgaccattgtcaatgcgtttaccggcccttccatgcaaagctacttaaaccatcttgacgaacggtttcgcgaagacggatttactggagaactgtttgttatgcaatcaaacgggggggtccaaaatgtcattcaaagcgggaaatttgccgcgggtggccttttgtcaggtccagccggaggagtgacggctgcttcctttatcggggaaaaatcgggctacgagaacgtcattaccgtagacatgggcggaacaagctatgatgtctcggttatcgaaaaattaaatccggcgatcacgacggaaaattggatcagcagatacagggttgccttgccgatgatggatatccatacgatcggctccggcggcggaagcatcgcctggattgacagcggcggagctttacaagtcggcccgcgaagcgcaggctcaaatccggggccggcctgctacggaaggggcggagaagaaccgactgttacagacgtgaatgtcttcttaggctatatcaaccctgataacttccttggcggagaaatgaagcttgaccgttcgctggctgaaaaagccattcgtacacgaattgccgaaccgctcggaatttcgacagtggaagccgcgcttgcaatctcacaaatcgtcaatagtgatatgtcaaatgcagtccactttgtaacgacacagcgaggccatgatccaaggaacttcgccctgatggctgtcggcggcgccggagccatccatgcaggcaagcaggcggaagacctgggcattaaaaccgttatcgttccgtcccttgctccggtcttttgtgcgctcggcgatgtggcggcaaaccttaaagtaacggagctcaggacgcgctttgaaagtttgaaaaacgttgacctgcaagcgatgaacgccgattttgaaaagatggaacagacggcccgcgaaaaacttggaggccaatcggtcaccaatcaatatgaaacgcgtcgctttatcgatatgcgctacgcgggggaagtccatgaagtaaccgtaccggtgaagtcaaggacgcgaaggattacagagttgaatcttgaagcaacggcggcagacttccatgaccttcatgaaagaatgtttgcccataaagaccctgagcacgacattgaaatcttaaacctccgtcttgatctggtgggagtcagagagccgttaaagcttaaggaggagcagtttgaacaagaggatccttcaaaagcgaaaacaggtgaacgcgatatgtattttgacatcgaaccggcgaaaacgcctattttcaacgggtcaatgcttgagccgggcaacctgattgtcggtcctgccatcattgagcaatggggtacgaccattgttgtttacccgggacatgaggctctaatcgattcataccgcaactgtgtcatcgaagtaaagcatgctcaacaggcgacaagaggtggaaatgcatga

SEQ ID NO: 1883 - DNA, 1479 bp, Bacillus licheniformis
atgatccaagctcaaattctttatagaaagctgcaagcgatcggcagagaagtcggggataatttgcagcgaatctcccgttctcctgtgctttcgcaagaccgggcatttgctgcagcgatttttacgaatgagctgaaaatcgcggttcaacatcaatacgagcctgaacatttgttcgcattaaaagaaagtgtcgaaaatctgttcgactatttttcgtttgatatcgcagatggagatgtgctgctggtcgcagatccatacagcggcggaacgaaagggcagtcgctcaccatggcggcgccgctattccttgaaggggagctcgtactcttccccgctatccgcgctcagatgattgatttggccggcgagtatccggggggcttccatcccgatgcatttgaagtatggcaggaaaatatcagaattactccggttaagctttataaacaaggagttctgcagactgatattcttcgttttttattatcaaacagccgggtgcccgcttcttttaaagcggatcttgaagccatgtatacatgtttgcatggtgccaaacagcaattgaaaacgtttcttggcagctacggtcaaaaaacagtggccgcatcgatcaaaagcatgtttgaatacagccaaaaaagggttgagcatcatgtctctcatctgcctgaaacagaaatgagcgctgtccaggagtttgaagttaccaaagggcacaagagtacaattcatgtgcaaatttcaaagaaggagaatgcggttgagatcgatttgagcggatcgtcagagcagtccgtaaagccggttaattcacctgccgctttaacgaaggcgtttgccgtttggccgtttcttgcaaggattgccgatgaaataccgatcaatgaaggaacgcttcaaccttttcaaacgaagacgaggccgggaacgattctagatccggaatttccggcagctacagcactagctccaagcattaccggacatttcgtcgctgcagcggtatttaaagccattcaaaacggacaaggcacaagtgaagaatttccgccgatttatgggccaggtccgcaggccgttttttatccggagcttggcacaggagccgaaacaaaatcaatcgttctcgcacccgggtatccttcagcttcaaaaggcttcggaccgcctgctttatttggccaacggatgcttgtctctgcggaggaattggagctttaccacggttttaaaatggtttcccgggagtggacggacaatggggaggaaatggaagtgtccctgcttaaccaggaggacgatatttatttcaaccttcttctgccttttagcgaaaggggaaaatacgggtctctgtcaagaacgggagaccatgacgaaaccttttatgaaagcacggtacaccaacatgtgaaaaaaggcaacctcctcgtctttacgtactctcaaaaggaggagcagctatga

SEQ ID NO: 1884 - DNA, 1740 bp, Bacillus licheniformis
atgatcaatcaggactttatcttatcacaggtggtcggcggttctcttgatgcggttgccagggaaatgagcgccactgtcacgagaacggcccgttcaccattgtttaacgaagcgcatgattttacgacgggcgtctttgacctttccggcaaaaaatcgcgccttgtcgcgcaggcccccggctgtacgcttcacctttatgcggtcgtaggcgcagtggaccatctattggacgcctttcggtatgatcttcaccccggggatattctcctggtgaatgatccgtatcatggaggctcgcacagccttgactggacgatcgtcatgcctgttttttataatcgcaagccgatcctgcttcctgctgtacgaagccatatggccgataatggcggtccggttgccggagggtacaatccgcgctcaaaagacatttggcatgacgggctgcggattccgccgttaaaaatttatgagcggggagaaaagcgaagggatgtattcgatttaatcgttgcaaacaaccggctttcacattggcttgaaggcgacttaaatgcgatgatcggggcgtgcaaggtcgctgcctcccgaatccagacgatgctggataagtatggcgccgagaaggtgattacagccattgacaaccggattcaatatacagaaaacagggttcgcgatgaaatcagcagctggccggacggcacctatgtcggtgaaacattcgctgatcacgactttcaaggcaaccgcgatattaaggttcgcgcaacggtgaccgtcaaaggcagcgatcttcacattgactttaccggttcatccccgcaagtaaaaggcttcatcaacagcccgctctcaaatacgacttcgtttgcttttgtcggtatttcgacttgctgtgatgaggatattccgatcaatgaaggatatatgaatccggtaacagtaaccgcgcctataggaacagttgtgaacccgcagctgccggcaccgtgcggacacgcgactgcgtgcgtcggagcagaaatagccgaggctgttcttcaggccatttcacaatgtgcgccaaaacgggtcggagtgaacgcccataagcttcctctcgcctattctcacggaaaatacgatgacggcaagccgtgggtgaatctgaatttttacggctataccggcggtgcgggagctgcatacgaaacggacggatgggggctttatcctcctgttatgacaggagttattcttccatctattgaaatgaccgaagttcaatacccgagccgtgtattaaagcatgaatatacaagcgattttacgggtgcgggccgatggagaggcacacccgggttggatgttcaaatccagcacttaaaggaaagccgcacaagcgtcatgatggcagggggccgaaacacaacaaaaggcttctgcggagccggcgattcaccaagcaacaaggtgattgtcgggtatggaacagacgaagccagagaaatcgatgaaacggcttttgaagtcaaaatgcctgtgggcggcatcatccaattttaccgtgcaggcggcggaggctggggaaatccgctggaacgtgaaccggaaaaggtgctggacgacgtcttaaacgagtttgtcagcattgaatcagcattgcaggattatggtgtcgtgattgaccctgagacacttgccattaacgaagctgaaacaaaacgtgtgcgggcatccaggcttccataa

SEQ ID NO: 1885 - DNA, 435 bp, Bacillus licheniformis
atgaaaaacaaaaaagcgttttggggaccttttctgttcggcgtcggcatcatcgccatgatcgacggcatcatctttcatcaattgcttcaatggcacagcgtgtacatggacacagaccgctctcaccaaattatgagcgacggactgttccatctgttttcgctcgtcatccttttcatcggcggaatcctgctgtggaacaggggcgaacttggcagcagccggccgcagcacatcttttggggagcctctttgcttggggcgggctggtttaacttccttgaaggcatcatcaaccatcatcttcttcagattcaccacgtcaaccagctaagcccgaaccgcctcttattcgactttgcttatgacgcatcgggccttttgatcattctggccggatggctgatctaccgaaaaggcaaacagggataa

SEQ ID NO: 1886 - DNA, 342 bp, Bacillus licheniformis
ttggataagaaagatattaagttcctcgaggagctgctttataatacagataaagacgatctagtaagagtgacgagaaatattgaaaaccctgtgattcttcaagtttttgcagcgaattataattggaatagtggttttgatgttccaaaagcaattcttgagaatgagaattgcgattatggtacggggttattaatgttccattatgcagatggttatcgtatgctcgaaagcccagacaatgtttcagcatctgctttagaagaatggaaagattttttaatccaaacatatcaaaagcttataaatttgcagtttaaatctcaaaatatatcctga

SEQ ID NO: 1887 - DNA, 192 bp, Bacillus licheniformis
atgaaaaacataagcaaatatgttgtcctgttttttggggtagccctatttttatacttttatgatatgtttatgcctaaaagtgtgctttattttgttgtgggaataccagcattatatattagcacagtccttatcatgaaaactttaaagctacaaaaaatacaaaagattaatccagaattaaaatag

SEQ ID NO: 1888 - DNA, 699 bp, Bacillus licheniformis
atggtaaatgtcttaaataatatcttgaaaaatgacagattggatgcatatccattatttaaaaagttttgttccctcaaagaaaaagggttgcgtaagaaatcctttacagcattatcttcctttattgatgaagcaaagaaatgggatgatattgcacaacagaattttgcttgttggctgtttgctttatttgaaacatcagatgatattcaccatgtactcgttcatccattggaaaaggaacttttacagcctttgcttgagagatggatgaagagtgatcctgaagattcaagaccatataggtggtatggggtgtttttaaatcctgaaaaccgtgtcgattatttaaacaatgcacttagacttggtggcgggaatgaacaactatccttattaactctaatcgatattaatttgaacgccctttggtattcatttcatcatatctccgaagatttgtatcttggcgatattaaagaagatacagcacttcttgctaagtcccggccattaaacaacaaagtagaatgtgaacaaacaaggaaaaacaataacgaagcacttaactattatcaagatctgttggatgactgggtgatgtttaaaaaagaacgatcaaagggatttgttgaatggtgtgaaaataagggtagaacctattattgggtcaaagcttattattacgaaagataa

SEQ ID NO: 1889 - DNA, 966 bp, Bacillus licheniformis
gtgttggaaagggctgttacttataaaaacaacggacaaatcaatatcatattgaacggtcaaaagcaggttttggccaattcagaggctgaagccgaatatcaggccgcactgcaaaaaaatgaagccaaacacagcattctgaaagaaattgaaagggaaatgaacacgctggtcggaatggaggaaatgaagcgcaatatcaaggaaatctacgcctggattttcgttaataaaaagcgcgaagaacaaggccttaaggccggaaaacaggcgcttcacatgatgttcaaaggaaatccgggaaccggaaaaacgaccgtcgccaggctgatcggcaggcttttttacgaaatgaatgttctctcaaaaggccatctgatcgaggcggagcgcgccgatctcgtcggtgagtacatcggccatacggcgcaaaaaacgagggatttaatcaaaaaagcgatgggcggaatcctgttcatcgatgaagcctattcccttgccagaggcggagagaaagacttcggcaaggaggcaatcgatacattggtcaaacatatggaggataagcgcaacgaattcattttaatcctcgccggatattcgcgggaaatggatcattttctttcattaaacccgggccttcagtcaaggtttccgatcagcatcgattttcccgattactcagtcagccagctgatggacattgcaaaacggatgatggcggaaagggaatatcagttcagccctgaggctgaatggaagctgaaagaccatctgatggccgtcaaaagtacggtcagccccgcgaagttcagcaatggccgtttcgtccgcaacctgatcgaaaaatccatccggtcgcaggcgatgagactgctgatgggagactgctacttaaagaatgacttgataaccatcaaaagccaggatctcgacttgaaggaagacgcgccgcacgtataa

SEQ ID NO: 1890 - DNA, 1263 bp, Bacillus licheniformis
ttgaacgaacaggaagtcatgaaagagaaagccatattagtcggatgccagcttccgcacgtgtctgatgagcgtttttcatactcgatggaagagctcgccgcgctgacgaaaacggccgacggaacggttgtttccacggtcacgcagaagcggaaccgtgtggatgctgctacatatatcggaaaaggaaaagtagatgaattggcggtgctctgtgaagagctgtcgcccgatgttttaatttttaatgatgaattgtcgccgagtcagctgaaagcgcttgtcacaacgcttgacgtgaaaatcatcgaccggacgcagttgatccttgatattttcgccaaacgcgcgaggacaagggaaggaaagctgcaaattgagctggcacagctgcaatacgccctcccgcggttaagcggccagggaatcaacctgtcaaggcaaggcggaggaatcggaacaagaggtccaggggagacaaagcttgaaaccgaccggcgccatatcagaaaccggattcatgaaatcaatgttcagctgtctaccgtcattcgccacagaagcagatacagagaaagaagaaagaaaaacggtgtactgcaaatcgcgcttgtcggctacaccaatgcagggaaatcgacatggtttaacaggcttacagacgccgacagctatgaagaaaaccttttgttcgccacacttgacccgatgacccgcaaaatgatgctcccgagcggatacagcgtgctgctctcggatacagtcgggtttattcaggatctgccgacaactttgatcgcggctttcagatcgacgctcgaagaggtgaaagaagccgatctgattcttcatatgatcgattcttctcacgaagactacgagggccatgaggagacggtcaagcgccttcttgaggaacttgaagcagacgatattcctgttttaaccgtctataacaaaagagaccggaagcggcctgatttcatcccttcttcagggagagggcatatcatgacgagcgccaaaatagacggagacttgccgctgtttaagcaggcggttgaagactatctgaaaaaggagctgctcgttccgtatgacgtgagaattcccgcttcagaaggaaggctgttgtcgagaatcaagtctgagacaatgacgaacagcaccgtttttgacgaagatcgcgaagcatatgaagtggaaggatatattctccctgaccaaaacattttgggagagctgaagaagtatatgtag

SEQ ID NO: 1891 - DNA, 1266 bp, Bacillus licheniformis
atgtttgagacattaaaacacggagatctactaaagaaaacggcggtggaggctgaaaccgacatcgcacagatccacaaaacaattgatgaaatcagtgaacgaaatgagtggagggtgctcgaaagctacagaaagcacaaagtatcggacacgcatttcacaccatcgacaggctacggctacgatgacatcggccgcgatacgctggaaaaaatctatgccgacgtcttcggcggtgaagcggcccttgtcagaccgcagatcatctcgggaacccatgcaatatcaatcgctttattcggcgttctccgcccgggggaagaacttctttacatcactggcaaaccgtacgataccctcgaagagatcgtcggcgtcaggggcgaggaaaactcggggtctttgaaggatttccagatcggatacagccatgtcgagctgacagaagagggagccgttgattttgaccgggtggcagcttccatcacgccgcagacaaaggtcgtcggaatccagcgctcaaaaggatacgcagaccgtccgtcttttacaattgatgagattgagaagatgattcgctttgttaaagaaataaacgaaaacatcatcgttttcgtcgacaactgctacggcgaatttgtagaagagcgtgagccgtgccatgttggagcggatctcatggcaggctcgcttattaaaaacccgggaggcggcctcgccaaaacaggcggctatatcaccggcaaggaaaaatgggtgaaagcctgctcctacagaatgacttcaccgggaattggcagtgaagccggtgcatcgttgtacacgctccaggagatgtatcagggctttttccttgcgccgcatgtcgtctcccaggcattaaaaggagcagtgttcacagcccgattcctcgaaaagctcggctttaggacgaatccttcatggggcagcaagcggaccgatttgatccagtctgtcgaattttccaccccggagcagatgatcgcgttttgccaggcgattcagtacgcttctccgatcaatgcccatgtgacgccgtatccgagctatatgccgggctatgaagacgatgtcattatggctgcaggcactttcgtacagggagcaagcattgaattatcagcggatggccctataagaccgccttatgtggcgtatgtccaaggcggattaacctactcccatgtgaaaaatgcgatatgcagtgctgtggatgcgctcatgaagcagggattaatgtaa

SEQ ID NO: 1892 - DNA, 408 bp, Bacillus licheniformis
atgagtgataaaattcgccgctcaatgcccttatttccgataggtatcgtcatgcagctgactgaactgtccgcaaggcaaattcggtattatgaggaaaatggactggtatttcctgcaagaagcgaagggaacagacgtttattttcattccatgatgtagataagctgctcgaaattaaagatttgatcgaacaaggtgtaaacatggcggggatcaaacaaattttcgccaaaacagaaaacgaacaaaaagaagacaaacaagacaagccgaaaaaagcagagaagcacaacttgtcggatgaagaactgagaaaactgctgaaaaacgagctcatccaagcaggccgtttccaaagagggacgacattccgccagggagacatgtccaggttttttcattaa

SEQ ID NO: 1893 - DNA, 1335 bp, Bacillus licheniformis
atggcaaagtatacaagagacgacattgttaaactagtaaatgaggagaatgtaaaatatattcgccttcagtttacagacattcttggaacgattaaaaacgttgaaattcctgtgagccagctggaaaaagcacttgataataaagtcatgttcgacggctcttcaatcgagggattcgtccgcattgaagaatccgatatgtacttataccctgacttagatacatttgtgattttcccatggaccgccgaaaaaggtaaagtagcccgcttcatctgcgatatttataatccggacggcacgccgtttgaaggtgatccgcgcaacaacttaaaacgcattttgaaagaaatggaagacatgggcttctcagatttcaatcttggaccagagccggaattcttcctgttcaagctagacgaaaaaggcgagcctacgcttgaactgaacgacaaaggcggatatttcgaccttgcgccgactgatcttggcgaaaactgccgccgcgacatcgtacttgagctcgaagaaatgggctttgaaatcgaagcgtctcaccacgaagttgcacctggacagcacgaaatcgacttcaaatacgccggagccatccgcgcttgcgatgacatccaaacgttcaagctcgttgttaaaacaatcgcgcgcaaacacggcctgcacgcaacattcatgccaaaaccgttgttcggcgtaaacggatcaggcatgcactgcaatctatcactcttccgaaacggcgccaacgccttctttgacaaagacgccgatcttcagctgagtgaaacggcaaagcaattcatcgccggcatcgtcaagcacgcaacaagctttacagctgtgacaaacccgactgtcaactcttacaagcgccttgttccaggctatgaagcaccttgctatgtggcatggagcgcgcaaaacagaagcccgttaatccgcatcccggcttcccgcggcatcagcacgcgcgtagaagtcagaagcgtagacccttctgcgaacccgtaccttgccttgagcgtacttcttgcagcaggacttgacggcatcaaaaacaagctggaagcaccggctccgatcgaccgcaacatctatgtcatgacaaaagaagagcgcctcgaaaacggaatcgtcgaccttcctgcgacactcgcagacgctctcgaagaattcaaatcaaacgaagtcatggtcaaagccctcggcgaccatctattcgaacacttcgtcgaagcaaaagaaatcgaatgggatatgttccgcacacaagtccatccttgggagcgcgagcagtatatgtctcagtattaa

SEQ ID NO: 1894 - DNA, 144 bp, Bacillus licheniformis
atgcttttatggggtgcattaatttatgaactaagtaaatcttcaaaaaagcaaaacaaccgaaaaattgtatctttgatatctttgggctctttatcaactttagttattactatttcgctttttcaaaacctcccgttttaa

SEQ ID NO: 1895 - DNA, 468 bp, Bacillus licheniformis
atgaacttatctcgttttttgaattccattcaattatccccacaatcaaaacctatgatggagctacttgaattaaatgaaaaaacaaaagagcatggcctgatcttaacacccagcgatataaaaatgttaatcgtttatagaaataaagtgcttcatgatcatggacgtatagaactggggattgaagtactaaaggaattaattgaggtgtttgctgcttcaccctatatggatgaggataattatgtcgaaacgttaatcgagcttcaggagattttttattatctcagaaatgaaacagaagataagataggggacatgaaactgattcatcagatgatggagtgttttaacgggccttctgccgggtctttagagatattaagaagtaaaatggaggaactcgcggagagtttcagaagagatacgatgagaagtgagtctttatataaaggtgatgaataa

SEQ ID NO: 1896 - DNA, 696 bp, Bacillus licheniformis
atggacaaagaaaacactttaaatcgctatgatttggtttcaaattttacgattgataaatcaaagttaaagcaaagccaatatatgttgtcgcttctaaaagaaggccaaagtgttggagttattaccagcgagaaagcatacaagatacaggtagagattatgcaaattctgcaacgattgataggccagtataccaaaggggaaagtatgtcggtgacaacggaaacggcggaagggattatggtttccctcatgtatgcaatagatgcttatgctctccattttgagaaacctgaagagtttatagtacatttacattctgatagtataaaaaatatatatacaaaaggtgtcgcattacttcactgttattttgaagaagctaaacaattatatcaagacgtaaaaaaaataaaattagatgtgcctgttgatgcttatactttaaccattgacgaatcgttacctgtatttatgaatcattataatgttatttttgaagctcaaaataccatggcgagcattgactatcctttagccattgacaacatggaactgcaaggtgttttttatattaaacagtatttagagcgactgctgatagaaacgagattctgtcacttttttaaccatcacgatttaatgtatgtcttggcaaactttggaagaatatgtcattttattatcgcatag

SEQ ID NO: 1897 - DNA, 627 bp, Bacillus licheniformis
ttgttaagtgattgccatgctgataaaagggcaaacttaattaacaatgcatttgatcggttacagcgggatttaaagacggatcaaacaatttctgattatatcaatttgtatcgcaatgaatttattcaaagggtaaataacgctgcggaaattgatggcttcaaaatgttgatcatcagagaaattgaagagagagaaaaaccaatagcgttaatgttaaatgaaaatgatcgcatgagtgatattgaattgcggaaattggtggattgcatcatggaacgaaaaaacacagcagaaaaaatattgctgatccgcgatcattttgtttcactacatgattatttggatttgctaaattcggggtgtctgtttgacgacgaatatgacgcactttttgctacgtttgggaattttgaattggccatttttgcgaaaattgtattttatgaagaattaagagggggaattctcaatttcattgacattgttgctgactgctctgaagcaaagagcgagtgggaaacatattatatgaaatttattaaacaactagaagatgagcgcattgcaactattggacacctgatcaacgatattgactatgaggagatttcgttttattaa

SEQ ID NO: 1898 - DNA, 318 bp, Bacillus licheniformis
atgtttataaaatataatgaatatgatttactggaactttttgagagcgagccggtcagtatagctgatgatccagaggccggcgaattgatttatacttttaaagataatcaaaacttcaagttaattttaacgctggatgtttatcaactaacttgtagcctggatataacctataaagatttcttagtatttacaggtgtttttcaaaacataactagcattaagaaagttgaagatttcatggttataagtattggagaagaaaagagaataaaagtaaaattcactaagcaaattggagtagagttactttaa

SEQ ID NO: 1899 - DNA, 429 bp, Bacillus licheniformis
atgaatagtgaaatagacaaatgtatattttgtgaaatagttagtcggaaaatttcaagttttgaggtttataaaactgactatgtgacagcatttcttgatataaatcctgttacaaatggccatacattaatcataccaaataagcatattgaaagactggatcatataaacgatccccatctatctaatgaaataatggattctttaattaaagttcctcaattattaattcagtcaggtatttgtgatgactacacgatactctcagacaacggtcactttgctcagcaagatattaaacacctgcattttcatgtcataccgagacatatgaatgaaaagtttgaattcaaattaaacaccgactttactgcagctaagaagagtaacttactttcgatatggaaaaagattgtagggagatga

SEQ ID NO: 1900 - DNA, 303 bp, Bacillus licheniformis
atgaatttcgatccggaaaaactaaggaaatttcttaattgcgcgtcaaacccgtcaagcccaaagaatacaaagattaaaaattactgtgtgaatcaagaatgccaggagtttgtagcctttgatattgattttgaaaatgtagacatcgctctgcgtattgccggcatgttggggaaatccgccacgaaatttacgataaatcattttcttttccctggtacgaacaaaatagattatattcaatttataatttttgaaattaatgattcagaactattagcatttttagagcaactataa

SEQ ID NO: 1901 - DNA, 978 bp, Bacillus licheniformis
gtgttttttgcaaagatcatcgatcgtttagccttatatgatttgcacagaaaaagaagtaaagatgaacatttttccgctttttcattgaatccgattgacagagacgaattttataaagcaaaagcggctgatgtcgccattatgctttatgaatcaagaaaaaaccatttggccggacatttcagctatgaatctttaattccatccggggaccctgtcaacgatgctttaaaaggcgaggtttttttaaataaaaatgatatagatcagcctaatgttatttttgtgcacggctggcgaatggattcatacgacagaataaaaaagatatttcatgatcgtattatgaacgaattaggctggaacttgtattactattctcttccatatcattttgaaagagagccggaacattcgctttacagcggagaattgatgataagcgcgaatttgaatcgtacggttgattcgacgagacaagctatcgtcgatttacgggctcttattcattggatcaaagcaaataaaaacggccctgttattatagtgggcgtcagtttaggcgggtggatgacaaatttactggctacccttgagactcaaatcgacatagtggtatcgatattttatgctaatcgtctttcttatgcgatatggaataccatcccgggtaaattcataagagaagaattagaacagcacggtgtgacatatgaggatttaaaaacatattgggaaatcacagatcccagccaagctgcgccgaaaattaacaaagataacattttgctgatttccgccgtgcatgaccaatatgttcacttagaggatgctgataagttgtgggaaagctgggggaaacccgaaagacatctctacaactgcggccatgccggaattgttctttgtcgcaaaaaactggcattagatacaatttctttcatccgaaaaaaattaaagcagcttcataagtaa

SEQ ID NO: 1902 - DNA, 480 bp, Bacillus licheniformis
ttgtttcgatctaaacataatatcccaaaagtgaaatttgattataagttcacatctgatgaatcagatatcccaatgaaaatgagaaaaggcccttcagtagcaatgagagtagagggagaacttgaaatcaaaataaatgaaattacatattttaaagaaaatatcgccttattggaattttatgtttctttaaatgagtggattaaaaagaacaagaaaaaaaacaaagttacggagtatagatattacacaatggagtatgaaaagggcgaacccattatttcattgataccatttgattataaggctcgactaacgaccatttgggaaactcaacaattatataatgtattcgaccttgattacatcaccgaacaaatggaaatttcacgcaaaaaacttggacgtgatattgaacatcattataggatttcattgaaaagctttgttggtaagatcccattaagaaaatattga

SEQ ID NO: 1903 - DNA, 597 bp, Bacillus licheniformis
atgaacttttggcacaagcgctttcaagatgagaactatgtgtatggaactgaaccgaatgcgtttttggcagattcgcagaaaaaacttcaattgtcgggcgatgctttagccatcgcagaaggcgaggggcgcaatgcggtttttttagcagaacaagggatgaacgtcacttcatgggattatgccgaatctggactgaaaaagacgcaaaagcttgctgaaacccgtcatgtatcagtaaagacggagcttgttgatttaaatgaagcgtcttggaatcaagatcagtgggacgagattgtatgtatttttggacattttccagaagagctgcgccgaaaaacgcttctgggagtaaaaaaagccgtgaagcccgggggctttttcgtaacggaagtgtattcgacgcaccaaatcccttacaaaagcggcgggccgcaggatccagaacttttatatacaccggaagaatttttgcaaatcttttcagattggcgtactgtccacttttttatgggagaagtcgttcgtcatgaaggagattcgcacaacggcctgtcccacgtcattcaatttattgggcaaaagcaataa

SEQ ID NO: 1904 - DNA, 498 bp, Bacillus licheniformis
gtgaaagcgggggaaacgatgaaaaacaatattagactcaagcggctgctgatgatcagcgcaattttgcttttaatcgtcgggggatatgtcagtgcaatgatctttggaaagaaagtggtgtatgaaggaacgggagaaagcggtctgtggcatgcttcgattgagaaatcggataaaacgtcaatcgggcctaattattttttgaatttatattggaatggcacggaagaagatgcgaaaagaacgatcgtgaaaacaatcaccttatacatagatggcaaaaagtatgatgacagaggagaatacgatctttccgagtatacgggagaggaaatggatggcggaggccatatggaagatcatatcgcgacttttgattttatgcctgaagaggatgttatcgggcatgcattatcagttaaagtggaatggaaaaccggagatgaagaaaacgcggaaacaatgaaattaaacaagattccgtggtataaatga

SEQ ID NO: 1905 - DNA, 576 bp, Bacillus licheniformis
atgaacgatattgagatcagaaggccgcgaattgacgacgttgaagagctgaatcagtttttcagaattgtggtcgaggataccttcgctaaagagggaatagccgatctgctcgatgataaagaaagtgaaattgaaagtaagaggcaatacttgaaagcagatttagacagcaaggggaatagccggcacttttttatcgcttcagatcaacgtctgaataaaatcatcggtactatcgaatatggccctgcaagcgaattgatcagcatttgtacggatggagctttaaaggatttatatgaggtaggaacggtatttgtccacccggattatcaaagacgcggaatcgggactttgctgttgaacgtcatgtttttgacttttttgaatcagggagtaaatgaattttgtttggacagcggctatcccggtgcccagagaatatggaagaagaaattcggcgagcctgactatgtgctgaaagattattgggggaagggatacgatcatatgatttggaggagacggacgaaggatatgccgattgatacaagaacatcagtcatgccgtag

SEQ ID NO: 1906 - DNA, 477 bp, Bacillus licheniformis
atgttcaacgaaagagaagcgttgcgtttgagacttgaacagctaggtgatgcggagatccaggtgatgcgggaattgcgaaaagaacgagagggcatttattcgaagctgcgtgaattggatcgggagagtgagcctgcaattaacaaaaaatcttcattaatcgacttggcaagcgctgcagcagaggaattaaaacaatcccagcatgccgctgacaaacatccgcctatcaagaccccatctcatactattttccaatcaaaaacaaccatacagcgtgaggctgccataaacattttaagccgctatgaagagggcttgaaaggcattaagctcaaaactgaaatcgagaaagaaaccggctttccgattaaaaacatgacgacatttatgaagagcttaatgaaacatcgcccagatattaaaaagcctgcccgcggccattatattttgcataaagaaaaagacctttga

SEQ ID NO: 1907 - DNA, 234 bp, Bacillus licheniformis
ttgaaaccaaacagcacctatatcgtatatttagctaaaactaatgcaagggtgttctacatgttggataaaaagaaatacttcatgattatggtaccggctttaattttagggtttttatttcaattttttgttccctcagaacaaaggtacttggggattgtgtttattttagcaggcggggtgatttattatctttgggtgcatatcgaaaaggacaaacagaaagattga

SEQ ID NO: 1908 - DNA, 621 bp, Bacillus licheniformis
atggaacttacgatcaccagagcactaagcgaactcaaaatgttggataaaagaatcaagcgggccgtaaatgaagccacattcggaggcttgatgatcggaaaaaaactgccaaacggatttcggacaaccgaagacttggaatccagagcgaaagccgattaccaatcaatcgaagccttaatcaaaaggcgaaatgccattaagtctgccattgttgtatccaacgcgacgaccaaaatcgaagtggccggagtcaagatgaccgtagctgaagccatcgaaagaaaaacctctatcagctacgacattcagcttttggataaactgaaggaagtgtacgctgatttagtcggcgaagccgagaacgtcaatcaaaaagtaacggaaagactggacaagcatctcgagacacttttcggaaaagacggcaaagtaaaagcggctgaaaaccaggaaatcgtcaaatctttcctcgcagaaaatgaagcaaaaatcatcgatccgctgaatctaaaagagaagatcgattgcttatcaaaaaagatcgaggactttgaaatggaagttgactttgcattgtccgagagcaatacactcaccaaaatcaccatcgattga

SEQ ID NO: 1909 - DNA, 585 bp, Bacillus licheniformis
atgtcaaagcaaacgtccgggaaatatgaaaagattttgcaggcggccattgaagtcatttctgaaaaagggcttgataaggcgtcgatttcagatatcgtgaaaaaggcgggtactgcgcaaggcactttttatctttatttctcatccaaaaatgcgctgattccagcgatcgcggaaaatcttctgacacattctttggaccatattaagagcaaggtcgacggaaccatgtctttctggaccgccttggatatcatgatcgatgagacgttcaacatgacggaacttcatcaggatattatcgttctttgctactcaggtcttgcctttgaccattcgatggaaaaatgggaggcaatctatcagccttattattcctggcttgaaggacttattgaaaaagcagttgagaaaaacgaggtcattccggccattaatgtgcgctggacggcccgaacgattatcaactttgtcgaaaacacagcggaacgttattacatcggggcggaaaacgacgaagagctcagtgtgttcaaaaaagaaatatttacttttctgaagagaagcataggaaccaagtaa

SEQ ID NO: 1910 - DNA, 336 bp, Bacillus licheniformis
ttgagttggctcctcgtaattgctgcgggttttttggaagtggtgtgggcctcaggtcttaaacatgcggattcattcgtcgattggctgatgatctttgtactgatcgcggtaagctttattatgctgatacgatcttacaggaacattccgatggcgtcggcttataccgtatttgtcgggatcggaacggccggcacatatgtgacgggtatttttatgggcgagaccttttcaggagggcaaatattctttttgatcgtgctgttgggaggcattattggcatgaagatgtttacaaaagagaacaatgcccagtcaggaggtgatgaatga

SEQ ID NO: 1911 - DNA, 318 bp, Bacillus licheniformis
atgccatggatgtttttagtgatttccggaatcgaagaggttattgccgccatcgctatgaaatatgtagacggcacaagaaaaaaatggccgattatcgtcatggtgttggggtttggcttgtcttttttctgcctttcaaaagcaatgcagatgctatcagccggtgttgcatatgccgtatggaccggaatcggcagcatcggcattacggcagtcagtttattttggtttaaggagcgtattcgtgctccgcagctcatctcgcttggctttattataatcggggtgatcggcctgcgccttacatcatcttaa

SEQ ID NO: 1912 - DNA, 543 bp, Bacillus licheniformis
atgattaatcagcttaaattgcgtccgcttgaaagagaagaccttccgtttgtccaccgtcttaacaacgatgcgaaaattatgtcatattggtttgaagaaccgtacgagacttttgttgagctgcaggatttatttgacaaacacattcacgaccaaagcgagcggcgctttatcatagagaaagagactgagatgatcggattggtagagctggtcgaaattgattatattcacaggcgggcggagtttcaaatcataattgatcccgagcatcaagggaacggttattcgtcaagcgcaacatatttggcaatgaactacgcattttccgtcttgaacttgcacaaattgtatttgatcgtcgacgaagataatgcaaaagcgattcacttgtataaaaaggcagggttcactatcgagagcgagctgcaggatgaatttttcgtcgacggctattatcgtaacgccattagaatgtgcatttttcaggatgagtttttatcacttaaaaaaagcaaagaggaaggcatgcagggataa

SEQ ID NO: 1913 - DNA, 357 bp, Bacillus licheniformis
gtgaaaaaccatattccatggatcagcctgatgatcatatttgccgcatttttaagcggatgtaacttaaaccgtgtggggacggacgaatattatgttcacattactggaaacggggaggaagacacgtcgaaatttgacgacggcgaggaatactccgtcttcaaatatgaactggccggttttgatgaagacggtcaagaaaaaacaatggaattcacagctgataaaaaccttcgcataggcgcgtttttgaggcttttctattctgaaaacaaaggcgtgaagtcatgggaagaggttgacaaagacgatattcccgccaaagccaaagagcaattaggtgtgaaaaattaa

SEQ ID NO: 1914 - DNA, 435 bp, Bacillus licheniformis
atgaaaaaaatcgtatgtttgatggtgttttcaatcatgacggccttcggtattcacatccagcctgctgaagctgcggttataaaagatgagaaaaagatgaccatgacaatgactgaagatcatgtgggattttttatggcggacagcaccaatgtaaattactacccgacatggctgtattacaagcttacgatttttaacgcggaaggctgcacactcaacatcaagctgcagagaatcacgttaacaggacatgcggtcactttaagcgagaaagagtatacgggaaatcatcttcatttaagtgctgcagataaagtgagcgggtcgccgcaccgaaatcatttcttggatatcacaaaagtgtcggggtgcggggatgttggaatcacaggtttttacggctttgagcaccaaatgccgggctactaa

SEQ ID NO: 1915 - DNA, 498 bp, Bacillus licheniformis
ttgctgctatgttctgcggctggttatgctctttatcagcatgttgccggaggccggaatgaacaggcaggcgccgtccttcatcagcaggcattacattttaaattatcgactttagagggcggtgacatcgaactgaaaaaatgacggggaaaggcggtgcttgtcaacttttggggggctttttgtacaccgtgcaaagaggagatgcccgtcatgcaaaaagcttatgaccgttttaaaggagacggttttgaaatcatcgctgtcaatgtgcgtgaatcgaaaggtgcggtaaagagctttgtcgaccgccatggcttaacttttccggtcgctttggatcaatcggctgaagtttaccgttcttgggaaatgtattatttgcctgcaagtatattcattaatcgggaagggagagcgtagcgaatgtatgtcggaggaatgtctgagcggcaagttgatatgtgggttgcagacattcttagcgattcatag

SEQ ID NO: 1916 - DNA, 864 bp, Bacillus licheniformis
atgttttttcatattaaagaactacagtatcacgcaaagcctgataaacccgatccattatttgcgaaaaagctgcaagagatacttggaggacagttcggggaaatatcagtagctctgcagtatcttttccaaggatggagtgtcaggggcaatggcaagtacaaagatctgctgatggatacaggagctgaagagcttgcccatatcgagatgctggcgacgatgatcgcaaggcttttggacggtgcgccggtcggtgatcttgaaaaagcggcaaaagatcctgtgatcggtgccattctgggagggatgaatccgcagcatgccatcgtatcaggattaggggcgatgccggccgacagtgtgggaaaccgctggaccgccgattatattatcgcaagcggaaatttgcttgccgactttcgggcaaatttaaacgcggaatcacaggggcgcctgcaggccgtccgcctttatgaagagacgacggaccgcggtgttaaagatatgctctcctggctgattgcaagggatacgatgcatcaaaaccagtggcttgcagccatcaaagaactggaagcgaaagaaaatgtcgtcgtcccaagtacgtttccgcgcaatctggaaaaaagggaagtctcccatgtattatttaatttttcaagaggcaacgagagcgctgcaggcagatgggcgaagggaccgagcatggatggagaaggcgtttttcagtatgttgagcatcctcagccccttgcgaaaaaaccggtgttaagacctgcgcctccatatattcatgatacgccgccatcagttattcaacatcaccgggatgatgtactgcctccgaatctttattga

SEQ ID NO: 1917 - DNA, 801 bp, Bacillus licheniformis
ttgaaaacttataaggaaacggccgttttcgaacataccttttggcttcaggttttaggtgatcatgcgcgttttattttggactctctcgccgaaagggaaaaaaacgatattcaaaaggcgaagcagttcaagcaagcgtttgatgttttgctgaaaaaagtgaacgcttcgcctgatttgtattcattaacgcttgaagctgaagaatatgctcttcagttcaggaaatttaaactcttcatcattaaaaggcacctgacaggcgatattaaaattcacctttctccaacttttatcaaccatatggtaaatgaactggaggaacatttgcttgtgctaaaatacttgaaaaagcgggaagcgccgcctgttttccacgagctgcaccaccatatgctgtggctgatggatgccgccggacatgccggcgcgattgccgatgacttggatgcggttgaaaaacgattgaaagaaaagagccgggagtttgtcaaacactttgaacagttctacattaaatccgttgaattgacgggatatctcagagcgaatgttgaatcttttcccgctctcagaaggatgaacaaagacgtgaagcttgagatcgaactgttccgtacatttttgaaagaagtggaggaattggagcttacagatcagatgctcggtacgttctccgcactgatggcagaccatatgatgagggaagaatgctattatttaatgaaaatcgccgaatcgacaaatacgcaagaacctgcgtgcgaccctgcaaaaccgaggctgcttgaaaagtaa

SEQ ID NO: 1918 - DNA, 519 bp, Bacillus licheniformis
gtgcaagtcagaaaaataaaggattcagatgccaaaagctatctcaaactctgtgaaacgatcgatgaagaatctgaattcatgctgtttgaaccaggtgaacgaaagcttcacgcgcaacggcaaatcaaacagatcgaatccggaatgtgcgaagtttttgtttgtgcggctgacgacggaagcttaatcggatatgttgcagcagccaaggggcaggttcagagagctcgccaccgcgcccatgtggtgatcggcatacgccaagcgtatatcggacaaggtattggagtaaagctttttcaggcattggaaaaatgggcctgtgaagaaaagattcacagacttgaactgactgttatgactcataatacagctgccgttcgtttatacaaaaaaacgggctttatcattgaaggcactaaaaagcatgctttgaaagtaaaagggcaatatgttgatgaatatgtcatgtccaaattaatcaacgaacagcaaagggaggtttcaaatgaatga

SEQ ID NO: 1919 - DNA, 303 bp, Bacillus licheniformis
atgaatgacgggtgccatcaggccattgctgctgtcagctattacaaaacagaacggacgattgattttaaccggcaaacttatacaaaaaagcagaatcaaatgtacttgtacaacgataaaattttaacagcaagccgccagtatcgtttggagcacgtctatgacgtttcatacagacctttttccgaggccggtttgctttacctccatacgaacaagggggtatttgcttatgaagtgaacgttgaccccgggtatttcattgaggcttttaaaaaacagaaaaatccaattaaataa

SEQ ID NO: 1920 - DNA, 579 bp, Bacillus licheniformis
atgaaaaagaagacacagaatacggttcaaaagatcgtagaagccggatatcgtctgttcgcccaaaatggatattcggcaacctctgtagatgaaattatgaaagaagccggtttttctaaagctacgttttatttgtattttaagtcaaaggagatgctgtttctccatattatgaatgagcagatggaagatcgctttcagaccagcatgaattgttttcgaaaaaagacgctgaggggattgctcgcggggattgaacacttgattcaaacatcaaataaagagcattcgacagctttatttttggaatttatggcaaatagtcatagatatcctgagattcaaagaaaggtagcccttctgtatgagcagtggagggagttttttgtcgaaatgattgagcagctgcaggaagaaggcattgttcagaaacagctccatccgaaggtgatggcgtctacgctgattgccatctttaacggctacaaccatcaacaccacgcggatccgtcgattaataaacaggaacagcttcagtccattattttcttgctgaatccgaagctgcatctttag

SEQ ID NO: 1921 - DNA, 456 bp, Bacillus licheniformis
atgggcagtcaagatatggagagatatgaagaggagttgtctttaaaggcatttattgtcttgtctcgagcattacaatcgattaaaaagcgtgtggaagaagacattaaatgtttaggattaaatccaactgagtttgctgttttagaattaatctataataaaggcgatcagccgatacaaaaaataggcgaaaaggtattaatcgcaagcagcagtattacctatgttatagataagctggagaagaaaagtttaatagtaagaaggccttgtcctaaagatcgccgtataacatacgctgccttaacgaatgaaggaactgcactgatgaacaatctttttcctaaacataaagcagctatgaaaggcattttcggcgggctggacattaaagaaaaagaagttctaattgaaaagttgaaaaaactgggcttccatgcccaaagcatgtaa

SEQ ID NO: 1922 - DNA, 624 bp, Bacillus licheniformis
atgaccgaatttctagagttagtaaaagaaagacgatcagcaagtaattttcttcctggatattcaatttctgaacaggagcttaatgaaatatttgaaattgtaaaattggctccctctgcttttaatttgcagcatacaaactatattgcggtgttggataaagaaaagaagaacatgttgcatgaagcagctaatggccaatacaagatcctaagctcgtcggcagtcatcatcgttttgggtgacaaaaaggcctttcatcaagcaaaagaaatctacgaaggtttaaaactgctcggagtacttaataaacaagaatatgatgatatggttcacgatacggtttctttctatcaatccagaggagaagcatttcaaagggatgaagccatcaggaatggctcattatcttctatgctctttatgatggctgctaaagaaaaaggttgggatacttgtcccatgattggctttgatcctcaaaaggtaaaagaggtattgaatataaatgagcaatatgaggtcgtcatgatgatcacccttgggaaggaaaaattagaaagcagaaaaccgcggggatttagaaaacctgtaaatgaatttgtaacctatatctcttaa

SEQ ID NO: 1923 - DNA, 939 bp, Bacillus licheniformis
atgaaaaagaaaacaagcggaatccatcacattaccgcgattgtcggccatccgcaagagaatgtcgatttttacgctggcgttctaggtttacgtttagtgaaaaaaactgttaattttgatgatccgggaacataccacctgtatttcggtaatgaaggcggaaaaccgggaacgattattacattctttccatgggtgggtgctcgccgaggagtcattggagatggccaggtgggagttacttcatacgtcgttcctaaaggcgcaatggcattttgggaaaacagattggcaaaatttaatttgccttatacaaaaatgaaccgttttggagaggagtacttagagttcgatgatcctcatggacttcatctggaaattgtcgaaagagaagaaggggaaaagaacagctggaagataggagaaattacaccggacaaagcaatcaaaggatttggcggagcaacacttttatccaaacaaccggaaaaaacggctgaattattagaaaaggttatgggacttgaaaaagttggtgaagaaggagattttgtacgttttcgttcttctggtgatatcgggaatataattgatttgaaattaacaactataggcagcggacaaatggggattggtacagttcaccatattgcctggagagctattgatgacaatgatcaattagaatggcaaaaatatgttgcagaaaatggttatcgtgttacacccgtgcaagacagaaattattttaacgcgatttattttagagaacacggggagattttatttgaaattgcaacagatcctccagggttcgcccatgatgaatcacatcaaacaatgggagaacagttaatgttgccggctcagtatgaacactacagagagcagttagaaagaagattaattcctataacagtgaaggcgctggattaa

SEQ ID NO: 1924 - DNA, 609 bp, Bacillus licheniformis
atgctgtccattgatccgcttacaaaaacggaaagagagaactacaagtttttaatcgggagtatcataccaagacccgtggcgtttgttacaagcctgtcagaggagggcgtcttaaacggagctccatttagttattttaatattgtatcttcaaatcctcccatgatctccctgtccatacaacgttctgaagggagccaaaaagatacagcgagaaacattctgaagagcaaagaatttgtggtccatatcgttgatgaacaaaatgttgaaaaagtgaatgcaacggccgcgagcctacctccaagtcaaagtgaaattcagttagcggagttaaccccggttgaaagtgtgaaagtctcggtaccgggggttaaagaagcgaaagtgcgcatggaatgtgttctggagtattcattagagttgggagataaacactctcccggctgcgatttcatgataggtcaagtcgttcaatatcatatcgagagcggcatttatgaaaatggaaaaattgatccgagaggcctcggagccatcagccgattggccgggcatgattacgcaaagattggtgaaatctttaccagggaaagaccgaagtaa

SEQ ID NO: 1925 - DNA, 612 bp, Bacillus licheniformis
atgtcaaatgtgaaattagctgtagttttttatagtatgggcggaacaaactatcaattagcaaaatgggctgcagaaggcgcaaaagaagcaggcgctgacgtcaaagtattaaaagtacaagaattggctccgcaatcagttattgaaggaaatgaagtatggaaagcaactgttgatgcaacaaaagacattccagtcgtaacctcagaagatatagagtgggcagacgctattatattcagtacaccaacgcgttttggcaatatggcatcccaaatgaaacagtttcttgatacacaaggcggactttgggcaaacggcaagacagttaataaagttgtaagtgcaatgtcctccgctcaaaatccacatggtggtcaagaagcgacgatcttgtccttatatacttcaatgatgcactggggagctattattgcttctcctggatacactgatcctgtcctatttggggctggcggaaatccatatggaacgagtgttacagtcgatcaagacgggaagatgattgaagacgtagaagccgcagtgaaacatcaagcaaaacgaacggtgaccgtagctgaatgggtcaaaaagggcaatcagtaa

SEQ ID NO: 1926 - DNA, 834 bp, Bacillus licheniformis
atgaatgaaaaacaaccaaagaaaaataaaaacaaaacgctgctcggcggaatcattgtcgctgccgctttaattattggaggattcacggcctccctgttcatcgagaaaatcccgaacggatatgtcggcgtcgtttattccccgaatggcggggtaaaatcggaaacgctggatcaaggctggcatttagtcgggctgtttgacaaagtcacaagatatccggtacggatgcagactgtaaacaatcaggatattcaagtggctacttccgacggcaaaaacatctcaatggacattgcctacaactatgtcgttcagcctgataaagtcgtagaattgtttaataaattcggagcggtcgatattgaatcaatcgaaaacagctacttgaaaacaaggctgtgggacgctgcgagaaagtcgatttccaaatattccgtcattgatacatacggacaaaaatcatctgatgccgctgcagaaattcaaaaaacatttgcagatgatatgaaggggctcggctttgtcattgacgatttaacactcggcgtgccgaagcctgataaagcgactcaggaagcgattgacgcgcgcgtgaagtcttcgcaggaactggaaagaacacagacggagctgaagatcgccgaagcggaagcgaaaaagaaaaagatcgaagcccaaggtattgccgagtacaacgaaattattaaaaagtcgatgtcggatgaaatgatcaagtatcaatggatccaaaaatgggacggaaaaatgcctaaagcgaccggatcgaattccctgatccagattccgaccgatgagaaaggaaaataa

SEQ ID NO: 1927 - DNA, 759 bp, Bacillus licheniformis
ttgtttgctccggaagccattctccgtacgtggagaaaatttgactcttttccgatggaaacgctgacaaaagcatggttttatcatcaggcaggagatgggagacagcgggaagtatcgatgatgaaggagcactatcaagagtacgggattgccggcaattgttttgacctttcgatttggctgctggatgagttcacaaaagacggagtggaagcttttccaatcggccgttcgttcaaaacggaacgcgcgcatgccgcagtcatcgcccttgatgaaagaggccggcgctttttgtgtgatctgggagaccaatggctgcatccgattctgatcgattgcgaatctgaagattataccaatgaaaagctgggcggttttttccctgccgcacaagttcaagtcatgccgacagccggcggagttgaggtcctttaccatcggccgaacggaaaggtgtcgactcaagtctacaatacagaccctgttgacatgtccgtttttttaaaggcggctgaatactcgcaggcggcattgaagcctgcgcctttactggaatgcagaattccgtttcagcatgaaatcgcccattgggaattcagcggctgggacatatatcttagtacgagcaaaggattatacagagaagcgaagccggacacaatcgaaggatggactgaaaaaatccacgatatctcaggatacgataaaaatgttctcaagaaagcattggagatttatcaaacccgcgcgtga

SEQ ID NO: 1928 - DNA, 840 bp, Bacillus licheniformis
atgagccattatgaccagcaatacaatgcaatcatacaaaaaattattgaatcagggatctccgatgaagaatatcaggttcggacgaagtgggattcagacggaacgccggctcatacgctgagcatcatgagcgaaaaaatgcggtttgacaattcagaagtgccgattttgacgacgaagaaggtggcgtggaaaacggccattaaagagctgctttggatttggcagctgaaatccaatgatgttcaagttctgaatgatatgggggttcatatttgggatcaatggcgtcttgaagacggcacaatcggagcagcgtacggctatcaattagggaagaaaaacagaacggttaacggccagaaagtcgatcaagtggattatttgcttcatcagttaaagcataacccttcttcacgcaggcatttgaccatgctgtggaatcccgatgatttggatggcatggctttgacaccctgcgtctatgagacgcaatggtatgtgaaagaaggaaagctctctttagaagtaagagcgagaagcaacgacatggcgcttggcaacccgttcaatgtgtttcaatataatgtcttgcagcgcatgatcgcgcaagtcctcggttatgagctgggcgaatacatcttcaacatcggtgactgccacatctatacccgtcacatcgacaatttaaacattcagatgaaacgcgagcagtatgaagcgccaaagctatggatcaacccggatatcaaaaatttttatgactttacaatcgatgattttaaattaatcgactataagcacggcgacaagctgacatttgaagttgccgtatga

SEQ ID NO: 1929 - DNA, 429 bp, Bacillus licheniformis
atgatcaaaaaatgggcggttcatctgctgttttccgcattggtactgcttgggctttcgggaggcgccgcatattctcctcagcatgccgaaggtgctgcaaggtatgacgacatattgtattttccggcatcacgctatcccgaaaccggcgctcatatcagcgacgcaatcaaagcagggcattcagatgtctgcacgattgaaagatcgggagcggataagcgccgccaggaatcactgaaggggattccgactaagccgggctttgaccgtgacgaatggccgatggccatgtgtgaagaagggggcaaaggagcgtctgtcagatatgtcagctcatcggataaccgcggagccggctcctgggtcgggaacaggctgagcggtttcgccgacgggacgagaattttgtttatcgttcaataa

SEQ ID NO: 1930 - DNA, 624 bp, Bacillus licheniformis
atgacgaagctatcaaaaagacaacttgatattttgcgtttcattaaagaagaagtgaagcgcaaaggctatccgccttccgtcagggagatcggagaagcggtcggcctggcgtcaagttcaacggtacacggccacttggcaaggcttgaaacgaagggattgatcagaagggatccgacgaagccgagagcgatcgaaattctcgatacagaggaggaaattcatattccgaaaaaccaggttgtcaatgtcccggtcatcggaaaggtgaccgccggtacaccgattaccgcagtcgaaaacatcgaggaatactttccgcttcccgaacgcctggcgccgccggatgagcacgtcttcatgctggagatcatgggagaaagcatgatcgatgccggaattcttgatcaagattatgtgattgtcaagcagcagaacaccgcaaacaacggggatatcgtcgttgcgatgaccgaagacgacgaagcgactgttaagcggtttttcaaggaggaaacccatatccgccttcagccggaaaacccgacgatggagccgatcatccttcagaatgtgacgattctcggaaaagtcatcggcgtttttcgcactgttcattaa

SEQ ID NO: 1931 - DNA, 312 bp, Bacillus licheniformis
atgaaaaaagaatcattgatttttgtcagtctgtttactgctgtgatcagctgctgtattctgtttgtgtcttttgccggtaagatcgaagaaagaaagcaatatgttaaaatagaagtgcaagaaggcgatacattgtgggagctggccgaccggatcaaaggcggaaaaaccgctgacaaacacaaattcatcgaatgggtcgccgataaaaacaatctgccgacctctgtcattaaaccgggagatgtcttgatcctgccggtagccaaacagcactccgatcaatatcagcttgcagttgtagaataa

SEQ ID NO: 1932 - DNA, 648 bp, Bacillus licheniformis
atgaatgcgattatttacaccagggtaagcactgcgaaggagcagcaggaaacctcattaaagcggcaggaggaagagcttaagtcgcttgccgccgaacacgggatgaacgtcgtgagcgtcatttccgagcaggcgagcggatatgaaatggaccgcgacggcgtcttcgatctgctcgaggaaatcaaaacatcagacatcgacgcggttttaatacaggatgatacgcggcttggaagagggaatgccaaaattgcccttcttcactgtttatataaagaaggcgttcaaatctacacgctggctcaccgcggaaagctcgagctttccgaagcggactcgatggttttggagattgtcggcattgtcgaggaataccagcggaaaatacataacctgaaaattaagcggggaatgaagaaggcggtcgaaaacggctaccgcccggagaggaacctaaaacaccgcaatgaaggcggcgggagagagcgaatcgaagcgcctctttcagaaatcgtcaggctcagggagaacaagctgacgtttgcggagattgcagccgtgttgagaggcttcggatacagcatatcaaaagcaaccgttcaccgccgctaccaggagtataaggacggccttgcagactaa

SEQ ID NO: 1933 - DNA, 234 bp, Bacillus licheniformis
atgatttctaaagaaaaaatagccagaattaacgagcttgccaaaaaagcaaagagcggatctttaacagacgaagaaaaagcagaacagcagaagcttcgccaggaataccttcaaggcgtccgcgcgtctatgaaaaacacgttgaaaactgtgacgattgttgaccctgaaggtaatgatgtgactcctgaaaagctcaaacaggaaaaaagaaaccgccgattgcattaa

SEQ ID NO: 1934 - DNA, 2004 bp, Bacillus licheniformis
atgaaaacgattgaattaaaatctgtcgcaacaatacgaacactctccatagacgcgattgaaaaagctaaatccggtcaccccggcatgccgatggggactgctccgatggcttatgcgctttggacaaaaatgatgaatgtcagccctgaaaatccgaattggtttaacagggaccgttttgtgctttccgccggacacggatcaatgcttttgtacagcatgcttcacttaagcggatatgacgtttcaattgaagacctcaaaaatttccgccaatggggaagcaaaactcctgggcatccggaattcggacatactccgggtgtagatgcgactacaggtccgcttggccaaggaatcggaatggctgtcggaatggcgcttgctgaacgtcaccttgctgaaacttacaaccgtgacgactatcgcgtcgttgaccattatacatacagcatttgcggtgacggagacttgatggagggaatttcatccgaagcggcttcgcttgcgggacatttgaacctcggccgtctcatcgtgctttatgattcaaatgacatttcgcttgacggcgaactaaaccgctcattctctgaaaatgtaaagcagcgctttgaagcgatgaattgggaagtgctttatgttgaagacggcaacaacattgccgaaattacggcggccatcgagaaagcgaaacaaaatgaaaagcagccgacattaattgaagtgaaaacaacgatcggtttcggttctccaaaccgtgcgggcacatccggcgtccacggcgctccgctcggatcagaagaggcgaaattaacgaaggaagcgtatgagtggacatacgaagaagatttttatgttccttccgaagtgtacgagcactttaacgaaacagtgaaggaagcgggcaagaaaaaagaggcggaatggaacgaactgttctccgcatacaagaaagcccacccggaacttgccgaagagcttgaactggcgatcaaaggcgagcttcctgaaggatgggatcagaaagtacctgtatatgaaaaaggaagcagccttgcttcacgtgcatcctcaggtgaagtgttaaacggaatcgctcaacaagtgccgtttttctttggcggatccgcggacttggccggttccaacaaaacgacaatcaaaaacggcggagatgtttcagcgaaggattacgccggcagaaatatctggttcggtgtaagggaatttgcgatgggagcagctttgaacggaatggctcttcacggaggcctccgcgtattcggcggaacgttcttcgttttctccgattacttgagaccagcgattcgtcttgctgcattgatggggcttcctgtcacctatgtatttacacatgacagcattgccgtcggtgaagacggaccgactcatgagccgattgaacagctggcatcacttcgtgcgctgccgaacttgtccgtcatcagacctgccgacggaaatgaaacagcagctgcctggaagctcgcgcttcaatcaaaagaccagccgactgcgcttgtgttgacacgccaaaacttgccgacaatcgatcagtctgctgaaacggcttatgaaggcgttaaaaagggtgcatatgtcgtttcaaaaagccaaaacgaaaaaccggaagcgatcttgcttgcgagcggatctgaagttggccttgcgcttgatgcacaaagcgagctgcaaaaagaaggcattgacgtatccgttgtcagcgttccgtcatgggatcgatttgacaagcagccggctgaatataaaaacgctgttcttccaactgatgtgacaaagcgtctcgcaattgaaatgggatcgccgctcggatgggagagatatacaggcactgacggggacattctcggaatcgaccagttcggtgcatcagctcctggcgaaacgatcatgaaagaatacggttttacgcctgcgaatgtagttgaccgggtgaaaaaactgttaaatcgctaa

SEQ ID NO: 1935 - DNA, 438 bp, Bacillus licheniformis
atggaacgccattattatacgtatttgatagaagaggaatttgccagccattattttggaagagagtccgtcatgttcaaactgttttacgattatcattggacgagccccgatcaaaagtctcaattagccgcgaaacagatcgagtttattacaaaaccgattcccgctgctcatatacacaaaagaatgaaaatgaacctctgccgggaagactatacacaggttgactatgtatacagattgattgttccaaaaggaagcgcttcttttattatcaaagaccgtcatattgagattttggcaaagggtccattcgatgccgaaacggttttctttgaggtattgcgaaaagtcagtccgtgttttcttgcgatggattttaatatgaaacgttatggctggctgaaccctgtgaaagaaagaaattttgtataa

SEQ ID NO: 1936 - DNA, 219 bp, Bacillus licheniformis
atggatttgtgggttgtcatcctagtgggcgttttagcattgctcgcaggtgttgcactcggattttttattgctcgtaaatatatgatgaactatttgaaaaaaaatccgccaattaatgaacaaatgctgcgcatgatgatgatgcagatgggtatgaaaccatcccagaagaaaattaatcaaatgatgaaagccatggaaaatcaaacgaaataa

SEQ ID NO: 1937 - DNA, 162 bp, Bacillus licheniformis
atgaaagaaaatctgcttcatgaaattgaggaaaaaagaaaagagctgctaaaaatcgtcatgacaaacggcatgacttcacatatcaccattcagcacagccagcagctggatatccttctcttggaataccaaaaactatctctcggaaatacacaataa

SEQ ID NO: 1938 - DNA, 708 bp, Bacillus licheniformis
atggctgatatcaattatattctcgctttcggtgcagggtttctatcgtttatttcgccatgctgcctgccgctttatcccgcttttttatcatatattaccggtgtcagcatgagtgaaatccattctgacaaacttatgtttcaaaaaaggagcttggtacatacggtctttttcctgatcggcttttcgatgatctttgtggcactcggctacagcacgtcgcttgtcgggtcgttttttaaggattatcatcagctcatcaggcagcttggtgcggtttttatcatctttttcggatttgtcactttgggggtttttaagcctgaatttttaatgaaagaaaggcgcctccaatttaaaaacaggcctggaggtctgctcggttccatcggaatcggaatggcatttgccgccggctggacgccctgcaccggcccgattcttgcagcggttattgcactcgccggaacgaacccgatgtcggccgtgccttatatggcgctttatgcactcggattcagcttgccgtttctgcttctgtcttttttcattacaaagatgaaatggcttcggaagcatcagctcatcatcatgaagatcggcggagttgcaatgattgtagtcggcatcctgctgttctttgactggatgacgaaaatcattatcgtattgtcaagcctgttcggcgatttcagaggcttttaa

SEQ ID NO: 1939 - DNA, 372 bp, Bacillus licheniformis
atgacaagggttttaattgttgatgatgcaaaatttatgagagataaaattagagaaatacttgaaacagaagacttgcaagtcgcgggtgaagccgagaacggggaagaagctgttttgctttatcaagagctgcagccggacttggttatcatggatattacgatgcctgtgaaaaacgggatagaagctttaaaggatatgatccagctgaacccgaaagtgaaagtgatcatgtgtacggccatgcggcaaaagcggatcgtcgttgaggcgatcgaagccggagccaaggacttcatcgtcaagcctttcgaggaaacgaaagtcgtcgaagcgattcggcatgtgctcggaaatgcttgcagctga

SEQ ID NO: 1940 - DNA, 486 bp, Bacillus licheniformis
atgatgatcgtcgtttcatctatacttgctatcgtgatggccgtcattgtcatggctgtcagaatcaagtcatctgaaaaaccggctacggccaaaaaaattatactgcctccgatttttatgagcaccggtgctctcatgtttttatttccggtgttccacgtaaccggtgctgaatttttggaagctctcaccgtgggcatgatcttttctattttcttaattaaaacctcaaaatttgaaatccgcgatgataaaatctatattaaacggtccaaatcgtttgtgtttattttaattgcgctgctcgtcatccggatcgtgatgaagagcatattaagcacaacgatcgattacggcgcactgagcggaatgttttggattctggctttcgggatgatcgttccttggcggattgccatgtatttatcgtttagaaagctttcaagccagattgaagcgtcaaatcacatacaggtcaattaa

SEQ ID NO: 1941 - DNA, 429 bp, Bacillus licheniformis
atgctggaaggatggtttttatggctgatgctcgcttggatcgtcatcatgatcgtcctcttgtcaatcggcggttttttcatgtttcgcaaatttttaaaaaggctgcctaaagaagatgggaaatctgagctggactggcaggattattatattgaacagacaaggcatttgtggaatgacgaagaaaaagaactgcttgaggaattggtttcacccgtacccgagctgtttcgcgatgtagcaaaagcaaaaatcgccggtaagatcggggagcttgcattgaaagaaaaagcaggcgccatcgaccgggatttaatcatcagaggctatattatggccacaccgaaaagagaccataagttcctcgtgaaacgtttaaaagaaaagaacattgatcactctacatatcaagagctttttaaataa

SEQ ID NO: 1942 - DNA, 408 bp, Bacillus licheniformis
atgacaaatacaaaacgtttcgattccgcagattttgataaagaatggatgaaacagtttgttgacgacccttttctcctctatgatgaaactttaccgattgacctttatgaaacgagcactgaatatataattgaagcagatttaagccacttgaatgtccggcatcttgacttgacgttttcaggctacgatttcaagcttgcagttaaaaccgatgagcagctttacgagaaatcgctgatgcttcctttctttttgaatgacaaacagatcgaagcggaatgcgaaaacaacattcttgcagttaaaatcaataaagaatcaagcaaagatgacatttcgctttcaatcaatattccttttatatcaaacctgcacaacaagcagaacccggacagcgcttaa

SEQ ID NO: 1943 - DNA, 147 bp, Bacillus licheniformis
ttgacaaataaaaacgacggcaaagatatgcgcaaaaacgcaccgaaaggagctcagccggggcagccagagcctttgagcggaagcaaaaaagtaaaaaaccggaaccatacaagacaaaaacacaattccagtcacgatatgtaa

SEQ ID NO: 1944 - DNA, 147 bp, Bacillus licheniformis
ttggccaaacgaaaagcaaatcatgtaataaatggaatgaacaatgcgaaacgccaaggaaacggcgcgggatatattgaaaatgatcagcacatactcactgaggcggaacgccaaaacaacaaaaaacggaaaaccaatcaataa

SEQ ID NO: 1945 - DNA, 2727 bp, Bacillus licheniformis
atggcgaatcagcaacaaatcgcaaaaaaagacgcttttcaatcaagaaaaacgtttacagtacaaggcaaaacgtacagctattattctttaaaagcattagaggatcaaggaatcggaaacgtatcaaaacttccttattccattaaagttttgctcgaatccgttcttcgtcaagtagacgggagagtcattactgaggaacacgttgaaaacttggccaaatggggcactgccgaattaaaagatattgacgttcctttccaaccatcccgcgttattttgcaggactttaccggcgttccagccgttgtagaccttgcttcattaagaaaagcgatggcttcagtcggcggagatccggataaaatcaatcctgaaataccggtagaccttgtcatcgaccactccgtacaagttgacaaagcgggtacggaagatgcattgaccgttaatatggaccttgaattccaacgaaatgcagagcgttacaaatttttaagctgggctaagaaagcgtttaataactatcaagctgttccccctgctacaggtattgttcaccaggtgaaccttgagtatttggcaaacgttgtccatgcagtggaagaagacggcgagattgtcacttatcctgacacgcttgtcggtactgactcccatacaacgatgatcaacggaatcggcgttctcggctggggcgtcggcggaattgaagctgaagcaggcatgctcggccagccttcatatttccctgtacctgaagtaatcggtgcgaagcttgtcggaaagctgccgaacggtacgacagcgacggaccttgcgcttaaagtgacacaggtgctgcgtgaaaaaggcgtagtcggaaagttcgtcgaattcttcggtccgggtgttgcggaactaccgcttgcagaccgtgcgacaatcgcaaatatggctcctgaatacggcgcgacttgcggtttcttccctgttgatgaggaagcattggaatacatgcgtttaacaggccgtgatgaagaacatatcaatgtggtgaaagaatattgccgtcaaaacggactgttctacacgcctgatcaggaagatcctgtatttaccgatatcgttgaaatcgacttgtcaaaagttgaagcgaacctttcaggtccgaagcgtcctcaggatctcattccgctgactgacatgaaagaaacgttccacaagcatttggcaagccctgcgggcaaccagggattcggtttaaacgcgagcgaggctgacaaagaaatcaaatttaagcttgaaaacggcgaagaagccgtcatgaaaacgggtgcgatcgcaattgcggcgattaccagctgtacaaatacatcaaacccttatgtcttaatcggtgcgggcctcgtcgccaaaaaagcggttgaactgggattgaaagtaccgaactatgtgaaaacatctctcgctccgggttcaaaagtcgtaacaggctacttggttaattcaggcctgctgccgtatatgcgcgagcttggatttaacatcgtcggctacggctgtacgacatgtatcgggaactccggaccgcttgcgcctgaaatcgaaaaagcggttgccgaaaacgacctgctgattacgtctgtcctttccggtaaccgtaactttgaaggccggattcatccgcttgtcaaaggaaactacttggcgtctccgcctctagtcgtggcctatgcattggcaggtacggtagatatcgacctgaaaaacgaaccgatcggcgtcggcaaagacggtcaaaatgtgtacttcaacgatatttggccgacgatggacgaaatcaattccgtcgtgaagcaaaccgttactcctgagctgttcagaaaagaatacgagcgcgtgtttgatgacaatgaacgctggaatgcgattgaaacaacggatgaagccctgtataaatgggatgaagagtccacttacattcagaacccgccattctttgaaaacatgtcagttgagccaggtacagttgaaccgcttaaaggcttgcgcattgtcggcaaattcggagactctgtcacgacagaccatatctctcctgcgggagcgatcggcaaagacacgccggccggaaaatatttgcaggaaaaaggcgtttctcctagagacttcaactcatatggttcaagacgcggaaaccatgaagtcatgatgaggggaacattcgccaacatcagaatcaaaaaccagatcgctccgggcactgaaggcggttatacaacgtattggccgaccggagaagtgatgtccatttatgatgcctgcatgaagtataaagaagacggcacaggtctggtcgtcattgccggaaaagactacggaatgggttcttcccgcgactgggcggcaaaaggaacaaatctgctcggcatcaaaaccgtcattgcagaaagctttgaaagaattcacagaagcaaccttgtgctgatgggcgttcttccgctgcaatttaaagagggagaaaacgctgaaacgctcggtttgaccgggaaagaaacaattgaagtagacgtgagtgagtcggtgcgcccgcgcgatctcgtccaagtcaaagcgattgccgaagacggcacggtcaagtcgtttgaagctgttgtccgctttgacagcgaagtggaaatcgattattaccgtcacggcggaatcctgcaaatggtgctccgcaataaaatgaaacagtaa

SEQ ID NO: 1946 - DNA, 504 bp, Bacillus licheniformis
atgaaaaaagtgctggctgccgcgtttcttttagtcttggccggtcttgcggtttggaattttacagggcaaaaggaagccgaaatcggcattgagaaaggagacaaggcgcctgattttacgctgccgtcattaaagaatggaaacgatgtatctttgtcagactttaaagggaaaaaagtgctgttaaatttttgggccacctggtgtagaccgtgtgaaaccgaaatgcctgcaatggaagagcttcaaaatgaaaatcaggacattgccgttttagccgtcaactttacatcttccgagaaaaacgaaaagacggtcaaagcgtttgccgaaaggcacggtttacatttccccatcgtcttagaccgaacgggcatcaatgcgaaatacgagattttttcatatccgacgacatttatcattgatgaaaacggaatcattaaagatatcgtgctggggacgatgtcgaaaaagaatatggaagaaaagctgggattataa

SEQ ID NO: 1947 - DNA, 126 bp, Bacillus licheniformis
atgaaaaaagcgaaaaggcgaacatttgaagaacttgtctcggaaaataaaaaggagctcatgaccaaccaggagtttcttgatcggctggaagataagcttgaagagaaatttaagctgaagtga

SEQ ID NO: 1948 - DNA, 144 bp, Bacillus licheniformis
atgccgagagaacacgacaaacagtctaaatttgccccgagccatcttgggacaaaaccggtagaatataagcgcaacaaaggaaaaaagatgcatgataaatcaggagaaacaccgatcattatgcagacaaaaggcgagtaa

SEQ ID NO: 1949 - DNA, 237 bp, Bacillus licheniformis
atgacacatcaaaaacatcatccggatgacagatcagacaacgtagaaaagcttcaagacatggtgcagaacacaatcgaaaacattgaggagtctgaagagcagctgtcttttgccagcgaggcggaacaggaacagatccgcgaaaaaaatgaacgccgaaatgaaagcattgaggcgatgcgcaatgaaatccatgacgaggcggaagcccgcaaaaacggatatcatcaataa

SEQ ID NO: 1950 - DNA, 417 bp, Bacillus licheniformis
ttgtacgtctcaaaaaaagaaatagaagtccgctatgccgaaacagaccaaatgggtgtcgtctatcacgccaattatttgatttggatggaggtaggccggacggctttaattaaagaactcggcttttcttatgccgaaatggagaaagacggcatcctgtcgcctgtcgtggatatcaatgtccgctacgtcaaacctcttcgctacggtgaaacagcgacggtacatacgtggattgaagattacaacggctttaaaacggtatatgggtatgaaatttttaattccgccggagaaaccgctgtgaagggaacatcgtcccatatttgcgttgacggggacagcttcaaaccggttcagttccgcaagctttatccaaagtggcatgaagcatacgaagaggccaaaaagtaa

SEQ ID NO: 1951 - DNA, 303 bp, Bacillus licheniformis
atggcgttcggtattaaaagaaacgagctgaacgaatggaagcgcgccgttttaaacggcgaagttgcgtttcttacgcattactggctcgatgacaggtatccggatgtcaaaacggtgacaaaagcaggatgcgcgaacattgagaagcttgcagagtggggcaaacagtacggactgaaaaaagagtggattgataaaagaagcgaatttccccactttgatttattgggagagaagcagatcatgattttaaaacaagaaaagctctcaagccatatcaagcgtttcaggcttgaataa

SEQ ID NO: 1952 - DNA, 360 bp, Bacillus licheniformis
atgaaatggtttttaggaattttaacggcaggactgataattttggtcgggggctactttttatattccggatattattcaacggaagattattacgtcaaaattacaacagatccaaaagtcgtgaaagaaaaagcaagtgatggatacacatatataaattataactatgatgttacgggttatgataaagatgggaaatccaaaaacctaaagctctcttctcaagaaaaaatgcagaaaggtcagtactatattattcattgggaagatagaagggaaatcatatccagcaaagaaaaagcgagcgagaagcaaatagataaggacatcctgcataaattagacaatcaaaattaa

SEQ ID NO: 1953 - DNA, 1032 bp, Bacillus licheniformis
atggtttacggtgtgacaacttttattttactggctgtttttctgatcttttatttaacggaccgaagaaggatcatcaacggttttttattcaatctatttttttgttcatttcttgttctttcctactatctggcatacgttttcggaattggctttttcagacttttcgtcattgtaccgctgctgatctttttctttatcctaacgttcggtctatttgctttaatgatcgggttatttctgaatgcgagaattcttatcaaaagagaaggacgacgattgtctaattgtttgactttaatttccgggctaggcattatcatattttttctattgtcagtgattgaccccgctcgttttttatcgccaaatgttcagccgttgtttgcgggatcatcgcttattgcggtctatttcttctttcatttaacaaatttcttaacagcctattttctatatcaatttaacagaccgaaacttaatcaggattacatcatcgttctcggaagcggattaattaacgatactgtacccccgcttttagcaagcaggatagataaggctgtcgatttttatcggaaacaagcagctgttgctcctccgccgaaaattattttttccggcgggcaaggacctgatgaaaacctttctgaagcagaagccatgcagagatatgctttaaaaaaagggatacctgaagagcacactttcaaagaagaccgttctgtaaatacatatcaaaatatgcttttctccaaacaactgatggactcattatcagacggcaaatacaacagcatcttcacaacaaacaatttccacctgttccgcgccagcctatatgcaaaacgagcaggcttaaagagccaggggatcggttcaaaaaccgctttttattattggccgaacgccatgatccgtgaatatatcgctgttgttgtaatgaatcgtaaacggcatagcattgtcgtaggtactattttaggtttttctataattttgactgctcttaattttttcattgattaa

SEQ ID NO: 1954 - DNA, 288 bp, Bacillus licheniformis
gtgaatttgaaaattaatgaagaggcgcttaaatggtataagaacgagcttgatttaaaagaaggtgatcaggttcgcttctttgtccgctacggaggatgcagcaatgttcaaaaaggcttctcccttggggtctcaaaagatgagccgcagcaaatcggtgtaagtgcggaaaaagacggcattacgtttttcgttgaagaaagcgatgtatggtatttcgacggccatgatctgcttgtcacctataacgaatctgcggaagaacctgtttttgaatatcagtaa

SEQ ID NO: 1955 - DNA, 594 bp, Bacillus licheniformis
atgttaatagctttattatttattttagcctatctactcggcagcattccgtccggcttgattgtcggaaaggccgccaaaggaatcgacatcagggaacacggcagcgggaatcttggcgccaccaacgcatttcggacactcggcgtaaaagccggctctatcgttgtggctgcggacattttgaaagggacgctcgccgcctttctgcccgccatcctgcacatcggcgtacaccctttgctggccggcgtagccgcagtcatcgggcatatgttccctgtgttcgcaaaatttaaaggcggaaaagctgtcgctacttccggaggcgtattgctttgctatcagcctcttctgtttctcacaatggttgcggtgttctttctgtttttgtatatcacaaaatatgtatcgctttcttccattttaaccggcttgtatacaacggtttacagtctgtttacgaaagaccttttattggtggcagtcgtcgcctttcttacggcgtttgtcgtatacagacacaggacgaacattaaacgcatcatcgataaaaccgagcccaaaatcaagtggatgtccggcaaaagatga

SEQ ID NO: 1956 - DNA, 414 bp, Bacillus licheniformis
gtggaaaatccttctaaacaggaaatcaaaaccattcttgaaaacagcagacgaattgcggtagtcggcttgtccgacaaccctgaaagaacatcgtacatggtatcaaaagcgatgcaggacgcgggatatgacatcatccctgtcaatccgaccattgatgaggcgctgggcgtcaaggctgtggcatccttaaaagacattgaaggacacgttgatatcgtcaatgtgttcagaagatccgagcatctgcctgatgtcgcaaaggaattcctggagatagacgcagatgtgttttgggcgcagcaggggcttgtcaatgaagaagcttatcagcttctgagcgaaaaaggctatacggtgattatggatttgtgcataaaagtggcacactcgttaacaaaatcggcataa

SEQ ID NO: 1957 - DNA, 1968 bp, Bacillus licheniformis
ttggttaaaaaacagcaagttgactataatgatgattccatacaggtgctcgaaggccttgaagcggtcagaaaacgccccggtatgtacatcggttcgacagacagccggggactgcaccatctcgtatatgaaatcgtcgataattccgtcgatgaagtccttgcgggccatggggatcacattatagtaaaaatacataaagataacagcatatcggtgcaagacagaggccggggaatgccaacaggaatgcataagctcggcaagccgactccagaaattattttgacagtgctgcatgccggaggaaagttcggccaaggcggctataaaacgagcggggggctgcacggcgtcggtgcatccgttgtaaacgccctgtccgagtggctgacagtcacgattgagcgggacggaaatgtttacaggcagcgttttgaaaacggcggcaaaccggtgacatcccttgataaaatcggaacgaccaaaaagaccggcaccctgattcatttcaagcctgatcctgcgatgttcagcacgacgacgtttaactttgaaacgctttcagagcgtctgagagaatcagcctttttgttaaaaggactaaaaatagaattgatcgatgaacgcgatcaaacaaaagaaacgtttttatacgaaaacggaatcgaagcttttgtcgcttatttaaatgaggagaaagacgcgctttctgaagtggtctcatttgaaggagagcacaacggcatcgaggttgacttcgcgtttcagtttaatgacggctattccgaaaacatcctgtcgttcgtcaataatgtcagaacgaaagatggaggaacccatgagtccggtgccaaaacggcgatgacgagagcattcaacgagtatgcgagaaaggtggcccttttaaaagaaaaggacaaaaaccttgaaggaacggatatcagggaaggcctgtcagccatcgtttccgtccggattcccgaagagcttcttcaatttgaaggacagacaaaaggaaagctcggcacaagtgaagcacggtcagccgttgatgcaatcgtctctgagcagctcgcctattttcttgaagaaaacagggaaacggcaacattgcttgtcaaaaaagcgattaaagcctcccaggcgagagaggctgcgagaaaagcaagagaagaggcaagaagcggaaagaaaagaaagaaatccgaagcgacgctctccgggaagctgacgcctgcacaatcaaggaatccatccaagaacgaattgtatctcgtggagggtgattctgcgggaggatcagcaaagcagggacgagaccggaaattccaggctgtcctgccgctccgcggaaaagttatcaatacggaaaaagcgaagctggccgatatttttaaaaatgaagagatcaatacgatcattcacgcgatcggcggaggggtcggcgccgattttgacattgaggacatcaattacgacaaagtcattatcatgacagatgcggatacagacggcgcgcatatccaagtgctgctcctgacttttttctaccgctatatgaagccgctgatcgagcacggaaaagtgtttatcgcactgccgccgctctataaagtgagcaaagggtcgggcaaaaaagaaatcattgaatatgcctggtctgatgaggaaatggacgacgtcctcaaaaaagtcggaaaaggatatacgatccagcgctataaaggtctcggcgaaatgaacgctgaccagctttgggaaacgacaatgaaccccgagtcaagaacacttgtcagggttaaaatcgatgacgcggcccgggtggaacggcgcgtaacgacattgatgggcgacaaagttgagccgaggagaaaatggattgagaaaaacgtcgctttcggacttgatgaagaaagcaacattttggaaaacgagaatttatcggtcgctgaggaggtttaa

SEQ ID NO: 1958 - DNA, 2424 bp, Bacillus licheniformis
atggcacagccagagatttatcatgatttaccattggaagacgtgatcggcgaccgtttcggccgatacagcaaatatattattcaggaccgggcgctccctgatgcgcgcgacggcctgaagcctgttcaaagaagaatcttatacgccatgcatgcggaagggaacacatacgataagaatttccgcaaggccgcaaaaacggtcggtaatgtaatcggaaactatcatcctcacggagacagctcggtctacgaagcgatggtgcggatgagccaggactggaaggttcgcaacgtgctgattgaaatgcacggaaacaacggaagcatcgacggtgatccgccggctgcgatgcgttatacagaagcaaggctcgcggcgatcgcgtcagagctattgcgggatattgacaaagaaacggtcgagtttgtaccaaactttgatgatacgagcaaagagcctgtcgtccttccggcaatgttcccgaacctgcttgtcaacggatcgacagggatttccgccgggtatgcgactgacattccgccgcatcatctcggggaagtgatcgatgccgtgattaagcggatcgactcgccgaactgcagcgtggatgacctcatggagttcgtaaaaggtccggactttccgaccggaggaatcatccaggggaaagaaggcataaaaaaagcctatgaaaccggaaaaggaaaaatcatcatcaggggcaaagccgagatcgaaacaatcagaggcggccgccagcaaattgtcattactgaaattccgtttgaagtcaacaaagcgaatttagtgaaaaaaatggacgaattcaggattgaacggaaggtcgaagggatttcagaagtccgtgacgagaccgaccggacaggcctcagaatcgtgattgagctgaaaaaagaagcggatgcacaaggcattttaaatttcttatacaaaaacacggatttgcagattccttacaactttaacatggtcgccatccataacagaagaccgatgctgatgaatctcacatcgattttggacgcttatatcggccaccaaaaagaagtcatcaccaaccgttctcagtatgagctgaaaaaagcgaaggaaaggcatcatatcgtagaaggcttaatgaaggcactgtccattttggatgaggtcattgcgacgatccgctcctccaatgacaagcgcgatgccaaaaacaatctgatcgaaaagttcgcatttactgagccgcaggctgaagcgatcgtttccttgcagctgtacaggctgacaaacacagatattacggccctccaggaagaagcaaaagaactggaccagaagatcaaagagctggaagagatcctttccaatgataagaaacttttgaaagtgatcaaagacagcttgaaaaaggttaaaaaaacctatgccagtcaaaggcgctctgtcatcgaagaaaaaatcgaagaaattaaaatcaaccttgaagtgatggtggcgtcggaagacgtttatgtgaccgtaacgaaagacggttatattaaacgaacgagccagcggtctttcgccgcatcaaacggccaggacttcggcatgaaagataccgaccgtctgctctgtcagctggaaatgaatacgacagacgttctgctcttgttcacaaataaagggagctatgtctattgtccagttcaccagctccctgatatcagatggaaagatttaggtcagcatataacgaatatcatatcgattgacagcgatgagtccatcgtcaaggcgattcctgtcagagagtttaccgaatctgaatacctgctgttctttacgaaaaacggaatggcgaaaagaactcagctgatgcagtataaagcacagcgctattcaaaagcactggttgcccttaatttaaaaggcgacgatgaagtggtcgatgttcatgtaacggacggaacgaaagatttgtttattgcgacacattccggctacggtctgtggttcacagaagatgaagtcagcgtcgtcggcgcaagggcggccggtgtcaagggcgtcaatttgaaagacggcgactttgtcgccagcggacaggttttagaggaaaaagacgtgcttgtgctcgtgacccagcgcggatctattaagcggatgaaccgcagcgaatttgaaaaaacgtcaagggcgaaacgaggggttctcatgctgagggaactgaagaaaaaacctcaccgcattgccggcctgctcgcatgttcatatcatgatcaaatcacgcttcaaaccgaaaaaggcatcacagaggagatgcttgtcaaagaaatcaagcttcatgaccggtacagcaacggttctttcatcatcgacgaagatgaagcaggggaagtaacggatgtatggatcagcaaacatgagctggagtga

SEQ ID NO: 1959 - DNA, 1092 bp, Bacillus licheniformis
atgaaaccaaagtataaggtcatcattaatgacataaaaagtaaaatactttcaggagtttacagagcgggagaccaaattcctactgaatccgccatacaggaagagtacaaagtcagccgccacactgttcgaaaagccattttagaactatcgaacgaagggttcttaagaagtgaaaaagggtctggcacttatgttagtaaccagtatcaatcaaaagccggcgggaattccaataacaaaataatcggtgtaatcacgacctacatttctgattacattttcccctccattattcgtggaattgaagggagattgaatgaggctaattattcgttactattagctagtacaaataatgatgtcgaacaagaaaaaaaagctttggaaatgatgctgtcatttggcgtagatggtttaattgttgaacctacgaaaagcaatctgtacaatcccaatattgcctactacctatcgtttaaggaacaggatattcctttcatcatgatcaatgcttattatgaagaattagatgttccttttctttgtctcgatgacgtgcagtcaagctatctcgcaacaaaagaattaatatcaaaaggacatacacaaattggtctcatttcaaaaatggatgatttacaaggaaagtatcgaatgaaggggtatataaaagcgcttggtgaagccaaattacgattttacccggagcatgtgctttcgtacaatatagagacgaagctggacctatacacagacctgaagaagtttctaaatgaaaaaagagacgtgttgactgcaatcgtctgctacaacgacgaagtagggctggaagtagcaaatgtatgcagacaacttaatatttctatcccggacaaattgtcaattattggtcaggacaattcgtatatcgccaaaaatgcgaatatcaaactaacaacattgacccatcctcaagaacaaatgggacacgatgcagctgattgggtcattaaaaaattacaaggaaagaaggatttaccaaacgaaacctactatcaacctgtgttagttgaaggcgaaaccgtaaaagagttagaaatacaataa

SEQ ID NO: 1960 - DNA, 1608 bp, Bacillus licheniformis
gtgaaagcgaatcgagtaaacatcaagcaagccataactgagggagaaacatcacttggaattgaattcggatccacacgtattaaagcagtgttgattgatagcagttttgaaacaatcgcatctggaagctatgagtgggaaaacctcttggaagatggattttggacgtacaacttggtagatattatcactggattgcgaacagcttatagtgaaatgaagaatgaagttgaacgaaattatggcatcaccattcgcaaaatcggttctattggaatttctgcaatgatgcatgggtatatggcttttgacaaaacaggggagctgcttgttccgtttcgaacttggcgtaactcaacaaccggtgctgcagcaaaagaattaactgatcaatttcaattcaatatccccgaacggtggagtattgctcacctttatcaagcgatattaaatgaagagaagcatttgcctcgcattgactatatcaccaccttagccgggtacattcactggttactgactggtaataaagcaattggcattggagatgcttcgggcatgttcccgattgatgaatcaacgcaaaattacaatgaatcgatggtcaagcagtttgatgaactgatttcgaacaaaggctacccttggaagctgaaggatattcttcctaaagtttatatttcaggcgagcaggctggtgaattaaccgaaattggtgcaaaaattctggatcagtcaaaaaatttacaaccaggcattccaatttgtccaccggaaggcgatgctggaacaggaatggttgctacgaatagtgtgaggaaacgcactggaaacatttcggtgggaacttcagtttttgccatgattgtattagaaaaagaactttcaaaagtatatccagaaattgatttggtcacaacgccaaacggcagtccggttggaatggttcatgcgaataactgctcaagcgatattaatgcttggctaggattgtttcgtgaattttttgaagcaatgggacaaaagattgaaacgaataaattattcgaagtgatgttaaataaagctttggaagctgactcagatggcggcggtttgctaagctacggctatttctccggtgaaaatattacgggattagaaaaaggccggccattatttgtccgctcaccagagagtcgtttcaatttagcaaacttcatgcggacacacctttttacagcctttgctgctttgaaaatcggaatggatattttgaccaaagaggaaaaaattgaaatcgatagcattttagctcacggcggtttattcaaaacccctcttgtcggacaaaaaattgttgcagctgcaatgaatacgccggtatcagttatggaaacagccggagaaggcggtgcgtggggaatggctattcttgcttcttacatgatgaacaaaggtcaagaagagagcttagaagacttcctcgacaaaaaagtctttgaagaggatgccgggcaggaaatttaccctgatcaattagatgtagaaggatttgaagcatttatcgaacggtacaaaaaaggtttaatgattgagcaggccgctgtagaccatttgatttaa

SEQ ID NO: 1961 - DNA, 696 bp, Bacillus licheniformis
gtgctagaacaactgaaagaagaagtattacaagcgaatttggacctgcctaaatacggactcgtgaaatacacatggggaaatgcaagtgccattgaccgtgaaacaggtctattcgttatcaaaccgagcggtgttgattatgaaacgatgaaagctagtgatatggtggttgttgatttagatggcaatgttgttgaaggagagctgaggccttcatcagatacagcgactcacgcagtgctttataagcgctaccctgaaattggaggaattgtacacactcattcaacttgggcgacaatctgggctcaagcaggccttgatgttccagcgatggggaccactcatgcagacacattctatggttccgtaccatgtgcccgttacttgacacaagaggagattgatcgcggttacgaagcagaaacaggtcatgtgattatcgaaacatttgaggagcgagggttagatattttagctgttcccggtgtcttacttcacggtcatggtccatttacttggggcaaagatgtaaaatcagccgtattgaatagtgtggtgttggaggaagttgcgaaaatgaatttatttacaagagaattaaatctttttgcaaaagaattaccacaacgtattttagataaacattacttacgaaaacacggtaaaaatgcttattatggtcaaaagtaa

SEQ ID NO: 1962 - DNA, 1425 bp, Bacillus licheniformis
atgttaacaacagggaaaaaagaattttggtttgtcgtaggttcacagcatctttatggggaagaaacgttagcggaagtcagagcgcacgcgcaagccatgaccgatgcattaaatgaaagcgctgttttgccatatccgcttgtattgcaagatttggctgttaatgcagataaaatcactagcatcatgaaagaagtaaattatcgtgacgaagtcgccggtgttatcacttggatgcatactttctcgcctgcgaaaatgtggattcgcggaacaaaattattgcaaaaaccattacttcatttagcgacacaatttaatgaaagtattccatggccaacgattgacatggactttatgaacctcaaccaatctgctcatggcgaccgtgaatacggttttatcaatgcccgtttgaaaaaacaaaataaagttgtcgtaggttattgggagcgacctgaagtgcaacagcaaattgcagaatggatggacgtagcggttgcttataacgaaagcttcaacatcaaggtcgctcggtttggtgacaacatgcgtaacgttgctgttactgaaggggataagattgaagcgcaaattcaatttggctggacagttgattactttggcatcggtgatcttgttcaatacgtgaatgcggttacagatgaagagattaatcgtttgtttgcagaatacgcagacctttatgaatttgattatggcacttacagtcgggaagattgggagaagagtgtaaaagtacaagcaagctatgaaatcgctattaaacgtttccttgatgatggtggttacaatgctttcacaactaactttgaagatttatatggaatgaaacagcttccgggtcttgccgtccaacgtttgatggcgcaaggatatggctttgccggtgaaggagattggaaaactgcagcgctcgaccgcttgctcaaagtgatgagccgtaaccaatcaactggttttatggaagattacacatatgaattggctgccggtcaagaatcaattcttcaatcgcatatgcttgaagttgacccatctttagcaagcaataaaccaaaaattatcgtctctccattaggtattggtgatcgtgaagacccggcacgcctagtgttcgacggaaaagcaggagatggcgtggttgtttcaatggcagactttggtacgcactacaaattgttgattaacgaagtttctgcatttgaaccaactgttccagcaccaaaccttccagttgcacgggtgctttgggaagtgaagcctaacttccaagatggagtgaaagcatggcttgagaatggcggcggccaccatacagttgtttcattgtttttaacaacagaccaaatgatcacttatgcaaagctcgttgacttggaatatgtagtgattaagtaa

SEQ ID NO: 1963 - DNA, 1395 bp, Bacillus licheniformis
atggttaatgaaaagaaaatctcaagtggcttcatttacttttttggggcttttgcgggcattcttttcggttatgatatcggcgttatgacgggtgctttgccttttctgcaaaatgattggaaccttcaagacaacgccggggttattggatggattacctcttcggtaatgttaggcgctatttttggaggcgcccttgccggacaactttctgatcgtttgggacggcgcaaaatgattttaatttccgctatcatttttgttgttggatccattttgtcaggaatagcacctcataatgggatactatttttgattgtttctcgggttttattgggattggccgttggtgccgcttctgcattggtcccagcctatatgtcggaaatggcgcctgcacgtttacgtggacggctgtcaggaattaatcaaacaatgatttgttctggaatgttgctttcttacattgttgattttctattgaaagatttgccggaaacaatggcgtggcggttgatgcttggtttggctgctgtacctgctttgatcttatatgttggaatgctaaaattacccgaatcaccacgttttttaataaagaacaataaacttgatgaagctcgcaaggtgttgagctatattcgctctaacaaaggagagattgattctgaaataacgcaaattcaagaaactgccagagaagaagcgaaggcaaatcaaaatgcatcatgggctaccctcttaagcaataaatatcgttttttattaattgccggtgtgggtgttgctgcttttcaacaattccagggtgcaaacgcaattttttattacattcctttaattgtagaaaaagcaacaggaaatgcagcaagttcagctttgatgtggccgattattcaaggagttattctcgtgctaggttcattaatattcttagtgattgctgataaatttaatcgccgtactttattaacagtaggcggaacaataatggggctgtcctttattttgccggcaatattgaatatattaattcctaatgcgaatccgatgatgatggttgtctttttgagtatctatgtagcactttattcattcacatgggctcctttaacttgggtcatagttggagaaattttcccgctggtaattcgcgggcgtgcgtctggtttagcttcatcatttaactggattggttctttcttggttggattgctatttcctgttatgaccgcttcgatgtctcaagaagctgtgtttgcaatcttcggtgtgatttgtttgcttggagttgtatttatccggacacgcgtccctgaaactcgaggtcgcagtttagaggaaatcggaaaaaatggagaaaataaacgagttgacggaaaaagcgcgtaa

SEQ ID NO: 1964 - DNA, 783 bp, Bacillus licheniformis
atgagtaaagtatctggaaaaattgcttttgttactggcggcggtcaaggaattggagaagcaatctgcaaacgattggcagaggacggattcgcagttgcagttgccgattataatgtagaaactgcaacacaagttgctgaggacatcaataagcttaacggcaaagcaattgcggttaaagtggatgttgctgatcgcgatgatgtttttaaagctgtcgatgaaacagtaaaacgtcttggcggtcttgatgtggtgattaataatgcgggtcttggaccaaccacccctattgaaagcattacatatgaagattaccggaaagtctatgatgttaacgttggcggtacttattggggaatacaggggggtgtaaaagcctttaaagaacttggacacggcgggaaaatcattaatgcatcttctcaagccggccaagtcggcaacccgggcttagcggtttacggaggaacaaagttcgctgttcgcgggattacccaaactgcggcaaaagatctagctgaattaggtattactgtaaacgccttttgtccgggtatcgttaaaactcctatgatgatggggattgcacagcaaaccgctgatgaagcaggcaagccgtttgaatggggcatggaacaattcgctaaaaatattgcattaaaacgcttatccgagccggaagatgtagcagcatgcgtttcttaccttgcagggccagattcagattatatgactggtcaagctcttatcattgatggcggaatggtatttaattaa

SEQ ID NO: 1965 - DNA, 345 bp, Bacillus licheniformis
atgaaaaagacattgtttctgcaactgtccatattctttttagtcattgcgagccttcattcgttctcaatgccccagatgccggcaaatcaccatgcgcaaaaagccgctgtttcaggagacgaactccatgaactgacagtcggaaaatatggtgaagaaaaggcgaaatcattatggaattcactcggtttcggagctgaatccgtccttctcttaatcttagctgccgcttccggtcaagcgttcatgatgaacaggcggaaagagcatctgaaggcatttatgctcgcggtgttctatcactcttcttatttcgataaagcgcatgttttaaaaccataa

SEQ ID NO: 1966 - DNA, 1413 bp, Bacillus licheniformis
atggaagaaattttaagcgaaatcatcaatgtcccgagcggttttatttggacttatttagtctatatattaataggaataggcctgttctttacgtttaaattgaaattcgttcaattccgctatttcttcgagatgtttcgtatcgtcggacaaaaagaggagaaaggaaaaggcgtctcgtctttgcaggcattctttatttccgccgcttcccgtgtcggaacgggtaacctgaccggtgtggcgcttgctgttgcaacaggcggaccgggagcggtcttttggatgtgggtcgtcgcgcttgtcggaatggcttcaagctttgtggaaagtacgctggctcaagtctacaaggtcaaagacggcgatcatttcagaggaggccctgcttattacatggaaaaagcgctgggcgccagatggatggggattatctttgccgttttaattacaattacattcggcttgatttttaatgcggttcaagccaacactatcgtcggttcgatgcaaggggctttcaacctggataaaacagtggtaggcatcatccttgctgcaatcaccggatttatcattttcggcggattgaaacgcgttgtgacagtttcgcagttgatcgttccggtcatggcgatcatttatcttggacttgctttatttgtcgtgctgacgaatatttctcaaataccggccgttttcgcgatgattgtgaaggatgctttcgggatcgagcagattgcagggggtacgctcggcagcatcattattatcggtgcgaagcgcggtttgttttcaaacgaagccggaatgggaagcgcgccgaacgcagcagcgactgccaatgtctctcaccccgcgaagcaaggctttatccaaacgcttggcgtattctttgatacgatggtcatctgcagtgcaacagcctttatgatcctgctgttcaatctgacgcctggcaaagagcttgacggcattcaaattacacaagcagccatgcagcatcacattggaagctgggcgcctgcatttgtcgcagtggcgatttttctgttcgctttcagttcaatcgtcggaaactactattatggtgagacgaacattgaatttattaaaaagagcaagacggcgcttgctgtttaccgtacagccgttgtagcaatggtgatcttcggatctgtatccggtttccagcttgtgtgggacatggcggatttatttatgggattaatggcgatcattaacctgattgcgattctgcttctttccggaattgctgcgaaagtgctgaaagactatactgaacagcgcaaagcaggaaagaaccccgtctttaaggcaagctcgattccaggtctgaaaaatacagaggcttgggaagacgagaaggaaacattgcaatcgaaataa

SEQ ID NO: 1967 - DNA, 687 bp, Bacillus licheniformis
atgatcgaacaaatactgtgggtcatcctcccctacattgtcatcaccatttttatcggagggcatatttaccgctatcaacatgatcaatttggctggacggccaaatctagcgagatgctcgaaaagaaaaaacttgcgcttggcagcagccttttccactggggaatcttttttgtcatcggcggacatgtgatgggaattttaattccggaaagcctttatgaggcgctcggcgtttcagagcatatgtaccataagatcgcgatcggcttcggactgcctgcaggcatcgccgcgctgtcagggcttctcatattgacctaccgccgattcacggacaaacggattcgaaaaacgagctctgccggcgatttaatcacccttgtcgctttgttattcgtgatgaccactgggcttgcggcaaccttcttaaacatcgattcaaaaggattcgactacaggacaacaatcggcccgtggtttcgcaacattttcttattcaagccggatgccgggcttatggcgagcgtgcccctctggtttaagcttcacatcatcatgggctacgtcattttcatcgtctggccgttcactcggctcgtccacgtattcagcatgccgctaaaatatttgacaagaagctatgttgtttaccggaaacgggcgccccgcaaaagcatgtaa

SEQ ID NO: 1968 - DNA, 543 bp, Bacillus licheniformis
atggatggaacagacaaacaaaccgtttttgccgctctttcttacctcctctcctaccctgatgaagagtggagaaaagaacgttccgaatggcagcagatcatcggcgaaatcgagcatgaagcgctgaaaggacatctgcttgccttcttggaaagcgcggcttcctattcgtctgaggaattgattgaaacatacgtatatacgtttgatttcggcaaaaaaacaaacctttatgtcacctatttcaactccggcgaacaaagggagcgcggtattgaattgctgcagctgaaagatctgtatcagcagtccggttttcagccgacagataaagagctgccggattatctgccgctcatgcttgaatttgccgcagttgcggatcaagaaaaagctgctgctgttttccaaaaatacgcagcaaacctggaagaattgagatcgcagctttcagagaatgaaagcatctatacaccgttattggacggattaatgctgatcttagaggaaattggtgttgaaaggaatgtacagccatga

SEQ ID NO: 1969 - DNA, 1470 bp, Bacillus licheniformis
ttgaagattaaagcgcaaatcggaatggtaatgaaccttgacaaatgcatcggctgccatacatgcagcgtcacatgcaaaaacacttggacaaaccgttccggtgcagaatatatgtacttcaacaacgtcgaaacaaaaccgggcatcggctaccctaaacaatgggagaaccaggataaatacaaaggcggctgggagctgaaaaaaggcaagctccagcttaaatcaggcgccaaagcaacgcggctcatgaatttattctacaacccgtatcagccgacgatcgatgactactatgaaccttggaactatgattatgaaacgctgacaaacagtccggagaaaaaacatcagcctgttgcaaggccgaagtcttccattacgggagacttcatgaaccttgaatggggtccgaactgggaagacgatcttgccggcggccacattacaggcctccaagatccaaacgtcaaaaaaatggaagaatccatcaaaaccgaatttgaagacgtctttatgatgtatctgccaaggatatgcgaacactgcatcaatccttcctgcgtctcctcctgtccgtcgggagcgatgtacaaacgcgaggaagacggcatcgttctcgtcgatcaaaatgcgtgccgctcatggagacactgtgtatcatcatgtccttataaaaaagtgtatttcaactggcagactaacaaggcggaaaaatgcacattgtgcttccctcgtcttgaagcaggactgccgacaatctgctctgagacatgcgtcggcagaatccgctatctcggagtcatgctttatgacgcagaaaaagtcgaagaagcggcttcagccgaaaatgaaaaagatttgtatcactcacagctggagattttccttgacccgaatgatcccgctgttgcagaagaagcaaaagctcaaggcattccgctggagtggattgaagcagcgcaaaaatctccgatctacaaaatgatcatcgattggaaaatcgctctgccgctgcatcctgaataccggacattgccgatggtatggtatattcctccgctcagtccgattatgaatatgtttgaaggaaaaggaacagcccaatcagctgaagatatcttccctgctattgatgaaatgcggattccgatcgaatatttggccaatttgctgactgccggtgatacacaccatattagaacgacattaaagaaaatgtctgtgatgcgtatgcacatgcgggcgacccaaacgaacaaacagatcgattcatctctgattcaagataccggattgactgaagagcagattgaagacatgtaccgtctgcttgcaatcgccaaatacgatgaccggttcgtcattcctcaaacccatcgcgaagaagtcgcggatctatacatggaacaaggaagctgcggattatcgtttgccggaggacccggctcttgccaaaacatataa

SEQ ID NO: 1970 - DNA, 3687 bp, Bacillus licheniformis
atgaaaaaaaagaaaaagagtcccattttcaggagattaaattatttctcccctattgaacgccattccaatcaacacagccaaaccacttatgaagaccgggattgggaagatgtatacagaaatagatggcagcatgataaagtggttcgctctacccatggggtgaactgtacaggatcctgcagctggaatatctacgtcaaaaacgggatcgtcacatgggaagggcagcggcttgattacccttcgacaggccctgatatgccggactttgaaccgcgcggctgtccgcggggagccagcttttcctggtatatatacagcccgctccgcgtgaaatacccgtatgtacgcggtgtgctgatccagatgtggcgcgaggcgctaaacagcagcaaaaatccgcttgaagcatggaaatcaattgtcgaaaaccctgaaaaagcgaaagcctataaacaggcgcgcggaaaaggcggatttgtccgcgccgaatggagcgaagtcctgaagctgatttcggcttcccttctgtataccattgccaaatacggccctgaccgcaatgtcggcttttcgccgattccagccatgtcgatgctcagccatgcagcaggatcacgctttatgtccctgatcggcgggccgatgctgagcttctatgactggtatgccgacctccctcctgcttcaccgcaaatttggggagatcaaaccgacgttccggaaagcagcgactggtacaattctggctacatcatgacatggggctctaatgtcccgcttaccagaacgcctgacgctcactttttagccgaagcccgctataaaggagcaaaagtgatttcgatcagcccggactttgccgagtcctcaaagttttccgatgattggctgagcatcagacaaggcacggacggcgcactggccatggcgatgggccacgttattctgcaagacttttatgtcaaccagaaaacggaacgttttattgattatgcaaaacaatataccgatttcccgtttttggtgactttgaaagaggaaaacggaacgttcacagcaggccgcttcctccatgctaaagatatcgggcgcgcgacagagcacgatgagtggaagcctgccgtttgggacgaagacacagatggatttgcgattccgcagggcacgatgggctcccgctgggacggcaaaggaaaatggaacctgcgcatggttgatgaggattcagaaaaaccgatcacacctcggctttccatgcttggatacgaagatatgatcggcacggtcaacatcccgtatttctcacatgacggcaataaagtgcttgaaagaccgcttccgatcaaaaaagtcatcttgaacggcgaggaagtctttgtttccaccgttttcgacctgactctcgccaactatggcgtcaactgcggaatcggcggacagacgccggcatcatttgatgatcctgaaccgtttacaccggcttggcaagagccgattactggcattaaaagtgaaatggtgatcaagatcgcgagggaattcgcgcaaaatgcgattgacacagagggccgctcgatgatcattgtcggcgccggaattaaccattggttcaattcagacaccatttacagagctgtactgaaccttgtgcttctcgtcggagcccaaggagttaacggaggaggctgggctcactatgtcggccaggaaaaactccggccggccgaaggatggcagacgatcgcgatggccaaggactggggaggccctgccaaactgcaaaacggcacatcatttttctacttcgccaccgaccagtggcgctatgaagatcaggaaatcagcgggctcgcttcaccaatcgcaaaaacatcgcgctacaagcaccatgccgattacaatgtgctggcggcgagactcggctggcttccatcgtatccgacgtttgagaaaaacggcatcgacttgtataaagaagcagaaaaagcgggcgctgagaacgctcagcaagtcggaatctatattgccagacagctcgaggagaaaaagctcaagttttcgattgaagatcctgacaatgaaaagaacttcccgagaaatctatttgtctggagagccaatttaatctcaagctccggcaaaggccatgaatattttctgaaacacttgctcggcacgacaaacggactgatgaacgatgatcaggacagcatccgtccggaagaaatcacttggcgtgacaaagcgcctgaaggcaaactcgatttactgatcaatctcgatttccggatggcgggaacagccctttattcagacatcgtgctccctgcggccacctggtacgaaaaacacgatctcagcagcacggatatgcatccgttcatccacccgtttaatccggcaatcagcgcgccgtgggaagcaaagtctgattgggatatttttaaagcactggcaaaagcggtttccgatctggctgaagaagtggatatggaacctgtcaaagaggctgttgcgactcctcttctccatgacactccacaagaaatggcgcagccgctcgggaaaatcaaagattggagcaaaggcgactgccctgccgtaccaggcaaaacaatgccgcaaattcacgttgtggagcgggattataagcagattttcaataagatgacatcgcttgggccgaatgttgtcaaacagccgtttggtacgaaaggaatgaactggtctgttgaagcggaatataattctctcaaaaaaacgctcggcgtcgtaaaagacgacacgatcgccaagggctgtcccgacatcagtgatgctagacaagctgctgaagcggtattgactctctcttccacttcaaacgggaaagtagccgttaaagcgtgggaatcgcttgaaaaaattacgaatcttgagttgaaagatttagctgaagaacgggaagaggaatgcttcacatttgagcaaatttcagctcagccgaaaacggtgatcacctcccctgctttcagcggttctgaaaaaggcggacgacgctattctccgtttacgacaaacgttgaaaaactgattccgtggagaacgctgaccggcagacagtctttttaccttgatcatgaaatgatgacagaattcggcgaaaacatggcgacattcaagccgatcctgatccaccgccctttcttgaacaagcgtccggatcaggaaggaaaagaaatcgttttaaactacttaacgccgcataataaatggtcggttcacagcatgtattttgattccctgccgatgcttacccttttcagaggcgggccgacagtctggatgaataaagacgatgccgaagaaaccgacattcaggacaacgactggatcgagtgcttcaaccgaaacggtgtcgtcgtcgcacgggccgtgacatcacaccggattccaaagggaatggcgtttatgcaccatgcccaagacagacatatcaacgtgccgggaacaaagctgacgaataaccgcggaggaacccataacagcccgacccgcatccatgtcaagccgacgcagatgatcggaggctacggacagctcagctacggattcaactactacgggccgacaggaaatcagcgcgacctcaatgtcgtgatcagaaaattgaaggaggtcgattggcttgaagattaa

SEQ ID NO: 1971 - DNA, 1143 bp, Bacillus licheniformis
atgagcgaaatcattaacaatcgggaaacgcagcaaggtctgcctgaggaaaaaaagcagcttctgaaggagatcatcatcgaccttcataaaggaaagccgcttgccgacgtcaaaaaacggttcgaaaaggcattcggctcagtcaatgccgaagaaatcgcccagctggaacaggcgttgatgaaggaagaaggcattacacctgaagagatccaagagctctgctccgttcacgccgctgtgtttaaaggatcgattgaagacattcaccgcgcggacgccgacaagcagcctggccatcccgttcatacatttatgaaagaaaataaagaaatcgacctccttttgaactttaaaatgcagcttcatttggaacgctttgaaaaagaagatcatcgcgacaacattctcaaactgctcgcagacttaaatttgctagctgacgtcgacaaacattacagcagaaaagaaaatcttctgttcccctatttagaaaagtacggaattacagggccaagccaagtcatgtgggctgtcgacgattttatccgcaagagcattaaagaagtgaagcgtttgttggaagagtatacgccggacaaaaaagatgaggtcatccgcgaactaacgtttatcattcaagaaggcacggaaatgatttataaagaagaaaatatcctcttgccgatggcgctcagaacgctgacagaagacgaatggctgaaaatcgcagccgaaagcgacgagatcggatattgcctgactgctccggaaacggtgtggaagcctgaacgccatcagatcaaaacgagcgaagaggcggctgatggctatgtcagactccctaccggtattctgtctgtggatcagcttgaacacatgatgaaccatcttccggtcgatatcaccttcatcgatgaaaacgatgtggtccgctatttttcacacggaaaggaacggattttcgcccggacaaaagccgtaatcggccgaaccgtccaaaactgccatccgccggctagcgtccacatcgtcaacaaacttctggacgactttaaatctggcaaaaagatgttgaagatttttggatcaaatttaaagacaatacgtgttcatccgctattttgccgtacgcgatga

SEQ ID NO: 1972 - DNA, 243 bp, Bacillus licheniformis
ttgcataaaaaaattgatttggacgattccgtttacaaactttgcacattgcatcctgaactaaaagccgtgatgaaggatgccgggtttcaaaatattacaaagcccggcatgctggaaacagccgggcgcatcatgacgattccaaaaggcgcgcgaatgatgcaaatcgaatggaaccatgtcttagacatattgaaagcacacggatttgaccccgtttggaaaggagaaaaacaatga

SEQ ID NO: 1973 - DNA, 1104 bp, Bacillus licheniformis
atgatactttgcgatttcgacaagtctccgtttatcgtcatttgggagctgacaagggcttgcgagctcaagtgccttcattgccgggcatcggctcaaaataaacgcgatcctcgggagctatccctgaaagagggaaaagatttaatcgatcaaattcatgcgatggacaatcccctcctcgtgcttacaggaggcgatcctttaatgagagacgacgtattcgccattattgaatatgccgtccaaaaaggggttcgcgtctccatgaccccgagtgccacgccgaatgttacaagagaagcgattcaatcagcaaaagaaatcgggttatcccgatgggcgttcagcttggacggcccgacccgggagattcatgatcattttcggggaacggacgggtcttttgacctgactatgaaggccattcgctacattcatgaatgtcagctgcctctgcagattaataccgtcatatcctcctataacatcgattacctggatgaaatggcaaagctgatcaaagaattgaactgcgtactatggagtgtgttttttctcgtcccgacaggccgcgcgaagcgggaagatatgatttccccggtggaccatgaaaaagtctttctctggctcagccgtttggcaaaagaagcgccttttgacatcaaaacgacagcagcccagcactaccggcgggtcgtcattcagcaaaaaatgcgggaagcgaaagacccccacatgaaaatccgctatgaacacgcattgcagaaaggaaaaatggatgccatcggcggattgggccgggctccgaaaggtgtgaacgatggcaacgggttcatgtttatctcccatatcggtgatgtatatccaagcggactcctgccggttaaagccggaaacatccgcgaacagccgctggctgagatttaccgcgaatcaccgatctttaaggatcttcgaaatccggacggatttaaagggaaatgcggcgtctgtgaattccgtcatgtgtgcggcggttcgcgctcgcgtgcttatgctctgacaggcgattacctagaaagcgatccgagctgcatttatattccgaaggctttgcgctaa

SEQ ID NO: 1974 - DNA, 468 bp, Bacillus licheniformis
atggaccggtttgactacttattgtttctgaaaaatcttcctatgtttttcggagtaccccttccgatcatcaaaaagctgctgaagaacggtaaggtgatagatatccaaccgtctcagcattcgcgatcgttccttcattcgcaatccgtctattttgttttaaaaggagaagtgcatttttccgacagaaggcttccggaagaatcacggacgatcgccgagtgggaaaaaggcgatgtttttcctattgatcaaaaaggcgaacctttcttatctccgtttatttcagtcaatactgcctctgaaaccgccgtacttgaaataccgtttcataatttcaaaaaaatgatgacttataaccgccaattacagacgaactttctcatgttgctccagcagaatttatttttttcataccagctttttttgcgctacctcaactcctccgcagaagacgacgtgtga

SEQ ID NO: 1975 - DNA, 723 bp, Bacillus licheniformis
atgaaagtgttcataccgaagcagcacggcgcctgggcgatgcttgtcatcccgtttattctcggcatgttcgccggaggcgcagatgtaaagcatattccgctgttctgcggatggctgtttctatatcttgcggcatctccggctatgatgatggtgaagaagaaaaatatcgtttactatcaaaaatgggttctcatctacggcattccggccgtcgttttcctgcttatttcggtcctgctggagccgcagcttgtgtatctcggtctgccgctgtttccgctctttctcatcaatctttattatgcgaaaagaaacaacgacagggcgcttttaaatgatatagctgcaatccttgttttcagcacgggcgggcttgcgagcttctggatgggagcggggaagcttgatggtgaggcatcgtttgtttttatccagtccgctttgtttttcacagggagcgctttttatgtcaagtcgatgatacgtgaaaagaaaaacaatcgattcaagctttattcatggggctaccatgttttcctgccgttcgtctcgctggccgcaggggcaggatgggcggtgatcggcgtagtgccgagcagtcttagagcgtggtttttccacgggaggaaactgtcgattaagataatcggaatctctgagctggtgaatgcctgtatctttatggccgtgttgatcgtttttctgctgcaaacgtaa

SEQ ID NO: 1976 - DNA, 714 bp, Bacillus licheniformis
atgaacatttctgttagaaaatcagacacagatttgctctcagacgatctgcatcacttgctggaatcgatcagtacgcgacgaaaaatcaggcaggacacattcctttttcaagaagggatggatgcagaggaactgtatcttattcagtcaggacttgtccagatcggcaaattgacgtccgatggcaaagaactgacgcttagaatgtgcaaaaaaaatgatattgtcggggagcttacgctttttacagaagatgcgaaatatatgctgagcgcaaagatcctctctgatggcgaagtgttggtcatcaataaagataagcttgaaaaagaactcattcaaaacggtgcgctgacgtttgagtttatgaaatggatgagcacgcatttgcgaaagattcaatcgaagatccgcgaccttttgctgaatggtaaaaaaggcgcgctctactccaccttgatccgtctcgcaaacagctacggcatcacaagaagcgacgggattctcatcaatattgtcctgacgaaccaggatctggcgaaattttgtgctgctgcaagagaaagcatcaaccgcatgctgagcgacctccggaagaacggtgtcatttcaattgaggactcgggaaaaatcgtcatccaccagatcaattatttaaaacgcgaaatcgactgtgaaaactgcccgctcgaaatctgcaatatcgactga

SEQ ID NO: 1977 - DNA, 1185 bp, Bacillus licheniformis
atggcaaatcgtcaaaaaatacaattaccgctgcagtcatttagtttagtcgcaggatttatggtttgggtattgatttcctctttaatgccccacattaagcaggacatcgccctgacagacagcgaggtctcccttgttacggccattccggtcatactcgggtcgcttctcaggattccgctgggctactacacgaacagatttggagcaagaattacattcatgatcagctttttgctgcttctgttcccggttttttggatcagcacagccgattcgctgttcgacttgatccttggcggcttcttcctcggcatcggcggagcggtcttttccatcggggtcacatcactgccgaaatactaccctaaagaaaagcacgggtttgtcaatgggatctacggcgctgggaacgtcggtacagcgattactacgtttgccgctcctgttgtcgcaaaaaccgccgggtgggaaaatacggtgcggatgtacatcgtgttagtcgccgtattcgctttattgaactttatccttggagatcgaaaagaaacaaaagttacggtatctgtaacagagcaaatgaaggcagtctaccgaaatcagacattatggtttttaagcttgttttacttcattacattcggatctttcgtcgcgtttacgatttatcttccgaactttcttgttaatcacttcgggcttgatcccgtcgattcagggctgagaaccgccggatttatcgctgtcgccacttttctgaggcctgtcggcggctggctggcagacaaattcaacccgctgaagctgttgatgtatgtatttgccggctgcaccttgtcagggattttattggccttttcgccgagcctcggactgtacgggtttggggtattaaccgttgccgtgtgcgccggactcggaaacgggatcatctttaagctcgtgccgctttatttttcaaatcaggccggcatcgttaatgggatcgtatcagcgatgggcggcttgggaggatttttcccgcctctcatcctgtcaagcgtttttcaggcaaccggccattatgcgatcggattcatggcgctgtcagaagcggctcttgcaagctttgtgatcgtggtctggatgtattttcaggaagtgaacaaaacatcgtccaaaacgaaggccaaccatttataa

SEQ ID NO: 1978 - DNA, 240 bp, Bacillus licheniformis
atgtttataaagcttacccaagaagaaaaacaagcgatcatcgatgaaatcaaacgcttttatgttgaagaaagaggagaagaggtcggagacattgcggcgattcaaatgttcgaattcgtaaaggaaaagctcggaccttacttttacaatcaggccttgaaggacagccgcagagtggtggaagagaaggcagcggcgattgaagaagagctctttgcactggagcgccgtctgtga

SEQ ID NO: 1979 - DNA, 669 bp, Bacillus licheniformis
atggagtttctgaagcaatttatgattttcagcgggttgaatgatgaagagttcaagcaaatcgagcagatcgcggccaagcgcacctatcagccgagaatgtttgtttttatggagggggaagagagggaagcggtatttttcatcaaatccggtcttgttaaagcctttaaaatcgatgaagacggcaatgaacaagtgatttcgattctgcaaaacggggatatgtttccccatgtcggcttttttgacctctccccatacccggcaacggcagaagccgttcaagaaaccgaattgatcgtaatccgcatcgccgattttaatgaacttttgatgaaatttccggaaatgacgataaaagtgatgcaaatcatggggaaaaagattctcgatttgcaagagcggatccagggttttatctcaaaagacgtccagcaccgcttgacacatgtattaatgaagcttgctgctgaacatggcattcctcaagaaaaaggggtctacatcagcctgcccattaccaatcaggattttgcgaacatggtcggaacgtcaagggaaacgattaaccgcacattaaatgaattgaaaaagaaaaatctgctgacagctgacaggagcggaattttcattcatgatacagactggctgaacggctgcaattaa

SEQ ID NO: 1980 - DNA, 2355 bp, Bacillus licheniformis
atggaagtacaaagaaagacggtgcccgttaaaaaagcatcaaaaaacggttttctgaaatccattctcgtctttactttaatcgtaagtttttcggtgctgcttttgggaggctattggatcttcaaaggacttgcaccaagacctgttgaagtgtccgggccaaacggagaggtgctcatgacaaaatcgtctatttcaggcggtcaggccgtatttcaaaaatacgcgctgatggtctatggaacgattttggggcacggatcttatatggggcctgattacacggccgaagccctgaaaatctatacggaagggatgcaggattttaaggcggaggcacaatacggcaagcgctttaaacaactttcagatgaaaagcagtccaccatccggaatcacgtcatccgcgaaatgagaaaaaaccgttatgatcgcccatcagatacattgaagctgacagacgcgcaggtctacggcttgcatcaagtgcgcgatcattaccgcaaagtctttacaaaaggagacggctgggggcttgagcccggtttaattaaagaaagccacatgcctgaacgcaacagggcgtgggtcgacagcgaagaccaaatcacgcaggtctccgattttatcttttggacggcatggctttccagtacattaaggccgggcgacgacattacgtacacgaacaactggccgtatgatgaagatgcgggcaacacgatgtcattcgccgccgtttggtggagcggcgcaagcgttaccatcctcattttatttgtcggcattattttattcgtgttttaccgttacaagcttggaatgaaagaggcttaccaggaaggggcgtttccggtatttgatctggataaacagccgctcaccgcttcacaggttaaaaccggaaaatatttcgccgttgtgtcgctgctgttttttgttcaggcgatgttcggggctttgctcgcccactattatattgaaccggacagcttttttgggattgattggatcagggagctgttgcccttcagcatatctaagggatttcaccttcagctggcgatcttctggattgcaacttcatggctcgggatgggtatttatgcggcgccgtttgtcggaggccgcgagccgaaaagacaggggctgcttgtcgacattctgttttgggcgctgatcgtccttgtcggcggaagcatggtcggcgaatggctcggagcgaaaggctttttaggaaacaactggttcttattcggccatcaaggaatggaatatattgaactcggccgcttttggcaggtcattcttgcgctcggcatgctgatttggctgtttatcgtcttcagaggcattaagagcggcctcaagcgggagcctgataaaggcggtttgattcatctgctgttttattcttcgatcgccattccgctgttttacggtgctgcctttttctttaatcccggcactaatattacaatgtcggatttttggcggtggtggatcatccatctttgggtggaagggatttttgaagtctttgccgtcgtggtcatcggctttttgctcgtgcaaatgaacctggtgacgaaaaagtcgactgtcagaacgctctattttcaattgacgatcctgctggggagcggtgtcatcgggatcggacaccattactattacaacgggtcttccgaagtctggatcggcctcggttccgtcttctcatgcctggaagtcatcccgcttaccctgcttgtattggaagcttacgaacaatacaagatgatgaaagacggcggacatcacttcccgtataaagcaacgttctggttcctgatttcaacggcgatctggaatctggtcggcgccggggtattgggctttttgatcaacttgcctgccgtcagctattttgagcacgggcagttcttgacacccgcccacggacacggggcgatgatgggtgtgtacggcatgtttgccattgccgtctggctgtatacgctccgcaatatcgccaaaaaagaagcatggaatgataaatggctgaaaatagcctgctggtcgctgaacatcggcctgttcggaatggtgtttatcaatttgctgccggtcggttttcttcaattgaaaaaagcgtttgaagacgggtactggagctcaagggcgcctgagtttttacagcaggatgcagtgcaaacgctgctgacttggagggccgtgccggatacgatctttttagccggaatcgtgattttggttgtattcagcatcagagcattattccatctccgcaaaccgacgtatcgggaaggagaagcgctgcctgttaaagacattgcttcagatgaatag

SEQ ID NO: 1981 - DNA, 714 bp, Bacillus licheniformis
atggaagcagtttttgatcaaaatacaaaaacgggtgatattgttacacgttttccaagagccagccggctgctgaaagaatatcgcatcgacttttgctgcgggggcaaccgcccgatcggtgaagcgataaaagagcaggatttaaatgaagaagagatcttagctagaatcaatacattatatcaagagacaaaggcattaaacgcaaaagagacgaactggagtgaagccccgtattcacagctgatcgaccatgtgattcatacgcaccatgcctacctgtatgaggtgcttcctgaactgtcaggctttgttacaaaagtataccgggttcatggcatccatcatccggagctcgcccaggtccatcaattgttccatcagctgaaaacagaactcgaacatcacctcttccaggaagaggaacatattttcccgaaagtgatggcctatgaagagacgcgatcaatggaccgcttagcagaagcggttcagacgatcgacgtccttgaacaagagcatgaagccgcaggcagcatcctgaaggaactgagaagagtgaccaatgactatacccttcctgaaggggcatgcacaacatatacactgacttacttaaagcttgatgaattggaaacggatctttttcagcacattcacctggaaaacaatattttgttcccgcggcttgaagcggaagccaatcaataa

SEQ ID NO: 1982 - DNA, 372 bp, Bacillus licheniformis
atggagcatatatcctggcttacatttacgatgctgattctcgccagttaccggttaactcatttgattgtttttgataagatcacggagtttatccggaaaccgttcatgaagaagaagcagacgattgatgaacaagggcatgtagaaacgaaaaaagtgccgaaatcaaacttcggctatttgctgaattgctattggtgcgcagggatatggtgcgcgttgatcattgctgtcggatatctgattgccccaaaagcgatattcccgttgattttgattttgtcggtcgccggggggcaggcgattcttgaaacgtttgtcggtgtcgccacaaaacttgtcggctttttctccgatttaaagaagtaa

SEQ ID NO: 1983 - DNA, 1605 bp, Bacillus licheniformis
atggctgcggaaaaagtattttcgaaaaataaaatcattggaggaaaaagaatgtcatatatgaaacgttccatctctgtcttcatcgcctgttttatggtagcggcgcttggcatcagcggtatcattgcaccgaaagcggctgccgcttctaaaacacccgttgctgtaaacggacagcttaccttaaaaggtacgcagctcgtcaatcaaaacggaaaagcggttcagctgaaaggaatcagctcccacggtctacagtggtatggcgattatgtcaacaaagactcgttaaaatggctgagagacgactggggcatcaatgtcttccgcgcggccatgtatacagctgaaggcggctatattgacaatccgtcggttaaaaacaaagtgaaggaagccgtcgaagcggcaaaagaactcggaatctatgtgatcattgactggcacatactgagcgatggcaatccaaaccaaaacaaagcgaaagcaaaagaattttttaacgaaatgtcaagactttatggcaagacgccaaacgtcatttttgaaattgccaacgagccgaacggcgatgtcaactggaatcgcgacattaaaccttacgccgaagaaatcctgtccgtgattcgcaaaaactctccgaaaaatattgtgattgtcggaacaggcacctggagccaggatgtcaatgatgcggcggacaatcagctgaaagacggcaatgtcatgtacgcgctccatttttatgcgggcacgcacggtcagtctttgcgggataaagccgattatgcactcagcaaaggagcgccgattttcgtcacagaatggggaacgagcgatgcttcaggaaacggcggggtctaccttgaccaatccagggagtggctgaaatatttagacagcaaaaaaatcagctgggtaaactggaacttatccgacaaacaagagtcgtcagcagctttaaacccaggcgcctctaaaaacggaggatggtcgcaatccgacttgtccccatcaggcaaattcgtcagggataacatccgcagcgggtcaaacggttcgtcaggagactctggatcgaattcgaaagggtcagatcaaaaagaccaaaaaaaggatcaggataaaccaggtcaagacagcggcgctgcagccaacacgatagcagtacaatacagagcgggggacaacaatgtaaacggcaaccaaatccgccctcagctcaacattaaaaacaacagcaaaaaaaccgtgtctttaaatcgaatcactgtccgctactggtataaaacgaatcgcaaaggacaaaattttgactgcgactatgcccaaatcggctgcagcaaaatcacgcacaaattcgttcaattaaaaaaagcggtaaacggagcagacacgtatcttgaagtaggatttaaaaatggtacattggcgccgggggctgatactggcgaaatccagatccgtcttcacaatgacggctggagcaattatgcccaaagcggcgactattcattttttaattcaaacacgtttaaaaatacgaaaaaaatcacgttgtatgagaacggaaagctgatttggggcactgaacctaaataa

SEQ ID NO: 1984 - DNA, 276 bp, Bacillus licheniformis
atgaaaggagatggatgtatgaatgaaacattgcagcaatacatgatgcttgtcaaggaacactatgacacgatcaatggaccggattacacaggcaaggaggaagacattgaaaagagaaaggaacaaatcgagctttacgccaaaacgcttcagcaaggcttttcaacagatgatgactatgatgaattcgcagatgccgtgattaaatgcgcatacggagatctgacggtggaagaattagaaacggtttatcgggaattaacgtctccataa

SEQ ID NO: 1985 - DNA, 507 bp, Bacillus licheniformis
atgaaagacatgatcatgaagacagaccggcttattttgcgaaaaatgaggcgcgatgacgccgaaaacctgctcgaaatcttttctgacccgatagcaatggaatattatccatcgacaaagaatgaaaaacagacattgcaatggatcgaccggacgcttgaaaactatgaaaaacacggaaccggtctgtgggttgccgaacataaacaaacgggcgaatttttaggccaatgcggcatcgtgccacaggaagtcgaaggatcgaacgaaatggaaatcggctatttgtttaaacggagcgtctggaaaaacggctatgcaaccgaagcagcatcagcatgcaaacaatatggatttgagtcatttcatctgaaaaaaatcgtatctttacctgatgcgcaaaatctgccgtccagaaaagtagccgaacgaatcggcatgactttagaaaaaacaatacataaatggggaaaagaaattgccgtatattcagtgtatcgctaa

SEQ ID NO: 1986 - DNA, 1137 bp, Bacillus licheniformis
atgaaaacttatgacgcatttccagaaccaattggcggctatactgtcggtcgaacccagatggattttgagtacacggcatcagatcactcaaaaagagaactgacggcgtttgtgtactatccgtccgacagtagcgaaggtaagactacatcaacgtacatgtttcctgaagtctacgagatgtttaatgagcagccacttgtcactgcgttgaaggatgttttctctatagatatcaagacccagtgttacgacgaccttgctctctccgggaaggaaaagcgctatccggtattattctatgtttgcggcgggggcggttctccagaatggggtacagtgatctgtacagacttggcaagcatgggatatgttgtggtaagcatcggccatcagaatagcacgatgtataagcgtaaagatgggcgcctgtttaatgtatcaaaggatttttcggatgtcattatggcgttttctgaagatccggagatgctggcgttggctggtaagatggagatgcggcctgacgatgaaactgccattgagatgtgccataacgtgcttacactgccgatacttgccaagttaacagagtatagtgagttacaggcagaagatgtaaggtatgtagccgattatctttacaaactggactctggagaactgaattccatctttaagggcagattgttgcttgacatcggcatgggcatagtcggacattcttatggagggcctacgacggcgattgtttgccgggacgacgaccggttcgcctgcgggattggcttggatagcggtgcgttcggccttctcgacagcgaccttaagaaacccttcttgctactgttttgtgaacctaactataacatgaatgcgataattggcgctaacaatagcatggaaacctattatttctctgttgatcgtgttgcgcatttagattactgcgacatcgtgtttaccagtgttaatgaggaactcagaggtgaacgggatgctatggagatgcgaaatcttgttacagactatacgaagaacttttttgatcattacatactgctgaaggctgcaagtgtggaaagtctggcatacgatggcgtggacttgatcaagaagaccagcaacaagtga

SEQ ID NO: 1987 - DNA, 918 bp, Bacillus licheniformis
atgaaaaaacaacttctcgatgtagcgattattgggggaggtccagcagggttgaatgccgcccttgttcttgggcgtgcgaggaaaaatgtggcggtgatcgatgcaggccggccacgcaacgccgttactcgcaaagctcacggatttcttacccgtgacggaataagcccaagtgaatttcggcaaattgcaaaggaacagatcagtgcatatccctccgtgtcttttatagcggataaagctgtgtcgattacaaaaaccggcggtcattttcaaatgacaactgcgcaaggaaacacttttgcaagcaagaaagtgctgtttgccgtcggaatgaaggatcagccgctagatattccagggctggcagaggtttatgggaagagcgccttcgtctgcccgtactgtgatggctgggaattaagggataagcctctagtgatcattaccaagggggacgaggccattcacttcgcttctctcatatcaggatggacgaaccgttttacgatttgcacgaacggcccccatcaactgacggacgagcagtgcgaggagctcagcaggcatcgcgtccctgtattcgaagcgccgattcgatgcatcgactcagacgacgggatcgtgcaacaagtcgttctcgaagacgggacgacaattccatgtaagggaatcttttttaaaacggaacttgtgacaggatcggatttaccgcgagccataggatgcgacatcacagaatcgggaacggtcgtcgttgataactttgggaaaacgaatataccgggcatctatagtgcaggcgatgcagctacgaaattgcatcaagccgttgtcgccgcctcgatgggtgctatggccgccgcggccataaacaatgaactgaatttggaggcttgggagcaaaacggatga

SEQ ID NO: 1988 - DNA, 891 bp, Bacillus licheniformis
ttgataaacgaattttttaaagaaaccgtttgggaagaagcttggaaggaagatcagcagacagcggttaacaaaatgaaaaaagccggaatggataaagtacaccattttgaccttagagcaaagtcattcaatgagcaagcgtttaacgaagaagggaggaaaaggacaaaacggattatgaaatggctggaagggcagggggtgacatttaaagatacctctattttagatattggagcagcctcgggcggatttacagtgccatttgcagagagaggggccgaagttaccgccgtggagcctagtcttcctttagtcgagctgatgaaagaaaatataacaggaataacaaacgggaaggttaagattgtagctgagcctttcgaagacatagatatccaagcaaagggatggggaaatgcttttgattttgtatttgtctccatgtgcccggctattgctgattgggagagcgtaaagagggtgctgagctgcgcacggcagttttgctatatcagtctgtcagccggctctcgggagcacagtcttctgaatgagatttggccgctggtttcagatcagccccttaaaaatgaacattcggagatggcctatttgctccatttattgtttctaaaaggttatacctatgaatcactcgtaacccgggaaatgaaaacgagggaggtatccagggaaacggcgctcaatgaggttatggacatgttgagaatgtttggtttgcctgcggacgatcgcaaccggaaaatcaccgccgcttatttggaacggacttatccaaacgacaaggtggaaatccgacagggcggccgttttggaaaagttctgatccgattacagaatcagaacatgtacatgaattcatga

SEQ ID NO: 1989 - DNA, 426 bp, Bacillus licheniformis
atgattgaggtgaaaaactgcgctatgaagtattcgaaagcaacgaactatgcccttcacactatgctctttcttgcagcaggcgccccaaatacatttgtcggtgtacagcagttggcagaacggcaagaggtatcgcccacgtatttatcgaaaattttaacgaagctggccaaggcgggaatgattgaatccgcttcaggcgccaatggcggatataggctaaagcggaattgggaagacatttcgtttcttgatattattcacgcaattgaaggtacagcctccttgttcgattgcaacttgaaccatggatcagaatgtgtgattcagaaggtgatggtatctgcagaagatgaaatggagaattatttgagacaacaaaaaatatctgaccttgccaaaaaaataactgttgagttgtga

SEQ ID NO: 1990 - DNA, 1407 bp, Bacillus licheniformis
atgagaaaatggtattttattttatcagcgtgtattttagtttctgttatcatcgcttttgcttacgataagaccggagcaaaagaagcagaaccggctaacagcttgtatgtttcccccgatggaaatgatcaaaatgaaggaacgaaagaaaagccgtttcgaactctgaaacaggcagcaaaaaaggctgtccccggcacaactgtcatgattcgggaaggcacgtatcatgaaacgcttgatgtgagagagagcgggtcggctgaaaagcctatcacatttcaaaactatgagaatgaaaaagtcgtcatcagcggagaatctgttaaggacgcggaatatgaaacaccgctcattcagattcacaatcaacagtacatcacaatcagcggactgacgattcaagacctttccgtttcatcagaagaagcaacagccatgggaatttatgtgtcaggctccagcagtcatattaccatcaaaaacaatcacgtccgggatataaaaacaacagcggatgatggcaatgcccacgggattgccgtttatggctccggcagcatgaaagacattaagatcgaggacaatacggttgaaaagctgacactcggagcgagtgaagcggttgtgctgaacggaaacattgacggtttcacggtgagaggcaatgtggttcgcgacaataacaacatcggaattgatctgatcggatatgaaggaacggccgctcaaaacgattttgtgcgaaacggtatcgtagaaaacaacacggtttacgataactccacttacggaaatcctgcctatggtgatgactattctgcgggcggaatatatgttgacggaggacaaagcattgacattaaggaaaatacggtctacggcaacgatatcggaattgaagcaacgtctgaacataaagggaaatatgctgatgatattcaaataaccgacaacaaagtgtatgagaatgcgtatacgggcatttctatcggcggatacgaccaaaagcggggaggcaccagccattctgtcattgcacacaatattatttaccgcaatgatacaaaggggctggatggcggacagcttttgctccagtatgatacaaaaaacaatacaatcgaaaaaaacatcataacagcaagcgattcgcgaatatttatcgcaaacgattttacgaaaaatgaaggaaataaagtgaatcataacgtgtaccacaaggaatccggcaaagacggactatggatttggaaacagaatgaatacgactcgttttcgccgtatcaaaacgcaacaaatcaagatcaagactcgatttatgccgatccgatgtatcgcgacgagtcatctcatgactttacattagatcctgattcaccggcttggtctgtgattgagtaa

SEQ ID NO: 1991 - DNA, 1284 bp, Bacillus licheniformis
atggcaaaaaaaattcctttttcatttatcctaatcataggattaatgctattcgcattatttttcggtgcaggaaatctcattttcccgcctatgctgggtcagatggccggagagaatgtatggacagccaatgcaggattcttggtgaccggagtcggattgccattgctcgccattacggcattcgttttttcaggaaaaaatgatttgcagtctctggccagtcgtgtgcatccgttgttcggcattgtatttacaacggttctctatttagcaatcggccctttttttgcgattcccagatccggcaatgtgtcgtttgaaataggggttaaaccttttttatcaaatgatgcgggccctgttgccttaatcatatttaccgtattatttttcactgtggcatgcttgctgtccctgaatccaactaaaattatcgatgtaatcggaaaatttctaactcctattaaattaacatttatcggattgctcgttgttacggctattattcatccaatcggaagctttcaagctccgtctgaaggatatgcatcacacgtattttttaaaggattcaaagaaggttactttactcttgatgcccttgtcgcttttgtatttggaatcatcattgtgaacgccatgaaagagaagggagcggcctccaaaaaacagctcataatcgtttgtgcaaaatcgacggcgattgcagcggcgctcttggctctgatctattcagcgctttcatatatgggggcttccagcgttgaaaaactgggtcttttagaaaatggagccgaggttttggcaaaggtttcatcctattatttcggaccatatggttccgtttttttgggcttaatgataactgtagcatgtctgacaacaagtgtgggactcatcacagcatgctcttcgtttttccacggcttgtttccaaacatctcctataaaaaaattgctgtcattctgtcaatgttcagcacccttgtagcaatatagggattaacacagctgattaacgtttcaatgccggttttaacaactttgtatcccattgcgatttctttaatattcttaacatttttacatcctttatttaaagggaagagggaagtgtatcaaggcagtctgatattgacctttatcatcagcctgtttgacggcctgaatgctgccggactcaaaattgcagctattaatcaatttttcaatcagtttctcccgatgtatgacatcggaattaggatgggtgcttccggcgattttaggaaggaatag

SEQ ID NO: 1992 - DNA, 1059 bp, Bacillus licheniformis
atgtgtaatctgcataaaaccatctcaacccgtgtactgagtgctccgagagccaaggcgaaatttgaacagaccacaattgaaagaagggaattacaaccgaatgacgttttaatcgatattaagtacagcggcatttgccattcggatatccatagcgcgtacgatgaatggggaggcggaatcttcccaatggttccgggacatgaaatcgccggcatcgtcaaagcagttgggacaagtgttaaaaaatttgctgtcggcgaccgcgtgggggtcggctgcttcgttgactcttgcggcgaatgtgaatactgccagagcggagaggagcaattttgtacgaaaggcgtgatccaaacgtataactgtttagactacgatggaaatccgacatatggcggttacagccaatacatcgtggttaaagaagattttgttgtccgcattccggacagcctgaacttggatgttgcaagcccgctcttgtgcgcaggcatcaccacgtactctcctttgaagcattggaacgcaggccccggcaagaaagttgccgttgtgggaatggggggactcggccacgtcgccatccaatttgcgcatgccatgggggcagaagtaacggtcttaagccgctctttgaataaacaggaagaagccttgcgttttggcgcagatcattactttgcaactggcgaccctgcagtattcactgagctggccggacgctttgatcttattttaaacacggtgtccgccaatctggacgttgatgcatacttatcgcttcttcgcgccgatggaacacttgttaacgtcggcgcgccggcagaacgggatcagtacagtgtgttttccttaatcatgggccgccgcagcattgcaggttcgcttgtcggcggcattcgggagacacaagagatgcttgatttcgctgctgaacacggcttggctccgcaaattgaggtcatcggagctgaccaagtagatgaagcatatgagcgcgtcctcaaaagcgatgtgcgttatcgattcgtgattgatgtctctactttgtaa

SEQ ID NO: 1993 - DNA, 396 bp, Bacillus licheniformis
atggggtattctataaaagaagttgctgaaaaagtaggtttgcctacacatacactccgatattatgaaaaagaaggtcttctgccttttattaaaagagacgcaaatggaaaccgcatttttgaagaaaaagacttgtcatggttggagcttgtgatatgcttgcggaaaactgacattgcgctttcggaattacgggaaatcgtcaatttaacaaaagaaggagattggaccatctcgaagcgcaaacaaatacttgaaaaacataaagaaaaaatgcttgaaaagcaaagagtcctggaacgcgcctttttaaaaatcgatgagaaaatcatgtactatgatggattagaaaaaaagaatcaggcaatgtccttgaaagcggatgaaaagtaa

SEQ ID NO: 1994 - DNA, 261 bp, Bacillus licheniformis
gtgttagtaacaaaatcaacagttcggctcccccgggggcttcaggccaggcatacgaccctatttgtccgcaaagcgatttcattcaaaagtgaaatcgtactcgctaaaaacgggcagacagcaaacgggaaagatctgatggaaatccttcaattaggagtgcaagaaggggatgagatcacgttaatggtctatggtacggatgagcaagccgcaaaggagactttggaaaaatttcttttgaatgtagtgccataa

SEQ ID NO: 1995 - DNA, 1038 bp, Bacillus licheniformis
atgatgtttttattcatttttatcatcatcttagctgcggctgttttattgttcatcaatttacatcctgtgtttggaggaaatccaagcaaggaacaaaaaaagctgtatcaaagctttgacaattatgccgatggcaaatttcttaatcaaacacaagaaaagatggatatgggcggaatatccggagttttctcaatgatgagagacgctgtttccggcggcaaggagcgcaatccttccgatcaaatccctgtttctgagattgattggaacatcgttaaaagtaacgaagacagcttaacatggtttggacattccgcttttttactgagcatcgaccgcaaaaaaatactcgtagaccctatgctgggtccaattgcttcacccgtatcattcatcggaagcagacgctacagcgaagacatcctgcatacggtcaatgatatgccgccgattgacgccgtcttgattacacatgaccattatgatcacttagattatccatccatcttaaagctgaaggaaaaggccggtcatttcttcgttccttacggaatcagcgcacacttgatccggtggggaattgagaaagaaaaaatcaccgaactcaattggtgggatgaaacggagtttcaaggtttgacaatagccctgacaccgtccaaacacttttcaggcagaggattattgaatcgaaacacgaccctgtggggcggctgggtcatcctcggaaaacatacgcgtttttatacgagcggtgacgggggatatgatgaacactttaaggaaatcggcaaaaaatacggccctttcgatatcacattaatggaaggcggccaatatgacagacgctggtccgggattcatatgacacccgaacaatctgtacaagcccataaagatgtaaaaggaaagaacatgatgttgattcattggggagcctttaccctcgcataccacggctggaaagagccgattgaacgcgcattgaacagccaatactcgcttcccgaaaccttttggtgggatatataa

SEQ ID NO: 1996 - DNA, 453 bp, Bacillus licheniformis
atggagaatatgtatactgacaatatttggttagaggttgacaacatgaacatcggaaaattaagcaagtatttcttgtcactagccattgcccttgcgacgattctgtcctttcatgccgtttctgcaaatgctgcatcagttggtactattaaaccaagcgaatgctcaactcacatcttcaccgtatacgacgaaacagttggcattggcggttccggccgtgcgcatttctattgcggcagtataaatggaggtcctcaaattgaattttcggacgaagatttagaggttgcggtcgatgacccctttattctccatgcatatgctaatccgagcatgaactcggtagactacgaaggacgccaaaagggagatgcggaggtaacgatttattggaaaaacaagccggagggcaccaaatacacatttttattagtgcaaaataaataa

SEQ ID NO: 1997 - DNA, 1062 bp, Bacillus licheniformis
atgtccgatgacgtgctgttttccgtcaatcaaaacggcgccgcagcgattgttctgaatcgcccgaaagcgctcaactcactcacatacgacatggtccgtctgattggtgaaaagttaaacgagtgggagacagatcaaaacgtttctatcgtggtcatcaaaggtgcaggaccaaaaggactatgtgccggaggggatattaaggcactctatgaagctcgttcgtcaaaacaggccctgcaagatgccgagcgcttttttgaaacagagtacgaagtcgatatggcagtccatcgattttcgaaaccgatcatcgcctgcttggacgggatcgtcatggggggaggcgtcggcctgacgtacggggccagccaccggatcgtcacggagaggacaaaatgggcgatgcccgaaatgaatatcggcttctttccggatgtcggggcagcctattttttaaacaaagccccgggccgcttagggcggtatcttggattaacggcgtctgtcatccatgcagccgacgtgctgtatatcaatggggcagacgcctacatggagagcggcgctttagaacgattgcttcaagcagtggaacaaaccgattggcgccttgcaagcgttgaagaaaagctcgatcagctgatccgcgaatcgaaaacggagccctcccaggagagcacgctcgcccgtgatcagcaagcgattgaccgtcattttaagtatgataagctggaagagatccttcaatcgctcgaaagcgagggaagcacctttagctcgaatgtgaaaaaaacaatgctttccaaatcgccattttcattaaaaatcacattgaaacagctggcggacggacgtcaaaaaacactggaagaatgctttgccacggatctggtgctggcaaagaactttttgaagcacaatgatttcttcgaaggcgtcaggtccgtcctgatcgaccgtgatcaatcaccgaactacaagtaccggaacgtttcagatgtaaccgatgaagcggtggaccggtttttccaaccctctgaatctgtccggttttaa

SEQ ID NO: 1998 - DNA, 786 bp, Bacillus licheniformis
ttgaacttgaaatatgccacacttaaaacagaacatggcatcacaaccgtgacgttgaacaatccgccggcaaatacactttcttcttcctgtatcgccgaattgcgctctctttttcgggaattggcccgcgacgaggagacaaaagcaatcatcattactggagaaggccgcttttttgtggcgggagcggatataaaagaattcgtttcaaaacttggggaccaaaaacaaggattggcgctcgcacaagggggccaggcgctctgcgatgaaatcgaagcttccaaaaaacccgtcattgcggcgataaacggaccggctcttggcggaggcctggaactcgcgatgagctgccacttcagaatcgtatcagacgatgcaacagtcggtcttcccgaattaaagctcggcttgattcctgcatttggtggtacacagcggcttcgcaacataacggacacagcgacagcactcgaccttatcctgacgggccgatcgctttcagctcaagaggcggtagagctgaaaattgcacagatggctgtaaagggagaggaactgatgaagacggcagctgctgtcgcgtcgtcttttatcgaaggaaaaagcatgaccagcgtgaggcgcgccgtcgaatgtgtcgtacagggcgccagcgaaagcatggaacaagcactggagagggagcgaaacagattcgccgagctgtttgtcacttcagatgccaaagaaggaattcacgcatttgtcgaaaagcgcaaaccaaactttcatcattcataa

SEQ ID NO: 1999 - DNA, 1455 bp, Bacillus licheniformis
atgatcacaaccaatgcaaaaaaaatgatgaaccatatcgacggggaatgggtcaattctctaggtgcggaatcggaagaagtcgtcaatcctgcaaacggaaacgtcatcgcttatgcgcctctatctgtgagagcggatgtagatcgtgccgtgcaggctgccaagcacgcttatcagacctggtcgcttgtgcccgtccccaatcgggcaaggcttttatacaagtatttacagcttctccaggagcaaaaagaacaattggcagacattattacgacggaaaacggcaaaacgttaaaagacgcccgcggcgaagtgcagcggggaatcgaagttgttgagcttgcgacagccacacctactttaatgatgggagaatccctgcccgcgatagccgggggcatcgacggatcgatttggcgctatcctttgggagtcgtcgccggcattacgccgtttaactttccaatgatggttcccctgtggatgtttccgctcgccatcgcctgcggaaacacgttcgtcctgaaaccttcggaacggactcctattcttgccgggaagcttgttgagctgttctatgaagccgggtttccaaaaggtgtgttaaacctcgtccatggaggaaaggatgttgtaaacggaatattggagaacgatgatattaaagccgtctccttcgttggttcagaaccggtcgcaaaatatgtgtatcaaacgggcacagccaacgggaaacgcgttcaggcgctggccggcgctaaaaaccatgcgattgttatgccggattgccatcttgaaaagactgttcaaggcatcatcggtgcggcattcggcagcagcggggaacgctgtatggcctgctccgttgcggcggtcgttgatgacatcgccgatgacttcatggaaatgctcgtctctgaaacacggaagctgaagacaggagacggcagatccgaggatcactttgtcggcccgctgatccgcgaagtccataaacaacgcgtccttgactatatcgacagcggtataaaagaaggggccgcactcgccgtagacggacgcaatccggatgttcgagaaggatactttgtgggagccacgattttcgatcatgtgacaccagagatgaaaatctggcaggacgaaatctttgcaccggtcttgagcgtcgtccgtgtacaagatcttgacgaggggatcgagctcgccaatcaatccaagtttgccaacggcgctgtcatctacacatcgagcgggaaaagcgcccagcagttccgcgacaaaatcgatgccggaatgatcggcgtcaatgtcaacgtcccggctccgatggcgttcttctccttcgcagggaacaaagcctctttctatggagatcttgggacaaacggaaaggacggcgtccagttttacacgcgtaaaaaggtcgtcaccgaacgctggttctaa

SEQ ID NO: 2000 - DNA, 888 bp, Bacillus licheniformis
ttgaaaaaaatcggatttatcggtttgggcaatatgggtctgccaatgtcgaagaatctgcttcaggagaactttacggtttatggaatggaccttaacaaagaagctgaattggccttgcatcatgcaggaggaacgatcgggatttcagttgaaaaaatggttgaagagtgtgacgccatcctcacaagccttccttcctcaaacgctgcagaggaggtttttctgggaaaaaaagggctcgtacacctggctgaaccgggcgtcctcctgatcgatacaagcacggtcgctcctgaactgaatatccgaattgcggaggaagcgaaaagcaaaggtatcgattttcttgcggcgccggtcagcggcggtgtgatcggggcggtcaaccggacgctgacctttatggtcgggggtccgaagtccgtttttgataaagcgttgcctgttttcaatgcattgggcgagaatatttttcatgtgaacgaaaacatcgacagcggaacgaatacaaagctgatcaacaacctcttaatcggtttttatacagccggcgtcagtgaagccttgcaccttgccaaaaacagcaatctcgacctcgaccaattgtttgagatgctgaacgtcagctatgggcagagccggatctatgagcgcaactataaaagtttcatagcggatgaaaactataaacctggcttttctttgaagctgctgctgaaagaccttggctttgcattggatttggctgagaagaacaacgttgaactgccggtgagcaagattctcttcggcatttacgaagaagccgatcagaacggatacggggaaaaagatatgtctgttttatacaaaaaaataagcgaacagaagacaacttatcagtaa

SEQ ID NO: 2001 - DNA, 1716 bp, Bacillus licheniformis
atggggaaagcaaaacttcgatggaatgaacccttgatttctcaacacgaatcggctgctgaaggatttacaccggaagatttcacagaggaagatcgactgatttcaaaaacgacagaatcatttgtcaaaaacgaagtcatgccccttcttgaatcgattgatcagcaggatcacgaaagcgtgaaaaaattgtttcaaaaagcaggagagctcggtttgctcagtatcgaagttccggaggattgcggcggcctttcactcagcaagaagctttccgggttggtggcagagaaaatgggagccggcggatcgttcagcgtctcctttaatattcatgcgggagtcgggacactgccgtatatttattatggaacagaggaacaaaaacaaaaataccttccaaaactggcatcgggcgaatggatcggagcatatgctctgacagagccgggcgcaggatcggatgctttaaacgcaaaaacgacagccgtcttgaatagggaagggacagcctggattttaaatggggaaaagcagtggattacgaacgcgcaagtagctgatgtatatgttgtctttgcaaaaacggcggaaggcatgacagcatttatcgtcgaacgctcgtttaaaggtgtttccatcggacctgaagagaagaagatgggaatcaaagggtcttcgacagcaaccttaatcttggaggaagtcgaggtgccaagcgacaatgttctaggtcatatcgggaaaggtcatcacgtcgctttgaacattttaaacatggcccgcttaaagctcgcgttttcgaacattggaacggcaaaacaagcattgaaccttgctgttagctacgccaaacagcgaaagcaatttaacaagccgatcatcggtttttcaatgattcaagaaaagattgccgacatggcggtctcgattttcggcgcggaaagcgctgcttacagaacggcagattgcttggacaatgttttagattcggctctcccattagacgatagactgagaaaactcacaaactatgcatccgaatgtgcgatcaataaagtttactgctccgaaatcctcggccggatcgcagacgaagcggtgcagattcatggcggctacggatacatgcaggagtacgaagtcgaacgattgtaccgggacgcgaggatcagccggattttcgaggggacaaatgaaataaaccgcttaacgatcgccaaactgctcatgaaagaagtgcagcaaaacggcatctcagagccggaagctcaactaggcagcgagggaaatcgaaaccggcgatttattcagctgtccaacaggcttttcggcaagacactgaaagcgcttatccgctctcgcgtgaacactcaagaagatcaggaatacgcacggcttctcgccgacatgaaaaaagaaatctatgtgatggaatccgccgcccgccgaaccgaaaaagctaggcaaatatacggtggtgaaaaagcacggttgaaagaaatgatgacgaatgtcatttgtgaagaaggctaccgcagaatcgaagagatggcggtgaccgccttatcaagcatagcatctgatgaagccgaaagaaaactcgcatttgaagaggctcgcagcgtttctttgcctcttttcagcaatctgtttactcaaaaacgcgaaatcgcagaaaaaatagccgctcatgaaaaatatacggtgtga

SEQ ID NO: 2002 - DNA, 954 bp, Bacillus licheniformis
atgactgaaccgttatttttcgagcctgtttttaaagaaagaatatggggcggaacggctttagcctctttcggctatgacattccatccgaacaaacaggggagtgctgggctttcgccgcacatcaaaatggacaaagcgtcgtgaaaaacggcttgtataaagggctcacattaagcgaattatgggatgaacaccgtcatttattcggacatataaagggagaccgctttcctcttttgacaaaaattttggacgccgaccaagacctatccgtacaagtgcatccaaatgatgaatatgcaaagctgcacgaaaacggggagcttggaaagacggaatgctggtatatcattgattgcaaggaagatgcggagatcatttacggccaccatgccaagacgcgggaagaactggtctcaatgatcgaaaacggaaaatggaatgagcttttgcgccgcgtcaaagtgaagccgggagatttcttctatgtgccgagcggaaccgtccatgcgatcggaaaaggcattttgattttggagacgcagcagaattctgacacaacctacagactatatgattatgacagaaaagacgctgaaggaaacctgcgcgagctccatttgcaaaaaagcatagaagtgatcgacgttccgtcttcccctgatcgcgaaaccgttcaatacgaaacatcgggcgacgtcaagactgccgcactgattgattgtccttatttctcagtagaaaaatgggatgtaaaaggatcggcctgtttcaaacaggataaaccgtttcttcttgccagcgtcatagaaggggaagggcgcatcgcatctggcggccataacttttcatttaaaaaaggagatcacatgctgctgccctggggctttggagaatttacgctcgccggccatgcggaatgtatcgtctcaagcttatcaattgaataa

SEQ ID NO: 2003 - DNA, 1944 bp, Bacillus licheniformis
atgaaactgttagcgattacatcatgtccaaacggcattgcccatacgtatatggctgcggaaaatttgcaaaaagcggccgatcgaatgggcgttcaaatgaaagtcgaaacacaaggcggcatcggggtggaaaatgagctgaccgagcaggaaatccgcgaggctgacgcgattattatagccgcagaccgctcggtcaacaaagaccgttttatcggaaaaaaacttctggctgtcggtgttcaggaaggcatccgaaaaccggaagaattaatacaaaaagcgatcggcggcgatatacctgtctatcgttcggctgtgaaaacggaagcctccgctcaaacggagaaaaagcaaaatccgatttacaggcatttaatgaacggtgtatcgtttatggttcctttcattgtcgtcggcggattattgattgcggtcgcattgacgcttggaggcgaaaagacgccgaaagggttagtgatccctgatgattctttttggaaaacgattgagcaaatcggggcagcctcattctcattcatgatcccgattttagccggttacatcgcctacagtatcgccgataaaccggggcttgtgccgggaatgatcggcggatacatcgcagcgacgggaagcttttacggcagcgggagcggtgcagggttcctcggcggcattatcgcgggctttctagccggatatgcggcgctggccatcaaaaaattaaaagtgccaaaagccatacagccgatcatgccgatcatcgtcataccggtggtttcctcgctcattgtaggcttggcgttcgtattgctgatcggcgcgcctgtcgcgcaaatctttgaatcattgacggtttggctggctggtatgcagggctcaagctcgattctgctggcattaattttaggggcgatgatctcatttgatatgggcggccccgtcaataaagtggcattcttgtttggctcggccatgatcggtgaaggcaactatgaaattatgggaccgatcgccgtcgccatttgtattcctccgatcgggcttggaatcgcaacgtttttagggaaaagaaaatttcaggcgcaagaaagagaaatgggaaaagcagcatttacaatgggattattcggcattactgaaggcgccatcccgtttgctgcacaggatccgctccgcgtcataccaagtattatggcgggttcaatgacaggttccgtgatcgccatgatcggtaatgtaggggacagagtcgcccacggcggaccgatcgtagcggtgcttggcgctgtcgatcatgtgttgatgttctttatcgctgttattgccggatccctggttacctctcttttggtcaatgtgctcaaaaaagaggtcacagctgcacccgcagggataagtgaagctgctgcagggaacgacattccccaaccgaacatcgaaatcgaagcggaaagcaaaaaaatcgaaaagccggaaattacaaagctcacagacatcatcgatacagatttgatcgaacctcatttgtcaggagatacgagagacgacattattgatgaaatgatccaaaaattgtcccggaaaggcgtactgcattcagaaagcgaatttaaacaagctatcatcaatcgcgaacttgagggtacaacggcgatcggtatgaatatcgcgatcccgcacgggaagtctgatgccgtcaagaagccgagtgtagcattcggcattaaacgttcgggcgtagactggaggagtcttgacggaactgacgccaaactgatttttatgatcgccgtcccgaaagaaagcggaggaaacgagcatctgaagcttctgcaaatgctctccagaaaactgatggatgacacctaccgggacaagcttctctctgcccaaacaaaagaagaagcatacaaacttctggatgaaatcatctaa

SEQ ID NO: 2004 - DNA, 291 bp, Bacillus licheniformis
atgtataacataaaatcaaacttttctttccctgtgacaacaattgttttagtggtttttgtggctgcttgtttgcattttgacctggttaaacgtaaaaagagcaaagatcagaatgataaaaagtatgagtttatatggtggatcgcaacaattctcatggttctagtgatgactcttaataccgtctttgtaaaaattgaccctaagtataatatcatcgttgtattgattcacattttgtttatggtgattattaagagtagatggaagaaagctaagacagactaa

SEQ ID NO: 2005 - DNA, 171 bp, Bacillus licheniformis
ttggataatcaagttttgcaagcgatctacgaaatgcaaaaggaaatgaaagaagacttcaaaagcgtaaacgagcggttagatacaatcaacaaaacattaacacgcatagaggaaaacgatcctgaaaaagtcatatccatgcttaaactaatcaataagaaacattga

SEQ ID NO: 2006 - DNA, 273 bp, Bacillus licheniformis
atgaattatgatgaagcacaacatctacatattagttacaataaaaagggattagatcttgaagcggtaggattaaaacgcctagatatcgatgtgtgggacgtgtattttaactttcaggatcatgggatagatgagccacctttgagtttttcaaaaatcgatccattcggttgcaatatactttcaataacaagcaaagatttaaagattaatgaggctactcaatacttcgaactttggattaaacatgagttatataaagatctctaa

SEQ ID NO: 2007 - DNA, 1944 bp, Bacillus licheniformis
atgaatacgaggcaaaaagacattctgaatctgttgttatctgaacctgatgactatttagtcgtacaagatttcgcagacagggtaaagtgttctgaaaaaacgatcagaaatgatctgaaaacgattgaagactatctcaatcagcattctgatgctcaattaattcgcaaaccgggattgggcgtttatttgaatattgaagatcaagaaagagtccgtttaagccggcaattatataccgaacatcacgccgcacagcagctacccgatgaagaaagaatgctgcaaatcgcttatcagctattaatgaatccaaagccggtttctgcaaaagaaatggctgccgagcatttcttgaataagtcttccatcaaaagggatttgaataaaattgacgtttggctgaagcggtttggcctcacactggtatccaagcagcgcctcggtttaaagatcgaaggaagtgaaaaaaataagagaaaagcgctggcgcgcatctcggagttgattgacaacccggagtttacaagccgatttattaaaagtaaatttttaagccatgaagtggaatttgttaaaagtgagatcagatcattgcaaaggcggcattctttatatttcactgatgaaacgttcgaaaatttactgttgcatacattgctgatgatccgccgcatcaaaatgaaacagccgatcaccatttcgccgggggaaatcgatgcagtcaaaaagaaaaaagaatttcagtggacgtttgcctgtttaaaacggctggaagctgtttttgcgatccgctttcctgaagaagaggccgtctatttaacattgcatatattaggcggaaaagttcgctacccatttggaaaagaaggggacagcggactggaaaaccctttgcttccaaaggttgtcgaatatttaatcaatcgcgtatcagagttgaaaatgatggatttccgcgaggaccgggttttgatcaatggattgaaagttcaccttaataccgttttaaaccggctgagctatgacctttccgtatcaaatccgatgctcaatgatatcaaaaaaatgtacccttatctgtttcatattgtcattgatgctcttgaagacatcaaccaaacgttttcactttcgattcccgaggaagaagccgcctatctgacattgcatttccaagcggcgatcgagcgcttcagctatggaaaagacaagcataaaaaagcgatcatcgtttgtcatatgggcatcggaatgtcacagctgctgcggacaaaaatcgaacggaaattccaccaaattgccgtgatggactgcatcgcgaaagcagatttggcggactatactgcaagatataaagatatcgagcttgtcatatcaacggtcagcctggaggatttatcaattcctcatattgttgtatcaccgctgctcgagtcggctgatgagaaaaagctcagcgactttatggatcagctcggtgaatcgacccgccaaaaacaaaaaacgtttaaagtgctgaacgacacgactccttttctcgttttcttgcagcaagagtcagaacaccgctacaagctgattgaacagctggcaatcgctttatacgagaaaggctatgtggaaaaagaatatgccgtacacgccgtcttgagagagaaaatgtcggcgacaaacatcggagcgggcatcgcgattccccacgcgaacgccaaattgattaaacaatcagccattgcgatcgccacattaaaggagccgcttgactggggctctgaaaaagtatcgctcgtctttatgctggctgtcaaacatgaggatcaaaacatgacaaaacaattgttccaagagctgtccagcttaagcgagcagccggccttcatccaaaagctgacgaaagaaacaaatgtgatgaagttcttatcttatttggattattaa

SEQ ID NO: 2008 - DNA, 657 bp, Bacillus licheniformis
gtgtatcatctaattaaaaaagatattttaatgcagaaaagggcaatgaagctatcgctgttattgatgatttttttcacttttacattgtcgcagcttgagcttgtcggatatacggtcgctgtattggctgtcacgtaccagctggcattaggcgcaagctccttggaagacaaaaacaacagtgacaaaatcctgatcagcttgcctattaaaagaaacatcatcgtattatcgaaatatgtatcggtttatgtctatgcggcttatgccattctcttctattctttgatcaatgcggtcggacatttgctgcacttgccgcttgatttcccattgacattttcaggagcgatgggtgctgttgtggctgtcactttatttagctcgatctcatttccgctgatttttaagtacggctatttgaagtccaaaatggcgaatatcctcatatttttcttcattatttttggaggaacagccttttttaaatttatagacgcggacgagacccttgcattgagccaaaaattaacggcttttctgagcggaatgtcaaatgcgggtacattcatccttttggttggtgtactgctcgtgatgatctccgtttcatacgcgatatcgctcagcttttataataaaagagaattttaa

SEQ ID NO: 2009 - DNA, 879 bp, Bacillus licheniformis
gtgaccagcatactggaattaaagaatgtaacaaaacactatcaagatttctctttaaaaaacatcaacttctcgcttgagaaaggttatattatgggttttatcggcccgaacggagccggaaaaagcacgaccatcaagctgatcatgaacctgatcaaaaaagacgaagggaacatcagcattttcggtctcgacaatgaaaaacacaatatcgaaatcaagcagagaatcggctttgtatacgatgaaaatcatttttacgaagaactgacaccaaacgaaatgaaaggaatcatcagaccgttttacaaaaagtgggacgaagctgtttttcagcggtacgcaaaagacttccagctccctttaaacaaacagatcaaaaacttgtcaaaagggatgaagatgaaattctcattggcggtcgcgctttcccatcatgccgaattattgatcatggatgaaccgacatcaggactggatccgcttgtcaggtccgagctcctcgacgtgctgcaaacattgctgcaggacgagaacaagtcgattttcttttcgacgcatattacctctgatttagaaaaagtagcggactatattactttcattcataacggccggctcgtgctgagcaagacaaaggatgagctgttggaggagtactgcattgtgaaaggagacctcgatacgctgcgcaaagggaacgaagacgccttaatcggcatcaagaaaaaccgctatggttttgaagcgctctccagagataagcgggaagtcgttcagcatttcggggattccgtcatgatagaaaaacccactttggaagatattttggtattttcaaccggcaggagtgatcatcgtgtatcatctaattaa

SEQ ID NO: 2010 - DNA, 375 bp, Bacillus licheniformis
ttgaatatcatcatttcaaattcatctgatgaaccgatttatttgcagatcgtcaaccaattaaaagatcaaatcgtcaagggagaactctcagagtcagaggcgctcccgtcgatcagaaacctggccaaagagcttaaaatcagcgtaattacaacaaaaagagcctatgacgagctggagagagaagggtttatcgtcacagtcgcgggaaagggctcgtatgtcgcagccattaacaaggacatgctgcgggaaacaaaagtcaaattaatcgaagaacacatagcagaagccgttactgaagcgaaacaaatcggctttacatacgaagaactccaagagatgctcaaactggtttatgaggagtggtaa

SEQ ID NO: 2011 - DNA, 852 bp, Bacillus licheniformis
gtgcagattccttttcatgtcaacttgaaagataaggtggctgtagtgacaggtggaagcggcatcttatgcagcggtttcgctaaagcattagctcaatgcggtgcaaaagtagcagtagtcagccgaagagctgaatcggcagacagagtagcgagagatatccaagaaaacggaggcgaagcacttgccgttacagcaaacgtccttgataaacaaagccttgaacaagcgaaacaactcattaacagaacattcggcagatgcaatatcctcattaacggagcaggcggcaatcatccaatgggaacaacagataaagaatatttatataaaaaagacttgaatactaaagaattgactacgttttttgatttagaaatagagggtgtaaggtctgtattggatttaaactttcttggtacactgttaaccactcaagtatttgcaaaagacatggctgatcacgacggaaatgtgatcgttaacatctcatccatgaacgcctatacgccgctgacgaaaattcccgcctacagcggtgcaaaagcggccgtcagtaactttacacaatggcttgctgtgcatatgtcaaaagtcggaattcgtgtcaatgccattgccccaggcttttttcttaccgcccaaaataggagcctattgctcaatgaagacggaacatatacggagcgagcacaaaaaattatcaaccagacgccgttggatagatttggggttccggaagatctaatcggaacgttattatggttggtaagcgataaagcctcgcgatttgtcactggaaccatcataccggtcgatggaggattctccgcctattctggagtataa

SEQ ID NO: 2012 - DNA, 1107 bp, Bacillus licheniformis
atgttaaataataagagggaagaggatgggggaaccatgcaaatgacgtttcgatggtatggagacagcgacccggtcacattagagtatattcgccaaattcccggcgttactggaattgtttcggccatttatgatattcctgtaggggaagcatggccttatgagaaaattgtagagttaaaagaaaaaattgaaaatcatggtttatcgttaagtgtcattgaaagtgtacctgtccatgaagatattaaattaggtcttccgacaagagatcaatatattgaaaactataaaacgacgatacgcaacttggcaaaagccggtgttaaaatcgtttgttataatttcatgccggtctttgactggacccgttcttctttagactatgcactagaagacggttctacagcattaatttatgaagaagaaaaagttagacaaatgaatccattacatggtgaactaaaacttcccggttgggacacaagctatgaagatggacagctaaagaatctttttcaacaatatcagcacatgacggaagaggatttatgggaaaatctttcgtattttattaaagcggttataccggcggcagaaaatgaacaagtcaaaatggcgattcacccggatgatccgccatggcctatctttggactgcctcgaatcataacgaacaaagagaatttggagcgattgattcatctctatgacagctcctttaacggtttgtgtttatgcagcgggtcactgggtgtgaagtcaacaaatgatattccggaattgattcgttatttcggaaaaaaaggaaaagttaactttgtgcacctgagaaacattaagatcatcggggaaaagtcatttcaagaatcctcccaccgttcagaagacggttctttagatatgtatgaaatcgtaagagcattaagagatatagattttgccggaccagccagaccggatcatggaaggatgatttggggagagaccggaaaaccgggttatggtttatatgaccgggcgcttggtgcagtgtatttaaatggaatgtgggaaacattgacgaaagaaaagaagcggatagccttagaatgcaataaatga

SEQ ID NO: 2013 - DNA, 2409 bp, Bacillus licheniformis
atgtcaattaaagaaacctatatgtttacatttatgaaagaagagaataatgtgctggattttcatttgaatgacggtcatgcacatgcgaaaatattcattcttgaagaagatataattcggattttgctgacggagggagaagcgttaacgcttgaaaaaacgtggagtgtcgcgcctggacagatcgatgtgccatgggagggacgccatcgtttagacatgagcggatttacattgcctcaatacgaattccagcaagtcaaagatgtttttatcgtgaaaaccggcaaggtcaagcttcatgttcaattgaacggctttaggatcagctggttttatcacaatggttctgaatggatcaatgttgcaaacgatcggcaaacacaagggtataattttgaaggggcttttggaaagggcgtgtaccattatttacaacgcgatgtccaggaacaatattttggatttggcgagaaaacgggaaacgtcgataaacacgggaaacgctaccggatgttaaatatcgacgcgatggggtacgacgcagagcggtcagatccgctatacaaacatatcccattctatattacacgtcataagaaaacaggcatctcctatggaatgttctatgataatctatcagcttccatttttgatatgggttcagagcttgataactatcatggactgtaccgctattatcaggccgaaaagggggatttagactactacttcatagccggtccgaaaataaaagatgtagtcgaaacattctcttggctgacaggcaaaacgatcttgccgccaaaatggagcctgggctattcaggctctacgatgagctataccgatgcgccaaatgcacaagaacaattaaaaaatttcgttcgtctttgtgaagaacatgatatgttatgcgattcgtttcagttatcgtcaggatacacatctatcggtgataaacgttatgtctttaactgggatgagatcaaaattcctgctccaaaagagatggtgcaacacttccatgagaagggcgtccgtttatgcgccaacattaaaccgtgtttgctaaaggatcatccgtactttgatgaactacaagaaaaagacatgttcattgtaaacagagaaacacaaaaaccggaaatggcccaattttgggatgatatcggagcttatttagacttcacgaagcgccaaacgttcgactggtggaaggctcaagtaacagaaaagctgttggaatacggaattgattcaacttggaacgataataacgaatttgaaatatggagtcaaaatgccaagtgtcacggcttcggcaaagaagtggaatttgaactgatccgagcgcttcacccgcttttgatgatgaaagcgtctttcgaggcgcagctagaatacaacccggaattacgcccgtacctgatctcaagatccggctgtcccggcatgcaccgttatgcacaaacttggaccggtgacaaccgaacaagctggaaaacattaaaatttaatattaaaactggcatcggtttaagtttatcaggcatttacaatttcggccatgatgtcggcggattttcaggactggcccctgaaccggagctattcgtaagatgggtgcaaaacggtatcatgcatccgagatttaccattcattcgtggaacgatgacgggacagttaatgaaccatggatgtttccagaaacaatcgatgaaatccgtgaactcattaagtttagacataagatcatcccttacatttacaccgcgctatatgaggcgcacgaacattatcagccgatcattcgaccgacattttatgattttgaacatgatgagaaaacatttgaagagaacgatgaatttatacttggtgaatctttgctcgttgcatctgtcgtcgaaaaaggaatgacggagcgggaagtatatttaccgaaccatgaaaaaggctggtatgatttccatacgggaacatggtatgaaggagggaagacagtcgttctgccggcaccattacattatactccgctattagcgaaagcgggagcgatcgttccggtaaatgatgcaaaagtgacattccaaacaaagaaccaagatgaaagaggatttttgttattcccattcaaaggaaaaggaaaatcgacttatcgtttgtatgaagatgatgggttaacaaatgaatatactcatacatttgcctttatacatgtcgatatggagacaacagaagacgggatcaaactttcaatacaaaaggaaggaacatacgagttatcgtatgatcaactcacttttcacgtaccaaatggagaaaagagaaaactgatcgtaaatggcacagaactggaaagcaaaaacggagcgttttcttacagtttgccgtgtgattaa

SEQ ID NO: 2014 - DNA, 1296 bp, Bacillus licheniformis
atggccatagcagccggtctcattttatcggcggtattcttcatattgttgtttctcggcgttccgatttctgtaagtattgcggcggcatccattgtaacaatgcttaccatttttccttttgatgttgccattttcacttcggcgcaaaaaatggtcactggaatcgacagctttgctttattagcggtgccgttcttcattttatcaggcattattatgaataatggcggtattgcaatgcggctcattaacttcgcaaaattgatcagcggcaggctgcccggttctctggcccatacaaatgttgtcggaaacatgttattcggttccatttccggttcgtctgtagctgctgctgctgcaatcggcggggtcatgtcgccgcttcaagaaaaggaaggatatgaccggacttactctgccgcagtaaatattgcttcagcaccaactggtttgcttattccgcctagcggtcttttgatcattttctcattagtcagcggcggaacatctgttgccgctttatttatggcgggctatttgccgggaatcttgtgggggctggctacgatggttgtcgcctgtatgattgcaaaaaagaaaaaataccctgttgcgccaaagattacgattagtcaaggttttaaagtgcttctcgatgcgattccaagcctgttgctcattgtaatcgtaatcgggggtattatcgccggtgtatttacagcaactgaaggagcagcaatagcggtggcttattccttattgttgtcgctcttttataggacattgaaatggaaacagctccccaaaatgctgctggaaacggtagaaatcacagccgttattatgtttttggttgggacatcaacgatgctgtcattggtcatggcgtttacaggcataccgacggcaatcagcaatggaattttagggattacagataacccaattttgatcctgctgatgatgaatatcatcttattaataatcggtacatttatggacatcactccggctgtactaattttcactccaatctttctgccaattgttgaaagctttggcatggatcccgtgcattttggaattatgatcgtatttaacctttgtatcggcaatatcactcctcctgtaggaagtgctctgtttgtaggatgcagcataggtaaagttgatattgaacgagtggttaaaccgattctgccattttatgctgcgatcatgatcgtccttttaattgttacctacattccacaaatcagcttagtgttgcctcaattatttggactttaa

SEQ ID NO: 2015 - DNA, 516 bp, Bacillus licheniformis
atgctagctttaaaaaaagcagtgaataaaacgattgaatgtttgacttgcacactaatggccatcatggttttggttgcgatatggcaagtatttacgcgctatgtactgaattctcccagtacgttttcagaagaatttttacgctattcactgatatggatttctatgttaggcggtgcctatgcattttggaaaaaaaagcacttggcgattgaatttatcgttcgaaaacttccaataaaagcagctgttttcgttcatactttcattcagattcttttgattgcttttgctctgattgtgttggtgttaggaggttcgaaagcagtgatcaccacaatggagcaatcttcagcagcattagggataccggtgggatttgtttatctatcacttcctgttgcaggcatactcatcattggatacagcttggccggtttatatgaatctttacatgaattcaattcaaaacaaaagtcaggtgatgatgtaaaaaaagcagcaaagatgtga

SEQ ID NO: 2016 - DNA, 1002 bp, Bacillus licheniformis
atgagaaatatgctatccgtgttttttgtatgcgctttaatctttggaatgcttacggggtgtaaaagcagcgatgtaataggcgtcgataaaaccgtaacgttacggcttgctcacaaccataatgaggaacaccccatccacaagtctttactcaaattttcaaaagacgtagaaaagaaaaccaatggcaccgttaaagtgcaagtgtatccaaatgctcagctcggttcagaacgtgaagtgattgaattgacacagaccggggctgtcgatctggctaaagtaagtgcaagcgctttagaaagtttttcagaggtctactccatcttcagcttgccttatttatttgacagcaaacatcatttctatgaagccatggacagtgatattgcaaaagaaatgtatgatacaacgaaaaacatagggtttattggattaacctactatgatgcgggattacggaacttttacacaaagaacaaaccgattatgcacccaaatgaccttaaaggtttaaaaattcgggtgcagccgagtgctacagcgattcgaatggtggaactcatgggtggagcacctactccaatggcttatggagaagtatatacagcattgcagtcaagtgtaatcgatggcaccgaaaacaacgaaatggctttaacaagcagcaatcacggggaggtggcaaaagaatattcatactcagaacatgcaatcgttccggatattttgatcatgaatttggacaaaaaggatcaattaagcgaagaacagcagaatgcggtgatcgaagcggcgaaagagtctactgagtatcacaaaatcgtttgggctgaagaaactgaaaatgcggttgagaaagcaaaggaaatgggagtgaagttccacaagccagacaagactccattccgggatgcggtaagcccgcttcatgatgagtttgccaaaaaagaattgatcggaaaatactatagggaaattcgaaagctaaaaaagtaa

SEQ ID NO: 2017 - DNA, 1011 bp, Bacillus licheniformis
atgactgtaaccattaaagacatcgccaatgcttccggagtaagctattcaacagtctcaaaggctttaagaaacagccctcttgtaaaaccggatacaaagaaaaaggtcttgcaagttgccgaacaattagggtatagtccgaattttgcagcgagaagcttggcatctaaaaaaagtcaaacgatcggtcttgtctggcctaccattgaaagaatcgctttatcagcacttgttactaaaataaatgaagtggtcgaaaagaacaactattcaatgattttatctgttaacagagctaaagaggcagtggatttgtttaagagttttcgcgtggatggaattatgatttttgaagaaggcggcgaaactcagcttagtgatgatactggcttaactattcctatcttatcttacggagtgtcaggtgaacatacacatcctattatcgatgtcaatcataaaaaagcaatttacaaagccgttgcgtatctgtatcaacttggccacaaaaacattagctacgtcggcgacctctcccctgccgacaagcgtcaggttgaaaaaagcaaagggtttgaagaggttatgatggaagccggtttgaaattaagtcgaaacagtattttaaatactaatgggttaagctggtataacggttataccgctgcgaaaaaactattacaacaaaccccaaaacctacagcaatcattagcggaagctacgatatcagtgtagggattttacgagccgtaaaggaacaacagctcagtatacccgaagacctatctttaatttcttatgataatatccctcaaatggcaagccttgaaaccccgctgacgagcgtaggggttccaatcgatcaattggctcacaaaatggtcgattctctgctgtctcttattcgcgagccgggctcaataccattaactcaaaaaatggaccctgaattaaacgtaagaatgtcatgcgcttctccagcagttttaggtgaagaaaacaagtaa

SEQ ID NO: 2018 - DNA, 420 bp, Bacillus licheniformis
atgtcaaaaaagaccatctattttttatgcacaggcaactcctgccgcagccaaatggctgaaggctgggcgaagaaacatctcggagacgagtggaacgtctacagtgcagggattgaagcgcacggtttaaacccgaacgcagtcaaagccatgcgagaagcaggcatcgatatttctgagcagacgtccgatatcattgatcccgatatcttacacaacgcagacctcgtcattacgctgtgcggggacgcggctgataaatgcccgatgacaccgccgcacgtcaagcgcgagcattggggttttgacgatcccgccaaagcagaagggacagaagaagaaaaatgggcattctttcagcgtgtacgcgatgaaattggagagcggatcaagcgatttgcggagacaggagaataa

SEQ ID NO: 2019 - DNA, 1296 bp, Bacillus licheniformis
atgacgacagtcttagccactttgatttttctgctgacgctcacgctcgtgatttggcagccgaaaaatctatccatcggctggtcggcctgcggaggagcggtgctggctttaattgccggagtcgtcaattttcaggatgtattagacgtaacgggaatcgtatggaatgcgactttggcatttgttgcgatcatcattatctccctgatccttgatgaaatcggatttttcgagtgggccgccctgcacatggccaaggcagctaaaggaaacggcattcggatgtttgtctatgtcaccctgctgggagccgtagtagccgcgctgtttgccaatgacggagctgctttaattttgacgccgattgtgcttgccatggtacgcgcgttaaattttcaagaaaagctcgtttttccttttattatcgcaagcggatttatcgcggatacaacatcgctgccgcttgttgtcagcaaccttgtcaatattgtctcagcagactttttcaacatcggatttatcgaatatgcaacaagaatgattgttccaaacctgttttcgcttattgcaagcatcatcgtgctttttttgtttttcagaaaaagcattccgcggcattatgacatgacaaatgtaaaacagccagcggaagcgattagagacaggaaaatattccgcttgtcatggctcatattagccgttctgttggccggttactttatcagcgagctgttctcgatccctgtctcgatcatcgcgggcgtgatcgccgtcattttcttaattacagcgaaaaacagccccgcggtgcaaacgaagaaagtgctgaagggagcgccttgggcgatcgttttcttctcaatcgggatgtatgtcgtggtatacggtttgagaaacgccggcttaacagatgttctctcacaggtcatccagaccgtcagcgatcaagggctgtttgccggaacaatgggaatgggctttatcgcagccatcctgtcttcattaatgaacaatatgccgacggtgatgattgatgcgcttgcgattcagaataccgatacacacgggattctcagagaagcgctgatttacgccaatgtcatcggctctgatctcggtccgaaaatcacgccgatcggctccctggcgacgctcttgtggcttcacgtcctttcactgaaaggcgtaaagatttcttggggaacctattttaaaacaggtgtcattttgaccattccaaccctgttcatcacgcttgccggactttatgtgtggctgctgatcatccattaa

SEQ ID NO: 2020 - DNA, 348 bp, Bacillus licheniformis
atgtccgtacaaacaaagcttgattcgaaaagcacggtgagctgcatgaagatattgagcgattctacccgactcttaattctgaaactgcttcaggagaaaccatattgcgtctgccagcttgtcgatatgtttgaaacaagccagcccgcaatcagccagcatttgcgaaagctgaaaagcgcaaatatgatcaaggaacagagaagggaacaatggcgtttttattcgcttcatgacgactttccggaacgcgaattggtccttgccgttctcaatcagatcgatgcacacgacgaggttcttcaaaccgttaaaagaaaagaaagacccgtttcgtgcagttaa

SEQ ID NO: 2021 - DNA, 594 bp, Bacillus licheniformis
atgacaaatagcagaacgaatccaaaggttgatgaatttttaagcaaagccgaaaagtggaaggaagaatttaagaagctccgtcaaatcgtacttgaatgtgagctgaacgaagatttcaagtggaagcatccttgttatacgttcgagaataaaaacatcgttttaatccatggatttaaggaatattgtgcgcttttgtttcataaaggcgcattgttaaaggaccccaacgggattcttatccagcaaacggagaatgtacaagccgcgcggcaggttcgattcaccaatgtacaagaaatagctgaaatggagaccattttgaaagcttatataaatgaggccattgatgtagaaaaagccggcctgcaagtggattttaaacaggctgcagaatatacaattccagaagaacttcaaaaaaaattcgctgaaatcccagctttaaaagcggcttttgaagcattgacgccgggccggcaaagagcatatattctttatttttccaaaccaaaacaatccaaaaccagagagtcgcggattgaaaaatatactcagcaaattctcgatggaaagggattgaatgactag

SEQ ID NO: 2022 - DNA, 756 bp, Bacillus licheniformis
atgcttagcaaaagaagaggcgggatgattatgaaatttagcatcatgacgtttaatatccatcatggaaaaggaagggaccgccgcgttgatttaggtagaacagccggtgtgatcgctcaaagcggctgcgacatcatcggcctgaatgaagtggatcggcatttctcaaatagaagcgattacgaagaccaaatcggccggcttgcagaacaattgaacatgcactatgcgtactgcccctccctttcattgagttccggcgattcttctgagaaaaggcaatacgggaacgctctattaacgcgttttccgattaagaaagaacggcatcattcattcaattttgtcaaagggctgatcgaaggaaggtctcttcttgaggctgatgtccggatcggtgaccggctctttcgcgtttttgttacgcatttgagcctgaatccgtggcttcacggcaagcagacggattttttaatcgagaaggttcaagagagcgatctgcctgtgatcgtcacgggagactttaatatgaaaccttattcacggggatggaaaaaggtcgcggaaaaactggccgacctgtgggatgaaagtcaatacggacaggggttcacccacccttcccaccgcccgagacggcggttggactacatctttctcagtccgtcttttcatgtgtcagcggctgaaattgtcgccgttgatccgaacgcttccgaccatctgccgcttaagggcagcatcacatattaa

SEQ ID NO: 2023 - DNA, 858 bp, Bacillus licheniformis
atggacattttcttagcgattttaccagcgattttctggggaagcatcgtgctctttaatgtaaagcttgggggcggaccgtacagccaggtgctcggcacaacattcggcgctttaattttttcaatcggaatctacttcgtcgtccagcctgaattatccccccggatatttgccgtcggcgtcgtttccggactattttgggcgctcggccagaccaatcagctgaaaagcatcgatctgatcggcgtgtctaaaacgatgccgatctcaacagggcttcagctcgtatccacttctctgtttggggtgcttgttttccatgagtgggcgacgacaatctcgatcgttctcggcgttctggcgctgatttttatcatcgtgggaatcgtgctgacatcgctggaagaccgcagccaaaaaacagaggaaaaaaccggcgacatgaaaaaaggaatcgtgattttgctgatttcaacattcggctatctcgtgtatgtcgtcgtcgtccggctttttgatgtcagcggctgggcggctctttttcctcaggctgtcggcatggttgccggcggtttgatcttgacattcaggcataagccgtttaatttttacgtcatcaaaaatatcattcctggtttaatctgggcagcgggaaacatgtttttattcatctcccagccgcgggtcggcgtagcgaccagtttttcgctatcacagatggggatcgtcatctcaacgctcggcggcattattctgctcggcgaaaagaaaacaaagcggcagctgatcggtatcgccatcggcatcatactgatcgtcgcagccggcgttttgctgggcatcgcaaaagcttaa

SEQ ID NO: 2024 - DNA, 1188 bp, Bacillus licheniformis
atgaaagaaaagagcgcaggctgcgaaactaaagaattccgggcagtgtggatcgccaccgtcacaaatattgactggccttcaaaaaaaggactgacaatcgaagagcaaaaaacggagtatgtgaagcttttggatgatgtgacagcaatggggatgaacgcggtcgtcgttcaaattaagccggcggcggatgctttttatccttccgcatacgggccgtggtcggaatacttaacagggattcaaggaaaagaccctggatacgatccgctggcatttttgctcgaagaaacccaccggagaaagcttgaatttcatgcatggttcaacccttatcggatcacgatgaatcataccgatttgaacaggctgtcacaggatcacccggccagaacgcaccccgactgggtcgttgcctacggcagacagctgtattacaatcccggcatccctgaggcccaggaattcattgtccaaggcatagcggaagtcgtcaagaattacccggtcgacgccgttcatatggatgactatttttatccgtataaaattgcgggagtcgaatttcccgacttgagcacatatgaacaatatggaaaagaccgtttttcaaatattgaagattggcgaagggacaacgtcaaccagcttgtcaaacaaatcaatgatgccgtcaaaaaagagagggcctcagtcaaatttggaatcagcccctttggtgtatggcgaaatatagcagatgatccgacgggatcgaatacagccgccggaatgacaaactatgacgacctttacgctgacacgagggaatggatcagacagggatacatcgattacatcgccccgcaaatctactggagcatcggctttgccccagcttcctacgacatcttagtggactggtggaaaaatgaagtcagccatcgccccgttcatttatacattggacaagcagcctataaaatcaatcaaaactcagatcccgcctggtcagaccctgaagaatatccgcggcagatcgcattaaaccgcgcctcaaatgtgatgggaagcatccatttcagcctgaaagatttaaaccggaatccgctcggcattaaagacagactgatccaggacttgtacaaaaaaccggcagctgttcccgatatgccttggcttggcagcgtaaacagtgaaaactga

SEQ ID NO: 2025 - DNA, 1203 bp, Bacillus licheniformis
atgtatcatttgtatactcacaacgacttggacggagtcggctgcggaattctcgcaaaagtggcttttggcgaacgggtcgaggtccgctacaattcggtcaccggactcgacatgcaagtcgggcgttttttggagcggacaaaaggcaaagaaaaacagcatgaaggcctgtttatcacggacttgtccgttcatcaagaaaatgaggaaaggctggaccaatatgcggaagcggggggaaaggtcaaactgatcgaccaccataaaactgcgcttcatttgaatgaacgcccttggggcatgataaaagttcaatatgaggatggcaggctcgcttcagcgacttctcttttctatgaatacttaatagacaacggccacattcgagagacaaaagcgatggatcagttcgtcgaactcgtacgcctctatgatacatgggaatgggaacagacgggcgctctcgaagcgaaacgcctgaatgacctgttttttatggtatccatcgacgaatttgaggaaaaaatgatccggcgccttaaagaaagcgacgcgttttcatttgatgaattcgaagaaaaaatcttggatatggaagaagaaaaaattgaacggtatatccgcaggaaacggcgggaaatcgttcaaaccttcattaatgcgcactgcgtcggcatcgtgcatgccgaatcctatcattcagaggtggggaacgaactcgggaaaacgtatccgcacctagactatatcgccatcttaaatatgggcggcaaaaaagtgagccttcgcaccatccatgatgaaacagatgtatcagaaatcgccggcacgttcggcggaggcggccatgccaaggcagcggggtgcccgctgacagatgaagcgttcaagctgtatgtaactgaaccgtttccgctggagcccttgagagcagatgcctttaaaaacgtctataatgtaaaaaagtccgactacggcagcctttatgtcaacagggacgaggaccagttttttctctttcctagcgcaaatggctggaacattcaattaaacggcgtggctcagcatgagacattcacttcattcgaagaggcagagcggttcattaaaagaaattacgctgcatggctcgcgagggatgaagcatttgtccaatatttgatgcagcaggtgaaactggcgattcaaacgacaggctaa

SEQ ID NO: 2026 - DNA, 759 bp, Bacillus licheniformis
atggatggaaatattcattcgatcgaaacattcggcaccgttgacggtccaggcatcaggtatgtcgtcttcacacaaggctgcctgatgcgctgtcaattttgccataatgctgatacttgggaaatcggaaccggaaaacaaatgacggtttccgaaatcgttcaggatgtccagcattatctcccgtttattcaatcatcgggcggaggcatcaccgtgagcggaggcgagccgcttttacaactgccgtttttaatcgagctgttcaaagcatgcaaaagcctcggcattcacacggcactcgattcgtccggcggatgctattcggctgcgccggcatttcaagagcagatcaaagaactgatccagtatacagaccttgttttgcttgacctcaagcatcacaacagaaaaaaacatatcaacctgacaggaatgccgaatgaccacattttagaatttgcccggtttctcgctgaacatcaagttcccgtctggatccgccacgtactggttccggggatctccgatatcgatgccgatttaacggccctcggcacgtttatcggcacgcttgcgaacgttcagaaggtggaggttcttccttatcacaagctcggcgtctacaaatgggaagcgcttggcctggattatccgttaaaaggggttgaaccgccaagtgccgacagggccgaaaatgcgtacagactgctcaccgcacacttgcaaggcggatccttgctgcaagagacataa

SEQ ID NO: 2027 - DNA, 2226 bp, Bacillus licheniformis
atggaacaatggaaaggtttcaccacaaacgtttggcaaaaagaagtcaatgtccgcgattttattctctcgaactttgagccatatcaaggtgacgaatcgtttctcgaacctccgacggaagctacatcggcattatgggatcatgtaatggatttgacaaaaaaagagcgtgaaaacggaggcgtccttgatatggatacagagatcgtctcaacgatcacctcgcacggtcccggatatttgaacaaagacctggaaaaagtcgtcggcgttcaaaccgatgagccgtttaaacggtcgcttcagcctttcggcggcatccgaatggcaaagcaggcatgcgaatcctatggttttaaactgaatgaagaagtggaaaggatctttaccgattaccgcaaaactcataaccaaggcgtgtttgacgcatatacggacgaaatgaagctcgcccgaaaagtcggaatcattaccggactgcctgatgcttacgggcgcgggcgcatcatcggtgattaccggagagtggcgctttacggcgtggatttcttgatcgatgaaaagaaaaaagatgcggccggcacctctcgggtgatgtctgaagaaaacatccgccttcgtgaagaactgtcagaacaaatccgagcattgaacgaacttaaagcgcttgcaaaaagctatgggtttgacatttccaagcctgcggcgaatgcaagagaagcatttcaatggctgtattttgcctatttggctgccattaaagagcaaaacggagcagcaatgagccttggccgcgtgtccacgttccttgatatttacatcgaaagagatttgaaaacgggcgtattaacagagcgtgaagcccaagagcttgtcgaccatttcgtcatgaagctgcgtttggtcaaattcgcgcgcacacctgactacaatgaactgttcagcggcgatccgacgtgggtgacagaatcaatcggcggaatggcgcacgacggacgcgccctggtgacgaaaaactcgttccgtttcctgcatacgcttgacaatttaggcccggcgcctgaaccgaatttaaccgttctttggtctgtcagactgccgcaaaagtttaaaaactactgtgccaaaatgtcgattaaaacaagctcgatccaatacgaaaatgacgatatcatgcgtccagaatacggtgatgactacggaatcgcctgctgtgtatcggcaatggcaatcggcaaacaaatgcagttcttcggagcacgcgccaacttggcgaaagctcttttatatgcgattaacggcggaaaagacgaaaagcataaaatgcaagtcggtccggaaatgccgccggttgcttccgacgtgctggactatgacgaagtgatgcataaattcgatcagacgatggaatggctcgcaggcttgtacatcaacacgctcaatgtcattcactacatgcatgataaatattgctatgaaagaattgaaatggccctgcacgacacggaaattttgcggacgatggccactgggatcgccggcttgagtgttgtcgccgattcattaagcgctgtcaaatatgccaaagtcagcgtggtccgcgatgaaaacggcattgcggtcgattttgaaacagaaggcgactttcctaagtacggaaataacgatgaccgcgtcgacgcgatcgccgttgacattgtcaagcgctttatgaaaaaactgcgcaagcatcagacatatcgccagtccgttcagaccatgtcaattttaacgatcacgtcaaacgtcgtttacggcaagaaaaccggaaatacgccggatggacgccgcgcgggagaaccgtttgctccaggtgcgaatccgatgcacggccgcgatactaaagggacgcttgcatcgctgtcttcagtggcaaagctgccttacagctatgcgctcgacggcatttccaacaccttttcaatcgtcccgaaagcgcttggcaaagacgaagagagccgcgccgccaatttgtcaagcatccttgacggatatgccgcaaaaacaggacatcacttaaatgtaaacgtatttaacagagagacactgctcgacgccatggaacatccagaggaatatccgcagttaacgattcgcgtctcaggctatgcggtcaactttattaagctgacgaaagaacagcagttagacgtcatcagcagaaccttccatgaatcgatgtag

SEQ ID NO: 2028 - DNA, 1470 bp, Bacillus licheniformis
atgaagaaacatatgaagctttgtctgtgtatgatgatgatctttgtattgactttggccggcagcatggacggcttgggcgctgaggaaaaaggcgggctcaaagagcaaatcgatcagctgttaaagaccgaacctgatttaaaaggagcgctcgcaggcatcagcgtcaggtctgcggaaagcgggaaaatgatatacggacatatgggcgatacacggatgagacctgcgtccaatctgaagcttttaacggcagcagctgcctattccgtcctgggcgaggactatacctttcccacagaggtaatggctgatggggcgcgagccgcgggcacactcaaaggcagcctttatataaaaggaaaaggcgatccgacgcttttgacagcggactttcagcaaatggccaaagcactccgaaaacaagggatcacagttatccggggagacttggtcggcgatgattcctggtacgatgaaatccgctattctcaagacctttcctggaccgatgaagacgcatactatggagcgcagatttcagctttaactgtttcgccaaatgaagactatgatgccggaacggtcataatcgacgtgaaccctgccggaaaaaccggaaaaaaacctgctgtattgctcaccccgcaaacaaaccatgtcaaaatcaaaaacgatgccaagactgttgctgccgacggaaaaaaagatatcacgattaaaaggaaacacggaggaaataccatccaaatcaaagggacgattccacaaggcgcttcaagggtcagacaatgggttgcggtttgggagccgtcagaatatgcactcgatttatttaaacaggctttacatcaacaaggcattcgaatcctgggaaagactaaaatcggcaaagcgccaaaaacagcgcaccgcatcaccacacatcaatccatgccgctgtcagagctgatgattccctttatgaagctcagcaacaacggccatggcgaaacgctgatcaaggaaatgggaagggccgcgagacgtgaaggaagctgggatcaagggctagaggtgttaaatacggaactgcagagatttggactggacacggaaaaaatcgttctcagagacggctcaggcatctcgcatatcaatttgatttctgcacatcagatcacaaagctattgtattccgttcaagacgagaaatggtttccgtcgtttgcccgttcactcccagttgcaggtgaaagcgacagaatggtcggcggcacattaagaaaccggctgaaagacccggctctaaaaggaaaagtcagggcgaaaactggctctctttcaaccgtcagttccttgtcgggctatgtcgatactgcaagcggaaagacattgattttctccattctcctcaatcagctcgtggatgatgagaaaggaaaggatattgaagacaaaatcgttcaaatattagcttcttcatga

SEQ ID NO: 2029 - DNA, 1179 bp, Bacillus licheniformis
atgtcaaaacatatcgtcattttaggcgctggttacggcggattactgtctgctctaacagttcgcaaacactacacaaaagaagaagcaaaagtcacagtggttaaccaatatccgacacatcaaatcatcacggaattgcaccgccttgctgcgggcaacgtgtcagaacaggcagttgcgatgccgcttgcaaagcttttcaaaggaaaagacatcgatcttaaaatcgccaaagtcaactctttctcagttgacaaaaaagaagtcgctctttctgacggctctaccctgacatatgacgcacttgtcgtcggtcttggttctgtcactgcttacttcggcattccgggacttgaagaaaacagcatggtgctcaaatctgcaaacgatgcaaacaaaatcttcaagcatgttgaagagcgcgtgcgcgaatacgcgaaaacgaaaaacgaagctgatgctacgatcttaatcggcggcggcggactaacaggcgtcgagcttgtcggtgaactcgccgatatcatgccgagccttgcgagaagctacggtgtcgatccgacagaaatcaagctgaagcttgttgaagccggtccgaaaatcctgccggttcttccggatgagctgatcgaacgtgcgacaaagagccttgaaaaacgcggcgttgaattcttgacaggactgcctgtcacaaatgtagaaggaaacgttgttgatttgaaagacggacaaaaaattgttacaaatacatttgtctggaccggcggtgttcaaggcaatccgctgatcggcgaatcaggtcttgaagtcaaccgcggacgcgcaactgtaaacgacttccttcaatctacatcacatgaagacgtgtttgttgcaggggacagcgccgttgtcttcggtccggatggccgtccgtaccctccgacagctcaaatcgcatggcaaatgggcgagctgatcggctacaacctgtatgcatacttagaaaacaaatcaatggcgacgttcagccctgtcaactcaggtacgcttgcaagcctgggccgcaaagacgcagttgccgttatcggcgcgaacagcacatctcttaaaggcctgcctgcttcattgatgaaagaagcgagcaacgtccgctacctgagccacataaaaggtctgttcagcctggcttattaa

SEQ ID NO: 2030 - DNA, 435 bp, Bacillus licheniformis
atgccggaaacaatcgatcaaacagctgatcaaacaaacgaatctgtaagccaaagccaacgcgatcttatcgatcaactgctaaaacctgaagtacaggagtctttgactgttttagtcgaccagcttccaaagctgacagaactggtcaacattttgacaaagtcttacgacttcgcacaatccgttgcaactgatgaagtattaaaaaatgatacggtcggtgccattacagaaattcttgagcctgtcaaagatacggcaaaagaaatcgcggctaccgccattgaagcaaaagaccgcgctgacgaaagcaatgaagtcatcggacttttcggtttgctgaaaatgcttaaagatccgcaggcccaaaagctgttccgatttgttcaaagctacctgcaaatcatgtcagaacgcgaaaaacaaaaataa

SEQ ID NO: 2031 - DNA, 324 bp, Bacillus licheniformis
atgaaagaagccctatatataaagttttctatgattttatttcatttccgaaacaatcacgttcattttttgttcaaaaagtgttatcatttagtagtaaaaaatacagcgtgttttgagattgcgggttttcgggagttccagaccgaaaacagcaaaacaaacacaaaaggggagagcctttttgcggacttgtttgtgcataaattcacaaactataaaaaggggcttccttcaaaaaacagcacatcgcttattgaaaaggagaattggttatgccggaaacaatcgatcaaacagctgatcaaacaaacgaatctgtaa

SEQ ID NO: 2032 - DNA, 231 bp, Bacillus licheniformis
atgtacttgacgataaaggaaaccgcagaatatttaacgctttcagaagcatatgttgaacagcttgtcagagaaaagaaaatccgcaccgtctttgacggacagcagcatttaatcaacaaagagcaattcaatacgcacatggaacagatggaaaagtataaagagtgggcggaatccgttctgaacgagcccatccccgaagatccggacgtcaaagatgaagattaa

SEQ ID NO: 2033 - DNA, 225 bp, Bacillus licheniformis
atgtattcaaaatggaattctgaaacgtcttatccgccttcagccccgcaaatgcataccggtcaatcttcgcagcagatgaaccaaaggctgaaaaatctcgaagatcaaatggaattgctcatcaagctcatggaaagcaacaatcagctgctgcgttcgattgaagagcagcagaatcgcgtctgcacggccggcggcggttcggttatcgtcaggatgtga

SEQ ID NO: 2034 - DNA, 1953 bp, Bacillus licheniformis
atgggcgaaaaagcggtttggcagcctgatccggaatttgtaaaaacaacccggctgtttcaatggatgacagccctcggtttttccgactatgatgattttttgaaagcaagtacaaacgatatcgcctggttctgggaagaggccgaaaaagcgctcgggatcagctggtacaagcggtacagccaaacattgaatctcgacaaaggcataaaatggccgcaatggtttaccggcggccgcttaaatgccgtttacaacgccgtggaaaaatgggcccgccggcctgatacggccggcaggacggcactcatctgggaaagtgaagacggaaaaacagaacagatcacctattcttctttacaccaacaagtcgcccgtgcggcggcaggctttaaaaagcaaggcatctcaaaaggggatgtcattgcgatttacatgccgatgatccccgaaacggtcatcgccatgctggccgccgctaaaatcggagcggtattctcaccggttttttcaggctacggcgcccatgcagcagcggcgagacttaccgctgccggagcgaaaatccttgtcacagcagatgcctttttgcgaaggggaaagaaggtctgcatgaagaaagaagctgacaaagccgcggaccgttcccccactgttcaaaaagtcgtcgtctgcaagcttcacggcggcgatcaagattggaattataagagagatatcgactggaatgaattgatgaaaaacgagcccatgcaaaacaccgaagaaatggacagttcagatccgctcatgctgctatacacatcagggacgacaggacagtcgaagggagcggttcatacccatgccggttttccgctgaaagctgcatttgatgcgggattcgggatggatgtcaaacaaggggacacatttttctggtttacagacatgggctggatgatggggccgtttttaatattcgggggcctcataaacggagcggctgttttgctgtttgacggagcaccggactacccggccccggatcggctgtgggagcttgtcagcagacaccgggtgacgcatctcggcgtctctccgacgctcattcgctcgctgatgcagcacggcgaagattttctctatcaatacaatctgaacagtctgaaggcaatcggctcaacgggcgaaccatggaattatgagccgtggatgtggctgttccgccatgttggaaaagaacggattcctatatttaattattcaggaggaacagagatctcaggcggaattttaggcaatgtgctcctgcggccgatcacgccgatgacgtttaattcgcctcttcccggcatggcggccaatgtcttcaatgaaaaaggagaggaagtcgtcaatgaagtcggagagcttgtcctgacaaagccctgggtcggcatgacgaacggtttttggaaggagccgtcaagatacgaagaagcatattggagccgctggaccgacgtctgggtgcacggcgattgggcaaaacgggatgaaaacggctactggacgatcagcggacgctctgatgatgtgatcaatgctgccgggaaaaggatcggccccgccgaaatagagtccgttctggtcggccatccagcggtggcggaagcaggcgtcatcggcgttccggataagctcaaaggccaggctgccgtctgcttcgtcgtcctcagacagtcggaaaagccgtcggaagaattaaaagatgatttgctgaaccttgcatctgatgcgatcggtaaagcggtcaagcccaaagcggtttattttgtcagcggtttgccgaagacgagaaatgcaaaagtgatgagacggctgatcagagctgcctatatgaacgagcccgcaggcgatttgtcaactttggaaaaccgcgaaacatatgatgaaattgccggtctttcagtgcgaaaaaatctgtag

SEQ ID NO: 2035 - DNA, 1530 bp, Bacillus licheniformis
atgccggccgaaaaggaattgtatgaacgcatccgccggattcaggagggcggcgcggagaaataccatgaagctaataagaaaaaagggaaattatttgtcagagaccgattaaagctgctgcttgacgaaggactcgacctagaggacgcgttttttgccaattgcatggctgacgggctaccggcagatggagtcgtcactggaatcggaaaaatcggcgggcgaaccgtttgcgtcatggccaatgattcaactgtcaaagcaggatcatggggagcgagaaccgttgaaaaaatcatccgcatccaggaaacagccgaaaaactgaattgcccgcttctttatttggtcgattcggcaggcgcaaggattacggatcaagttgacatgtttccggggcgaagaggagcggggcggattttttatcagcaagtcaaattatccgggcgcatcccgcaaatctgtctcttgttcgggccttcagcggcaggaggcgcctacataccggctttttgcgacatcgtcattatggtcgaaggtaacgcctcgatgtatttaggctcgccgcgcatggcggaaatggtgatcggcgaaaaagtatcgcttgaagaaatgggcggcgcgagaatgcactgttctgtttcaggctgcggagacattcttgccgacacggaagaagatgcgatcaagtcggcgcgccggtatctttcctactttccgtcgaactacaccgaaaaagcgcctgtcattgaagcaaaatccgcccgtccgtttgaccggtcattggaggacatcattccgaaaaaccaaaacgctccgtttcagatgatggatttaatcgatcggatcattgatgaagcgtctttttatgagatcaaaaaattgttcgcgccagagctgattaccggtttggcaaggattcacgggcagcctgtcggcatcattgccaatcagccgcgggtcaaaggcggtgttttgttccacgattcggcagacaaggccgcaaagtttatcaatttgtgtgatgcctatcatatcccgctgctgtttctggctgacatccccggttttatgatcggaacgaaagtcgagagggcgggtatcatcagacacggtgcgaaaatgatttcagcgatggccgaagcaaccgtaccgaaaatatccgtcatcgtcaggaaagcttatggtgcaggcttgtatgcgatggccggtccggcctttgaacctgactgctgtctggcgctgccgacggcgcaaattgccgtcatgggcccggaagcagcggtaaatgccgtttacgctaaaaaaatcgcagaattgcctgaagaagaacggtccgcattcatcgccgaaaaacggaaagagtaccaaaaagacatagacatttaccggcttgcttcagaaatgattgtcgacgggatcattccggccgactcgctgcgaacggaactcatcaaacggctgaatgcatatatgaccaaatacatgacatttacggaacggaagcatcctgtttatcccgtctaa

SEQ ID NO: 2036 - DNA, 783 bp, Bacillus licheniformis
atggagcccaatgttctttattccataaacgagcagtcggtcgccgtgttgacgctgaacaggccgcaggctgcaaatgccctctcgcttgggcttctcgacgactttcagcgcatccttcgagatattcgttcaaacccggccgtccgctgtgtcatcataacgggaaaaggggacaggacgttttgtgcaggcgccgatttaaaggaaagagcccgcatgagccaaacagaagcgaagcaggctgtttccctgattcaacgcgtggtcagcgaaacggaaaaactgccgcagcccgtcatcgcttcattaaacggaagcgctttaggaggggggctggagcttgcattggcgtgcgacatcaggatcgcagccgaacatattgaactcggcctccccgaaacaacgctcgcaatcattccaggggcaggagggacacagcggctgccccgcttgatcggcaggggaaaggcgaaagaaatgatctttaccggctgccgcatcagcgccgaagaagcgcaaaagatcagcctggttgaacatgtcgttccgctttcgaagttaaaggaagcgagtgaaagcatcgcggcgaacatcgcggcgaacggaccggtagccgtcagacaagcgaagtttgccatcaatcaaggccttgagacagctatcgaaacagggcttgccattgaacaaaaagcctatgaactgacgattccgacgaaagacaggacagaagggctgaaagcttttgcagaaaagcggaagccggattatacgggagaataa

SEQ ID NO: 2037 - DNA, 912 bp, Bacillus licheniformis
atggacgtaccgaagaacattttcattaaagaagtcgggccgcgcgacggtctgcaaaatgaacaaaccgcactttcgacagctgataaaattacctggatcgacatgctttctgccacagggctttcgtatatcgaaatcacttcattcgtccatcctaagtggattcctgcactgtctgatgcccttgatgtcgccaaagggatcaaccggaagccgggcgtcacctacgcagccctgattccgaaccgaaaagggctggaacgggctctcgaaggagggatcgatgaagcttctgttttcatgtcggcaagcgagacacacaaccggaaaaatattaacaaatcgatcggggaaacgcttcccgtcctgaaggaagtcatcggagcggcaaaacaagcgggcctcaccgccagagcatacctgtccacagtatttggctgtccttatgaacatcacgtgccattggaacaaattatacggacatctgaaacgctgttcgacatggggatcaacgaactttccctcggagatacgatcggcgcagcaaatcccgtacaggttcaaagggtgcttgaagtcctcttaaagcgctttccaaaagagaatatcgcccttcattttcatgatacgagagggatggcgctcgccaacatgatcgcagcgatggacatgggaatcaccgtatttgactcatcatgcggcgggctgggcggctgtccttacgcaccgggagccacggggaatgcggcaactgatgatttgatctacatgtgcgcccagatgggcatcgaaaccggagttgatctcagcaagctgctttcagctgctaaatggatcgaagacaaaaccggaagagagctgccaagccgaaatttgcaggcggctaaatcaaagaactgttttcattga

SEQ ID NO: 2038 - DNA, 213 bp, Bacillus licheniformis
atgaatactgttgtcaccaatatggcaggaaacgtgtggaaaatattagtgaaagcgggggacaaaatcgaaaaggggcaggaagtcgccattttagaatcgatgaagatggagattccgattgtcgccgaaacggccggaacagtcaaaaccgtcagaaagaacgaaggtgattttgccgatgaaggggatgtcttattggagcttcaataa

SEQ ID NO: 2039 - DNA, 1341 bp, Bacillus licheniformis
ttgtttaagaaagtactgattgccaaccggggagaaatcgccctccggatcatccgaacttgtcaacggctcggtattcagacggctgctgtctactctgaagcggatgcggagtccctgcatgtcaaagctgcggatgaagcctggctgatcggcaaaccgcgggtcagtgaaagctatttaaatattgaaaaaatcatcgaaaccgctaaaaaagcgggggtctgtgccattcatccgggatacggcctgctttccgagaacagccgttttgccgaaaggtgcctcaaggagaatattacgtttatcggtccgccgcctgacgttatcgccaaaatgggaagcaaaattgaagcaagacaagcgatggaacaagccggggttcccgtcgttcccggcgtgacaaaaagcttgtccggtctgaatgaagcccgggctcttgccgaatccatcggctatcccgtgatgctcaaggcttcttttgggggcggcggcatcggaatgcagctgatccgcaatgaaagcgaattagaaaaagcatatgaaggcaaccaaaaacgagccgccgattttttcggagacggggctatgtacatcgagaaatatatcgaacaggcaagacatatcgagattcagattttaacagacaaatacgaaaatgccgtctatctttgggagcgggactgttcgattcagagacgccagcaaaaaatcatcgaagaagcacctgctccgttattcgatgaaaccatgcgcacaaagctcggtgaagcggccgtgaaagctgcgctgtcgatcggctatgtcaacgccgggacaatcgagtttttagtagacaaggagaatcatttttattttcttgagatgaatacccgcctgcaagtcgaacacccggtgacagaggaaattacagggcttgaccttgtcgaagaacagctcaatatcgcagcgggaaaaccgctttcccataagcagaaagacattcggcgggacggacatgcgatcgaagtcagaatctgtgccgaagatccgaaaacatttttcccttcgccggggcggattaccgaccttaagctgcctgagcaaccgaatgtccgtcatgaatgcgcagcagccccgggtatgactatcaccccgtattacgacccgatgattgccaagatgatcgtcaaaggaagcagcagagaagaagccatctgcacattggccgaagcgctttcacaatatcaagtgaaaggcattaaaacgaacattccgctccttgaagacattgtaagttctgacgaattccgaaaaggcggggtccaaaccgattttatcagtcgctatcagtcaaaatga

SEQ ID NO: 2040 - DNA, 1638 bp, Bacillus licheniformis
ttggcagagctgctccatttgacaattggaaagttattggagaaaaccgcggcagacgcccctgatcacgaggctgtcgtctatccggaccgcggcctgcgttatacgtaccgggaatttgaccagttgtgcagaaaagtcgcaaaaggactgatggcgctcggtattgataaaggtgaacatgtcgcaatttgggcttccaatactccggaatggctcaccgcccagtttgcttcggcaaaagcgggtgctgtactagtcacagccaacacgaactatcaattatcagagcttgaatatgtgctgaaacagtcagatgccacaacactcattttaatggaatcataccggggcacttcctacattgatatcctttgcaaactgattcctgaattaaaggagggcgaaccgggcaggcttgcatctgaaagactgcctttcttaaaaaatattattttgctgggggatcaaaggcatcccggcatgtacctatgggatgatttattaaagctctcagggtcagtaagcgaaaaagcgcttgatcgcaggatggaacggctcaaagagcatgatgtcattaatatgcaatatacatcaggtacgacaggctttccgaaaggcgtgatgctcacccattccaatttggcaaacaatgcggcaaatattgcggaatgcatgaatttatcgaaaaaagacagaatgtgcatccccgttccgtttttccactgcttcggctgtgtactggggactctcgcttgcgtcaccgccggcgcgacgatggtgccggtacaagaattcagtccgaaagaagtgctttcagccgtcgaaacggaaaaatgcacggcgcttcacggtgtaccgaccatgttcatcgccgaactgaatgatccagatttcgcatcatatgacctgtcttctttaagaacgggcatcatggccggttcaaactgtccgatcgaagtcatgaaaaaagtgatcgataacatggggatgtctgaaataacgattgcatacggacagacggaagcctcaccggtcattacccagactagggtcaacgattcgctcaaaagaagggtcgaaaccgtagggcgcgctttgccgaatgtagaagtcaaaataactgaaccgggtacgaaccgggaggttgaaagaggcgttcaaggcgagctgtgcacacgcggctaccatgttatgaaaggctactacaaaaatcctgaggccacggcagcggtcatcgatgaggatggatttttgcatacgggagatttagccgtaatggatgaagaaggctactgccggattaccgggagattaaaagacatgatcatcagaggcggtgaaaacatatatccgcgggaaatagaagagtttttatacaagcatcccgacattctcgacgtccaaattgtcggagtgcctgacgaaacattcggcgaagaggtatcggcctggatcaaactgaaaagcggagcatcgatgacggctgacgaattaaaagaatactgcaaaggcaaaatcgcccgctataagattccgcgctatatcgcatttgtagaagagttcccgatgacggcatcagggaaagtgcaaaaattcaagttaagggagcaggcgcttgagcattttcaattgtaa

SEQ ID NO: 2041 - DNA, 1161 bp, Bacillus licheniformis
atgaattttgaactaaccagagaacagcaaatgattcgtgaactcgcaagagattttgcgaaacaggaaattgcaccgcacgccgaacatgttgacaggacgggagaatttccgattgagacatttaaaaaaatgggggagctcggcctcttggggattccgtttcctgaaagctacggcggttcaggcggagatacgatttcctatgcacttagcgtcgaagaaatcggcaaagcgtgcggaagcaccggtcttagctatgctgcggctgtatcgctcggggctgcgccgatttattatttcggcactgaagaacaaaaacaagaatatctcgtcccgcttgcgacgggccgggcgctcggagcatttgggctgaccgaaccgaatgcaggttccgatgcgggcggcacccggacaaaagcccgctcggaaggggacagctatgtgatcagcggtgagaaatgctggatcacaaatgcaggatttgccaggaccgtcatcgtcaccgccgtcaccggaatagatgacaacggaaaaaacatcatttccgccatcatcgttccgacagattcggagggcttcaccattaaaagcgaatatgacaaaatgggtgtccgcggctccaatacatcacagctcatattggacaatgtccgcgtaccaaaacaaaatctattgggaagcccggaaaaagggtttaaacaatttctcaatacacttgacggcggcagaatttcgatcgcagcgctggctgtcggtattgcccaaggcgcatttgaggcggcgctcacatacgcgcgcgaacgaaaacaattcggccgaccgatctcttatttccaggcgattcagttcaagcttgccgacatggccatggaaattgagctcgcccgcaatatggtgctgaaggccgcctggctgaaagatcaaggacgtccgtttacaaaagaagcggcttttgccaagctttatgcctcagaaatggcgttcaggacatgcaatcagtccattcaaatacacggaggatacgggtatatgaaagagtatggagtggagcgcatgctgcgggacgcaaaattaatggaaatcggtgaaggcacttcagaaattcaacggctcgtcatcgcaaggcagctcggcatcggcaaacaagcgctgaaatga

SEQ ID NO: 2042 - DNA, 561 bp, Bacillus licheniformis
ttgaaaacgctagttatcgttgcacacccaaatttagaaacatcagtggttcataagcgctgggtagaggaactcaaaaaatatccggaaaagtatacggttcacgaattgtccgacgtttacccggatggaaacatagacgcggaaaaagaacaaaaattggtggaatcgcacggcaatcttgttttgcaattccctatctattggtttaactgtccgcctcttcttaaaaaatggcttgatgatgtattagcttacggctgggcttatggttcaaatggaggagatcgattaaacaatcgtaaagtggcattaggtgtatccgccggaattaaagaggaagattatcgtgaaaacggaaggtaccggtatacgcttgaacaaatattagttccatttgaaacgacattccggtattgccgcgcagattatcgttcattttttgcattttacggcaaggaaaaagagcctggcggaaacgaggaagaagaaaatgagccgggagcaggagaattggagaaaagcgcacgagattatttgcattttattgatcatatgtag

SEQ ID NO: 2043 - DNA, 351 bp, Bacillus licheniformis
atgcaaatcccatccggaaaaacctgcgttccgaccggtgtggaacttaaagacaccggctttggctatacgttgtcattgataagcggcaaatataaaatagtcattctatattggctgtctgaacgcgaagtgatgcggcataatgaattgaagcgaagcatcggcaccatttccttcaaaacgctaagcatcatgttaaaagagctggaagcagacggccttatcattcgcagagaatttccccaaatccccccaaaggttgagtattcattatctgaacgcggacgctccatcgtgcctttgttaaatatgatgtgtgagtggggggagaaaaacaggctgggctga

SEQ ID NO: 2044 - DNA, 1272 bp, Bacillus licheniformis
atgactgcgacgagcgagagcatcagtgcacaaatcgaagaaaaagcgataaaggcaaaaacggccgcaaaatctttgcggctggcaactgaaaaagaaaagaacgaggcgcttgctgcattggccgaccacctgaaacaaaacatgagctatattctcactgaaaatgccaaagatatcgaagcgggacgaaaaaaaggctatgatgcagcctacatcgaccgcctgtcgctcaatgaagacagggttctggattttgccgatgggctgctggaagtcgcggaacttgatgatccggtcggagaaacgctatcaagctggacgctcgacaacgggttaaaagcggaaaaagtcagcgttcctctcggcgtcatcggcatgatctatgaagcgcgtccgaacgtaactgtcgatgcgaccgggcttgctctaaaatcaggcaatgcgatcgttttgaaaggcggctcttccgccattcattcgaatacagcgatcgtatcggtcatgcatcaagcgcttgattcgacaaacatcccccgcgatgccgttcaattcatcgaaagcacagaccgaagcgcaacgaagcagctctttaagatgaaagaacatatcgatgtactcatcccccggggaggcggggccctcattcaggaagtcgttgagaacgcaaccgttccggtccttgaaacgggagtcggcaactgccacatctatattgaccgggaagcggaccctgaaaaagcgatcgatgtcatgatcaatgcgaaaacagaccgccccgccgtctgcaatgcacttgaaacgctgatcgtccacgaaaaatggcttgaggaaaacagcgccgcgcttatcaatgctttaaacgaacacgggattcaagttcacggggacgaaaaggctgttcaaatgattccaggcgcaagaccagcaggggaagccgattggcagaacgaatatttaagccttgatctcgcggttaaagtcgcaggaagtcttgaagaagcctgcgatcatatcgaaacatacggaacaaagcattcagaagcgattatcaccgaaaatccggaaacagccaaagcttttctgaataccgttgatgctgcagcattgtaccacaatgcctcaaccaggttcaccgacggcggcgcactcggattcggcgctgaaatcggaatttctacacagaagcttcacgcccgcggacctatgggtctgaaagaattgaccacatgcaaatatatcatgagaggcgacggccatatcagaagataa

SEQ ID NO: 2045 - DNA, 1122 bp, Bacillus licheniformis
atgacctctaatcaacagagggtagttgtcaaagtgggaagcagttctttaacaagtcttcacggcgaaatcagcagcaaaaagctcgaaaagctcgttgagcagattgtccgcctcaaagatgaaggacacgaagtcctccttgtttcatctggcgctgtagcagccggttaccggaagctcggctttatcaacaggccggatacattgcctgaaaaacaagcatccgcttctgtcggccaaggcttattaatcgaagcgtattccaagctttttttatcccacggctatatcgcttcacaaattttaatcacaaaaagcgatttttcagatgaaaaacggtacaacaatgtgagaaatacgatgaacgtgctgctgaaacgcggcattattccgatcatcaacgaaaatgatacggttaccgtcaatcggctcaaattcggagacaatgacacgctttctgctaaagtggcgggtctgatcgacgccgacctgctgaccatcctctctgatatagacggcctttatgacgcgaatccgcgaaaaacgccggacgccgcactcgtccaggaagtaactgaaatcacgccggaaatagaagcttcagcaggggatgcaggaagcgaagtcggaaccggcggcatgaagtccaaactggacgcttttaaaattacaatggcttcaggcatcaaagggtttttagggcgcgcggacacccccggcattttgcacgaagcgatctgcgggactgcgaggggaacgtattttataccgaatgcggattcacacgccctcaaccataaaaagcaatggatagcatttaactctggacctgaaggagacatcgtcgtccacaacgaaagcaaagagtttattatcgaccgtaaaaaaagcctgtatccttctagtatttacgacatcaacggccgtttcagcaacggatccgtcgttcgaatccttgatcaggaaggagaggaaatcggcctcggcgtcgtcaacttttcctcatcccagcttcgtaaatggaagaaggatacgaatcaggaaacagccgcttcctcacaggctgtcgttgacagagaagcgtttgtctgtcatttagagctatccgttccgctttaa

SEQ ID NO: 2046 - DNA, 801 bp, Bacillus licheniformis
atggcagagggaatgatctcaggcatcgttcaatccaaaaaactgcctgcttcgcaaatctatgttacaaaccacacgaaccaccggcgtttagaagaactccagcagaaatatggaatacaaggcgtcaaaaaagaacaacttgactatcagaacatcgattgcttcatcctggcgatgaagccgaaagatgcagagggcgctcttaattccatgaaaccgcatatcaaaccccatcagcttatcgtgtcagttttagctggcatatcaatatcatttattgaaaacacgctgcacgacatgcagccggtcatcagaatcatgcctaatacctcaagtgcaatcggcgcatctgcaaccgccatggccgaaggaagccatgtaacggccgatctgtcaaaaaccgcgaaacaactgcttcaatgcatgggagaagtctattccatcgaagaaagcaaaatggacattttcactggcattgccggcagcgggcctgcttacttttattatttaatggagcacatcgaaaaagcgggagccgaggctggattaagccaaaaattaacaagggaaatcggcgcgcagacattgttaggcgccgccaaaatgctgttggaaagccctgaggatacagctgttctcaaagacaacatcacttcccctaacggtacgactgccgccggtttaaaggccttggaagaaagcggcggaggcgaagcgatcgaacaggcggtcaaacaagccgcaaaacgatccaaaacgatcagtctcgaactggaacaattagtcgcagcaaagtaa

SEQ ID NO: 2047 - DNA, 678 bp, Bacillus licheniformis
atggaatatgtacacttggtagtcgaactgacgatagggtttgcagcattgtttctgatgacgaaaattctgggaaaaacccaatttgcccaaattacgccgtttgattttatttcggctttaatattgggcgagatggttggaaacgcgattttcgatgaggatgtcaccatctggaaaatccttttcgccatcctcatttgggccgttctaatctattcaatagaagttttatcgcaaaaagtgcaaaacatcagaggttttctcgaaggcaggccgagcattgtcatcaataaaggaaaaatcgattacaacgcccttaaaaagaacaaattggacctgaaccagctgcagacattggcacgtgaaaaaggctgtttttccttacacgagatccaatacgccatcttggaaacagacggttcgatcagcgtcctcccaaaacacaaatacgggatgccgacaaaagatgacttaaacattccttacaaaccggttcagctcccggtgccggtaatcctcgacggccagctcgaaaagaacaatctgcacgaagccggatttgatgagctttggctgcaaaatcaattatcaagtcagggtatcactcagtatcaagaggtgctgtatgcggaatggcgcggtgatgaggggcagctttacatcacaacatattga

SEQ ID NO: 2048 - DNA, 1137 bp, Bacillus licheniformis
atgacgattacaattttggcattcattatcgctttgttttttgccatgaacataggagcgagcggagcagcagcgtcgatgggaatagcatatggcgcaggcgccgtcaggaaaaggcaggcggccttgtggatcagcggaattggcgtatttctgggcgccatgataggcggaggagaggttgtgaaaacaatcggttcaggcatcattcccgcgtctattctcaatgtgcatattgtcgtgattatccttggatcatccgcgatttcgctgtttatcgcgaacatcgccgggattcctctttcaaccagcgaggtgacggtcggctcgattgtcggggtcggcgtcgcgtttcaggcggtatttaccgataagcttttggtgatcgtcatgtattggctgatcattccgattgccgcattttttctcgcttttttaattggacaattgctgaaaaagactgaggcgaagctgcggtggctcaaacagcaaaaatgggcgcggctgcttactgcgctggtgattttaaccgggtttttagaagctttttcggcgggaatgaacaatgtcgccaattccgttggacctctcgttggagcaggcctcttgtcagtcggcagcggaacgtttcttggagggctgttcgtggctatcggggccatttgccttggaagccgagtcattgagacgaacggaaaaaaaatcaccgagttttcgcttttgcaagggtcctgtgtttcagggctcggtgcgtccctggtcatcggcgcttcgctattcggcattcccgtgccgcaaactcagattacgacttgcagcatcatcgggatcggcctttctgaaaagggaagggcaatttttcgtaaaagcgtcattttgaagttaatgaaagtatgggttgtgtcaccggttttttcacttgtcatttcctacagtctcgtgaaaatctttctcgattttgatttatattcagtggcagttgttttatgtgtttttcttgccactttaggatctataagccttatgaaacatgccaggcagaaacaatcagatgtccgaagaaatagggatcatgtgaaatcaatcgttggagggaggggacgtaaaagagaacctgccgcatggagggacttttag

SEQ ID NO: 2049 - DNA, 711 bp, Bacillus licheniformis
atgaacgatgttttaacgtatagcacatgggatgaaaaagcttctgaagaggtgatggatactttcagcggcgagatggacgttttgaaatgggcgtacagcacgtatcaaaaaatcgtttacgcctgcagcttcggcgcggaaggaatcgttttgatcgacttgatttcaaaggttgtgaaagaagcggacatcgtgtttttagatacaggactgcattttccggaaacatatgagctgatcaatgaagtgaaagatcgctatcccggtctgtcgatccactttttaaaacccggcctctcacttgaagagcaggaaaaacgctatggcagcgaactttggaagcgccagccggaccagtgctgccgccttcgcaaaatcgagccgctcagggagcatctgtcaggcatggaagcctggattaccgggctgaggcgggagcagtcggaaacacggaaacatgtccgatatatcaacaaggacgacaattttaaactgattaaaatctgcccccttattcactggacatgggaggatgtctggacttacattaagctgaatcagctgacgtatcacaagcttcatgatcaagattatccgagcatcggctgtgaggtgtgtacgcttcccgtgacagacagcggcaatttaagagcgggaaggtgggcccaccaggaaaaaacagaatgcgggctgcatcaattccggtag

SEQ ID NO: 2050 - DNA, 765 bp, Bacillus licheniformis
atgatttcttctgaactgatactgcccgacaggcagcttaaaccaagaaagaaagggatcaccatcctgatcgataacggggttcccttgagcttttttaaagatacgattcacggagcggcagattatatagattttgtgaaatttggatggggaacgtctttgattacgaaatatttggaggaaaaaatcgatagtcttaggcagaatgacgttcaattcttttttgggggaacgttgtttgagaagtttttaagccaggataaaattgaagattactaccgctactgcaaattatatggatgccgttatgtcgaaatatcaaacggaacggtccgtctctctaataaagataaagcaagctttatttccgacttttcgaaagaatttcacgtgttcagcgaagtcggcagcaaagacagcaccctcagcagcgagctggagtcagccgaatggatcgattatatcctcgaagatcttgaagccggagccgagaaagtaatcacggaaacgagggaaagcggcacgagcgggctgtgcaaaagcgatggagaaatgcggtcccagcttattgaggagatccttcattccggtatcgcttcaggggatttaatttttgaagcgccgacaaaacagctgcagacgtgtttcattgaaaaaatcggtcctgacgccaatttggctaatattccgtttcaagatgccattccgcttgaaacgctgagactgggacttcgatcagatacattttatttatttgattag

SEQ ID NO: 2051 - DNA, 624 bp, Bacillus licheniformis
atgggaagaaaactcaaaatcgtacatgctattgtgttgggcagcgtgttgcagggtctcggtatggcgctgtttttgtttccgaaccatattccttcagggggcgcagccggcatcgctgttttgctcaatttctggtttcaggttccgcacggattaaccgtctgggctgtcaacttctcgctccttttgacggccgttaaatggcttgaacccgtgacagtcttcgggacgatgggggcgattaccatgacgtccgtttcggtgcagatcttcgaatcctgtatgccggttatgacgacgaacaatatctggctggatttattttacggctccgtccttttgggagcgggggttggactgctatataaatataatatttctaacggcggttttggcgccttggctttaatgatatcgatttaccgcggcggaaaaccgggaactgcgctgtttatcatgaatgcattcatttttcttttgaccgcgtctgtcatcgcctggggaatcgttatccaggccttaatctgccaatggatttctacgaggatcatcgatgcgatttatcagattcgcttccggccgttattgatgcctatcgccggtttccgcaacaaaaaatag

SEQ ID NO: 2052 - DNA, 1107 bp, Bacillus licheniformis
atgcgcatagaaaaggttgacacatttccgctgttccacaagctttcctccccttacggcgatgcgaacggattgaaaagctacagaacaagctatctgattcggattacgacagcttcaggtctgacaggatggggagaatgcgcggattggctgcctgctttggatgcaggctttaaaaaacggatcattccttatttaattggaaaagaagcgagcaatcgaacggagctgatcactgtcatcaaaaaatggcatcagcgggccgcctctgctgtaagcatggctttaacggacatcacggcgaaaaaagcaggcctttcggtatgcgaattatggggaggaaaactgcgggagcagatcccggtatatgcgtcattccaatcgtattcagacaggccggattggagccgccattccctccggcttatcgaaaaggcagttcgggccggatttaaggcagtcaagctgaaagcgggaggcaagatgttttcagaagacttggcacatattcaggccttccaggagatgacagggcaaagcaccggactgatcctcgatgcaaaccagagttatgatcaggccgccgcgcgcaagtgggaaacgtggttttccggctggcaaaacgtgctttggtttgaagagcccatgccgtttgacgacctagctgaataccggatgctgcgctcagcgctttctgttccggttgccggaggagaaaacgtaaaaggcgcaaagccgtttttgccgatttttctggagaacgcagtcgatattgcccagcccgatgttatgcactgtgagggcacggacgaatttcaaaccgttctgaagctcgccaggcatttcggaaaaagggtctctccccacagctatgacggcggactttcaagaatatacgccgctttcggacaagcctgtttaccgcattggaccaaaatggacggagaagatatcgaaccgcttgaatgggatgcgatggagaatccgttcgcacaaatcgtgcccgtcagcataaaagacggctgcattcaagtccccgacaaaatcgaaattgatacagagctcgtagaagcgtatgtgtgggatggctcgtcttacatctga

SEQ ID NO: 2053 - DNA, 1245 bp, Bacillus licheniformis
atggcagaaaaacaaaactctggcatgacggttgttgctatcgggtcgatcccgttgattatgacgttgggaaattcgatgctgattccgattttgccgaaaatgaaatccgaactcaatttatcgcaatttcaagtcagccttgtcattacagtgttttcgatcactgcagcgctctttattccgctgctcggttatttggccgaccgcttctcacggaaagtggtgattattccgtgcctgttcctttatggggcaggggggattcttgcagggtttgcatcgacgacctttgcgaatgccttcccatgggtgctgttcgggagaggactgcaagggctcggggcagccggtacagcgccgatcgcaatggcgctgacaggagacctttttaaaggggccgacgaaagccgggtgctcggtcttgttgaagcctcgaacggcttcggaaaagtgctgtctcctattttaggatcattgattgcattaatcgcttggttttgggtgttctttgcatttccggctttttgtattgcgccgatcattttgacttggatttttattaaagaaaaagacaagaaaaaagatccgccgcctcttggaaaatatgtaaaagggctgacaagcgtttttaaacatgagggcagatggcttttcaccgcatatctcgcaggagccgtctgtttgtttactctgtttggcatcctcttttacttatccgatgttttggaaaaagaatatcatacagacggcgtaaaaaaagggctgattttggcgatccctctgcttgtgatgtgtacaacatcatatattacgggcagcaaaatcggacaaaatcagcggctgatgaaaaagatgatggtcatcggactcgctctgattacggtttcctacggcacactgtcttttttctccgcgctcattccttttatttcgatccttgtcatcagcagcatcggcacaggctttgttctgccatgtgtcaacagcttcataaccggggctgtcggaaaagagaggcgcggctttgtgacatctctgtacggttcggtcagatttttaggagtcgccatcggaccgccgattttcgggagactgatggaatggtcgaaactcggcatgtttatgtccatagcgggcctgacgttgattgtcggtgtacttgtgctgaccatgattcacgtcaaaaaggaagacacgacaaaaaaaggggacaaggggctgcagccggctgacgcaagatag

SEQ ID NO: 2054 - DNA, 1008 bp, Bacillus licheniformis
ttgaatcttcaacagcctttgctgacgatcgtcgtaccctgttataacgaagaggacgtgtttgccgaaaccgcaaaacagctgactgcggtattggatgatctcacagcagataaactgatttcttcagagagcaagcttttatttgtcgatgatggatcgacagaccgcacatggccgctgattgccatggaaagcacaaaaaaccgctatgtgacaggcttgaagctggcccgtaattcgggacatcaaaaagctctgttagccggactcgataaagcaaagcaaaaatccgattgcgttatttcaatcgatgccgatcttcaggatgacatttcggcgattcgccggtttatcgaaaaatatcatgaaggctatgaaatcgtctacggtgtacgccgaagccgccaaacggatacatggtttaaacgaacgacagccggatggttctacaagatcatgaataagcttggcatccagctggtcgataaccatgccgactttcggcttttaaataaacgggcgcttgaggagctcagccgctatgcagaagcaaatgttttcctgcgcggtttggtgcccctgatcggccttcggtcggcaaaagtgtactatgaccgaaaagagcggatggctggagaaacgaaatatccgctgaaaaaaatgctgtctttcgcttttcacgggattacgtctttcagtgtcgctccgatccgattttttaccctgattggcttcttcttatttttcctaagctgcatcgcgggtatttatgcaatgattcaaaaactgctcgggtatacgaatgcaggctgggcttcgctgatcatttcgatatggtttttgggcggtctgcaattgatggggatcggcattatcggcgaatatatcggaacgattttcaccgaagtgaaaagaaggccgagatatgcggtggatatcgatttgtatactgaacggctcggccggcgcgaacctgaaaaacggccggaaacgaagctcagctga

SEQ ID NO: 2055 - DNA, 1716 bp, Bacillus licheniformis
atggatgtggtattcgtgtcgttattcgtcaaaaagttgagcagagaaaagcgatatttgattttcgcattcagtgtcattcttctctatgtccttccgctttacatattaaatgaagacgctcatatccgtgtgcatgacaacctggattccaatatcgcctggtataaggtgctggccgaaagcgggcagctgctcggcggcgttaaagccgtcattccgcaaatcatcaacgggttgccgcgggacgcttacggaacggaatggagcggcattgtctggcttcacgccttgtttccttcgatgaccgcatatgctttaagccagacgatcacgagggtgtttgcctttgtcgggatgtacctgctgctgaaaagccatgtgattcgcgatgaaaaggcgtatttcatcagaatcgccgtatcgctggcatttgccctgacacccttttggccttcaggaatgcttagtacgcttggtcaccctttggccttatgggcttttttaaacatcagggcagggaacgactcatggaaagagtggtcaacccttgcgcttttaccgctttactcaagctttgtgctcggtttcttctttttccttgccgccgtttcgctgatttggctttatgatttggtcacaaagcgcagctttaaccttcgctttctcggaagtatcgctcttatgacaggcatattcctggcgatagaataccggcttgtttattcggttttcgcttcaggcgaaacgatgcatcgcgttgaatttatttcgtccaggcatgacatccttcattcgtttcggttgtcctttaaaaatttcgtgctcggccacaatcatgtcatgaccgtccatacggcagtgatactgcctttgattgtgctcactttcgggctcgtcgttgctagacaacgcaaaaagcggccaagcgaagaaaagctgttcatctttttattcattttaaattatgcgctttctttatggtatgccctctggttcaacaagctgtgggcgcttccaaaggaaaagatcagtctgctttcggcattcaatttcgcccgtttccactttttgcgccctcttgtgatatacgcaagctttgccgttgcatgctacatattgtggaaaatggggaagagatggcggcgttttgttcatgccgcactaatcgcccagctgcttgtgcttattccgtttcatgaagagctgacttacggcgcataccaccacgccccaagctttcgggaattttatgcatcagatcagtttaaacagatcaaacgattcatcggccgtcctaccgattcctaccgggtggcgagcatcggcctgcatccggcgattgcgcagtataacggcttctacacacttgatacgtatgccaatatttatccactgaaatacaagtatcaattccggaaaatcatcgccaaagagcttgataaaaatccggccctgaagcgctatttcgatgagtgggggagccgctgctacttgtttgttgacgagcttggaaaacattacgcgttcaaaaagagcacaaagaaaaaaatcacgaacctggagttaaacactgaagcattcaaaaaaatggggggacaatatattttttcttcagttccgattatgaatgcagaacaaaacaagcttgcgtttttaaagcggttcagccacccgcagtccgcttggaacatctatgtatatgaagcgaaataa

SEQ ID NO: 2056 - DNA, 1482 bp, Bacillus licheniformis
atgggcaaagcaacaggatttatggaattcaagcgggaaaagcctgctgaacgcgatcctctcacacggataaacgactggaacgaatattcgtctccattttctgaggaagcatcaaaaagacagggagcgcgctgcatggactgcggcacccccttttgccaaatcggcatggatataggcggttatacgtcaggatgtccgattcacaatttaatccctgaatggaacgacctcgtttacaagggaaggtggaaagaagcgcttgaccgccttctaaagacaaacaatttccctgaattcactgggcgggtctgtccggcgccttgtgagggctcttgtacggtggcgatttccgatccggccgtatccatcaaagggatcgaacggacgattattgacaaaggatttgaaaacggatggattcagccgcgaattccgaaaaaacggagcggcaagaaaatcgcgatagtcggctcagggcctgccggtcttgcaagcgccgatcaattgaaccaggcggggcattcggtcactgtttatgagcgcagcgaccgcccgggaggcctgttaatgtacggcatcccgagcatgaagctcgaaaaaagcgttgtcgaacgccgcatcaaactgttgacacaggaaggcgtcgactttgtcaccaatacggaaatcggcaaagatattacagccgacgaactaaaagaacagtacgatgcgattatcctttgcacaggggcccaaaaacagcgcgatctcttgattgaaggccgtgaagcaaaaggtgtccactttgccatggactatttaacaggcaccattaaaagcatgctcgattcgaattttaaagataagcagtttatcaatacgaaaaataaagacgtcatcgtcatcggcggcggtgacacgggggcagactgcgttgcaacggccctgcgccaaaaagcgcgaagcgtcgtccaattcggcaagcatccgaagctgcccgatacaaggaccgccgaaaatatgtggccggaacagccgcatgtccatacgctggactatgcctatgaagaggcgcaagcagtattcggaaacgatccgagacaatattcgatccaaacaaaaaagcttgtcgcagataaaaacggccatttgaaagaactgcatacgattcaaatgaaaaaagtaaagaatgatcaagggaaatttgagttccacgaaattccgggaacggaaaaagtatggcctgctcaatacgtctttatcgccatcggctttgaaggaacggaacagccgctgcttgagcagttcggggtaaatacggtgagaaataaagttgacgcagcatacggggaatttaaaacaaatgtcgatggagtcttcgcagcaggggatgcgagaagaggacaaagcctgatcgtttgggcgattcacgagggacgcgaagtcgcccgtgaagttgacaaatatttaatggggagctctgtactgccttaa

SEQ ID NO: 2057 - DNA, 4566 bp, Bacillus licheniformis
ttgacttattatcaccttccacatgcacaaggtctctaccgtcctgaatttgatcatgatgcttgcggaatctgtctttatgctcatttgaagggccttcctactcatgatattgtccaaaaaggattgcaaatgctttgccaattggaccaccggggcggtcagggcagtgacccgcataccggagacggggcaggcatcatgatgcagattccggatgctttttttaaaaaagtctgcgccgatttcaacttgcctgaaaaaggacgctacggcgtcgggatgatcttcttttcgaaagacgacagcgggcgcgaaaaatccgaagcgcgcattaacgagctgatcgaacaggaagggcagacggtactcggctggcgaactgcacctgtaaatgtcggaaaaatcggaacagtcgcacaagaaagcgcgccagtcgtccgccaggtatttatcggagcaaatgaagcgctgaaagacaatttggcatttgaacgcaagttgtacatcattcgcaaacaggccgaaaattgggcaaaagaacacgagaaaacgttctatttcgtcagcctctcgagcaataccatcgtatataaaggtcttttaacgcccgagcaggttgatgccttctatgaagatttgcaagacgaggacttcgtctcggctttttctttggttcactcccgtttcagcacaaacacgtttccgagctgggaaagggcgcacccgaaccgttatttgatccacaacggggaaatcaatacgctgcgcggcaatatgaactggatgaaagcgagggagcagcagtttgtttctgaagcgttcggtgaagacttgccgaaggttttgccgattctcgatgaaaatggaagcgactcctcgatactggataacgcttttgaattctttgtactggctggaagaaagccggcccatgctgcaatgatgctgattccggagccgtggaacgagaacccgtacatgtcaaaagaaaagaaggcattttacgaatatcacagctctttaatggagccttgggacggcccgactgcgatttcttttacaaacggaaaacagatcggagccattttagaccggaacggactcagacccgctcgctattatgtcactaaagacgactaccttattttttcttccgaagtcggcgtaattgatgtcgaacaggaaaacattttatataaagaccggctggatcccggaaaaatgctgcttgttgatcttgaagaaggacgtattatctccgatgaagaagtcaaatccgaaatcgccggagagtttccgtaccaggaatggctcagtaaagaactggttcatgtctcaaacgacattgaggaaaccgaagaaaaatctgtgcctgatctgctgacccgccagaaagcattcggttttacgtacgaagatattcacaagtatttaattcctgtcattacagaaggcaaagacccgctcggttcaatgggtcacgatgtcccgctggcggtgttgtcagaccgtccgcaatcgctgttcaactattttaaacagctgtttgcacaggttaccaatccgccgattgatgcaatccgcgagcagatcgtcacatcgacattgacatggctcggagcggaaggcgatattctccatccgaacgaaagcagctgccgccggattaaattgtatacaccggtcttgacgaacgcgcagttcaattctttaaaggggcttgtacacaaagatttcaaaagcaagacgattcacacgctctttacagacgacttgaagagcggactcgaagatatgtttaaagaagcggacagagcgatcgccgaaggcgtgacactccttatcttatccgaccgcaaaatggacggtcaaaaagcgccgattcctgcgctgctagccgtcagtgccttgcatcaatatttggtccgtgcaggaaagcgcacaaaagtcagcattatcgcccaatcgggtgaagcgcgcgaagttcatcattttgccgccttgatcggctacggagcggatgccattcatccgtacctcacatatgcgacatacaagcaggcgattgaagacggagcgctctccatcagttatgaagaagctgtaacaaaatacagcaaaagcgtgacagaaggcgtcgtaaaagtgatgtcaaaaatgggtatttccacagtccaaagctacaggggcgcacagatttttgaagcggtcggaatcagcaaggacgtcatagacagctatttcacaggaacggcttcacagctcggcggaatcggtttggacacgattgccgaagaagcgaagcgccgccacagggaagcttatgaagatacattcagtgaaacgcttgattctggtagcgattttcaatggagaaaaggcggggaacaccacgcttttaatccgaaaacgattcacacgctgcaatgggcctgccgcaaaggtgattacagcctgtttaaacaatattcgaaagcggctgatgaagaaagaatcggttttctccgcaacctcttctcgtttgatgaaaaccggaagccgctgccgcttgaagaagtcgaatccgctgaatcaattgtacgccgctttaaaacaggggcgatgtcattcggctctttaagcaaggaagcccatgaagcgctggcgattgcaatgaaccgtctcggaggaaaaagcaacagcggggaaggcggagaagatccggcgcgctttacgcctgacgccaatggtgataaccgccgcagcgcgatcaagcaaatcgcttcaggccgtttcggtgtgaaaagccactatctcgtcaatgccgacgagctgcaaattaagatggcgcagggtgcaaaaccgggggaaggcggacagctccctggcaacaaagtgtatccatgggttgccaatgtacgcggatctacgcctggggtcggcttgatttcaccgccgccgcaccacgatatctactcgattgaagatttggcgcagctgattcatgatttgaaaaacgccaaccgcgatgcacggatcagcgtaaagcttgtcgctaaagccggagtaggcacgattgcagccggagtcgccaaagcgacggccgatgtcatcgtcatcagcggctatgacgggggcactggagcatcaccgaaaacaagtattaagcataccggcctcccatgggagcttggactcgcagaagctcatcaaacactgatgatgaacggtttgcgcgaacgcgtcgtattggaaacagacggaaaattaatgacgggcagagacgttgtcatggctgcgcttttaggagccgaagaattcggttttgcaacggcaccgctcgttgttctcggctgcgtcatgatgagagcctgccatttggatacgtgccctgtcggggtagcgacgcaaaaccctgagcttcgcaaaaagttcatgggcgatccagatcacatcgtgaattacatgctctttgtcgcagaagaagttcgcgaattgatggcccagctcggtttcagaacggttgatgaaatggtgggccgcacggatgtcctgcgtgtcagcgaacgggccaaagcgcattggaaagcgggtcagctcgatttatcaagcctgctttaccagccggaaggcacacgtacattccgtacgccgcaaaaccataaaatcgatgaatcgctcgatgttacgcaaatcttaccggccgtgcagtcagctgttgaaaacggtacgcctgtagaagcgtcttttgaaatccgcaacatcaaccgtgtaacaggagccataaccggaagcgaaatttctaagcgctacggcgaagaaggtctccctgaagatacgattacgctccgattcacaggttcagcggggcaaagctttggagcgttcgtaccaaaaggaatgacgatgtatttgacaggagatgccaatgattacatcggcaaaggtctttcaggcggaaaaatcgccgtcaaagcgcctgacgaattcaaccctgcattccgtgaaaatgttattgtcggaaacgtcgcgttttacggcgctacaagcggagaagcttatattaacggactcgcgggcgaacggtttgccgtcagaaacagcggagtcagcgttgtcgttgaaggcatcggcgaccatggatgcgaatacatgaccggcgggcgcgtcgccattctcggagacgtcggcaaaaactttgccgcaggcatgtcaggcggaatcgcctacgtatacgccgaagacaaaaaagcctttaaacggaaatgcaatcctgaaatgatcgagtttgaaacacttgaagcacctgaggaaatcgctgaactgaaaacgatgatcgaaaaccattacaaatataccgaaagctcaaaagcagcttcgatactggatcattgggaagaggccgtcggtcggtttgtgaaagtgattccgaaagacttcaagcaaatgatagagcggattaaagagcagaaagaagccggcttgtctgatgaagaagcgttgatgtacgcgtttgaagccggtacgaaacaaaagattgaaccatctgcggctgcttcatcaaaagaagcggtggcacagtaa

SEQ ID NO: 2058 - DNA, 903 bp, Bacillus licheniformis
atggaattacgccaattgcattactttatggaagttgcggaaagagagcatgtatcggaagcggccatgcaccttcatgtcgctcagtcggcgatcagcaggcagatcgccaatctagaggaagagctcggcgttgatttgtttgagcgcgaaggccggaatgtgaagctgactccgattgggaggcagtttttagaccatattaaaacggcgatgaaagcgatcgattttgcgaaggaacaaatcgacgagtatttggacccgaatcgcgggaccgttaaaatcggtttcccgacaagccttgcgggccagttcctcccgaccgtcatttccgcttttaaagaggagcatcctaatgtcgcttttcttttaagacagggatcttataaatttttaatcgaagcggtgaaaaacagggatatcgatttggcttttctcggtcccgtcccgtcaaacattgccgagattaaaggagacattttgttttcggagagccttctggcgctcgtgccggtcaatcatccgttgtcaggccagaaaagtcttcatctcggcgatctcagaaatgatcagtatgtgctgtttcctgacgggtacattctccgaaaaatggctgttgacgcatgcaagcaagtcggatatacgcctaaaatttcctcggagggcgaagatttggatgcgatcaaagggcttgtttctgctgatatgggggtgacgcttttgccggaaagcgcctttaatgaaacggcaccccgttttacaaagaagattccgattgattatccgcaggtaaagcgcacggtcgggatcatcacccctaaaaacagggagctttccccttctgcaaaagtcttttatcagttcgtaaagaagtttttttctcgccttcagcaatatcaataa

SEQ ID NO: 2059 - DNA, 1926 bp, Bacillus licheniformis
atgaataaacataagtggttagccgcaattgctatcatcgcaattttagccgttattggctatttcacggtcagacaccttgaaccggaatatgcctatatgcctcctaaagaaaaagtcatctcaaaagaaaaacgattgcacggatacgatttatggggggcatttacaccggataagcccgcgtccgcaggggagggagctgtaaaggttgatgaccgccttcttgacttgggacgtgagacattttataaggaaacattcggaaacgaggtgtttttgacggatatcgtcggactgcttgacggtcccattacagctgccaacatgacgaaagccattgctggattgaaagggaaagggacgacaaacttgcgcatcgaattggcggaaacggttaaggtcggcgggaaaacctttaaaaaaggcgagaagatcgacaccggcattgatgttgcaaaaggggcatacgcgccccttggcatgccttttaaatacgctgacggaaaaatcaaagccggcatcagctgtgcggcctgccacgccacagttgattcgaaaacgatgaaggtgatggaaggcgtgacaaactcagatttaaatacagggctgatgctggcgctggcgacgaactcagctgcatattttacacatgccgaaattcataatattaaacaatttatgaatgataaaagccctgtgatcaccgcaagaaacggcaaaaaagaacgcctccccgatccggaccgcctcgaagatgcagtcgatcgtattttcctgaagtggccgagaggttttttcgattcaacgatcgatatgaaaagcaatcccacgcagattccagatgcctatacattgggcgaccatccgtacagctggagcggtgtggcaatggccgggccgtttaaaggcttgactgtgttcagcaataatgttcatgcgcaaaattcggacagcctctcacaatctccggcaagccgggcgcttttcggaatgagcgaagatgtttatatcgggacgatcctgcaaagggctcccgcctcaacatacaggtatcagccgaaaaaaggggaaagtccgaccgcgtttttcaaaaaagcagaccccactcccggagtaccgggcgtcaaccaaatggtcaagccgccgagctttcctaaaatcactctggcggcgcccgacggcgtgcatgtgagctcgcccggacgaaatgtaaatgaagaaaacaacgctgtgtctgcctggcaaaatacacttagaccgcctgaaccgcggcaaaaaaccgacggccaaaccatcaggcgcggcaggcgcgtttttgaacaagcaggctgcatatcctgtcatgccggccggtatttgacgaacaacaaggtcatctcggctgaaacgatcgggaccgagccgacaagggcgcagtcttttaagaaagcagaaagcatattcgggaaaagccttgtccattcgcctgacacaccggtgcctctgccgcgcaagccggaggttctgaaagtcccgacagccggatttgaccccgaacagatcaagctttcgtgggcgcagggtgattccaaaggcgggtataaagtgccgagtctgattggcgtttactggcgcgctccttatttgcacgacggaggggttgcagttgggagctcattgaaagaaacaggcataccaaagacgattatcaaaggtaagccggcgaacccttataacagtttattggcgatgatcgacagagacttaagacagaaggtcatcaaaagcaattcggaatcgcccgacttaaaagcagtcagagtaaccggcaaagggcatgaattttggatcgacgccaaaagcggcttttccaaacaggagcaaaaagcgttgatccattatttaatccatgccgatatgcctgaaaagcaagaaataaaatga

SEQ ID NO: 2060 - DNA, 1575 bp, Bacillus licheniformis
ttgaaaaagctaagcattgtacttgtcattttcatatgtgcgctggtttcattcatcatatggctgaatgccggggatgaaaaattggggctctcagatgaagaagcagaggccgtcaaaccctctaaaaaaccggtcattgtcctgatcatcgactctttgatggatcagcctttgaaaaaagcgattcaagaaggccgcgctccggcattaaaattctttcttgaaaacggtcattatgaacctgaagtggcgagcgcgtatccgaccatgtcggtcgcgattgacagcacgctgctcaccggaacttatccgaatatccaccgcgttcccgggcttgtctggtataatcaggctggacagagaattgtgaattacgggagcgataaaaaagaaatcgccgcgctcggcctcaaacaaacgatcgaagacgggatatattctctcaatcaccgccatttaaaccgaaaggtgacaacggtacatgaagatttgcaaaagcaaggaaaacagtcggcatccatcaacgggctcatatacaggggacctgaccgccgcgaattaaacataccgcccccgctcaagaagcttagactgatgcctgaacatatgacggtaaacgggccggctcttttttcgtacggccgctttgcccagcttgatcccgacaactcctaccaccatatttggcagggttatggcgttaacgacaagttcacggcgcaggaaatggcttatttgattaaaaagaggaagcttcctgcgctgactgtcgcctacttgcccgatttcgaccacgatgcacacaaaaaaggcccgaaggatatggaaggcctcgaaaaaatggaccgtcagctgcagcgtatattgaatgcatatgattcttggcgcgatgcggccgaaaaagcggtgtgggtcgtcatgggagacggcggacagacatcgatcggacgcgataaagataaggcagccatccggctccattcgctttttaaaggatatcggatcgctaaaataaacgaaggcccagatcgaaaagaccagcttctttttgcggtaaacgacagaatggcatacatttatgtaacggatcaaaacacgccgctgcaagatgccgtcaatgaattgaaaaaagacggacggatcgctttcacagcgtggaaaaaagacggctggatatacgtcgattcgaagcgttccttaaaaccgctgcggtttcgtccgcaaggcggttatcaagatccttacgggcagtcatggacgatcagcggagatttttccttattggacattaaaacggacggtgcatcgatcatgtatggcgattacccggatgctcttgcccgcctgtacagcgccatgcattcgcatcgcggacggtttgtaattgccgatgcgaaacccggattccaatttgccggagaaaagtctcccctccattttggcggaggcggccatggctcactttataaaacggatagcttggctccgatgatcatcgtcggttccgaagaagttccggctcaccttcgccaccttgaactgaaggattttttaatgaagctcgtacaatga

SEQ ID NO: 2061 - DNA, 474 bp, Bacillus licheniformis
atgaaacaagataaagtcggccgcgagaccgttgagcagttgatcgaagctttcaacaggctgcgttatgcggaaatgaaacagtcatttccttcagttgaatggaaaaagactgaggcgaaagcgctgatgtttttaaatgaagcaaacggtgaaggaaaaatggcatccgaaatcagccgcgctttgcatgtcacctcccccttcgtcacgcagctgttgaacagaatggaaaaaaaaggactcgttttacggcgcatagatgaggatgacaggcggatcgtccggatttttctaaccgatgaaggaaaaaaagcggctgacgatgcgcttaaaggcctgaaccgatggttcttgcagctctcgcggtttctgggcgaggctgaaagcaggcacttcgccgatctgattcataagctgtccgagtttatcgaacaaggagaaaaaacaagtgaaaagaaggttgaaaaatga

SEQ ID NO: 2062 - DNA, 1728 bp, Bacillus licheniformis
atgatctcactcttaaaatatttaaagccctataagctgcaagtgattctcgtcgctgtttttactttgctgagcagtgtgcttgagctttatttgccgacgttgatggctgatgtcgttgatgtcggaatcgtaaacagtgatatgccatttattttgaaaaccggcggctggatgatcgcctgctcccttctggccatcatgatgactgtcggaaaagcgtttttcgcttcgaaaacagccctcggctttggaagagatatcaggcgcaaactgtttgtcaaagttgaacaccattcaatggatgaattcggaaaaatcagttctgcttctctcattacccgtaccaccaatgatgtcaagcaggtccaagatgtgctcaacatgatgctttcattgatgacgagagcgccgttaatgctggtcggcggtattgtgcttgcggtttccagagatgccaagctgtcgattatatttctggccgctctcccgatacttgcagggctgatttttctcattacaagaaaagctgtccccttattcggcgtcctgcaaaaaaagacggatcgtctcaaccttgttctcagggaaggtttgacgggcgttcgtgtcattcgcgcgtttaaccgcgttgatcaagaaaaagtccggtttcaaaaagcgaacgaagaatttcgcgatacaggcatcgccgtcaacagaatcatggcttttctattccctgtcatgatgattatgatgaatttcacgaacatcgcgattatctggttcggaggcatccgcatcgatcaaggcagcatgcaggtcgggaacttaatggctttccttcaatatgcatcgatgattctaattgcgctgatcatgcttgcgatgacattcgtgatgatcccaagggctcaggcatctgccggccgcattaatgaagtgctgttaacagagccttcgattaccgatccgaaagagccgcagaaagacagcggcttgcgcggttatgttgagtttcagaatgtgacttttcgttatgccggggccgaaaagcccgttctcgaagatatctcgttcaaggcaaagccgggtgagacgactgcgatcatcggcagcacaggagcgggaaaaacgacgattcttcaattgatcccgagatttttcgatattgaaaaaggaactgtgctagtcaacggaacagatgtcagaaagatggcgcaaaaggagcttcgcgcgaaaatcggctatgtcccgcaaaaagcttcaatattcagcgggacgattaaagacaatatccgctttggcaaagaagatgcaacagatgaagaaattctggaagcacttgaaacggcacaggctgccgagtttgtagaaggcaaggaaaacggaattgaatctgaaatcgagcaggccggagccaatctttcaggcggccagaaacagcggctttccatcgccagggcattagtcagaaaaccggaaatttatttatttgacgacagcttttcggcgcttgattacaaaacggatcaaaagctgagaaaagcgctgaagaaaacaaccgctgatgccgccgtcatcatcgttgcccaaagggtaagcacgattacggatgcggatcaaatcatcgttttaaatgaaggaaaaatagccggcatcggcactcatcaacaattgcttgctgaaaacggcatttaccaggaaatcgtcgcatcacagcaggctgaggaggaaagcgcatga

SEQ ID NO: 2063 - DNA, 1824 bp, Bacillus licheniformis
atgagccaacaaccaaagcatcacggctctatacccaaaggaatgcacaagacaaaaccgaaagaatttaaaaagacccttttgagattggcccgctatttaaaaccgcggaccttccagctggtgctcgttgtcttcgctgcaatattggcgacattatttaatgtcatcagtccaaaacttctcggggacgcgacctcttcccttttcgcaagctttaaagaaggcaccggtgttcaattcggctttctcggccggatcacgctgatcctggcaggattgtatctgctttctgctttgtttacgttcttgcagcattacctgatggccggggtagcccagaaaacgatatacgaaatgcgccaggaagtgaatgaaaagctgacgcggctccctttaaagtactatgacaagcattcgcacggcgacacgctcagccgcgccgtcaatgatatcgacaatatcaatacgtcattgcagcaggcgctgacgcaaatgattacgtctgtcattacaatagtcggaatcatcgtcatgatgcttttgatcagccctgtgctgacgctcgtcgtcttcatcacggtcccgctcagcatgctggccgtccgattcattgcctcattttcgcagaaacacttcgccgcgcagcaaaaagaactcggcgacatcaacggacacgttgaagaaatgtttacggggcatcaggaagtaaaggcattcgggcatgaagaaaaagcgattcagcaattcgatgaagtaaatgagcgtctttaccagtcaggctggaaagcgcagtttatttccggtctgatgatgccgatgatgacattcatcggcaacctcggctatgtgtttgtcagcataaccggcggtattttcgttcttaacggcacccttttgatcggaggcgtgcaggcttttatccaatatacgcagcaattttcccagccgctcgttcaagctgccggaatcgcgaatacaatccaatcggcaatcgcatccgccgaaagggtgttcagtcttttggacgaagaagaagaaaccggggagacgccggcttccatcgataccggcaaattaaaaggcgatgtatcgtttgaacatgtcgccttcggttatgataaaaacgttccggtcatccgcgacttaagccttcacgccaaagaaggccagacgattgcgatcgtcggaccgaccggcgctggaaaaacgacgatcatcaatttgctgatgcgtttttatgaactaaacaaaggcagcatcaaggtcggcggcacagatatcagcgagctgtcgcgcgaacaggcgagaagcatgtttgcgatggtgttacaggacacatggctgttcaacggcaccatccgggaaaacatcgcttacgggcgtgaaggcgcgaccgaagaagacatcatcagagcggcaaaaggcgcctatgccgacgattttatccgcaccttgccggacggctatgatacggtacttggcgaagatgcccaaaacatctcgcaagggcaacggcagctcttaacgatcgcgagagccattttagctgatccgaagattttaatattagatgaagcgacaagcagtgtcgacacccggacggaaatgaatattcaaaaagcgatgaacaaactgatggccaaccgtacgagctttgttatcgcccaccgtctttctaccattaaagatgccgacatgattcttgtgatgaaaaacggagatattattgaaaaaggcagccacgaagagctgctccgcaagaacggattttatgccgatttgtataacagccagttctcccgggaagaagccgtcagctaa

SEQ ID NO: 2064 - DNA, 1215 bp, Bacillus licheniformis
gtggcaaattcaaattcacttcaatcaagcaagcattatgccaattggattccgatgaaagaaatcagctcgagtaatgaccggctgtttccgtttccgatttataaccggatcagaaagacgtctcctgtgcgttacgatgatgagcgaaaatgctttgatatcttttcttatgaagacgttcaattcgtgttaaaaaacccgaagctcttctcttcaaaacgcggcggtaatatggaaggaaaaagtatattaacaatggacccgccgagacacacaaaaatgagagccatcgttaataaagcttttacgccgaaagcggtgaaagagcttgaaccgcatatcgaagaagtgacggcttttttatttaacgaagcgaaacagaaagaattgtttgatgtggtggacgacttggctgctcctcttcccgtcattatcatcgctgaacttttaggcgttccggctgaagaccgcctcatgtttaaacattattcagacatccttgtcgcaggtgcggaagaccgctcggctgaagccgccgaacggatgtacaaacgacgtgaagaaggcaatcggtttttggcggattattttaaaaacattatcaagcagcgcaaaaaagagccaaaagacgacctgatttcgcttttactgcgggcggaagttgacggcaaatcgctgacagaagaagaactgcttcatttttgcatcattcttttggtcgcaggcaatgagacgacaaccaacttgatcgcaaacagcgtccgctatctcacagaagataaaatcacacaggaagccgtaagacaagatccgtccctcgtccctgtctttgttgaagaaatgctgcgttattatccgcccgtgcaagcgatcggccgcacggcggcagaagacgttgatatcggaggcgtgaggattgcaaagggttctacagtgatcagctgggtcgcttcagcgaatcgtgacgaacttaagtttgacgatcctgacagcttcaagcttgatcgcaaatcaaaccctcatatgagcttcggcttcggcatccatttttgcctcggcgctcccctcgcccggcttgaagcgaaagtcgcgctcgattacttgctgcggcgcgcatacatggaaagggacagctctaaggagcttgaagcgattcaaagtccgtttgttttcggcgtccgccatctccccgtacaactttcacaaaaatag

SEQ ID NO: 2065 - DNA, 717 bp, Bacillus licheniformis
atgcaatccttacaaaacaaaaccgctctgattacaggagggggaagaggaatcggccgcgccacagcgattgccctcgcaaaagaaggcgtacatatcggccttatcggccgtacagctgcgaatcttgaaaaagcggcagaggaattgaaggcgttcggtgtaaaagtatctgtagccgcagctgacgtaaaggatttaacagctgtagaacgtgcagtccaatccgtcaaagaagagcttggacaaatcgatattctcattaacaatgccgggatcggcgggtttgcaggatttcttgagcaatctcccgaagaatgggaaaatattatccaggttaatctgatgggggtttacaatgtaacacgcgccgttctgcctgaaatgattgaaagaaaagccggcgatatcattaatatttcttctacagccggccaaaggggagcagccggcacaagcgcctacagtgcgtctaagttcgctgtgctcgggctgaccgaatcgctgatgcaggaagtcagaaagcacaatatccgcgtgagcgcccttacaccaagcacggttgcgacggatttggcaatcgactcaaaattgacagacggcaatccggaacgcgtcatgcagcctgaagatctggcggaatacatggttgcccagctcaaactgcatccgcgcattttcattaaatcagccggcatgtggtctacaaatccttaa

SEQ ID NO: 2066 - DNA, 2601 bp, Bacillus licheniformis
atgcagaatgagtcatttggttctcggttttcacgaaatggaaaaaacacagcttccactcgttgggggaaaaggattgcatttaggggaattatcaaaaatcaagggatacaagtgccagacggattttgtgtcacaacagcaggatttcaaaaagccatcaaacaaaacaaatcgttccaagccttgttggatcaactgacaatgcttaaagttgaggatcgagatcaaatcggtgaaatcagcaggaagattcgacataccattatggaaatcgaaattccttccaatgttgtgaaagaagtggctcgctatctctccctgcttggcgatgaacatgcttatgctgtgcgttccagcgcgacagctgaagatttgccgcacgcctcttttgccggtcaacaagacacttatttaaatatcatcggaaaagatgcgatcttgcagcatatcagcaaatgttgggcttctctatttacggatcgagcggtcatctaccgcatgcaaaatggatttgaccatcgtcaagtttattcatccgttatcattcaaagaatggttttcccgcaggcttcagggatattatttaccgctgatcccattacttcaaaccgaaaactgctatccatcgatgccggttttggtcttggggaagcactggtctccggcttggtctctgccgattgttataaagtgcaaaacgggcaaatcgtcgataagagaatagcagccaagaaattggcgatttatgggcgaaaacaaggcggaacagagacaaagcggattacgcctgatcagcaaaagacgcaagcccttactgacgggcaaattttacaactggcacacatcggaagacagatcgaagcacatttcggccagccgcaagatatcgaatggtgtttggaccgcgatacattttatattgtccagagccggccgatcactactttatacccgatccctgaagcgaatgatcaagaaaatcacgtctatctatctgtcggtcatcagcaaatgatgacggatcccataaaaccactgggattgtctttttacctgttcattactccagcacctatgcgcaaggccggcgggaggttgtttgttgatgttgcgcctaggcttactacacgtatcggccgggaaactttattaaataccgtaggatccgatccgctcataaaaggcgcactcatgaccgtaatagagcgagattatataaaattgtcaccaaatgatcaaacagcaccgattcctgacagagggaatacggatatgctggcgcaattcgagaacgatccgacaatcgtttctgatttgattaagcgcagtgaaacatcgatagaagagttaaaacaaaatatccaagcgaaatcgggatcggatttgtttgattttattctggaagatatccggcaattaaagaagatattatttgacccgcaaagtacggcagtgtttatggctgctataaatgctacatcatggatcaatgaaaacatgaacgagtggttaggcgaaaaaaacgcagcagatactctttctctatctgtaccgggtaatattacttcggaaatgggtctggcgctaatggatgtcgcggatgtgattcgcccttatccagaagtgattgattatttgcagcatgcaaaagatgataactttttggatgagctggtgaaggttgatggcggacaggaagctaggggcgccatctatgcttatcttgacaaatacggaatgcgctgtgccggagaaatcgatattacaagagctcgttggagtgaaaaaccaatgacacttgttcccatgattctgaataacatgaagaactttgagcctaatgccggcaatcgaaagtttgagcaagggcggcgtgttgctttggaaaaagaacaagagttaatagagcgattgaagccattacgggatggtgaacaaaaagccaaagaaacaaaacgaatgatcgacctcatccggaatttcatcggctaccgggaatatccaaaatacggaatggtcagccgcttcttcatttataagcaggctttactgaaagaagccgatcaactcgtacaagcgggcgttattcatgaaaaggaagatatatactacctcacttttgaagaatttcacgaagccgttcgcacaaaaaaaatagatgacaagatcatcagcatacgaaaagacgagtacaaattatatgaaaaactaaccccgccacgtgtgatcacgtctgatggtgaaatcattacaggtgattacaaacgagaaagtttgccggcgaatgcgattgtaggtctacctgtttcttccggagtgatagaaggaagagcgcgtgtcattttaaacatggaaaatgccgatctggaagacggagatatattagtcacctcctttaccgatcctggctggacaccattatttgtatccataaaaagcctggtcactgaagttggcggactgatgacccatggagcagttatcgcacgcgaatatggcctgccggcagtggtcggagtggagaatgctacccaactgataaaagatgggcagcgaattcgcgtgcacggcacagaagggtatatcgaattattgtaa

SEQ ID NO: 2067 - DNA, 1425 bp, Bacillus licheniformis
atggagaaaaatttaaattccaaagcaatattagtcaccttcatgattggtgcattttttgcaatattaaacgaaacgctgttgaacatagcattaacagagctgatggaagtctttcacgttgatgccccgaccgttcaatggctggcaaccggatttatgcttgtaatgggtgtgttaatgcctatttccgctttactgattcaatggttcacgacaagacagatgtttatcggcgttatgtcgatttttttagcaggaaccgtcattgccgcttgtgcagtgaatttcccgatgctcttgacggggcgcatgattcaggcagtcggtacgggactcttgatccccattattatgaacgccctcttgctgatttaccggcctgaagtccgcgggaaaatcatggggacgttcggactggtcatcatgtttgctccggcgatcggacccactttttcgggcgttattgttgacatcctcggctggcgctggctgtttatcatcgttattccttttgcagtattttcaattctgtttgcggtaaagtatttgcaaaatgtcggagaaccgacgcgcccgcgggctgattttttatcgatcatactctcaaccatcgggatcggcggaatcgtatacggattcagcagtgccggagaggctcaggaagggtttcagtcccctctgatcatcggtgtgatcatcatcagcctgatcagcatcgtgttgttcgtgcttcggcagttgaaacttgaacaaccgttgcttgatgtgcgtgtgttcgcctataaaaattacacgcgcggggtctgcctttttgtgattgtcattatggcgatgttcgcttccgaaattgtgatgccgatgtatttgcaagggccgctcggtttttcagcaaaagcagcaggtcttttgcttttgcccggagccttgctaaacggtctcatgtcgccggctatgggcgctttgttcgataagttcggcccgagaaaactcatcattccaggtacgatcgttctcgtcggcgtgatgtttttcttcagcaggatcaatccttcggtgccgatttgggcgttcattattgtatacatcatcttgatgctgtccatctcggccatcatgatgcccgcacagacgaatgcattaaacgaattgccgaagcatttatatcctcatggaacggcaatttccaatactcttcagcctgttgcaggcgcactcggtgtttcggtgttcgtcagcatcatgagccagggacagaaaagctatcttgccggccaagaagcagccagcaaacaaatcgtgcatgaagcgatgactcatggtgttcaccatgcctactggtttgcgctcgctttaagctgtatcgctttctttaccgctttatttattaaaaaagcggtcgcgcctgattttgataaagaataa

SEQ ID NO: 2068 - DNA, 2040 bp, Bacillus licheniformis
atggagtcatatgttgatcaaaaagacgggattttcaaatccgtatgttcgctcgactgcccggatcaatgcgggctgctcgttcataaaaaagacggaaaaatcgttaaaatacagggcgacccggaccatccggtcacacagggcaatatttgcaataaagtccgcaatatgacggagcgtatttatgaccccaaacggctgaaaaccccgctgaaacggacgggtccaaaaggagccgggatgtttgaaccgatcagctgggatgaagcgattgaaacgattcgcacccgctggcagtcgctcattgaacaggaaggccccgaaagcattctgccctacagcttttacggaaatatgggaaacttgacggctgaaggaatggacaggcgctttttccaccgcctcggttccagccagcttgaccgggcgatttgcacccctgccggttctgtcggctataaatacacgatgggcggaagcatcggcaccgatcctgaagatacaacggagacaaaactgtttattttttggggaatcaacgcggtctcaaccaacatgcatcaaatcaccattgctcaaaaagcccggaaaaacggcgcaaaaatcgtcgtaatcgatgttcataaaaatcagaccggccggatggccgactggtttattccgattcgccccggcacagacagcgcgcttgcgcttggcatcatgcatgttttattcaaggaacatttggctgatgaatcatttttgaaagaatttacagtcggccacgaagagctgcgccgccacgtgcggcaatacgaccccgccgcagtagaggcggtcaccggcgtatcccggaatgatattatcgagcttgcccgcctgtacggccgcacctccccttcattgattcggatcggcaacggtcttcagcatcatgataatggaggaatgatcgttcgcaccatctcgtgcctgcccgcgatcacgggccaatggacgaaaaaaggaggcggagcgatcaaaggcaacacggcatttttggcctataatacaaaagcattgcagcgccccgatttattaaaaggcagaacgccgagagtcatcaacatgaatcagctcggcaaagctctcttagaaaccgaaccaccgatccgttcgctgtttgtgtacagcagcaatccggccgttgtcgcgcctgaggcgaacaaagtcagaaaaggacttgagcgcgaagatttattcacggttgttcacgatctatttctgacggaaacggcacggtacgccgatatcgtcctgccggcttcttccgctttcgaaaatacggatttctatacatcatattggcaccattatgcgcagattcagaagcctgtgattgagaaatacggcgagagcaagtcaaatacagaagtattcaggcttttggctgaggcgatgggctttgatgatgagccgctgaaagattccgacgaagagatgatcagacaggcgcttgactaccctgataatccgtggctcgatggcattgactatgacagcctgactgaaaagcattttgtcaaagcaaatcgaaaaacggtttttcctgataaactgccgacgcctagcggaaaaattgaattgtattcaaaaatgatggagcagcacggctatccgggcctgccgactcataccccgctcattgaaacggacaagtatccatttttatttgtgcccggcccgaatcacaattttttaaattcgaccttttcaaacaatgaaaaacatatcaaattagaaaaggagccgaaacttcacttaaatataaaagatgccgaagaaaagggcatcgaaaatggagatttggtgaaagtttggaatgaccgcggctcatgcatcctgcccgctgccgtcggagaaaacgtccttccgggcgtggccgtcagccagggattgtgggcggatgcagaagggaagcattatctcgtcaatgcgctgacgcccgaccgtttagctgatatgggcggtggtgcaactttcttttcaggaagagttcaaattgaaaaaatatga

SEQ ID NO: 2069 - DNA, 477 bp, Bacillus licheniformis
atgtcaagaacaaatcatattgaaggaaaagggctggtcaacgagctgatacagcagttgaggtttcacagcacagcaaccgtttttctgcaccaggcgatcggcgagaaaatcggactgaacggaacggatcataaatgccttgagatcatctcgcgggaaggtcaagtaacagcgggggagctcgccgcaaaaagcggactgacaacgggagcgatcacaggagtgatcgaccgtcttgagaaagcgggctatgtcagacgcatcagggattcgtccgacagaaggcgtcttttagtcgaactgatcccggaaaatctggagacgatatcacatatatttcatgacttggcgcaagagtctgccgaatttctaagccgatattcagaggaagaactgcaaaccattatcaagtttttgaaaaacagcacggcgtttgccgccgattatgccaaaaccttaaaaaagacgaagtga

SEQ ID NO: 2070 - DNA, 1455 bp, Bacillus licheniformis
cttcgatggacaataccatcgttgttacggcaatgggaacaattgtcggcgatcttggcggactcgacagctttgtctgggttgtatctgcctttatggtcgctgaaatggccggtatgccgatattcggcaagctgtcggatatgtatggcagaaaacgttttttttctttttggcagcatcgttttcatggcgggatcagcattgtgcggaacggctacaaccattgagcagctcagcatataccgcgcgatccagggaattggcggaggcgcgctcattccgattgcttttacgattatctttgacatttttccgctggaaaagcgcggtaagatcactggacttttcggtgctgtttttggcctttcaagcattttcggaccgctcatcggcgcctatgtcactgactacatcagctggcactggattttttatatgaatctgccgctcggtatggtttcttttattttcattcttctattttacaaagagacgaaacagcatgaaaagcatcgtattgattggctcggagcgattacgctcgtaggggcggtcgtatgcctcatgtttgcgttggagctcggcggcgggaaatacgcctgggattcgaatgtcatccttacccttttcggaagtgcagccgtcttgttggtttgcttcctcatgatcgagcgcaaagccagtgaaccgatcatttcgtttcatatgtttaaaaaccggctgtttgccggcagtacgcttgtcgccttattttatggagggacatttatttcagcgaccatccagattccaatctttgttcagggtgtttacggagattcggcgacaaactcgggacttgtgcttttgccgatgatgctcggctctgtcgtatcagcacagcttggcggattcttaacaacaaaaatgagctatcggaacattatgctcatctctggattggttctcgtcagcggattttctttattaagcacgcttaacattgacactccgcgtttattattaaccatgtatatgatcgtcgtcggcttgggagtcggtttttctttctctgtattaagcatggcagcgatccatcatttcggcccggagcagcgcggctcagcgacatctacgagcaactttatgcgctctctcggcatgacgatcggcgccagtatgttcgggatgattcaaaaaaaccaattttcagaacagctggaagatatgtttaaaagcagcggcgcttcaaatttcgcctcaacgaatgacgccgaccagattttatcaagtgcacgggcatcactgccgccggatgttttacataacatcaccgaagcgctatcaaattcgattgttcacacgttcatttgggcgatttccccagcagcggccgcctttttactggtgttcttcatgccgaatgacagggtgaaagtgaacgcaaaaaaggaagtgaacaaagccggctga

SEQ ID NO: 2071 - DNA, 1098 bp, Bacillus licheniformis
atgatccgttccgaagataaaatcacgacttctcaggcaatcgttgtcttggtcagttatattatggcggccgggattctcaccctgccaagaaccgctgtagaagaagccggtacgccggatgtatggatttccgtcctattaggcggacttgtcacaacggcagccggagtggttatgacaaagttaagccagcattatcccgggcaaacattttttcaatacgggggagacattgtcggaaagtggctcagtattgtgatcagcctgcttttcattgagcattttgtagcgattgctgcttttgaagcaagaattctggcggaggtgatcaccttttttttgctgcagcaaacgccgatttgggcgatcgtcatgtcgatgatgtggatcggattctattcaataaaagacggaatggggtcgcttgcccgtttgtttgaaatcatctttccgattacaattcttttctttttaaccgtggtatttatgagctttggcatatttgaactggataacctgcggcctgtcttagggaaaggcatcatgccggcattaaaggggacaaaagcaacaacgctttcgtttatcagcgcagaagtgatggtattccttttggcgtttatgaaaaagccgaaagatggtatcaaagtcgttgtcatgggaatcggcatcgcaatgctcttttatctaacaacgatcgtatttgtgatcggagggctgtcagttgacggggtgacagcgatgacatggccggcgcttgacctcatccgcagttttgaaatgcccggcttaatatttgaacgttttgaatcgctgctccttgtcatctggattatgcagctgtttgcgactttttccgtctcatattacgctgcatccctggggctctcgcaaattttcaagaaaaagagcagaccgatcatgttcggtctgctcccggtgatgtatttgctcgcgatgacgccaaaaaacattgatgatgtattttctctcggcgacatgatcggctatattgcggccgttttattcggcattgtgccgattccgcttttattggtttcgaaaatgagaaaaaagaaggcagtgcaaagctag

SEQ ID NO: 2072 - DNA, 1197 bp, Bacillus licheniformis
ttgaaaaaaactaacaccatccgttatttaacgagtgttttactattgtttctattaaccggatgctggagcagccacgaaattgaagagctcggcttaacatttgcaatggggattgacaaaggcgaggaaaccgaacttgaaaaaaagtttgacaaagttgggggcgattatccgaaaaaagaccggatcacgatgatctatcaatacgtgaacgaacaagcagccggttcaaaatcgattggaggaagcactgatcaaaaaacgtatatcaacgtttatgaaactggagactcgcttcagcaaattaacgctgaagtagcattaagacaagacaggcctgtattcagtcctcatttaaaagtgattgtcatcgccgctgacctcctccgcacctattcgctgtcggaactgctagatcagcctctccgcgataatgaaatcaggccgagcagtatggtgctggtcacaagagggcgtgcgagagacacgcttgagctgaaggaaaccggcgaaatgccggcgtttcgtctgcttaaaatcgttgaaaatgagtataaagcgaaaaaaattctccctcctgtaacgcttgccaaattgacaggcaaaatgagatcaggaacaagctatctgcttcaaaatgtcatcggtaccgatggagaaataaaatatgcgggagcagccgcaattaacgggaaaaccaataagctgatcggctatttggatgaacacgatttagaaggcgtgatgtggatcatcggaaaggggattgggggcatggttaaaagctatgatccgacagaaaagaaggtgaccgcatttggcgttgaatcgattaaaagcaacatcaaacccatcgtcaaaggaaaccgcctgtcttttgaagtgaacgtaaagtcagaggggtatcttgcggaaaactggaacacgaaagaaaaagcttttgatgacaaatttttagaaaaagtcgaaaaaacaaccgcgaaaacggtgaaaaaatcgatggaggacattacaaaaaaaatgaaaaccgaatacaaagcagatcttgccggattcggtaacgagctgaggatcaagcatccgaggctttgggaaaaactaaagaaaaattgggatgagacctttaccgatataccgattacatttcatgttcaaatcgcgattaaagaatacggaactgttggggatcagtaa

SEQ ID NO: 2073 - DNA, 1101 bp, Bacillus licheniformis
atgatggtaggtcagcaggacaaaattaccgtttcacaaacgagcatcgtcatcacgaattttctgctgggaaccggcatcttgacgctgccgcggacatctggggaagcggttaaagcgccggatgtctggctttctgttgcattcggagggctggttgccatattagccggtttcatcatggtgaaattaagcatggagtaccccgacaaaacgctatatcaatatagccgggatctcattggcaagtggccgggaggacttttcaccctgcttttgatttgttattttctcgcaacatcaggtttccaagtccgatctgtcacagaggttatgggattttacttactggaagaaacgccgatttgggcgacagcgatggtttttttatggagcggaatctatttattaaccggcggtattaacccgctcgcccgactttatgaaatcatctttccaattactgttctcatttttctgatcgtcatttttatgagcgcaagcatattcgacatcgacaatttgcgcccggttctcgggaaagggatcaagccggtgctggaaggagtcaaaacaacgtcttttgcttatacaggcatagaaatcatactgatcatcgttccttttatgagaaagcccgagcaagccttaaaagctactttgatggggatttctttcccgattgtcttttatatgatcaccgtcattatggtcatcggtgcattggcaatcgagggagtgacatcacggacatggccgacgattgatttgatgcgaagttttgaaatacctgggctgatttttgaacgttttgagtccttgctgctagtcatctggatcatgcaaatgttctccagttttacgatcagctattttgctgctgctttaggtttgtcgcaactcttgaagaaaaggatggaaccgatattattcagcttgcttccggtcatttatctcattgcgatggcgcctaaaaatatcaatcagctttttcaaatgggagatctaatcggcaacagcgccatctatttggtcggtctcatcccgctaatgcttctggtcatatcgaaagtgaggaggaaaaagtttgaaaaaaactaa

SEQ ID NO: 2074 - DNA, 1101 bp, Bacillus licheniformis
atgatggtcaggcacgaagagcgcatcaccacttcgcaaacagcagttctcatcaccaatttcctgcttgggacagggattctgacgctcccgcgaacgtctgttgacgaggtggggacgcctgatgtctggatcacgcttgtattaggcggcttggtcgctctgacggccgcagtcatcatggtaaagctcaaccatcaatatcctgataaaaccttttatgaatacagtcaggacatcattggcaaatgggggggcagcttgatcagcctgtttttcgcatgttacctcttggcccattccggttttcaggtccgctcaatgcttgaaatcatccgcttttttctactggaaggaaccccccgctgggcagttgcgatggtttttttgtgggttggcttatatttgatcgtcggcggcttaagttcgatcgcccgcttgtttcaaatcgtgttacccattacattcattctttttctgctggtcgtgttcatgagtatcggaatttttgatgtggacaacttgcgtcctgtactgggagagggaataggtcctgtcttaaaaggaataaaggtgaccgcactgtcgttttcaggtattgaaatcattttgatcctgatgcctttcatgaatcagcctcgcaaggccattcatacgatcatgatcgggatcgccatccctttgcttttctatatgatcacagttgttatggtgatcggcgctctgtctatagacggagtggtttcacggacatggccgacgattgacttaatgagaagctttgaaataccaggtctgatatttgaacggtttgagtctttgctgctggtcatctggatcatgcagctgttctgtacctttgcgattgctttttatggttcggcattaggcctggcccagctctttaaaacaaatattcggccgatgatgtttgttttgcttccggtcatttatctgattgcaatgatcccgaaaaacatcaacgccatgtttgcatttggtgactttattggaaacagcggcgtttatttaggcggtttgaccccgctcgtgctgctggtgatttcaaaaataagaaggagaaaacagggaatcagctga

SEQ ID NO: 2075 - DNA, 1569 bp, Bacillus licheniformis
atgagatggtggaaagcaaaaacgcgaagaatgatacagtcgtccaacaagccggataaacctaaaaatgaagtgccgtctgtggagtcaactgggtattttaccggcgattttgatcacgacttgaaactggccaaaacggctatggagaataactcagacgttcatttccgcgaattcaacttagggcgcaccggcatccgcgcggcgattgtatttgtcgaaatgcttgcggatcaagacctgattgacaagcatattatgaaatcccttatggatgatttttccaaagaatataaagttgaactttcttcattaagcagcaatgtgaccgacttaattaaaaagcaaattttatcaattagcggcgtatcagaggtaaaccatgtcaacgaagtggtgcccgaagtgttatccggtgcggccatgctgctgatcgacggttcagcggaagttttactgctgggaactgttaaaagaaatacaaggaacattgaagagcccgtatcagaatctttggtaagaggcgcgcgcgtcggctttacagaaacgatcggcaccaatacagcccttttgaggcagcacggcaaaaatcaaaacttgtctatggttcaatttcaagttgggaagcgagccgtcaaaaatcttgtcgtcgcttatatcaaagacattgcggaaccagggctggtggaagaagtcaaaaaaagaatcgaaaagattgatatagatgatgtccttgaatcaggttttgtcgaacagctgatcgaagacaattatctcagtccatttccgcaggtgcaaagcactgaacgtcttgacagggtaatgagtgcgttaatggagggaagagtggccattttattggacggaacgccttttgttttaatcgttccggttacattcagcatgctcctccaatcgcccgaggattattatgaacgctggctgccgagttccctgatccgcatcatgcgaatcggcgcagccatgatctcgctgcttgggccggctctatatatttcctttatttcgtttcatcccgggctgattccgagtgaacttgcgatttccattaccggaacgagggtaggtgtgccttttccatcgctgattgaagcgctcattatggaagtggcaattgaaattttgcgcgaggccggcctgcggcttccaaaaccaatcggtcccgcgatgggaatcgtcggcggtatcatcatcggggaggctgccgtgcaggcaggcatcgtcagcccgattatggtcatcgtcgttgccgtcaccgcgatttcttcatttgcgattcctcaatacagcgccggcatttcgctgcgcatgctgagatttgtagcgatgttttgtgcagccacgttcggtttgtacggggtgattatgtttttcctcatgcttgccagccacgcggtgaagctgaaaagctttggcgttccttatgcgagccctgccgttccttatcgtttgcgcgattggaaagacttcatcgttcgcatgccgatacagatgatgaaaaaacggccgaagctgttaaaaacagacgattcgacacgccagtag

SEQ ID NO: 2076 - DNA, 126 bp, Bacillus licheniformis
atgtggaaaaccattgtttcctattttccggactggctggtcctgatgcaggctttttttgtcttttttgtcccgtttgccatatcaaaagtatttttgtggcttcgcacggcaggggatgagtga

SEQ ID NO: 2077 - DNA, 1728 bp, Bacillus licheniformis
atgacgattttaatgaaaataagaggcttggaaaaaagctttggagagcaaacgattttaaaaaacattgattttgacatttccaatcatgagcggattggtttggtcggatgcaatggagcggggaaaacaacgcttgcaaatatattgagcggtcatgcagaagccgacaaaggcactgttcaaacagaccggacgctcaaaatcggctatctgctccagtcgattgagtactctgttcatgatttcaacagcatattaacaggcgacgagggcgggaaattatatcagttgacgagcagtcttggcttatcaaaggttcaaagctggaattccgaacggctcagccatttgagcgggggagaaaaactgaagcttgcactggcacacgtctggaagacgatgcctgatcttctcatcttagatgaaccgaccaatcacttggatttaaaagggatcagctggctccttgaagaactgcaacaatatcaaggggctgtattgattatttctcacgaccgttattttctggatcaatccgtctccaaaatacttgagctggaagatgggaatttgcacacctatcaaggaaactacagtgcataccggcgggagaaaaaacggttatacgaagcacgcctgcaccaatacgaagtccagcagaagcaaaaagaaagaatcgagtcacagattgccactcttcaaaattggtcgcagaaagcccaccgcgactcaacaaaacagggatcacagtcagaaagaaggcagcttggttttaaagaataccaccgggtaaaagccaaaaagcttgacaaccaagtcaaatcaaaactgaaacgccttgaacaggagcttgaaaaaaacaaagctgaaaagccaaaggaagcagcatctgtcaattttcagttttcatcaggagaaaaaaggggcaagcggattatcgaagcaaaagatctgacaaaagcgtttgacggacgtactttattcaaagacagccatttttacgtcaaacacggcgagagaatagcgcttatcggagacaacgggtgcggcaaaacgacccttgtcaaaatgatgttggatgccgaacctccaacagccggaacgctatggaaaagccggtctgtaaaggccgcatatttaagccaggatgtcagtgatctaagggttgaccaaacagttgctgaagtgctgaatttgtctgacagagccgaaatcgcaaatgcgcggacgattttggccaatatggggatcaaagaaaaccgctttcatgatgaaatcgggacgttcagtctcggggagcggacccgaatcaaactggcaggcatgattttaaaagattatgatctgctgattctggatgaaccgaccaaccacctcgatttgccaagcagggagcagcttgagcagacattgcttgagtttcagggaacgatcatcattgtgtcgcatgacctgtacttcacagacaaattgtgtgagaagctccttgtatttgaaaacggtcgtatcacccgcgtcgaaaccggattaaaagattatcggaacagacagaaacagccccatgcaaaaagcgatgaagaggagcggctgcgcatcgaaaatcggatgaccgccgttcttggagagttggccggacttacgcctcaagatccgaaatatcatgaattggatcaggagttttcagagctggccaaacggaaacgggcgtttttagaaaaagaataa

SEQ ID NO: 2078 - DNA, 1986 bp, Bacillus licheniformis
atgaaaaaaatattggaatggttcaagcatccatctctttcaaaaagattagcggtctcatttttattgattttaacgctccctgttttaatcctttcaggtgtttcctattatacggcaggcgggtcgattgaagatgaaatcatgagaagcgcaagaaacagcgtggatcaattaaacgaaatgatcgatcaaaacattgagaaaaaagcggatgctgttacatatttcagtgaagagatcaaagaaaaaacatacaaggaaaaaggccagacttcgttaagacaaaagtttgaacaatacgccaggcaaaacaaagatgtagaagccgttttcacaggctctgaagacggtgtatacgtgcagcacccttatacgaaaatgcctgacggctataatccggcggaaaggccctggtttaaagaagcggttgagaaaaaaggcgaaattatcgttaccgatccatacacatctgccgctaccggcaacacggtcattaccatcgccaaacaaaataaagacgggtcgggcgtcgctgcgctcagcttgaatatcgacgagctgattaaagcgacaaacgatatcaaagtcggaaaagacggctttgcttttatctcaagtgcgtccaaaaaatatatcgcccacccgacgattaaagccggaactgaaggtgaaggcggctgggttgatcaagtttacggcaaaggaaaaggcgaattcaagtatacttttgaaggaaaagccaagcaaatggcttttacgacaaacaaactgacaggctggaaaatcgccgggacgatgttttccgatgagataacaaacgcaacaaagcccgtcctttatatggctctcatcgtcttttcaggggctttggtgcttggcggagttctcattttctttattgtccgcgcgattagcaaaccattgaatcagctcgttctatctgcaaagaacatcagcagcggcgatttgacacagcaaatcgaagtgcgttcaaatgacgaattcgggcagctcggcaaaagcttcaatgacatggcggaatcgctccgcacactgatcggcaccattcaggaatcggttgagaatgtcgcctcctcttctgagcagctgacagcaagcgcagaacagacgagccaagcgacagaacatattacatctgcgatcgaacagttctctaacggggctgaaagccagaatgaaaaagtcgaaacgagctcgcagcagctcagccagatgaatgatcatctgagcgaaatgaccgaagtgtcggaatcaatcaccgaagcatcgatcaaatcgacagaaatcgccgaaaccggaggagaactcgttcagaaaacggtcggccagatgagttcaatcgaccaatctgtcaaacaagctgagagcgtcgtcaaaggcctcgaaggcaaatcgaaggatatcacatcaattctcagggtcattaacggaattgccgatcaaacgaatctattggcattgaacgccgcgattgaagcagcccgcgccggcgagtcaggcagaggattttccgtcgtcgccgaagaagttcgaaagcttgccgcgcagtcagcggactcggcaaaagaaatcgaagcgttgattcaggaaatcgtcaaagaaatcgaacattctctcagcatgtttcaatcggtcaaccatgaagtgcagtccggacttaaaattaccgagaaaacagagtcgagctttcacgaaatcagcggcatgacgaatgagatcgcaggcaagctgcaaacgctcaatgcggcggtcgaacagttgtcgaatggctcgcaggaagtctccggtgccgttcaggaaatcgccgatgtatcaagggaaagtacagctggaatccaggacattgctgcatcagcggaagaacagctggcttcaatggaagaaatcagtacatcctctgccacgcttgagcagatggcggaagatctgcgagaattgacgaaaaaattcaaggtgaaataa

SEQ ID NO: 2079 - DNA, 333 bp, Bacillus licheniformis
atggcaacaatcgaagattttttaaagcttgatattcgggttggaacagttttaaaagcagaagagtttccggaagcgaaggtaccggccattaagcttgaaatcgattttggcggagagattggcgtcaagtgttcgagcgctcaaatcacaaagcgttatacgcctgaaaagcttgtaggccggcaggtgacggcagtcgtcaattttccgccgcggcggattgccgggtttaaatcggaagttctcgttcttggaggcgtaccggaaaaaggcgatgttatattgctggcccctgatcaagaagcgcccaatggaacgaagatcagctga

SEQ ID NO: 2080 - DNA, 1329 bp, Bacillus licheniformis
atgttcggttcctacatggttcaaatggtaaggtccaacgcccataagctggaccggccgctgagagaaagcgtgctgaaactctataaaccttttaaatggacgccttgctttttacacggttttttcgaaaaaatattaatgaaaaacaaaaaaataccagtcattattgaatttgaaaaagactgtcagcataaaggctatcaattagtcaatgaaatgatcggcagcaaaagaagaaacaaaatcaagcatcgcttctccaacgttagctgctgcagcgctgaagtcaccccttcttctttgcaatcgcttctatctgagtgcggcgacattcgcaaaatttatttaaatcgcaaagtaaaagcgctcctcgacgtagcggttgaatcaagccatgccaaagaagtggtcagaaacaatcagacgctgacaggcaaaggagtgacagtcgctgtcattgatacgggcgtataccctcacgaagatcttgaaggcaggatcagggcttttcaagactttatcaaccagagaacagaaccctatgatgacaatgggcacggcacacactgcgccggtgatgcttgcggaaacggagcggcctcatcgggtcagtaccgcggacctgctcctgaagcagaacttgtcggtgtaaaagtattggacaaaatgggatccggatcgctcgaaaccgtcattcaaggcgtagattggtgcattcaattcaataaggaaaatcctgatgatccgatcgacattatttcaatgtcattgggtgcagaagccttgcgctacgagaatgaagaagaagatccagtcgttaaagctgttcatgcagcatgggacgcaggcattgttgtatgtgcggcagccggcaactccggtcctgatgcgcaaacgattgccagcccgggtgtcagcagcaagattattacagtcggagccttggatgacagggatacagtcagccgggaggatgacgatgtcgcctcttattcaagcagagggccgacaatctatggtcaagtcaaaccggacttgctggtaccgggcacaaatattacgtcgcttcgttcacccggatcttttctcgataagctgcaaaaaacaaacagagtcggcacaaaatatatgacattgtccggaacctcgatggctacgccgatctgcgcaggaattgccgcacttatccttcagcaagccccgggcacagaacctgatgaagtcaaacagctgctaatggacggtaccgatttatggaaagatcgcgatccaaatgtttacggtgcagggtacatcaacgcagaacaatcggtgccgcaagactaa

SEQ ID NO: 2081 - DNA, 411 bp, Bacillus licheniformis
atgggtaagttgactgaaaagctgggtttggctcttgttttttcaatcgttgtctggcttggcgccaccgtattttttatgctgttcggcagtgcggttcttacagaacccggccaagatggttttatgctccgctttttgcttcttgaagccggaacttttgcccttttatatgccgtgatgctcgtttatcggcgggttgacaaaacgaggtttgcggcggttaagcttggcattgtggggtcggctgtcggtttgtttctcgacgctttttctttatggaatcattcgctgatcttcccggcgctttcagatggccagatgattgggtttgcggtttggatggtcttcgcgtatgccatgtatttgacgataccgctcatccttgaaaaaagaaggtctgcagtttaa

SEQ ID NO: 2082 - DNA, 600 bp, Bacillus licheniformis
atggcaaggccaaatgtgacatcaaaagaaacgttgattgaggcggctaagcgccgcattgccgaacatggcctggacaaactgacgctaaaggcggtcgctgaagaagcaaaggtcacacagggaactgtttactatcattttcggacaaaagagcagcttgtttttgaagtggtccgcgacctatgccgcgcgtcgtgggagcgattgaaagcaaatgaaaagcccgctgccgaaaggataaaagacggattgtcttccgcgaaatcaagaacactgaaggatgcgtattatcatcagctttttttagaattggccgttttagggtttcgaaatgaaaagataaaagaacagctcggcgaacttctcgaagaggaaaatgcggtgttggcagaacagctttccgacctgtggaagcgttctcctgttgacggggtttctttcagcacgtggggcattcttttaaacgcactaatcgacggtcttgcacttcagtcgcttatgtctccgggattttcccctgaaaaaatctacagggaattagaagctgtgctgcagatgctgacggaaaccgctgttaaacagcatggaggggagtaa

SEQ ID NO: 2083 - DNA, 486 bp, Bacillus licheniformis
atgtctgaactgacaaaacagctgatctatgatatgtatgttaaactcctgcacctgaacgaacaaaaagcggatacagatctcaaggcatttttaaagcaggcggcagaatctgatgttaaacggctcccggggaatatgactaccatccatgtcatcagctgtatcggtcatgatgaaccgatcaacaacaccggcatcgcaaaaaaaatgaatttatcaaaagcaaatattacaaaaatcagttcaaagctgttaaaagaaggcctcatcaaacggtttcaattgacggacaacaaaaaagagatatacttcaggctgacgcccagcggaaaacaagtgtttgagcttcatgaaaagctccatcagcaaaaagcggatcagtttagcagatttctcgattcgttttcaacagcagaacagggagcgattttgaaattccttcaagggctgacgtttatgacagaaacggataagaagcattaa

SEQ ID NO: 2084 - DNA, 432 bp, Bacillus licheniformis
atgaatattgaaggaatagagatggaagttcgctgcacaggcgatgtatgttcagatgcccttgaatttttgagacgccataaccacgaaaaaacagccgaacattcgataagggtgaaacaagcggcagaaagattggcaaatcgttttcatgttcctgcacaaaaagctggtatagccggtatgatgcacgacatcaggggtgtcatccctaatgaaaaaagaattgcggctgctgaagcgctcggtattgatattctgcccgaagaacggatattcccgatgatcatccatcaaaagctgtcgaaagtgatggcgcgggacctgtttcaggtggcggatgaagatattttaaatgcaatagaatgccatacgacgcttaaaaaaatccttcccagctcgaccttgtcctgttttcagcggacaaaatag

SEQ ID NO: 2085 - DNA, 486 bp, Bacillus licheniformis
atgctaaaaaacgttttgcttgaacagtttaaagcatgctataacgaaacgacttggtttgtttgttttcaaacggctgccgctgatctcacggaaagccaggcaaggcaaaaaggggaaggttcggaaaattcgattttagaaattgccaaccatttgattttttacaacgagcgctatttaaagcggtttaaaggaattcccgttccggcttttgattatacgatcgatgatacgtttgtaaacaaaagcggacttggctggaaagaaagccggcaggaactgaatacgatctatgccgaatggatcgatgcgctttcggaatgcgaagaggagatgctgaaacaaccggctcagcacgatccgcattctacctgggcggagattttgtcctgcctcattcttcataatgtttatcatttggggcaaatcgtccatatgagaaagcagctgaaaatctgggatgcttcaaaaggcgtgaattaa

SEQ ID NO: 2086 - DNA, 1647 bp, Bacillus licheniformis
atgaaagcccgccgtttttttgtaagcgttctttgctacgcggtttttttcatcggcaaagcgccggatatcccggcggcagaggcgcttcttttattatcaatgctgttttttgttccggctgcgctcgatctcattcagcatgaaaatgggatgtttcggctgatcagcgtctgttttccttatgcggcttgttcggcatcgctatcactgctgttccattccccgcttttttcattggtttggctatgctatacggggatgatcgccttatacggggcacttcgcctctgggagagagaaggaaggagccttgaagaggcatcgattgacagcggcctgctttaccttccttttggaggggggtggctttttgcttatacgctgaatctccaggtcatggatttcagcccgctgattgtgctgctgacagcggtacattttcattattctgcatttctcattccgatttttaatggaatgctcggaaggaagctgaaaaagaaaggcctcctttatgcggcggtgacatggctcatcatgctgtctccgctgttcattgccatcggcatatcgttttcgaaaaccattgatgtcatcgctgttgcgctgtatttgtcggccctatacggaagcggctttctcgcctcgattacggccttcaaaaacagcgcggctcgccgctttgttatcttttcgtcttttacattaatgatcaccattgctttttcactcatttactcttacggcgtttttcgcggccggacgacttttacaatccaggaaatgatttggattcacgggcttgtcaacgcctttggcgtcatcattccagcgctgaccggctggcgccttgaatcccctgggccgggctgtgaaaggaggcaaggcgaaacgatgagcaacatttacggcacttggaagatcggagccgattttttacacagacaccgattacaaaccgattcgtcttaccaaggtcttgccgatgatatgagcgcatttcagagcaaaggatttcagcctgagaaggtttctcctcttattctcgatttctatgagcatactgccgattattcgttaacagcggagatctcctggcgtccatggtttaaaccgctcgcgcacatgtaccagctgatttcaagaaagacaggacaaattcatttggggactaagaccggacggcaaacgatggacggagagattatcggtgttgattcagccagagacggaaggaagaatgtgcgcgcctggatcagaacgaacgaggtaggcgagactgtgtttgtggcgctttattctgctcatacccacgatcacatcacatatatgaatatcgcgctgccattgccgttttccaatatgacaggcattttaaagccgaaagcagaggacggctgcctgattttgacgagcagtgataaacgatctgaccgtggggatgaaggcatcttcctttcgaccggaacaggaacgtttaaactgccgctcgccgaacgctttatcattaaagagcagggacgaaagaggctctgcgcccatcaccgcatgtggctgttcggcatacggtttctcgacattcaatatcatattgaaaaaaaggattctgccgtgaaaagggcgaaaatagcaaatgaaagctag

SEQ ID NO: 2087 - DNA, 618 bp, Bacillus licheniformis
ttgatttcgatgtatgaacgggtgatcgaggattttcaccttctccacccaaaactcaaggagcggtatcagctcactcaagaaaacgtgttcaaaggaaaaggagtgatgacggaaatttccggcggttcatactgggtcagactgttgttcaaagcgggaacggtcttccgctgtttttttcccgaaagggggaggaacgttccgttcacgattgaaaatcacattcggctgacgaaaaatgatacaccggcagccgtttggaacaggactttcttttttcaggataaacaaaggcatttcgatgctgtcatgatctatgataaaagccgtgttgaaatcatcgactatttcgggcatccgccaatcttaatctcaagcctgcggtttaaggcggaggccgacggctcattatcgattacttctgtcagacaatggctgcctttattcagaaaaaagctgccccttccaaagtgcttatacggtatttccagcgtgaatgaatcgtatgacgaagaaaaaggctgttttacaattgacgttcatgtgaaaaacccgctgttcggaacgctgtttgcctacagaggaacgtttaacagggaggaggagacggcatga

SEQ ID NO: 2088 - DNA, 900 bp, Bacillus licheniformis
atgaaaaaaactccaatttatgtagaaatatccatccaggcagaaatggagcggctatggcgctatacccaagacccaaccctccatcggcaatgggacttgcgatttacggacattacctatttaaagcgcagaccgggtgaacctcagaggttcttatacgaaacgagaatcggcttcggcttaaaaatctccggcaccggggagtctgccggaaacgtatttcaagatactggagacagagtctcgtcactcaagttcgctacaaaccacccgctttctgtcattcgcgaaggaagaggatattggaaatacagcgagagcgaaaccggaatcacgtttatgacacaatacgattatgacacccgttacggtaggctgggccggcttgcagatatggcattcaggccgctcctcggctgggcgacggcctggagttttgatgcactgaagatttggcttgaaaaagggctccatccaaggctgctttttcaaaaaacattggtctattggctcgtttgtctgctgttttctttcgtctggatttaccaagggcttgttccaaagctcatcatggctcaccctggggaaatcagcatgctttcggcttttacgggcggccgtttccatcccgaaacgctcctgaggcttatcggtttagccgaggtgatggtcggcgtgttatggctttatcctgttcggaaaaggaagtggtttcttctgcatatcgtcctgcttgtgctgctttctgcctccgcgggaatggctgatatcgcatcttttgccgaaccttttaacccggtcgtgctcaatgccgcacttatcatcttgtccgttatcggctatgtgagcgcttgcggcattccaaacgcgggaaatacgatcagaaagaggcgttga

SEQ ID NO: 2089 - DNA, 573 bp, Bacillus licheniformis
ttgtctccgcgaatcggtttgaataaagacgcagtattggaagctgctgcagctctggctgatgaggaaggcattcatgaagtgacgcttgcttcactttccaaaaggctgaatgtcaaatctccgtctctgtacaatcatataaaaggattgaacgacttacggaaggaactcgcactttacggcttgacgattctttatgaaaacatggcttcggctatccagagagccgaagaggatcaggctgtcagccaaatggctcatgcctatctcgcttttgccaaaaacagaccggggctttatgaagcaacttttattgcaatgcccgatgaagatggacggcttgacgaggctggagacagagtcctcgccttggtgctttccgttctgaaagactatcatttagatgatgaagccgcgattcatgcggtcagaggcttgagaagcatcctgcatggatttgccgcactcaggcaacacgatgcgttcggtcttccttatgatgtagaagaaagtcttgatctgacaatccgcgtcttcttaaaaggcattgctgtctatcagaccgaataa

SEQ ID NO: 2090 - DNA, 714 bp, Bacillus licheniformis
atgaggatgacccgatttgaatctgtttaccagctgactttttttccgcacatatttcctgtcaactgttatttagccgatgaagaagacggtctaacattaattgatacagggattccgatcagcaaaaccgggattttaaaggctgcggatcacctccgcaagccgattaagcggattttgctgacccatgcccacagcgaccatgtcggttcgcttgacgcgctgtaccacagccttccgggtgtgaaggtgtcaatatctgaacgggatgcacgtctgttaaaaggcgatacaaagatgctggaaggggagcgcggaataatcaaaggaggcgttccgaaaaacatcaagacaaatcctgatatctttttaaaggaaggagacagaatcggttcattgctgactgtttcatcacccgggcatacgcctggcagcatttcgttttttgatgaaagaagcggccttctcatagtcggtgatgcgtaccatacgcgaagcggcatgacggtatcggggcatttaaagctttcatttccttttccggctttggccacatgggacaaagaaatcgctttagaaagcgcacaaaagctgttagatttaaaaccaaaggcgcttgccgccggccacggcgatcttgtccatgatccggctcaagcgatgaaaaaagcggtaaacgaagcatacatcaaattaaacaggaaaggatga

SEQ ID NO: 2091 - DNA, 474 bp, Bacillus licheniformis
atgagcttttctcatttcgaaaaacagaaggcaaagttattcagcggggtatccaccgtaacaagcaaccaaaatgaagcaaccgaaaaaggtaaaattccttccatgtggagtttataccgtgaaagatttccgcataaggaacgccaggacatgaagagagatacgattgcgctttattcagattatgagtcggaagaatatggggcgtatacattttcaatcggtacgttcgctgatcagcatgaaaaagcggccaatgtgatttcgctccctgcatccgaatatgccgtttttgtttcaaggcgggggaggatcgaagaggtcgtgtttgagacttggcaggagatttggacatgggctgagaaaaatctccgtacatataccggagattatgaagtttatggtgaacaagcagtgaatcccgaaaatgctcaagttgccatttatattgctgtcgatcgaaaaaaataa

SEQ ID NO: 2092 - DNA, 282 bp, Bacillus licheniformis
atggaacattatttttgccaaagctgcggcatgccgatgacaagcgaacttttcggcacagaaaaagacggggggaacagtcgtgactactgcatttactgctatgaaaacggagcttatactcatccagatgcgacattgaaagatatgatcgaaatctgtgtgccttatataaaagaagagggaaaaaccgaggccgaagcgagagcgcttttgtcgcggacactcccttatttaaaacgatgggcggcggcgcaaacggaaggcgggcagggaagatga

SEQ ID NO: 2093 - DNA, 936 bp, Bacillus licheniformis
gtgaaaattgaccggcttttggccattgtgattttattgattaataaacgccaagtgcaggcaaaggagcttgccggcatgttcgaagtctctgtcagaacgatttatcgggatattgaggcgatcaaccaggcgggcattccgattgtcacctcacagggagcaggaggcgggatcagcatcatggagcggtttcggctcgaaaataagctgctgtcagcagacgaactggcggccattacgacggctttggaaagcgtttcctcgacgtacgaagtgctccatcacgggtctgcacttgaaaaaatccggtttctcgtttcggaagaagaaatgccggaattccgcaagaaaacggaaaaatggtttgttgacatctcttcctggggagaaagtcctgtcatcaaagaaaagatccgcttgctggatgaagcgtcagacagcacgcgggcggtctcctttaattatgtggacagagaggggcagaccggaaaaaggaaagcggagccgcataccctcgtcctaaagggaaggcactggtatttgtatgctttctgcctgaagagacaggcgtttcgcttctttaaactgttgcggatgaaagacgtgcggatgcttgaagaaaagtttgaaagaaaggaagtcgatctgtcttcacttccttgggagacatcgtggtacaaaccggacaatatgaccgaggtgacccttctcattaagccgtcgggagagtctttggcaagagaatggttcggctcagaagctctcacttatgaaaacggacaatgcgtggcaaccatttcttatccggaagatcaatggctgtacggatttctgctccaatttggaacccatatcgaagttctcgatcctcctcgcatccgtcaaaaaataaaagacttggcaaaacaaattgtacatttatacgaaacctga

SEQ ID NO: 2094 - DNA, 498 bp, Bacillus licheniformis
ttgcagtttttcatcattgtgtccatcgtctatatcaagttcaaacggtcggtcggttatcagcctttaaagccggcacgcatgttgttccggatcatccttttttcgggaattttcgtttttctgctgacgatgagcgcacttcaccctttatcatacttttatgatctgattgggatcgcgctcggactcatcttgaccgtctatgcgctgaagcatgtgtcgatcgaaaatcggggcggagtcctttatttcagaacgcatttatgggttgaattgatcgtactctttttatttttataccggtttctgtaccggatcgccgagatcggccagctgcagactgcggtttcagacgggggttcggcagcttacggcgccctttttgcgcaggacccggcgacgatgatcggtttttttgtactggccgtttattatgtcggtttctctttttttgttttaaaaaaaggcagaaccgaagaaaagcgctcagcttaa

SEQ ID NO: 2095 - DNA, 333 bp, Bacillus licheniformis
atgagtgagcacaatcaagaaacaacagaaaaacaggtgcgggccgagttagatgaagaaactttatttctcgtttcacagacgtttaaagcgctctctgacccaacgagaatcaaaattcttcacctgctctcacaaggcgagcattcggttaatgaaatagcagagaagctgagtctcctgcagtcaaccgtttctcaccagctcaggtttttaaaaaaccttcgtctcgtcaaatcaagaagggcagggacttccattttttattctccggaagaccagcatgtcctcgatgtacttcagcagatgatcgatcatacacaacatgactaa

SEQ ID NO: 2096 - DNA, 825 bp, Bacillus licheniformis
ttgaaaaaccatatttgcacgacgtgcggcgttcaatataacgctgcttcgaaagagccggcagaatgcattatttgcaatgaagaaagacagtatgtcagtttatcagggcaaacctggacaacactggaagaaatgaagcaaagcgggaggtttcaaaacgagatcacctttgtagaggagcgcctatacagtttgacgacaacacccgaattcggcatcggtcaatcggcgtacctgattcaggagcccggctttaacttgctgtgggattgtattacatacctggatcagcgtacgactgagaacatcgagcagatgggcggaatccaggcgattgctttatcacatccgcattattattctgcacaggcggaatgggctgaaatgtttgatgctccgatctatattcatgaagatgacaaacaatgggtgcagcggccgagcagccggattgttttttggtccggcgaaactctcaagctatcaagcgggttgaccttgcacaggcttggcggccattttaaagggggagcggtctgccattgggcaaacgggaacgcaggcaagggaatcctcctttcaggagacattatccaagttgttcaagatcgcaggtgggtgagttttatgtacagctatccgaatttgattcctcttcccgccggcaaagtgcagcaaatggctgatcaaataaaggatgttccattcaacaggctgtacaacgcttttcgccgctcagttgaaaaaaacgccggagaatgtgtgcagaggtctgctgcaagatatgtagaagcgcttcaaggaacgctgttttcgacttga

SEQ ID NO: 2097 - DNA, 243 bp, Bacillus licheniformis
atggatatattgagaggctatgttgaagccgtcaaaagaaatatggaaacgatgaatgcatctgattatgatggaaaagaagaggatttaagaagacagcaggaagagctcgaacgctatgaacaacagttaaaagagaaaagcgcttcggccgaaagctttgatcaggtagtcaatgccgctgtagattgcgcggccggcgacatttcctattcacagcttgaacaaatgtttcaaccatag

SEQ ID NO: 2098 - DNA, 1152 bp, Bacillus licheniformis
ttgaaaaacgaaactgcgcttaaacgaagccttacactcggcccgctcgttgtgatcggccttgcttatatggacccgctcgtcgtatttgattcctacggagttgtcgcacagctgacaaagggacacgttccggcggcatacgtattcactgttgccgccctccttttgaccgctttgagctacggcagcatggtcaaagcttaccctaaagcgggatcggtttatacttatgcatatgaaagcattcatccgcatgcgggatttttagccggctggacgatcatgctggactatttgtttttgccgatggtcaactttgcgatcggcagcgcttatttaacggcggcttttccagaagtgccgcatggtttttgggtcgttctgctcgctctatccatcactgtcgtcaatgttttaggcatcagactaacggcaaatattacagggctgttcgtcgcttttcaagtgatcgtcgccctgacttttgccggatttatgatcgccgggctggcaggcggcctcgggacgggcgagctgatttctgccgatccgtttttccattctgatatcgaaccttccctgattgtgtcaggggcgacgattttgtgtttttcgtttctcggttttgatgcgatctctacaatgtctgaagaaacggtcaacccgaagaaaaacattccgttagccatctttctaacagtagcgatcggcggaacgctgttcacggcgatttcttatttgatgcagcaaatctatccgtcctatgataacttccggcatgccgattcggcatcgctggaaatagccctatatacgggaggcgcttttttaaagtccttctttctggcgggaacgatggtcgcagtcatttcatcctcgctctcttcgcatgcgagcgcttcgcggcttttgtatgcaatggggcgtgacagctctcttccgaaacgctttttcggctacgtgcatccgactttaaagacgccggtatttaatattttgttcatcgggctgatttctttgacggccatgatcggggaattagaggtcatctattcattcatcagtttcggcgcgctgatcggattatttttgtccatttgtctgtcatcggccattactacattcggaggcaggaaaaaggctttttaa

SEQ ID NO: 2099 - DNA, 609 bp, Bacillus licheniformis
ttgtcattttttgtgtttgttccattgatcattttctttgccatctccggtctggaacaattaaaatggcttcctcttgacactgaatctaatattcttgagagattaaaagattacaagcctcttgttgaagaagaactcgataaacagggtctttcacaatacaccggtcttttattgggcatgatgtatcaagagtcaaaaggcagaggcggtgatccgatgcagtcgtcggaatctctcggcatgaagcgaaatgagattgacgatccaaaagcaagcattaagcagggtgtgcgccattttacagtaatgtatcaaaagggacagaaaaaaggcgtcgatattgaaacgattatccaaagctataatatgggggccggttatatcgactatgtctcaaaacacggcggaaagcactctgagaagctggcaaaggcattttccgaagaacaagtcaaaaagaaccccgacctgtacaattgcggcggggatacaaacaatttccgctatccttattgctacggggattactcttacacggaaaaagtaatggaacgcacaaaaaaagtcgaagaacatatcgaaggattaacacttgaacattga

SEQ ID NO: 2100 - DNA, 987 bp, Bacillus licheniformis
atgtttgaaaataaaacgatattcattactgggggaacaggctcatggggtcaggaactcatacttcagctgctagcctcaagccctaaaaagatcattgtattttccagaaatgaagaaagacaagttcaaatgagaaggcagattgaagatccgaggctgacgtttttcatcggggatattagagatcggaaagcgctcaatacaggattaaaaggtgtcgactatgtcttccatttagcagcgctgaagcatgtcccggtttgtgaagaacagccgcttgaagcattaaaaacaaatgtcacagggaccgaaaacgtcattgaagcagcgatcgaaaacggcgttaaaaaagtcatcaacgtctcgactgacaaagcggccgaccctgccaacttctacggaatgacgaaagcgatcggcgagaagctgatcgtatacgcgaaccatctgtattcagacacgggttttatttgtgtaaggggaggaaatgtgcttggaagcagcggaagcgttcttcagctttttaaagaccagatcagggaaaagaaccaagtcgccatcacagacaaaagaatgacccgtttcttccttacgaaggaaaaaacgattcagcttttattaaaagcggctgaaagcggccaaggcggggaaattttcattatgaattcgccggcctgcaaaattttagacatggctgaggtgctgatcgaagcttatggaaacgaaataacgtccatcgcagaaacgggggcaaggccgggggaaaagcttcatgaactgctgatttcacctcatgaacggcagcatgctgtctcatttacagatgacctcgcggtggtgcttcctgcaatcaaaatgcccgagcttcataaaaagtatgcggattgccagcctttagaaacagataacttgagctcaaaagactttttaatctcaaaagaggaagtaaaagaaatgctgaaaaaaggcggttttttggattag

SEQ ID NO: 2101 - DNA, 639 bp, Bacillus licheniformis
atgaatttaaaagagatacaaggcgaatatgatgcggttttcagcctagggcatttgtgcctgacagctcttcagctgagaaaaatgaataaaagaccttatgcaggaccttttgattgggtcggcacctcgtcgctgcctgatctgtgccgcttgatacgaaaccggtttgaagggtttatgaatcctataaatttgagagtgacgggctattctacaggagttgccactaaagacccttttatctcggttacggatgattattactgcattgactcggcacacgattttaaagcggatcgaaatacactcgacaacctggctacttatcatgaagtaatagagaagtttaataggagatttaacagatttttagaaaagacctcgactgcaaagcgcgtgctgtttgtcagaacgagcggcacgatgcaggaagccaaagagcttgaagaggtgctctctgatttggttacaaacgatttcagcgttcttttgatcaatcatacaaatgtatccggtattgttgaaaatcactggccgctgaagaacgtatgcgctgttgaacttcctgatcaagaaatttggcaatcaaacgacccgtattggagagaaatgttccaaggcataacaattcgttag

SEQ ID NO: 2102 - DNA, 414 bp, Bacillus licheniformis
atgaagtctgaaattaaaaagcatttgtttgaacttctgacaaaagaggaaatcgatgtcggttggtgggataaatatttggaattgcttttcgagttccgaaaagaaagagttgaagcactggcagaaaaggcagctcagacgaattcagcagcaggctcagaagctgtatcaaatgaacagccggctgaatccggagaggccttaaagaacgaaagctcaaccaatgtaaacagcaaaaatgaagtcttagacgaattaacagccagctttgaagaaatgaacaataaaattatagaaagcaataataaagtgcttgaagcgatcaaagagtcacttcctgaaaattacacacttccaaatgatactacattaaaattctttcaaacacaaaatgaaaccaaaacagaatag

SEQ ID NO: 2103 - DNA, 1209 bp, Bacillus licheniformis
atgaaaattcttcttgccacttattggagtattccgcacgtaggtggtgtgtggacatatatggtccagctgaaagaatcgcttgaatctatgggacatgaagtcgatctgcttggatatggagaagagaacgagattgttcatattgtaaacgaagatcgcaaggtgaaaaaagaacagcttttgcctatgattgagcaatcagtcgatcaacagtcttttccgcaattatatgacaatcaattggtccactttactgagatccagcgctatgtatacgaacttgcagctatttatttagggctggaaaaatacgacctgatccatgcccaagatgtcatctcaagcggctgcctgaaaagagtgaagcaaaaagacacgccgcttgttgccacgcttcacgggagtgtagcccatgaaatcagacatcagcttacaacgatccacaggaagtctaattctgacatcgcaagggcgtactttgaccatcttgaacgggtcggcgctgtttcggctgacgctacaattgttgccaacaattggttgaagaatctgttgacaaaggaattcgatacaccggaggaacaaatcagcgttctccattatggctatgatattgacagctttctaaaacgaaaggatacaaagtcagcggaaataccgcaaacagataagaaaattatccttttcacaggaaggctcgttgaaaacaaaggtgttcagcatctgcttgccgcactttcgcatttaaaagaggttcgggatgattgggtatgctggattgccggcgacggggagagaatggcgggactgagaattttatgcgggcagctcggtttggaaaacgatgtcgtgtttatgaaaaagcgcgatgatgtcccatatcttctgtcaatcgctgatgtgtatgttttgccgagtcttctcgaaaatcagccgctgtctgttattgaagcgcaattagccggacttcctattatcgtcagcgatgcagggggacttcccgaaatcgttgaacataatgtgaccggtatggtgacgcctaaaggagatgcacaggcaatttgcaactctatcaatcagttgttggaagatgagacgcttagaaaaactttagggtccaatgcacacaaatttgcaatggagtattggaatatggatgaagctgtcaacaaggttttggacatttatcaacaaactttaaaataa

SEQ ID NO: 2104 - DNA, 534 bp, Bacillus licheniformis
atgacccatacaaaaaaaaataaaaactacacaggaattgttgttgctctgacgattatcataaacggcgtcattgccctcttgttttttatgccgaaaagcgacaaattcgctcatttggatttgacttttctgccgcttttgaacgcagtctgcaacagcttcacattcattttcttagtggctgcactgatcatgattaaacagaaaaacattaaagcgcacaaacggtttatttttgccgcttttacgacaacgttcatctttctcgtctcatatttgacctaccattcattgatgcctgacactcattttggcggggaagggattataagaccgatctactattttattttgatcacacacattgtcttgtccgctttaatcgttcccttggcattgttcacgctgttcagaggcctgagcatgcaggtggaacgccaccgcaaaatcgcccgctggacgatgccgctttggctgtatgtcagcctgacaggcgttctcgtctatatgatgatttccccatattattaa

SEQ ID NO: 2105 - DNA, 981 bp, Bacillus licheniformis
ttgaagaaaagaattttttctctattgatgctgatgtcagcttttgttcttgtattagctgcatgtcagcaggctgatccaaaaggatcttacgcagcggcttataaaaagctgatttctgcgaaatcatacgaattttcaagtgatatcggcttgaaagttgacgcatccaaccttggtgcggaagataagcaattcgctgacatgctgaatgatgcaacattgacgatcagcggtaaaacaaatgctgaaacgaaacagtctgaggccgttattaaagcgaagctgaaagtccaaaacatgtctcttgatttcgatattccggtttatatggatgaaaagaaacaagtcggctacatcaaaattgacagcgttcttgacagcttcggcatcttccttggaacagccggcatgaattttgacagcgtcaaaggcaaataccttgaattcccgcttgaagatgacaaatcttcatctaaagacacggatgaacttcaaaaacaattgatggaatccatcaaagaagcagcggacaatctgcctgcagataagtttgaaaaagctgatctgacggataaagaaaaagagcagggtgcttctcaaaaagtcgctttcagctttagtgacaaagaaattaaagctgcggtcgtcaagttcatcgaaatcgccggaaaagcgagcggagaagctgttccgaagagcgagctgaacaagattaaagacggactgaaagacgtcacatttaaaaaattcgatgtgacatcgacaatcgatgacaaagaaaaccttctgacagaaaatgcggatatctctttctcggttgacagcaaaaaagcgcctcaatctttcggcatcacagcatcaacgacttacaaaaatatcgatggtgacgtaaagtttgagcataaaccgaataaagaagatatcgtaactgaagaagaattcgaaaaattaatggctcaagatgctatgaatttctaa

SEQ ID NO: 2106 - DNA, 510 bp, Bacillus licheniformis
atgataacggatgaagaactgcaaaaagacagctccggcttgcagaaggaattgaacgacctgcaatttcaactgtttcggatgcgtgaaaatatgaaggatatctccaaagattcgcgagtgctcggtattgatcaatcgaaagacgatgaatggatgattgtccattcgattgatgatggccggacatgcaagatcatgttaagcgattgccagtcgccgtaccgcgggaggtgtgatttttctctcgtcgcttcctacacagaagaaaaacgcgcgatccatatcggggatattaaaggaccggcaggctttggatatggttcaatctgtatgaagtatttaaaggaaaaagcccgcgagcataacatccccgtcatcaccggggacattgctaaaagggattgggaccatgtggaccggctgatccatttttacgaaaagcatcattttgaagtaacgatcgatcctgattcaaaatccggcgaaattcagtggcaggatctttaa

SEQ ID NO: 2107 - DNA, 1590 bp, Bacillus licheniformis
ttggtgtggattatcatgacatttttattgattaatgcaggaatttttattttttcttatttgaggacaaaagatattgatttaaaaacgtcagacggctattttctcggcgggcgcagtctcactgccctctatatcggaagttcgctgcttttaaccaatttgtcaacggaacaaatggttggattaaacgggcaaagctattcgggaaccatgagtgcgatggcgtgggaggttacagcaccgcttgcgctcattatgctggcatttgtctttttaccgaggtatctcagttccggagtcacgacgatacccgactttcttgaaaagcgctatgatcaaagaacgcggcaaatcgtctcgatcctgctgcttctgggatatgcgacctcgtttctgccaaccgttttgtactccggggcgctcgttctcgatcaagtattcaacatttcatccgcgcttgggatcaatacgttagtgactgtttttttaatctcgcttgtgatcggcgccgcaagctgctgctacatatttttcgggggactcaaagccgcggcctcggctgatgccatttatggcgtcggtttaattcttggcggtctgttcatctttgtgctcggaattatggcaataggagacggcagcctcttgagcggctatacagagctgacgagtgtacataaggaaaagctgaatgccattacagcggacaactctgcagaagtgccgtggccgacgatttttacaggactgcttgtgaacaacttattttattgggctgttaatcagtcgatcgttcagcgggcgctcggagccaaaaacttggctgaagggcagaaaggcgcattgctggccggtgtatttaaaacgatcggtgtgttttatctcgttctacccggcgttattgcttatcacctttacggaggccatattcaaaacgctgacaccgtttatccgaggctgatcgttgatttgctgccgactgcactgattggcgtctttgccgcgatcttattcggagcgattctcagctcgtttaacggttcgctgaacagtacgatcacgttgtttacattggatttatacaaaccgctcttcaagccagaggcaaaagaggaagagctcgtgaaaaccggaaggatctttgtggtgatcctggccgcggtatcgattatcatcgcaccttttattttgtttgcgccgtctggcctttacaattatctgcaggaaatgttcggttttttcaatgttcctgtattggctgccgtcgtcgttggatttttttcgaaaaaagtgccggcgcttgcagtgaaatgggcgatatttgcacacattgtattgtataccatctcaaaaatctatttcggccatattcattttctatatatattggctgttctgtttccgttttccgtcctcttgatgcttttcatcggaagattgaagccaaggccgtcggaattcaagcttgagaaaaatgccaaggtagatttgcagccatggaagcatgccaaacttgcttctgttcttgtgatttgcctgatggcctgcatttacctgttattttcgccttgggggcttgccaaataa

SEQ ID NO: 2108 - DNA, 807 bp, Bacillus licheniformis
atgaagaagacgtttatgtcctttgttgcagttgcagcattatcttcaactgcattcggagcgagtgcctctgcaaaagaagtaacagtccaaaaaggtgacaccctttggggaatctcgcaaaaacaaggggtaaatctgcaggacttaaaagaatggaatcagctttcctctgacttgattattccgggacaaaagctgaacgtttctgaaaaacagacagaagaaaagaaacaatataccattaaaaagggagacactctctggaaaatcgcccaaaaattcggcgtttcagtgaatgaccttaaaaattggaacaacataaaatcagatatcatttacccgaatacatccataactgttgacggacaggcgacggtccaggctgctgcggcgcaacctgcggaaacaaagcctgccgtacaaaaagaagcgaaagtcgagaaggctgcgcctgcccctgcacctaagcaggaaaaagaaccggcttcccgttcaaacgtatctcaaagcactgccaaagaactgacggttacagcaacggcatacactgccaatgacggcggtatgacaggcgtgacagccacgggtatcgatctgaaggccaataaaaacgccaaggttattgcggtggatccaaacgtaatcccgcttggatccaaggtgtatgtggaaggctacggagaagcgaccgctgccgataccggcggtgcgatcaaggggaacaaaatcgacgtatttgttccaagcaaatccgcagcaaaaaactggggcgttaaaacggttaaagttaaagttttaaaataa

SEQ ID NO: 2109 - DNA, 1782 bp, Bacillus licheniformis
atgctagagaaagccgaagcactattgcagcactattttggctatccttcactgcgcccggggcagaagaaagccattcaatctgtcgtttctgaaaagcgagatacagcatgcattatgccgacgggcggaggcaaatcaatctgctaccaaattcccgcgctccttatggaagggacaaccattgtgatctctcctttaatttccttgatgaaggaccaggtggatgctttaaatcagcttggaattcaagctgcgtacgtgaacagttctttaggccataacgaaatcgctgagcggctctccgtatttaaggaaggcggctacaagctcttttatgtaacacctgagcggctgacgtctcccgaattcattcgcgcgatttcccacattcatattccgctggtagccattgatgaagctcattgcatttcacagtggggacatgatttcaggccgagctacagacatattgaaggctttttaaatagcctcggcacccgcccggttgtattggcgttgacggctaccgcaacgcccgaggttcatgaggatatttgcacacagctcgggatcgaaaaagagaacacggtttttaccggtttttcacgggataatttgacgtttaaaattttaaaaggcgaaaacagggaccgttttatcgaatcatatgtggagaaaaaccgctcagaggcgggaattatctatacagcgacaagaaaggaagccgaaagaatatcaagccgcctctctcaaaaaggaattgcggccgggtgctatcacggcgggatggatgatgaagaaagagaccggcagcaggatctctttttaaatgatgagatcagtgtaatgacagcgacctcggcgtttggaatgggcatcgataaatccaatatccgctatgtgattcatgcccaaattccaaaaaatatggagagctactaccaggaggcgggacgagccggacgcgacggccttgacagcgagtgcatcctgctgttttcccctcaggacattcggcttcagcggtttttaatcgaacagtcgacagaagatgaagacattcgggcgcaagacgtgaaaaaactgaggcaaatggttgatttttgccatacggaaggctgtctcgaacggtttattctttcttattttggcgaagttccaaccgaagactgcggcaggtgcggcagctgtctcgacacccgaagcatcaccgatgtgacgaaggaggcacagatggtgctgtcctgcatcatccgcatgggagaaaggttcggaaaaaccatggtggcgcaagttctggcaggttcgaaaaataagaaagtgaccgaaaacggcttccagcaattatcgacttacggaattttaaagaaacggtctattgccgacataagcgattttatagagtttttaatcgcagatgagtacatcaaaatgtccgacgggacatatcctgttctctttgtcgccaacaaggggcgaaacgttttgctcggccgggaagcggtgatgcgcaaagaaaaaatgcaaacaaatcaaatcgttaaagatgacgaattgtttgaacggttaagggcgctgcgcagaaagcttgctcaggaacaaggcgtgcctccttttgttgtattctctgacgaaacgctgcgggaaatgagcgggaaagtccctctgacagacgaagagcttttgtcagtcaaaggagtgggagaacaaaaaagagtaaaatacggagctgtatttctacaggagcttcaagcctataaaactgagaaagaagcataa

SEQ ID NO: 2110 - DNA, 519 bp, Bacillus licheniformis
atggattggcttgaatttgtttctgcgatggttcaatcattggcatggccagctgccttgatgatttgcgttttgctgctaaaggagcctttgtccgatcgaatgaaggaattgatcaaactgaaatataaggattttgaattggagtttgacaaaaggcttcaggagctcgtctccgtacgggaaaaaaggttatcgggactgacttctgtacggtcagcgcagcgaggggaaaacatgatcgaaagcgcttggtcagatgttcacaatgttctgcgggaaacagcctcaacatttgatcaagatgcgatccgccttgaaggcgatgaattgattcaaatgctgcatgaccgcggaattttacaagacgacgcggcagctgtgctgtcagagctatccgctctgcgccgcgatgcatctgacggagcgagtattgccggagccttggcatacaaaacgctttgccgggaggaagcggagcgcttgcgattattagctgaacaacagaccgggatttaa

SEQ ID NO: 2111 - DNA, 228 bp, Bacillus licheniformis
atgagtaaagtcctcacctctctaaccgatacacatgttaaggaggtggttatgttggatattgctgttttatcaatggccatgagtcaggcggctctttatcaaaacgtgcaaatgtcgctgacaaagacggctttggataccgccgaacaaagcgcacagcagctcgtagacatggtgcaggcgccacatcccgtttcaggacatcatattgacttgaaaggctaa

SEQ ID NO: 2112 - DNA, 354 bp, Bacillus licheniformis
atgttaacaagagaagatatctttaagcacgtcaaagaaaaattcgggacatcgccagattacccatttcaaaaatttccaaactatgccgctttaagacatgaaactaccgaaaaatggtatggtcttgtaatgaatgttcttccggaaaagttaggcttagatggaaatgacgaaatagatattctgaatttaaaatgccctccagaaataagtggcagtttaagaaatggaaagagtattttacctggttatcatatggataaggaaaattggatatcaattgttttagaacgaatagattcagaagaagtttataacttaattgagcaaagctttaatttaaccaagtaa

SEQ ID NO: 2113 - DNA, 966 bp, Bacillus licheniformis
gtgtctacattagctattattgttcttcttggcttttctggttatatgatctggaaattaaaagaggcaaaaaaaattcatcaaaacaatttagaacgtgaattaaaaaatctagagcaaacatatcaagatcacctggtgcaagctcataaagaggcttccgctgctttacaacaagctgaagtcatgaatattaatcaaaaaaatgaattcttaaatgaaaacgattttctgaagaacaagattgtaaagatggatgaatatataaacaatcttaaaaagtattcaagaaatagcggtgaagttattacccacactattttaacggaattaaaagaaaagcttatttctgaggggaaaataaatgaaaacgagatggttataatgggaaacgtatttgtaccctatgaagaaaatggggagacaaaaaccaggcaaattgatcatttagttattttgccatcagatatctatattatagaaaccaagtattggcgtggaacagttatccatgggattaatcgtaaaaatgcggaatcaattgcaaatgatttttcatttgtctttgaacaattatttccgaaagcgaatagtgatacagagaagacaatcatttttatgaaaaatagcaatatagataaggattccgagcaaaaaaattctataaatatttcttattatgataacccgagaaatcaagtcatggacacaatgtataaactcaggaattttctcataacctataataataaattcaactatgttgagcctatagtctattttggttatccggaggacaaagaaaatcgtgtaatagattattctacaaaagataagaatagatttacctcaaaagcaagtttgtgcgagtattttaagaatgaggttttaaagcctgctaaatatacagtcgatgagatacaacaaataaaaaggatcatgcaaaaagttaactatctatcataa

SEQ ID NO: 2114 - DNA, 93 bp, Bacillus licheniformis
ctggtatatcatccgtttttagctgatacaaatagcagtaatactgaagagagagttaaggacgatattgattacttggtgaagttagattag

SEQ ID NO: 2115 - DNA, 561 bp, Bacillus licheniformis
atggctagagcgattaaacgaattcagaaaatcgagataaccgaagaggaccagagaaagcgtgatatgaaagaaatagaggatgcattagtcgaaaataaggaagccattcttgaaatgctgcatatgattggccacatgaacgagcgtggtgtattgccattgctgcgcggcctttttggccaaggagataaagttcttgacatcttagtgaaaaaggcagatacagaggaaacggccaatacactgaaaaatctgcttcttctgttcggaacgcttggcatgctggatgtaaaacagcttgaacctctcattttgaaagtgaatgcgggggtggcaaacgcggtggaacagaaggacagcgaagagaaaacaggttattttgatatcatccgctcgctcaaagacccggaaatcaacaaagcagttacgctgcttttctcctttttaaaaggaatgggacaagatacaaaggagctggaacgcacgactcagcctccagagcaccaaaaacatcatcaggaaccccgagagaaaagggggatgaataagagggattga

SEQ ID NO: 2116 - DNA, 2295 bp, Bacillus licheniformis
atgacgaaacgctgcgttccgatgatcgagatcacaaaaggcgtagaaacaggttacggctctattctcgccatttctgatatggaatccgccatgcgtgacgagcgaattaagaaaacaaaacccgtctgcacctattgcggtgtcggctgcagctttgatgtctggacaaagggcagagatattctgaaagtcgagccgcaggaggaagcaccggccaacggcatttctacttgtgtaaaaggaaaattcggctgggatttcatcaacagcgaggagcgcttgacaaagccgctgatccgcgaaggcgaccatttccgtgaagcggaatgggaggaagcgttaacgctgatcgccagcaagttcacggatttaaaagaggagtttggcccggattcacttgcctttattacatcttctaaatgtacaaacgaagaatcctacctcatgcaaaagctggcgagagggatcatcggcacaaataatgtcgacaactgctcgcgctattgccaatctcctgcgactgccggcctgttccggacagtgggctatggcggtgactcagggtcgattgcagatatcgcgcaagcggaccttgtgttgattatcggttcgaacacgtctgagtcgcatccggtcttgtccactcgcattaaacgggctcataagctgagagggcagaaagtgatcgtagcggatatcagaaaacacgaaatggcagagcgatctgatctgtttgttcagccgcgtgccggatcagatatcgtctggctgaatgccatcgccaaatatttaattgaaaacggcaaggccgatgaacgctttttgcaggaaagagtgaacggacgggatgaatatgtgaaaagcctcacgccgtatacccttgaatatgccgaggagaaaaccgggattgatcaagaaaccctcatccaaatggcggagatgattggccaggctgacagtgtgtgcgcattgtgggccatgggggtgacacagcatattggcggaagcgacacgagcacagcaatctctaatctgctgcttgtgacaggaaactacggaaaaccgggagcgggctcttacccattgcgcggccataacaacgtgcagggagcaagtgacttcggaagcatgcctgacagactgccgggctatgaaaaagtgacggacgaacaagtccgccaaaaatacgagcaggcatggggtgtaccgctgccgaaggagccgggcatgaccaaccacgaaatgatcgaaaaaatccactctggcaagctgaaagcgatgtatgtaaaaggtgaagaaatgggtctggtcgattccaatatcaatcatgtacacgccgcatatgaaaagcttgatttctttgtggtgcaggatattttcttttcacgtacagccgagtttgccgatgttgttcttcctgcgagcccgagccttgaaaaagagggaacctttacaaacacagaacgccggattcagcggctttatcaggtgtttgaaccgctgggcgaatcaaagccggattggcagattattatggaagttgccaataagcttggcgctgactggcactatgagcaccctgctgacattatggaggaagcagccaagctgtctccgatttatgcgggtgtcacctatgaacggcttgaaggctacaattccctgcaatggcctgtaagcgctgatggaaaggattcgcctttactttttactgagcgcttccctttcccagacggcaaagccattctctatcctgtgcattggacagaacctgaagagttcggagaggaatatgatatccacgtcaacaatgggcggctcttggagcatttccacgaagggaacctgacctacaaatcaaaaggcatttcaaagaaaacaccggaagtgttcttagaaatttctcctgaactcgcggcagaaagggggattcaggacggaacccttgtcagactcacatcgcctttcggaaatgtcaaagtgaagtgcttgatcactgatcgtgtcaaagggaaggaagtatatctgccaatgaacgattcaggagaagcagcgatcaacctgttaacaggcagccatgctgataaggataccgatacgcctgcgtacaaagaaacatcagccaagatggaaattttgaagcgcgacggaagcaatccgctgcctaagatcaatcaccgcaacggcaatccgcagccgcaaatcggtgtgcaggtacaaaagaaatgggcgcggaaggattatattttccctggcgacgctgtgaaaagggggattgggcataatggctag

SEQ ID NO: 2117 - DNA, 660 bp, Bacillus licheniformis
atggagatggctgaacagaaaaaaatcacaataaacggcgttgaaatggaagcgtccgaggaacagacggtgcttcagcttttgaataacagttcgattgaagtgccgcaaatttgctatcatcctagcttagggccgattgaaacatgtgatacgtgcatcgtcagcatcaatggcgagctaaagaggtcgtgctccgctgaagtaaaggatggagacgtcattgatacgctttcacctgatgtgaaaaaagcgcaggtcattgggatggacaagattttatataatcatgagctttattgtacagtttgcgattacaacaacgggggatgcgaaatacataatacggtgaaggaaatgaaggtcaatcaccaaagcatcccgtttgatcagaagccttaccataaggatgaatcaaatccgttttaccggtacgatccggatcaatgtattttgtgcgggcgttgtgttgaagcgtgccaggacgttcaggtgactgaaacactgaccattgactgggagcggaaacgcccacgcgtcatttgggataatgatgtgccgatcaatgagtcgtcgtgtgtatcatgcggccattgttctaccgtctgtccatgtaatgcgatgatggaaaaaggaatgagggagaagccggatatttaa

SEQ ID NO: 2118 - DNA, 255 bp, Bacillus licheniformis
atggacttcatttatgtggaagtactcaatgattcaaatattactaagtacatttcgttattaagaaaaacatcatctaaacctattaacgaactaaagcaggcgattgaaacaggaaaaccagttattgaatgtgattactatgacacagaagaattgaaatcactagtaatcattatagaacagttactctcattgggagctagcattaaaatttatgaaaatgatagagaaataacacttgagatgtcttga

SEQ ID NO: 2119 - DNA, 666 bp, Bacillus licheniformis
ttgttatctttaggaaatattttaacaatagaatttgaaaacgaaattcaagagtatgtcctcgcgaaaagcaaagtgctatccattgaggacaatgttttaagagtacattatcctgttgatgaagaaacagggagaactgttattattccaacaaatacagtagcaatagttcactttataaatgagcaacaagtcccatataaatttaccagtgtaatacagggacgagagatctatcaggatatacctgtattaaatatgtatttacccgaagaagatcaaatgacaaaaattcaaagacggcaattttttagagtaaatacaacgattcctgtcactgtccgcccatatggatctggttcaatgtttaaaacatatacagcaaatatcagtgctggaggcgctgcgttaattattgaagagacgcaaatacacgaagcggaagaggatttaaatttaagcattcatctgccaaatgagggacatgatgaaaatgtgattgacgtttatgctcaagtcaaacgcacttacatagatcggagaacaaacaaacagatcatgacagttgaatttatcaagatggatgaacatgatgaacaagcacttgtacattattgcataaaattgcaattggaagaaagaagaaaactgaaatctgattag

SEQ ID NO: 2120 - DNA, 183 bp, Bacillus licheniformis
atgttagtgttttttgaagtcggtgaggggacatatctgactctagatttagatcaggaagaagagaacggtatttgtccagtatactattttgacaagataattgcggcatcactcgaagagttttcaagaaaatggatgaagaagaaccagactattatattcatgcctaaattgacttga

SEQ ID NO: 2121 - DNA, 279 bp, Bacillus licheniformis
atggatcaagaaataaaagtgaataccggagaagtcaaacaagcgctctctaaattaaagcattccagccattcaatgaaagcgacgattccgacagatatcaagggccagaatcaccttgatgcgacaaagaagatagaggaactgaatcagacgattaataagatcgcttcttcctatgcctctgctttctcaaaacaagtcgtccaaacggaatcagcagtcgaagcaatgatggacaccgacaaacagctggcttcatcgatgaaaacaaaatag

SEQ ID NO: 2122 - DNA, 441 bp, Bacillus licheniformis
ttggtcattacttttgtcatgcattttttgggaagcgaggtattgcaaatgatcggttcaatcctgggagaaacgctggctttagatatcatgaaagttgatttatcgatgaagaaagaatttttggcagagctgaaagcttgccgcaaagagctggaaaaagacaaaacagagttctctgattcgaaaaagacgatcaccgaaccacaactgtcgtctcatacgtggcaaggcagtcttgctgactcctttgaccgtattcgaggtctgatgaagactgcttacaatgacataagcggaaaacagctttctgatgttttaagcaaaatcgatgaacgaatcaaatctttacaagaagatattcactcgctcagccaggaagttcgttctttagagaaaaagattgagaacgcgaagcgggaagcacgagacaaggagtaa

SEQ ID NO: 2123 - DNA, 144 bp, Bacillus licheniformis
atggagtctaaaatgaagatcggtttaggtgttttgataattggactcggctttctcagtcattttcgattttcgaacaacaatgatatgaacacagcttcaagaaacaccacaagcgcacccagtcacgattttattgtttag

SEQ ID NO: 2124 - DNA, 108 bp, Bacillus licheniformis
ttgaactctggaaccaatcttttcatgcctgtttatgcttttttgtttctatatgatgaaattgtcgttttcaatgatgcatatgaaccaatagctgcgcaaccatag

SEQ ID NO: 2125 - DNA, 297 bp, Bacillus licheniformis
gtgattaacgtgcctcaaaaaaatggagcagacagaccggatgattacaaaagattttcttcactagacaaggaatatgattctcagcaatctttagacagcaatgctaagacagaaaacgtaaacactgaaactgataacaaagaaaacacaactgacactaccgatgtggccggaaaatatttcgacccttcggattatgaaggggctactcaattggaaaaaggattagctgaaactcatgaacaggtcagtgatgactattttgaaggaacgatcgatcaaaatttggattag

SEQ ID NO: 2126 - DNA, 555 bp, Bacillus licheniformis
ttgtttggtgccgacggggaagtcaaatatgcaggagctgttgccattaacggaaaaacaaataagctccttggttttttagatgaaaaagatttagacgggatcatgtggatcaaaggacaaggggtagggggcactgtcaaaaactatgatcaaaaaacaaaaaaattgacggccatgtcagtcgatcaccttaagagtgagatcaagccagtcttcaaaggaaaccgcctctcatttaaagtgaatattaattcagaggcacacctggctgaaaactggaatacaaccgaaacggcaattgacaaaaaatatttgaaaagaaaggaagaaagtgcgtcacaaacagtgaaacagctggtagagcagatcacagaaaaaatgcagaaggaatataaagccgaccttgccggcttcggtgatgaagtgaggatccactatccctttctttggagaaagctgaagaaaaattgggatgaagtattcacagaaacccccattcaatatgatgtgaacatcacgattgaagaatttggatcacaaagtagacattag

SEQ ID NO: 2127 - DNA, 222 bp, Bacillus licheniformis
atgagtttaagcattaaagattttgaaggggactggcctgaccgaaccgctcaggatgtcatcacgttgatgcctcgaacctacaggctttattttgaaaattccgaaggcgaatgtaaggatattcgcattaaaggaacatacggggccattccgcaaacttatgattatttctcggccttcaaaaagactccgggaaggacaaccctttttgccaaatag

SEQ ID NO: 2128 - DNA, 843 bp, Bacillus licheniformis
ttgaaaaacttttggacatacgaagacgaagatccatacaaattaaaaagcatatcagagagagatattcaaaaagctgaaaaaaagttaggtgtgaaacttccggaggaatacaaagcgcttattcttgaacaaaacggcgggtatatcaattttaacgccttcccttctgaacggcctacctcctgggctaaagatcatgtccagtttgactacttattaggcttagggaaaaaggcagggattctcgagagcaaatacatcattaaagaatgggaactgcccgacaacctgatccttattcacggtgacggccatacatggatagcgcttgactacagagaaacgaaagaaaatccgcccgtgcactatttcgattcagaatttgaagagaattataaattagcggattcatttggagaatttctctctaaactttatacagataatcccatggatgatgacgactgccagcttatcgaaggcgtgcatcctgacattccctatgtctatccggaagatgccattacaaaagaagaagctgaacaaattctgactaaaaattcggcagccgagctgcatcagcttaattactaccctattgaaagtattgatgatttaaaatggcttttgacaaaaatgaaaaaatccgctttaaaagcagaccgtgacactggtttggcacttgccggcgctttggaagccgtcatttcttactataaaaatttaacgtttgaggatgaacaaacaagaaggtcagtccgcgatatcttggtgatattagagaagttgaatgactctactgtagacatatacttatcccaaattgacgacttattttaa

SEQ ID NO: 2129 - DNA, 1350 bp, Bacillus licheniformis
atgcaaaaaacgctttttcaaaatgctacgattgtgacgcttgatccgcagcttcatacgctcgaaaaaggggacatgctgattgaaggctccgtcattctggacgttgccgagtcgattgaagccggagacgctgagattgtggatgcctccaatatgctgatcatgcctggatttgttgatacgcaccgccacgtatgggaatctgtgatccgcggaatcggagccgactggtccctgcaaacctatttaaaccggatttattatgggaattatgggtcgatgagaagacctgaggatgattgggccgcgaactatttaggagcgcttgaggcgctcgatgcaggcgtcacgactttgctggactggacgatgattgagtcgcctgatcatacggaccagctgattgccggactgaaagacgccggcattcgcgcagtattcgcctttggaacatctggtgacgccgaatattgggacagagacagcgatctttcgaatatggacgaagcgaaacgggtaaaaaaagcatattttcaatcgaaggatcagcttctgacgatggggcttgcaattcgaggtccggagttttcttcatggaagacatctgtctttgaaatcgaaacggcccgggaactggatgccttatgcagcatgcatattgcttttggcaactggggagcgaaagatcgttcgattgaaaagctgaatcaagccgggctgcttggtcccgatttaaacatggtgcatgccaatgcgatgagtgaagaagaaatgaaaatgcttgcggctcacggaagctcgatatctgtgacaccagaaattgagatgatgatggggcacggctatcctgttacagggctctctctaaaaaacggggttcttactgcgcttggggttgatgttgtcacatcgaccgggggagaccttttcgcacagatgaaatttgctcttcaagcagaacgcgcaaagcacaatgatgaactgctgagagaaggaattatgccggggcccgaattgagcatatcggccgaacaaatcctgaaagcggctaccattgacggggcgcgcgccctaaagctcgatcataaaatcggctcgctttccccaggcaaagaagctgactttatcatggtgaaaacggacagcgtcaatttgctccctttcactgatgcggcgggggccatcgtccaatgcacgcacaccggaaatgtagattccgtatatgtcgcaggaaaagcggtgaaacgaaacggccggctggttgatgcagatcttgaaaaggtgagacaaaaagcgctggaagcaagagatcatattttattccgatcccctgagggcgccttttaa

SEQ ID NO: 2130 - DNA, 249 bp, Bacillus licheniformis
atgtattgcaaacatcatgagccgcatgtttaccctacgaaatattgtgaggatcatcattactcaaaatctgtcgttcctcatattcatccacagcatacaaaaaaaatagaccaccacaagtatgaacatgttcattactatccgcacacttactcacatcataaagatgtttcacatgaacactatcattgcggaaaaccttgcaaaagctatgaaaaaaaatcggattacggccattgctattaa

SEQ ID NO: 2131 - DNA, 783 bp, Bacillus licheniformis
atgggatattttatcgaggcagaaccaagcgttaatctgtacgttgaagacatcaatcctcaaagcggcaaagccattgtatttttgcacggctggccattaagccatctccagtttgaatatcaatttgacgatctttcgcgaaagggataccgctgtatcggcattgactggcgtggattcgggcgttcggataagccggcgacgggctataattacaaccgtttggctgatgatatccgcgctgtcgttgaggcgcttcaattaaacaacttcacgcttgccggtcattcaaccggcggcgccatagcactccgctatatgtcccgatataggggcgctggggtctcaaagctggttttgatcgatgcggcggcgcctgtgggatttactgaagaaacggcagccaaattgcttcagcaagcgtctaacgatcgtcccaagatgatgcgcgaagtgaccgacacgtttttctttcaatatattacacaaccgttctcagactgtttttttcaattgggattgcaggcggcaggctggtcgacaaaagcggtcatcgaaatgctgagagatgagaaactgtatgatgatccggaaaaagtcgctgctccagccttaatcattcacggtattcaagacaaggtgattccgtttgcacaagcaaaggagctcagccgcaaaatcagaaattcatatcttgttccgtttcaatacagcggacacggtccattctgggaggaacgcaaaatgttcaatcggattttaacgcaatttatcggttga

SEQ ID NO: 2132 - DNA, 492 bp, Bacillus licheniformis
atgatggcacttctgagaagtctggcgatatcgtttgtcctcattctgcctgcggcagcggcctacgcacaagtaccttatccatgcagcgtcgttcttgatccagtccgagatattcccaatgcccgcggaacggctttaattgcgaaagtgaagaaaccgtataccgaagcccccgggagtcctgtcagggaaaggcagagtgtcggcatctacgctgattggcttccggaccctgcttcatttggagattatgatcaatttgaaggaattgcccggatacctgaccagatcagctggcgtttcaccatgcatcaagtccaagaagacgcgccgagctggtttggcggaagtccttgggcgggcaaatttgacgaaatatcatcagagctgactgtgaatacccaagtcgaagtgcgccctttcaattcgaagacgaaaaaggccggcgaagctgttttgcgtgggaatttgcaaggatgcaggagctaa

SEQ ID NO: 2133 - DNA, 237 bp, Bacillus licheniformis
atgtcttactgcaaaccgcgcgttctgccgccagttgtgcatcctactagatactgtgaggatcacagattctctaaaacgatcgttcctcacatccatccgcagcatattaaaaaagtggatcatcataaatacgaacatgttcactattatccgcactcttattcaagctataagccggtttatcatgaccactcttactgcggtaaaccttgcgatcgctacgaaaaatactaa

SEQ ID NO: 2134 - DNA, 624 bp, Bacillus licheniformis
atggacgcgatatcgatcgtttcttttttgggtgcggccgtactgctaacacttatgccgggccctgacaacctgttcgttttggcacagagcatatcaaagggaaaatcggccggtatagcaaccgcatccggactatgcacagggctaatcgtccacatcacggcggctgcagcaggcatttctgctgcgatctatcaatcagctgtcgccttctcgattgtaaaatatgcaggtgcagcctatctgctgtttttagcttaccagtcttttcggcaaaaaagcgccggtttcaacgttgaaaccaaagattcattgaaccgcagggctttatatcaaaaaggcgtggtgatgaacctattaaacccgaaggtctcattgttcttccttgcctttcttccgcaatttatccaccccggcaccttcaatgtgacaacgcaaatgcttgtttacggcatgttatttttgattcaagcgttcgctatctttgtgatgatcagcctgtttgcggaaaaagtcggagaccggctgcgcagaaatccgcaagccgccaaaaaagttcatttgctggaagggtctttgttcgctttgatcgggcttaaaatagcggtcagccaaaggtag

SEQ ID NO: 2135 - DNA, 186 bp, Bacillus licheniformis
atggccaagacttcaatgattgtcaagcaaaaacgggaacaaaagttcaaagtcagagagtacacccgctgtgaacgctgcggcagaccgcattccgtgattcggaagtttaaattgtgccgcatctgcttccgcgagcttgcttacaaagggcatatacccggcgttaaaaaagcaagctggtaa

SEQ ID NO: 2136 - DNA, 474 bp, Bacillus licheniformis
atgtcgcaaaatggaattgttttagtagccagtgtatctatctttagtgatgataaagtcttgatgataaaagagaataaacctacttctgttaataagtggaattttctgggcggacgtatcgaatatggagaggacattctctattcagcccgaagggaagttaaagaggaaactggattcgacgtaaatctgattgccactacaggtgtatataattttatcagtagtacgaacaatcaagttattttatttcattttatcggcgaagttactggaggttctttaaatctcgaagaagatgaaatttcagacagcaagtggataacagtaaatgaccttgtaacatttgaaaacgaaggcttacgagaaccgaatgtaataaagcaaatcactgatagcttattaaaagagaatttacactcaattagtgtgtataatgagcaactgattaaatcgttcttattgagctga

SEQ ID NO: 2137 - DNA, 2667 bp, Bacillus licheniformis
atggagaaatacgtgctgtatttcaatgaaatcgatcaatttgacttgccctctgtcggcgggaaaggggcgaaccttggggaaatgacaaaagcgggctttcccgttcctcagggattttgcatatcaactgaagcctaccgtgcgttcatacaaacaagcggcatcatcgacagtctgttcgatcagcttgaacagctcaaacatgatgatcttgaacagattcggactgtggggaaacaaattcgtgagcatcttgctcagatctccatgcctgacgagatcaaatcggcgatattggagggcatagatacgaccggcaaagataaagcctatgccgtccgctccagcgcaacggctgaagacctgccagatgcttcattcgcgggacagcaggacacctttttgaacgtctgcgggaaagatcagcttcttgaagcggtgaaacaatgctggtcctcgctgtttacagacagggcgatttcctaccgagcgaaaaacggtttcgaccaccgctctgtctttcttgcggttgtcgttcaagagatggtttttcccgaggtttccggaattatgttcacggcggatccgatcacggggcaccgcaaaacggtatccatcgatgccagcttcggcttgggtgaagcgttggtgtccggcgtcgtcagcgctgatctgtatcagattcggtctggtgaaatcgttaaaaaacaactctctaagaaagaatcggccatttactccgtaccagagggaggaaccgtccagaaaaccctctctccggaaaaacaacaaacacaggctttgccggatccaagaatcattgaattagcagaactggggcgcaaaatcgaggctcactatggcaaggaacaggatatcgagtgggcttttgccggcggcaggttttacattcttcaaagccggccgatcacatccctttacccggtcgtacgcttttttgatgataggccgcacgtattgattaattttggctacatccaaatgatgaccgatccgctgaaaccattgggtgtatcggttatcagccaagtcctccgatttttaaaaaaagatccttcggcacagccgattcttcgcgaagcgggaggaagagtctttgccgatattacgggtgctctctccctcaaattcgtccgaagccggctgcttaaagtattgagcggcatggatcagttgatggcatcagctgtatcggaggtagtcaagcgcaaagaacatcagctatattccacatccacaaaaggcatttttcatattgccgggaatttggcgccgattttgattccggcagcattaaaagttgccggaatcctgctcatgagaaatccggataaagccgagaaaaaagcggaattgatcattgaagcgatcgtgacggacaccgaagagcagcttagccggacttccggtgctgagacgatccgcgtcatccaaaaaggaatgggaaacatgttgcaagacgtgctttcaaaagtcgctgtgtatgtcttgagcggaatgattgcagccggattgctcgaaaaaaagctgaaaaagaagctgggggacgagaaaagcgctattttgctggggaaattgtataaatccctgccccataatgtcacaacggaaatgggtctagagttaggagatctttccgatcaggcgagaaagtatcctgctgtcattgactatttcaagcgtgcaaacagcgaaaattttatggaagaactgctcaaaatccccggcggcgccgaaatgaaacgcagtttagacgattttctcaaaaagtacgggatgcggtgcgtgggagaaatcgatttgacaaggccgagatgggccgaggccccggttcagctcgttccgtccatactcagccatattcggacgattgccgccggggaacacagaaggaaatttaaacaaggtgaaaccgaagcggaagaggcaaaaaaggagatcatctctcaatttcgttttccagaaaaaaagagagtctcccggctcgttcatatgtaccgaagcttgatgggaatgcgggagcatcataaatttacacttgtaaaactgatgtttttatacaaaaaagcgattcttaaagaagcccgcaccctcgttggaaaagggattttgaattgtgaagaagatgtcttttactttacgcttgaggagcttatcgccctattggagaatcgcggcatcggggatattccggaattgttaacagacagaaaacggcagcatacgtccaatcaaaagctcacatctccacgcgtgatgacgagtaaaggggagatcatcacaggaaagctgcgaaatgaaaaaagtcctgaaggcgctctcacaggtacccctgtttccgcgggaatcatcgaagggaccgccagagttgcaaagagtcctgaagacgcgaagctgaatcaaggggacatattagtggcgccgtatactgatccgggctggactccgctctttacttcagcggtcggactgattacggaagtaggcggcatgatgacccatggttcagtagtggcaagggaatacggcattcctgctgtcgtcgggatcgacaaagcgacagaaatcatagaagacggcgcttacatccgagtcgacggaacaaacgggtttgttcaaatattggacggcaacggctcctga

SEQ ID NO: 2138 - DNA, 606 bp, Bacillus licheniformis
atgactgagcagaaaaaagaccgcagggtaaaacgcacgaaaaaaatgattagagacgcactctctgaactgatgaaaaataaagcgtttgaagagatatccgttacggacattacgaagaaagccgatattaaccgcggcacgttttacttgcactacgaagataaatacgatttgctggaccaaagcgaggaggaaatcatccaagagatcaataaaattgctaaacgctcgattcactcaatggatgtattaaatcaggatgtgattgaccatccgctgacattcgtcgtcgacatttttcaatatataaaagaaaacgaagtttttatgaaggcagttttaggccctaaaggcccgggttctttccgtttaaaattcaaatcggttttgatcagcaatttaaaacggctgaaaacagcgatcagaacggatccgattgtaccggaagactacttgatttcctacataaccggcgctcatatcagcgttatgcagcaatggcttgagaacgggatgaaagagacgccgcatgatatggcgctgattttatcaaaaataaccggaatgggccctgcatatgcggcagggctgagaaaaaaatga

SEQ ID NO: 2139 - DNA, 126 bp, Bacillus licheniformis
atgcagaagaaaggtattcaaaacagcagccttgagcagctgaaaaacgatcacgaaacagaaagcgcattccagcaggatgacaaaaacaataaacagcaacaaaacaggaatgctttaaaataa

SEQ ID NO: 2140 - DNA, 465 bp, Bacillus licheniformis
atgaagcatgtaagagcattgtgtttaaaattcattgtgagccttgtccttttatatgtggtcctaactctgttttttggcgttccattcggtgaaatgtttgttttgacattgtttctgggtgtgatatcctatctggtcggagatcttctgctgctgccgagaacaaacaatacaaccgcgacaatgggagattttggcctttcactcgtattgatttgggtgattctcgccatgcaaaataatcccccgtatggtacgcttgctgcagcttcaatcgtgtcagcgatcggcgtcacagtgttcgaatattttttccaccgctatatggaagccaacgtcttgaacgaaacagaaaacggaaaacgggaaaacagagaaaagcctggttcattgcagtatcaaagcgaatcatcagaggagctttatccggttacccactctaaaaaacaggacgaagaataa

SEQ ID NO: 2141 - DNA, 516 bp, Bacillus licheniformis
atgacacatagcgcattaaagcatttagattatcacaattgggcgaatcaaagggtgctcacccacctgaaaagcctgcctgaagagctgttcacccgggaaatcaaaagcgtttttcaaactgtatctgaggttgttacccatatgtgcgtggctgacgccttatggctgaagatcatatccggagccgcttacgaggaagcaaaggaaacaggcatgcgtctgaaagaaggattaaagaggaaaaagatcgatgacttcatttccatctttcatgacacggcgcttcaatatgaagcgttttttgaaaatcttgaagaccccgatggtgaaatcacgattgcccatccaatattaggcgaaatcaaaacgcctattagcgaaatccttcatcacgtagtcaaccacggcacttatcacagaggcaatatttcagcgatgctgagacaaatgggtgaagcgggtgtgccaacggactatatttattatttattaagcctgaagcaaacgacataa

SEQ ID NO: 2142 - DNA, 627 bp, Bacillus licheniformis
atgtctaaagtattgtttgttaaagctaatgaccgtacagctgaagaagctgtatctgtaaaactttatgaagcgtttcttaacagctataaagaaaatcatccaaacgatgaaattgtagagcttgacctttacagagaaaacccgccgtacctaggcagaaatgccattaacgggacatttaaagcaggaaaaggcatggaattgaacgaggatgaaaaagctgccgccgctgtagcggatcgttacttagacgaattcgtcaaagccgataaggttgtttttgctttcccattgtggaacttcgccgttccagctgtacttcacacttatgtggactacttgtcccgcgcaggagtgacgtttacatacactcctgaaggacctaaaggcctgatgggagataagaaggttgctctgttaaatgcaagaggaggcttctattctgaaggaccgatggctgcaatggaaatgtcgttgaactacatgaaaaccgtcatgggcttcttcggtgttcaagacttgcataccgttgtcatcgaaggacacaacgctgttcctgacgacgctcaaaaaattattgaaaacggcttagcagaagctaaaaagcttgcagcatcattttaa

SEQ ID NO: 2143 - DNA, 483 bp, Bacillus licheniformis
atgccattgacagaggaacaaaaacagcacctttacgataaattaatcagcttaaaaaacgaaatcacaggtacaaagtctgaggtgcagccgatgaatgaagaaacaggcgaattgtcaaacggtattgacaatcatcttgccgaccatgccggcgtgtataccgaacgaatgagggaccaggctttccggcaatcggacgatgctttgctgaaagagatcgaagacgctttaaataggatgaaagacggcacatacggcacgtgtgaaacaacgggaaaagaaatcccctatgaacgccttgaagcgattccatatgcgcgaagaaccgccgaagctcaagcggaagcaagacaagaagaccgcacagagaatgatcggcaatttacacggcaaatgaaggatttgacgaataaagaaacgatggaccaaaaacattcatacgtctatgaacggcttgaccaggaacaggactccaaataa

SEQ ID NO: 2144 - DNA, 123 bp, Bacillus licheniformis
atgttcaatccagacagttctctttctctgatgaccagcagcaaaatctttgatctggaatttacgaaggataccgacatgcttgaaattcaagcgctgttatcaaaatacttatgtgcataa

SEQ ID NO: 2145 - DNA, 309 bp, Bacillus licheniformis
atgtttggcaaaaaccacattcgccgacagagcgcattgcatttcggcgaaaaaacgctacaatggaaactatacacgtatgaaaaaggagacatccacatgattcatgaaaaatggcagaacaataaaaccattaaaaaagtaaagtgcatacataccgatgccaaaaagtatatcgtcaacagagcgctgaccgtcggtaacatatacgaggtcaaaaacgaaacgggagaatttttgtttatcatcgataatacaaacaaagtcggcggctattacaaagaatactttgaagaagtaaaagcctga

SEQ ID NO: 2146 - DNA, 1497 bp, Bacillus licheniformis
ttgacaaacatgagttcattaacgatgcaggtcagtaagaagctggagtcatttttgcagggaacaaagaagctctatattaacggggaatttgtagccagcgcctcaaacaaaacgtttgagaccccaaacccggcgactggtgaaacgctcgccacgttatatgaagcaggtcccgaggatgtggacaaagctgtaaaagctgcgcgggaagcctttgaccgcggtgagtggcggacgatgaaccctgccgaaagaagccggctgatgtacaaactcgccgatctgatggaggaacataaaacggaactggctcagcttgaaacgctggataacggaaagccgatcagcgaaacgaccgcaggcgatattccgctgtcaattgaacatatgcgctattatgcgggctgggcgacgaaaataaccggacagacaattcctgttaacggaccttattttaactatacacggcatgagcctgtcggagttgtcgggcaaattatcccttggaacttcccgcttctgatggctatgtggaaaatgggagccgcccttgcagccggatgtacggttgtcttaaaaccggctgaacaaacgccgctttccgctctgtatttagctgagctgatcgatgaggcaggcttcccgaaaggcgtcatcaacatcatccctggctttggggagacggccggagaagctctgaccgaccatgcccttgtcgacaaactggcattcacagggtcaactgaaatcggcaaaaagataatggagaaagcggccaaatcggtcaaacgtgttacccttgagctcggcggaaagtcgccgaatatcatcctccctgacgccgacctgaagaaagcgattccaggcgcactaaccggcgttatgttcaaccagggccaagtttgctgtgcgggatcgcgcgttttcatccataaagaccaatatgacaaagtcgttgatgaaatggccgcttattcaaaatcgctccgccaaggtgcgggccttcatgaagacacgcaaatgggaccgcttgtcagcaaagaacagcatgaacgcgtcctctcgtatattgaaaaaggacgccaggagggtgcgaaaatcgcggccggcggaacatgcccttatgaacagggatactttgtttctccgactgtattcacaaatgtcgaggatgagatgacaatagcaaaagaagaaatcttcggtcctgttttggcggcgattccttatgaaacggttgatgaagtcatcgaacgggccaatcgcagcgaatacggcctcgctgcgggcgtatggacggaaaatttgaaaaacgcccactatatcgccgaccgtctgcaagccggtaccgtttgggtcaactgctataatgcttttgacgccgcatccccattcggcggctacaaacagtctggactcggacgtgaaatgggctcatacgctctggataactatacagaggttaagagcgtctggattcatacaggcgaataa

SEQ ID NO: 2147 - DNA, 1281 bp, Bacillus licheniformis
atgacaattcaagtcgactggaatgatagaatcgtgtattcttcctctcttggcataaccgtctggaaacaaaaaaactttagatacatatgggcgtcgcaaacagcgcaggctgtcggatcaatcttgatgacgatcattgtcatggtcgatgtatttaaggaaacgaactctgtattcggatccggtctggttttggctttatcctcgttcggcagtgtattaggcggagcgatcgctgcttttgctattcagcgtctcgatctgctgcaaacagcggcctggtcaacatggttcagagcggtctgtgcattatgcatcggcttatgccaatcgcttggcttaccctcttatatcatttatctgctgctatttttgcaaagctttgtcggctcctggtatactcccgcacagttaggtttactgtaccaagccattaaaaagcgcgattacgtggctgcatcgggaagcatcgtagcggtcaaccagtttgtccaggcggcaggctggggtctcggcggctttttaaccgttttggcccagacttatacgttgacagtgtttacagcagcactctttttcatatcagggcttttaatcagattgccggatttcaaaaaagcgattatccctcgtcaaaaagcccgcgcacaatcggtctggcgcactgtttacaggaagaaaaccgttttgctgcttacgatgatggacatgtcggaaggtttagcaaatgcagtctggacttccgccgttttgctggcttttactaaagaggcgctgaataaaggagaggcttggtggggattcatcaatgccggttattttttgggagcgattttgggcggcattctcgctgtgctcttttccaaccagctcaaaaaaaggcttggcctcatgattttctttggctccgtttcaatgggcatcacaacgcttttattcgcctattcgtccaaccccctcctttcggttatcctctgtatcatgatggggccgctttatcaagtaagagacgtcagccagacggttatccttcaagatacattgactgatgaagagcgtgcaccggttaccgccgccaaaaataccattttggctgcatggtctatcataacaatcgccatcatgggggctttggcagacttgatcggggtacgaagcgtatttatcgctgccgctgtattatatgccggaacagccgctgccacatttttcgtccgggatttaagaacgtacagccaatctgcaaggcagcagacgaaagggaaaatagaaggatga

SEQ ID NO: 2148 - DNA, 537 bp, Bacillus licheniformis
atgttcaagagccgcaaggtttatctcagacctgttgaaaaaggcgatatggagagcttttacaaagccgttcaaaatgaagacatcaggtatatgacgggcacgacgcgcgaatatacgatggaagacctttatgagcactatgagagaatcacgagtgatgagacgcgctatgattttgccgtctgcttaaaggaggacgatcgtttgataggcgatctgtccattatggacattgaccggaggaatcgaaaagcggggtttagaattgctttgcacagccccgcttatttgaacaaaggctatgggattgaagcggtgcggctggccatgcagcttgctttcgaaaggctcgatcttaaccccctccagctcgaagtcttttcacacaatatccgcgcgctgaaagcatatgaaaaagcgggatttaaaatggaaggaaggatcagggaggctctttatatgaatgagcagtactcggatgaaatcattatggggatattgaagcgggaatacgaagagctgatgtcccgctga

SEQ ID NO: 2149 - DNA, 402 bp, Bacillus licheniformis
atgaatattgaacagatgctgtatgacaccgcagtcgaattgatcaaaaagaggtatccgaccggatggggcggggcagccgccatgtataccgaggacggaagaatcttaacgagcgtagccccggaagtaatcaacgcttcaacagaattatgcattgaaacgggcgccattctcgaagcccataagtatcaggcgaaaataacgcactctgtttgtgttgcaagagacgacgaacattccgaatgcaaggtattaacgccgtgcggggtatgccaggaaagacttttttattggggtcctgatcttaaagcagctgtaactgtaccggatgggcgcctggtttataaaactttaaaggaaatacagccataccattggtttgccgcgtatcaaaagtag

SEQ ID NO: 2150 - DNA, 1890 bp, Bacillus licheniformis
ttgcgatctatactagaagacgtgaaagctttcaggcaaaagacgctcgcagagcttcaaaacagacaaagatctgatggttcgtggcggttttgttttgaagggcccgtgatgacggacagttttttcattctgatgctgacatcactcggcgatcaggactcttctctcatcgcaagtcttgctgaacgaatccgttcaaggcagagcgaagacggcgcgtttcgcaatcacccggatgaaagagcaggcaatctgaccgcgacagtccagggctataccggaatgctggcttcggggctctatgaccggaaagctccgcatatgcagaaagccgaagcttttattaaggacgcaggcggattgaagggcgtccactttatgacgaagtggatgctcgccgccaacggtctgtatccatggccgagagcctatattccgctctcgtttttgctgatcccgtcctatttcccgctgcatttttaccatttcagcacatacgcaagaattcattttgtccccatggccattacgtttaatcggcgattctctttaaaaaacaaccaaatcggctcgcttcggcacctggatgaagccatgtcaaaaaaccctctcgaatggctgaacatccgcgcctttgacgaaagaaccttctattctttcaatctgcaatggaaacagctctttcaatggccggcttacgtccatcagctcggatttgaggccggcaaaaaatatatgctggacagaatcgaagaagacggaacgctatacagctatgcgagcgcgaccatgttcatgatttacagcctgcttgcgatgggaatatctaaaaacgcccccgttgtcaaaaaagcagtcagcggaatcaaaagtcttatttcatcatgcggaaaggaaggggcccatttggaaaactcaacttccaccgtctgggatacggccctcatcagctatgccatgcaggaatccggagtgcctgaacaacattcttccacctcatcggcagccgactaccttctcaaaagacagcatgtgaaaaaagcggactgggctgtctcaaatcctcaagcggtccctggcgggtggggtttttcacacatcaatacaaacaatcccgatttggacgataccgctgcggcattaaaagctattccgtttcaacggcgtccggatgcatggaaccgggggctcgcctggcttttatccatgcaaaacaaggacggagggtttgcggcatttgaaaaagatgttgaccatccgcttattcgaaatctgccgctcgaatctgccgctgaggcagcagtcgatccgtcaacggcagacttgaccggacgcgttcttcatctgctcgggcttaaagggcggttcacagataaccatcctgcggtccggcgcgccctcaggtggcttgatcatcatcagaaagcggacggctcttggtatggcagatggggcgtctgctttatttacggtacatgggccgcactcaccggtatgaaagctgtcggggtttccgccaaccagacgtctgtcaaaaaagcgatctcctggctaaaatcgatccagcgtgaagacggaagctggggagaatcttgcaaaagctgtgaagcgaagcgttttgtccctcttcactttggaacagttgttcaatcttcatgggcgctggaggcgcttttgcaatatgagcgtccggatgacccacagatcataaaagggatccgttttctcatcgatgaacacgaaagctcgcgtgagcgactcgaatacccgacgggaatcgggctgccgaaccaattctacatccgctatcacagttatccttttgtgttttcattgctcgcttcaagcgcatttattaaaaaagcggaaatgagggagacatattga

SEQ ID NO: 2151 - DNA, 846 bp, Bacillus licheniformis
ttgaacagagatgcttacaaagaaaaaatatcgtcatgggccaaagacctgaaagaccagatgaaagatgatccttctttagaaagccatttagaaaaactttttcaatcattggatgatcctcgtgcgaccgaacaggaatggtatgagcaggcagaagccgtgtatcaagccatctcccgcagtgatgcgtctcaagcaggccggcagccattcagaacagtgccgatcggaggccatcgcctgccaagcctgccctactcgtattcagcccttgagccctatatttcaaaagaaattatgtttcttcatcatacaaaacatcaccaaagctatgtcgacggtttgaacagagctgaaaaagaactgcagaaagcgaggcaaaccaaacagtttgacctcgttaaccattgggaaagagagctcgccttccacggagccgggcactatttgcatacgatattttggtacgcgatgcacccaaaaggaaaaagacggccgacaggcgaattgctggagatgatcaaccgttcattcggcagctattcggcctttaaagaacacttttccgaagcggcgaaaaaagtggaaggcgtcggctgggcgatcctcgtctgggcgccgcgttcgcaccgcttggaaattctgatcgcagaaaaacatcagctgatgagccaatgggatgtgatccccctgctcccgctcgatgtatgggagcacgcatattaccttcaatataaaaatgaaaaggcaaaatacgtcgataattggtggaatgtcgttgactggagagagcctgaaaggcgatttgcgtcagcaaagcgcgttttatgggagccgttctga

SEQ ID NO: 2152 - DNA, 531 bp, Bacillus licheniformis
atgaaaaaaatgtttgctttctttacagctttaatgctcggtttgacttgtctgccatacttatcggaagcgaaagaatcaaaacatacggacagttctgttacaagcttgccttctatgtctatacctacatctctcaatcagtcattgaacgaggaaaaacagcagtttaaaacttccgctattgatctcagcatcagcctcgacctcttaggaatcggaaactcgattagagacgctatcgttcaaagcaataaccgcagcggtttcgtcaaaaactgcatggaaaccgctttttattctgcagggcaaagatacaatgtcatggtgttcaacttaagccaaggctatcacaatggtttaagaggagttaaattttatggatctgccaactatcatggcgtgatttacggcatttgggtatttgaaagcggacaatttacaaaccaaggagacggcggctggattaactgggcctttaaaggctggtttgatcgaaacggccaaacagtaacattccgtaagccttaa

SEQ ID NO: 2153 - DNA, 1341 bp, Bacillus licheniformis
gtggaaaataaacaaaatatatggtcatcaaagcttggatttatcttagcttcggccggttcggcaatcgggctcggcgcgatatggaagtttccttatgttgccggaacaagcggcggcggagcatttttacttatgtttattctttttactttattgattgggcttcctttattaatggcggagttcattatcggcagaaagactcaaaaagatgcggttgaatcctataaggagcttgctcccggctcgctctggcactgggttgggcgcctcggcattatcacgtgtttcattctgctgtctttctatagtgttgtcggcggctggatcatcatttatattgtcaaagggctgaccggtgaactgtcaagaagtacggattatgccggtcttttcggggagacgattgcaaatccgtatctcgttctagggagccagtttgcatttatcatcataacgatccttgttgttgcaaaaggagtcagaagcggaatagaaaaggcgagcaagtttatgatgcctgctctgttcattatttttctgcttttgatcgttcgttcgctcacacttcccggttcaatggagggcttggagtttttcttaaaacctgatctttcacatatcaaagccgaaacggtgctgtttgcgcttggacaatcctttttctcgctaagcgtcggtgtttccgtgatggtaacgtacagctcttatttatcgaaaaaagaaaaccttgtacagtcagccgtatcagtgacattgctcaatgtatctgtagcgattcttgccgggtttgcgatttttccggccgttttttcattcggattatctcctgatgccggcccgatgctgttatttaatgtgctgccgtcagtctttcataagatgcctttaggaatcatctttttattggcgtttctgctcttatttttatttgctacactgacgtctgcattttcaatgcttgaaatccttgtttcttccttgtcaaaaggggatcctaagaaaagacaggctttcgcttgggcgggaggaattgcgattttcctattcggtattccttcagcattgtcatacggcgtgcttcaggatgtgtcgatttttaatctatccatttttgatgcggcggattatcttgtcagcaatatattaatgccgctcggcgctttgctaattgccgttttcgtgccgctcaaaattccgaaagacgagctttttgccgaattgaaagaaggctctaaaatcagcagaaaatggtttgcagcctggcttctgctgatccgctacgcagctccaatcgtcattattgtcgtctttttggatgctatcggggtattttaa

SEQ ID NO: 2154 - DNA, 981 bp, Bacillus licheniformis
atgagttatttgatcaaaatcagtcaatttgcaggaaaaacgttcgccatttgggtgattctatttgcgattctcggctttgcctttccgtcgcagttcacttggatcgtcccttatattacgattctgcttggcgtgattatgtttggcatgggattgacattgtcagcggacgattttaaagagctgctgagacgtcccctgcatgtgctgatcggtgtgctgattcaatatacggtgatgccgttgctcgcttttggactggcctatggactcgctctcccccccgaaatagcagtgggggttatattagtgggatgctgccccgggggaacagcatcaaacgtcatgacatttctggcaaaggggaatatcgccctgtctgtggcgatcacaacgctttccacactgcttgccccttttttaacgccgtttctcattttatttttcgcgaaggaatggcttccggtatctccgggctctctgttcgtgtcgattttacaggcggtgctgctcccgattatcgccgggctgatcgttcaatttttctttaaaaaacaagtgaaaaaagctgtacaggtgctcccgcttgtctccgttctcggcatcgtcgccatcgtctccgcagtcgtcggaggcaatcgggaaaacattattcaatcagggctgctgatttttgcggtagttgttcttcataatggcctcggacttttcctcggctttgttttggcaaagtgctttaaaatggattatgcgtcgcaaaaagccgtgtccattgaggtcggcatgcagaattcgggtctcggcgcggcattggcgacggcgcacttctccccgctttcagctgttccgagcgctgtgttcagcgtctggcataatctttcaggttcatggcttgcgacatactgggccaaaaaaacaaataaacagaagaatgacaatcattctcctgccccgcaaatgataaataaaaagctttga

SEQ ID NO: 2155 - DNA, 1281 bp, Bacillus licheniformis
atggcggaaattaaagtacctgaattagcggaatcaatttcagaaggaacgatagcccaatggctgaaacaaccgggagattatgtagagcaaggggaattcctgcttgagctggagactgataaagtcaacgtggaattgacggcagagcagtccggcgttcttcaggaagtgctgaaagattccggtgacacggttcaggtcggcgaaataatcggaacgatttcagaaggcgaaggagaaggaggcaaatcaacggctccgcaagctgacgctcaagaaagcgccggcgcttcggaagagaaagcagcctcgtctgaaaagacagccgaacctcgcgaaggtgcgagcgatgaggcggatacagccaaaacaagaactatcgcttctccggctgcccgaaagctcgcccgggaaaaaggcatcgatttatcggaaatccctaccggtgatccgctcggaagggtcagaaaacaggatgttgaatcttatcaaaagaacgagcagccgccaaaagctcagcctgaaccaaaacgcgcaacacaggcgccggccgctaaacaaaccgaagatgctggtaaacctgtagagcgtcaaagaatgtcccgccggagacagacgatcgccaaacgcctcgttgaagttcagcacaccgccgctatgctgacgacattcaacgaagtggacatgacggcggtcatgaacttaaggaagcgccgaaaagatcaattcctggagcagcatgacgtgaagctcggattcatgtcattctttacaaaagctgttgtcgccgcgctgaaaaaatatccgctcctcaacgcggaaattcaaggcgacgagcttgtgatcaaaaaattctatgacatcggaatcgctgttgctgcgccggatggcctcgtcgtaccggtcgtgcgcgatgcggaccgcaaaacctttgccgatattgaaagggatatcggagagcttgcgaagaaagcgagaaacaacaaattgtcgctcaacgagcttcaaggcgggtcctttacgatcacaaacggaggaacgttcggttcattgttatcgactccgattttgaacagcccgcaagttggtattttgggcatgcacaaaatccagctgcgtcctgtagcaattgatgaagagcgctttgaaaaccgcccgatgatgtacattgcattatcgtatgaccaccggatcgtcgacggaaaagaagcggtcggcttcctggttacgattaaaaatctgcttgaagatcctgaacagcttctgttggaaggttaa

SEQ ID NO: 2156 - DNA, 2835 bp, Bacillus licheniformis
atgtttcaaaatagtatgaaacaaagaatgacttgggaagaatttcacggtccgaacctcggctatgtgctggagctttacgatcagtacgtcaaggatccagaaagcttggatgctgatttaaaagagatgtttgacgaacttggagctcccccgggcgatattagggccgcctctcaaaaaaacgaagaggcagatttcacggctggatctattcaaaaaatcgcatcagcggtaaaacttgcagaagatattagaacctatggccatttaaacgcttccgtcaatccactgagaaaaacacaagagaaacaggagctttttcctcttgctgagtacgggttaactgagcaggatgtgaaaaaaatcccggcgtctgtcatatgcaaagatgcccctaaagaagtaacgaacggtttagaagccatccagtacttaagaaacacatacaaaaaatcgatttcttttgaatttgaccatgtgcacatttttgaagagcgcaactggctgatgaaaaagatcgaatccggggaattattcaccccgaaatcgaaagaaaaactggtagaagttttaagaaggcttacagaagtggaaagccttgaacagtttctccacaaaacctttgtcgggcaaaaacgcttttcaatagaaggacttgatgcgcttgtgcccatgctggatgatattatcgccaagtccgtttcggcaggtacgacaaacgtcaatatcggaatggcgcacaggggccgcctgaatgttcttgcgcatgtgctcggaaaaccttatgaaatcattttttctgaattccagcatgcgccgaacaaagatctcgttccgtcggaaggttcgaccgggatcaattacggctggacgggcgacgtaaaataccacctcggcgccaaccgccagattcaggatgagcatacgaaaacggcgcgcattgcgctcgcgaacaatccgagccaccttgagttcatcgatccgatcgttgagggatcgacaagagccgcccaggaaacgagaacggagagcggctatccggttcaagacgtcaaaaaatcgatggcgattctgattcacggcgatgcggcattcccaggggaaggcattgtcgcggaaacgctgaatttaagccagcttaaagggtatcaagtgggcggagcgattcacattatcgccaataacatgatcggctttacgacggaaagcaatgagtcaagatcgacgaaatatgcaagcgaccttgcgaaaggttttgaaattccgatcgtccacgtcaatgctgatgatcccgaagcatgtctttcagcggttcagctcgctgttgaataccgcatgactttcaacaaagactttttgatcgatctgatcggctaccgccgttttggccacaatgaaatggatgagccgtccgcaacgcagccgatgctgtatgatgcggtcagaaagcatccgaccgtcaaaaacatctttgctgaaaagctgattcataaagggatcgtcgataaagaaaccgtcggcaaaatcaaggacgctgtccagaagcgtttagaagaagcctatcgcaaagtgccggccaaaaaggaagacatgacgcatgaaatcgtacttccagagccggtctccaacggttttcctgatgttgacacatcggttgattttgaaactttgcgcaaaatcaatcaggagcttgtttcatggccggaaaacttcaacgttttcgataagctaaaacgaatccttgaaaggcgcgccaaagctttcgaagatgaccgaaaagtcgactggtcgcttgcagaggcgatggcgtttgcgtcgattttgaaagacggtacgccgctaaggctgaccgggcaggattcagaacgcggcacattcgcacaccgcaaccttgtccttcacgacagcaagacaggggacgaattcatcgcgctgcatcaccttgccgatacgaaagcgtcatttgcggttcacaacagcccgctttctgaagggtccgtcctcggcttcgaatacggctataacgtgtcttcgccggaaacgatggtgatctgggaagcgcagtttggagattttgcaaatgcggcgcaagtttactttgaccagttcatttctgcaggaagagcgaagtggggtcaaaaatcagggctggttgttctcttgccgcacggctatgaagggcaggggcctgagcattcaagcggaagaacagagcgattccttcaattggcggcggaaaacaactggactgtcgccaacctgacgagcgctgcccaatactttcatattttaagaaggcaggcgaagatgctccttcgcgaggagatccgcccgctgatcatcatgacgccgaaaagcctgctgagaaatccgaataccgtgtcagaagtgcaggagctcagtaacagcagctttaagccggtctatgaaatgtcaggactttcccatcaatatgacaaagtgacgcgcctcgtcctttcaagcggcaaagtttcgattgacatcagcgaccatttcaataaaatggaaggtgaaaaggattggctgcacattgcacgggttgaagagctgtatcctttccctgcaaagcatattaaagcgatcttcagcaaacttccgaatttggaggagatcgtctgggtacaggaagaaccgcaaaatatgggcgcatggaactatatcgagccttatttaagagaggtagctccaaaggacgtgaaggtccgctatattggcagaagaagacgttcaagtccggcagaaggggatccgacggttcataaaaaggaacaggaacgcattgtatctgatagcttgactcgcaaaaattaa

SEQ ID NO: 2157 - DNA, 1914 bp, Bacillus licheniformis
atgaagtttattaaattcaatgacagcaagattgactctttgctatttatggagctgacagatctggcgaaaacgctcgcgaaaagcgatcaggttgaagtggagtacggggttcagtcttattacaatccttttgagaaaaagatctacatgagccacttttggaaagacaggaaccaccgcgatatggtagacggcttgaagagcgatgtatacttgcggtcaatcggctcccgctacagctcgatgaaagacttttcccgcatgctggactcggctcggaaatatcagtttaagagtttggcaaaacagttgtttatgctttttgaggatatcagaattgaagagtccatcaagagggagcgccccggtacaaagcaggtattttcaaaccggaaatcgatgtaccgcaaacactttgcgacacagctgacgctgaatctggagcggagcatttttacagatgctttgttttgcgctgtatatcttaagctgaccgcggagtcgccgcttgaagagataccggctatccatgaatcggtcgatccgatgaaggggtttatagaagccgagctcgcccgcgtattcgaagcgcgttcaactgctgacatcgtttcgtttgtaaacgggttaatggaaggttttgaagaagtgctcgaaaaagatatgctgaatacgtacttcttttttccggaacttgactacgaacaagttgacgaagaagcgctctttcaagatttaaaagcaaaaccgaagctgagcgaggatctgacgctggaagagaaaagtgcgggtgacgaggaagttcatgaagaagaaatgccgacttggcacagagaaacggaagctccggccaaaagctttctccagtttgatttggagcacggcgcaaaatccgatatttccggcggcgctttaagagaaggagaagacggcgaccaagcgctcgggtctgttcaaggaacggcgaagcagacgaaaaggaaagactactcaaaacttgaatcgcttgaatctgttcaagatgaaccgaacgccggaacagcccaagccggtaaagaaaaccgctatgccttttcggtgatgaagccgccggaaaaaccttcgaatgaagatatattagactaccaggctcaagccaaaacaatcgaatcatatcaaaaacggctcaaacagatgattcaaaaaacgcttgagcataaaaaaacactcccgagaaccgatttgcatgcaggcagattgaacaataaactgctccgttactttacagagcgcaatccgcgcctgttctataaaaagcaggagccgtcaacagaaatcgacgccgttttcacattgctcgtcgactgttcggcaagcatgcatgacaaaatggcggagacgaaacggggcattgtgctgtttcatgaagcgcttaaatcagttgctgtccctcatcaaatcgtcggtttttgggaagatacaaacgatgcgacagagacgagccagcccaactactttcatacggtcgtttcttttgcggattccttaaaagcaggagccggaccgcacattatgcagcttgaaccggaggaagacaaccgggacggatatgcgatcagacagatgacgaagatgcttgttcaaagaagcgaagctcagaagttcctgatcgtcttttcagatggagagccggccgcattcgattatgagcaaaacgggatcgtcgatacacatgaagcggtgatggaagcgcggaaacgaaatatcgaagtcatcaatgtatttttatcaaacagcgaaattgaagaatcgcaaatgaagacgatacaggacatgtacggaaagtacagcctttttgtcccagacgtcgatcagcttcccgatgttctgtacccgcttttaaaaaagctgttgaacaaaagtataggatag

SEQ ID NO: 2158 - DNA, 891 bp, Bacillus licheniformis
atgaaatatgatctgcacgaactagagctgcctgaaaagataaaagagcggctgattcagtctgccgctaaacctgttgacgcggaataccaatcattgattgggacgcccggctatgaagcggaagacagcgccattctctatgacgcgatgatcgcgttgtcactcggaaaaaacgttttgttaaaaggtccgacaggttccggaaaaacaaaacttgccgaaacgctctccgcttattttcaaaaacctatgcacagtgtcaactgttctgtggaccttgatgcagaggcgcttgtcggttacaaaacgattgaaaacaccggcgggaacgcctctattgaatttgtcgaaggtcccgtgacaaaagcaatgaacaacggccatttcctatatattgacgaaatcaacatggcgaaaccggaaacgctgccgatcttaaacggggtgctggattaccggaaaatgatgaccaatccgtttacaggggaagtcgtcaaagcgaaagagggattcggcgtaattgcagcaataaacgaagggtatgtcggaacagtcccattgaacgaagcgctgaaaaaccggtttgtgatcatcgacgtgccatacattaaaggcgacctgctgaaacgggtgcttgaaacacaatccgaactaaaaaatcagaagctgctggaccggtttgtcaccctgtcatcggatttaatgacgcaagcccacaacggacaggtatctgaagaggctgcttccatcagagcgcttctcgatacttgcgatctgtcgacgtatattccgccgctgcgagcgatcgaacggggcatcgttgaaaagcttgatgatgaacgcgaaaaagcggcggtccgaaatattgcccaaactttgttcgaatga

SEQ ID NO: 2159 - DNA, 594 bp, Bacillus licheniformis
ttgagaacattacattacatattgctcgcatgtatgtccgtttgtttggcagctgcatgcacacagcaaaaagaaatcgagcaaaaaaatgccgaacaggaacataaagaaacttttgaaacgatgacacagccattaaaagtaccgctgatcaaacgcgacgggacggagaccggttttatagaagtgtatgaatctgctgcagaaggccttgatattagagtgagcgcccatgatctgccgccgggcatgcttgcttttcatattcatgaaacgggcgtttgcaaaaagcctgattttgaaagtgcgggtgctcatttcaatcctgatcaaaaggagcacggctttaacaatccaaaagggccgcatgccggtgatttgccgaatattgaagtcggagcagacggcaaagtcgacgtcatcgtcaatgcgccggcagtcaccctcgatcagaaaagcaggttcagtctgctggatcatgacggaagtgcttttattattcacgagcatcaggatgacgatttgacaaatccatcaggtaactccggagcccggatggtttgcggagcgctgacgaacagcggaaaaaagtga

SEQ ID NO: 2160 - DNA, 1308 bp, Bacillus licheniformis
atgaagaagaagatagcagcaggtttggcggcctctgcggtagttggaacttcattggcggcgtcaccggtcgaagcccaaaccatcaaggtgaaaagcggagactcactgtggaagctttcagctgagtacaatacgagtgtttcggcacttcaatcagccaacaatctttcatcgacggttatttatgtcggacaaactttaaaagttccggacggcaagtcgaaaagcagctcacagacaaaatccgcaagttccagctcaagttcaagcgctgccaagtccacttacacggtgaaattgggagattccttgtggctgattgccagagactacaaaacgaccgtacaagagattaaaaacttaaacgggctgagcagcgatatgatttatccgggacaaaagctggttattaaaggaagcgcaaaaagcgccggttccagctctggatcaagctccaaatcatccggctcatcatccggctcacaaagtgcaagcagttcaagcagcacatacaaagtcaaattgggcgactctttatggaaaattgccaatagtttgaatatgacagtcgccgaaattaaaacgctgaacaacttgaagtcggacacgatctacccgaaccaggtccttaaagtgaaaggaacagtttccagcggaagcaaaccatcttctggttcgtcttcaagctcttcatcaagtaaaacgaacacaggcagcagttcaaaaacgaccacttacacggttaaaccgggcgattctctgtggaaaatcgcgaattcgatgaaggtaacggtacagagcatcagagaggctaatcaattaaaaacagatgtattgcaagtcggccagaagcttaaaatttctggtgcatcgtcttcagggtcatctggcagcccatcttccagctcgccgaactcttcagtttcaaccggcacttcgacaagcgcaaaagtcgagcggatgattgcagaggcagaaaagcatatcggcgtgccttacagatggggaggcaacaatccttccggttttgactgcagcggattcatctattacacgttgaacaaagttacatctgtctcaaggctgagcgcagcaggatactggaacatcatgtcgccagtcagccagccttcaagaggtgattttgttttcttctcaacatataaagcgggcccttcacacgtcggcatttatttaggaaacaacaagtttatcaatgccaacgattccggcgtcaccgtgagcgacatgaacaattcctactggaagcagcgctatctcggcgcaaaacggtattcattttaa

SEQ ID NO: 2161 - DNA, 1359 bp, Bacillus licheniformis
atgagggaaacaaaggatttgcgggagaaagcaagacagtttttaacgattttaattccgattttgattacgcaagcgggactgtcgctcattacggttctcgacacggtgatgtcaggcaaagtcagcgccgccgacctcgccggcgtcgcaatcggctcgagtttatggacccccgtttatactgggcttgccggcattttgacggctgtaacacctatggtcgcccagctgatgggtgccaagcggcaaaaggatgtcccttatactgttattcaatcgatctatgtggccggaatcatcagccttgccgtcatcgtttccggatattttctgattgatccggtgctggagaatctcgatcttgaacggaaggtagctgtcatcgcaaagcaatatttaatctgcatcgggctaggcatattgccgctgtttgtttacaatgtgatgcgctgctttattgattcactcgggaaaacgcgggtgacgatgctgattacgctttgttctttgcccattaattttgtcttgaactatttgtttattttcgggaacttcgggtttccaaagcttggaggagcaggagccggtttggcttccgctatcacatattggtgcatttgtctgatctctttatacatcgttcataaaaagacgccgtttcaccagtttaggatttttggaacattctattcattttcttttgctgaaagtatgaaacttctgaagatcggcatcccgatcggtttcgccatcttctttgagacgagtatattcgcagctgtcaccttgctgatgagccactttgacacggtcacgatcgcttcccatcaggcggcaatgaattttgcttcgcttctttacatgcttccattgagcgtatcgatgacgctgacgattgtcgtcggctttgaagccggggccaaacggtttaaagactcgagggcctacagctatctcggcatttcaatagcggtcggtttttcattattcaccgcactcatcatactactgttcagagagcagatcgccggtttgtacgcggctgaccgggatgtcctgcttctgaccaaggacttcttgctgtatgcgttgttttttcagctgtcagatgccattgccgcgccgattcaaggagcgctcagaggatataaagatgtcaactacacgcttgtcacagctctcgtctcatattggattatcgggcttccggtcggttttgtaatcggaacgtatacttcattcggagctttcggatactggatcgggctgatcacggggctagcggccggtgcagtcgggctgttcttcaggctcaaacgcattcaaaaccgctatattcacactcaaagcatgtaa

SEQ ID NO: 2162 - DNA, 666 bp, Bacillus licheniformis
atgaaaaaacatttactcgtgatcctgccccatcctgatgatgaatctttcggagtcgccggcttgatcgccttaaaccgaaaagaagacattcctgtaacatacgcttgcctgacgctgggcgagatgggaagaaatatgggagacccgctttttgccaacagggaaacccttccgctgctcagaaagcaagagctgatcgacgcctgcagggaaatggatgtacaggatttgcgcatgctcggataccgcgacaaaacgctcgaattcgaggatgaagaaaaactggccgatcaaattgaggctgtcatcgatgatgtaaacccgagccttgttgtgacgttttaccccggacacggcgttcatcctgaccatgatgcatgcggtgccgcggtcatcagggcattatcgcggaaaaagaaagaggaccggccgcgcgtcttatgcatggctatcactcaccacagggaagaggttcttggcaagcctgacgtcgttcttgatatcaaagaagtcgcggatattaaaatgaacgctttaaaagcgcataaatcccaaacaggcggccttttgaaagaaatagagaaaaaactcgccaatggcgagccggttgttgagacatggtttgaaaaagaagcattttggacctatcaatggaatgattaa

SEQ ID NO: 2163 - DNA, 351 bp, Bacillus licheniformis
atgaaagcaataaaaaaagaagatgtgcaggcttctttggaaacatttttaaatcagcctgtttacattcatttggaaacgacaaccggatcgtattccgcgcataaagatgagcagaacatgaccgtggtggcatatatcagaaacgcgaaggtagcctgctcccgggccaaaatcacgggcgagggaccatttcgcgccggtttgaaaaccgaagacggctggatctacgccgaaggcctgacggattatacggttgacgatgaaggaaggttgcttcttgccggctatttgccgggcggcaaactcgccatttcgcttcaaatcagcaaaaagccatttgcagtctaa

SEQ ID NO: 2164 - DNA, 276 bp, Bacillus licheniformis
atggcagatgaactggagcttttccaggcatataaaaccctttggaaaaaccggacgatggagggggaaggcagggaggcgcttcatcaggcggttgatgatgagctgaacgacctcggcacccatccaaggctcagaaagacgaagcacgaaaaatactatcaatcaatccggcgcatcgtgaattcacaattggaatcagaaatgaagctcaagctgattgaatgtcatacggaacgattggagttattaacaaacgaagaaagcagggagtaa

SEQ ID NO: 2165 - DNA, 933 bp, Bacillus licheniformis
atgaatcattcatctcaaacgaaaggaatcatttacacagcgctttcttatttgctgtgggggctccttcctttatattggaaagtgctcgatcagacggccgcgctcgatattctggcgcaccggattatctggtcatttgtttttatgtgcggggtgcttctcgttttgcggcagtggaaaaacggagtcaaagcatttcgctcgctttcgggaaaccgaaaggaatttgttccgctcattttgtcgtccgttctgatttcgatcaattggtatgtctacatatgggccgtcagcaacggctatattcttgaagcgagcctgggctactacatcaatccgctcgtatcgatcgttctcggaattgtctttttaaaggaaaagctaacgcggatgcagggagcggcagttcttctcgctgccctcggcgtgcttatttcagcttttcagtacgggtccgtgccgtacatcgccctgatgctcgcattcagcttcgggctctacggactggcgaaaaagcgcacatcgctctcaagtgccataggacttactttggaaacgatgatgatcgctccggttgcagcgatctacctgctgttcttcagccatccggagaaggctcaggcagcctcagggagcatcggcatgatggtgctgctgtttctggcgggggtgctgaccgcgattccgctgcttttatttgcggaaggtgcaaagaaactgccgctctatcaagtcggcattttgcaatatatcgctccgaccattacattatgtttaggcgttttcgtctaccatgaaccgttcaacagcagcaaggtctttacgttttcctgcatatgggcggcgctgatattgtttacactttcgcaatttcaatggaagagaccggagaaggtatttttaaaaagaaaaaaatcctttcatccgtaa

SEQ ID NO: 2166 - DNA, 453 bp, Bacillus licheniformis
gtgtttgattggcaacgcttttttccatttcagcagttttccaaggacggattaaaaaacgctgacccgaaagatgtggagcaatatatccaccacatgatgaaaagcgttttcggaccggggtatgcagttcaatttccttttcgtgaccctctctcaaaagaaacatcggcggcagatgaatctgatccgattgatatttttgaaacgacaagccatgtatttgttaaaataccgctcaccaaagaacagcttaaccttctgaaaattaaacatacttcacaaaccctgatcatagaaaactaccctgaaaaagggcggcaggaaaaagtcgttctcccctctctagtgcgcagaaagggtacgaaagcaatatttaaagacggcattttggaagtgatgttcttaaaaaatgaggactttaacctgtctgaaatcgacatcacgttttga

SEQ ID NO: 2167 - DNA, 699 bp, Bacillus licheniformis
atgaaaaagaaaatcagcatattgatcacagcaatgtttttgacaatcctttgtttttcgcctcaagcttccgctgcgtacaactcactgcatacgggctatgccacttatacggggtcgggctactccggcggcgcattgcttttggaccctattccgtccaatatgaagatcaccgctttaaatccgacagatatgaattaccgcggtgtgaaagctgctcttgccggcgcctatctgcgggttgaagggccgaaaggaaaaacgaccgtctatgttaccgatctgtatcctgaaggagcgccgggagcccttgacctttcaccgaacgcttttcgcgagatcggcgatatgaaagacggcaaaatcgacattaaatggcgtatagtcaaagcgccgattaccggcaatttcacttaccggatcaaagaaggcagcagccaatggtgggcggcgatccaagtcagaaaccacaaatatcccgtcatgaaaatggaatattacaaagacggaaagtggatcaacatggagaaaacggattacaaccatttcgtcagcaccaatctcgggacaagtccgcttaaagtcaggatcacagatatccgaggaaaagtcgtcaaagacacgataaaaaagcttccggaaaacgggacgtcaagcgcatataccgtaccgggaaaagtacagttccctgactga

SEQ ID NO: 2168 - DNA, 279 bp, Bacillus licheniformis
atgaaccctcatatgctttattcgagatcaggtcctgccggatacccggccagattcccgttattctggggttttggagcgccgcttgtcggcggattgctgggcggatttctcggaagcgcgatttttaactacccaagaccttacgcttacccgccgccatacccgggaccttacggcggcgcgccttattacggctacggggcagctcctggggcttttccgtacggaggtgttccgggcgcagctccatacagaggagcaggaccgggctattga

SEQ ID NO: 2169 - DNA, 747 bp, Bacillus licheniformis
ttgaacagtaaagaaactgtcgtcattacaggcggggcaaaaggcattggaagagacctcgtggccgcctatgctcaaaaaggttttatcgtcgtattcgccgacgtattgaaggaagagggtgaacagcttgaaaaagagctgaccgcttccggtgcgcgggtccaatttgcaccttgtgatgtagcttctgaagaagacgtgaaacggctgatgcaggaagcttcccgaaacggccgttcgatatcggcgctcatcaataatgcgggccgatcagtttggaagtccccttacgacttgacggctgaagaatgggacggcgtcctgaatacgaatttgaaaggcgcgtttctttgcgcaagagaagcggccaaaagaatgaaagaggcgaaaacaggcggtgccatcgtcaatatcgcttcgacaagggcatttatgtccgaaccggactcagaagcctatgccgcgtcaaaagggggcttaatagctttgactcacgcattggccgcgtctttaagcaaagattcaatcgtggtcaacagcatttccccgggctggattgaaaccggtgattatactgccctgcggcctattgaccacgcgcagcatttgtcaaacagggtcggccgcccacaggatatcgtcaaagcatgcttttatttgaccgatccggacaatcgcttcgtcaccggtacaaacataacggtggacggcggaatgacaaaaaaaatgatttatgaagaatag

SEQ ID NO: 2170 - DNA, 321 bp, Bacillus licheniformis
ttggggtttacaatgtgtcctagaatggaagccgccttttctttactcggcaaacgatggaatggactgatcatccatgtattattggatggacctaaacgatttaaagacttgactgaaatgataccgatgatcagccagaaaatgctggctgaacgtttaaaagagctcgaacactgcaaaatagtcgagcgtcaagtgctcccggaaacgccggtaaaagtgatctatcaattgacagacaagggaacggcgctggagcctgtcctcaaggagatacaaacctgggccgaaagccattgtgatccggaagggagctga

SEQ ID NO: 2171 - DNA, 621 bp, Bacillus licheniformis
atgtcttcacaagaaaacaccgctctcaacattctggaagagcgtacttcgattaaagaatatgacacaagcgtttcgatttccaaagaggagctgacaaagctgctgagcatcaccacaaaggctccgtcagcctggaatctgcagcactggcattttacagtctttcacagccaggaatcaaaagataggctccttccgatcgcgttcaaccaaaagcaagtcagtcaggcctctgcggtcgtagcggtgctcggggacttacaagcgaatctgaacggtgaagccgtatacggccctctggcagaagcaggctatatgactgaagaaatcaaaaacacgctgctcggacaaatcaacggcgcttatcaaaacagcggatttgcaagagacgccgcgtttacaaacgcatctctagcagccatgcagctgatgatcgcagccaaagcaatgggctatgacacatgcgcaatgggcggctttgacaaggaagcatttgtgaaagaattcaacatcgatgaacgctatgtaccggttatgctgatttcggtcggaaagccggtcaaacctgcgcacaaaagcaatcgtttcgatgtgtctgacgtatctacatggctgtaa

SEQ ID NO: 2172 - DNA, 606 bp, Bacillus licheniformis
atgaattatatatatgaaaaaggggactctgatctcaccctgttgttattgcatggaacagggggaaacgaacacgatcttctgccgatcggcaagatgattgatcccgatgcaaatttgctcggggtcaggggaaatgtgctggaaaacggaatgccccgttttttcaggcggctgagagaaggggtgtttgacgaaaaagatttgatcgaacggacggatgaattaaaaacgtttctagatgaagcagccaaggaacttcactttgacagaagccgggtggtcgcaatcggctattcaaacggcgccaatatcgcgggaagtctgctgttccgtcatgaacatgtactgaaaggggcgattttgcatcatccgatggttccgtttagaaatcgcaagctccctgatatgacaggtctgcccgtgtttatcggggccggcaaaacagatccgctctgtccgccgcaggaatcaagcgagcttgccggctatttcacaaacgccggcgccaaagtgctccttcactgggaaggcggaggccatcagctgacacacggcgaaattgaaaaggcgaaaatctggtatgaaaagcatataaaagcataa

SEQ ID NO: 2173 - DNA, 204 bp, Bacillus licheniformis
gtgaatcaacagcttttcaaatgggttctgttcatcatcccttttatcggacagcttgccttgctgccgtttgtaaaccggatcgatccgatcgttttcggacttccgttttttcatttttggctggtgctgtggattgtgctgacaccgctgatcacatttgcgatttacagatttgagaaaagaaacggaggttatgagtga

SEQ ID NO: 2174 - DNA, 1482 bp, Bacillus licheniformis
atgcagggaaatctaacagcgctcctcattaccgccggcatcattttggccgtagtttgtatcggatttatcgccggcagcaataaacagtcgcggaaatcggttgaagaatggtcggtcggcggaaggcggttcggcgggctgctcgtctggtttctcgtcggcgccgacttgtatacagcctacacgtttttaggattgacaagcaccgcttttacaagcggaagcgttgcttttttcgcgatcccttattcggttttggcctattttatcgcgtacttttttctgccgaagatttggaaggtggcgaaagtacatcagctgacgacgctggccgattacgcaagggaacgtttcagcagcaagctgctgtcttcgcttgttgccattgtcggcgtcttgatgctgatcccgtatatctgcctgcagctcagcggaatccaggatacgcttcaagtcgcgggtacagggtttattaacgtcaatgccgtcgtgatcatatcattcatccttgtcgcgctctatacgtttttcagcggcatcaaaggtcctacatataccgccattattaaagatattttagtttgggtgatgatgctgtttatggtcgtttcgttgccgctcatccattttaacggctggacgccgatgattgacaagcttgcaaatgaagcgccgcatatgctgacgatcccttctgacggaccgcgcgggatcgcctggttcatcacggcatcgatcgtttccgcgtttgccctgttcatgtgggcccatgcggcgacaggcgtcttcacggcgaacagcgcggatgcgctcagaaaaaacagcatgtttctgccgctgtacaatatcgtattgatcttagtcattttcttaggctttatcgcatttctcgtacttcccgatgacattaatccgagatttgccttgctgtatttaatccaaagttcctacggcggcgtcacgcaaggattcgcctattcaacaattgccctggcaagtctgatcccgtgttcgatcatggcgatcggggcgtctaatctattcgccaacaatttataccgcgatttgatcaatccccgcgtttcggggcaaaaactgacgatcattacgcgctcaatggtatttgtcgtcatcggcctggcccttttatttggaatgctgttccccgcagcgcttgtcacgcttcagcttctcggcgtttcaggcatggtgcagatattcccggccatcgtcatcagcctgttctggaaaaaccagacgaaggaagcgacgatcatcggtcttctcatcggccttgccgttacatttaccgtttatttgacaggggccactttcggcatttacgaaggattctggggccttgcagccaaccttttgactgttgtcttgttgaatccgttttttgtgaaaaatgtaaaacacaattctgtgatcaactatttgtttcatactaagaagaatgtgcaaaaaagcgcctga

SEQ ID NO: 2175 - DNA, 333 bp, Bacillus licheniformis; identical to SEQ ID NO: 485

SEQ ID NO: 2176 - DNA, 861 bp, Bacillus licheniformis; identical to SEQ ID NO: 484

SEQ ID NO: 2177 - DNA, 1398 bp, Bacillus licheniformis
ttgaaacagcagttgaaactctttttggctgtattgattacggccgtcgccgcctccgcactgacgctttatctggtgggcaaaggcagcggcggttcagtatattccgcttcagattccgagaaattcgaaaagctgatggcggcgtacgacaaaatcaagagcgactattatcaaaatgcagacgatgaaaagctgactgacggcgcgattaaagggatgcttggagctttggatgatccatattctacatacatggataagaaagaagctaaaagctttgaagaaagcattacatcttcttttgaaggaatcggcgcccaagtagaagaaaaaaatggacaaattctaatcgtcgcgcctattaaaggatctcccgcagaaaaagccggcttaaagccgcatgatgaaattcagaaagtggacggcaaaagcgtaaaaggcaagaccgtcaacgaagcgacagcgatgatccgcggcaaaaaaggcacgaatgtcaaacttgttctcaacagggaaggcgtcggccaaatcgatgttacgattaagcgcgatacgattccgatcgaaacggtttattccaaaatgatcgacggcaatatcggtgaaatccaaattacgtctttctctgaaaataccgcaaaagaactgacaaaagccattgatgacttgtctgaaaaaggtgcggaacgattcgtgctggatctcagaggaaatccaggcgggctgatggaccaagcgattatgatgagcaacatgtttgtcgataaaggcaaaaccatcatgcaggttgaatccaaaaacggaaaaaaagaagtgtacaaagctgagaaggagcgaaaagtgaacaagccgaccgttgttctcgtcaacggaggaacggcaagcgccgctgagatcatggccgcagcacttcaccagtcttcaggcatcccgatcgtcggtgaaaatacgtttgggaaagggacggttcaaaatgcggagagcttctccgacggatcgaccgtcaagctgacgattgccaagtggctgacgccgaatggggactggattcacgaaaaaggaatcaaacctcaatataaagcggagctcccaagctatgccaaactgccgtacctggattccaaaaaagagtataaggcaggcagcaccggagacgaagtgaaagccgcccagcaaatgcttcaagcgctcggctataagctgaatgcgactggagctttcgacgcacagacggaagctgccgttaaggcttttcaaaaagaccaaaagctgaaaacgacaggcatcctaacgggcgagacgacaatcagcctgacaagcaagctgcaggataagctttccgacaatgatacgcagttggataaagcgattgagatcttaaaaaaagagaaataa

SEQ ID NO: 2178 - DNA, 711 bp, Bacillus licheniformis
ttgagcgattatttagacatgctcgccagcttcggcgtctcatccgctcatcccggcgggatgtccctgtcaaaggcagtgctcgccaaagccggcatcgaccctgagcagccgattcttgatgcaggctgcggaaccggccagaccgccgcttatttgggtcagcttctgtttcctgtcactgcccttgatgccgacccggtcatgatcgataaagcccgacagcgttttaaaaaagaacagctttccattccggctgtccgctctccacttgaggaaatgccgtttcagtctgaaagctttgcctgtgtattaactgaatctgtgctgagcttcacaaatatccggtctgctttacaggaaatccggcggattttaaaacccggagggatgctggtcgcgatcgaagtctgccttaaggaaggaaacgcactgacagacgaagcaaaaaaagaaatcacggaattttacggattcaccgcattatatgacgaggatgagtgggtcaatgtccttcgagaagaaggattttcaaagattgacatcattcctgtcgtattggaagatgcaggagacccggatgacgccgttgaaatggatctgtcgcctgcaatttccgacaaagactatgaaacgatggaaaaacacctgcattacctggaaaaataccgggactctctcgatcatattatttttatatcacatctataa

SEQ ID NO: 2179 - DNA, 255 bp, Bacillus licheniformis
gtggaccgatattataggttttgccaccaaaatattggcagagttgcgagaatcaccgacaaaggaggccgcgtccatgtcggaagaatcgtccgtgtttcaccaagcaaagtatatattgccccgatgatcagacggggaggccgcgggttcgcctacggatattacggcggctggtggggttggggccctgtatacggacttggcctcggtctaattgccggtgtggctcttgcaggcttgtttttttggtaa

SEQ ID NO: 2180 - DNA, 822 bp, Bacillus licheniformis
atgaacggaaagtacaaatacgtgacgattgcttcattgctgagtgcagcggtcctgcttggcacaggatgtaccatgaccgaacagaagcaaaatgacacggctaaaacacagaatactgcaaatgcaagcaaggatgcaaaagaccaaaagtcagacagcagcctggaagatcaggacttcatactcgagagcaagtactttaatcaaataaaagatgtagacgggctgccgacgattcaaaatccggaaaacataatggcgcttgtaaataaagaatacgcgcttcccggcaactatgcaccgagcgacctgacagtgcctgatgtcgcgttttcttttaccgaggatatcgacaagcgttatatcagaaaagaagccgccaaagcgcttgaagagatgttcagcgccgctaagaaagaaggctatgaactcgttgcagtgtccggctacagatcctatgacagacaaaaagcgatctataacaacgaagtcagccaaaagggagaagaaaaggcgaaagaagctgtggcatatccgggccaaagcgagcatcagacaggacttgcgatggatatttccagcaaaagcaacggcttcgccttatcagaggaattcggcaatacgaaagacggacaatgggtcgagaagaacgcctacaaatacggctatatcatccgctatccgaaaaataaagaagacatcacgaaatataagtatgaaccttggcacctgcgctatgtaggaaaaaaagcggctaaagccatccaagaacacgacttgacgcttgaagagtattttaaacaggtgaaaaagatataa

SEQ ID NO: 2181 - DNA, 699 bp, Bacillus licheniformis
atgagcgtacatattggcgcagaaaaaggacaaattgcagaaacggtgctgcttccaggagacccgctgcgcgcaaaatatatcgctgatacatatttggaaaacgttgaatgttataacgaagtacggggaatgtacgggtttaccggcacttataaaggaaagcgcgtttccgttcaggggacgggcatgggtgtgccgtctatttcaatttatgtcaatgaactgatcagaagctatgatgtgaaaaacctgatccgcgtcggatcgtgcggtgcgatcagaaaagacgtcaatgtaagagatgtcattcttgcgatgacttcatcaactgattcacaaatcaacagagtggcattcggctcgatcgactttgcgccctgcgcggacttcggcctgctaaaagctgcttatgacgctgcaagtgagcggaacatcccggttacggcagggaatgtgtttacggcggatcaattctataacgacgacagccaaattgagaagcttgccaaacacggagtgcttgcggtcgagatggaaacgacggcgctttatacattggctgcgaaattcggccgaaaagccctctccattttaacggtcagcgatcacgtcattaccggcgaggaaacaacggcagaagaaagacagacgacctttaatgatatgattctgctggctctggatactgctttgtaa

SEQ ID NO: 2182 - DNA, 1008 bp, Bacillus licheniformis
atgtttcgttcacttaacagttatttaatcgactttaccgggcttgttgtcatcagtgttctgatatgccttgtgtcagccggcgggtcgctcgcctcaggcctccccttccagattccggcttccgttctgcagctgaatacgattttcatcagcattttaatcgaagcccttccctttgtgttaatcggagtattaatcgccggtttcatccagatctttgtgactgaagagcatattcgctccctttttccgaaaaacaggttttcaggagtgattgtcagctgtttactcggcgcttgttttccggcttgcgaatgcgggattgtcccgatcgtgagaagactcgtgtcaaaaggcgttcccatctatgcaggcgtcggctttctgttgacaggtccgctgatcaatccgattgtcgtcttatccacttatatggcttttggcaatgacttgcgaatggccgttttaagggttgccgtcggttttgccgcagcggtcatcatcgcttttgcgatcagcatgatgttccgctcgagccagctgaaaacggaaagccggcagacagctgcacactgcgcccattccggcagacgatcccctttttcggaaaagctctttgatatgctgaaacatgctgttgacgaattctttgatatggggaggtttctgattatcggcgctttagttgcagcgcttgtgcaaacatacctcccgttaaaatcgctgtttgtgttcggagggggcatgcttgactcggcattggtcatgatggggctggcttactttttatcgctgtgctctgaagcggatgcatttatcggcgcttccttcaccaatttgtttccttcctcatccatccttgcttttctcgtttacgggccgatgctcgacttaaaaaatacggtcatgatgctgcatgcgtttaagccgaagttcgtcatttgtttgtctgtcctgatcaccgttgttgtctttgtttgtatcaaagttgtcagtttgctgtag

SEQ ID NO: 2183 - DNA, 873 bp, Bacillus licheniformis
atggtttttcagcttcggcaatttttgcgcgcacttgtgctggctgccttttccgtctttattttcaagctccattacacaggggaaattgataagctgattaatcctaaatacgattacaccagcctcatcgccgcaggtgtgttcgcgtttctgttcatcattcagctgaccaggatctggacggtgaaggatgaccgcgctggggattgcggctgcgggcatgatcatggcgagtcaaagccctttttcatcaggctgatgcattatgccgtcatcgctcttcccctcatcaccggattcaccctttccccggctgtactgaattcgtctgtcgccgccaataaagggacgatgctcaccaaaacggagatcgcccctcaaactgaaggcgaaaaggaacatgtcatgacaccggagattcagcaaggactcgccgattcagcgatgacgaagtcggcgtatgacaggaagatggatcagtttaaacaggaaaagcggattgtcatgaatgacgacatgtttgcagactattatgatgaagtgacaagcaatcttgatcactatattggaaaggagatcacggtcaaaggcttcgtccataaggaagcggggctgagcgcacgccagctcgtgctgtcccgatttatgatcacgcactgcatcgcagacgccagcctgatcggatttctcgccgaatggaacggtgctgagcaattgcagcctgacacatggattgaattggaaggaacgcttggcaaagcgtcttataacggctctgtcatcccgatcatccgcacgaagcgatggaaggagatcagcgagccggagcagccgtatgtctatccggccgcgattagtatgacagattaa

SEQ ID NO: 2184 - DNA, 135 bp, Bacillus licheniformis
atgatgggcaaaaaacagcgaaacagagtcaccggattgaaaaaaaacaaccacatcccgacaaaggacgtcatcgcggcagaggatgcgcatgaaaaggaatacagcgccagaaaaagaaaaaatacaacataa

SEQ ID NO: 2185 - DNA, 321 bp, Bacillus licheniformis
ttgccgttaatgtttcaactgtttaaaaaaaagctgataccttatgatgtgacgatttttcaaacgccttgctttggtgaagataagggatacgagatggtttacagaacggaaataaacggcagaacccatgaagatgtgctggaacggacgttttccactttcaatgtttatgacacggtgccgaatgattataaggcgagatttcttgcaactggcgacatcgttttaatcgatgaaggaagaaagggaaaaacctattataaactgctgtctacggggtggagcaaaatcaaccgcattttgctgcagtcttcgtaa

SEQ ID NO: 2186 - DNA, 651 bp, Bacillus licheniformis
atgtttaaaaacaatgtcaaggaggcactgacttttctaatgtataaagcactattttcagcagctgtctttgtcatcatggccattcttatccgcatcccggcggttcaatcatttgatgtgagcgtgatacaggctctcgagtctgtcagacatccggttctcacagcggtttttaaagcgctgacagagctggggtcaagcggcttcatgctgccgctgatgcttgctttaaccctggttctcgccgtctataaaaaagcagcggcatcactgtatctttatttgctgttttttgttgaaagaacggccaatgaagccttaaaaggctggattgccagagagcggcccgcgataaacccgctcgtgcacgaaccgtcatacagctttccgagcggccattcgatgaatgcggcgagcatgtatccgtttatcgcatttctccttttgctctgcattcctttttttcaaaaacacagtcgcgcggtttacgtgtggacgggccttctcgtcggactcatcggaatcagccgcatgtatctcggcgttcattacatgactgatgttatctcaggtttttcgctcggtctcgcgctgtttttcatcttcaaaaaaattggcgaaaagtacccgcttgttcgacaaaagtag

SEQ ID NO: 2187 - DNA, 171 bp, Bacillus licheniformis
atgaaagaaattgaactgatgatagatacagaagaaatcgctgattttttttatctagagctgacaagaagaggctacataccgaacgaggacgaactgttcgaaattgccgatatcacctttgattatctgattgcaaaatgtatgatagatgagcatatagaggattga

SEQ ID NO: 2188 - DNA, 681 bp, Bacillus licheniformis
atgaagtcaaacgcgcctaaattcaaagtcggggatgtggtcgtcgtcgtgatgtacgggacggtcggaacgattacaaaagttcataaaatcgataagcattttttgtatgaagtcaatcataatgaagtgctttatttcgagacttctcttcaactttacaaagattatgacggggtcattgtcgatacggaaaagcttgacatcgaatatgaatttttaatcggagatgtcgtctatgtaaaagattacggcaaagaattgtttaaaatcaccgggcacagaacggaaatttggagatatgtggaggatggctgggaagatatcatttacgagctgacccgtttgaaagacggagaatggcttgaaactgaagaagaagatttaacgctcgtgcttagaacctacgaaatggaccagttcgtccatcagcttctgtttgttcattatgtcggcgaagccggacaagagcttgatgaaccgatatctgaaaaagtgtttttgccattttctggtgattccgaggagcaggatcatgagcgcaatatggcagttactgtcgtggatgaactgcttgatatctacaatgactataaagtattgtatgaaatgtttcaggatgcggaatataaagatatgatggagtttgtgttaagcagcctgaaagaatatttcaaatga

SEQ ID NO: 2189 - DNA, 222 bp, Bacillus licheniformis
gtgaagtctttttaccattatttaatgaaataccgccatccgaaaccgaaggacgcgatcagcgaattcgcgaaccatgcttaccttgatcacggatttcccaaggcatcaactcattacgatgaaatcagctcttaccttgagcttaatggggattatttatcgtcaatgacgacatttgatgaggcttgggaacgatatatttcggaaacaaagcgataa

SEQ ID NO: 2190 - DNA, 282 bp, Bacillus licheniformis
atgaagaagtgtgaatggtgcaatgaagaaaaagccgcggcagcccgcacggcggtatattgggagcttcccgacgggacgaaagcgattgaaatcaccgacacacctgcggtggaatgcgaagggtgcgggatggtctatcaggaggacagtgtcacctgggaaattgaaaatcagctgctcttgattgatacaaaaaaactgccatcgtccgtttcatatgatgcgctgatgaaaacagagcgcatactgaagcggaattactttgacttttcctcatga

SEQ ID NO: 2191 - DNA, 1410 bp, Bacillus licheniformis
atggaaaacggtctgtttaagccgaaaaggcactggaaggatattgagctttggaaagatgttcccgaggaaaaatggaacgactggatatggcagctgaccaacaccgtcagaacgcttgaagatttgaaaaaagtcgtcaatcttacgaaagaggaagaagaaggggtgcgaatctccacaaagacgatccctttaaatatcacgccgtattacgcctcactgatgaatccggatgatccgcgctgtccgatcagaatgcagtcggtgccgctcgcagaagaaatgcacaaaacaaaatacgaccttgaagatccccttcatgaggatgaagattcgcctgtccccggcttaacccaccgctatccggaccgggttttgtttctcgtcactaatcaatgctcgatgtattgcagatactgtacaaggcggcgtttttccgggcaaatcggcatgggcgtgccgaaaaagcagctcgatcaggcgatcggctatattcgggatacgcctgatgtcagggatgtgctgatatcaggcggggacggcctcctcattaacgaccagatccttgaatatattttgaaaaacctccgcgccattccgcacgtggaaatcattcggatcggcacaagggccccagtcgtcttcccgcagcggattaccgacaagctatgcagcattttgaaaaagtatcatcccgtctggctgaatacgcatttcaacacgagcattgaaatcacgaaggaagcgaaggaagcctgtgagaagctggtcaatgccggggtgccggtcggcaatcaagccgttattttggcaggcattaatgacagcgtttccattatgaaaaagctgatgcatgatttggtgaaaatcagagtccgtccgtattatatttatcaatgcgacttgtctgaaggaatcggccatttccgagcgcctgtatcaaaggggcttgaaatcattgaaggcttgcgcggccacacgagcggctatgcagtgccgacctttgtcgttgacgcgccgggcggaggcgggaaaatcgccatccagccgaattacttgatttcgcaaagccccgataaagtcgtgctccgcaattttgaaggcgtcattacgtcgtatcctgagcctgaaaactatgttccggggagagcggacgactattttgccgaaatcttccctgatgtgatgaaggaaaaagaggagatcggcatatcggcaatctatgcggatcaagctctttcatacacaccggacggcttaaaacggctcgagagaagagaaagctattccaagaggcctgatcatgaaacattgaaaagccgccgggcaaagcgcgatgaattgaaagaaaagaaattccttgcccagcaaaagaaagaaggcgaagctgaggggcatgcgcaatga

SEQ ID NO: 2192 - DNA, 834 bp, Bacillus licheniformis
atggtgaaaaaatggagcaatgacagctgcacgcttgaagcggatgtcgacttgttcagcaaaaggatcagaattgtcaattatgaaggcaatgtgtgttcattttttcccgacatactgaaagaagcaaaaaaacatgatatagggaaaattatcattttcaccaaaacgactgacagagacgcattgcttgagcggacgtttgaaccggaagggaaaatcgacggatactttaacgggcatgatgctgacgtgttcgtaaaatatgtaaaagaagacaggcgaaaaaccgctgactggcttatgcaggatcaaatgctggcagagctgttcagcacaccccgcatcgccgagatccaaaacgcttcctttaaaatcaggcgggccgtctctgttgatgcgcctgttctcgccgacctctacaacagcgtctttcctgtatatcccgcacctgtttcagattcggcatatctcaaggaagcgatgggaaagggggctgtttactacctcgcttttgacggcgaaaaagtcattgcatcagcaggcgcagacgttaatcccgctttggggaatgcggaaataaccgactgcgccgtcctgccggaatacaggggcttttcattgacgaggcggttgattgccgagcttgaaaccgacttgaagcaatcgggcatcttttgcgttttttcaatcgcaagagcggcttctttcggaatgaacgccagtctttatcatttatcatactcatacaggggccggcttttgaacaactgcctcatttatagaagcattgagaatatgaacatctggtgcaaaaatttaagccggtcttaa

SEQ ID NO: 2193 - DNA, 1269 bp, Bacillus licheniformis
atggagaacatagagagaaaagtgtgcgattggatcgattcgcatgagcaaaaagcgattcgccttttgaaaaaactcgtcggagaaaaaagcacgatgggccgagaatttaacgcccaggccgtcgtcctggagaaattgaggcaattcgaagctgaaatcgatgtctgggagccaagcataaagcagttggaacagcatccgctgtttaaatcagacagaacaagctttaaagaaagcccgaatattgcggctgttaaaaaaggaaagggcggcgggaaatcgctgatcttaaacggacacatcgatgtcgtgcctgaaggaaacagaaaagactgggagacggagccttttcagccggttgtgaagcaggggcggatatacggccgaggcacaactgacatgaaaggcggcaataccgctcttttaatcgcgatggaagcgctggagcaatgcggggttcaactaaaaggagaccttatttttcaaagtgtcgtagacgaggagtgtggcggagccgggacgcttgcggccgtaatgaggggctacaaagcggacggcgctttgattcccgagccgacaaatatgaaaatgtttattaaacagcagggctcaatgtggttcagaatcacggtcaaagggctttctgcgcacggcggcacaagatatgaaggcgtcagcgccatcgaaaaaagcatgcttgtcattcaatcgctccgccagcttgaacaggtcaggaataagagaataacagattctttgtatgacaatatcccgattccggtcccgatcaacatcggcacgatcaacggaggcgcctggccttcgtcggttgccgacacggtgacactggaaggaaggtgcggaatcgctccgaacgaatcccctgaagccgtccagtccgagcttgaaaactggctcaacgatcttcagtaccatgatgaatggtttaagcactatcctgttgatatagaatggttcggcgccatgtggcttcctaacgatttggctgaagaccatgaactgacgaaagtgctgaaatccgcctatcaaaccatcacggcagaggctccgctcatcgaagcttccccgtgggcgacagacggcggaatattgtcgcacgccggaggcacccctgtcatcgtcttcgggccgggagaaacgaaaatggcccaccaggcaaacgaatacattgaaaaagacgccctgatccagtcagccaagatcatcagcctgtttattatgaattggtgtgattatgaaaggtga

SEQ ID NO: 2194 - DNA, 654 bp, Bacillus licheniformis
atgggtttgggagtcatagagcgggagagaatcgcgaaacgggcggcccgcgaaatcaaaagcggaatgattgtcaatctgggcattggcattccgtctttagttcccaactttttagacccgggcacttccgtaatgatccaatctgaaaacgggcttctcggcatcggcggatcgcctgaaaaaggaaaggaagatgagaatctttgcaatgcggcaggctggcctgtcaccgtagtaaaaggcgcttcttattttgattcagctctgtcgttcggcatgatcagaaagggtgcgattgatgtcaccattcttggttctctgcaggtcagccagtcaggagatctggccaactggatcgtcccaggcaaaaaggttcctggaatgggaggggcgatggagcttgcccaaaaggcgaaaaaagtcattgtcgtgatgagccataccgataaaaacggtgcacccaaacttgtcgctgactgtactctgccgctgacagcaaaaggctgcgtcgacatggtaattacagaaaaagccgtgatcaccattgacagcggcggttttgtattacaagagctgatgaatgaagaggatcttgatgatgtgctgcggctgacggagggaaagatccggatcgacgggccgctttcgtaa

SEQ ID NO: 2195 - DNA, 693 bp, Bacillus licheniformis
atgacgatgccgaacaaacgtattgctgttgaagatgccattgccgatttgaaagacgaagcgaccgtcatgtttggcggatttgggggagtcggttcaccgccttctttcatccgggcgattttgaaaaaaggcgtaaaaaatttaacggtcatatgcaatgatgcaggatttcccggcatcgggatcggcccattaatcgtcaataaccgcgtaaggcggctgatcgcttctcatatcggttcaaatcccgttgcgggaaaacaaatgaccgacggttttctcgccgttgaattttctccgcaaggtacgctggccgaacgaattcgtgcgggcggcacaggtcttggcggcattttgaccgatatcgggatcgataatgacatggtgcgccaaggaaagaatatcgtttcattaaacggacgcgcataccttgccgaggaagccttgagtgcggaatacgctttcatttatggaaaaaccgccgatgaattcggcaatatcatctacgacaaaacggctcgcaacatgaacccgcttatggcgatggctgctgatcggacatttgccgaggtcgagcggatcgttcccattggagagctcgatgaagaagaaattgtaacacccggtgtttttgtcgaaggtgtagctgaaacggaaggggtgaactggaaatgggtttgggagtcatag

SEQ ID NO: 2196 - DNA, 1341 bp, Bacillus licheniformis
atgtcgtttttgattaagccggatctgcacgcaagctatccggtcgttcagtatgcaaaaggaagctggattgtcgaccattccggaaagcgttaccttgacggttgttcgggggctgttacctgcaatctcgggcacggtgtccaagaagtgattgagcctctcaaagagcagcttgatgctgtttcattcgtctaccgttcgcagtttacaagtgagccggccgaacagcttgccgaactcctggctgaatggctgccgggtgatctgaattggtctttctttgtcaacagcggatcggaagcagttgaaaccgccatgaaaatcgccgttcaatactggcaggaaaaaggacaaaacgacaaaacgattttcctttcaagatggaacagctatcacggaattacaaatggagccctgtcgctgtcgggattttatgagcgccgctacaggtttacgcacatgctgcacaagtatcccgccgcttcagcgccaaactgctacagatgccggctttctcatcctgaatgccaggaagcgtgcgtgaaagaaatcgagctcgccgttaaaaggatcggaaagcaattcatcgcgggcttcgttgccgaacccgttattggggctgctggagcagctattacggcacctgctggctattataaaaaagtaaaagaaatatgcgaagataatgaaattctctttatcgcggatgaagtcatgagcgggatcggccgaaccggccggatgctggcgattgaacattggggtgtgactccggatattgccgtactcggcaaggggctgagcgcaggctattcaccgattgccgcagcggtcatgtccgacggcatgatggaaacggtcaaaaacggctcaggggccatcatgagcgggcatacgtacagcgcaaaccccttttcagcccgtgctgcgctcgccgttctccgctacatcctgaagcacgatcttgtcaaacaagccgagataaaaggggaaaagctgaaaagaatgctgaaagaagttatgaaacagtcgagcattattggcgacgttaggggcaagggacttcttctcgggattgaatttgtcgccgatcaaaaaagcaaaaagacatttccttcttcaatgccggtgtcggctctcgtcatttccgaagcgaaaaaaagaggactgcttctttatccgtcccaggcgggtattgacggcggcgggggagatgcggtcatcattgcgccgcctcttacgatatcggacaaagaaatggaagagctcattgaaatatttaaacatgccgtatatgagattgaaaaacaagcggaaaaggtgatgcgcgaaagatga

SEQ ID NO: 2197 - DNA, 1236 bp, Bacillus licheniformis
ttgaaatatgcttgggtcataaaaggggactttttcagactgtggtctggaacttttttatcgctctttagttcggttcttttctattattcattggtatggtggtccttatctgaaaccgggagcgccctttcgggaagcgtcgtgatcggcatcgggctgactgtctcgattttggtatcgccgtttacaggctggctgtccgacaggtttcacaggggaaagctcattgcggcttcggatatgatcatttcagctgtatttttaatgatcggatttttggcgctgtcaggcatgaattcggtttttttgctggccgcttcaagggtgatcgtatcggcatgtttgaccgcaatcgaacccgctgcaagatcgctcttgccagatacattgagaaaagaacaaattgaaaaaggaatcgcatttcaagaagtgctcacacagctcatccaagtgattgttccgcttgtcacaggggttctgttttcctttttgcattttggctggttatgggtgctgtgcggaagcctttccttcttgtcgatctttttggagtggagaatcaaagatgaaaggggcagccaaaagcgtattccttttaccaataaacaattgttcagcggttttacaagcttgtatcaaaataagccgctcaagtatttgttgtatgggacgagcatacagcagcttgtattcagcggttttccgatatatatcgtcatttggacttcgctgcttttaaaagatcaggcctggctgggcggcgctttccaatcattttgggcgtgcgggacgctgtgtgcggcgcttttcttgtcctttatcgcaaaaccggagcacgcaaaagcagctgtgcctgctttaatgctgattttcggcctgcttttgtctcctctcggctggattgatcatgtcgtgctgggcgctgtgaatttgatcgtcatcggaatgatcagcggcgtcgtcaacatctatattgaaggttacttgcaaagggtaacggaaggtgaaaatagaggcagatcgctgggcgctttctttgcggtcaacagctcttttatgccgctcggctatgctgccgcagggatgttgtcggaggccgtcagtccggaatatttattcctcatcgtcgcactgcccgcgccgttcgctgcgttttcaatgatgagatcattttatttatgggaaaaacagacgaaggaaacggtcgctttgcaggatgaaacgtcaatataa

SEQ ID NO: 2198 - DNA, 771 bp, Bacillus licheniformis
gtgacatccatttcaaacacagaagaccgttatttaatgctgacatgcagcaaaaaaattgaatcccattatcatatatacacagatgaggagatcccgcagatgttttcctctcattttctgcagctgcaggacgattttccgctgacagagctgtactccctgctcgttcggacacccgaaattttaaaacgaaattatgttcatgtgaaaagctcttataagcgggatctgccttttacgatgaaaaagtcgctctttgatcttggctatattcttgatgaagaattgttttattccatcaggcttgcagattggaaaggagattcccctggtgtacgggcagagtgggggacggagaaatcgctcattgacggctgccgcatgatgcaggcttatgatacattgtctatcaatgaagcgtttgcgaaggaaaagctgctgcgcaagtatcctttttatgaggaaggcatcattcagctgtgtgtctgctactcggaagaaggcgaaccgattggatgtgctgagctttatctcgatcacgacgaaaacgttgctaaaatcgaagaagtcgccattttggagccataccagcggaaaggctatggatcgggccttatcaagcagatgctcaccgccgccaaacaatcgggcatggaatcgtgctatcttgtaacttcgggaagcgatcaggtgaaaacgttttatgaaaagctgggctttcagcagaaggaaaagctcacgacaatatttaaatatttgttcgtataa

SEQ ID NO: 2199 - DNA, 456 bp, Bacillus licheniformis
atgacgaacaataaagaagaacggctgaaacagctgacccggatgcaatatgaagtaacgcagaaaaacgggacggagcctccattccaaaacgagtactgggacctgcatgaagacgggatctatgtcgatatcgtttcagggaagccgctgttttcatcgcttgacaaatttgacgcacactgcggctggccaagcttcacaaaaccggtcgatgccggagaaatcgaagaaaagctggacacttcacacggcatgattcggactgaggtgagaagcaagtctgccgattcccatcttggacacgtgtttccggacggacccggaccggacggcctgcgctattgcatcaattcagccgccctccggtttgtgccgaaggacgaccttgagaaagaaggatacggcgaatatgtcaaactgtttgaacgcaagaaatccggagaggaaagctga

SEQ ID NO: 2200 - DNA, 546 bp, Bacillus licheniformis
atggctgaaaaacgcgaactcgccacatttgccggaggctgcttttggtgtatggtcaagccttttgacgaacagccgggcattctaaaagtcgaatccggctataccggcggccatacggaaaatccgacctatgaagaagtgtgcagcaatacaacgggacatagggaagcggtgcaaatcacatttgatccccgatgtctttcatacgaaaaactgctggaactctactggcagcaaatcgatcccactgacagcggaagacaattcacagaccgcggagagtcttaccggacagcgattttttaccataatgacaagcagcggaaactcgctgaagaatcgaagaaaaagctcggagaaagcggcatctttaaagatccaatcgcgaccgacattttggaggccgggccattttatccggctgaggagtatcaccaggactatcataaaaagcaccctgaacgctacacacagtatcggatcggaagcggaagggaaggatttttacaacagcattgggggcgaaagcatgacgaacaataa

SEQ ID NO: 2201 - DNA, 435 bp, Bacillus licheniformis
ttgaaagttagagaacaaatgatgtatgatatggaagcactgcttcgcacagtatttaaacagatacgtgatgagataaatgagctgctcgaaaaagagatgtcccgcaatgaattcatgattctccgcctgctgagcgagcaaggtccaaagaaagtcacggagtttgcaacgattttaggcgtttcagcaagccatatcacagctgtaaccgatgcattggttgaaaaaggctggatcacgagagtccggtcaaaagaagacagacggatcatcaaaatccatctgacagacgcaggaaaagaaattatcagatatttcgaagaaaagaaaacggaatattatttcaagcggttcagcagctacagtgatgaagagctgaaaacgctgattgaactgttcagcaaattggacaaaaaacgggaacagcgctaa

SEQ ID NO: 2202 - DNA, 171 bp, Bacillus licheniformis
atgactgctccttacctttgtccaaactgcaaaacaaaccgaacacggttcaacttaatcgaacagtccccgacatccgttaagattgatccggcaacaggggaaatagtggaaacgtattcagatgacgagctttcgccttttcacctgccgtacagcgccctgccataa

SEQ ID NO: 2203 - DNA, 1089 bp, Bacillus licheniformis
atgtttttaatcgatttatttttgaatttgtgcattttaattacttcgctctttatttacactcagctaaagtggaatattttttcccgaaaagctacaaacaaacaacttgattggattgacggcattcttggcggggtgctcggaaatgtgcttatgttcttttcgatccaggcaaccgatgagacgatcgtcgacttgcgttatgtccccgtcatgattttgtttttatttacgggcgcctttccggcctttatctgttctctgctgattataggaggaaggtttgtttacgggacgaatacatcctcgattgcagcgcttataggtatgatcgtgatattcgcaggatattatctcattcttcggatcatggataaagacgccggcacttatcgaaagacatttgcattagttatttttgccaatgtggcgatttcaattgtgatcttgatgatccttcatgatttcttcttaatgaaaatgttattgacgtggttctggattttatctactatcggcggctttacgtcagtatacatcgtctcatatttaagaaaatctcattttctgttaaaaaagtatgaagaggaatcgtcgattgattatttaacgggattgaataatgtccggcaatttgatgcgatatggaatgctcatatttcaaacgcaaaagagaagaacgagaaactgtctttgcttttgatcgatatcgattatttcaaaacgattaatgatacgtacggacattcaaatggagatgcgattttaaaagaattaggaacgattttaaaaaagtctgcccgatcggaagatatcgtatcaagaaacggcggagaagagttttcggtcatattgccgaactgttcccattcgcaggctgcagagattgctgagagggtgcgcaaggaagtggagacacacacttttttcatttctcattcaaaaaagattcatattacggtttcgattggagttgcggcatttccggaggtgattcacagtacgggagagctgattgaaaaagccgatcaatgtttgtacagggctaaacaccttgggagaaacagagtgtgcacctccgtttga

SEQ ID NO: 2204 - DNA, 1332 bp, Bacillus licheniformis
atgaaaacggactttacatacggaaatgtatttaaacagctggtctatttttccggaccgatcattttagccaatcttttgcagatttcattccaattcgtcgacagcttgtgggtcggaaatctgctcggagcaaaagctcttggtgctgcggccgtctcaggaacggttttctttacggtgctgtcgttcgtattgggcgtcaacaatgcggcgctgacgattcttgcgcagcaaaaaggaaaaggggataaaaagggactggcatcatatgtaaacgcgtttgtcgttctgatgacggcgatgagcgtattgctcggggttatcggctattttttcacagagcctttgctctcgctacttcaaacgcctggcaatatgatggatttggccgtaagctatttgaggattcattttatcgggattatatttttattcggctataatttcatcagtacagtattaagagcggtcggcgacagtcaaacacctttgcgtttcgtcctgttggccgtcatcctgaacctgttcatggatccgctgtttatctcggtattcaacctcggaattgccggagcggcctatgcaaccgtcgtgtcccaagggattgcttttatttacggagtggtctatacggtgagaaagcagcttgttccattttcaaagccggcgcttccatcgctggcagagacgtccgtcattttgaagctcggagtgcctgccggcttgcaaatgatggtgatttcaggcggctcgatggcgattatgagcgttgtcaattcatttggagaaagcgtcgtgtcagggtttggcgcggtacagcggcttgacagcctgctgattctcccagcgatggccatcggcacggctgtcaacagtatggctggccaaaccttcggaagcggcgacatggagcgtacgaaaaaaatcgccaactacggcgtcatttatgtcctgctgtttatggctgccgtcagcaccgcgatatttctgacaggctatcacgcggtcaggctgtttatatcggaagccgattcagccgcattcggggaagagtatttaaaaacgattgcttttttctatccgtttatcggaattaactttgtgttgaacggtgttgtaagggcagccggagcgatgtttcaaattttggtgctgaacgtgatttctttttgggctttgcgctatccgtttacatatctattttcaaagtggcttggcgagaacggcatagcgctgggcatcggaatgagctttatgctgagcagcctgaccgcctttttatattaccgctacgggaagtggaagcacctcgttctatttgaaaaatga

SEQ ID NO: 2205 - DNA, 705 bp, Bacillus licheniformis
atgttctctgcagttcataatgcccgttatatggcggaaggcttccaggggagccgctatgatgttctgcctgccgaggcgcccttttattttcgaaacagcggaaaagcagtgatgatcagactgctccacgcggctcctcataccgacaatctcgacgttttcgtaaacgggatatccgtttttcgaaacgtctcctatacagatttatcttcttatgtccggtttcctgccggccgtattcaaatcgacgtttttcgaagaggctgggcgaacggtcccctgcttacggtacagtatcacctgatccacggccggtactgcacggttgctgtcacaggcacagccgcaaagctcgttcccgtcggaatgtatgaccagcctgcggctgatccggaaagccgcagcattcgatgcgtccatctctcgccggactctcccgctcttgactttgcagtgcaaaacggacctgtcctgttttccggcgtcccctttcaatctgttacccggtacatcccggtgcgttcacagaaaatggacgtcgagctgaggggggccggttcaacagcagtcctgctgaaggccccgaggatcacgcttcatgccggcgaatccacaacgttgtatggcctcggtttcgtcaacggctctccttctctcgaaataaaagcggcgccgtttcccgtcaaagctccgccttcatag

SEQ ID NO: 2206 - DNA, 201 bp, Bacillus licheniformis
atggaacgtatctacacatatttcagcttgttgtctatgttgttttcactgtacttcggcggtctcgccgccttcagtttcgttgatgaaaacatggacaagatgtatttgaacatcaggtattgtgcgttgtttttaagcattatgatttttactcttgatgcaaaaaaacacaaaaaaactgaccatcacaatcaataa

SEQ ID NO: 2207 - DNA, 573 bp, Bacillus licheniformis
atgaagaaatggaagagcttatttttaattttagcagcagtcaacgtcatgatacttgccgggattttcattctcatttccctgcccggcggacaaaaggagccgccgcgtccgactccgagcgaatatcaattgaacgtgacgagcacgaaagattcattggccgcattcatcaacacgtacttggaaaaggagtcttcgcctgatcttgactatcaaatcgaaatcgatgatgaattccatatcgtcggtgcgatccgcgccttttcctcgacagtcgatgcgagggtgtcctttcggccgacggtggaaaaaaacggagacgtggtccttgacgtgacgagattttcgatcggcaagttgaatgttccgatatcgatggtgctcaactacatggatcaattttatgaccttcctgattttgtacacgttcgttcagacgctaaagaaattcaagttcgtctgtcagagatgccgcttaaaaacggaatgtatgtgaaagcaaaagacattgatttagaaaaagatcaaatcgaatttgtttattacaagcctgcacaaacagattcataa

SEQ ID NO: 2208 - DNA, 753 bp, Bacillus licheniformis
ttgaacatacgttttattacagtcatgatggccctcgtctgtctgctttcagcctgtacggagtggaatgcgggtgttgaaaaaacatcggtctcccctaagcgcgatatcgtgattgcagcggtgggcgattctctgacagagggggtaggcgatcaagaaaagaaaggctatgtcggcatggtggccgatgagcttgaaagccggagcgatgtgaagtccgtaacggtcaaaaattatgccgttaaaggctcccggactgatcagctgcttgaaagattaaaagacaaagaagtacaagagggcctgaaagatgcagactacattttgtttacaatcgggggcaacgacctgatgaaagtcgtccgccaaaacttcgcgcacttaacgctcacacctttccgtgctgaacaaaaactgtttgaaaagcggttttcgaatattttagcggaaatcagagagcaaaacgccagcgctgaattgatttatgtcagcatgtataatccgtttaagtttacgctgtctgaactgcgggaagttgaccaagtcgtagacgaatggaatgaaggcgcggaaaaaaggctgaagaaggtctccaacacgaaaatggcggatatcgctgatatttttgaggaatacagcgatgaaaagaagattgcagaagacgagtttcatcctaatcaatacgggtattctttaatagcgaaacgcgtttacgaacaaattaaaaacgaagacctcccagcagaataa

SEQ ID NO: 2209 - DNA, 582 bp, Bacillus licheniformis
ttgaaaaacgtttttggcattttccttgcaggtattctcacagtgtttctttcgtcctgcggaactagcaagattgataatcctttgaactatgatgtacagtctttttcttttcaaaatcaagacgggaaagcggtgactcttgaaagtttaaaaggccaggtgtgggtggctgactttatatttacgaactgtgaaacgatctgtccgccgatgacttcacatatggctgaactgcaaaaacaaatggaagaggaaaacctgcaggcccgcatcgtctcattcagcgttgatcccgaaaatgatacgcctgaaaaattgaagaaatttgcggccaactacccgctcagttttcaaaattgggactttttaaccggatactcgcaggaagaaatcgaaaagtttgcgctgaaaagctttaaatcaatcgtgaaaaaacctgaagatgaggatcaggtgattcaccaatcgtcattttatctagtcgatcaaaacggcaaagtcgtcaaggattatgacggtgcaagaaatacgccgtacgatgaaatcatcgccgatattaagacgctggaaaaccgttga

SEQ ID NO: 2210 - DNA, 843 bp, Bacillus licheniformis
ttgacaagcattaaaattgtaacggactcgaccgctgacttgagcgaagaactgctcagaaaatatcatatttccgttcttccgctctcgatatcgatcgacggcactgtatacagagacagattcgatattcagccggacgaatttattgagaaaatggagagcgccgcagaactcccgaaaagttcacagccgcctctaggcgcttttatcgaactgtatgaagagctgaccgctgacggaagcgaagtgatcagcatccatctctcaagcgaattgagcgggacataccagactgctgtaagcgcttcaaatatggtcggcgggaacattacggtgattgattccatgtatatttcaaaaggcctcggttttcaggtcgtgcgggccgccttgctggccgaagagggcatgacggccgaagcgattgtaaaagacttggagaacttgcgcgaccggacttccctctatgtgacaattgatcattttgacaacttgatcaaaggcggccgcatcgggaggggaaaagcgctgctcggctcattgctcaaggttaagccgatcgcgaggcttgaggacggaatctatacgcctgaaaaaaatgtccggagcagcagtcagcttatccgttatttaactggtcaatttgtttcagcggttaagggaaggacggtacaggcgatcggaatcgcccatgccgatgcgctcgatctcgcccatcggctgaaagactccttgcttgaacatatcccgggaatcgatattgatattgactacaccacaccgattatctcggttcataccggaaaaggagcgatcggttttaccttttacaccgattga

SEQ ID NO: 2211 - DNA, 252 bp, Bacillus licheniformis
ttgttacttaaaagcctggagttcaaacgttcggatggacagaaggtgaaggtgacggaaatacctctgctgaaggaggacgacccgcatttttttatggccaatctgaggcttgaaatctttttaaagacgctctattgctcaaagcggaaaaaaaacgtctactcctttagggactacttaaagagagcattgaaatggcaggattacctggccatttatcaacatgatgaattgaagcataatgcataa

SEQ ID NO: 2212 - DNA, 1269 bp, Bacillus licheniformis
atgaaaccgttgcttaaagaaaactctctcatccaagtcaaagacattttaaaagcccaccaaaatgtaaaagatgttgttattcatacccctctccaaaaaaatgagaggctgtccgagaggtacgattgcaacgtatatttaaaaagagaagacctgcaggttgtccgctcttttaaactgagaggcgcctattataaaatgaagcagctttcaaaagaaacgacgaaaaacggggtggtctgcgccagtgcaggaaaccatgcgcagggagtcgctttttcctgcaaacatctcggtattcacggaaagatttttatgccgtcgacgaccccgaggcaaaaaatttcccaagtcgaattgttcggcaaggaatacgtcgagatcatcctgacaggcgacacgtttgatgatgcttatcaaagcgcagtcgcctgctgcgaggaagaaaagcgcgcatttatccacccgtttgacgatcctgccgtcatggctggccagggtacggtcgcggtcgaaatcttaaacgatatcgaaacggaaccccattatttattcgcaagcgtaggcggagggggtctgctttcaggagtgggaacctatatgaaaaacgtgtccccggatacaaagctgatcgcggttgagcctaaaggcgcgccggctctttttgaatcaaacaaaaaaggcgaagtcgtcatccttgagaaaatcgataaatttgtcgatggagccgctgtgcagaaaatcggcgaagagacatttaaaacgcttgaaaccgttgtcgatgatattttgctcgttcctgaaggaaaggtgtgcaccgcgattcttgagctgtacaaccaatgcgcgattgtcgccgaacctgcgggagcgctgccgatcgccgctttagatctttacagggatgaaattaaagggaaaaatgtcgtatgcattgtgagcggaggaaacaacgatatcggcagaatgcaggaaatcaaagacagatcgatgatgtatgaaggactccagcattatttcatcgtgaacttcccgcaaagggcgggagctttgcgcgaatttttagatgaagtgctcgggccgaccgacgatatcacccggtttgaatatacgaagaaaaataataaaagcagcggccctgcgctcgtcggcatcgaattgaagcagcgcgaagattacgagccgctgatcgcaagaatggacaggaaaggcttccgctatgtcgaagtcaataaagatgaagggctctttcatttgctgatttaa

SEQ ID NO: 2213 - DNA, 1002 bp, Bacillus licheniformis
atgattaaacacacatatccgtccgtaggtttctccgagctgatcggggaatgcgattcctttttgcaaacgaaaaacagagcgatacaatttgcagcatcttcccatccgattctgattcatggggaaacaggcacaggcaaagagctgttcgccaaagccattcattccggatcatctttcaaggatgatcccttcacacatgtaagctgcagcacgctggatgaagatgaaacggctgaagatttttttctttcagagctgaatgagcccggaaccttgtttctcgacgaagtgtggggtctatccttgcatctccagggcaggcttttggcagccattgaaaaagggatgcaaaaaagattgatcacctcttcaagcatgcctctcattgaacggattgatagcagcgaattccgcaaggacctgtactacaggctcaatgtgctcgaccttccgcttccctctcttagtgaacggcgaagcgacatcccccttctcgtgcatcattttttaaaaagcggggatcatgacatatatgtcgaaccggtcgtttggaaagctttagagcagcatgagtttgaggggaacgtcagagaactcaaaaacatgacggattatatgataaccgtctcagacggaaaaacgattcagctttacgacacaccgccctcgttaagagaacaaatcaaaaaaaagaagcctaaggacaaaaaaacggcttcggcatcacttaccttaatggaaaaagaggagtttgcgtttttgctcgatgcaatcaagcaattaaatgaaaaaggagagcctgccagccgcagggttctgtccgagctgagcaaaagcggcaagtcggagcttacaccccagcaagtgagaagcagattggattatttggaaaaaagagagtttattacaaagggccgcggaagagccgggacaaaaatcacgcttgaaggcctccgctttttaagctctttaaagcatcacattattcaagattag

SEQ ID NO: 2214 - DNA, 642 bp, Bacillus licheniformis
atgtacacgattaaagaagaaattgctaatgcaataacccatggactcggcgtcctcctgtcaatacctgccatcgtatttttggtgatatttgcgatccgctacggaagtccggttgatgttgtcagcttttcaattttcggcgcttccatgctgttcctgtatttaagttcgacccttctgcacagcattcagcaccaaaaaacaaaagatattctggagatcatcgatcactcagccatctacgtactgattgcagggacatacacaccgctgctcctcggacctttgaaaggcgcgctaggctatacgatgcttgctgtcgtttgggggcttgcgattggcggggttgtgtttaaaatcttttttgtgaaacggtttatcgttgtcagcacactggtatatcttgtgatgggctggatggcgatcattgcgatcaagccgctttatacggccttgaccggagaagggttcgccctgctgcttttagggggaatcttgtattctgtcggaaccatcttttatttatggagaaagattccatatcatcatgcgatatggcacactttcgtgctcggcggcagcgcctcaatgtttttctgcgtgcttttctacgtggcaaaagtgccgtttgtatcgtaa

SEQ ID NO: 2215 - DNA, 624 bp, Bacillus licheniformis
atgttgcgctattgttttttatggatttattcggcctatatgctcatcaagcatatcaagcttctgcaggcgctgcagacacttgatccgcgcctttcgtatgccaatcagatggaagctgtctttgataagccgaaagcttttttgcgagggtgcatcggcttaaccggttcaaccgtttccatccatcagaacggaagatcgccggctggccccgtgctttatgtgcacccaaagctcggcctgtcagagcttgccgtgctgcttggacaccttgacaaaaccgcttcgttttttgctgatccgcgcgcctttcgttatccgctgatcagcggctggctcaataaaatggccgcggtcagaaaaagcgccgacaaggaagcatcgctagaagaagtggaagagattctccggaaaggccaaagctttattatgtctgaagatgacggactcgattacaaatctttatccaaaaggctcggcattccgatcgttgcagtcgaaacagccggtacggaagacatgaaaaaaggcacgttgttcaagaggctgagacctgttgatatcgatttgacgatccacccggcatacgtcatgactgaaaacaaacagcttcgggcataa

SEQ ID NO: 2216 - DNA, 489 bp, Bacillus licheniformis
atgatctcattgattgctgcaatggacagaaaccgcctgatcggcaaagacaatgatttgccatggcatctgccgcaagatttgaagtattttaaagaggtgacgaaagggcacgccgtaatcatggggagaaagacgttcgagtccatcggcagacctttgccccaccgcgagaacatcatcgtcacatccaataaagaactggatatcccgaattgtcaggtgatgcactcggcagaggaagcggtgcggtttgcgaaaaacagaaacgaagaatgttttgtcatcggcggttcaacactatacacggagattctgccttttgcggacaagctgtatgtgacaaaaattgatgaaacctttgaaggggaccggtactttcctgaattcagcgaagctgagtgggaaatcgtttcgaggcggaaaggcctgaaagatgacaaaaatccttatgactacgaattcctcgtttatcaaagaaaaggatag

SEQ ID NO: 2217 - DNA, 549 bp, Bacillus licheniformis
atgaagaagtatacgatgaatgaaatggtgcacttaacgaaaaatatgctgaatgagcgcggggttgcgattgaggatatcgcgctgatcgtacaaaagctgcaggaaaaataccatcctgatctcccgcttgatgtatgcattgaaaatgtcgaaaaggtcttaaataagagggaaatcgttcatgccgttttaacggggatagcgcttgaccagctggccgagaaaaagctgttgcctgaaccgcttcaatatttggtcgaaacggacgaacccctttacgggatcgacgagattatccctctatctatcgtaaacgtctacggttcgatcggcttgacgaacttcggctatctggataaagaaaaattcggcatcattaaagaactggacgactgtccggacgatgaggttcatacgttccttgatgatatcgtcgcagctttggcggcagcggcggcaagccgaattgcccattcgcatcaggatcttgaggatgaagtgcaggaagagagaacagacggacagagcgttgcgaaaagccgctga

SEQ ID NO: 2218 - DNA, 363 bp, Bacillus licheniformis
atgaagatgtggatgagaaaagcgcttgtcgcattatttacaattgcaacgttcggccttgtatctcctcctgcggcattgatggcggacaagccgcaggagcatcagagcgtgaaagaatccggatatacggctgtttatcaaaagcaagaagagcccgagcttgatgaagacggcgaatccaaatcttcatttgacacctacagggatgaactgctcaatgaagctgaagatctatcattcgtaaaattcggcagcaggatatcgccggtcattgaagacgagtacagggaagaagtgcttccatggatcgaggagatcatagacatccatcgcaaaacgaggcaggccagagacacataa

SEQ ID NO: 2219 - DNA, 627 bp, Bacillus licheniformis
gtggttggaaaagagcgctttgagctgtatcattcagaaggtgaaaagttctttttccatccgaactctgcgatgttccgggccaagcgtatgttaagaggcgaaccggacccttttgtcgaagctgcacaagttgaaccgggggacaaggtgctcgattgcacgctcggtcttggatcagacgcgatcattgcgagccttgccgcaggcgaacaaggcgaagtgcgcggaattgaaaaaagcccgcttctcgcttttcttgtcgaggcggggcttcaatcgtgggagaccggccttgacgttttggatcaggcgatgaaaaggattcgggttcattcaggcgacagcattgattacctgctggaacttgatgatgcttcagcagatatcgtctacttcgacccgatgtttgatgatggaatcaaagaatcagacggcatcgcccctttaagaaagtgggcgcattccgagtttacgcttgacggcgctttacatgaagcccttcgggtcgccagaaaaagagtggttctgaaagaccactggaagagtccgcgctttgaaaaatacggattttccgtaaaaaaacgcaaaacggccctgtttcattacggtgtcctcgaaaaatga

SEQ ID NO: 2220 - DNA, 435 bp, Bacillus licheniformis
atgtcaacagcttatgaagaatacatgcgccagcttgttcttccgatgcgtcaggaattggtgcaggccggctttaaagagttaacgaccgcggaagaagtggagacattcatggaagacgcagaaggcacgactttcgtcgtcgtcaactcagtctgcggatgtgccgcagggctggcgcgaccggcagccgttcaggccgtctccggaagcgaaaaagggcctgacgagaccgttacagtttttgccggacaggatcgtgaagcaacggcaaaaatgagggaatacttcgaaggatatgaaccgtcttcaccttcaatggcactgctgaaaggcaaagaagtcgttcatttcattccgcgtgaacagattgaaggccgtgaaatgacggagattatgaaaaacattacggacgcttttgaaaaacattgctaa

SEQ ID NO: 2221 - DNA, 1677 bp, Bacillus licheniformis
atgacaggtttacgcagtgacatgattacaaaagggatcgacagagcgccgcaccgcagtttgctgcgcgcggctggggtaaaagaagaggacttcggcaaaccgtttattgccgtttgcaactcatacatcgatatcgtaccgggtcatgtccatttgcaggagtttggaaaaatcgtcaaagaggcgatcagagaggccggcggtgttccgtttgaatttaatacaatcggggtcgacgacggaattgcgatggggcacatcggaatgaggtattctctcccgagccgcgaaatcatcgcagattcagtggaaacggttgtatcggcgcactggtttgacggaatggtatgtattccaaactgtgataaaatcacaccgggcatgatcatggcggcaatgcggatcaacattccgaccgtgtttgtcagcggggggccgatggaagcgggaagaacgagcgacggacgaaaaatctcgctttcctctgtatttgaaggcgttggcgcttatcaatcaggcaaaatcgatgagaaaggactcgaggagcttgaacagttcggctgtccgacttgcggatcatgctcgggcatgtttacggcgaactcgatgaactgtctttctgaagctcttggcatcgccatgccgggcaacggcaccattttggcgacatcgcccgaccgcagggaatttgccaaacagtcggcccgccagctgatggagctgatcaagtcggatatcaaaccgcgcgacatcgtgaccgaaaaagcgatcgacaacgcgttcgctttagacatggcgctcggcggatcaacgaatacgatccttcatacgcttgcgatcgccaatgaagcgggtgtagactattcgcttgaacggatcaatgaggtagcggcaagggttccgcatttatcgaagcttgcaccggcttccgatgtgtttattgaagatttgcatgaagcaggaggcgtatcggcagtcttaaacgagctgtcgaaaaaagaaggcgcgcttcacttggatacgctgactgtaacggggaaaacgcttggcgaaaatattgccggacgcgaagtgaaagattacgaggtcattcatccgatcgatcagccgttttcagagcaaggcggactcgccgtcctgttcggcaacctggctcctgacggtgcgatcattaaaacgggcggcgtccaagacgggattacccgccatgaaggacctgcggttgtctttgattcacaggaagaagcgcttgacggcatcatcaaccgtaaagtaaaagcgggagatgtcgtcatcatccgctatgaaggccctaaaggcggaccgggaatgcctgaaatgcttgcgccgacttcacagatcgtcggaatgggcctcggcccgaaagtcgccttgattaccgacggccgcttttcaggagcctcccgcggtctttcgatcggccacgtttcaccggaagcagccgaaggcggcccgcttgctttcgtagaaaacggcgaccatatcgttgtcgatatcgaaaagcggattttaaacatcgaaatctccgatgaggaatgggaaaaaagaaaagcaaactggcccggctttgaaccgaaagtgaaaacgggctatctcgccaggtattcaaagcttgtgacatctgccaataccggcggcattatgaaaatctag

SEQ ID NO: 2222 - DNA, 1242 bp, Bacillus licheniformis
atgaaaattaaatcgatagaaccgacaccgagtccgaatacaatgaaggtgattttgaccgaggaactgccgggtggaaaaagcaataattataaaaaggatcatgcggaaggcgcacctcccgtcatccaggaagttttaaacatagacggagtaaaaggcgtctatcatgtggccgattttatcgctgtcgagcgcaatgcgagatttgattggaaagacatccttcctaaggtgcgcgctgcattcggaatggatgaagccgaagaggcggagggccgttccgaagaaaaagaatcgttcggcgaggttaaagttttcgtgcaaatgttcagcggaataccgatgcaggtgaaattgaccgacggcgagcgcgaggagcgcttcggccttccagaacgtttccaggaagcgatcttgaagcttaaaaccgcgtcttccaacgtcgtgctcgaacggtcttggaaagagcaaggcgtcagattcggcgatttttcagaaatcggccgcgaagtaacggaagagctggaggcggcttacgatgaagagcgcctgcggaagctgacggaatcagctgcatcaagcgatgctgaggctaaacgtacggctgtgcagcgaaagtcttaccgggtaacgcttgaaatgatggatgaggaagattggcaaaaacgctatgcgcatcttgaacaaatggatcctactgaagaggatattccagtactcgaaaaagcgctcaatgacccgaaaacatcgatcagaaggcttgctgtcgtttatttgggcatgatcgaaacgcctgcggtgcttccccttttatataaagcgctcgaagacaaaaccatcacggtcagaagaacggccggcgattgtctgtcagacatcggcaacccggaagcgattccggcgatgatcaaagcgctgaaggatccgagcaagcttgtgcgctggagagccgccatgtttctgtacgaagtcggcgatgaaagcgcgcttcccgctttaaaagaagctgaaaacgatccggaatttgaagtcagccttcagatcaaaatggcgatcgaacgatcgaatacggtgaagaagcaaaaggctccgtatgaagcaaatgacggaaagccgcaaaaaagacagctgacaaagacgctggaaacagcgtctttttttatgcttcaaagcggcgatcgatccgggaattctgaaaaaagtcacgcgtcttgtaataaaatatcactttttctataa

SEQ ID NO: 2223 - DNA, 672 bp, Bacillus licheniformis
atggctgggctgaatcaggaacaaacagaacagatccgcttgatgtccgaatgggtaaaagagaagctttctgccgaaggcacaggtcatgactggctgcataccgaaagggtgaggaacgtaagccttcagatcgcaaaagaagagggtgcagacctgtttatgaccgaagcttgcgcacttctccatgatgtgattgatgaaaagctgtccgatgagcaccgggttccgctgcaggagctgaaaaggcgcctgtccgaagaatggaaggtcgatccggaaacggttgacgggatttttgctatcatcacaagaatttcattcagagacagagagaaatataaagacgaacttctttcaaaagaaggaatggctgtccaggatgccgatcggcttgatgcgatcggcgccgtcgggatcgccagggctttgatgtatgcgggtgcaaagggccatctcctctatgggggcggcaatgcacctactgcagtcggccacttttacgagaagcttctccttttaaaagatttgatgaatacaaagacgggacggatgctcgcagaaaaaaggcataagctgatgctcgaattcctcggcgaactggaaaatgaatgcgccttctctagagaaagccgccttgatagatcagggctgggggttatggtagaataa

SEQ ID NO: 2224 - DNA, 480 bp, Bacillus licheniformis
atgtccatttacgatatcagcgtcaagacgattaaaggcgaggacacgacactgcggccgtataaaggcaaagtgctgctcatcgtcaacaccgcctcgaagtgcggatttacacctcaatatcagcagcttcaagacttgtatgaaacatataaagaccgggggcttgagattctcggctttcccagcaaccaattcatgaatcaggagccgggcgatgaaaaaagcattgaagaattttgcagcgtcaattacggtgtcacgtttccgatgttttcgaaggtgaatgtaaaaggggatcaaatccacccgctgttccgccacttgacgaacaaggcgaagggcatgcttggaacaaaagcggtcaaatggaatttcacaaaatttctcgtcgatcaaaccggagaaaacgttgtgcgcttttcaccgcaaaccaatccaaaggagatggaggagaccattcagaaatggctgggctga

SEQ ID NO: 2225 - DNA, 1686 bp, Bacillus licheniformis
ttgcaaatgaaatcccatttatcagacatagaaatcgcacaaagaacggaattaaaaccgattaccgaaattgcacggaaactcaatataaatgacgaagaaatagagtgttttggttgcacaaaagcgaaaatttctttgaaaatttttgagcgtttgaaagaaaaacccgatggccaggtgattttggtaacctccatcaacccgacaccggccggcgaagggaagtcgactgtcaccgtcggattgagccaggcgctctggcagattggcaaaaaatcgatcgtggcgatgagggagccttcactcggtccgacaatgggcttgaaaggcggggctgccggaggagggtattcccaggttcttccgatggaggacatcaaccttcactttacgggagatatgcatgcgatcacagctgcaaacaacgctttggcggctttcatagacaatcatattcatcagggaaacgaattaaacatcgatatcagaaaaatcgtctggaaaagggcgcttgatctcaatgacagggcgctgcgtgaaaccgttgtcggcctgggcggaaaagcgaacggatttcccagggaagacggctttgacattactgtcgcttcggaaatcatggccgttttatgcctggccagagacttggccgatttaaaaaagcgcctggcttcgatgatcgtcgcctacacagtcgacggacagccggtaacggccggcatgctcggtgtgcagggagcgcttgccctcctgttaaaagatgctatcaaaccaaaccttgttcagactgttgaaggaacaccggcgctcgtccacggaggaccgtttgcaaacatcgcccacggggcaaacagtctgatcgcgacaaaaacggctgcgaagctggctgactatgtcgtgactgaagcgggatttggcgctgatttgggggcggaaaaattcatgcacatcaaaacgagagccggcgggttcacaccgggggcggtcgtgatcgtcgccaccgtcagagcgctgaaaatgcatggcggaacgcctctcgccgatttgaagcaaaaagacctggaagcattaaaaaggggaattgccaaccttgcgaagcatatcgaaacgatagatgccttcggtcttccatacgttgtggctgtcaacagattcgtacaggacacggaggacgagcttgaggccgttcttggctggtgcagagacaacggacatccggctgcactttgcaatgtttgggaagagggcggaaaaggcgggactgatctcgcaagggaagtcattcatgtcatggagcaaaaagacaacaggttttcctatttatacgaattaaccgactcgatcgaagacaaattagccaagatctcccgcaccgtttatggcgccgaaggggtagagtttaccgaaaaggcgaaaaaacagctgcttgaattgaaaaagaacgggttggacggactgcctgtctgcgtggcgaaaactcagtattctttatcagatgacccgggtaaaatcggcaggccgcaagattttagcatcaccgtccgcgaattaaaaccatcgaggggcgcgggatttatcgtcgctttgacaggcagtattttaacaatgccggggctgccgaaacaccctgccgcgcttaagatggatgtcgacgaaagcggcagagccaaaggtttattctaa

SEQ ID NO: 2226 - DNA, 909 bp, Bacillus licheniformis
ttgcctatcaacatacctatcaatttgccagcaaagcagattcttgaaagtgaaaatatttttgtcatggatgaaaaacgggcttttcatcaggacatcagacctttaaatattgtgattcttaatctgatgccgcagaaaatcaagaccgagacacagctgctcaggatgctcgggaattctcctttacaggtatatttcacttttttaataccgtctacacacacgccaaaacatacaccaaggcagcatttggaacagttttatacaactttttcttcaatcagggaccgaaaattcgacggcatgattattaccggtgcgccgatcgagcatttggagtacgaagaggtatcctattgggaagaactccgggagattttagactggagcaaaacgcatgtcacgtcaacgcttcacatctgctggggagcgcaggcgggactgtatcatcactacggcattcgcaaagtcaaactgccgaaaaagacatttggcgtttttgaacacagaataatggagaaaaatgaaagactggtcagaggctttgaagagttctactatgtcccgcactccaggcatacagatatcaatatggatgaccttaaagccgtttcccatttaaaagtgctcagcatatccgatgaagcgggcgtctgtttaattgcttcaaaggatgaaaaacaagtttttttaactggacatcctgagtatgatacagatactcttaaagaagagtatgaaagggatttagccaggaacatggagattgatccgccggtgaattattttaaagaagggccggatggcgcggtacctgtaaaccgctggaaagcccatgcgactcttttgttcatgaattggctgaactactacgtttaccaggaaacgccgtatgagtggaaatga

SEQ ID NO: 2227 - DNA, 1152 bp, Bacillus licheniformis
ttgaataccaataaaaatatattaattttgactgcaaattacggaaatggccatgttcaagtagccaaaacgctctaccaagagtgcgaaaggctcggttttaagaatgtaactgtttcgaatttgtatcaagaatcaaatccgattgtgtcagagattacgcagtatctctacttgaaaagcttctcaatcggcaaacagttttatcgccttttctactatggagtcgataaaatttacaataaaaggaagtttaatatttatttcaaaatgggaaataaacggctggaccaactggttaaaaaacatcagccagacattatcatcaatacgtttccaatgattgtcgtgcccgaatacagacggagaatgggaaaagtcattccgacttttaacgtcatgacggatttctgtcttcataaaatttgggtccacgaacatattgataaatattacgtagcaactgattacgtgaaggaaaagctgctcgagatcggcactcaccctagcaacgtcaagatcacgggcattccgatccgcaggcagtttgaagaagaaatggacaaagataaaatctacgagaagtatcagctgtctcccgacaagaagatattgctgatcatggcaggcgcccacggggttcttaaaaacgtaaaagaactgtgtgaatctctggtgacgaaagaggatgttcaagtcgttgtcgtgtgcggaaaaaatacgatgctgaaatcttcattggaagacattgaagccctttatccaaacaagctgagaacgctcggttacatcgaaagaattgacgagctgttcagggtggcagactgcatgatcacaaagccgggcggaatcaccctgacggaggccacggcaatcggcgttcccgtcatcctttacaagcctgttcccggacaggaaaaggaaaatgccctgttcttcgaagacagaggggctgccatcgtcgtcaacaggcatgaggagattcttgagtcagtctcttcccttttggctgatgagaaaaaattaaacgaaatgaagaaaaacattaaaagcctgcatttatccaattcatcagaagtcatcctgacggacattatcgagcagtctgaaatcatcatgaacaaaaaacagactgtccgggcgctgtcctaa

SEQ ID NO: 2228 - DNA, 690 bp, Bacillus licheniformis
atgaaccgttattcagttgatgagtttgtatccaaaacccagcaggaagacaaaggggaggggctgtttgaaatggaaacgccccgtctcttggaagtcaatctcgacggaaaagtgtgggcaaaggccggttcaatggtttcctatagaggaagagtcaaatttaagcgagaaggggtatttgaacacggaattggacggatggtgaaaaaagtgttcagcggcgaaggggctgccctgatgaaagcggaaggaaacggaaaggtgtatctagcggatcagggaaagaagatatccatcttaaacttgaaagatgactccatatttgtaaatggacatgatctgctcgcatttgacccgtcgatccattgggacattaaactgatgaaaagaatttccggcatgctggccggcggactgtttaacattaagcttgagggaactggaatggctgccattacaagccactacgagccgctcactttgatcgtaaccccggaaagccccgtctataccgatccaaacgcaacggttgcctggtctggaagccttcagcctgaatttgtgacagatgtttcttttaagacgttcatcggcaggggaagcggggaatccatccaaatgaagttttcagggaatgggtttgtcgttgtacagccatttgaagaagtttattactcggaatcttag

SEQ ID NO: 2229 - DNA, 201 bp, Bacillus licheniformis
atgcaaaacggtaaagtaaaatggtttaacaatgaaaaaggcttcggcttcatcgaagttgaaggcggagacgatgtattcgttcatttcactgcaatcgaaggtgaaggatacaaatctctagaagaaggacaagaagtttctttcgaaattgttgaaggtaatcgtggacctcaagcatctaacgttgtgaagctttaa

SEQ ID NO: 2230 - DNA, 183 bp, Bacillus licheniformis
gtggaaagcaatgaactgcaaaccgttcttcacaagacatttgtggaggtatataaagatcttgaacagctcgttgatatcgctaaaaaggggcgtccatctctcgagaagaacattgaggaaatcgagcaaaggctgaagcaaaatatactggcgatcgaaattcagctgaaaattaaatag

SEQ ID NO: 2231 - DNA, 273 bp, Bacillus licheniformis
atgatcatgaaatcagaccatcgcgatgatctcgaaaccggatttaatcagcgcaagcagcttgaaattgccgtagaaactgctcaaaaaacgacgggaatggcaacgaggcaaaagagctccactttgctgaaatcggcgtatcaatccattgaagatgccagacagctgtcacaggctgaggaattagccgcactggatgaagattttttaaacgaacagctcaacatactaaatgattgccagcatcagcttgatgaatcacagcattaa

SEQ ID NO: 2232 - DNA, 195 bp, Bacillus licheniformis
atgaacgttttggataagaaagagatctttaaggaactgacacatttgcaggacacctactgtgaagggtgcttcatcaaaaaacacttcagaaaagaatacggaaaaacgtatgcccacgcattttgcatttcaaaatgtacggtcggagaaaagctccgcacctatggagacgtgctgacaaacaaaaattga

SEQ ID NO: 2233 - DNA, 660 bp, Bacillus licheniformis
gtgaaactgagagcaggaatgaaaatcaagattaaagggtcttcacccattcaatttacagccgatgaatggatcgaagtgaaagaggcagtggcggcggggcgtcagctttctcaaagcccgtatgtcactgaacttgaattcgaagatgagaagggcagcttttggaccctgaaagaactggaaaagctgaaagaagaacttgcggctgaaccggatgagatcaccgtgtattttgacggcagctatgataaagaaagtcagctcgccggtttaggcattgtgatttattactccctcggcggggaaaggtatcgattgagaaagaataagagctttcggctgacaacgaataacgaagcggaatatgcggctctctacgaagccgttaaagagcttagagacctcggggcaagcaggaactccgtcgtcattaaaggggattcgctcgtcgttctgaatcagcttgaaggcagctggccatgctatgatcccgttcattcgaaatggctggacagaatcgaaagccagcttcaaaaattaaagctcacgcccacctatattcaaatcagccgtaaagacaataaggaagcggaccagctcgcaaaaaaaatgcttgagcataccattgtggaaagcacaatcaaactagatgaataa

SEQ ID NO: 2234 - DNA, 702 bp, Bacillus licheniformis
ttgtttaacgaaatattatggattagttttgcgatcattaattttatcattgttctcttcttttttaaacgatttggcaagaccggtttatttgtctggatcggttttgcgacagccgccgccaatatcgaggtagtcaaaacggtcgagctgttcggtttgactgcgacgctcggcaacatcctgtacggaagcgtgttttttgcgaccgacgtcatcaatgaaagatacggaaaggaagaagcgaaaaaagccgtttcaatcggttttttcattctgattaccttgacgctcgtcatgcagggagcgctcctattcaagccgcatcccgaagacatcgcacagcctgcgctggagacgatattcggcttcttgccccgcgtggccctcggcagcctgctcgcctatatcatcagccaaacgcttgatgtttatgtatattcgggaatcagaaggttatttccttccgaccgggcactgtggcttcgcaacagcggcagtacagccttaagccagctgcttgatacgttgatttttacgagcgtcgcgtttatgggcgcttatccgctggatgtatggattcagatttttatcacgacatacgtcttgaaattcgttgtagccgtattcgcagcgccgtacgcttatgccgctaaaaggatcacccctttggatgaaaggagcgaaaacaatgccggttga

SEQ ID NO: 2235 - DNA, 399 bp, Bacillus licheniformis
atgccggttgaggtgtatattgacggagcaagcgccggggatcccggaccgtccggacttggcatttttatcaaagacggccagaagaccgagtccttctcccttcccgccggctcactgagcaaccatgaagcagaattcatggcgctgatcgaaggaatgaagctgtgcgccgaacgaaactaccggatcgtttcgtttcggaccgattcgcagatcgtcgagcgcacggcggattcggagtttgtcaaaaatcaggctttcaagccttatctggatgctatcatccgcttaaaaaaggattttgatttattttttatcaagtggattccttcgaagtcaaatcaagcggctgacaagcttgcgaaaaaagcgatattgctgaaccaacccgagtaa

SEQ ID NO: 2236 - DNA, 888 bp, Bacillus licheniformis
atgaacaagaagctgctgcttgtagacgggatggctttattattccggtctttttttgcgactgcggtgcaccgcaattttatgctgaatgacaaaggcgtgccgacaaacggggttcacggttttttaaagcatctgttaaccgctgcgtctgcgtttgaaccgagccatgtcatctgctgctgggacatgggaagcaaaacgtaccgaaacgatttatttaaggactataaagcgaaccggagcgagccgcctctagaattgattccgcaatttgacatggcgaaggaagcggcggaagagctcgggattttaaatatcggccttgcgggctatgaagccgatgactgcatcggcaccctgacagcgatgttcagcgaagaagcggacatcacgatcgtcaccggtgataaagatttacttcagcttttaacagtcaatgttaaagttgccctgcttcaaaaaggaatcggcaattataaggtatacacagaagaatcattcagtgaagagacaggtatcgaaccgaaagctttgattgacattaaagcgctgatgggcgatacaagcgataattatccgggtgtaaaaggcatcggcgaaaaaacggcctacaagctgatcaaggaatattcgactgttgaccggctgctggaaaacatcggtcagctgacgaagggccagcagacgaaaataaccgaatgtctagaagatctgaagatgtccagaattcttgcagaaattaaatgcgatgtaccgctttcctgctcattggacgatgcggacttcaccttgatgcatgacagggcaaaggagatgctgagacttcatcaaatacggggaatcgagccgctgctgatgaaattcgaaaaaagagagatcggataa

SEQ ID NO: 2237 - DNA, 150 bp, Bacillus licheniformis
atgggaagaacaaagcttggcaacgcgaatgcacagcgaaacaacaacgctaaaaagaagaacggctttaacactgaatttgcgactgaatcctattcgcaaatggaagccgcaaaattaatctcaagcaaaaaacagcaccaaaaatag

SEQ ID NO: 2238 - DNA, 270 bp, Bacillus licheniformis
atgacaaacgttcatgaagcgattacagcacattcaaaaaaacagcaccagcacatcaagcagttcgtgcgtctcgaacaggagagggaaaaagcaatcgatgatgtggtcgataagtgccggcgtaacgaagcattttcaaccgacctcatcaaccaaattacagtgcagatgaacgaattggccaaaaaaggcatcgttcccacaagacggctcgtctcgaaggaaatggttgccgaatacgtcagccgaaaatatccgcaggcctag

SEQ ID NO: 2239 - DNA, 3564 bp, Bacillus licheniformis
atggcacaaataaacacgaaagacgatctgatgaaaagagccggagcggttttcggggagctcacaaaaaacggggatgacaagcggtcggcgcagcttgcgggcatcatccgaaaatggctgagaaaagaagtgtacatcgcgttaaccggacactattcagcagggaaatcatcgcttttgaacgcgctgcttcaggaagaagtcctgccgacaagtccgattccgacgagcgccaatctcgtgctggtccgccggggagaaatgaaaacaacactccatacggtcgatggaagatacgctcagatggacggctcttatgataaagaaaaagtgcaggcgtactgcagggacggcagccagattgaaatggtggaaatcggggggcctttttcaggaatagcgcctcaggccgtcttaatcgacacgcctggaattgattctacagacgatgctcattttctatcggcgtcttcgattcttcaccaggcggatgccttgttttatgtcgtgcactacaatcatgtccattccgaagaaaatgtgaaatttcttcgatcaataaaagataagatacccaatatttttttcatcgtgaaccagattgaccgccatgacgaagctgaaacagacttccacgcctataaaaagcaagttctagatatgctgctgaaagaagggatcagtgaagaacacctcttttttacatcggtcaccgcagccgatcatccgctcaacgaattcaaccggctccgtgctgagctggaaagactgcagcatcaatccgaacagcagctgcaggcatatacggagcaaaaaatcagcagcttgattcatgaacatatcaaaatgctgatcagtgacgaagatacggctctgtctgaagaaaccgcttccttaagagaaaccgtcgagactttaaaatcacagcttgccgatttgacagaacaggaaaaacgggcggaggaacaaatcaaaaaagacatccaaacgattgcccaaaacgcaaatataacgccgtttgagatgagagagctggccaaatcgtatttggaatcaatcgaaaagggctttaaaaaaggaattcttttcagtaaggccaaaacgcttgaagaaaaacaaaaacgaaaagaagcttttcttgccgacgtccaaaaaagggttcaagccgaaatcgattggcatgtcattgaagcaatcaaggcattcatgaaatgctttaacgtccagaatgatgaaatgcttcgggaagttcttcaatttcggaccgtgatagatgaaaacgacctgcttcgttcccggaaaaaaggggctgagcttacaccggaatacgtgctgaactacacgaaagaactggctgaaaacatcagaagaaaggcgaagagacaagcgcagccgctcatcgaccagctcaaaacctttattaaagaaagaagcgtcctgcaggcggaagcgataaaagctgaatatgatgcggaacaagcgaagctcgccgagcgcgaaagacggttgattgagcagcagaagtcatatgaaaaagcaaaccgtctctgggatcaatgggaacacggcaatcagagcgatctgccggcgaattggtatgccgccgaaagaaagccccttgaaaaaacgcttgatgcgaagcgagcggaaccggtccgtgcacaaggggaaaacagcagccgtaaagacgaggctcttcatccgaaaaagggcgtttctgagtccattgagcactttttcgaacttgcccggattttggcggatatcccggctttagaaaagcagagaaaagcattcctgcacaaaacggagcgccttcatacaaggcagtttaccctggcgctcttcggcgcattcagttccggcaaatcgtcttttgcaaatgcgctttgcgggcggaaagtgctgccgtcatctccgacgccgacaacggcaacgattaataaaataacaaaaccgtcgggaaccaaaagggacgggacagccgaagtcgcttttaaaacggaaggggaaatcacagctgaactggatcagcttttagatggaaaaatggcttcagcaaaaggctccgcttttggcgaaaaacttaaaaacctcttgaaaaaagaggaactgcacgatgatgaacggctgctgatcaagaacttcctcaaggcttataagcgttatggttcatatatcaatgatcaggaaatcctgacgatttccgctgacgatctgcatccgtatgtcgctgaagaacaaacggcctgtgccgtccgcgaagtcaccgtttatttgagcacaccggtcacggagaaaggaataacaatcgtcgatacaccgggagccagcagcatgaataaacggcatactgaacttgcgtttcaatacatgaaagatgctgatgccctgctttacttaacatactaccagcattcattttccaaagcggaccggtcgtttttgcgcaggctggggctcattaaagacgctttcagcatggataaaatgttttttattttaaatgcggctgacctcgcgaaaagcccggtcgaattacagacggttgaagactatgtaaggggagagctcttgaaagaaggcatccaaaatccgcacctgtaccatgtatcgagcaagcaggagctcaacaaaaaaacttcgccgtacaacgacttcagcaggctaaagcgggagctcgacgattttatcgaaaacggtttggccagaacagctgtcgaagagctgcttgatgaaggcaaaaaactgtgtgaaaccgtctttcagctccgcggttcactgcaccgttccgctgaagaaaaggaagcggagcaaaagcgcgtcgcaaaagcttatcaagaggctttggctgcgattgaagaagcagagaaggggtcatcaatccttcaaatgacggaaaaggatgtggaagagcaattttaccacatgaagcagcgtctggccttttttgcacacgatttatttaaagctgcgatacaccccgggcttcagaacggagattggcgcgccaatctgcaaaccgctttgaaaagctgcttaaaggagtatgaattcgaatttttgcaggaactaaaagcgcttgatatcagaatggaaaatttgatgctgaaatttgcgggcgaacaatgggcaaatgccgtaaaagagcggcttgccggcaatccttatttttcggttcatatccaggctgaccggcctgagaccgaaagctgggaaacgactgaagcgtcagcggatgaaggggagtttacagatgaactgaaaatgttcaaaacacctaaaacgttttttcagcaaaatggcaaagcccggcttgtcgaggcgtttactgcaaagctttcggcgatcacggacaattggattcaacgtgaaaagcagacatttttaaaccgctgcaaaacgagcgccggtcaattacagaaagcggctgttctatccgcaaaagctcaactcgaagaacaaaaagaagcatattttcatgaggcgctggagagcgcagagcgcgaaaacattgaaaaagcgcatgccttggcaggcgaatggctccgctcatgttga

SEQ ID NO: 2240 - DNA, 96 bp, Bacillus licheniformis
atgacgatgttttttctactggcggccgtcagtacatacagtttattgattggatatgtcttaaaaggaatcgcaggagcgaatccgcaaaaataa

SEQ ID NO: 2241 - DNA, 504 bp, Bacillus licheniformis
atgttttggacgattttaagcatttttgccgcccagcgcctgcttgagctggcagtcgcgaagttcaacgaaaaaaacgctctgaaagagggagcggtcgaatacgggaaacgtcattacccttacatcgtcgcgatgcatgtttcgtttttcgtatctttgatttgggaaacgaccgcttttcaacgcggaacccttccgatggcgcttgtcgtattgacaggcctcatcttcacgcaggttctccggtattgggcgctcttttcactggggaaatgctggaacacgaaaatccttgtcatccctggaacgaatcttgtccgaaaggggccctatcaatggattaaacatccgaactatttggcggtcgctcttgaatttctgcttttgcccctgctttttcaggcatacgccaccgcacttttatttacggtgctcaacgctgctgtcatgtacatccgcattcgtacggaagaacaggcattagaaaaattacaccattga

SEQ ID NO: 2242 - DNA, 1125 bp, Bacillus licheniformis
atggcctatgtcatttcggcggggacaagcattccgcgctgccatgtcgaccagaaggaagcagccgtttttgcgagggagatgttcaaagattcatttaaagacattgatcgtctgctgtcagcttttcaaaatggcgaaatcgcttcacggcaatttgtcatgcctttggattggtacaaagaggccaagagcttcaaggagaaaaatcaaacgtacattgatatggctgtcagacacagtgctgaagccgtttcgaattgtctgtcggacgaccgttttttgaaaaaagaaatcccttgcggaaaaattgacgcgattttttttatttcctctacaggcatctcgactcccagcattgaagcgaagcttatgaacattctgcctttttcaaaacgggcgaagcggatcccgatctgggggctaggctgtgcaggaggggcttcaggtatagcgcgggcattcgaatactgcaaagcgtttccaaaagcccatgtccttgtgattgcggcggagctgtgcagtttaacgtttcaaaaggatgatcaatcgaaaagcaatcttatcggcacatctttatttggcgatggaatcgccgcgcttttaatgtgcggcaaggaagcggatttctcagaagccagatttgaggttcttccggaagtattgggctcacaatccagcaccttggaagattcggaagaggtcatgggatgggaaatcaatgacaacggttttcgcgtcgttttttccagggacattccgacattgatcaaaacacacttaaagaacgatatcgaagcatttctgaataaagaacattatcgctttggagaacattcaagtatttctggcccaccctggcggaaaaaaagttctcgacgcttatatggaaatccttggattttccgaagcgcacatcgactgttcacgaaaaattttggccaggcacggcaatatgtcatcggccactgtgatgcatgttttaaaggaatattgcttgcatggcggccccgtgccgggaaaatacggtctcttaggggcgctcggaccgggcttttcatcggagctgctgctcttgagatggacaaaaagagagtgactgacacatgttttggacgattttaa

SEQ ID NO: 2243 - DNA, 552 bp, Bacillus licheniformis
atggaaactgtgaatgagcttgtcgaacgaatcaggacgaaagacggcggtgaagctgtcatccgtcccgtcaaaatggcggatgcccctgacatcatcgaggcggtgaaagatgtgattcaaacgggcgtttacatccaaaaagaacggccgcgcacacttgaggaagagcgtgcatttatcagcgatatgatgaaaaaagacaacatgtatgcggcggttgaaatcgatggtacggtgtacggaattgcccgggtcatacgcggcgaactcaaaatgaagcggcacacgggtctgttcagaacttggctccacagcaaggcgcaggggcttgggatcggcagggaaatcatgtcctacaccctgaaatggtgcaggctgcatcgcctgcataagctctgcttgaccgttttttccgaaaatgaagcagcgctgtcgctctataagaaaagcggctttatcgttgaaggggttcaaaaggaacaggttttgtcggacgggaaatatgaagatgaagtgctgatggcctattttttcaacgggtccacataa

SEQ ID NO: 2244 - DNA, 1317 bp, Bacillus licheniformis
atgaaacttacagccggtaaaactgtttcattaagcattcagcacgtccttgccatgtatgcaggagccgttgtcgtaccgctgatcgtcggcggcgctctcggtctgacgccggctcagctgacataccttgtatctgccgacattttgatgtgcggtgtggcgacgctgctgcaagtttggaaaaaccgctttttcggtatcggtttgcctgttgtattggggtgtacgttcacagccgtttctccgatgatttcgatcgcctcgacatatggtattccagcgatctatggaagcatcatagcaggtggtgtgattgtcgtcatcatttcttttttcttcggaaagcttgttaagtttttccctcccgtggtcacaggatctgtcgtcacggtgatcggtatcaccttgattcccgttgcgatgaacaacatggccggcggtgaaggcagcagcgatttcggcgagctgtccaatcttgctttagctttttccgttttactagtcatcgtccttttatatcgttttacatcaggatttatcaagtcaatttccattttaatcggcttgatcgcaggaacagccggcgccgctctaatgggaaaagttgattttacagaagtcgcaaacgctggctgggtgcagatgattcatccgttttacttcggcgcccctgtttttgaagttaccccgatcttgacgatgtccctcgtgctgatcgtcagccttgtcgagtccacaggcgtctactttgcattgggcgatttgacggaccgccgcctgacagaaaaggatttaggaaaaggatatcgcgccgaagggattgccgtgctgttgggcggggttttcaacgcctttccttatacggcgtattcgcaaaacgtcggtctcgttcagctgacaggagttaagaaaaacagcgtgatcgcgcttgccggagcttttctcattttgttggggctgtttccgaaagccgctgctttaacgacgatcattcctaaacctgtgctcggcggcgctatggtagcgatgttcggcatggtgatcgcctacgggatcaaaatgctgagcagggttgatttcggcaagcaggagaacttgttgatcgtagcgtgttcaatcggaatcggcctcggcgtgacggttgtaccgcaaatgtttcaaaaccttcctgacgccgtcaagcttttgacagagaacggaattgttgcgggaagctttaccgccattctcttgaatgcgatctttcacattcatccgttttctcgtcatgctgaacagcctgaagcagtttctgctgagaaatctgccgtttaa

SEQ ID NO: 2245 - DNA, 585 bp, Bacillus licheniformis
atggaaaagctaaaacgaaaaattgcagagcagggcacggtgttgtctgacgaagtgctgaaagttgattcatttttaaatcatcaaatcgatccggaattaatgcttgctgtgggtgaagagtttgcttcgcttttccgggaggaaggcgtcacaaagattgtgacgattgaatcctcaggcatcgcacctgccgtgatggccggcttgaagctgggcgtgccggtagtatttgcaagaaagcgtcaatcgcttaccttgacggaaaatctgttgacggcttctgtctattcatttacaaagaaaacggaaagtacggttgccgtatcagccagccacctttcaaaggatgacaaagttctgatcatcgacgattttttggcaaacggacaagcagctaaagggctcgtttccatcattgaacaggccggcgctaaggtgtgcggaatcggaatcgtcatcgagaaatcattccagacgggcagggaggaacttgaaaatcttggaatcagagtcgaatcccttgcgcgtattgcctctcttgccggtggaaaagttacctttttacaggaggttgggtcatga

SEQ ID NO: 2246 - DNA, 1503 bp, Bacillus licheniformis
atgtcgatcaatacatatgaaaaagagtttttagaaacattaaagaaaatcagccggtatgagcaggcgattaatgtcatgtactgggatatgagaacgggcgcgccgagaaaaggggaggaaagccgcgctgaagctatcggccaattgtcggcagacgtctttcagatgagaacgtccccgcggatgaaagagcttttggataccttagccgggcaaaaacaagatctgccttttgatacacagaaagcggttgaagaagcgaaaaaagagtacgatttaaacagcaagattccggaagaggagttcaaagaatatacgacactgacttccaaagcggaatccgtctgggaaaaagcgaaaaaggcgtccgatttttctctctttgctccgtatttagaaaaaatcatcgactttaaaaaacggtttatctcatactggggatatgaaggccatccttataacacgcttctggaccaatacgaaccaggcgttacagtcgaaaagctcgacgcccttttttctgaattgcgggaggctatcgttccgcttgtgcaaaagattgccgccagtgataaaaagcctgatacgggctttgttcacgatcatttcccgaaagagcggcagcgcgatgtttgccacttcttcttacaggagctgggctatgattttgaggcggggcgcctggatgagacggttcatcctttccaggtgacgatcagccaaggggatgcccgggtgaccacagcatacaatgaaaacgattttcggtcggctgttttcggaacaattcatgaatgcggccatgccatttatgaacagaacattgatgaagcgctgggcggaaccaatttatcagacggcgcatcaatgggcattcatgaatctcaatcccttttctatgagaactttatcggcaggcatcaaagcttttggacgcggtattttgataaaataaaggaagcaagccctgaccagtttgcaggcgttactgccgaagggttctacagagccgttaatgaatcaaagccgtcgctgattcggatcgaggctgatgaactgacatatccgctgcatattatgatccgctatgaaattgaaaaagcgattttcagcggcgaagtatcggtcggagaccttccaaaactatggaatgacaaatatgaagcatacctgggcattacgcctcccgacgatgctaaaggaatcctgcaggatgtccattggtccggcggagatttcggttattttccttcatatgcgcttggatatatgtatgcggctcaactgaagtcaagcatgctgaaagatcttccggagtttgaccgtctgattgaaaacggcgattttcaaccgatcagaaagtggctgacagagcatgtacacatccacggcaaaagaaaaaaaccgctggaaatcattaaatctgcgacaggcgaagaattaaacgtccgtcatttaatccgctatctggaagaaaaatatacaacactctatttgtaa

SEQ ID NO: 2247 - DNA, 1920 bp, Bacillus licheniformis
gtgacagcatctcgtctgcctttttcattaacaaaaacaaaaaacttttatgaagaactgaacaattggatcggtgatgtattttacgatattcttcctgaaaaaggctttgatttgcgcgatgagcaaatattcatggcttttcaattagagcgggcatttaaggaaaagaaggtcatgtttgcggaagccggcgtcggcaccggaaaaacgctcgtctatcttctgtttgccttgagctatgccaggtatacgggcaagccggcggtcatcgcctgcgcggatgagacgctgatcgaacagctcgtcaaaaaagaaggcgacatttataaaatttccgagcatttaggcctgacgatcgacgcaaggctcagcaagtcgcatgatcaatatttatgtttgaaaaaactggagaaaacgatgcagcgctctgatgatgaaaaatggcttgacctttacgaaagtctgccgtctttcgttcacgaatcgcagggcatgcaggctttttatccgtacggcgaccgaaaagagaattcgtctttatcaaacgatgagtggtctgaaatcggttacgactcttttcaggactgtcttacatgtgatatgaggcaccgctgcgggctcacactgtcaagagaccattatcgaaaatcaaccgatttcatcatctgttcccatgatttctatatggagcacgtttggacggaagaggcgagaaagcgggaaggccagcttccgcttttgccggagcacagcgcagtggtttttgatgaagggcatctgctcgagtttgcggcccaaaaagcgctgacatacagggtgaaacaatccacgctcgaaatgttccttgagcgcctgctcggcaatgacatcagagaagaatttgcagagcttgtcgaagaagcgcttcgcgccaacgacgaatttttcggtttgcttacggaaaatgccgaaaaagcagaaggctctgagcgcatgcgcatcaaagacgataccgatgtgaaaaaagcggccgccgagctgtatgatttgcttgaaaaaatcggagaggcgctcgtttttgagggcgagctgtacacgatcgaccagtacgctttaactgttgtcgaagagtatttagaacagatggcttactccctttcgctctacaggaaaaatgcgatcagctggcttgaacaaaaagagcttgagtcgacattcgtcgtcatgccgagaaccgtctctgaagttctcggagaaaaggtgttctccaagcagattccgtttattttctcatcggcgacattatcggaaaacggatcgttcgattatttggcgaccagcctcgggatccgcgattacttatcatttaccgtcgattcgccgtacgattatgaagagcagatgaaagtgtacatccatcaaatcgaggaaaaagaagcgaaagaagaagcggcaatccgtgcaatcaaagaatctggagggaagacgctgatcctgtttccgtcttttgaagagcttctgtccttcaagcgccggactgcacaggaatcattttcgtttcccgtttactttgaaggggatgaagaaatcagtacaatcgttgaaaagtttcaaacggtagaagaatccgtcttgtgctctgtccatctatgggaagggctcgatattcccggagacccgcttcaaaatgtcatcatctggtcgctcccatttccgccgcatgatcccgtgtttgaagcgaagcggagcggcgtggaaaacgcctttcgcgaagtagaccttccttacatgctgctaagacttcgccaagggatcggacgtctgatcagatcaaacagcgacagcggcacgatcagcatttttgcgggcgatgaaaaagaatggaatgtgataaaagaagtcgaatctgttcttcctgttcagccagtctatgtataa

SEQ ID NO: 2248 - DNA, 177 bp, Bacillus licheniformis
atgttgaacagcgatcatattcaaatgattcaaaaagcgctggagacgtcagaaagccagctcgaggacattggcgaagagcgccttacatatgcaaaggaagaattgaaaaacgcgatcagccatatggaatcgacagatcatccgtttttgacgcattcgatttaccggaaatag

SEQ ID NO: 2249 - DNA, 411 bp, Bacillus licheniformis
atgtattattatgaaccggcaaagaaagattattgggattatgattatgatccttacaagaaggatcacgactattgcaaaaaggacttttactatcatgagccttgcaagaagaattactactatcacgagccttgcaaaaaagacttctattaccatgaaccttgcaagaaggattacgattattgcaaaaaggattatgactaccatgaggattacaaaaaagactacgattaccacaagccttgcaaaaaggattacgattactgcaaaaaggacttctactaccatgagccttgtaaaaaagactatgattaccacaagccttgcaaaaaagactgctattatgagccgcgcaaaaaatgctatgattcgtcttataaaaagaaaaatgattcatggatttattag

SEQ ID NO: 2250 - DNA, 1152 bp, Bacillus licheniformis
atgaaaacctatacattaatcgcaacagcgccgatgggaattgaagcgatcgtcgccaaagaggtgcgcgaccttggatatgattgtacagttgacaacggtaaagtcgtgtttgaaggcgatgccctcgccatctgcagagccaatctgtggctgagaaccgctgacagggtgaaagtgcaggctgccgaatttatagccaagacctttgacgagctatttgagaagacaaaagcgatcgactggagcgcctatcttcctgaacacgcgtcattccccgtgacgggaaagtctgttaaatcagtgctcgcaagcgtgccggactgccagcgcatcgtcaaaaaagcgatcgccgagaagctgaaatcagaatatcagacacagggcgagtggcttgaggaaacagggccggaatacaaaattgaagtctctcttttaaaagacaaagcggtcataacgcttgattcatccggagccgggcttcataaacggggatatcgaaccggccaaggggaagcgccgctgaaagaaacccttgctgcagctttgattctattgacaaattggacgcctgacaggcctttcgtcgatccgttttgcggttcgggtacgataccgatcgaagccgctttgatcggccaaaatatcgccccgggtttcaacagggattttgcatctgaaagatgggaatggatcggtaaagaagtgtgggatcaagcgaggctggaagtcgaagaaaaagcgaattatgatcagccgctttcaatctcggggtatgacctggatcatcgcatgatcgaaatcgccaaggcaaacgccgaggaagctggactcgccgatttcatcgaatttaagcaaatgcaggtaaaggattttcggacgaaagaggaatacggcgtaattgtcggaaatccgccgtacggggaacgcctcggtgaaaagaaagcagtcgaagccatgtataaggatatgggcaaagcatttgccgagcttgatacatggtctgtctacatgctgacatcaaacgagcgttttgaagagtgctacgggaaaaaagcaacgaaaaaacggaagctctttaacggttttattaagacggactattaccagtattgggggaaaaggccgccaaaaccgaacaaagaaaagtga

SEQ ID NO: 2251 - DNA, 297 bp, Bacillus licheniformis
atgcttgctgataaagtgaagctttctgctaaagaaattttggaaaaagaattcaaaacaggagtcagaggctacaagcaggaagacgttgacaaattcttggacatggttattaaggactatgaagccttccatcaggaaatcgaagaattgcagcaggaaaacctgcagttgaaaaaacagcttgaagaagccaacaagcgacagccggctcaatcaaatacgaccaattttgatattctaaaacgactttccaatttggaaaaacatgtatttggaagcaaattatacgattga

SEQ ID NO: 2252 - DNA, 552 bp, Bacillus licheniformis
atgaaagtattggccgttacagggtacaagccgtttgaactcgggattttcaaacacgatgacaaggccctgttctacataaaaaaagcgcttgaaaaccggatgatcgctctccttgaggaaggcctggaatgggtccttatctcgggccagctcgggactgaactatgggcggcggaagtcgcgttttcgctgcaggaagaatttcccgacttgaaagtggcggtcatcactccgtttttggaacaggaaaagaagtggagcgagaaaaatcaagagcagtatgaagccgtgctcgcagccagcgatttcactgaaagcttgacacacaggccgtacgaaagcccggtgcaattcaaacaaaaaaaccggttcttcatcgaaaaggcggatggcttattgattctgtacgatgaagaaatcgaaggctcgcctgtgtatatgctgaatgaagcaaaaaaggctcaggaaaaacgcgattttccgatctacacgattacgatggatgacttgagagtcactgttgaagaatgcagcttttacgaagagtaa

SEQ ID NO: 2253 - DNA, 270 bp, Bacillus licheniformis
atgcactgtaaaccgcatgtaatggcgccgattgttcatcctactcaatgctgctacaaccatacgcacagcaaaaccgtcgtaccgcacattcacccgcagcacacaacgaatgtcaaccatcagcattttcagcatgttcattactacccgcaaactcaatcagctgtcaacaaggcgtcacatcagcacttcgtgagccctggagcaggaatgatgcctgggcctggagggatgccgggacctggaatgggcatggggccttactaa

SEQ ID NO: 2254 - DNA, 96 bp, Bacillus licheniformis
atgtataaggggctgttttatctgttttttgtcgtcgtattgtttatcgtattgatcatgacgaatttcaaggaaagctttatggcttacttttaa

SEQ ID NO: 2255 - DNA, 1314 bp, Bacillus licheniformis
atgtctttaaaacgaaaacttaatcgctataagcatcacctgggaaatcaagcgaaagaagaaaaaacggaacctcccgcagataagctgacttccttgtccgtcagttttgaaaaagaatgggccgaactcggtgttaaaccatatgtgtttgaggaatgctattgcctgatcagggaagtcgtttacccgttgactcatgttcatggtcattacgcgttttctgagctgcatgagacggttaggcgatggaacaacagcgccgtttcccattcgctttcaagcaaagggtacacaccgagccagctcttcttctttgatacggaaacgaccggtctcggaggcggggccggcaatgcgatctttttgctcggccatgcaagggtgtatgacgaccgcgtagtcgtcaaacagcatctgctgccaaagccggggtacgaagccgccctctatcacagctttctgagtgaagtcgatattcagtctcttgtcacctataacggcaaagcgttcgactggccccaggtgaaaacgaggcacacgctgatccgcgacagggtcccaaagcttccggatttcggccactttgacctgctgcacggatcccgccgcctttggaagcataaatttgaccgcgtttccttagggacggtggaaaaggaagagctgggcgttgtaagaactgaagatacgccgggctatctggcgccgatgatgtattttcattttttaaaggaggaacggccggaaatcattgaaggcgttttgcgccataatgagcttgacgtgctttctttaatcactctttacatccatttatcgaagaaaatcctcactccggagcagacagcggaagcaaacgaaaagtacgcgatggcaaaatggctcctcgccaaccgggagacagagcttgcgacagcgcaattgcaagagcttgaaaaaaaaccttttgaacattctgaacgcgcatcattcgatttatccatgcagtataaaaaacaaggcatgctaaaagaagccgcagccctttggctgaagctccaaaatggagaagacggaaaaaccgcctggcgcgcaggcatcgaacttgccaaatactttgaacatcgaaagcgggatattcgggccgctcttgaggtagcggaaaacctgctggagcagcacggttcacaaaagtttgagctgaccgaaaaagaaatggccggcctcttgagaaggcgcgagcggctggaaaggaaatacggacgaaatattccccgggcaagcgcagaaaacgacgatcttcgaaagccaaacatttcaagcacgttatga

SEQ ID NO: 2256 - DNA, 2268 bp, Bacillus licheniformis
ttgtttcaaaaacgaaatttgacagatatgattcagcttctgaaagaagaccaagctttcagcaggcaaattgttcattggcatacaatcgagggaaaagaagcggattaccgcgattttcctgaaggtttagataagagaatcgtgcatgctttacagcaaagagggatagaaaagctgtattcccatcaggccgacgcatttctgcacagcgccgccggcaaaaacgtgacgcttgtgacgccgacggcatctgggaagacgctttgctacaatctgcccgtcattcagaggatcacagaagaccaagatgcgcgcagcttatacctttttcctactaaagcattgtcgcaggaccaaaaaagcgaactgaatgaattaatcgatgaaatcggtgcgtcgatcaactgttatacatatgacggagatacgtcgccttcgatcaggcagaaagtcagaaaagcgggccatatcgtgattacaaatccagatatgctgcattcggcgatcttgcctcaccatacaaaatgggtgtcattgtttgaaaatctgaaatacatcgtcatcgatgagcttcacgtatacaggggagtctttggcagccatgtagccaatgtcatcagacggctgatgcggattgctgaattttatggaagcaagccgcagtttatctgtacatccgcgacgatcgccaatccattggagctcgctgagacgctcacggggcagccgatgcacctgatttcaaacaacggcgccccgtcgggaagaaagcacttcttattttacaacccgccgatggtcaaccgttcccttaacatcagaaaaagcgcgacccttgaagtgagaaagctcgcatccgaatttctaaaaaacggcattcagacgattgtgtttgcaagaagcagagttcgggtggaaattatattgacatacttgcaggaagtgatgaagccgattgtcggcccgcattcgattcaggggtacaggggcggctatctgccgaacgagcggcgcgtcattgaaaaaggccttcgcagcggggacatcaaaggcgttgtcagcacgaatgcactcgaactgggcgttgacatcggacagctgcagacatgcatcatgaccggttatcctggaacgatctcaagcgcctggcagcaggccggccgcgccggaagaaggcacaacgaagcgctgattgtcatggtggcaagttccgccccgctcgatcagtacatcgtacagaatccggactatttctttaaacaaaatcccgagactgccgtcattaacccggacaacctggtcattctcgtcgatcatatcaaatgcgcggcctttgaactgccattcaaaagaacggacacattcggcggtatcgaaattgaggatattcttgactacttggcagaagaaagggtcctccacttaaccgggaatacgtaccactggatgaatgacgcttttcccgcgcacggcatcagcttaagatcggcttctcaggaaaatgttgtgattattgatcagtcaagacgcgagaaggcgaaagtaatcggggaaatggacaggttcagcgccatgacgcttcttcacgatgaagccatttatttgcatcaaggcatccaataccaggtggaaaagcttgactgggaggagaaaaaggcgtttgtccgcgaggttcaagttgattactataccgatgccaatcttgccgtcttgctgagagttctcgaggttgacaaggagaaaaagacggaaaccgcagcgttcggttttggggatgtgaccgttcaggcaaaagcgacgatttttaagaaaataaaatttgagacgcatgaaaatatcggttcaggaccgattcatctgcctgaagaggagctgcataccaatgcggcttgggtgcaggtgaacgatagtgagcggcaaaattggaatgacatcaaattggaagaggctttgcttgggactgcaaacgttcttgggcatgtagccgccttaaaagtgatgtgcgatccatctgatctgcatgtttttccgcaaatcaaagccgttcataacgaaaagccgacgatctttttgtatgatcgctatcccggcggagtgggtctttcacaaaaagtgtatgaacaaatgcccgagatcatcagtgaagcgcatcggctgatttcaagatgtccgtgtgagtcaggatgcccttcctgcataggagtgagcggcggcgatcagacaaaaaacaatgctctgcgccttttaaaaggctggaaaggttga

SEQ ID NO: 2257 - DNA, 507 bp, Bacillus licheniformis
ttgctgaaaaaattattcggtattggtcaaaaacaagatgaagtgaaagaagaaaccgttttttcaccggttgacggacaagttttggaactttcaaaagttcctgaccccgttttctctcaaaagatgatgggtgacggaatggctgtcgagccttccgcgggcgagatcgtatcgcctgtcgacggggaagtgatccagctgttccacacaaaacacgccataggcattcgttcattgtccggcgtggagctcttgattcacatcggtctggaaaccgtagcaatggaaggcgaaggtttcacagcccatgtcaaagaaggagacaaagtaaaagtcggcgatcctttaataacatgcgatttggaactgatcaaggaaaaagcgagcagcacaattacgccgatcgtcattatgaacggcgatgtgttggaacgcgtcacaaaacatgaagaggcagcagcgaaaaaaagcgagacaaagctcatggagcttaaagtaaagtaa

SEQ ID NO: 2258 - DNA, 420 bp, Bacillus licheniformis
atggattttaaggaaaacgacaatcactcgctcagcaaaaaggacgaaattcaagaagctgttgaacagttgttttacaactcgcctttccacgatattttaaattcattccaaaaactcatatcagaccagcttcagaattccacgatttccatgaatatcagagaggatgatggggcgctttacgtcgatatcgccgttcctgaatcgtttcaaaatggagatattatgattgaagcgaaatcacggtatcttcatatcgccttgaaggagaaacaagaaagcggcggttcttcatcatttacaagcctgtccagaaccgttctgctcccataccctgtccgtgaagaaacaatgaagacgtcgtggaaccgaaatgtcctcacggtctcattttcggagcaaaaaaagcatgaatga

SEQ ID NO: 2259 - DNA, 444 bp, Bacillus licheniformis
atggaagagaggagatccgccgtatatccttattccggccctggtgcgcatattcaagcctatcagcaaaaccatcaggcctatcatcccgttcagctgtacttcagccaggaaaccgttccgtacgcccatcctgcacagcggccgcagccatatcagcagccgattgagcagaatttggacccgttttcagtctatcatcagcctgttcagcagcaaatgcagccgcttccgccgtttcagggatttccttatcagcatccatacccttcgccgcggcctaatctccatcagccgtcacagtttcaaagctttctgtcgcaattcaaaaaaaagaacgggcagattgatttcagcaaaatgatggacaccgcaggccagatggtgagcacggtcaatcaggtcggagcgcttgccaaagggtttatgggattcttcaaataa

SEQ ID NO: 2260 - DNA, 348 bp, Bacillus licheniformis
gtgtatgatatagaggcatttctcgttccaaaggttctgtcacaagtttgtcaaaaagtgtcgaaaattttaatatttgaaaaacagaaaaaagtcgaattgttatggtactatattattaatataaaaggagaggggatgcaccatatgaacgtatcatacttaagaaattgttttgccgagatgaaacagtatgagacagactgcatgaacaaactgatggatttcgctaagtttttgtatatccagggacatctgacattaaacgaatttcgcacaagtatgaaagttcttgaagcgaatggcgcacagcaccctgcttatgatatgaatacggacgccagctaa

SEQ ID NO: 2261 - DNA, 381 bp, Bacillus licheniformis
gtgaaaaaattggatacacaatctcttcttatacagacacaggatttaatccgccttgtaaaagaagcggaagaacgatatagaaagggaaaagaggaagggacggaatacgattttttcgaggttgtcaaaccttctgtcgagaggttcgaacaaacagtgaaaagctggctggcggaaagcctgtcttatatcaaggccaatcggccaaaatacatttacgaagaacagctcaactcggttgaggaaaatgcgaatgaaattttcatgcagtcctatttctgcaaaattcataaaaaacgctttaaagatctgacggaatccgtcctctacacgctcaaaaacgtagaagacgatatattaaaagaagaccgggcctaa

SEQ ID NO: 2262 - DNA, 399 bp, Bacillus licheniformis
ttgcaaaaaagcgctgatcataccatttttcgcaagatcacttgtcgaaagcggcgcgtttggctggaaaatgagtttctttggcggtttgcttctagttttgtcagctgtggaggagagagtgcgcataagggagaatgcatagaaggccatcaaaaaggagggaagcaaatgaacggatttgcaagcaaagactcggtccttcaaatgcttttggaaacggaatcagacatgtcgtctgcggagaaggctttgacagaagccgtacgccggacggagcaggaaaagcagtctgcctggaacgaacggctcgatctgattgaaaaagagctggcagaactcagctcatgtttaaacagcacgttaatgggagtggagcccggggtagagacggcttaa

SEQ ID NO: 2263 - DNA, 105 bp, Bacillus licheniformis
gtggaaaacaataaaaagaaatcacctgcgaaaacaaaaccagatgctaaacaaacagacacactggataagaaattaggcggacctaaccgcccgtctacttaa

SEQ ID NO: 2264 - DNA, 960 bp, Bacillus licheniformis
ttgcacaacactttttccgcggcggagctgacgagccgcattcaagagctgaccgcaaaactgaacaaggacaatatctcacggacaaatgcctacaaacgctactttgaccgccatcctgaaatcaagtggtcgcttttggcttcatttgtttcccggaatgccggctggtcgatgaccgatttaaaagggcgcttattcgagctcggacttacggcttttcagcagaaatggctgtttttagcgtatgagagagcgaactggctgatcttttcagacgcctatccgcagctcctgctataccattggtccaagcagcttggccagccgctgtttcatttgctctcctcatttggcgtgtcttcatttatgaaaacggagtgggagcggttctggcatgagcgcgatcaaaagcggctcatgtacgctctcattataaatgaacaaaacactatccaaactcctattatacaaaatcctttgtttaaaaagaatgtttttcagacgattccttttcagctgtgtgaatggtttcacttcaacacggtcattttcccgacggttgaaggcgttttttacggtgtgtctgtcaaacgcttcaccagtttaaaggaaaggatcaagctcggcaagcaattaagcgagctgctgttttcgcctgagcttttccccggtttttttcattttacatcatgtgttccgcataccgggtcgcgctttgatatggagcgctgggcaggggttaaaatcagaacctcgccgtttttgagaacgtgttatcccgttgttgcccattcattagacggattaaaatgcgattggtttcgcggaggaaagagggaggcgatgttcaaagatgaaaaactgccgaaaacgatcgaaatcaccgattggtattttcaaaaaagaaggcagctgcaggcattgttttcgctggagcattggctgaataagaggtga

SEQ ID NO: 2265 - DNA, 597 bp, Bacillus licheniformis
gtgattcgttacccgaacggcaaatcctatcagccgaaaacagctgcctcatccttgcaaaagaagccgtcgtattccaatcgcggcatgaccctcgaagatgacctgaatgaaacgaatatgtattatcaatctcattcgattgcggtcatccataaaaaaccgacacctgtacagattgtccaggtcgattatccgaagcgaagcgctgcggttatcaaagaagcatatttcaagcagtcgtcaactactgattataatggggtttataaaggccgctacatcgattttgaagcgaaagaaacaaagagccgaacctcgttcccgcttcagaatttccacgatcatcagatcgagcatatgaagcaggttgtggcgcaagacggcatttgttttgttatcatatccgcttttgaagaaatttattttttggaagcagaaaaattattttatttctgggagcggaaaaagcaaaacggcagaaaatcgatccgaaaagacgagcttcaggaagccgctcaccccatttcacttggatactcgccaagaattgattatattaagattattgatcagttgtatttttcgccatcataa

SEQ ID NO: 2266 - DNA, 2688 bp, Bacillus licheniformis
atgtcagatcaatttaacagccgccaggaacggcgaaaagcccagcagggcaaaagcaggtctaatactcattctaaacccaagaaaaagaaaaaagcaggattgtttaagaaaattcttttatccattttaatcatcggtgttatcggcttgattgccgggggcgtcacttttgcggtgatggtagcggactcgccgtcccttgatgaagcaaaactgaagacaccgtactcttctaccatctatgacaaaaacggaaaagaaatcgccgaaatcggttcggaaaaacggacgtacgtgtcgattaaagacatcccggattccgtcaaaaacgcatttcttgcaacggaagacgcccgtttctatgaccaccacggcgtcgacccgatccggatcggaggagcgcttctggcaaacttcgaaggcggatttggttctgaaggcggaagtacgatcacacagcaggtcgtcaaaaactcccttctgtcacatgaaaaaacgctgaaacggaaagtccaggaagtctggctgtctttccagctggaaagaaaatactcaaaagacgaaattcttgaaatgtatttaaatcggatttacttctcgccgcaggcctacggtgtcggaaaagcggctgagcagttctacggggttacagatctaaacgacttaacggtcgagcaggccgcaacgcttgccggcatgccgcaaagcccgaataactacaacccgatcaaacatccggaaaaagccgagaaacggcgcaatgtcgtgctgagcctgatgaataaacacggctttatctctgacgcagagtacaacaaagcgaaaaaagtagccgtcacaaaaggccttgtatctccgaaagagtacgcaaaaacaacgtccaacaaatacagcgcgtttatcgagcaggccgtcgccgaagtgaaagaaaaagcgaacgtcactccgggaacggacggactgaagatttacacgacgattgatacagacgcacaggattatgtggatgagctgatggacggcgattctattcagtataccgaaaaaatgcaggccggcctcaccctgctcgatacgaaaaccggagagatccgcgcgctcggcggcggacgcgaccggaaagcaggcgactttaactatgcagtagatactaaacgtcaacccggttcaacgattaagccaatccttgactacggccctgtcattgagaacaagaaatggtcgacgtatgaacagattaaagatgaagcatacacgtattcaactggagatccgattaacaactatgacagaagctacagaggctggatatcgatgagagaggcgctggtcgattctcgaaacatcccggctttaaaagcgttccaggcagccggcaaagacaatattgtaaaatttgcaggcaaccttggccttaacataaattcagatgacttagtggaagcttatgcaatcggcggcttcggaaatggtgtgtcgcctctgcaaatggccggagcgtacagcgccttcggcaacaacggctactacaatgagccgcatactgttaccgcggtggaattcaatgacggcactaagcttgatttgacgcctgaatcaaaggctgccatgagcgattataccgcatttatgataacggatatgctgaaaagcgctgttcagcgaggaacaggaacagcggctcaagtccccggcgtcactgtagcaggtaaaacgggtacgacgaactttaccgaggacgacattagaaaacacggcataaatcgaaacggagcgagagattcatggttcgtcggctatacgccgcaatataccgcagcggtctggaccggtaaagaaggctttaattcgctgagccagagcgaacagcaagtcgccaagctcctattcaaaaaactgattgccaaggtggacaacggcagcggctcatttgaaaagcctgacagcgtcgttgaagcgaccgttctaaaaggctcgaacccgccggtgctcgccagcagcaacacgcctagcgataaaaaagtcactgagtactttgtaaaaggcacacagccgacgaccgtttcgaaaaaatatgaagaaaaagaaaatgccgacaagccgtcaggtttgagcgcagagtatgatgaagcatcaaagagcattaagctttcatggtcatattccggagacggtgatgtatcctttaaagtcaaacagtctgttgacggaggcggatacagcgaaattcaaaacagcagtgcgaaagaagccgtcataccgaatgcaaaagaaggatccgtttacagattccaagtcactgccgttaccgaagatggtgaaagcgaccctgcttctgtaacgcttaaagtcaacgcggctgatgaggatgagtcaaaaacggacgatgaaaagaaagacgatgacgagaagaagcaggatgctgatgatgatcaggacaaagacaaacaaaataacggcaattcaaatcagccgaatgatcaaaatccaggaaattccgatcaaaacaatcaaaatccgggaaattcagaccaaaacaacggcagaaaagatgatgacgccgatgatcaagacaacgatcaaaataaagataaagataaagacaaaaacaaaaacccggatcaaggcgccaacacaggtgatcaacaaacaaattccaacggtcaatcaaccggcaccaattga

SEQ ID NO: 2267 - DNA, 504 bp, Bacillus licheniformis
gtgacaagcgtttcactgttggacgaatacgaaaaaacgctgcggaagaaaaggccggaatccggcgaaaggcttgcggtactttctgaaaatccgctctgctatgatttttttcaagacgcaggagaggacaagccttgggagcatgcggaagaatgggtcccgcttctgtttgcagaatgggaacgcacaaaagaaaagcttctgcccgtctttaaaacgagaaaatcaaggtgcagccaggatgacatgctcaacggggtgtgctgcttgatcgcaagccttcactggacgatgggggagcctgtcaaaagtctcaactgggagatcatcacccggaaggattttggagcaaagccgatgaactggacggaacggctcgagttcatcctgctgaaaccgacgcagtaccattgttttatccagcttgacgaattgtttacggaaatgaaaaagcaattttataaatatgttgccatgaatcataaaaaagccactcactaa

SEQ ID NO: 2268 - DNA, 663 bp, Bacillus licheniformis
atgctaacaaaaaaacagatcgagttttgtttagacacaatcggtgaaatgtttccggatgcagagtgcgaattagtccatgacaatccgtttgaacttgtcatcgctgtcgctttatcggcccagtgcacagacgcgcttgtcaataaagtgacgaaaacgcttttccaaaaatacaaaaaacctgaagattatcttgcagttccgcttgaagagctgcagcaggacatcaaatcgatcggcttataccgcaacaaagctaaaaatattcaaaagctgtgcaaaatgctgctggaagactacggaggtgaagtgccgagagaccgcgatgagctggtgaaacttccgggtgtcggaagaaagaccgctaatgtcgtcgtttccgtggcattcggcgttcctgccattgccgtcgacacccatgtggaaagagtttcaaaaaggctcggcatttgtagatggaaggattcggtcatggaagttgaaaagacgctgatgaaaaaagtgcctgaatcagagtggtccgtcactcatcaccgcttgatttttttcggccgctatcactgtaaggcgcaaagaccgaaatgcgaagaatgcccgttgttttctctgtgcagggaagggcaaaaacgatataaaaaagggctggtgaagctgctgtga

SEQ ID NO: 2269 - DNA, 699 bp, Bacillus licheniformis
atgaaaaaacagcactttattaagatgcaggatatgggagctgtcaccattccgaatctgctctttatgaactatcgggagcttggcttaaacgagacagaattcatgctgctcttaaacattaaaatgcatgttgaaagaggttctttttttccgacgccggaggaattaagcaagacgatgtcgattgaaaccgaagaatgcatgaatatgctgagaatgttcattcaaaaaggcttcatctatatagaagaatgcgaagaccagaacggcattaaatttgaaaaatattcgctcgaacctctctggggcaagctgtttgagcttttagaaatggccgagcagaaaaaactcgccgaacagaatgaaggcgaacagaagagcctttatacaatctttgaagaagagtttgcacgaccgctttctccgctggaatgcgagacgctcagcatctggcttgaccaggatcatcacgatgcacagctgatcaaacaagctctcaaagaagccgtcatatcaggaaaattaaatttccgctacattgaccggattctgtttgagtggaagaaaaacggcgtttcaacagtcgaacaagccgtaaactacagccaaagattcaggcggaagactgctccgcggcaaaatgagcaaaaggagtatacaagacaggttcctttttacaattggcttgaacaataa

SEQ ID NO: 2270 - DNA, 1293 bp, Bacillus licheniformis
gtgaaaacaacaataaaccaagtgtacaagcatgttggtgaagaagtaacaatcggcgcttggatcgccaacaaacgttcaagcggcaaaattgcgtttttgcagcttagagacgggacaggctttatccaaggagtcgtcgtcaaagcggaagtggacgaagaaacatttcaaaccgctaagtctgtaacacaggaaacatcattatatgtaaaaggcgtcgtcaaagaagacgagcgttcgcctctcggctacgagcttgctgtgacgtcgcttgaagtcatccatgaagcgacagattatccgattacacctaaagaacacggaacagaatttttgatggatcacagacatttgtggctccgttcaaaacggcagcatgcaacgatgaaaatccgcaacgagattattcgcgctacatacgaatttttcaataaggaaggctttgttaaagtcgatcctccgattttgacgggaagcgcacccgaaggaacgacagagctttttgcgacaaagtattttgacgaagatgcctacctttcgcaaagcggccagctttacatggaagctgctgcaatggctttaggaaaagtcttttcattcggaccgactttcagagctgagaaatcaaaaacgaagcgccatctgatcgaattctggatgatcgagccggaaatggcttttgtcgaattcaacgaaaaccttgaagttcaagagaactatgtctcttttatcgtccaaagcgtgcttgaaaactgcaaaatagaactgaatacgctcggcagagacacttccaagctggagcttatcaaagcgcctttcccaagaatcacgtatgatgaagcaattcagttcttaaaagagaaaggctttgacgatattgaatggggcgatgacttcggcgctcctcacgaaacggcgattgctgaaagctatgacaagccggtatttattacacactatccgacatcattaaagccgttttatatgcagcctgcacctgacagggaagatgtcgtattgtgcgctgacttgattgcgcctgaaggctacggcgagattatcggcggatctgaacggattcatgatctcgagcttctcgaagcgcgcctgaaagagcacggtttagaatcggacgcttatcaatggtatgcagagctgagaaaatacggctcagttccgcattcagggttcggactcggacttgaacggacggttgcctggatctgcggctctccgcacgtccgcgaaacgattccgttcccaagactgttaaatcgcttatatccttaa

SEQ ID NO: 2271 - DNA, 1185 bp, Bacillus licheniformis
ttgaatctagctaaaagagtatcagcgttaacaccatctgcaacattggcaatcactgcaaaagcaaaagaattaaaagcggcagggcacgacgtcatcggtcttggggcaggtgagccggattttaatacgcctgagcacatcattgaagcggctgtccgttcgatgaacgaaggacataccaaatacacgccttccggcggtcttgcggcgctgaaagacagcatccgcgataaattcaagcgcgatcagggaattgaatacagccaatcggaagttattgtgtgcacaggtgcaaagcatgctctttacaccctatttcaagtgctcctcgacgaaggggacgaagtgattattccgactccgtactgggtcagctatcctgaacaagtcaagcttgcaggcggcaaacctgtgtttgtggaaggccttgaggaaaacagcttcaagatttctccggagcagctcgaaaaagccgtcacagaaaaaacgaaggctgtgatcatcaattccccaagcaatccgacagggatgatgtatacggaagaagagctcaaagctctcggtgaagtatgccttcgacgcaacgttttaatcgtatctgatgaaatatatgaaaagctgatttacggcggaaaaaaacatgtatccattgcacagctttctccagaacttaaaaaccaaaccgtgatcatcaacggggtttccaagtcacacagcatgaccggctggagaatcggttatgcagcaggcagcgaaccgatcattaaagcgatgacgaacctagccagccacagcacgtcaaatccgacatctgtcgctcaatatggagccattgccgcttacaatgggccaaacgagcctgttgaggagatgagaaaagcttttgaagaacggctgaacaaggtgtatgaactgcttgttgacattccgggattaacatgcctgaagcctgaaggagccttctacttgttcccgaatgcaaaaaaagcggcagaatcgtgcggcttttcaagcgttgatgaattcgccgaagcgcttttggaagaagaaaaggttgcgatcgttcctggttcagggttcggcgcaccggacaacatccgtctgtcgtatgcgacatccctgtcacttttggaagaagcggttgaacgcatccgccgctttgtcgtgaatcgcagccgctag

SEQ ID NO: 2272 - DNA, 486 bp, Bacillus licheniformis
atgggcaaaaaaacattaattttcatactgatatttggtattatctttttaacagcacttcttgcgggagcgaatgtctaccgtacggcaatggatcagaaagaaaacggccacgagcaggctgccgaaacagccaggcaggaagccggcttaaaacaagttgacagcgtggagacgtttgtcggtaaagaaaagcagtacattgttacaggggcagacaaaaaaggcgacaaaatgtatgtttgggtgcctgctgacaaaaagcagaaaacgctttacaaaaaagcatcagccggcattaccggccgccaggctgcaaaagctgttcaggatgagggcctgatgtctgagcttaaagaggtgcaccttgcaagggaaggcaatgttctattgtgggaagttacatacttaaataaagatgggcagtacagtttaagctatgtggactttataaacggaaaaattcacaaaaatattacgccttag

SEQ ID NO: 2273 - DNA, 171 bp, Bacillus licheniformis
atggaaaacaaaatcgaaattctatctactgtaagcgtcgagcactcagaagacctgtataaaatcgttgatcttttgaaccgtacgctcaaacgcgatgatctcatgttcggcctcgctctcgatgaagaagaccaaaaacaggccatttttacgatttatcgtacttag

SEQ ID NO: 2274 - DNA, 2793 bp, Bacillus licheniformis
atgaacaatcaacgatatgtggtcattgatgtggaaacgacagggaattctccgaaaaaaggcgacagaatcattcaaattgcagcggttgtgattgaaaatggacagataaccgaacgtttctccaaatatgtgaatcccaatcagccgattcccgcttttattgagcagctgacgggcatttcgaatgaaatggttgaaaatgaagaaccattttcggcgattgccgaagatatttttgagctgcttcatgacagctgttttatcgctcataacattcattttgatcttgcttttgtcaagcatgagctgcagctggccggctttggtgagattgaatgcagcgttctcgatacggtggagctttcgagaatcgtctttccgggttttgacggctataaattgacagagctgagcgaagagcttcagattcgccatgaaaacccgcacagggctgacagcgatgcggaagtgaccgctttgatctttttacatatgatggacagactgaaaaggctgccgattcccgttttgaaatctatcagacgtctatcctggcatttgatcagcgacgcgcaggagctttttgacggcttgattgctgaaaaaggcgccgatgctgaacttgaggccggctttacgaaggtcggttcttttgtgatcaggactcctgaagtcgaggatgaagaggccggccataagagccgggttccgcagacagagccgctcatttgggaaagagacggcgggctttcttcattggacgaccggtttgacaagagagaaggtcagacaaaaatgatgcgggaggtctggaccgcttttcaaaatcatgagcatgcgttaatagaagccgctactggaatcggaaaatcgctcggatatctcgtgccggctgcaattcacgccaagcaaacaggcaaaccggtcgtgatcagcacatatacgacattgcttcagcagcaaatgataaaccgcgatatcccgcttttggaaaagatttttccatttccggtaaaagccgcggttttaaagggccgctcccattacttatccattcgcaagttcaagcatattttacaggaagatgatgacaattatgatagcgtcctagcaaaagcgcagattctcgtctggctgacagacacggaaacgggcgatttatccgaaattaatctcccgtcaggcggaaagcttttatgggacagactggcatatgattcgcattcatatgcagaaagcagcaacatgaggaaattgtgtttttatgaaagagccaaagcgagggcccagaaggctgatatgatcattaccaatcatgcgcttctgttgactgacgaaaccaatcagcgaatccataccggagatgccgatatgttcattattgatgaagcccatcattttgagcgcgcggcgggcgagcagtatggagctagagcagactatgtctttctccacaaaagattgatgaggctcggcaccctcaagcagaggggtattttgaaaaaagccgaacggctctaccggtcggcaggcatttcatcagaatcctttttccaaatggacgaatggctcgctcagcttcttgaagaaagcgatctattctttacggctgttcattcttttgtcaagaggaggaaaccaagaaacgatctaaaccgtctcttatataagatcggcgaaaccggtgaaagcagagcatggagcaggcttgaagaaggcgcacgaagactgtgttccatgctgtatgacatgcatcggctgtttatggatcaaaagaaaagcctcgctgaaaaacaggcttctttcacaagccgtcaggcgtttttgttagaggaatacgattcgtgcatgaacgaccttgaagaatatcgaaagacgctcggccgcttgatgtttgaccctgttgaagatgaggtcgtctggattgaaattgacgcgaagggcgcaaaaaacgccgctgctatttacgctcagccgcttgatacaagcgaaattctggccgaccggtttttcaccgagaaaaaaagcgttgtcctcacatcggggacgcttgtcgtcgagaactcttttgactatatgatcaaaaagcttggtttaagcgatttctatccgaggaccttgcaaatcgagtcgcctttttcttatgataaacatatgaatatcatgattccgacggatgtcagcccgattcaaaacgatccgggagactatattcaggatgtctcgcgttacgtcaaggcgcttgcaaaacagaaagatgccaaagtgctcgtcctgtttacgtctcatgatatgctgcgagacgtctaccatacattgaaaaatgaggaagactttccttgtcagctccttgcacaggggatttccggcggaagtcccgttaaggtcatgaagttgtttaaatcgtatcctcatgcggttcttctcggaacgaaccatttttgggagggcgttgactttccgggtgatgagctgacgacgctgatcatcgcaaggcttccgttcagaccgcctgaccatccggttgaatcagcaaagtgcgaccgggcaaagagaaggggagaaagtccgtttcaagcggtatctctgccggaagctgtcctggccttcaggcagggaatcggcaggctgctccgctcagagaaagacagcggaacggtcgttattcttgaccgccgcatccgaacctcttcctacggcacggtgtttatgaaggctctgccccctgcaaaagtcatggagcctactttccttgagcttgaagcctacatagccgggaaaaacggctaa

SEQ ID NO: 2275 - DNA, 384 bp, Bacillus licheniformis
atgtaccgtacgttaatgagcgcaaaacttcacagagcgagagtgacggaagccaatttgaactacgtcggcagcgtgacaattgatgaagatttgctggatgctgtcggaatgatggcaaatgaaaaagtgcaaattgtgaataataataacggggcccggctggaaacgtacattattcccggtgaaaggggcagcggcgtcgtttgtttaaacggagctgccgcccgccttgtccaggttggagatgtcgtcatcatcgtgtcttatgcgatgatgtctgaagaggaagcaaagacccataagccgaaggttgccgttttgaacgagagaaacgaaatcgaggaaatgctgggtcaggagccagcccgtaccattctgtag

SEQ ID NO: 2276 - DNA, 867 bp, Bacillus licheniformis
atgattcagatctatacagcaaaagatatacaaaacttaacgaaaaattaccgcaaggaaggcaaaaccatcggttttgtgccgacaatgggcttccttcatgaaggtcatatgtcgctagtagaaaaagcgcgaaaagacaacgatattgtcgtgatgagcatttttgtcaatcctatgcagttcggtccgggagaagactatgaagcgtatccgagagatattgaaagagaccgtcagcttgcggccggctcaggagtggacgtcttgttcactcctgagcctgaagaaatgtacggccaggagccgacggttaccgcaagcgtgaaaaagcggacggatgtcctttgcggccgttcaagagaagggcatttcgacggtgtcgcaacagtgctcacaaagctgttcaatctcacgtctccgacaagggtttatttcggcatgaaggatgcccagcaggttgccgtcgtcgacgggctgatcaacgactttttcatggatatcgagctgatccctgtcgaaacaaaacgggaagaagacgggcttgccaaaagctcaagaaatgtcaatctgcgagctgaagaacggcaggaagcaaccgctctttaccgagctcttcagcgcggcgccgagctgatccgcaatggagagagagacccggaggccgttaagcgggagattcggagcattctggaaaaaacgagtggtgttattgattatgccgatatttattcatatcccgatctggagatcagggatccattgactggaaaagtcatcatagcggttgccgttcagttttccaaagcccgcttaattgacaatatcatcgtcgatatcccggcagatcaaaaggaggatttgtga

SEQ ID NO: 2277 - DNA, 834 bp, Bacillus licheniformis
atgaagacaaaaactgactttctaaaaatgaaacaagagggagagccgatcgtcatgctgactgcctacgattatccggcggcaaagcttgccgaacaggccggcgtcgatatgatccttgtcggcgattcactcggcatggttgtactcggccttgactcgaccgtatctgttacggttgctgatatgatccaccatacaaaagctgtcaaacgcggggcaaaagatacgtttgttgtgacggatatgccttttatgtcatatcactgctctttggaaagcgctctgaaaaatgccgcggcgatcgttcaagaaagcggggcagatgctttgaagcttgaaggcggcgacggtgtgtttgagacgatcacggctttaacacgcggcggaatacctgttgtcagccatttaggcttgactcctcaatccgtcggtgttttgggaggctataaagttcaagggaaagatgaagaaagcgccggcaagctgattgaagacagcaggcgctgtgaagaagcaggcgcgatggcgctcgttctggaatgcgtcccggcagcgctcgctgaacggatttcaaaggagctcacaattcctgtcatcggcattggagcaggtgctggcacggacggacaggttctcgtttaccacgatgttgtcggacacggagtaagccggacgcctaaatttgtcaagcagtatgcacaaatcgaccagccgcttgaacaagcgcttcggggatatgttgaggatgtcagaagccgcgtgtttcctgaagatgctcattcgttccgtatagatcagcaagttcttgaaggattatacggagggaaatag

SEQ ID NO: 2278 - DNA, 984 bp, Bacillus licheniformis
atgcagtcaaatttaagaaagaaactcattcaattgtttaccgaggcagacggcgaattcatttctggccagaaaatcagcgaagagctcggatgctcaagaaccgccgtttggaagcatatcgaagatctgagaaaatcgggatatgaacttgaagcggtccgaaagctcggctataaaatgataaaaaaacccgacaagatcactgaagatgaaatcaggctcgggttaaaaacgaaaaaaatgggacagacgatccattttcaggatgtcgtttcatcaactcaaaaaatcgcccacgaacttgcaaacaacggtgcgcccgaaggaacgatcatcgttgccgacaagcagactgaaggaagaggaagaatggcgagagcatggcattccccggaaggaaacggcatttggatgagcatcattttaaggcctgaaattcccgtgcaaaaaacgccgcagctgacgcttttagccgctgtagcgatcgttcaggcaatcgaagagcaaaccggcatcgcagccgaaattaaatggccgaacgatattttgatcaacggcaaaaaagtggtcgggatcttaacggaactgcaggcggaagctgatcaggtccattccgttattgtcggaacggggatcaacgtcaatcagcttgcagccgactttccggaggaattacaagaaacagcgacaagccttcgtctcgcaagcggtgaaaaaatcgacagagcggctttggtccaaacaataatgtcgacgtttgaaaaaaggtatgaagactatctcgcctacggttttgaaccgatcaagcttttgtgggaaagctatgctttgaccctgaaccgcgaattgacggcccggacgctgaacggaacgtttcacggcaaagcgctcggaatcgacgaagaaggcgtattgatcctggaaacgagtgacggcatcaaaaaaatatactccgctgatatcgatattaatccgtcatag

SEQ ID NO: 2279 - DNA, 1194 bp, Bacillus licheniformis
atggaggatctctttttgaaggctcttcctctccttcgtgagctgaaaaaacacggctggcaggcctactttgtaggcggagccgtcagggatgcccaaatgaacagagatgtcggcgatattgatatcgctacagatgcatccccggaagaaatcgaagccatttttccgaaaaccgttgatgtcggaaaggaacacggaaccatcatcgtcctctttgagggagaatcctacgaggtgacgacctttcgcgcagagcttgaatatgaggattacagaaggccgagcggcgttcagtttatcaaatcgctgaaggaagacctgaagaggcgggatctgacgattaatgcgatggcgatggatgaagaaggcagactgatcgactatttcggcgggctccgcgacatacgggaaagattgattcaaacggtcggcgacccggcggagcgttttcacgaagatgcgcttcgcatgctgcgggcgctccgttttatgagtcagctcgagtttgagctttctccaaatacaaaaaaagcgatttgcgaaaaccgtccgctcctggcccatatttctacagagcggaaaacggttgaattcgaaaaacttttaaaaggaaaagcagcaggccgggctctggaagcagcggctgaaacagggctttacaaggagcttccggggctggacggcaaaaaggagcgcgttctggctgcccgagcttttcctttttatcaacttcaaaaaagtgccgatatatgggcggctttcattcacatgatatcgatcaatcccgctgaagcgcaccggtttttaaaagggtggaagcttccggggaaagtcatcagacaggcgctccatacggctgaacggatcgatcaaaaatgggatgccgtctcgatgtatgaggcgggggaagagacgctgctggccgcatctgccattcgcagcttgagggacaagcaggcaatcgatgaagagcagctggctgaaatcagacagtcgtaccaggcgcttccgattaaaagcctgaaagacctggcggtatctggaagcgatctgctgaatttcagaaagaagccggccggaaaatgggtgtccgatgatttgaaacggattgagcgggccgtgttaaacggggagcttgccaatcaaaaaaaagccatagaggagtggctggattcatgcagtcaaatttaa

SEQ ID NO: 2280 - DNA, 1182 bp, Bacillus licheniformis
atgaaacagttaaaaatcggaatcacatgttatccgagtgtcggcggatcaggaattatcgccaccgagctcggcaagctgcttgcggaaaaaggacatgaaattcattttattacatcaagtgttccgtacaggctcaataaagtgtattccaacatctattttcacgaagtcgaagtcaatcaatatgccgtttttaagtacccgccgtatgatttggctttggccagcaaaatggcggaggtggcaaagcgggaacagcttgatgttctgcatgcccactacgcggtgcctcacgcgatttccgcttttttagcgaagcaaatgctgaacggaaacattaaaacggtcacaacgctgcacggcacagatataaccgtgctcggctatgatccgtctttaaaagacctgatcaagtttgcgatcgaatcgtctgaccgcgttaccgcggtttcttcggctcttgccgcgcaaacgtatgatttgatcaaaccgaacaaaaaaattgaaacgatctataattttgtggatgagcgcgtgtatttaaaaaaacaggagcatcattcgctgaaagagcagtacggcattgcacctgatgaaaaagtgatcatccacgtatccaatttcagacaggtgaagcgcgtacaggatgtcatccatgtattcagccgcattgtcaaacaaatgaaatcgaagctgattctcgtcggcgacgggccggaaatgaccgtgatctgccagcttgtcagacagctcggattaaaagacgacgttcttttccttggcaaacaagacagcgtagaagagctttacgccatcagcgatttaaagctgcttttgtccgagaaggaaagcttcggtttagtgctgcttgaagcgatggcctgcggcgttccgtgcatcggcacaaatatcggggggattcccgaggtgatcaaaaacggagtatccggttacttggtcgatgtcggagatattgaaggtgcagctagtaaggcgcttcatttactgactgatgaaagcctgcagcgccagtttgcggaagcggcgctgcaaagcatcaaggaacgcttttcttccaacaaaatcatcgcgcaatatgaagaaatttatcaacaattaacagactgggagtgtgacaatggaggatctctttttgaaggctcttcctctccttcgtga

SEQ ID NO: 2281 - DNA, 738 bp, Bacillus licheniformis
ttgagttcagaaacattgtccacggcagggatcgcgatgcttgatatacttgctttcggtgcacacagcgatgatgtagaaatcggcatgggaggaaccattgccaaatatactaaaaaaggctttcaaattggaatctgcgatttaacccaggctgaactgtcttcaaacggaacagtcgaaacgagaaaaagcgaagcggcgctggcggccgaaattctcggcgccagtccgcggatttccctcacgctgccggacagggggctgtttcccagccaggcggcgatcagggacgttgttgccgtcattcggaaacataaaccgaagcttgtctttgtcccttatccaaaggaccggcatcccgatcacgggcacgcagcggaaatcgtcgaagaagcggtcttttccgctggtatacataaatacgaagatgcagaaaaacagccggcccataaagtccaaaacgtgtactactatatgatcaacggttttcacaaacctgagtttgtcatcgacatttctgaaacgatcaatcaaaaaaaggatggccttgctgcttatcagagccagttcacccgttcccggcagtcggttgaaacaccgctgacaaacggatatattgaaacggtcgaagccagggaaaagcttttgggaaaagaggtcggcgtcgcatacgcggaagggtttttttcaaagcggactcttctgttaaacaacgatttatttgggggcggatga

SEQ ID NO: 2282 - DNA, 414 bp, Bacillus licheniformis
ttgaaaatcgccttaattgcccatgaccgaaaaaaacaggatatgattcagctgacgaccgcttataaagacattttaaaaaagcatgagctgtttgcgacaggaacgaccggtttaaaaatcactgaagcgacagggctgcccgtcgtgcgctttcaatcggggccgcttggcggtgaccagcagatcggcgctttgatcgcgaaaaatgacatcgatcttgtgatttttctgagagacccgctgacggcccagccgcacgaacctgacgtgtcagcgcttatccgcttgtctgacgtttatgccattccgctcgccaccaacatgggaactgcggaaatcttgatccgttctgtcgaggaaggcgcgtttgagttcagaaacattgtccacggcagggatcgcgatgcttga

SEQ ID NO: 2283 - DNA, 804 bp, Bacillus licheniformis
atgcaaaaggataccattaaaatcgcaatagcaggaccgcgcggaagaatgggaagcgaagcggtcaaacttgttgaagataccgcacattttgaacttgtcggtgcaatcgaccgtacatataaccgtgaaaagctgtcagatgtgatgacgtcaagttcagatgctgtcatttacaccgatatcacggaatgcttttcagaaacgtctccggatgttctgattgatttgacaacgccggaaatcggcaagctacatacaaaaatcgcgttggagcacggcgtccgtcctgttgtgggaacgacaggattttctgagagcgacttgaacgagcttatggaactgaccgatgagaagggaatcggagctatcatcgcgccaaacttcgcgctcggagccgtgctgatgatgaagttttcgcaaatggctgccaactattttaccgatgttgaaatcattgaacagcaccatgatcaaaaacttgacgcgccaagcggaacggccttgaaaacggcggaaatgatttcggctgttcgcgaagcgaaaacgcaggggcacccggatgaaaaggaaattctgccgggagcaagaggcgccgatcaaaacggaatccgtctccacagcgttcgtctgccgggattgattgcccatcaggaagtgatgttcggcggagacggccaaaccctgaaaatccgtcacgattcatacaatcgcgcatcttttatgtctggtgtgaaactggctgttgaacaagtgatgaaaatcgatcagcttgtctacggccttgaaaatatcatagagtaa

SEQ ID NO: 2284 - DNA, 339 bp, Bacillus licheniformis
atgacgaaagaaaaaacgatgaaagatatacagcgtgaagtcgacgaatatatcggccagtttaaagaaggctatttcagtccgcttgccatgatggccagactgacggaagagcttggcgaactggcgagggaaatcaaccatcattacggagaaaaaccaaagaaaaaaaccgaatcggaaaaaaagatcgaagaagaaatcggcgacgtattgttcgttttagtttgtcttgcgaattcgcttcatatatcattggatgaagcgcatgatatggtcatggagaagttcaacacccgtgataaagatcgctggacaagaaaagaagaaggaaagtag

SEQ ID NO: 2285 - DNA, 699 bp, Bacillus licheniformis
gtgctgaacatcccggtcttcttcatcggctggaaactcctcggcagaacggtcttctcatacaccattctcggcacagtcagcctgtcggtgtttttatggatttttcagcgcttccagattcatatgccgcttcaaaacgatcttgcgctcgcggcactttttgcaggcgtgtttatcggcaccggattgggcattattttcagatacggcggaacaacgggcggcgttgatattatcgtgcggctgatcaacaaatattttcaagtgccgatgggcaaagccatgtttgtgtttgacgcctgcgtcattacattatcccttattttttacctttcctataaggaagcaatgtacacgcttgttgccgtatttgtcgcctcaaaggtcatcgactttatgcaggaaggcggttatgccgcaaaaggcgccaccatcatctctgaaaagaacgaccagattcagcgcaaaatcattgaagaaatggaaagaggcgtcacagttttaaaaggtcaagggtcttatacgaagacggagcgggacattttatactgcgtcgttccgaaaaatgaggttttccagctgaaaaatgtgattacttcggtcgacccgcacgcttttgtagccgtaagcgacgtacacgacgtgctgggagagggttttacgcttgatgagaacaaaaatcccatcacccgctga

SEQ ID NO: 2286 - DNA, 801 bp, Bacillus licheniformis
atgatacgaaaggtgatcctttgcatgatgcttgcgcttgtttttcctgcggccggtttgaaagcgaaagaatcatcggctttgcaggaattgacggaactgtcggatacggtattccagctaacaaggcagtctcaatatgaggaagcggtacaaattcttcaatactttgaaaaaaggctgaaagctgcggagaaagacgggacagaggatatgatgacaggctcggaaatccgccaggtcagtctggcctatcatgatacgctgaaaagtctggaaagcgaagaggtcgcacaccaggagaaatttaaagccgccgcccagtttagaatgctgatggacgccattgaatcagatcatgatccgctgtggagcagtttgaaaaagccgatcatggattctttcagcgctttgaaagccgggattcagaaagaagacaacttgacattcagggaaaagtggaatcattttttatccttgtatgatacgatttatccaagcttaacgatcgatgtttcgccaaagcagttaaaaagcgtctccaaccatattgcagtcgtggaaaacggaggcttccagcaaatgacggaaagcagcaagctggaaaggctgacgcttttggaaaaagatttggaagatgtgtttgatcaagtagaagaagatgatgcagacccttccctgctatgggtcatcctgacgacgggaagcattatcctctcgacgctgacatacgtcggtttcagaaagtataaagccgaagaggacaggcgcagaaaaagagaaaaagattggccgaaataa

SEQ ID NO: 2287 - DNA, 594 bp, Bacillus licheniformis
ttgattgctttgaaactgatttcctacatgctcgctcaaaagccgatgcttctgctgcttttgatcattaatttcttcggtacggtttacgggtattattggtaccttccgcagctgacgaatacgccagcgaagtttctgatcttcgttcccgacagcccgacggcgaccttgttctttttattcgttctcatcggacttttattgggaaggaatgctccgctttttgaggcgcttgcgcttgttacgcttgtcaaatacgggctgtgggcggttgtaatgaatgttctcgtgcttgtggtgaccggaagccttcattggacggggtatatgctgatcgcgtcgcacttcgcaatggctgtgcaaggcgtgctgtacgccccgcatttccggttcaaagggtggcatttggcgcttgcggctgtttggacgatgcataacgatgccattgattacttgtttggaatgatgccgaattattctatgctcgatcaatatatgccgcagatcggctattttacattttggctcagcatcgcttcgatcggtttggcctactaccttgtcttgtcccgaaaagcttttaagctgtaa

SEQ ID NO: 2288 - DNA, 765 bp, Bacillus licheniformis
atgaaaaggggaaaagggatgaagtttgtcggtgattcacggatcccggcggaaagaaaaccgaatattccaaaagattattccgaatttccagggaaaacggaagcgttctggccgaatttcctgctgaaagaatggatggtcggagcggttttccttgtcggttttctcgtgctgaccatcgtgcatgagcctccgctcgcggatggcagatccgaccgataccggctacatacctttgccagactggtattttctatttctttaccaattgctgaaatacgaatatgctgccggacgtatacggttgtcggcgcgattattatcccgacaattgcgttcggagcgcttttattggcgccgtttcttgacagaggccctgaaagaaggccgtttaaacgcccggttgccgtagggttgatgcttttggcgatttcagcgacggttttcttaacgtggcagtccgttgtcactcacgactgggccgctgctgaagagcagggtaaaatcaaggaagaggccgatattgatacgagtgcggaaggctataagatttatcaggagcagggctgtatctcgtgccacggagacaacatgcaaggaggagcggcaggcccgtctctcgttgacaacggcttgtctcctgaagagattgcgaaaatcgccaaggaaggaaaaggcgaaatgcctgccggcgtttttaaaggatctgacaaagagcttaaagaactgtctaaattcatctccgaaacaacggcgaaataa

SEQ ID NO: 2289 - DNA, 675 bp, Bacillus licheniformis
atgctaaacaaaatttatgactgggtggatgaaagacttgatattacgccgctctggcgggacatcgccgaccatgaagttcctgaacacgtaaacccggctcaccatttttcagctttcgtgtactgcttcgggggattgacgtttttcgtgacggtgattcaggtgctgtccggcatgtttttgacgatgtactacgttccggatattaaaaatgcctgggaatctgtttattatttgcaaaatgaagtggcgttcggacagattgtaaggggaatgcaccactggggtgcaagcttggtcatcgtgatgatgtttcttcatacgctcagggttttcttccagggggcttataagaagccgagagagctgaactggattgtcggcgttttaatcttctttgtcatgcttggtttaggttttacaggctaccttttgccttgggatatgaaagctctgtttgcgacaaaagtaggtttgcagattgctgaggcgacgccgctgatcggctcggaaattaaaacattgcttgccggtcatccggatattgtcggcgctcagacgttgacgcgcttttttgccatacacgtctttttcctgccagccgctctgttcggactgatggctgcacactttatcatgattcgcaaacaaggaatttctgggccgctgtaa

SEQ ID NO: 2290 - DNA, 507 bp, Bacillus licheniformis
atgagcgaaaaaagacatcgggtatccagacgtcagtttttaaactatacgctgaccggagtcggcggctttatggcggcggggatgctcatgcctatggttcgcttcgcgctcgatccggttttaaggccgactgaagatcaggacatggttcaggttgtcagcgttgatgaattgacaaatgaaccgcagcgcttcgattttaaaatcaaacaagtggatgcctggtacgaatcggaagaatcgagatcggcgtgggttttcaaaagtggggacgaaattgtagctttatcaccggtttgtaaacatttggggtgtacggtcaactggaacagcgatcctaaaaatccgaataagttcttttgtccgtgccattacggactttatgaaaaggatggtaccaacgtgcccggaactccgccgcttgctcctttggaccgctatgagcaagaggttaaagacggctacctttacttagggaaagccaagccgaggaaggatgggtga

SEQ ID NO: 2291 - DNA, 447 bp, Bacillus licheniformis
gtgaaatggaatacgcacgatgcggatgtttacttgaacgcgaaagaatacatcgatacagctgtcatccctttaatatcggttgatcttggagatcagtttaatcggccgtatcaaaaggggaatttacgtctatacttgcagaagaactcgaaaggcagctgaagggcagaatctacctgttttccgccctgtacatatttagaagcggatgaaaaatcggcgcagcatatcgccgatttaaaagaaatggccgaaaaacattttcgccacatcgtttttttaacgacggatgaacgctggaagcagatgctcgacagcgagcaaaagctgctgtgggttccggcgattcctctcgaacatatgaaggattcgttaaagcagaagctgctggaagatcaaattgagcaaatattgaacattttgttacaatattggaactcttga

SEQ ID NO: 2292 - DNA, 540 bp, Bacillus licheniformis
atgcagacccctgtttctgtcaatgaaaaaaaagattttatccgctggtttctcaaccattatcagctgaaacgaagagagtgtgtatggattctgaattatttaatgagccatgactcgctgatggaaaaagtgcattttgtcgagcaggccgaattttgtccgaggggcattatcatgtctacccactgcgttgaggaagtgccttttcgtttttataaagaaaatgtcatgacgaccgatgcagaaaaatcatttcatgatatcaggctgaataagcagcaggatctctttatccagctgaacttccgctcagcctataattctccggaatatgcggctgtactcgaagccaatccgcatattccgaaagacctatatgaaaatgaaaaagataaaattgtcgctgaacagattttggagcattccattgccacttttcagagacaaaagctgctgcgggaaatcgacgaagcgcttgaccgccaggataaagaaagcttcgaaaaactagctaaacaactgagccagctgcgataa

SEQ ID NO: 2293 - DNA, 1275 bp, Bacillus licheniformis
ttgaatacttctattcaagaagccataaaattagttgaagcaggccacccggaaagcggattgaaaaaacttgctgatatcgagtctgaccttcatgatgaagacaaagccatagtagcccagctgtattacgaatggggaattgtcgataaggctatcgccatcgtgactgacctccatgaactgtatccggatgaaacagaactgacatgcttttatgccgaactcctcatcgaaaccgatcaggaagaaaaagcgctcagcgtgctcgaaacgattccggaaacagacgaggcgtacccgcagtgcctgcttttaatggctgatctctatcagatgcagggtctgtttgaagtcagcgagcaaaagctgttaaaggcgcaagccattttgccggatgagccggttatcgattttgctttgggagagctgtattttactcagggagcttacggcaaagcggtccgtcaattcaaaaaagcggccgaagaagaagccgtcatcggcggcgtcaatgtgtaccaaaggctggcggaatcattaagttcatccggagcgtttgaagaagcgcttgaatggtatgaaaaagccgtcaaggagaaccccgagcccaacacactgttcggctttggttttacggcactgaaagcggggtatcctaaaactgcgattaaacagctgacagagctgaaggaaatggatcccgcttattcttcgctttacaagcctctggccaacagctttgaaacagaagggctttatgaggaagcattcgaaacggcaaaagaaggaatccgtgtcgatgaattcaacaaagagctttatctttctgctgcaaaagcagccttaaaaacgaaaaggcattcggaagcgaaggagctgcttcgtgaagcgctggcgctggatcccggatatctggaagccgttcatacactgcttgccctgtttcttgaagaagaagacgatgagagcatcattgaactcgttcgggaagtgcgcaaatacggagaggatgatccgaagttcagctggcatctggcatcggcgttcgcccggaccgaagcgtacgacaaagcccgcgaggaatatgagaacgcatttttgcactatcgggatgacgccgatttcctttacgaatattccatgtttctgcttgaagaaggacggcggaaagaagcgctgcctctgctgaaaaaactggcagagctcgacccggcaaacgaggaagtccaggagacgattttcagaatcgaagatgaaaattcctttgaataa

SEQ ID NO: 2294 - DNA, 1395 bp, Bacillus licheniformis
gtgttctcagaatcagctttcaatccgatgaagatcgaaaacgcgccgaaaaatgcatccaaacccgcgcaaaatacgaaacattttatgctgattgaggtggaacacatgaaaagaggaaaaatcagttcactaaagggagagcttcatattccgggagataaatccatctcccatcgttctgttatgttcggagccatggcagaagggaaaacggtcatcaaaaactttttgccaggagccgactgcttgagcacgatcgcctgctttcggaaaatgggtgtcgaaatcgaacagaatggcagtgatgtcaccgtccgcggcaaagggctcgatcagctcgctgagcctgccgagctcctcgatgtggggaattccggaacgacgatcaggctgatgctcggcattttggcggggcgtccgtttcacagtacggttgccggcgatgagagcatcgccaaaaggccgatgaagcgtgttacagaaccgcttcgaaaaatgggggcgaaaatcgacggccgcgccggaggggaatacacaccgctttctgtccgcggcggacatctgaaggcgatcgattttcagtcgcctgttgcaagtgcgcagatcaaatcggccgttctgcttgcgggtctgcaggccgaaggcaccacaacggtgacggagcctcataaatcaagagaccatacggaacggatgctgtctatgttcggcgtcagccttcgggaagatgaaacgagcgtgtccattgagggcgggcagcagctgaaagcagcagaagtctttgtgccgggtgatatttcatcagctgcgtttttcctggcagcagcatcgcttgttcctggcagtgaagtcgtgcttcgcaatgtcggactcaatccgaccaggacgggaatcatcgatgtcttgaaagaaatgggagccgatcttgaaatcgaagaaaaggacacaggaaataccgagccgtacggcgatctgagaatcaaaacgtcctctttgaaggcagccgaaatttcgggcgatttgatcccgcgcctcatcgatgaaataccgatcatcgcgcttctagcaacacaggctgaagggacgacggtcattaaagatgcggctgaactcaaagtaaaagaaacgaaccggatcgataccgtcgcctcagagctgaaaaaaatcggtgcgaacatcgaaccgacggaagacgggatgaagattcacggcaagacgcctcttacaggcggcgcgaaggtctcaagccatggggaccaccggatcggaatgatgctggggatcgccgcctgcatctgcgagcagccgatcgacatattacagcccgaagctgtgagcgtctcatatccttcattttttgaacatatcgaaaagcttgcagaaaaagcctga

SEQ ID NO: 2295 - DNA, 1116 bp, Bacillus licheniformis
atgactcaaccgaatgaaacgattttgttggccggtttgggcttaatcggcggttcgatcgccctggccatcaaaaaggaacacccgggcaaacggattatcgggtttgacgtgtcagaagagcaggcaagggctgcacaaaagcttggcgtaattgatgctccggccgcttcttttttagaaggggtgaaagaagcgtcgactgttttcttagcggcgccggtcgaacagacgcttcacatgcttgatgagcttgccgcttcaggcatcaagaaaaagctgctcattacagatgtcggcagcacgaaacaaaaggtcgtcagccatgccgaaaaagtgctgccggatgactacaggtttatcggaggccatccgatggcaggctcgcataaatcgggcgtcgctgccgccaaagacttccttttcgagaacgcgttttatattttgacgccatccggctccgccggcaaagaagcggttgcttctttaaaagatctgctcaaaggaacaaatgcaaagtttgtggaaatgtctcctgctgaacatgacgctgttacaagcgtgatcagccattttccgcatatcgtggcggcgagtctcgtccaccagaccgtcaaattcgaagatcagtacccgctcgtcaagcgttttgccgcaggaggcttccgcgatatcacgaggattgcctcaagcagcccggcgatgtggcgcgatattctcttgcacaataaagataaaatattggagcggtttgacgaatggaaacaagagctggacagaatccagtcttttgtcgaaaatgaagatgcagacgggctgtttgaattttttcggcaagccaaggaataccgcgacggtctgcctttgcggcaaaaaggcgcgattccttccttttacgatctttatgtcgatgtcccggaccatccgggggttatttcggaaattacggcgatcctcgccgacgagcaaatcagcattacgaacatccggattatcgaaacaagggaagacataaacggtgttctcagaatcagctttcaatccgatgaagatcgaaaacgcgccgaaaaatgcatccaaacccgcgcaaaatacgaaacattttatgctgattga

SEQ ID NO: 2296 - DNA, 1083 bp, Bacillus licheniformis
ttgcaaattaaagaacagttaaaacaattaacgccttaccagccgggcaaaccgattgaagaggtcaaaaaagagttcaacctcgaccgggtcgtcaagctcgcttcaaatgagaatccttacggctgttcagaagcggcaaaggaagccctccagattgaggtgcagcaaatggctctctatcctgacggctatagtgcggcattgagaacaaagcttgcctcccatctcggcgtaaatgaaacgaacatcatcctgggaaacggaacggacgaagtcattcaaattatttcccgttctttgttggaccctgcctcaaacactgtaatggcgaatccgacattttcacaatacaagcacaacgctgtcatcgaaggagcggaagtcagagaagtcggcctgctcgaaaacggctgccacgaccttgatgcaatgctgaaggcgatcgatgaacagacgaaggttgtctgggtttgcagcccgaacaatccgaccggaacgtatgaatccggccgcaacttgatccgtttccttgaaaaagtgccggaacatgtccttgctgtcgttgatgaagcttattacgaatacgtaacggctgaagactaccccgagaccatcccgcttctggagcgctttccgaacctgatgattctcaggacgttctcaaaagcctacggtttggcgtctttaagggtgggctacgggattgcttctgaacagctgattcaggcgattgagccggcgagacagccgtttaatacaaaccggctcggccaggcggccgcgcttgccgccctcggcgatcaggcatttatccacgactgtgtgagaaaaaacaatgaagggctcaaacagtactacgatttctgtgatgagcacgggctaaattactatccttcacaaacgaactttgtgctgattgattttaaacgggatgcagacgaacttttctcagagctgctgaaaaaaggctatatcgtcagatccgggaatgcgctcggctttccgacgttccttagaatatcggtcggtacgaaggaacagaacgaaggctttttgaaaacgttagccggcatgttgtaa

SEQ ID NO: 2297 - DNA, 804 bp, Bacillus licheniformis
atgttcaatctgaaaaaacagccgtccgataagctatttgttccgtttattacagcgggagacccgctgccagaaatctcgatcgagctggcaaaatctcttcaagaggcgggagcgtccgcccttgaactcggggttccgtattctgatccgctcgctgacggcccggtgattcagcgcgcatcaaaaagggcgcttgacaacgatatgaacatcgtaaaagcgatcaggcttggcggtgaaatgaaaaaaaacggcgtccatattccgattattctctttacgtattataatcctgtgttacaattagatacagatcactttttcgctttactgcgacaaaatcagctagacggactccttgtaccggaccttccttttgaggaaagcgtatatttgcagcagcagtgtaaaaaacacgggattacctatatttcgctggtcgcgccgacaagcgaatcgcgcattcaaaaaataacgcagcaggcggaaggttttgtgtattgcgtttcttcgctcggtgtcacaggtgtgcgcaatgaattcgaagattctgtttcttcatttatcaggtctgttaaaggaatgagctccgtcccggttgccgtcgggtttgggatttccagctccaaacaagtggagatgatgaatgaactggcggacggcgttgtcgtgggaagcgcccttgtcagaaagatcgaggagctgaaagacgaactcgtcgcccctgagacaagggaacaagccttaaaggcgtttgaggcatacgctaagacatttagcggatcgtacatggtaaaatga

SEQ ID NO: 2298 - DNA, 1227 bp, Bacillus licheniformis
atgtattcatatccgaatgaacaaggcaggtttggtgattttggcgggaaattcgtcccggaaacactcatgcagcctttggaagaaatcgaaaaagcgtttcttgaactgaaagacgacccttcatttcaaaaggattatcaaaagcttttaaatgactactcaggcaggccgacggctttgacgttcgcagaccagctcactaagcagctgggcggagcgaagatttacttaaaaagagaagatttaaaccatacaggcgcccacaaaatcaacaatgccctcggccaggcgctcctggccaagaaaatgggaaaaacaaagctcattgctgaaaccggtgcaggccagcacggtgtggcggcggcgactgtcgccgcgaagttcggcttatcatgcatcgtcttcatgggggaggaagatgttgccagacaatcgctgaacgtgttccggatgaagctcttgggagcggaggtcgtcccggtgtcaagcggaaacgggacattaaaagatgctacaaacgaagcgatccgctactgggttcagcattgccaggaccatttttacatgatcggttccgtcgtcgggccgcatccgtatccttatatcgtccgcgaatttcaacggatgatcggcgaagaggcgaaagcgcagttttatcaattggagcaaagcctccccgataaagttgtcgcctgtgtcggaggcggaagcaatgcgatcgggatgttcagcgcgttcattgaagaaactgttgaactgatcggagtcgaagctgcgggaaaaggtgttgacacacctcttcatgcggccacgatcacaaagggtacaaaaggcgtcatccacggttctttgacctacttgattcaagacgagtacggacagatcatcgagccttattccatctcagccggacttgattatccgggagtcggccccgagcacgcccatcttcatcaaacagggcgcgtcacgtatgaatctgtcacagatgatgaagcggtctcggcattaaggctgctgacagagactgagggcattttgccggctattgaatccgcccatgcattggcaaaagcatttgaaatcgctaaagaactgccgagagagaaaagcgttctcgtctgcctttcaggcaggggagacaaagacgtccataccttgatgaaggtgttggaagaagaggtgaatcaagatgttcaatctgaaaaaacagccgtccgataa

SEQ ID NO: 2299 - DNA, 537 bp, Bacillus licheniformis
atgaagaaaccgagtctaaaatattgcgggattcattcattggaagatttaaaggtgacagcccgctcgaaagccgattatctcggatttattttcgccgaaagcaaacggtcggtagacccggcggatgtgaaacggtggtgcggcgaaacggatacgccaggtaaaaagcttgtcggcgtttttgttaatgaaaacatgagccgaatggctgaaatcgtaaaagatgcaggcttggacgtgatccagcttcacggagatgaaacggcggcagacatcaagcggcttaaaagcatgacagactgcgagatatggaaggcgctccctcacgggaatgataccgtacagagcatggcttctttcgcaccttacatcgacgggtatgtcatcgactcgtctgtcaaagggatgagagggggaacgggagtttcgttttcgtgggacagcgtcccgctgtatatagatgcagcccaaagagaaggcaagcgcctgtttatcgccggaggcgtgaacccggacacaatcgcagatctttaa

SEQ ID NO: 2300 - DNA, 759 bp, Bacillus licheniformis
atgcttaatcaaattattgatagaaaacgagaagacatcctaaagatcaagctgtcggaagatttaaaactgccaaagcggtcatttaaaaaagcgctcctttctccgaaccggtttgtcgctttaattgcggaggtgaaaaaagcttctccgtcaaaaggcgtgattcaggagggttttgagcccgtcaagatcgcaaaacaatacgaacaggctaaagccgattgtttgtctgttctgacagatacacctttttttcaagggaagaacagttatttgtcagatgtgaaacgctcggtttccctgcctgtgctgcgcaaggattttatcattgattccattcaggttgaagaagcggaccgcatcggagcggatgcgatcctgctgatcggtgaagcgcttgaaccgcaaaagctgtttgaactctatcagcaagccgttgaaaaaggcatggatgtgctcgtcgaagtacatggcgaagagacgcttgagggcattttaaatgtctttacacccgaaatcatcggcgtaaacaatcgaaatctaaaaaactttgaaacgaccgtcggacaaacggagcgaatggcgaaactcgttccgccggggaccgttctcatcagcgaaagcggcatcggaaaatcggaagacctgacttttgtaaaaacgtgcggagcccaagccgtgcttgtcggcgaatcgctgatgagagagacgtcacagctgaaggctgtctatgcgttattcggagaggacggctga

SEQ ID NO: 2301 - DNA, 1017 bp, Bacillus licheniformis
atgaacgaactgctgaaatcatgcgttaacggacggacactgaatgaaatcgaggcacacagcatcatgcgcgacatgatgaccggctcgctgagcgctgcggaaatcggaggcctcctgtccgttctcgcctacaggggagaaacggctgaagagattacgggatttgtcagagccatgcgggagcaggcgcatacaatagacggaccggaacatgttgttgatacgtgcggaaccggaggagacggaagctccaccttcaacatttccacagcggctgcgatcatcgcttcatcagccggggcaaaaatcgcaaaacacggtaatcgatccgtttcttcaaaaagcgggagcgctgacgttctcgaatatctcggcgtttctattcagacgtcgcctgaagaaacgattaagagcattgaacgccgaaatatgggattcctgtatgcgccaagctatcactcttccatgaagcacgtggcaggcgcgaggaaggatctggcttttagaaccgtattcaatctgctcggcccgctcagcaacccgatgaaggccaaacgccaggtgatcggcgtctactcgatcgaaaaagcaaagcttatggcccgcgctcttgaagcgtttgaaccggagcacgtattgtttgtttcgagccgggacggtcttgatgaactgtcgatcacatcgccgacagatgtaattgaactgaaaggcggcaaaacatacgaatacaccgtcgagccgggcgatgttggactgcctctcggaaggctgagagacattcaggtggcgacgcctgaagaaagcggccgtctgatcgtcgatattttgaaaaaccgcggtccggactcggctgttcatatcgcagcgtttaatgccggagccgctttatacgtcgcagaacaggcagcggatttaaaagagggcgttgcgctcgctttagaagctgttgctggcggtgaagcgctcaatcagctggagcgattaaaacagaaagaggaagagttgtatgcttaa

SEQ ID NO: 2302 - DNA, 1548 bp, Bacillus licheniformis
ttgagtctgcaaaccgattttgcctctttttcagaggattcttcacactttaaaacgataccgattattgagagtttttccgtcgatacgctgacgcccgttcaattggtcgagaagctgcaggaagacatcgtctatttgctggaaagccaggatgaaacctctgcatggtcaagatattctttcatcggccttgacccctttttgacgatcaaagaagaacgcggccggtttcacgcctgcgatcaaaagcagaagaagctttattcggcttcacagttaaaagacgttctcgaatggatgtcggagacgtattcgatcaaagcgcctgagctcgacatcccgtttacaggaggagcggtcggctatttaagctacgatttaatgccgctcattgaaccgtccatcaaagggcacagcaaagaaacggaaatggcaaaatgcctcctgtttgtctgccggacgatgatcgcttatgatcacgaactgaaaaagctgcatttcatccactatacaaggcttgaaggcagtgaaaatagggaggaaaagcgccgcattttcaaaaaggggaaagaagagctcaagcagcttacacacaggctgtcagaccggaaaacgccgaaagagctgtttcttccgcaaggacggcacacggcccccagctttgaagggattcaatcaacatatgagaaatcccggtttttggccgatgtcgatcgcttgaaagaatacattaaagcgggagacatttttcaaggcgtcctttcgcaaaggttcgacattccggtgaaggtcggttcttttgagttatacagagtgctgagaatgatcaacccgtccccgtacatgtactacatgaggcttcctgaccgcgatctcgtcggaagctcgcccgaacgtctgatccatgttcaaaacggccatcttgaaatccatccgatcgccggcacaaggaaaaggggcggtgatcaggctgaggataagcggcttgaaaaagaactattggctgatgagaaagaaaaagcggagcattacatgcttgtcgatttggcgagaaatgatatcggcagagtagctgagtacgggtctgtccaagtgcccgagtttacgaaaatcgtttccttttcgcacgtcatgcacatcatttcgatcgtaaccggcactttaaaagcgggtgtccacccggttgacgctttaatgagcgcatttccggccggaactttgaccggcgctccgaaaatccgcgcgattcagcttttaaatgagcttgagcccgaaccgagggaaacatacggaggatgcattgcttacatcggatttgacggaaatatcgattcgtgcatcacgatccggacgatgagcgtgaaaaacggagtggcgtccattcaggccggggcgggcatcgtagccgactccgtgcctgaaaaagaatgggaagagacctgcaataaagcaggggctctgttaaaaacgattcaaatcgcagaagaaacgtttctcgaaaagggggaggacggcaatgaacgaactgctgaaatcatgcgttaa

SEQ ID NO: 2303 - DNA, 384 bp, Bacillus licheniformis
atgatgatgcgcggtattcggggagcgacgaccattgaccgggatacagaaaaagacattacggagcggacgaagcagctgatcggaaaaatgatcgatgaaaatcgactcaaacctgaacaagtcgtacagatcttaatttctgctacttccgatatacacgctgcttttcccgcgaaggtcgtcagaacgtttgacggctggcagcatgtgcccgtcatgtgcatgcaggaaatggatgttgaacacggccttaaaaaatgcatcagagtgatgatgacggtacagacggatatgcggcaggatgaagtccgccatgtttatttggaaaatgcagtaacgctcagacctgatttatcattgacaaaaaatactgaattgtaa

SEQ ID NO: 2304 - DNA, 1089 bp, Bacillus licheniformis
atgaaatcacttcaaatcgaaaccgcttctttgtcctacccggtattcatcgggggaggcattagaaaaaacgcggcagagcttttgtcatccttgaaccttccgatgacgaaactgcttttgatcaccgacgaagaagttgataaacgctatggagaagagctgttcagtcttctccgcagcaaatggcccgtcaaaaaggttgcggtgccaagcggcgagcaggccaaatccatcgatatgtttatgaagctccagacggaagccattcaatttcaccttgaccgctcgtcatgcattgtggcgctgggcggcggtgttgtcggcgatcttgcaggattcgtcgcttcaacttttatgaggggcatcgattatgtgcaattcccaacgactctgctgtctcatgacagcgcagtcggagggaaagtggccattaatcacccgctcgggaaaaacttaatcggcgcttttcatcagccgaaggcggtggtatatgacaccgaatgcctgagcacgcttccggaaaaagaaatgcgttcaggtcttgcggaagtcattaagcacgcatttatccgtgatgaatctttcttgaacgaattgcttaaacttgattcaatagaagcgattacgaccggccagctcagtgaaatggtttacaaaggcatttcgattaaagcggaagttgtctcacaagacgaacgcgaacagggaatcagggcctatttgaacttcgggcatacgcttggccacgccgttgaagccgaatacggctacggagagatcacccatggcgatgccgtcgctttaggcatgcaatttgctttgtttgtcagcgagaaggtgctgaattgtcctgttgaccgtacgaaaatcgccgcctggctgaaaaatctcggctatccggaaagcgtgaaacgcgaagtttcaacagaagcccttatctatcgaatgatgaacgataaaaaaacacgcggaggcatcattcagtttgtccttctggataagatcggcagtgtgcggctgcactcctttaaagccgaagaaatcgaacgatggctgaatatgtggagattggagggagacaaatga

SEQ ID NO: 2305 - DNA, 1173 bp, Bacillus licheniformis
atgaggtatttaacagccggtgaatctcacggtccgcagcttacgacaattatcgaaggagtcccagcggggctttatatcacaaaagaagacatcgattacgagcttcaaagacgtcaaaaaggccacggccgcggacgccggatgcaaatcgaaaaagaccaggcgcggatcacaagcggtgtaagacacgggcgttctcttggatcgccgatcgctctcgtcgtcgaaaacaatgactggaaacactggacgaaaatcatgggttcagagccgatcacggctgaagaagaaagcgaaatgaaacgacagatttcaaggccgagaccggggcacgccgatttgaacggcgcgatcaaatacgggcacagagacatgcgcaacgtgcttgaacgttcatctgccagagaaacgaccgtccgtgtagcggcaggagccgtcgccaaaaagatcctttcccagctcggcattcaagtggccggccacgtgctggagatcggcggagtaaaagctgaaaaaacaaattacgaatctatcgaaaacttgaaaaaagtaaccgaagagtcccctgtcagatgctatgacgaagaagcgggcaggaaaatgatggacgcgatcgatgaagcaaaagcaaatggggattcgatcggcggaatcgtcgaggtgatagttgaaggggtgccggtaggagtcggcagctatgtccattacgaccgaaaactcgacagcaagcttgcagccgccgtactgagcatcaatgcttttaaaggggttgaattcggcatcggctttgaagccgcacgcaaaaacggcagtgaagtccatgacgaaatcatctgggacgaagaaaaaggctatacgcgggcaacaaaccgtctcggcggtcttgaaggcggaatgacaacgggaatgccgattgtcgtcagaggtgtgatgaagccgattccaacgttatacaaaccgcttaaaagcgttgatatcgagacaaaagagccgtttacagcgagcatcgagcgttccgactcctgcgctgtccctgccgcaagcgtggtggctgaagcggttgttgcatgggaaatcgcaaatgcgatcgtcgagcagtttggcgttgaccaaatggaccggatcgctgaaaatgttgagaaaatgagaaagcttgcgagggagttttaa

SEQ ID NO: 2306 - DNA, 768 bp, Bacillus licheniformis
atggacaattacagtttctttgttgataaatggaaaaaaatgactggtgtggatttggcattgtacaaagaggcgcaaatgaaaagaagactgacgtctctatatgagaaaaaaggatacggcgatttccgcgagtttgcgctcgctttagaaaagaatgaagctcttctgcaggaaacattggacagaatgacaatcaatgtttcagaattttacagaaactataagaggtgggaggttctcgaaaaaacgatcctgccgcttttaaagcctgcgaaaacgctgaaagtttggagcgcggcttgttcaaccggggaagagccttatacattatcaatgattttaagcagacagaaaggcctcacagactatcagattatcgcaacagatatcgatgacaaagtccttcagaaagcgaaagaaggcgtatatcaggaaaggtccctgcaggaagtgccgaaagagatgaaagaactttattttacgcaagacggaaaccgctttaaagtcaaagacgagatcaggaaaaacatccgctttcaaaagcacaatttactggctgatccgtatgagaaagattttgatatcatcgtatgccgcaatgtgctcatttattttacggaggaagcaaaagagaagatctatcataagttcagcggcagcctgaagaataaggggattttgtttgtcggaagcacggaacagatcttcaatccggaaaaatacggttttcaatcgacagatacgtttttctatcaaaaaagttag

SEQ ID NO: 2307 - DNA, 447 bp, Bacillus licheniformis
atggaaaaaacctttgtgatggtaaaacctgacggcgttcagcgtcagctgatcggcgaaattttgttaagattcgaacgtaagggcttacaattaatcggagccaagctgatgaaggtctcagaagagacggcaggcgagcattataaagaacataacgggaaaccgtttttcggcgaacttgtcgactttattacttcaggcccggtattcgccatggtatgggaaggcgaggacgcaatcgcggtcgccagacagctgatcgggaagacgaaccctaaggaagcgcttccaggtacaatccgcggagacttcggcatgtttgtcggaaaaaatatcattcacggttcagattctcctgaaagtgcagcacgcgaaatcaacttgttttttaaagaggacgaacttgttgaagacgagaaattaatgaatcaatggatttactaa

SEQ ID NO: 2308 - DNA, 963 bp, Bacillus licheniformis
atgaaattgacaacgttttattcttttttgaatgacgatattgaattaatagaaaaagagcttgaaaagaccgtgcactccgactatccattgctcagtgaagcgagcctgcatttgctgcaggccggaggcaagaggattcgtcccgtgtttgtcctgctttccggcatgttcggcgaatacgacatcagcaaaattaaaaatgttgccgtttcgttggaattgatacatatggcttcgctcgtacacgacgatgtcatcgatgatgcggagctgagaagaggacagccgacaatcaaagcgaagtgggataaccggattgcaatgtatacaggtgattatttgttcgctcgctcacttgaagcgatgacaaaaataaacgaaccgaaagcccatgaaatcttgtccaaggcgattgtcgaagtctgtcttggagaaattgaacaaattaaagataaatataatatggagcaaaatctcagaacctatttgagaagaatcaggcgcaagacagcacttctaatcgcgtcgagctgccagcttggagccattgctgctggtgcgggtgaaaacattcataaaacgttgtactggtttggctattatgtcggcatgtcctatcaaattattgatgacatcctcgatttcacctcaagcgaaaaagagcttggcaagcctgtgggcagcgatctgcttcaggggaatgtcacgcttcccgtattatatgcacggaaatcgcctgagctaaaagcgcgcctgatgctggtcaacagtgaaaccactccagaacagatcaagccagtgatcgaagagctgaagaaaacggatgccattgaacaatcgttcagggtcagtgaaatgtatttaaacaaggctttcgaactgcttgaaacgctcccgaaaaaccgggcgcggacggcactgggccaaattgcgaaatacatcggcaagcgaaagttctaa

SEQ ID NO: 2309 - DNA, 699 bp, Bacillus licheniformis
atggtgcagtcaaaagaacagcgcgtacatggcgtgtttgaaaagatttataaaaattatgaccagatgaactccgtcatcagctttaaacagcataaaaaatggcgcgacaaaacgatgcagctcatgaacgttccaaaaggagccacagcgcttgacgtctgctgcgggacgggagactggacgatcgcgctcgctgatgcggcaggagagacaggggaaatcaagggccttgatttcagcaaaaacatgctgagcatcgccgaacaaaaaacggaaagctacagccagatcgaattgatccacggcaatgcgatggaactgcccttcccggataatacattcgactatgtcaccatcggcttcgggcttcgcaatgttcccgactatttaaccgtattaaaagagatggcgcgcgtggtaaaacccggcggccaggttgtatgccttgagacgtcccagcctgaaatgttcgggttcaaacagctatacttcctgtacttccgcttcattatgcctatgtttggaaagctctttgccaaaagcttcaaggagtattcatggcttcaggaatcggccagggaatttcctggtatgaaagagcttgccgcgttgtttgaagaggctggattaaaaaatgttcaatatcatccgttcacaggcggcgtagcggcaacacatgtcggctggaagcgatga

SEQ ID NO: 2310 - DNA, 777 bp, Bacillus licheniformis
ttgcaagacatctacggacaattatcttatttgaaaatcaagctgaatcaaaagctttcacatccatatttggcgaagcatctgactgcgccgaaagttgatgaggataagctgtttcttttctacgctctgtttgaggaaacggatttaaaagaagctgacaaggaaagttacatcttaacggcgatgcttgttcaaacagcccttgatacccatgatgaagtcacgaccgcagcttcaattaaacaggacgattataaaaaccgccagctgaccgtattggccggtgattacttcagcggcatgtactactcgctgttatcgggtatgaaggatatttatatgattcggacgctcgctgcggccatcaaagaaataaacgaacacaaaatcaggctttacgaccattccgcaaaagatgcagacagcctgaaaaaaagcgtcagcatagtggaagctgcactttttcaccatctcgccgaccacttttacctgcctcactggaaaacagccgccaatgactttcttgtctttaaaaggtttgcggccgaagaaaaagcttcagattcccggctgctggagacgatcatacagaaagagtttccggaaggacaggcttcatgcggacagctggctgctgcggcttataaagaagccaagcttgcgatcaaccagtcgcttgccaaaaagcccgccgtccaaaaatggcttctgaaacgcctgcaggaaattcggcctgaaaaacgaacttatcatcagaaagtggaagaagggtaa

SEQ ID NO: 2311 - DNA, 237 bp, Bacillus licheniformis
atgaacatgaccaataatcaatcgaatgattttgtcgttatcaaagccgttgaagacggcgtcaatgtgatcggactgacaagggggacggacacgagatttcatcattcagaaaagcttgataaaggagaagtgatgatctgccagtttaccgagcatacctccgcgatcaaggtccggggcgaggcccttattcagacggcaaacggcgagatgaagagcgaatcgaaaaaatag

SEQ ID NO: 2312 - DNA, 570 bp, Bacillus licheniformis
atgagagaaatcaacaaagaccaaattgaacaagccgtccggcaaatattggaggcgatcggagaagatccgaaccgcgagggccttcttgatacaccgaaaagagtcgcaaagatgtacgctgaagtatttgcgggtttaaacgaagatccgaaagagcatttcaaaacgattttcggcgaggatcacgaagagcttgttcttgttaaagatattcctttttattcaatgtgtgagcaccatttagttcctttctacgggaaagcccatgtagcctatatccctaaaggcggaaaagtgacaggactcagcaagttggcgagagccgttgaagcggtggcaaaacgtccgcagcttcaggagcggattacgtcaacaattgccgacagcattgttgaaacgctgactccgcacggtgtaatggtggttgttgaagccgagcatatgtgcatgacgatgcgcggcgtgaaaaagccgggttcaaaaactgtcacttcagctgtaaggggaacgtttagacaggatgtggctgctcgctctgaggtgttggagcttatcaaaacatcatga

SEQ ID NO: 2313 - DNA, 279 bp, Bacillus licheniformis
atgaacaagacagaactaatcaatgcggttgcagaagcaagcgaactatctaaaaaagacgctactaaagcagttgattctgtttttgatacaattttagatgcacttaaaaacggtgaaaaaattcaattgatcggttttggtaactttgaggttcgtgagcgctcagctcgtaaaggacgcaatcctcaaacaggtgaagaaatcgaaatccctgcaagcaaagtacctgctttcaaaccaggtaaagcgcttaaagacgctgtagcaggaaaataa

SEQ ID NO: 2314 - DNA, 1479 bp, Bacillus licheniformis
ttggaaaaggtcgatattttcaaggatatcgctgaacgaacaggaggcgatatatacttaggtgtcgtaggagctgtacgtacaggaaaatctacgtttatcaaaaaatttatggagctagtggtgctcccgaatatcaacaatgaagcagaccgggcgcgcgcacaagatgagctcccccaaagtgccgctggcaaaaccattatgacaactgaaccgaagtttgttccgaatcaggcaatgtcagttcatgtcagtgacggactcgatgtgaatataaggcttgtcgactgcgtcggctatactgtacccggggcaaagggatacgaggatgaaaacgggccgagaatgatcaatactccttggtatgaagagccgattccgtttcacgaagctgccgaaatcggcacgagaaaagtcatccaagagcactccacaatcggtgttgtgattacgactgacggcacgattggagaaatcgccagacaggattatgtcgaggctgaagaacgggtgatcgacgagttgaaagaggttggaaaaccgtttatcatggtcatcaattccgtaaggccgtatcatccggaaacagaagcgctcaggcaagaattgatggaaaagtacgacattccggtgctggcgatgagcgttgaaagcatgagggaagcggacgttctgagcgttctcagagaagcgctttacgaattccctgtgctcgaagtcaacgtcaatcttccaagctgggtgatggtattaaaagagaatcattggctcagggaaaactatcaagattccgttaaagaaaccgtcaaagatattaaaagactgagagatgtcgaccgcgtcgtcggacacttcagcgaatttgatttcatcgagcgcgcaagcctcgccggaattgaaatgggccaggggatcgcggaaatcgatttatacgcgccggattacctgtacgatgaaattttgagggaagtcgtcggcgttgaaatcagaggaaaagatcacctccttcagctcatgcaggattttgcccatgccaagaccgaatatgatcaagtctcagatgcattgaaaatggtgaaacaaaccggctatggaatcgcagctcccgcattaaccgatatgagcctggatgaaccggaaatcatcaggcagggttcaagattcggagtccggctgaaggcggtggcgccgtcgattcatatgatcaaagtcgatgtggaaagcgagtttgcgccgatcatcggaacagagaagcagagcgaagagcttgtccgctatttaatgcaggactttgaggacgatccgctgtcaatctggaattccgacatattcggaagaagcttgagctcgatcgtcagagaagggattcaggcgaagctgtcactcatgcctgaaaatgcgagatataagctgaaggagacgctggagcgcattatcaatgaaggctcaggcggcttgattgcgatcatcttataa

SEQ ID NO: 2315 - DNA, 717 bp, Bacillus licheniformis
atgaaaatcgtaaacgttctgctcgctattttattgaccgcaatcatgttaagcggttgtttgtaccctgaagaaagaaaggcgaaaaacagcgcaccgcatcagcaccagctcaaagaagtgcaggcggccgttgatgaattcagggaggcgacgggagggcttctgccgattaagacaagggatatgggcgtgccaatctatcaaaaataccctatcgattttaacaggctgtccccccggtatatggctgagccgccgggcacatcctatgaaaacggcggagagtacttgtacgttcttgtcgatgtggaaaaaaagccgacggtcaagctcattgatgtaaaaatgtcggaaatgatcagggagttaaagcttcgggtcgaaatgtataaagatcagcacaagtatccgccgtataaaaaagtcgtatccaagaacttattcatgcttgaccatgaaaagctcggactgaaagaggcgccttctgtcacgagtccgctttcgggcacctcgctgccgcttctcgtcgatgaaaaaggcgacattaaagtggattaccggatggatttggccaagctgatgaagaagtcgaaaaaaacggtaaagccgggcgaggaagtccaagatttgatgtgggaagagacgcctttcgttccggcgttttcggtaaagtacacagtgaatgacaaacaggaacctgtttttctcgaatag

SEQ ID NO: 2316 - DNA, 204 bp, Bacillus licheniformis
gtgaatgtcggtctgttaaaaatgtggtttgccttgggatcaatgggcctgatgttcttagcggtgattgccatatacataagcagatataaatttaaaaaccgttttttaaaaattatcacgtcgtttgtcgcctacacatgtatgctcatctccggcgtgatcgtcttttttgtcgtcttcagcggccccgtcaacgaataa

SEQ ID NO: 2317 - DNA, 1041 bp, Bacillus licheniformis
atgacaaaagtatcgattttgggagccggaagctggggaacagccttggcgctcgttttggcggacaaccagtacgatgtgtgcatatggggccatcgtgaagaactgattcagcaaatcaatgaacatcatgaaaacaaagattatctgccgggtgtcaaactttctgaaaacgtgcgtgccacaacagatcttgaagctgcagtggctgatgtcaagacgatcattgtcgccgttccgacaaaagcgatccgcgaagttttggcacaggctgtttccttcatcaaccaaaaggcgatttttgtacatgtttcaaaaggaattgagcctgacacactgcttcgaatttctgaaatgatgaaagaagaaattccggctgaattaagggaggacatcgtcgttctgtccggaccgagccatgcggaagaagtcggtttaaggcatccgacgacagtaacggtatctgccgacagcagcattgaatcggcccaggcgatccaggatatgtttatgaaccagaatttccgcgtgtatacgaatccggatatgatcggcgtagagatcggcggcgcgctgaaaaacgtcattgcgcttgccgcgggcattacagacggtttgggatacggagataatgcgaaagccgcgctgattacaaggggcttggcagaaatcgcccggctcggcacaaaaatgggcggaaatccgctgacattctcgggtcttactggaatcggggacttgatcgtcacctgcacaagcgtccattcacgaaattggcgagccggtaatatgctgggtaaaggcttcaagctggatgaagttctggaagaaatggggatggtcgtcgagggggtccgcacgacaaaagccgcttatcagctttcaaagaaatttgatgtaaaaatgccgatcaccgaagcactgcacaaagtattgtttgacggcgaaaaagttgagacggcagtcgaatcattgatggcaagagtcaaaacacacgagatggaagatcttgtgaacacattcgaaaatcaaatgaaatga

SEQ ID NO: 2318 - DNA, 1311 bp, Bacillus licheniformis
atgggaaaacctgtcgtagccatagttggaagacccaatgtggggaagtccacgatctttaacaggatcgcgggcgaaagaatttcgattgtggaagatacacctggcgtgacgcgggatcggatatacagctctgccgagtggctgaatcacgacttcaacctgattgatacaggcggaatcgaagtcggcgatgagccgtttttggcgcagattcgccatcaggccgagatcgccatggaagaagcagatgtgattattttcatgacgaacggccgcgaaggcgtcacagccgctgatgaagaagtggcaaaaattttataccgtacaaaaaaacccgtcgttctggcggttaataaagtggataatcctgaaatgagagcaaacatttacgatttttatgccctcggctttggcgagccgttcccgatttcatggacgcatggccttggtctcggcgatctgcttgacgcggtcagcgaacattttaaaaacatacccgagacgaagtatgaggatgaagtcgttcaattttgcctcatcggccggccgaacgtcggaaaatcctcccttgtaaacgccatgattggagaagagcgcgttatcgtcagcaatattgcgggaacgacgcgcgacgccattgacacgaggtttacatacaatcaaagagactttgtcatcgtggatacagccgggatgagaaaaaaggggaaagtgtatgaggcaactgaaaaatacagcgtcctccgagctttaaaggcgatcgaccgttcagaagtcgtctgcgtcgtcttggacggcgaagaaggcattattgagcaggacaagcggattgccggctatgcgcatgaagcaggaaaagctgttgtcatcgtcgtaaacaaatgggatgcagtcgaaaaagacgagcggacgatgaaagaatttgaagaaaaggttagagaccactttcaatttttggactacgcgcctgttttgtttatgtccgctttgactaaaaagcgcatccatacgctgatgcctgcggtcatgacggcgagcgaaaaccattcgatgagggtgcagaccaatattcttaatgatatcattatggatgcggtggctatgaacccgacgccgacgcataatggaaaccggttaaaaatttattatgcgacacaagtggctgtgaagccgccgacatttgtcgtatttgtcaatgaccctgagctgatgcatttttcttacgaacgctttttggaaaaccggatacgcgacgccttcggatttgaaggaacaccaatcaggattttcgcaagagcaagaaaataa

SEQ ID NO: 2319 - DNA, 195 bp, Bacillus licheniformis
atgagcgaatcaatcgaaaaattcattctcgccgtcgtcacaacgaggcgagacagagtgatcggcgggacggctgcatttttctgcgacacccccgaggaaatgaacacgtacgccaaaaaccttgaagccattctcgacggaatcgcccacggaataggagatgacctttatttgattgtgaaacatttttaa

SEQ ID NO: 2320 - DNA, 900 bp, Bacillus licheniformis
atgagccaatatacttatccgatcatcttgggaattgtcgcaggtattgttgtcagagtatatatgctccgaaccgactaccgccagtaccccacttatcttcatgggaaaacgatacatattgcgctggctttgatcgctgccagcattggcgcgatcattattccgtcaatcttgaaatcggattatacagcgattacgtttttaacgctggctgcaacccaattcagggatgtccggaacatggaacgggaaacattgacgcagcttgacggctatgaactcgtttcaagaggcagcacgtatatcgaaggaatcgcgatcgcctttgaaagcaggaattacattgtcatttttacatcgctcctgacgaccctcgcatacattctgttttcatcggtatgggcaggccttgctgctgctttgatctgttttatcgcgggcagaatcttaatgtccggaagctttattaaggatatcgccgatatagagtataaaaagcctcattttgaaggggccggactttatgtcgacaatatttacattatgaatatcgggcttcccgaaaagcggaagctgattttggaacacggcatggggtttattttgaagccgaaaaattttaattccgcagtaacgattgccaatctcgggcaaagacaagcgattttatttgacgtttcaaatgtgctcggcgtgtatcgagattctggagaaccctctctttcgccgcttgcgaaaagggatttgaatgacgggcgggtcgcggtttttgtccttccggtcatcaaggacaaagagacggcgatcagggtcatcggcgatgttccgacgctggaaaacgccatccgcgtaccgatggaattcattaaagaaaagcacagcaaggtgataaaatga

SEQ ID NO: 2321 - DNA, 603 bp, Bacillus licheniformis
atggaagaattctattattattggtcaatgtggtttttatgggtgctgacgacttttatcctcgagaaaaacaggtttcgcttttatgcgtcagcatttattttgctcaacatcattttaagtatgtatcaggtcaggctctttatgtattttaatgccgcctatttgtcgttttatatcggagccttcatgctgtgcggttttttgaggcttcataaaagtgtcaagcggctgctgcttcatctctcgatggtgtccgcctacggttttttgtttctgtttgcattatatgaccctgtttggtttatcctaaagcctgaatggctgatcatcatcttgtttgtcatcatgacagcagcttttgaaagaagcttcgccgtccgtctcggggtgtttgtgctcgggatgtgccagggggagctcttgtatacattcgtcatcagaaagctctatggagacattgcagcgggcggttattcatggctgtcaatgtgcgctgcggggatcgttctcgtttacggaatatcccagtatgaacagctgatgcatcaagtctatcataaattgaagcgattgaataaaggagcagcaaaaatgtcatga

SEQ ID NO: 2322 - DNA, 132 bp, Bacillus licheniformis
ttgggaaaagacagacaggaaaagaagctgaaacagcagaagcgaaccgaatcggaccgtgaccagtcgatcagctacaatggcgccgcctctctcgaaagtgcggaggacgcgcgcaagcgaaacccgtaa

SEQ ID NO: 2323 - DNA, 1056 bp, Bacillus licheniformis
atgatggtgacgcgagcaaaaagaaaaaaagaacacattgatcatgccctgtccaccggacagaaacgtcagaccgggcttgatgatatcacatttgttcacgtcagccttccggaaacggaattgtcacaagttgatacttcaaccaaaataggcgaactgtttttaagttcgcctatttttatcaatgcgatgacaggcggaggcgggaaggcgacgtttgagatcaacagggctttggcgagggcggctgcacaaacaggcataccggtcgctgtcggctcgcaaatgtccgctttgaaagatcccgatgagcgaccttcatacgagatcgtcagaaaagaaaatatgaaggggcttgtattcgccaatttggggagcgaagcgacagtggaacaggccaagcgggcggtcgacatgattgaagccgatatgcttcaaattcacctcaatgtgattcaggaaatcgtcatgcctgaaggcgaccgcaattttacaggacgcctgcgccggattgaagacatctgccggagtgtcagcgtaccagtcgccgtaaaagaggttggctttgggatgagcagggataccgcggcccggctttttaacgtcggcgttcaggcgatcgatgtcggcggtttcgggggaacgaatttttcgaaaatcgaaaatttgcgcagggataaagcagttgagtttttcgatcaatggggcatatcgacagcagccagcctggccgaagtcagttcgatatccggcgatcggccgattatcgcatccggcggcatacaagatgcccttgatttggccaaatcgatagcgctgggcgcgtctgcggctgggatggcaggctattttctcaaggtgctgacagcttcgggagaagaggcgttagccgccgaaatcgagagcctgatagaagatttcaaaagaattatgaccgtcttgggttgcaggacgattgaacagttgaaaaaagcgccgctcgtcatcaagggcgatacatatcattggctgaaagcgaggggtgttgacccctttgtttacagcatgcgttaa

SEQ ID NO: 2324 - DNA, 1149 bp, Bacillus licheniformis
atgacagaggaaatgaatcaaattgatgttcaagtaccagaggttggagatgtggtgaaaggtattgtaacgaaagttgaggacaagcatgtcgatgttgacatccccaactgcaagcaaaccggaattatcccaatcagtgaattatcaagtcttcatgttgaaaaagcatcagatgtcgtcaatgttgacgatgagcttgaattaaaagtgacaaaagtggaagacgatgcattgattttatcaaaacgtgctgttgatgcagaccgcgcttgggaagacctagagaaaaagtttgagtcaaaagaagtgtttgaagccgaagtaaaagacgtcgttaaaggcggtctggtcgtcgatatcggcgtgcgcggattcattcccgcatcgcttgtagaggcgcattttgtcgaagattttacagattataaaggaaagacgcttactttaatcgtcgttgaacttgacagagataaaaaccgcgtgattttatcacaccgtgcggttgtagaaaaagagcagtcagaaagaaaacaagaatttcttcaaacgctggaagccggacaggtgcttgaaggaaaagtacagcgcctgacagacttcggtgctttcgttgacatcggcggcattgacggtcttgttcacatctcccagctctcgcattcacacgttgaaaaaccgtcggacgtcgtcgaagaaggccaggatgtcaaagtcaaagtgctgtccgtcgaccgcgacaatgaacgaatttcgctatcgatcaaagaaacgcttcctggaccttggtccaacatcggtgaaaaggtgaagcctggagacgtattggacggaaaagttcagcgcttggtgagcttcggtgcatttgtcgaagtgcttcctggagttgaaggcctcgtccacatttcgcaaatctccaacaaacacatcggaacgcctcatgaagtgcttgaggaaggccaggacgtaaaagtgaaagtgcttgatgtcaatgaagaggaagagcgcatttctttaagcatgaaagagcttgaagaaaacaccgataaagcagagcaggaagattaccgtcagtaccaggcgaaggaagagtcttcagggttccagctcggtgaaatgatcggagacaaactgaataaattaaagtaa

SEQ ID NO: 2325 - DNA, 681 bp, Bacillus licheniformis
atggaaaagaaattatgcattgcaatagacggccctgcggcagccggaaaaagcaccgtggcgaaaatcgtggccagaaaaaagtcgtatatttatattgatacgggtgccatgtacagggcgattacgtatctagcgctggaaaagggcgttgatttaaacgacgaagcggcgctgacggccttgttaaaagaatctgccatcgatctcacggtttcgcctgaaggagagcagaaggtttatatcgcaggcgaagatgtaacagaggcgatccgcacggatagcgtgagcaaccaagtctccatcgtcgccaaatacgccgggatccgcgaagaaatgacgaaaaggcagcagcagctggctgaaaaaggcggagtcgtcatggacggccgcgacatcggaacccacgttctcccgaatgcggaagtgaaaatatttctcttggcgtccgtcgaggagcgggcaaaacgccgctttgaagaaaacgtcaaaaaagggtacaatgtaaattatgaaacgcttgcagaagaaatcaggcgccgtgacaaactcgattcagagcgcgagatttccccgttgaaaaaagcggacgatgcgcttgaaatcgacacgacttcattgacgatcgatgaagtggccgaaaaaattctgcagattgtagacaaaaaggctcaaaaataa

SEQ ID NO: 2326 - DNA, 177 bp, Bacillus licheniformis
atgaaaacaatcgaacggttattatttaagatactcgtcgtacagacggtcattttaatcagcgtgcagcttctttttcatttctccaaggctgagccttatctgtcaaaggtcgtgcagtatgaaggcgtgaacaacatgaaaatcggcgaatggatcgagacatttaagccgtaa

SEQ ID NO: 2327 - DNA, 1353 bp, Bacillus licheniformis
atgatcagaggaattttaatcgcccttttaggtgtcgccatcgtcggaacaagctattggggctataaagaacatcaggagaaagacgccgttttgcttcatgccgaaaacaactatcaaagggcatttcacgacttaacttatcaggtggatcagctgcatgataaaatcgggagcacgcttgcgatgaacagcaaaaaaacgctgtctcccgctttggcggaagtctggaaaacgacttctgaagcgcataacaatgtcagccagctgccgctgaccttaatgccgtttaacaagaccgaagagtttttggcaaaggtcggagatttcagctacaaagcagccgtgcgcgatcttgacaaagagccgctcaataaaaaagagtacgcttctttaaatcagctatatgaaaattcaaaggatatacaaaatgaactgcgtaatgtccagcatttgattattgacaaaaatttgagatggatggatgtagaacttgcgctcgcgtccggccaaaaacaaagcgacaataagattattaatggctttaaaaccgttgaaaaaagcgcaagtgcattttcggatacggatttaggcgcgacagagatgacgaacacgaaaaaagagcagcaagggtacgaccatttacaaggcaaaagaataaccgaaaaagaagcgcgcaagattgcccaaaaattcgcccaggacaaaaattacaatatcaaagtatcgaaaagcggcaagaaaacgaacagggatgtatacagcatcagtatgcaggaccctgatcaaaaagcggatatttatatggacattaccgaaaaaggcggatatccggtttatctgattcaaaacaaaaaaattaaagatgaaaaaatcagcttaaacgatgcgtcaaacaaagcccttcaatttttgaaaaaaaacggctataaaacggaagacctgaagatggatgaaagctcgcaatacgacggcgtcggggtgttttcatttgttccggtccaggacgatgtctggctctatccggacagcatccgcatcaaggtcgcgcttgacgacggcgagattaccgggtttaatgcaaaggatttcttaatctcccataaaaaaagagacttgccgaagcccaaactaacgcctgaaaaagcgaaagcaagcctgaatcccaacgtaaaagttcaggagacgcgccttgctttagtcacgaacgagctttcgcaagaagtgctctgctacgaaattctcggcacgattgaaaacgatacattccgcatgttcatcaatgccaatgacggcacggaagagaaggttcagaaaatgaaaagcgcagaaccgatatacaacgacttgtaa

SEQ ID NO: 2328 - DNA, 966 bp, Bacillus licheniformis
atgaagtcgaaaggttctttttgtttgaatgtcattttatgtaccattatggcaaccagtctttcacttccattcagtcaaaaaagcgctgccttttctgaacaggtaatacagcggggggcgacaggggatgatgtgattgaactgcaggcaagacttcaatacaatggctattacaatggcagaattgacggagtatacgggtgggcgacatactgggccgtccgcaatttccaaaatcagttcggcttaagggatacagacggcctggtcgggccgaaaacaaaacgattattaatcaatcatactaaatattacagcgactacgtgcacagacagcttcgaaaaggaaaccaatttacacattacggcgggctgccgctgaagtatcagacgaagccttcaaaagaagtgcagcagcaggcgagaaaaaaggcggaagcaagacagcggcagggcgcacaacagcagggtaccgcccaaaaacagccgcagcaaaagcagcaggccgctcctgcacagccgaaaaaacaagcacagccaaaggctgcacctaaacaagccgcgcctaaaaaacaggatgccgttgcagccaatatgccgggcggattctcgaacaacgacattaatctgttggcccaagcggtttacggtgaagcgcgcggagaaccgtatgacggccaggttgccgttgcagctgttatattaaacaggctcgatagccctacgttcccgaatacggtggcgggcgttatctttgaaccgcttgcatttacagctgtcgcggacggacagatttatatgacgccggatgaaacggcgaaaaaagccgttcttgacgccatcaacggctgggatccatcagaaaatgccacttactattttaaccctgacacggccactagctcatggatttggggcagacctcaaattaaaaggatcggtaaacacattttctgtgaataa

SEQ ID NO: 2329 - DNA, 471 bp, Bacillus licheniformis
atgttcggaattatctcagcaggcctagctcccggaatcgcactgttaatgtatttttacttaaaggaaaaatatgaatccgagcccattcatatggtcatccgcctctttatactgggggttttgctcgtttttccgacgatgttcatccagtatgtattggaaaaagaacacatttctgagggcagttttgtcgtttcgtttttaacttccggctttttggaagaatttttaaaatggtttttgctgatggtcagcacctttcagcatatcgactttgatgaacactatgacggaatcgtatacgggacaagcctttcattggggtttgcgacgcttgaaaatatattgtacctcatcggaaacggggtggagtacgcctttatgcgcgctttgcttccggtttccagccatgctttattcggagtgatccatgggcttttacttccgcaaagcccgtttttcggatag

SEQ ID NO: 2330 - DNA, 969 bp, Bacillus licheniformis
atgaataaaaaagtagctctcattacaacgggaggaacgatcgccagccggaaaaccgaaagcggccggcttgcggcaggggcgatcagcggccctgaattagccgaaatgtgcagcctgccggaagatgtacagatcgatgtctacccggcgtttcagcttccaagtatgcatataacatttcagcatttattagagctcaagcaaaccatcgaacgcgtgtttcaggacggcggctatgacggcgcggttgtaacgcatggtacggacacgcttgaagaaaccgcctattttttggatttaacaatagaggatgagaggccggtcgttgtcacaggttcacagcgagcaccggaacagcaaggcacagatgcatatacaaatatcaggcatgccgtatatacagcttgcagtccggatataaaaggagccggcacggttgttgtttttaacgaaaggatctttaacgcgcgctacgttaaaaaagtgcacgcttcgaatctgcagggttttgacgtattcggtttcggctacttagggatcattgataacgacaaagtatacgtttatcaaaagccgttaaagcgggatgttcaccagctgcaaaggccgcttcctgcagtggacatcgtcaaatgctatcttgatggagacggcaagtttatcagagccgccgtccgcgagggtgtcgaagggatcgtccttgagggagtcggaagggggcaggtgccgccgaatatgatggctgatatcgaacaagctttaaatcagggcgtttatatcgtcatcacgacgagcgcagaggaaggcgaagtttatacgacctatgactatgcaggcagcagctatgacctcgcgaaaaaaggggtcattttaggcaaggattatgacagcaaaaaagcgagaatgaaactcgccgtccttcttgcaagctataaagaaggcataaaagacaaattctgctattag

SEQ ID NO: 2331 - DNA, 996 bp, Bacillus licheniformis
ttgccggatatgacaggagatgaacggaacatgaaagaagaaaaagtgatcattatcggcggcggcccctgcgggctttcagcagctattcacatgcaagagatcggaatagatgcactcgtcattgagaaaggaaacatcgtcaacagcatttatcaatatcctactcaccaaacctttttcagctcaagcgaaaaactggagattggcgatgtggcttttattactgaaaatcacaagccggtcagaaatcaggcgctttcttattacagggaagtcgccaaacgaaaaaatctacggatcaacgcgtttgagaaagttcaatccgtaacaaaaacagagaataaccaatttatcgtggaaacatcaaaggacacgtatttgtcttctttttgcattgtcgcaacgggatattatgacaatccgaactatatgaatgtaccgggagaagaccttccaaaagtatttcattattttaaagaggctcatccgtactttgataaagatgttgcagttatcgggggcaaaaactcaagcgtcgacgcggcaatggagctcgttaaggcgggcgcaagagtgaccgtattgtacagagggaacgaatattcctccagcatcaaaccgtggatccttccggaattcctttcgcttgtcaagcacggaaaaatcagaatggaattccgggcggtcgtcaaagaaattacggaagacgagctgattttttctgtcgacggaaaagaaaccaggatcaaaaatgattttgtatttgccatgaccggctatcatccagatcatagctttcttcaaaaaatgggagtcaaaatcgacgcagagtcgggccgtcctttctttaatgaagaaacgatggagacgaacgaagaaggcatctttatcgccggcgttattgcggccgggaacaacgcaaatgaaatctttattgaaaacggccgttttcacggcggcttaatcgcagctgaaattgctaaacggatataa

SEQ ID NO: 2332 - DNA, 1275 bp, Bacillus licheniformis
atggtagccgatcaaaacaccggtcatactgaagaaaacacacatgacgttttgaaatcaacgcaaacggtgatacataaggcgcttgaaaaattgggatatcctgaagaggtgtatgaattactaaaagaaccgattcgttttttaacggtgaaaattccggttcgcatggacgatggatctgttaagattttcacgggctaccgagcccagcacaatgatgcagtagggccgacaaaaggcggcatccgttttcatccgggagttacagaaaaagaagttaaagcgctttctatttggatgagtctgaaatgcggcatcatcgaccttccatatggaggcggaaagggcgggatcatctgtgatccgcgggatatgtcctttcctgaactggaacgtttaagcagagggtacgttcgggcgatcagccaaattgtcggaccgacaaaagacgtaccggctcccgatgtatttaccaattctcaaatcatggcatggatgatggacgaatattcaagaatcgacgaattcaactcgccgggcttcattaccggcaaaccgctcgttttaggtggttctcacggcagagaatctgcgacagcaaaaggggttacaatctgcattaaagaggcggcgaaaaagaaaaacatcgacattgagggagcttctgtcgtcgtgcaggggttcggaaatgcgggaagctaccttgcgaaattcatgtatgacgcaggtgcaaaggttgtcggcatttctgatgcatacggcggcctgtacgatcctgaagggcttgacatcgattacctgcttgaccgccgagacagcttcggaacggtcacaaagctgtttaatgacaccattacaaacaaagaactgctggagctggagtgcgacattcttgtgccggctgccatagaaaatcaaattaccgcggaaaacgcccataacatcaaggcgaaaatcgttgtcgaagctgccaacggcccgacgacgctcgaagcgacgaaaattctttccgaccgcgacattcttcttgtaccggacgtgctggcaagcgccggcggtgtaacggtatcctattttgagtgggtgcaaaacaaccagggattctactggactgaagaagaagttgaagaacgtttggaaaaaatgatggtcaaatcgttcaacaacatttatgaaatggcgcacaaccgcagaattgacatgaggcttgcagcctatatggtgggcgtccgcaagatggcggaagcatcccgcttcagaggctggatatag

SEQ ID NO: 2333 - DNA, 585 bp, Bacillus licheniformis
atgcggcttgagcgtctaaattataataagatcaaaatctttctgacacttgacgatctgacagaccgggggctgacgaaagaagacctttggaaagactcatttaaagttcagcagctgtttaaggacatgatgaacgaagcgaatacagagctcgggttcgaagcgaatggcccaatcgctgttgaagtgtattctcttcaagcacaaggaatggtcatcattgtcacaaaaaatcaggaaacagatgaagacgataatgagtatgatgaggactatattgaaatgcaagtcaaacttggcgaaagtgttgacattatatatgaatttcaaacgtttgagcatctgattgaactttccaaaaatctggaccgcatcggtattcaaggcgggacagtctaccactatgagggcaggtatttcttaagtctcgacgattttgactcccttgaggttgacggcgtgatttcgattttagccgaatatgggaatccgacgactttaacgatttacaggcttcaggaatacggaaagaaaatcatggagaacaatgccgttcagaccattcagacatactttaaatag

SEQ ID NO: 2334 - DNA, 786 bp, Bacillus licheniformis
atgatctattggctcagtctggcttcggccgctttcatcggccttgctgctttagtgtggaaaatgtcagccatcgcgcgcgaaaaccgggtgttgaaggctgaattttcactcgggcgcctgaaaaaggaattgaatgtcttttttatttcagatattcataggcggacagtcagcgaagacattatttgtgaagtgaaagaacgcggggttcagctcgtcatcatcggcggcgacttagcagagggcggcgtcccttatacgagaattgaagaaaatatcaaaaggctttcaagtttgggaaaaacgtattttgtatggggaaataacgattatgaagttgatcaggaaaggctgctggaaatattcaagacatacggtgtaacgcctttgcgcaatgcttcggtattgcatgaccatcaaggacaaactgtcaatatttgcggagtggatgacatcagactcgaattggatgattacccggcagctctcggcggcgtgcagccgggttttccgactgtccttgtgtcacataatccggagattcatcatcaaatacaggaggcggacggtattgacctgatattgagcggtcatacccacggaggacagattcgcttcggcagattcgggctctgtgaaatcggaggaaccggcactgttttcaaggctccgtacttgatcagcaacggctatggaacgtcgaagcttcctctgcggctcggagcgaggccggaaacccatctgatcaatctggttccgggcccccgtatggaaggaaactga

SEQ ID NO: 2335 - DNA, 444 bp, Bacillus licheniformis
gtgggaagcgagcttgaagagctggaccgttttacggacgaaccgacgaaacaaatgctccgcgccttaattaaaaggaagaaaaagtacgaaaactatgccagacagacattcaggtggcaggcggtggcggcgatatgcgcggtttcgttttgtgtgtttgcagcgtcaaaggggattgggcaaaacggcttcctttccggcttgctgaatgactccgtctatctgctgtggatcttgtcggccgcttttgcatacagcaccgcttactattttaaaaagaaggaagaaaaagcagaaggggaatatcataagctgagatgcgagattattcagaaaagcacggatctatggccccagcctgaagagtggaaatcaagggaaacggtttttaagatcatgaaacagcagtatgacattaatctttatttcgaaagcaaataa

SEQ ID NO: 2336 - DNA, 780 bp, Bacillus licheniformis
atgacggagatgtcaagaatagagaggaagaagagggaacaggagaaggccagcgctgaaatgaaccgggaggcggccgcggctgttgaactggagacacttgatgaggagattccttccagacggacttatcataaaaaaaagaagtccagcaaaaaaaagaataaagacagaaatccactattcacgtctcttgcagtcatgtttgttttcattccgatcatcgtcttcgtggtgttcatgtacatgctgaatcaaggaggcgataccgaccctgatcaatatgataatgtgttttatgaaaacaaaggtgaaacgggaatgacgaatgaaaatcaaaacggtgaacaagaagcggatcaaaaggcggcttcgcagcatacagccgccgcccttcaagaagaaaagctgaaagagagcaaacagccggaaaataaagaggatgaaccgtccaaaaaagacgagcaaaagcaaaaagagcggcctaaagaggcaaaaaaagcagatgagcagcctgtcgctgcaaagaagcccgccgcatcgaagcagcctgcggaacaagagaagaaaacggcaaacgcgcctcaaacgccgccagttcagcaagcaccgcagcccaaaaaggtgctgaagcacacggttggcgaaaaagagacgcttttccggatttcgatgaaatattataagaaccggtcaggagaggaaaaaatccgcaactacaatcaattatcaggcaacaatgtctacgccggccaggtcctggatatcccgatttattaa

SEQ ID NO: 2337 - DNA, 645 bp, Bacillus licheniformis
atgctgaaaaaacagtcggaaatcatacgtcgcctgtcagacggggaaatgctgaaacagctctatttttcccagacgctgatgctttttaccgcattattgatgggcatctttttatttgatgatgcagacgcttttctatcgctttggaatccatcggacttgagcatcctgaagtacggggcgccgctcgcggctctcgtgatcatcgccgacctgatggtgatgaaatgggctcccaagcatatgtatgacgatgaagggataaatgaaaagctctttcgtgaacgctcgtatccgcatatcgtgattcttacccttttcattgcatttgcagaggaaatattgttcaggggcgttatccagacgcatttcggtctctgggcggcgagcattattttcgcgatattgcattttcgttatttaaaaaaatggctgctgtttgtaatggtggtgtccatcagctttttgctcggattgagctttgaacggacagggaatttatttgttcctgtcacggcacattttttgatcgatgttgtatttgcgtgccagattcgttttcaacacgtaaggaggagttcacatgacggagatgtcaagaatagagaggaagaagagggaacaggagaaggccagcgctga

SEQ ID NO: 2338 - DNA, 1496 bp, Bacillus licheniformis
atggataaacttcatcaggcgctccgcaggtattttggttatcatgcttttaaaaaaggccaggaaacgatcatcaaaagcgtgctggagggacgggacacggtggcgatgcttccgacaggaggcgggaaatcgctgtgctatcagctcccagggcttttgttagacggcaccgtcctgatcgtctcgccgcttttgtctttaatggaagaccaggtgcagcaattgaagatgcgcggagagaagagagctgccgccttgaacagcgctttgacacaccaagaaaaaaatgacgtattaaaccggcttcaccgcctcaaatatctgtacatttcaccagaagcgcttcagtccggccaaatgctgaaaaagcttcaattgctcaatgtcagcctttttgtcgttgatgaagcccactgcatctcacaatgggggcatgatttcaggcctgattattcgaagcttggagacatcaaggcgctcctcggtcatcccgtcactctggcgcttacagcaacggcaaccgaagcgacattaaaggacatttcggaaatcctggggcttaaagccgccaattatttgattcattcggtcgaccgtccgaacattgcgcttcatattgaaaagctgagggatactgctgagaagacggagcggctgacagggctggttcaaaagctgcaaggtcctggccttgtttattgcccgacgagaaaatgggctgaagaactggctgacaagctccgtaaagaagcaaacttgagaacgggattttatcatggcgggatggagcaagcgacaggatgctgatccagcagcagtttatccgcaatcagcttgatgtggtctgctgtacaaacgccttcggtatgggagtggacaagccggatatcagatatgtgatccactttagcctcccgcagacgattgaggcgtatctgcaggaaatcggacgtgccggcagggatggaaagcggagcgtcagcattttgctgaaggctccgggagacgaggaaatccaggagcagctgattcaaatggaagccctctcccaaagcgatatcggctttttatacgaaaagcttgcaggagtgaaagatgaacgctgccggcgggaagctctgcagctggccggtttatcggaaacgcaagcccgccattttctccatctttatgagaaggtgcatcatctgggcggcgatggccgggcggtcattcagagggagatggacagccgcaggcagctcaaattgaaaaaagcggcgggattcgccgccgtcaccgaaacagaagggtgtttcagggaaagcttgctcgcttattttaatgaacaaaaaaagccgccgaaaacggatgaaacagcgtgctgcacatcctgcggtttaagtcttgaagcatacgaagtcaaaggagaccgtccgtctatgaacaaattgacagcgtgggaagaagaattggataccatatttgccgccagctgtgatcgtgtatgctga

SEQ ID NO: 2339 - DNA, 1059 bp, Bacillus licheniformis
atgccggttcatttttttgacgcgattgtgcttgacattctgtcatccatgaagggtgagcgttctccaagcgcggtctatcatttattaaaaggaaaaaggtcgtcacagacgatacaggacgccggtttatttgccgtttcaaaatacttcggcttttgttcggctctgtcgagagagcaggtggcagccagcgttcaacgattgaagcaggagtctttggtcagagaaaaagcggaaagcggcgcttacaccgtcaccgaaaaaggagaagcggaacttgccggcttttttgccctttatccgtggccccgccattttcacggcggctattatcaggcggcagccaaagtgatgtgggcaaggatgtcgcttttgatccaagtgctctccaacaagctttaccgcgaacgcgtgtatttgccgatcgtaaaagattatcagattcagaactgggttaaacagtatttaagaaaccggaatgctgctgaaacagcggcccagtttcaccaagagctgaaagagaagctgtctgttttaaatcatgatgaacaggccgctatttttgttcactccctgacatccagaacaaaagcgggctatacattcagacagctttccgaaaaaatgaaccttgatgagtggtacatatatgcactgttttgggatgttctgcaccattttattcaatccgcccaaaatggtgaaagtccgctttttcaaacgctcattcatgacattcctttgaatgatggtctgacacaatcgacgagaaaaacgctctttcttataaaagaagggtatacaatagaccggatcgcaaaaattagaaagctgaaattggcgacgatcgaggatcacattgtggaaatcgccattcatgatccgtctttttccatcgatcagtacgtgtcgaaagaggaacagaaaattattgccgattatgcgatagcgaaccaaaccaataaaatcagacaaattaaagagggactcggcggccgatacagttattttaaaatccgcctggccctgtcgaaaacggtgatcaggaatggataa

SEQ ID NO: 2340 - DNA, 249 bp, Bacillus licheniformis
atgccaaaatatacaattgtagacaaagatacgtgcatcgcatgcggagcttgtggtgctgcggctcctgatatttatgattacgacgatgagggaatcgcatttgtcacccttgacgacaatcagggtgtcgtcgaagtccctgacgtcttagaagaagacatgatggacgcgtttgaaggctgtcctacagattcgatcaaagttgcggatgagccgttcgaaggcgacccgcttaaacacgaataa

SEQ ID NO: 2341 - DNA, 579 bp, Bacillus licheniformis
atgaaacacaacaaggtgagacgtctcgtctctatcagcatgctgagcagcatcgcatttattttaatgatgctgagctttccgatcctgggggcattcccgtatttaaaaatcgatttcagtgatatcccggcattgctcgctgttattttgtacggtccgggagccgggattgccgttgaagcgatcaaaaacgtgctgaattactttattgcaggaagcgcctcgggcgttccgattgatcaggcggctaacttcattgccggaacattgtttatcctgccggcagctgtactgctgaaaaaatcaagttctgccaaagggtttgtcacagctcttttcgcagggacgcttgtgatggccgtttcgatgagcattttaaattatctgctgtttctgcctgcctacacttggtttttaaatgctccagcgctgactggagaggcgctcaagacaacagttctggccggaatcctgccttttaatttcattaaaggcatcgctgtggccctcgtgtccacgccgattttcctttcgctgaaaccgcggctgaaggaaaacgtccgcatggccaaataa

SEQ ID NO: 2342 - DNA, 129 bp, Bacillus licheniformis
gtgaaattccctaccggcggtgatgagcaagcgctctaagcccgcgagcctttttatgggcaggattcggtgcgattccgaagccgacagtatagtctggatgggagaagatggaggttccgcgcgttt

SEQ ID NO: 2343 - DNA, 1578 bp, Bacillus licheniformis
atgtttcgagtattggtctcagataaaatgtccagcgacggcctcaaaccattaatggaagcagattttattgaaattgtagaaaagaatgttgcggaagcggaagacgagcttcatacgtttgacgcgctcttggtgcggagcgccacgaaggtaaccgaagagctgtttaaaaagatgacttcgctgaaaatcgtcgccagagcaggtgtcggcgtcgacaatatcgatattgacgaggcgacaaaacacggtgttatcgtcgtaaacgcgccaaacgggaatacaatttcaaccgctgaacatacctttgcaatgttttcagcgttaatgagacatattccgcaggcaaacatctccgtgaaatcaagggagtggaatcgttcggcttacgtcggttcagagctttacggaaaaacgctcggcatcatcggaatgggccgcatcggaagcgaaatcgcgagccgcgcaaaagcattcggtatgaccgttcatgtatttgacccgttcctgacccaagaaagggcaagcaagctcggcgttaacgcgaacagctttgaagaagttctggcatgcgccgacatcattacggttcataccccgctcacgaaagaaacgaagggacttttgaacaaagaaaccatcgcaaaaacgaaaaaaggcgttcgtctcgttaactgtgcaagaggcggcatcatcgatgaagcagcgcttttggaagctctggaaagcggacatgtcgctggcgctgccttggatgtattcgaagtcgagcctccggtcgattcaaaactgatcgatcatccgcttgtagtcgcgactcctcacttgggcgcctcaacaaaagaagcccagctgaatgtcgctgcacaagtgtccgaagaagtccttcagtatgcgcaaggaaaccctgtgatgtccgcgatcaaccttccggccatgacaaaggattcattcgaaaaaatccagccttatcatcagtttgccaatacgatcggaaaccttgtgtctcagtgcatgaatgagcctgttcaagatgtagccatccaatatgaaggctccatcgccaaacttgaaacgtcatttattacgaaaagccttttggccggatttctgaagccgagggtcgcggctaccgttaacgaagtgaatgccggcaccgttgcgaaagagcgcggcatcagcttcagcgaaaaaatttcttccaatgagtcaggctatgaaaactgcatctctgtgactgtcacgggagatgtaacaacattctctttaagagcgacgtacattccgcacttcggcggacgcatcgttgccttaaacggctttgatattgatttttatccggctggacaccttgtctacattcaccaccaggataaaccaggggctatcggccatgtcggacgaattttaggagaccatgacatcaatatcgccactatgcaggtaggccgaaaagaaaaaggcggagaagcgatcatgatgctttcctttgaccgccaccttgaggacgatattttagctgagctgaaaaacatcccggatatcgtgtctgttaaagccatcgaccttccttaa

SEQ ID NO: 2344 - DNA, 825 bp, Bacillus licheniformis
ttgaagaaactcagacatcaaaacttcctgttcgcgatcgcatggctttcgggattggcgcttttcgtcaatgccccggggtcggaagcctcagagtggattgaaccgattaaaggagagatcacagatcaattcggtacgagaggcggaaagcataaggggcttgacatcgctgctcccgaaggggaagcagtagcggcagccgcagacggaacgataagcaaatcgtatcaatccgactcctacggccaagtgatatttattaaacatgacaacggatatgaaaccgtttatgcccacttaagcaaacgcctgaaaaaggaaaaggagcgggtgaaaaaaggcgagcaaatcggaatcatcggcattacgggaatatcgaccggaacccacctgcattttgaaatgcatcacggttcatggactgaagataaaagatatgcaatcaatccgctgacggtgcttcgtgaggaggcgttccggcaaaattctatccacgttcatcaaaacgccgggacaatgagcggtgcggtgaccgttcaaaaaggggacacgctctggagaatcagcaaggatagcggtatatccatcgaggagatcatgagaataaacgggttgaaacattcaaatctcaaggccggccaaacactccgccttcatgacgatgaatcgaagaccggtacatatgtagtgcggaaaggggatacgcttcatcatatcgccgaaaaaatgggcgtaactgtacagcgcctcaaagaatggaacgatttgaaaggagagcggatttatccccgccagatgcttgagatcagggagaattcctaa

SEQ ID NO: 2345 - DNA, 1107 bp, Bacillus licheniformis
atgaagaagtcagaatggaacgaagaacggctgaaggcgttactaagccaacttccaacggttaaggataatcgttcggcaaatcagatctatcaaaagctgattctcgcaccaaagcgtaaatcaccgaaaaaacgggtcggcgcatttgctgctacagttttggttctctttcttctgatgctgatcactccccagttaatcgaacagatcagatctcaaaacagcgccgacgccaacatttcttctgacggaaaattggtgcagacggaggctgatgctgccaagtctgaacctgcaaatacgtttgtcgtctcacagaatcaaaaagacgactatatcaccttcgctttccttgacgagtccaagtctgtcgttgtcccggtaagcctcgagaaaagcactggcatgacaaatcttgaagatgcgcttcacgcttacagccggcttggagtggaccagtttacatcatttgacacagcttaccttgataaggtgaagttcaaagagcagaaaaacaataaaaaactgaagattcaagttgatgagaaaataccggagctatcagtcgaagatttcgaacggctgaaaaatgtgatcaacgaaacctttaaatggggatcgtatgattctgttctgtttatttccaatgataaatcgggtgttgaatttgaaacattcggaatgctcgccgatatggcgattatgcaccagacgcaaaaatgctactatttatatgaaagctcagacgggcgccggttccttgcaccttcaagcgaatcttacgaatcggtgcaggaagcgattaagatgatgaaaaacgaagaaagcggcactcatttaaaacccattttatccgatgatacgccgattgaagatattcaaaagaatggaaaagaactgatcattcaattttcttcctccgcgaatattgaaaataaacccgaagatgtcttgatggtggaaggccttctattgaccgcgaaagatttcggcttcacaaaagtgaaatttaaaaacgcatccataaccaaggtcggcgcctatgacctgtcgaaatctgtacaggttccgtacgcaccgaatccgatgacgatagaaaactaa

SEQ ID NO: 2346 - DNA, 585 bp, Bacillus licheniformis
gtggaagaaacctttcagaaaatatatgatcagtatcatcaggatttatttcagtttttattttatatggtaaaagacaaaaatcaggcggaagacttagttcaggaagtatacatccgcgtcctgcattcttacgaaacatttgaaggcaggagcagcgaaaaaacctggcttctttcgattgcgcggcacgttgcgatcgactggttcagaaagcagcagacgatccgccagcggattttggggacgtttgactgggagaaacaagatgtaaaagaccgcaagcctctgcctgaggacatcgtgatgcaaaatgaaaacctaaaggaaattttcgaggccctagacaagtgtacgcttgaccaaagatcagttatcgtcttgcgttttattcaaggatattcgatcagtgaaacagcaaaagccttgaatttttccgaaagcaaggtaaaaaccactcagcaccgcggtctgaaagtgcttcgtaaacagatggagcttttgaaggaggatccaaagaatgaagaagtcagaatggaacgaagaacggctgaaggcgttactaagccaacttccaacggttaa

SEQ ID NO: 2347 - DNA, 915 bp, Bacillus licheniformis
atggtaaaaatgagaaaaggaaaactaaagatgaaaaatgtgatattgtttgtcctcgcgctagtgataacgatcggcagtgtggtgtcatacgggatttaccgtacagtcgccaaatcaataaatggaatgtacgaacctcttcatcgggatgccgagcagaaggatactgctccgcacgatcctatatccattcttttattggggatagatgagcgccccggtgataaaggacgcccggattctatgattgtaatgactgttaacccgaagacaaagaaaacgacaatgaccagtattccgcgtgatacaagggtgtttatcaaatcaaaaaataaattttcgaaaatgaattcggcttatacgtatggcggaattgaaggaaccgttgaaactgtagaacaatttttgaacattccaatcaattattatatcaaaatcaatatggatgggtttaaagatatagtagatgcgattggcggcgtaacggtggataatcggattgatttcacccttgaaggcgtgcatctgtcaaaagggaagcagcatcttgacggcaaaacagcattgacatatgcccggatgagaaaagacgatccccgcggtgattttgggcgtcaagagcgtcagcgtgagattatcaacgaaattattcatgaaggtgcacaattaaaatcattaacaaactatcaggagattttggcagcattagaaaaaaacatcaaaacaaacttaacactggacaagatgatcgatattcaaagttcttataaagaagctgctaaagatattaagcaggtagaaattgaaggtgaagacaaaaaagttgacagcttatggtatcacctagtgactgacgaaaagagaatggagatttccaaaaagcttcgccaacaattggacttaaagtcataa

SEQ ID NO: 2348 - DNA, 831 bp, Bacillus licheniformis
gtgtcaaattcaccaaaagaagatcataaattgagcgcactaggaaaattagtgctaggtatgttgattgtattcggtgtgactttgttatgcatttcttggaatgcgcttgccggcccaaagcaggaaccgataaaagaaaattccgcggcttcagcatcggtgccgggaggcaaacataaagcagagaaaaaagaaagtaagcaaacagcgccggaaatcggaaaggtcgtctatttgtcatttgatgacggtccgaatcctgcggcttcagataaaatcttaagtttgctcgataagtatcatgcgaaagctacatttttcatgttaaaaccgaatattgaacaaaatcccgatattgtgaagaaaatggttgaaaacggccattctgtcggctctcacggagtgacgcatcaagtatcgaaaatctataaatctcctgaaagcttcgcggcagaaatgaatgatacgcttaaagccatcaaagaaacgaccaacgttgacacacatttgatcagatcgccttacggatcaaagccctatatcaccggtccatttcaagaagtaattaagcgcgaccattttaacctttgggactggactgttgattcagaggactggaaatctgcaaatacaaacggtcaattcgtgaataatgtgattcagcaagtcaataacctttccggtgttgagccgctagttgtattgatgcatgaaaaaccgacaactgcggcccatttagagaaactattgaaatacttccaagaaaacggatatgaaatgaagcccattcatgattcgataaaaccggttcatttcagatggaattaa

SEQ ID NO: 2349 - DNA, 1131 bp, Bacillus licheniformis
atgaaaaacaaaccgtttattatatgggcaggagtgctgctgtttctgatcattatcgtgtccagttataatgtcggaaaaagatcggaaacgattattatcccaagcggggaagaaaatcatatctatgaccagaagacccgcccttttcaagtcaatacgatctatcgtcttccaaaagtcgggcagctgctcgggtggtcttcaccggattccgttgtcggttttttcaagggagaagggacatccgaacgtacagcgcacagtcttcagcgcctttcctccccctatgaaaaagctgaaatcgtaaaaggcattgaaagcaacacgtccaacctaaaaatgtctccagacggaaagcgtatcgccggagtcactttgtcattaagtaaggcatcaatgcagctgttttcgccggcgagcgggaaaaaaacagaaatcgccagcacctccgccagcagtgaggtctatgtccaagatgtttcatggtcaaataatagcagatacgtttgctatcttgttttagatgtcgggcagggggatgagaccggccttcgtgtttatgatacggcttccggaacgcttaaaacgtattcattgaatgattttgcggagaaggattcgcttaccggagttaacatctccgataatggacgagatttgctgtttaccgtgttgcagcgttccgacgagtacgggatcagaatgggaaccattgacggcagccgcattaaaatcgaggacaagcgtctggacagccgcggcgggcctgtttggttaaacaatgatcaatttgtattcctggacaccggggaaaccctgtgcgaatatgatcgcagaaacggagagctttctgctctgctcgataaagtaactgtttttaaattctcaaacgactttaagaaaatcgcttactctttaaaggatgaagacaatatctatgcaggtaagcttcaggggaaaaatatcctctatgaagaaccgatataccacggcaccatcccttcggaaatattttggagtccggacggcaacagcctgcttgttaacgctcaataccagtaccctgccatggagagtgcatccgtgcgatttttagaagagcaagcttatatcatcacatttaaataa

SEQ ID NO: 2350 - DNA, 1452 bp, Bacillus licheniformis
gtgttacggaccatcaagggcaagtttattgttggcttttttctgattttttctctctctttccttgtgctcaatcacacggttaagaacgtcatttggtcgagtaacgaaaaaattgtaacatcggatttagtcgaactgaaaaaaaacagtaccgtctatgtaaaccaagcatttttaatcaatcactataaaaacaatgaactttatttcggtgatatggccgatgaaatggtagataatttaaatcactccacaggaagcaatgtcggtgtttatacagtagatggcgcattgttgtcttcttctgatcagaaggtgttttccagagggagtgatgaagatcttcaacaggcgatcaaaggaaagactgcctatcatatcacctataaccggaataaagcaaaagtgtttttctcatatccggttgtcattgaaggcacaaaagtaggcatattacgcttttcgaaaaatttcgacctgctgtataagcagagcggagagattctggatattgttttttatatcgcgcttgcaatatttgtggcggcgttccttttctcctatatcctgtccagacatatcacgattccgctcgtcaagctgacagatgccacctcacaagtcaagaagggtaagctggatatggatatccactttaatagaaaagatgagattggccagcttgccgtcaactttaacgatatgatcagcaggattcgggaacaaattttaaccatcgaaagggatcgcgaccgtctaaaagaacttaacgaacaagaaaaacggttttttgataatatgacgcatgagctgaaaacacctctgacttccatccaaggatatgctgagatcataaaagataaaggggaagcggaccggaaattttttgataaaggaatgaaccacattgtcgaagaaagccggcgcctgcataatttggtgatcaagcttcttgaagtatcccgggaaacgtccaagagtgctcaatttgacaggatcgacgcaggcgaaattttaaaagatgtttgcgagtcgatgaaatttcgggcagaacggtataagaaaaggatcacctgtgacattgaagatggcctgtacgttcttggtgaggtgagcaggctgcgccagctttttatcaatctgctggacaacgccatcaaatacagcttatctcattcggaaatcatcattaaggccgaaatcgttggagaaaacattctttttacattcaagaatccaagcgatccattggaaaatgaccaacacaccaaaatgttccaacctttttattcagtcaatcagaagattaaggaagaaggaagtgtaggtttgggattaagcattgtgaaaacaattgttgacgaacacggaggaacaatcgagatgttctacaaagaaaaccacacagtgattcaagttgaattagcttacgcaaaggttgagaaatga

SEQ ID NO: 2351 - DNA, 702 bp, Bacillus licheniformis
atggaaaaaacaaaaatactgattattgaagatgatgaagcaattgctgatttgctttcatacgggctgacgtccgaaggctttgaaacgtgcacggtcaataacggttcttcaggaatgaggaaactagatcagttcaaacctgaccttctgctcctcgattggatgctgccggactgcagcggattggatatttgcaaaaaagtgaccgaaagctgtaatattccaatactgatgattaccgcaaaatcagatatcacggataaaatactggggttggaattcggggccgatgactatattacaaagccgtttgatctgcgcgaagttgtcgcgagaatacgcacgatccttcggcgtctggaacaagcccatcatgtgaacgaacgggaaacggaaaaagtggatgagatccggtttaaaaatattgtgatcgttccgggcgaaagactggtgaaaaaagacggggcagccgtcgaattaactcctaaagaatatgatctgctaatgactttggttgaccatcggggaaaagtttttacccgttcagagcttttggaattcatctggggatacgattttttcggtgacacccgtacagtcgatacccatattcaaagactccgcaaaaagcttgatgcaagcgacttgattaaaacagtgttcggcatcggatataaattcgagaagcaggaggagtag

SEQ ID NO: 2352 - DNA, 1782 bp, Bacillus licheniformis
atgaagttttggaagagcgtagtcggtaaactgtggtttaccatactgcttttggtttcatttgtcttatttatccttacgttctttctgctcgagtttattgaaaactaccatgtagatgaagcggaagctgatttgacaaagctcgccagcaaggtggccgtcatcatggaaaaccataaagaccaggagacagccagatcgattacatgggagcttgccgatgaactgacgagcatcgccgtcatcaaaaatgagaatgaatattggtattcaccgcgggaacatcaaaaagtggcttccatcacattaaaagatattaaaaacgatccagatctgaacgaagcgcttcgcaagcatcaaaaagtgcagaagaggacggttatctccaatcaaaagaacgatcagctgattgtcggcgtaccctacgggaaaggcgaagatgaaggcatggtgtttctttctcaatcgcttcttgccgtcaaggatacgacacagcatacgacgaggtatatcctctttgccgctgcgattgcgattgtgttaacgacgattttcgctttcttcctctcaagccggattacctacccgctcagaaaaatgcggcagggtgcccaggacttggcgaaagggaagtttgatacgaagattccgattctgacccaggatgaaatcggcgagctggcgattgcctttaaccaaatggggcgccagctgaagtttcacattacggcactcaatcaggaaaaggagcatttgtcgaatatcttaagcagtatggccgacggcgtgatcaccattaatatcgacgggacaatccttgtgacaaaccctccggctgaacgctttttacaggcttggtattatgagcagaacatgaatgtaaaagaaggccatgaactgcctcccgaagcgcgagagctttttcaaaacaccgtcagcacggagaaagagcagatgattgaaatgaccctgcaaggcagaacatgggtgctgctcatgagtccgctgtacaatcagtcccatgtacgcggagcggttgccgtgttgagggatatgacggaggaaagacggcttgataagctgagaaaagattttatcgccaatgtcagccatgagctgagaacaccgatttcgatgcttcaagggtacagtgaagcgatcgttgacgacatcgcaagctctgaggaagaaaaaaaggaaatcgcccaggtcatctatgacgagtctttaagaatgggaaggcttgtgaatgatttgctggaccttgccagaatggaggcggggcatatttccttaaacgttgaaccggtggagctccgcgagttttttgagagagtgttcagaaagttttacggagtggccggggacaaaaatattacgctttctcacaatcttgatctgcatgaagcaaaatttgtgtttgatccggacaaaatggagcaggttttaaccaacctgattgacaacgcgatccgccatacaaatgccgggggcaccgttcatgtcgatgtgcagtctgctgaaagcgggctgaagattgccgtgaaagactccggcagcgggattcccgaagaggatctgccgtttatttttgaacgtttttataaggccgataaagcaaggacgagaggaaaaggcgggactggcctcgggcttgcgatcgtcaaaaacatcgtcgatgcacacaacggatcgatcaccgtccacagcatgctgaacgaaggtacttccttcacgttctacattccaagaaataagcaggatgatggccaaatttga

SEQ ID NO: 2353 - DNA, 723 bp, Bacillus licheniformis
atggaacagacgaaagagacaaaaatattagtagtagatgatgaggcaagaatcagacgacttttaaaaatgtaccttgaaagggaaaactacaagatcgaagaagccgagaatggcgatgaagccatcgacaaagccctcggcaacgattacgatttaatcctgctcgatttgatgatgccgggaaccgacggcattgaagtatgccgccaagtacgcgataaaaaagccactccgatcatcatgctgacggcgaaaggcgaagaagcgaaccgggtgcagggctttgaagtcggaaccgatgactacattgtgaaacctttcagtccgagggaagtggtgctgagagtcaaggcgctcctaagaagatcatcgcaaacctcttacctgaatacggatacaacggcaaaaaatgtgcttgttttttctcacttatccattgatcacgatgctcacagagtcatggcggacggaacggaagtcagcctgacgccgaaagaatacgaactgctttactttctggccaaaactcctgataaagtatacgatcgtgaaaagctgctgaaggaagtatggcaatacgagtttttcggcgacttgagaacggtcgatacccatgttaaacgtttacgtgaaaaattgaacaaagtctcgccgaaagctgcgaaaaaaatcgtaacagtatggggcgtcgggtataaatttgaggtcggaaacgaatga

SEQ ID NO: 2354 - DNA, 1176 bp, Bacillus licheniformis
atggcagagttaagcggcaatttattgtacgcggcatttctcttgtatctctcagcggtcttcttttttggcggctccatcaggagcaaggcttcagaccggaagaagaagaaccgctgggcatcgatcgcagtgttgatcacgatcatcggatttgtatgccagtttggatattttattgcgagatggatcgtttccggacacgcgccggtcagcaatctctttgaatttacaactgctttcagcatgatgctcgtcctggcgttcatcatcatctactttatttacaagctgtccgcattgggactgtttacgcttcccgttgtcctgcttttgatcgcatatgccagcatgtttccgaccgatatcacaccgctgattccgtcgcttcaaagcaactggctgtatattcatgtcacgactgcagccctcgggcaggcgattctcgccatcagctttgtcgccggcgtgatctttctgctcaagcatgtggatcattcaaagccgggcaaaaaaacgttctggctcgaatgtgtcatgtttatgcttgtgacaacgctcgcgtttatccttgtgacgacctcattccgcattgggggctatgaggcgcagtttaagtggattgataaagacaaccaggaagacgtcatgatttacgagcttcccgctcttatcggcccgaataaaggagaacttttaacggaggagagaatggagccgcttgtcaatgtgccgcccattttttcaggccggaagctgaataccgttctctggtcgtttggaaccggcgccttgctttacggtgtcatcaggctgatcatcagaaaacgcatcagtcagcttcttcagccgctcgtgaaaaatgtgaaccttgaccttgtcgatgaaatcggctatcgctccgtttcgatcggctttccggtttttacgcttggcgcgcttattttcgcgatgatatgggcacagctggcgtggagcagattctggggctgggatccgaaagaagtctgggcgctgattacatttttgttttatgcagcttatctgcatctcaggctttcgagaggctggcacggcgaaaaatcggcgtggctcgccgtcatcggttttgccattattatgtttaatcttatttttgtaaaccttgtgatcgccgggcttcactcttatgcatga

SEQ ID NO: 2355 - DNA, 1629 bp, Bacillus licheniformis
atgaaagaaatcaaatgcgaatgcggccatgtgaatccggcgggtaccgttttgtgtgaatcgtgcggaaagccgctggtcaaacaggatgccaaactccttgacatgcggtatgacggaagtgcgagacgctctcaaacctataataaaacgatcgtagataaaatatggaatttcttttcgtctgtaaaggtcggcgtctggctgatcgtcattacgctgacagcatccgcttttggaacgatatttccgcaggaaatgttcctgccgccgggtgcgcaggctgatacatactacagcgaacaatacgggcttctcggacaaatctattatgctctcggttttcacaatctctacggttcatggtggtttattattctggttgcctcaatcggcatttcgcttgtcatctgcagccttgaccgggtcgttcctttgtacagggccctgaaaaaccagggcgtcacgcgaaatccgaactttatggagaggcagcgcctattcagccggacggaagcggacatgtctgaggacacaaaatcgcaaatcatcggtaagctgaagaaaaaacgataccgcgtcaaggaagaaaacggcaacctatttgccgaaaaaggccgtttttcaaggtggggcccatatgttaaccatatcggactgattatattcctcatcggggtcatgctcagatttgtcccgggcatgtatgtcgacgaaaccctttggatcagggaaggggaaacggtgccaattccgggaactgacggccattactatttgaaaaacaaccggtttataaaagaaatgtacgacagtgaaaaagaaaaagaagtattttcagaggcgatcaccaaagctggtgacgggactgtcgcaaaaacatatcaaaccgatgttgaactgtatgaaagaaaaaatgacagcctgccgggcgaagcgcctgaattgaagaaagtgaaaaacggcaagatcaaggtcaatgacccgttgaaattcggttcatatgcactctatcagctgacatacaaggaaggcgagctcgacaaaatggtgtttcagctgattgaaaaagacagcgggaaatccttcggcaaagtggcaatcgacctcttggagccgaaaccggaatatgatcttggtaacggttacaaagttcatatagcaagctacctgccggacttttattttaacaaagacggggaaccgagcacgaaaacgaggaatccgaacaatccggcatttgtattccagatcaccgcaccggataagcctaaaggagaaaaaagtttcgtggcgattcaggaaacaatcgaaggttctgacgacaataaatacaaaatgaagtttgaccatgtcgaaacgaagaatctctcaggcctcacaattagaaaagatttgactttgtgggtgctcatggtcggcggtgccatctttatgatcggcgtcattcaggggatgtactggcaccatagaaggatctggctcagaacgctggacgggcatgtgctcgtcgccggacatacgaacaaaaactggtacgggctgaagcaggacttgaaggccgcgctcgcggatacggggatatccgaaccggccgatcaaaaagaactgtcaaaggaaaaaaaataa

SEQ ID NO: 2356 - DNA, 534 bp, Bacillus licheniformis
atgaaaaaaaagcgtttttacattcggacaggcatcctccttgtgctgcttgcagcgcttggctacacgctgtacagcgccgtgtttcaaaacacggagagtgtggcggtgggggaaaaagctcccattttttcgctggaggatgttgacggcaaccgtctcaaactggacgaactaaaaggcaaaggggtatttttaaacttttggggaacatggtgcgaaccatgcaaaagagaatttccttatatggcgaatcaatacaaggtgtttaaggataaaggggtggaaatcgtcgccgtcaatgtcggcgaatcgaacctcgccgtcagaaactttatgaaagaccacggcgtcaattttccggttgtgcttgataaagacaggcaggtccttaacgcatatgatgtcacaccgctgccgaccacgtttttgatcaaccctgacggagagattgtcaaggtcgtgacgggcgagatgacagaacggatgatccacgattatatgaatatgatcaaaccagagggatcgtcatga

SEQ ID NO: 2357 - DNA, 783 bp, Bacillus licheniformis
ttgtttgttggtctggaaaaaagtaagataatacatgaggtgaaagatatggaacgacttcaaaaagtaatcgcccacgccggtatcgcatcgaggcggaaggcggaggagcttataaaagaagggagagtcacggtcaacggcaaaaccgtcagagagcttggcgttaaagtatcaagctccgatcggattgaggtaaacggcgtccagcttgaaagcgaagaacccgtttattttctcctgtataaaccgagaggggttatatcagcagttaaagacgacaaaggccggaaagttgtgaccgactttttcaccgaggtggaggagcggatttatccgatcggaaggcttgattatgatacgagcggcctcttattgctaacgaatgacggggacttcgccaataaattgatgcacccgaaatacgaaattaataaaacgtatgtagcaaagctgaaaggcattcctttaaaggagaatttaaaaaaacttgagcggggcgtgcgccttgaggatggaaagacagctcctgcaaaagtgaagcttttgtcgcttgataagaaaaagcagacaagcatcgtccaaatcacgatccatgaggggcgaaaccgccaggtcaggagaatgtttgaagccatcggacacgaggtgctcaagctgaaaagggaagagtatgcttttttgaacctggcgggcttgaaaacaggggaaaaaagagagcttacgcctcatgaagtcaaaaggctcagggcattggcagaacacggtaaagcggctttctaa

SEQ ID NO: 2358 - DNA, 537 bp, Bacillus licheniformis
ttggaattcatcaactggctttctctggcccttatcccgtttatcatcgccacgattctgctatacggtacattcaaaaaagttccgacttatgaagcgtttgttgagggggggaaggaaggaatccaaattgcattttccattatcccttatttagtcggtatgcttgtagcgatcacggttttccgggcttcaggggcgctcgatttttttatgaatcttttaaagcccgtgttttccgccgtgggaattccgacggaagtggttccgctggctctgatccggccgatttcgggaacggcagcgctcggcatgacgaccgatttgatcgccgtttacgggcccgattcgttcatcggccggctggcctctgtcatgcagggatcgacagacacgactctgtacgttttgaccgtctatttcggagcggtcggaatcaagaaaatgggggatgctttaaaggtgggactgcttgctgatttagcgggggttatcgcgtctgtaattattgtaacattgctgtttggaagcgcctga

SEQ ID NO: 2359 - DNA, 588 bp, Bacillus licheniformis
atggtcaatataatctgggtcggcttaacggtgatcggtctggtgtttgcgcttttcaacggaacggttcaggaagttaatgaagctgtatttaaaggatcgaaggaagccgtcacgattgtgatcggactgatgagcgtccttgttttttggctggggctgatgaaaatcgctgaacagtccgggcttctcgaaaaattcagcaggctgtgccggccgttcatttcaaagctgtttcccgagatccctccggatcatccggcgatgggatatattttatccaatttaatggccaactttttcggattgggcaatgcagcgacaccgctcggtattaaagcgatggaacagatgaaggcgctcaaccggaaccgcagggaagcgagccgctcaatgatcacctttctggcggtcaatacgtcaagcattaccttgattccgacgaccgtcatcgcggtcaggatgacatatgatgcaaaggcgccgacagacatcgtcggtccgaccattttggcgactttaatatcggggatctttgcgatcttcatcgaccgatacttttattatagaagaaaaaagaaggggtga

SEQ ID NO: 2360 - DNA, 1155 bp, Bacillus licheniformis
atgcgcttttttctaaaacaagcggcagcagccatcatgatatgctctcttttatgctcttcatacgaaaccgctcaagcacagccctcccttcatatcagcgcaaaaagcgcgattgtcatggacgggcaatccggacgggttttgtttgcaaaggatgagcatgaaaaacggcgcattgcaagcattacgaagattatgacagccattttggccgtggaatcgggcaaattggatgagacggtcacggtcagcgacagagcggtcaggacagagggatcatcgatctatttaacaagcgggcaaaaggtgaagctgaaggaccttgtttacggtttgatgctgagatcgggaaatgatgcagccgttgcgattgccgaacatgtgggcggaagcctggaaggctttgtctacatgatgaatcaaaaagcggccgagctcggcatggaaaacaccctgttccgcaatccgcacggacttgatgaccaccctgatcactattcctcggcctatgatatggcgcttttaacaaaatatgcgatgacaaatgaaacgtacaaaaaaatcgccggaacgaaacgctataaagcagaaacgatgcaaggcatctggagaaataaaaacaagcttttaacagggctttacaaatacagtacaggcgggaagacgggatatacaaagcttgcaaagcgtacgctcgtctccacttcatcgaaagacggaaccgatttgatcgccgtcacaatcaatgcccctgacgactggaatgatcatatgaacatgttcaactatgtattcggccactacaaaacatatatcatcgccaaaaaaggcgagattccgaaattaaaagactctttttacggaaataaagcttttattaaacgggatgtcacatatcttttaaacgaagaggaaaaagaagatgtgaaggttgatatcgagcttcttgaaccgaaaaaatcatggcgtaaaaacaaaaaagaaatcccggacatcatcggagaaatgaacgtcatgttcgacggaaaaacgattgcaagcgtaccgatctattatgaaaacgagcgaaacaaaaaaccgaaaaaatcgtttttcgagacctttcaatccgtattccaaaaagcggcgggcggttcatcatggtcaatataa

SEQ ID NO: 2361 - DNA, 492 bp, Bacillus licheniformis
atgggaaaatctatggcaagagcccaaaccgagcaggcaggcgaatttttagcacagaccgttcagacgctgtgcgattatttaaacgaaacgacgctttcatcccttgaagccgaagagcccgggagaagagattattatcgcgatgtcctcagcaacttgagaaaactggcggtttactgtgaagaagggcttgcggcctgccgaatcaggctgcagcaggatccttttcaggaggctgcagccgaaaggacgctctatcaggtctatcatcgatgcatagaagaattttttacaccgaaaaaagatacttggtacgaagacagcagagcggcctacacgggaaaaaacgccatttgctttcacgaaccagcgccggcctcattaaaaaatttgatggcttcgcttgaaacaggatatcaatcgatgagagaagaattggaatactatgcgactgactatcgaatgaagatggttcagccgagatcatag

SEQ ID NO: 2362 - DNA, 594 bp, Bacillus licheniformis
atgacgcttgatatcgtgaattggaaagccattgtcgaagcgcttttgtatgccgccggcgacgagggcctgacaaaaaaacagctattatccgttttggaggtcgatgaagccgagctgctggatattatgcttgatgtcaaagaaacctatgaaaaagaagacaggggcatcgagcttgtcgagtatgcggatacgtacatgctttcgaccaaaaaagaattcgccgtctatttgaaaaagctgatcgaagccccttcaaaagggctttctcaggctgcgctcgaggttttggccatcgtctcttataagcagccgatcacgagagcggaagttgaggagatcagaggggtcaaatctgaacggattcttcagagcctggtcgcaaaagcgctgttatgcgaagtcggacgggcggatggaccgggcagggcgatcttgtacggtacaacagaaacatttctggaacaattcggcttaaaaacgcttgaagagcttccgccgctgcccgaaaatgtagaagaagacggggttcaggaagaagccgatctgttcttcgaaaactttaaccagacgttcgaagatttaaaatag

SEQ ID NO: 2363 - DNA, 756 bp, Bacillus licheniformis
atggaatatcaggtgaaaatcgaggcgtttgaagggcccctggatctgctgctgcacttaatcaaccgccttgaaatagacatttatgacatacctgttgcgaagataaccgagcagtatttattatatgtgcacacgatgcgcgaacttgagctcgacgtggccagcgagtatttggtgatggctgcgacccttctcagcatcaaaagccgaatgcttcttccaaagcaggaagaagagctgtttgacgaagagtttctcgaggaggaagaggatccgagagaagaattgattgaaaaattaatagagtacagaaaatacaaaagtgccgcgcaaaatttaaaggagcgcgaggaagagcggcaaaaagcattcgcaaagccgccgagcgatttaagcgactacgccaaggaaatcaaactcagcgagcaaaagctgtccgtcaccgtttacgacatgctcggggcgtttcaaaaagtgctgaaccgcaaaaaaatcaaccggccgtctgaaacaagaatttcaagacaggaaataccgatagaagagcgaatgacgcaaatcgtcgactgtttgaaatcgtcccgcaaaaggatgcattttatggaactgttcccgtatgaacagaaagagcatctcgttgtgacgtttttggcgattttggagctgatgaaaaaccagctgatcatcattgaacaggaacacaacttttcagatatttacataacagggagtgaagcgattcatgacgcttga

SEQ ID NO: 2364 - DNA, 96 bp, Bacillus licheniformis
atgggaggtaaaggcttcggctacggcggaggatttgctttgattgtcgttctgtttattttgttgattattgttggagcggcatggatctattaa

SEQ ID NO: 2365 - DNA, 522 bp, Bacillus licheniformis
atgtatccccaagcttatatcgattacctcgccgaattccacggggcaagggattattttgagtgccacgaaattctagaagaccattggaaaaaggaccctcccggcgagcggaaattacactgggtcgggttgattcagctggctgtcgcgctctatcatcagcggagaaacaattttgccggcgcggagagattaatggcgaacagcattcgcatcctggcgtccgaaaaagacgcagttgaatcgctcggattggattacagccgcttcatcgaactgttaaggcggactcaccaaaaaatcgaagcccattccccttatgaaagcatcatgctcccgatcgcagatgaagcattgatcaaagcatgccggaaacaatgtgagaaaaagtcatatgagtggggagcaaacgctgcaccagacgcctttatcattgataaacaccggctgagggaccggactgaagtaattgccgagagggataaacaaatcaagcggcgaaaaaagagcagaggctag

SEQ ID NO: 2366 - DNA, 375 bp, Bacillus licheniformis
atgttaattcgttataaaaagtcattcgaaaagattgcgatggggctcctttcgtttatgccgaatgagaaggacgtcaagcagcttcagcagacaattaaagactatgaaacggacactgaaaggcaactgttcctatggaaagaaggcgaggatattgtcggctgtgtaggagtagagaaaagagaagaagaagtcgagatcaagcatatcagtgtaaatccgtctcaccgtcatcagggaatcggcaaaaaaatggtgtcggctatttcgccaatatttgcacctaaaccgctggttccgaatgaattaactaaaggattctttgagcgctgtcaggatcatgaaaatgaagacatcacatataaccaatga

SEQ ID NO: 2367 - DNA, 465 bp, Bacillus licheniformis
atgaataaaatagaaggtcatgtaattggaacagatttgaaaattgggatcgttgtgtcaaggttcaacgattttattacaagcaaacttctaagcggcgcagaagacacgctgttgagacatggggtcaaagctgatgatattgatgtcgcctgggttcccggcgctttcgaaattccgctcatcgccaaaaaaatggctgaaacgaaaaaatacgacgcagtgattacgctgggcacggttatcagaggagcgacaagccactatgactatgtctgcaatgaagcggctaaggggattgcagcgagcagcatgtcaacaggcgttccggtgatcttcggcgtattgacgacagacacgatcgagcaggcggtcgaacgcgccggaacaaaagccggaaataaaggtgcagaagctgccgcggcagcgattgaaatggcgaacctgacccggtcgcttcaataa

SEQ ID NO: 2368 - DNA, 1197 bp, Bacillus licheniformis
atgtttcacacaattgaagaagcgattcgcgatttgaagcagggaaaagtcatcatcgtagtcgatgacgagaacagggaaaacgaaggcgatttcgttgcgctggcggaatacgcaacacccgatgtaatcaactttatggcttcgcacggaagggggttgatctgcgcgccgctcaatgaagagatcgcttcccggcttgagctccaaccgatggtggacgaaaataccgattctcaccacacagcatttacggtcagtgtcgatcaccgcgatacaaagacggggattagcgctcaggagcggtcgctgaccgtcatgtcgctgatcgctgatcacgcgcatccgggtgattttaaaaggccggggcacattttccccctgatcgcgaaaaaaggcggcgttttaaaaagagccggacatacggaggcggccgttgaccttgcagaagcgtgcgggtccgcgccggccggcgtcatctgcgaaatcatgaatgaagacggcacgatggcaagggtgcctgaactcaaaaaaatagccgatcagcacggcttgaaaatgatcacgattaaagatttgatcgaataccgctacagcaagggaacgctgatcaaccgggaagtgaaaattacgctgccttccgaattcggtaccttcaaggtttacggctatacaaacgaaatcgatgacaaagaacatatagcactcgtcaaaggcgacatacctttcggtgacgagcctgtgcttgtccgggtacactcagaatgcctgacgggcgatgttttcggctcttaccgctgcgactgcggcccgcagcttgccgctgcgctcgcgcaaatcgaacaagcgggccggggcgtactcctgtatttgagacaggaaggaaggggaatcggcttaatcaataaactgaaagcttataagctgcaggaagaaggatacgacaccgtacaggctaacgaaaagctcggttttcttccagaccttcgcaactacgggatcggcgcccaaatcttaagggacctcggcgtgaagcaaatgaagctgttaacgaacaacccgcgaaaaattgcaggtctcgaaggttacggcctgacgatcgcagacagggtgccgctgcagatggagacaaaaaaagataatgaaaagtatctaaaaacgaaaaaatcaaaattggggcatatgcttcatttttaa

SEQ ID NO: 2369 - DNA, 648 bp, Bacillus licheniformis
atgtttacaggcatcattgaagaagtcggaacgattttggacatgaaaaaggcgggaagcgccatgtctttagtcattcaatccaacaaagtgatcgaagatgtgaagctcggcgacagcattgctgtcaacggagtctgcctgaccgtaaatgagttcggttccagcagtttcacggcggatgtcatgcttgaaacgctgaaagcaacatcactcggcacattgaaaaaaggaagccgcgtcaatcttgaacgggcgatggcggcaaacggccgcttcggcgggcatatggtgtcggggcatgtcgacggcactgcatcgatcgttcgcatagaaaaagcggcaaacaccgtatactatgatttaaaacttgacccttcactggccaaaatgcttgtgttaaaaggttcgatcgccgtagacggcgtcagcctcaccatattcggactgacggaggatcaggtaacagtctcgcttatcccgcacacattggatgaaacgatttttcctgcaaaaaaggtcggaagcatcgtcaacatcgagtgcgatatgatcggcaaatacatttaccgctttctccaccaaacaaaacaagaaaaacaggcacaggcattgactgaagcattctttaaagaaaacgggttttaa

SEQ ID NO: 2370 - DNA, 1089 bp, Bacillus licheniformis
atgacggatgcgcattatatgaatcttgcattggagctggcgaggcagggcgaaggccagaccggggccaatccgcttgtcggagcggttgtcgtcaaagacggcgaagtggtcggaatgggagcccatttaaaatacggcgaagcacatgcagaagtgcacgccattcaaatggcaggccgccatgcggaaggagccgtcatctatgtgacgcttgaaccgtgcagccattacggcaaaacgcctccttgcgcggaactgattattcgttccggtttgaagcgggtggtcgtggctgcggaagatccgaatccgctcgtttccggaagaggaatcgagatgctgagaagcgccgggatcgaggtggaaacaggcgttctcaaagaacaggcggaagagctgaatgaaaagttcatgcattttatgcggacaggccttccgtatgtgacattaaaagccgctgcaagccttgacggcaaaaccgccaccgcaacaggcgacagcaaatggattacttctgaagaagcgcggatggatgctcaccaataccgaaaaaaccaccagtgtattttagtcggatcgggcacaataaaagcagacgacccaagtttgacatgccgtctccccggtgcggtgaatcagccggtgcgcgtcgttctcgatacgacgctgtcaatcccgctccagtcaaaagtgattcaggataaagaagcgcctacttggatttacacgacgtccaaggcagatcccgaaaaggttcggaacgtggaaaaagaaggtgtgcaggtaaccgtgctcgatgcggatgaacttcaggtgcgcgacgtgcttctgcaccttgcagaccgcggcatcgcttcagtctttgtcgaaggaggcgcaacggttcacgcaagcttcgtcaaagaaggactctatcagcaaataatcttctatcttgcccctaaattaatcggagggctgcaatctcccagcatcctctccggtgaaggctttcaatcgatgaaagatgtccccttactgcaattcacaaccattaccaagatcggccaggatataaagctggcagcaagaccgataaaagaataa

SEQ ID NO: 2371 - DNA, 345 bp, Bacillus licheniformis
atggggaaaataaaattcaagctcacggttctgctcgttttggctgccgtactggccggaggcttttattatttaaaaaacggaagcgttcaggatgtctcaacggcgctcagccaaaccgtctcatctgaggaaaagaactataccatttatcaatataagatcaccaaaattgacggcactgaataccacggggtatcagataacggaacgaagatcattttcaatgcgaaaaatcttaaccaggatctgtccgacattaaagaaggagacaaagtaaaggcctacttctctaatgccaacagaatcgacggattaataaaagtcgtcaaggtggcagaataa

SEQ ID NO: 2372 - DNA, 2187 bp, Bacillus licheniformis
atgaggactttagtactgcttagaggctgccctggcaccggaaaatcaacctggatcagggatcatcaattgaatcaatatacgctgtctgccgatcagctgaggctgatccatcagtcaccagtgttaaatttggaagggaaatacgacatttcccaaaaaaatgacggcaaggtatggaagcttttgttcagcctgcttgaagaaaggatggagaggggagaattcacgatcgttgatgccacacatgcaaaacaaagcatgatttccggctataaagctctcgttttaaagtatcgctacagagcgtatgtggttgattttcccaatgttccgcttgagaccgccctgttgagaaaccgcgagagggctgagcataagcgggtgccagacagcgtggttcacgccatgcacgagcggattttatccgaaccggcgccttcctggacaacagtgatcaagccggaagaatttgccgatgctatgcagtataagccgaggcggcttgacagctacaaaaaaatacatgtcatcggggatgtgcacggctgttttacggtgcttgattcctatttgaaaggcagactcgaagatgacgagttatatatttttacaggcgatatggttgatagaggaatagaaaacgcaaaagtcgtccaattccttctccgtatcaaagaccgcaaaaatgtgattttgctcgaaggaaatcatgataaatatttaaagcaatacgggcatgacgaagtaacaagaagcagcgtattcaacaagaagacaaaaccagaattagacgaagcaggttttgacaagagagatatcagggaactggccaggcgcttccaccaaattgcctacttcacgtatggacaagacacttacatcatcacgcacggcggcatttccgcgctccctgacaaccttctgtttacggctaccagccagctgatcaacggtgtcggcggatatgagacagatatcgaccatgtctttacgaaaaatatggaagggcggaacatcattcaaatccacgggcacagaaacatgttccgacttccagtgcatgcagctgcaaaatcatataacctggaagggcaggtggagcacggcgggcatttaagagttgtcaccattgatcggtcgggaattcaaacacacgaaataaaaaatgatgtgtttaaaacttccgctcctccgcttacttctcatcacgcgcacgaggagctgacggtcgaacattttctaaagcatttggacgaacatgattatgtgtctgagcaaaaactagccggcggcatttcctcttttaactttacgagaaaggcttttcaggagagaaaatgggacagcgtcagcatgaaggcaagagggctgtttattaatagaaacacgaatgaaatcgtcagcagaagctacaacaaatttttcaacatcgaggagcgtctgacgacgaaaatgcatgttctcgttaacacgctgcgctttccggtcaccgtctatgataaggcgaatggatttttgggaacggtcggctacaattctgaaaccgatgagcttgtcttcacctcaaaatcctatacatcaagcggacaaaaagacggccatgcgaaatgggtggaagagctgttttacaaaacgtttgacgcatctcaaacagaggctatgaaagaatatgtgaaaaaacgcaatgtttcgttagtgtttgaagtcgtgctgccagaaaaagatccgcacattatcgagtacgaatcggacaagcttgtccttctcgacattgtcaagaggcagatgaaatatgaaaagctgctgtatgaagacgtccttcgttttgcggagacattccgcgtagaatgtaagcaaaaagtcattacttttcatcagtggaccgatttttataaatggtacctgtctgtgtcaaatgacccgtcgattgaagaggaaggatatgtgattgaagactcggcaggatttatgacaaaattaaaactgcctttctatcaatattggaagttcatccgcggaatcaaacacagactcggcgcggctgctgctcgctcgccccaacacgaggcactgttccattccgagcatgtgaagtttctcgcctgggcaaaaacaaaagacagcgagtattttaaaaatcagtctgttatcgccatccgaaacgacttttacaacgaaacctga

SEQ ID NO: 2373 - DNA, 438 bp, Bacillus licheniformis
atgccgttagtaccttacgaaccatttaaacatttgaatacgatcagaagagagtttgatcgggtgtttgccgattttccggcaaactttggaggagagcacggctttggcgatatcagggttgatgtgcatgaagccgggaatgaaatcgtcgcctcctgcgatatcccgggccttgaaagcaaagaagatgttcatattgaggttgaaaacaatatgcttcatatcagcggaaccatcaacaggtcaagcgaagtaaaagaggaaaacatgcaccggaaagaacgatttacaggccgttttcacagggcagtcgcgcttcctgctcccgtcagccgtgaaggaataagagcttcttataggaacggcgtgcttgaagtgagaatgccgaaagacaagcccgacgaaaaaaagaggatagatgtggaatttcattaa

SEQ ID NO: 2374 - DNA, 1131 bp, Bacillus licheniformis
gtgagcgtaaaaatcccatcgacggcagtcggcgtaaaaattaatgactggtataacgcgatacgtaaattcaacgtcacggacgccgaaatgctgaaggcagaaattgagcgcgaaatttctcaaatggaagaggatcaagacttattattgtattacgccttaatggaattcagacacagaatcatgcttgattacgtaaaacctttggaagaaggcgaaaccccgcctgacttttctgaaatattaaaagatatcgaagatgaacaaggaaagctgacaggcctgctcgaatattattttaacttttttagagggatgtatgaatataaaaaccatgattatattaaagcgatctctttttacaggcgcgccgaaaaaaagctgctgcacgtcgaggacgaaatagagagagccgagtttcattttaaaatggctgaagtgttttatcatatgaaacagagccatgtgtcgatgaactatgcgcttcaagcgattgaaacctatcaggcgcatgaaacctacacggttcggagaatccaatgcgagttcgtcatcgcagggaactatgacgatttagagtcgaatgaaaaagcgctgtcacatcttgaaaaggcgctgaagctttcacagcaagaaggccagctcatattggaaggacacacctattacaatttgggaaactgctattataagatgggggatttcgatcaggcagccgagtacttcaacagggctgctgcgatttatcaagaagagtcatcagatattcttccaaaagcgtttttcagtcttgcacttgcatatttcaagttgaagcagctggaaaaggcggatgacgcgttaaacaaaggaattgacatcgcccgccgatcagacgatgcgatctacctttcaaaatttcattttttaaaagctttgtatgttgatgatgacggcagggctccaatgctggagacatttcagctgctcgggtcaaaaaagatgtatcccgatattgaggacttggcattggaagcagctgaatactataatgaaattgggcgcttgagcgactctgtttatttctatcaaacggtattcagtgctcgaaaacaaatgaaaaaaggggactggtcgtatgaaatctaa

SEQ ID NO: 2375 - DNA, 438 bp, Bacillus licheniformis
atggctaaaaaaggatacatacaactgacaaacggcaaaaaaatcgagtttgaactatatccggatgcggcgccgggaactgtcgccaactttgaaaaacttgcaaacgaagggttctatgacgggctgaagttccaccgcgtcatcccgggcttcgtcagccagggaggctgcccgcacggcaccggaacaggcggacctggatatacgattaaatgcgagacagaagggaatccgcacaaacacgaagccggttctctctcaatggctcacgcaggaaaagataccggaggcagccaattctttatcgtccatgagcctcagccgcacttgaacggcgttcacaccgttttcggaaaggtcacatcaggccttgatgccgtcacttcaatggagcagggacaaggcatggaaaaagtcgaagtatttgatgcataa

SEQ ID NO: 2376 - DNA, 897 bp, Bacillus licheniformis
ttgaaaaaatcgatactaggaatctttacagcattgtgtctgctcattttcccgcaggtcagcttcgctgacgccgcagtgggtgatgtcatcgtcacgctggggaaagacttgtcaagccaggacagacaaaaagtattaaaagaaatgaatgcgcctgaaaatgcgaccatcatcgaggtgacaaatgatgaggagcataaatatttaggggattatataccgaaagcacaaatcggaacaagagcgatttcttcttcttcaattaccgtagcgaaaaaaggcaccggtttggaagttcagacacacaatatcagcagaattacagatgagatgtatttgaacgcgctgatgacggccggtgtaaaagacgccaaagtctatgtcaccgctccgtttgaagtgtcaggcacagccgctttaaccggattgatgaaagcgtatgaaacgacttcgggcgaaaaaatttccgaagatgtgaaaaaggtcgcgaatgaagagcttgtcaccacttcagagcttggcgagaaaatcggcagtgaaaacgcgtcagcgctgatggccaaagtcaaggaagaaatctcgaaaaacggagttcccgagtcaaaagaggaattggagaaaacgattgattcggctgcttccgaacttggcgtgacactcacagaagatcagaaaaactctcttatatctttatttaataacatgaaaaatattaatatcgactggaaccaggttggagaccagcttgacaaagcaaaggataaaatcacgaaattcttggattctgaagaaggacaaaactttcttcaaaaactgatcgacttctttgtgtctctgtggaacgccatcgtttccgtattcaccggcggcggcacctcagagtccaacggttaa

SEQ ID NO: 2377 - DNA, 333 bp, Bacillus licheniformis; identical to SEQ ID NO: 485

SEQ ID NO: 2378 - DNA, 861 bp, Bacillus licheniformis; identical to SEQ ID NO: 484

SEQ ID NO: 2379 - DNA, 732 bp, Bacillus licheniformis
gtgaatattttattgatttcggctgtgatctcattcccatattctgctgcggcccatggcgcaacacagtccggcgatcaatattcaagctttgaagaattggagcggaatgaagatccagcttcttaccgaattacggagaagaacgcaagagtgccgatgctcatcatggccatccatggaggcggcatcgaacccggaacgagcgaaatcgccaatgaagtgtccaaaaactattccctgtacttgtttgaagggctgaaatcatcaggcaatacggaccttcacattacaagcacgcgttttgacgagccagcggcgctcgcaattactgcaagccaccagtatgtcatgtcgctccacggctattacagtgaagaccgcgatattaaagtaggcggcacagaccgcgctaaaatcagaatattggttgatgagctgaaccgctcggggtttgccgctgaaatgctggggacagatgacaagtatgccggaacccatccgaataacatcgccaacaagtcgctttccgggctgagcattcagcttgaaatgagcacgggtttccgcaaatctttattcgaccggtttacactaaaagacagggcggcgacgcaaaacgaaacgttttaccgatttacaaagctgctgacagattttattcatgaaaactatgaagaagacggaggggatttcccctctgcaaaaataaaacacccccttcaagtgtga

SEQ ID NO: 2380 - DNA, 1320 bp, Bacillus licheniformis
ttgtttttacacggtactagcagacaaaatgaaagagggcacctcgaaatcggcggtgtcgatgttctatcattggcagaaagatacggaacacctctttatgtatacgatgtcgcgctgattagagagcgcgcccgaaaattccagaaggcattcaaggaagccggtttaaaagcgcaggtagcgtatgcaagcaaggcgttttcatcggttgccatgattcagcttgccgaacaagaggggctgtctctggatgtggtatcgggaggagagcttttcactgcgatcaaagcagggttcccagctgagcggattcattttcacggaaacaataagagccctgaagaactagccatggcgctggagcatcaaatcggctgcatcgtgctcgataactttcacgagatcgccattacagaagatctttgcaagcgatcaggacaaactgtagacgttttgctcagaatcactccgggagttgaagcgcacacgcacgattatattacgacggggcaggaagattccaaattcggttttgatctgcataatggacaggtcgaacaagccatcgaacaagtcctccgctcgtctgcgtttaagctcctcggcgtgcactgccacatcggttcgcaaatttttgatacggcaggatttgtccttgcagcagacaagattttcgagaagcttgcggaatggcgggagacttactctttcattccggaagtgctcaatcttggcgggggcttcggcatccgctatacaaaagacgacgagccgcttgcagctgatgtttatgttgaaaaaatcatcgaggcggtcaaagcaaatgccgagcatttcggctttgacatccctgagatttggatcgaaccaggccggtctctcgtcggtgatgcggggactacgctgtacacgatcggttctcaaaaagaggtgccgggcattcgcaaatatgtagccatcgacggcggcatgagcgataatatcaggccggcgctttatgaggcaaaatatgaagcagccgtcgccaacaggatgaacgatgcttgtcatgataccgcatcaatcgcaggaaaatgctgcgaaagcggagatatgctgatttgggatttggaaatccccgaagttcgcgacggagatgtgctcgccgttttctgcaccggtgcgtacggctacagcatggccaacaactacaaccgcattccgcgcccggccgtcgtctttgtcgaggacggggaagcgcagctcgtcattcagagagagacgtatgaggatatcgtcaagctggatctgccgctgaaatcgaaagtcaaacaataa

SEQ ID NO: 2381 - DNA, 330 bp, Bacillus licheniformis
atgtatccaaatcgttatccctacacccccgctcccggctatgcacctgaagatgtatacgccccttatcagccggctgcgcattatgaacagagaatttatgagccttatgaagggcagattattacagctccggcgaatacgagattttggcggagaggaactgaggttttccttcattcgtcaacgattgacccgtacggccgcgaaatgctgtatgtcgtctatccgatcagaagacagaacaacatctgcagcctccgggcagtcgcgatctctgccaatgaatacagaggcatcggtactcaaagaccggaattcgattattga

SEQ ID NO: 2382 - DNA, 1473 bp, Bacillus licheniformis
atgagtgctcaaaagcaagagaagacgaacgtattccttgatccttctaagaatgaagcgtatttcaagaagcgggtcggcatgggagaaagctttgaccttggcgtacggaaggtctttattctcggacatgaagttcagctttattatgtcaacggattgtgcgacacacaatacatcattcacctgttaagagaactggtgcatctgaatgataaagaaaaagaatcgggcgaggtcgaagacatcgtcgaaaacaggcttttgaaccagcaggtttcaaaagcggaaacgcttgatgaagctgtcgaccaagtgttgtcaggactggttgccatcatcgtcgaagatgcgggctttgcttttatcatcgatgtcagaagctacccgggcagaacgccggaagaacctgatacagaaaaagtcgtacgcggtgcaagggacggactcgtcgagaacatcatcgtcaacacagccctgattagacgccggatcagagatgagcgcttgcgctacaaaatgcttcatatcggtgaacgctctaaaacagacatctgcctctgctatttggaagacgttgcagatcccgatcttgttgaagtattaaaaaaagaaattgaagatgtgaagatcgacgggctgccgatgtcggataaatcggtagaggaattcctggtcggccaaggctacaatccgtttccgcttgtcaggtttacggaaagggcagacgtagccgcaagccatattttagaggggcatgtcatcgtgatcgtcgatacgtcgccaagcgtcatcatcacaccgaccactttgtttcaccatgttcagcatgctgaggaatacagacagacgccggctgttgggacgtttttaaggtgggtgcggtttttcggtattttggcctccacctttttgctgccgctttggctgctgtttgtcattcatccgtcgctcttgcctgataatttatcgtttatcgggttgaataaagacacccatattccgattatcatgcagattttcctggcggatctcggcgtcgaatttttaagaatggccgccattcatacgccgacggcgctttcgactgcaatgggcctgatcgccgctgtattgatcggcgatatcgcgatcaatgtcggcttgttttctcccgaagtcattttatacgtttccctctcggcaatcggagcctacacgacaccaagctacgagctgagcctggcgaataaaatggtgaagctgtttatgctgatattggtggcgctttttaaagtggagggatttgtcatcggattaacgatcttaactatagtgatgacttcgatcaggtcattgcgaacgccttacttatggcctctcctcccgttcaatggaaaagcgttttggcatgttctcgtgcgcacgtccgttccagggggaaaagtcaggccgagcatcgttcatccgagaaaccgctccagacagccgtga

SEQ ID NO: 2383 - DNA, 603 bp, Bacillus licheniformis
atgccagcaaaacgcaaggtcattttggtcacagacggcgatatatacgctgcaaaagcaatcgaatatgcagcaagaaaaacgggtggccgctgcatttcccaatcggcggggaatccgagcgttaaaacaggaccggagcttgtaaccatgatcctgcaaacccctcatgatcctgtattcgtcatgtttgatgattccggacttcaaggtgaaggcccgggagagacagctatgaaatatgtagcgatgcatcccgatatcgaggtgctcggagtcatcgccgtcgcttcaaaaactcattatgcagagtggacgagagtcgatgtatcaatcgatgcagaaggcgaactgacagagtacggcgtcgataaacacggggtcaaagagttcgatgtcaaacgaatgaatggtgatacagtctattgccttgaccagctggatgttccgatcattgtcggaatcggtgatatcggtaagatgaacagaaaagacgatgtggaaaaaggttcgccgattacaatgaaagcggtcgagctcattttagaaaggagcgggtatcatgagtgctcaaaagcaagagaagacgaacgtattccttga

SEQ ID NO: 2384 - DNA, 351 bp, Bacillus licheniformis
atggagtatgtcattgcttttattgcaggcgggctgatttgcgtcatcggacagctcttgcttgatatcttcaaaatgacgccggctcatgtcatgtcaacttttgtcgtatctggagcgatccttgacggattcggcatttacgaccgttttatcgaatttgccggtgccggggctacagtcccgattgtcagcttcggccactctcttttgcacggcgcgatgcaccaggctgagaaacatggctttatcggaatcggcatggggatatttgaactgacatctgccggtatatctgccgctatcttgttcgcttttcttgttgccgtgatttttaaaccgaaaggataa

SEQ ID NO: 2385 - DNA, 1020 bp, Bacillus licheniformis
atgaaattaacaggaaaacaaacatgggaattcgagaacccgctgtttgttaactcaagcggaacagcggtcggtcccaaagaaaaagaaggtcctcttggacacttatttgacaaaagctatgatgaaatgcactgcaaccagaaaaactgggaaatggcagagcgcaagctgatggaggatgcggttcagtccgcgttatcaaaacaaaatcttaaaaaggaagacatcgatatctttttggctggcgatctgctcaaccaaaacgtgacagccaactatgtggcgcggcatttgaaaattccttttctctgcttatttggagcatgctcgacatcaatggaatcgatcgcgatcagttcggcgttgattgacgggggtttcgcaaagcgcgccctagcggcaaccagcagccataatgctacggcagaaaggcagttccgctacccgacggaatacggggggcaaaaaccgggaaccgcgacttcgacagtgaccggaagcggagcggtcgtcctcagccagcagcccggcggaattaaaattacaagcgcaactgtcggaagggttatcgacttggggattaccgattcgcaagatatggggtcggcgatggcacccgctgctgcggatacgatcaagcagcatttggaggatctgggacgcacccctgatgattacgatctgatcttaaccggcgacctttcaggcgtcggcagcccgattttgaaggatctgttaaaagaggaaggaatcaatgtcgggacaaaacataatgactgcgggctgatgatctatacgcctgaccagcaagtttttgcaggtggaagcggatgcgcttgttccgcggtcgtcacctttgcccatattttcaaagaaattgaagcgggaaggctgaacagagtgcttgttgtcgcgacaggcgcccttttaagcccgacgatcatccagcaaaaagaatcgataccatgcattgcccatggcgtcgtatttgaacgggccgaaagggggaacgcttaa

SEQ ID NO: 2386 - DNA, 450 bp, Bacillus licheniformis
atgtcaagtttgaaagataattatcaatcgaaagttaaagcgtatcagccttcaccgccttatgtcctgaactgtatcaaggcatttctcgtcggtggtctgatttgtacgatcggccaggctttccagaatttttatatggctgtgttccattttgatgaaaaaacggccgggaacccgacggttgccacgctgatcctgatctccgctctgttaacaggccttggcgtctacgacagaatcggacagtttgccggcgctggttctgccgttccggttacagggtttgccaacagtatgacgagcgcagcgctggagcataaaagcgaaagctacgtcctcggcgtagggacaaacatgttcaagcttgcgggaaacgtcatcgtgttcggtgttgtggccgcttatattgtggggatgatccgctttgcctttgacaagctgttttag

SEQ ID NO: 2387 - DNA, 426 bp, Bacillus licheniformis
atgatcattagcgtgatatttatcatctttctcggactcgcaggaggggttgctgttggatccggctttgtcgcttttcttaccgtgcttggcattatcccgaggctgactcagctgacgaaaacaaaaggatttatccaggcgtatgaatgggctgtcattttaggcgcggttttcggaggatgggaatcgctgaacatgtcccgcttttttttatccaaatggctgcttgttccgatcggcctttttgcgggcgttttcattggaatgcttgcagcggcgctaacagaagtcttgaacgtgctgccgatactggcgaaacgcatcgggatgggagaccggattttgatacttttaatggccattgttttcggcaagattctcggatcgatgttccaatggctcatttttgttcatttgtcataa

SEQ ID NO: 2388 - DNA, 621 bp, Bacillus licheniformis
atggaacgtcaagtttttatcagactccgccaccggcttgaggcagatccggatgaattgattttgctcggccatatcgcacaggtagcgggtgaccgcggatacaaagaaaagcttgaacggctgcctatttatcaggtcagcaaagcggatcaaagcatggtggtgctggacgtgatgaaggtgattgaagctgtacataaatcgtttcctgaccttgatgtccaaaccgtcggcggttctgaaaccatcgtggagatccaatatccgaaaagggatctgtcgcccgtgcttttcatcgccgtctggctgctcttgttcgtcggtgccggccttgccgtcatgaactttcatgaagatgtcagcatgagggaagtgcacatcctgctttacgaaatggtgacgggcaaggtgaaccgctatccataccttttgcaggttccgtacagcatcggtcttggcctcggcatgatcttgttttttaatcatttatttaaaaaacggtttaacgaggagcccagccccctggaggtcgagatgtttaaatatcagcttgatttggaccattatgtggccatgcacgaaaacaaagaaacgacaaaggatattcatgatcattag

SEQ ID NO: 2389 - DNA, 768 bp, Bacillus licheniformis
atggatgtggaggttaaaaaagaaaaccagaacactcagcttaaagaccatgaagtgaaagaactgattaaaaacagccagaacggcgatcaaaaagcaagggacctcctcatagaaaaaaacatgcgtcttgtttggtctgtcgttcagcgttttttgaacagaggctatgagcctgacgacctctttcaaatcggctgcatcggcctcttgaagtcggtggacaaattcgatctttcctatgacgttcggttttccacctacgccgttccgatgattatcggcgagattcagcggtttatcagagatgacggaaccgtcaaagtgagccgctcgctgaaagaactcggcaacaaaatccggcgggcgaaagacgagctttccaagtcaaacggccggattccgaccgttcaggaaatcgccgattatctcgaaatcagttcagaagaggtcgtgatggcccaggaagcggtccgctctccctcgtccattcatgaaacggtttacgaaaacgacggggacccgattacacttctggaccaaatcgccgatcagtcggaagagaagtggttcgataaaatcgctttgaaggaagccatcaaggatttggatgaacgggaaaagctgattgtttatttaaggtattacaaagacaagacgcaatctgaagttgccgaccgcctcggcatatcccaggtgcaagtctcgaggcttgagaaaaagattttaaagcaaatcaaaaaccagatggaccattttgaaagctga

SEQ ID NO: 2390 - DNA, 441 bp, Bacillus licheniformis
atgaaaaatgaaatgaacattcagtttacagcgctcagccaaaatgaatcgtttgcacgggtgacagtcgctgcttttatcgctcagcttgacccgacgatggatgaactgaccgaaattaaaacggtcgtatccgaagcggtcacaaacgcgatcattcacggttatgaaaactcagggcagggaaacgtatatatttccgtcactctcgaggaccatattgtctatttaacgatccgcgacgaaggagtcggcatccctaatcttgaagaagcgcgccagcccctgttcacgacaaagcctgaactcgagcggtcgggaatgggctttacgatcatggaaaatttcatggatgatatttcgatcgactcctcacctgagatgggaaccacaatacacttaacaaagcacttatcaaaaagcaaagcgctttgcaattaa

SEQ ID NO: 2391 - DNA, 354 bp, Bacillus licheniformis
atgagcctcggaatcgatattcacgtcaaagaatccgtattatgcattcggttgacaggtgaactcgatcaccatacagcagaaaccttgagaaaacaagtcagtgaccatctggaacaaaccgacattcgccatattgtcatgaatcttgcagacctttcgtttatggacagttcagggcttggcgtcgtgctcggcagatataaggagattaagcagctcggcggagaaatgatcgtctgcgccatttcccctgctgtcaaacgtttatttgatatgtccgggctgtttaaaatcattcgccttgagcaatcagagcagcgtgcacttgaaacgttgggggtggcgtcatga

SEQ ID NO: 2392 - DNA, 1188 bp, Bacillus licheniformis
atggaggtctgggtgatgaaacgtcatttatccaaattgctgatttttacgataatcctgatgactgcgccgtcggcgcttgcaaaagagagcgcaaagaaaccgtcggagcttgctgatgacgcaaaatctgccgttttaatcgagcgggataccggtaaggtgatgtatgacaagaacagccgtgaaaagcttcctccggccagcatgacaaaggtgatgaccatgctgctgatcatggaggcccttgatgaaggcaaaatcaaaatgaaagacaaagtcagaacaagcgagtatgccgcttcaatggggggttcgcaaatttttctagagcccggtgaagaaatgacggttgaagatatgctgaaagggatcgccatcggatcgggtaatgatgcctctgttgcaatggcagagcatattgcggggtctgaagaggaattcgtcaaaagaatgaatgaaaaagctgctgagctcggcctcaaggatacgtcttttcaaaatacgacaggtctgcctgaagaaggccattacagcacagcctatgacatggcgctcatggcgaaagagcttttaaaatatgaaaacatcacgaaatttacgggaacgtatgaagactatctgagagaaaacactgataaaaaattctggctcgtcaacacaaaccgcctcatcaaattttatccaggagttgatggagtcaagaccggctttacaaatgaagcaaagtactgtctgacagcttcagcgaaaaaaggaaacatgcgcgtcatcgctgtcgtttttggagccagcacgccgaaagaacgaaatgcccaaatcacaaaaatgcttgattttgcgttcagccaatatgaaacgcatccgatgtataaacgtaacgaaatcatttccgatttgaaggtcaataaaggccgtgagcaaaaaataaaccttgtcacatcagaaccgatttcccttttgacgaaaaaaggcgaaaatatcgaatctgttaaaaaagaaatcaaacagaaagaagatatccaggcccctgtcaaaaaaggcacagagcttgggacgctcgttttgaaaaaggatggaaaggtgctcgctgaaagtcctcttgtcgctgaaaaagatatggacaaagcggggatgtggacgatgttcaagcggacgatgacccactggacgaagtggagtgaataa

SEQ ID NO: 2393 - DNA, 816 bp, Bacillus licheniformis
gtgaaacagatgattgcaaatgccgcagactatattaaaagcaaaacggaaatcaaacctgcggtcggcctgatattgggatccggccttggcgtgcttgccgatgagatagaagacgccgtccgcattaaatatgaagacatcccggactttcctgtttccactgttgaagggcatgccggacagcttgtcatcggcagacttgaaaatgtgcaagtcgtcgcgatgcaagggcgttttcatttttacgaagggtattccatggacaaggtaaccttccctgtccgtgtcatgaaagagctggggatcgagactttaatcgtgaccaatgccgcaggcggcgtcaatgaatcgttccgtcccggcgatttgatgatcatatccgatcatatcaattatatgggaacgaacccgctgatcggtccaaacgattcctcgctcggcgtcagattcccggatatgtcgtccgcatatgataaggaactgcgcctcttggcgaaaaaaacagccgaagaattgaacatcagcgtacaagaaggggtttacacagccgttacaggacctacatacgaaacgcctgccgaagtgcggttcctcagaacgatcggatcggatgccgtcggcatgtcgacggttccggaagtcatcgtggcaaaacatgcgggccttcgcgtgctcggcatttcgtgtatatcaaacgcggcagccggaatcctcgatcagccgctctcccatgatgaagtgatcgaagtcaccgaaaaagtaaaagccgacttcttgcggtttgttaaagcggcagtcgccaaaatcggctaa

SEQ ID NO: 2394 - DNA, 1185 bp, Bacillus licheniformis
atgcctgcatttgattataaccgcgtatttttaatagtaatggattccgttggaatcggcgaggcgcctgatgccgaaaaatttaatgacaaaggcgcagatacattgggccacattgccgaacacatgggaggcatcagcctgccgaacatggcaaagctcgggctcagcaacatccgtgaaatcaaaggcgtcgaaaaggcggaaaagccgcttgcctattacggcaaaatgaaagaagcctcaaacggaaaagatacgatgactggccattgggagattatgggactttacatagacaaacctttccgggtgtttcccgaaggttttccggacgaattgatccacgaacttgaacagaaatccggaagaaaagtgattggaaacaagcctgcatcaggcactgcgattttggatgaactcggtgcggagcatatggaaaccggcgcgctgatcgtctacacctcagcagactccgttctgcagattgccgcacacgaagaagtcgtgcctctcgaggaattgtacaagatctgcgagatcgcgcgcgagctgacgcttgacgagaaatatatggtcggacgcgttattgcgaggccgtttgtcggcaagccgggcgaatttaaacggacgccgaaccgccatgattatgcgctgaagccgtttgacagaaccgtgatgaatgaattgaaagatgacagctttgatgtgattgcgatcggcaaaatctccgatatctacgacggcgagggcattacggaatcgctcagaacgaaatcgaatatggacgggatggacaagctggtgcaaacgcttgacaaaggttttactgggatcagctttgtaaacctcgtggactttgatgcgctgttcggacaccgccgcgatccggaaggatacggaaaagcgctcgaagagttcgacgcgcgccttcctgaagtatttgaaaagatgcgcgaagatgatctgctcatcattaccgccgaccacggcaatgatccggttcaccatggcactgatcatacaagggagtacgttccgcttcttgtatacagcaaaaaacacgaaaagcctggggcgcttccgctcgcagatacattcgcggacatcggcgcaacgatcgccgacaactttaaaacgaatatgccaaagtacggaaaaagctttttatccctgctgaaatag

SEQ ID NO: 2395 - DNA, 891 bp, Bacillus licheniformis
gtgaaagttcatattaaagactttatccactacgccgttgttgaacgggggctttcccacaacacggttgtgagctatgaacgggatttgaacagctacgccgcctatttagaggagcaggagcagctgagctcttttgaccaggtgacaaggctgcacatcatccagtttttgaagcatttaaaagacgccggaaaatccggaaagacggtcgcgaggcatctcgcttccatccgcagctttcaccagtttctgctgagggaaaaagtgacggcccaggacccgtccgtccatattgaatcgcaaaaaacggaacggacccttccgaaggtgctgtcattacaggaagtcgaaacgcttttggatacgccgaagctgacggggccgttcggctaccgcgataaagcaatgctggagttattgtatgcgacaggaatccgcgtcagcgagatgatcgcattaaagctgtccgatgtccatttatcgatgggctttatccgctgcttcgggaaaggaagaaaggagcggatcgttccgctcggcgaagcggcgtcacatgcggtcggcgaatatctgtcaaaagcgaggggcaagcttttgaaaaaaaataccgaagacgccctgtttctgaatcaccacggcagacaaatgagccgccaggggttttggaaaaatttaaagaaaatcgctttggaagcgggaattaataaagagctgacgccgcacacgctgaggcactcattcgccacacacttgctcgaaaacggagccgatctccgggccgttcaggaaatgctcggacacgccgacatttcgacgacgcaaatttatacgcacgtgacgaaaacaaggctgaaagatgtgtataggcaataccatccccgtgcatag

SEQ ID NO: 2396 - DNA, 225 bp, Bacillus licheniformis
atgaaaatgctgaaaacggccgccgatatgatcaaggtgtttgtgctgtttaccggttttaccgtcttgttttattatgctatgatatggataaattcagagtatgaaaactatcatcggtatgataaacctgaaggagcagccctcaaggtcgcctcgatggaagaggacgagcagggcagctggtttaaccggttaatctttttttatttgaacggggagtag

SEQ ID NO: 2397 - DNA, 450 bp, Bacillus licheniformis
atggaaacacgtattgatcggattaaaaagcaactgcattcttccagctataaactcacccctcagcgcgaggctactgtaagggtgctgctagagaatgaggaagaccatttaagcgcagaagatgtatacctcctcgtaaaagagaaatctcctgagattggtcttgcgacagtatatcggactcttgaactgttaactgaattaaaagtagtggataaaatcaattttggcgacggtgtgtcaagatatgacctccgcaaagaaggtgccgcccatttccatcaccacctggtttgtatggaatgcggttcggttgttgaaattgaagaagatttgcttgaagacgtggaagaaatcattgaaaaggattggaaatttaaaataaaagaccacaggctgacgttccacggcatctgtcatgactgtcagcaaaaggaatcggaatag

SEQ ID NO: 2398 - DNA, 657 bp, Bacillus licheniformis
atgcggaagcccacaatcaaagagctcatctttcaacatatgaaggaccatctgtcgatctatttatttgtttctgtgctgttcttaatgggtgtgattttcggcgcggtcatcgtcaacagcatgacgatcggtcaaaaagaagatttgttctactatttgaatcaattttttggacagctttccgaaggaaaagcagccagctcaaaggaaatgtttttgcagagctttcttcataatatgaaatatttaggcttaatgtggattctcgggatatccatcatcggtctgcccgtcatttttatcatggtcttcttaaaagggatcgtcgtcggatttacagtcggctttttggtcaatcaaatgggaatcaacggctttttcctgtcttttgtctccgtgctcccgcaaaatattctgctgatcccggcgtacttgatcatgggcacctgcgccatcgccttttcgatgaggctcatccgccagctttttgttaaacgcagccttgcagaagcacctgtccattggtttggccgctacgcttttgtactcgtcctgattctcgcaatgtctcttatatcctctttctttgaagcatacctttcgccagtgttgatggaaaagctgacagagtacgtcttgccgaaacagcattaa

SEQ ID NO: 2399 - DNA, 1347 bp, Bacillus licheniformis
atgagcgggtttatggagaagtttgagcggaacgtggagcggtttttggttcccgttgctgcaaaattgaattcacagcgccatatatgtgcgatcagagatgcttttattctatcatttccgattattatggcaggatcgattatcattttattgaattttgccattttatctccggacgggtttatcgccaaaattttatttcttgaaaagatatttccgaacttggctgattaccagtcggtctttacgcccgtactgcgggggtcgctcgatattatgtccatatttgtcgtgtttctcgtcgcccgcaatttagccatctcaatgaaagcggatgaactgcttgccggattaacggctgtatcctgttattttatcatttattcaccgtaccgcctgatcgaaaacgagagctttttaacgacgaaatggctcggcgcccaaggactgttcgtcgccttaatcatcggaatcatcgtcggtgaagtgttcagcaggctatcaaatgccaagcgactgcaaattcatatgcctccgcaggtgccgcctgcggtcgcccggacatttaaagtgctgtttccgatcatcttcattacgattggttttgcgatattaagctttgcgctgatgtccctgtcgaaaaacggtctgcatgaattggtgtatactgtgctgcaggcgccgttgagagagatgggaacgaatattttcaccgttgtttttcttggaatcgtcgccaactttttatggctgttcggcattcacggtccgaatacgattgcggcgatcagagaaacgatttttgcagaagcaaaccttgaaaacctcggttttgccgctaaaacaggctctgcatggaacgctccgtttcctgaaacatgggcgctgaatgacgcctttgcgaactacgggggatcaggcatgacgctggggcttttgatcgcgatattcatcgcttcaaagcggcgggattataaagatatcggcaagctttcgatcgggccgggaatatttaatatcaatgaacctgtcattttcggacttccggtcgtgctcaatccaatcttcatgattccctttattatcgttccggcagtcaatactgtcatcggctatttgttcatcaagtttcagctgattccgccgatcgcatacgctgttccgtggacaacgccagggccgttgattccgtttctcgggaccggaggaaactggcttgcgctcggcgtcggctttctctgcctcgccatttcaacgatgatttatctgccgtttgtgatggctgccaacaagactgtgaatacggacagggagcattccgcggaaaacaggaaggaatcataa

SEQ ID NO: 2400 - DNA, 300 bp, Bacillus licheniformis
atgaagaaaattttattggtttgtgcggccggcatgtcaacgagcctgcttgtcagcagaatgaaaaagcatgcagaggcgctgaacgaagaggtcgacatcattgctctgcctgtatccgaagcggggactgccgcgtcaagcgcggacgtcgtattgttggggccgcaagtcaggtaccaaaagtcacaggttgaggcgagcgcaggagacacgccggtccaggtgatcgacatgcgagactacggcaccatgaacggcgaagctgtgctgcaaaaagcgctgcagctgatgaaataa

SEQ ID NO: 2401 - DNA, 1548 bp, Bacillus licheniformis
atgaaacctgtccatcaagaaaaaattcaaacagacctcacgctctcaaacagcgacttgcagcctctgaagccggaggaacgcacatggaaagcggttaatttcgcatcgatctggatgggctgcatccataacatcccgacttatgcaacggttggcggactgattgcgatcggactttctccgtggcaagtgcttgggattatcgccgtcgcttcgattgttctctacgcggccctcgcgttgaatggacatgccggcgcaaaatacggcgtgccttttccagtattaattaggtcttctttcgggatctacggggctaatataccggcgctcctcagaggtttcgtagcgattatgtggttcggcattcaagcgtttgcgggaagcacggcgatcaacatcctgatcttaaacgtatggagcggctggaaagacatcggcggcgactggaacttatttggtttgcatttaccgggtcttttgtcatttgttttcttttgggggattcatcttctcgtcctccatcacggaatggagtcgattagaaggtttgaagtctgggccggcccgctcgtttatctcgtctttggcgggatggtgtggtgggcggtcgatattgcaggggggctcggtccgatttattcgcagccgggaaaatttcagacattcagcgaattaatttggccatttcttgccggtgtgacggggattatcggcatttgggcgacgctcattttgaacattcccgattttacgaggtttgcagcctcccaaaaagaacaaatcagaggacagttttacggtttgccgggcacattcgttctgcaagcatcaccgtcacctccggctcacaggctgccttcggggagccgatttgggacgtggtcgatattctcgcccattttgacaatccgtacgtgatcgctctttcggtcattacgctttgcatcgccgccatttcggtaaacgttgcggcaaatattgtctcgcctgcctatgatctggccaattttttgccgaaatacatcgatttcaagcgaggcagctatttgacagcagttttggccctgttcacttttccatggaagctgatggagaatgaagcgagtgtgttttcgtttctcggcacgatcggcggaatattgggcccggtcgcaggcgttatgctcgccgattatttcatcatccggaagcgcaccctctgcctcgaagatctctattccgcaaaaggacagtatatgtattataaaggctataattacagggcttttgctgcggtagctctcggagcgcttatatctctcatcggctcttacatccccgccatgaagccgctttatgacatctcctggttttcgggcgtgctgatcgctgccttcgcctatatctttttaatgcgcatccatccgccggctgccatttcaaatgaaacggctcaatacgaaggcggcggaagaaaaataagcgggtaatatcgaaaaaggatttttcgctagtgaaaaatgccttttcttcttacctctttttttcaaaggcagcttatga

SEQ ID NO: 2402 - DNA, 657 bp, Bacillus licheniformis
atgcaaacgggcgccgagttcgacggacaggccttttggatcacgtcgcctgcggtggcaacatttcatgaaaaacacctgcgggaggaatactttatgaatccgatactgctcgattttccggacagcttcgaaacagagcgcctgctgatcagagcaccgcgcgccggtgacggcaaggcagtatatgatgctattgcagcttcgttttcagaactaaagccgtggatgccgtttgcaagggagatccccgaggaagagcgtgtagaaatcaacgtcaggcgggcacaggccgattttattttgcgcaacgatttgcggatgcatattttccataaagaaacgggaaaattcgtcggcagcaccggtcttcaccgcatggactggaaagcgaaacggtttgaaatcggctattggcgcagttccgaattttccggacaagggtacatgacagaagcgcttaacggtctcattgatttcgcgagaagacacgtcagagccaagcggcttgagatatgttgtgacagcatgaacacgaaaagcagaaaaatggcggagcgcctcggtttcgagcttgaagccgttttacaaagcgatgacctttcgaacgatttgagcgaatatcgggacacatgcatttattcgcgcatcttctaa

SEQ ID NO: 2403 - DNA, 207 bp, Bacillus licheniformis
atggccaaaagcaaggcaaggaaaaagcgcgagcacatgttgagaaacacaggcagagatgccgccgcatcaagaggcaaggcgccggacttcggcacgcacgtcagaaaaacgaaaagcaggcgggaagagcttgcaaagctgcatatgaaacataaacgaaagaacccttatgatttgcttcatgaagatcataagggttctttt

SEQ ID NO: 2404 - DNA, 453 bp, Bacillus licheniformis
atggagtggaaactaaaatcgtatgaggaattgtcgaaggaagagttgtatcgcatcatcaagctcagaatagacgtctttatcgttgaacaaaactgtccgtatcacgagcttgatcacttggatgagcgggcgcaccatttatttctgagccaagaaggagagatcgctgcgtattgcaggctgttcccgagcggcacagcataccccgaggcatcaatcggccgggtgatcgtccgcaaagaagacaggggaaagggatatgcgcaggcgcttcttgataaagcgatccgctttttggaaggcgagtgggaagagacaaaggtcaagatcagcgcccagaatcatttgcgttccttttacggctccttcggatttaaagcaatctcagacgtctatatggaggacggcattccgcatgtggatatggtcagaacggaagaaaccgtatga

SEQ ID NO: 2405 - DNA, 1164 bp, Bacillus licheniformis
atgaaagaaatattcgcagacatgcatatccatatcgggcggacggaatcaggccggcccgttaagataacggctgccagaacgctaacgctcgacgaaattttgattgaagcaagcgaacataaagggatggaactgatcggcattatagattgtcattcacccgaggtgctggccgaaattgaaaaaggggtgtcttcagggcgttatacagagcttgaagacggcggaatcaagtataaagataccgtgcttttatgcgggtctgaattggaaatcaatgatgacagatgccgcggcccgattcatgtgcttgcctttatgccgtcgatctccgcaatgaagcagttttccggctggctctcagaaagggtgacgaatatccacctgagctcccagcgcatctatgagacgggcatcggtcttcagcggaaggtgaaagagctcggcggcctgttcattcccgcgcacatttttacgccgcacaagagcctgtacggaaaaggagtcgaattttcgctgaaagaagtgtttgacccgaggatgattgatgcggttgaactcgggctgagcagcgacaccgatatggcttcacacgtatccgaactgaatccttatgcatttttgaccaattcggacgcccattctcttggaaaaatcggcagggagtataataagctgcacatcaaacatgccagctttcaagagttttcgcttgctttaaaaggacaagaggggcgtagcattgccgcgaattacgggatgaatccgcagctgggcaaatattttcaaaccgcttgtgaaacatgcggccgtctgcaggaggcagatgaaacgttgtgcaaagcgtgcggcagccgaaagtttacaaaaggcgtcagcacgcgtctaatggagctttatgatcaggatgaaagcccggtcaagcgcccgccgtacgttcaccaggttccgctgcagctgatccccggcatcggcccgaaaacgattcagaagctgaaagaggctttcggcactgaaatgaatatacttcaccgtgtaaaagaaggcgatctaaaagaaaccattcgtccgcagacggcagagctcgtgatcaaagcaaggaacggggatttagagctgaaagccggaggcggcggaacctatggaaaagtgcagagctaa

SEQ ID NO: 2406 - DNA, 567 bp, Bacillus licheniformis
atgatcaaactgaagcatttagaggagaaaaccatatcaaaggaaaagcttttttcaggcaaggtgatcgatctttatcttgaagatgtcgaactgccgaacggtaaaacgggaaagcgcgaaatcgtgaagcatccgggcgctgtagcggtgcttgctttaactgatgaagaaaacatcatcttagttaagcagtacagaaaagcgcttgaacggacgatcgttgaaataccggcgggcaagcttgaaaaaggggagaaacccgaatataccgcgctgcgggagcttgaggaagagacgggatacacggcggcgaagcttgagaaaatcaccgctttttacacatcgccgggctttgcggacgaactggtgcatctgtacctggctgaagagctgacgccgcttgaagaaaagcgcgaacttgatgaagacgaatttgttgaagtactggaggtgccgctttcaggcgcgctgaaactgatggaaactcaggacatctatgatgcgaaaacggcttatgccgtgcagtatctggagctgagaaaggccctgcaagcaaaaaaatga

SEQ ID NO: 2407 - DNA, 177 bp, Bacillus licheniformis
atgaaggtctaccgcctgaatgaccgcatcgtcatgtctgggaaagcatgggaaatccgcgccaagctgaaggaatacggacgaacgcatcactatgtgaaagattggctttctgaaaaagaaaatcgcctgcaaaagcttaattttattgacatcaagaagggctgcatgaaataa

SEQ ID NO: 2408 - DNA, 606 bp, Bacillus licheniformis
gtgggaattgaaaagggccgcaaaggcaaacaaagccggaagcggctgctcgaggtcgctgcaaacgaatttgcaaaccggggattccatgagacaaaagtgagtacgattgtgaaaagagctggactgactcagccttctttctacctatatttcccaagcaaggacgccatctatgacgagctgatcaatggctttcacgcgaacttaaaaaatctgatcgaatcgttccgtttagagaaaggaatcgagaaaaaacacgtatcaaaacgggtaacggccgctgtagaggctgtatttcgatttttggcagaggaccccgatttgactcgcatcggtttttttctcagccctgaagcaggcgaaatgaaaaaagatttaacgctcgccttgaaagaaaacttgaaagcagagcaggagctcggctacttccgatccgacctggaaatggagaccgttgctgaatgtctgacaggcatgattgagcaccttgccgatatctatttgcttgacggatcaaaggacccctcaagtctcgcaaaacaaatcacggatcttttgatccacggaatgctcgtaaatccgcagcatccagaaacggagtga

SEQ ID NO: 2409 - DNA, 348 bp, Bacillus licheniformis
gtggcatttattttcttaaaagcagggctggcggcatttatgctgaccggaggcgtaatcaaggtgctgcacgttccttttcaagtcgaacattggcgccattatgaatatccgctgtggtttctttctgttacaggatgtctcgaaatcgccggagcgcttggcatgatcggcggaatttggaatgtgcatctggctgtcggttcggggctgttattctccctgcttatgacaggagccatccatgcccacctggtccgggcgcggcagccttttttcacggccatccctgccgcggtttgtttgatttgcgccctaagcatgatcatcgtcgagctgtacttctga

SEQ ID NO: 2410 - DNA, 921 bp, Bacillus licheniformis
atgaaaaaaaggacgctcggacattccgatttacaggtgagtgaagtcggcctaggctgcatgtctctcggaacggacaaaaagcacgcactgtcaattctggatgaagctttggaactcggcatcaattacttggatactgccgacctgtacgattttggacgcaacgaagaaattgtcggtgaagcgatcaaatcaaggcgccaagatgtcatcctcgccacaaaagcgggaaaccgctgggaggaaggaaaaccgggctggttctgggatccccggaaagcatacataaaagaagccgtcaaacgcagcttaaagcggctgcaaaccgactatatcgatctttatcagctgcatggcggaacgatcgaagataacatcgacgaaacgattgaggcctttgaagagttaaaacaggaaggcgtcatccgccattacggcatttcctcgatccggccgaacgtcataaaggaatacgtcaaaaaatcaaacatcgtcacagtcatgatgcaatacagcttgttggacagacggcctgaggaatggctttctctccttgaagaacatggaatcagcgtgattgcaagaggacctctggcaaaagggattctgacagaaaaacccctgtcagatgcaaacgcatcgattaagaaaagcggctatttatcatattcctacgatgaactcatcaaaacaaaggcggacattgaaaaaacagcgcctgatttatccgcaaccgaaaccgcgctgaagtatattctcgcccagccggctgtcggcgcggtcatccccggggcgagcaaactctcccagcttcgggaaaacgttgaatctgtcggcggacgcagcctgacagaacaggaaatcaaagcgctccgcttttatacaaaacgcgacgtgtacactgcgcatcgcgaatga

SEQ ID NO: 2411 - DNA, 234 bp, Bacillus licheniformis
atgggaaagaaaaaacaagacccaaatacccggcagctgctgaaagatgcactcgccgacgatttgaaacataagcttcagcaaatgaaaagcgaattgaaagaggaggacgagaaaagaaaagagcgtgagaaagaacggcttatcaaggaaagacaggaaagggaaaaaaataaaagctttgaagaactcctcaacgaaagcggacttgacgactggaggaagtataagtaa

SEQ ID NO: 2412 - DNA, 930 bp, Bacillus licheniformis
atgttgatttggctggctgctatcggagcggttttgctgttcattgctgcgctcggaatctattttacgaatcaaatcatgtacattaaaaaacggaccgaccaatacattattgagcgggaaactgccgacggccattatgacgaaaaagctttcgccgctctcccgaaggaagaaatcaccctcgcttcttcttacggctacaatattaaagggtactacgtgcacccgcacaaaacgaaaaacaccgtgattatctgccacggagtgacgatgaatctgctgaattcaatcaaatatatgaatctgtttctggatctcggctggaacgccgtcatatatgaccacagaaggcacggcgcaagcggcggaaaaacgacgagctacggatattatgaaaaaaacgatttgaaaacggttgtcaattggctgagggaaaaacacggcgaacaagcgctgatcgggattcacggcgaatcgatgggcgctgtcacaacccttctttacgcgggaatggatgacgccgaggctgatttttatgtggccgactgtccgtttgccacatttgaggatcagctcatttaccggctgaaagaagattttcatcttccaggagctttcattttgccgctcgccagcctctttttgagatggcgggacggctaccgcatccgtgatgtctcccctttatccgtcgtcggaaagatcaaaaaaccggtgctgttcattcacagcaagcacgacgactatatcccggctgaatcaagcgaaattctttacgagaaaaaaccggggaagaaacggctttatattgctgaaagaggagcgcacgcaatgagctacacccaaaacagaaacagctacaaaaacacggtgcgggactttcttcaagaaatcacaaaccggcacaaagaaggcgaacgagcataa

SEQ ID NO: 2413 - DNA, 240 bp, Bacillus licheniformis
ttgaatcaaaaggtaaaatctttaaagcaaaccgctcaaaataaaacatgggcgtcctttttacatcaaaatcatccgtatacactccttcattggtcaatcggagggacagagtccgtcaaaaaggatgtctggcttcttcaggatgaaatgacctttgaaacaaaggaatttgatacaattgagacggccatctcctggatcggcgatcatatgagcgacattacagatatcctgtag

SEQ ID NO: 2414 - DNA, 324 bp, Bacillus licheniformis
atgcagcttgaaatcactgctcaggcaagacaagccattcaacgggcaacagagccttatcctgataaaaagatccagctccgctatgattccgagggatgcggatgcgcggtcagcggtgtgccggtcttgtggctgacggacgaattatcgggaagttgcgagccccttgagacaaacgggcttccgatttatattcagtcatcgcaaaaagtcttttttgatgaagcgatgaccatcgactattatgagaaagcgggtgcgttgatgctgaagagtccggcacaggtgctttctcccagaatgagtattttagtgaaatag

SEQ ID NO: 2415 - DNA, 198 bp, Bacillus licheniformis
atgtccaaaaaagtgcagattaaagtgatggacaacggcggtttccgggtcacgggagacgtcgaactgatcgacatggaaggaaatcctttccctgaaaaaccggctttttcgctgtgcagatgcggaaaatcgctgaaaatgccttactgtgacggaagccataaaggaatgttcgactcttgtgtcagagcttga

SEQ ID NO: 2416 - DNA, 972 bp, Bacillus licheniformis
atgattcaattgttaaaccaaaaagatccgcatacagcccgcagcattgtaaatgttcaaaggccggcttatgaaagagaagcggagatcattcaatttcagggcattccgcagctgaatgaaacggtttttgatgtaatggattcacgagaaactttcatcggctcgtttgagggggaagaattagccggaatcgcttccttcatacatacagctgaaaagctgacgatctgcaggctggccgttcatccggtccattttcgaaaggggattgcaatggccctgcttcgttatatattgatggtgaaggaagccgaatcgtttgaagtgacgacgggtgcggggaatgagccggcaaaagcgctgtatcggaaattggggttttctgaaattgaacagtatgaacctgaaaaaggggttgttctttcaaggcttacgctgcaagcaccgagaaaggttaaagtcgtctcctataaagaagaatggaagggcgaatttttcaaggaaaaaaagcagcttgaagcgcttttccggaatgaagtcttgcatattcaccacatcggaagcacgtcaattccgggaatgagcgccaagcctatcattgacatactgatcgaagtgaaagatctcggctccgccgccggcttcgaaaaggggatgaaaatgctcggctatgaaccgaagggggaaaacggaattccgggaagaagattctatcaaaaagggagacggaagcgtacacaccatgtccatctgtatgaaagcgggcatcccgatatcagacggcatctcgcgtttcgggattatttaatctcccatccggagcgggccgaagaatatgctgcactgaagatgaagctggcggagatgtttccgcttgacatagcaggctatattgacggcaaaagcggctggataaaagagactgagcgcttggctgaacaatgggaaaaggcggaggaggacagataa

SEQ ID NO: 2417 - DNA, 369 bp, Bacillus licheniformis
atgatttcaaaaacgccggagccgccgtattacgcggtgattttcacatcggtcagaacgaatggggataacggctacaaagagacggctgagaacatgctaaagcttgccgcagaacagcccggctttttaggagcagaaagcgcaagggacatgaacggaaagggaataacggtctcctattgggaaagccttgaagcgattgaaaaatggaagtttcacggcgaacaccggcaggcgaaggaaaaaggccgaacagaatggtactctgactttgccgtacggattgcaaaagttgaagacgccagaatttcggagcgttccggccggcccccgtcagatggcaccagcggggaggaaatgcaatga

SEQ ID NO: 2418 - DNA, 615 bp, Bacillus licheniformis
atgcgtcgtcattcatttttatctattctattgatttgcatgctgtctgttgtgtccgtattttcgttccggccttcagcagcttccgccgcttcccacaatccggtcgtcatggtccacggcatcggcggagccgattataacttcatcggcattaaatcgtatttacaatctcaaggctggacaagcagtgagctttacgccatcaactttatcgataaaacgggaaataatataaacaatgctccgagattatccgaatacatcaagcgtgtgctgaatcaaacaggagcatcaaaagtcgatattgtcgcccacagcatgggcggggccaatacgctctattatattaaaaatctggatggtgcggataaagtcggacatgtcgtcacccttgggggcgctaatcgtctcgttacaaacacggcgcctcagaatgacaaaatctcatacacttcgatttacagcacaagcgactatatcgtcttaaacagcctctccaaacttgatggtgcaaacaatgtgcaaatctcaggcgtaagccatgtcggtcttttgttcagcagcaaagtaaatgccttgattaaagacgggctgaccgccagcgggaaataa

SEQ ID NO: 2419 - DNA, 213 bp, Bacillus licheniformis
atgatgattacagtaaaaatacgccatactgctgaaaccgaaggcacagacataggtgacttcactcctgctgaactcgaaagcatcgtccagacgatcagaaaatacggagcttggctttcacctgatgccgacacagatgattataaatttacattccaagacgctaaatacaatctcgaacaaagagtctttgaaatcatagtggagtaa

SEQ ID NO: 2420 - DNA, 1530 bp, Bacillus licheniformis
atggcttacatagcaaaacgcatgatcataccgattatttttctcttcattctcgcttcctgctccgccggaggcgctggctcagcgaaaggggaagagaagaaactcacctttcttttcaatattccgagtcaaacccttgacccgaatcttgatgtcaattatacggctatccgcgccggcatcagtgaaacactcgtcaaaatcagtgcggacctttccatcgaaccgtggattgccaaagattggaaaagcaaagacggacaaacttgggtcttcacccttaaagacaatctgacgtttcaaaatggtaaaaaagcggatgccaaagcggtaaaagcgtctttagaacggacgatgcgcgagagtaaagccatgaagaacgccctaaaaatcaaggaaataaaggctgaaggacaaacattgacgattacaacgaaggagccgtttcccgaattcccttcagaattggttcatccaaacacatcgatcattgacgtcagcgcagcaaacatttctcaacagcccgtcggaacgggacctttccaagtttcctcttttgaggccggccataaaatagagttagaacggtatgacgattattgggacggcaaaccgaagctgaagcacgtcacattctcgtttaatgaagacgcaaacgcccgcgtcatggctctccaatcaaaagatgccgatatcatttacagaccgagcgttgaggatattgaccaaattcaaaaagattcgtcgattaccgttgattcggtaccgagcttgcgcgttcaccagattctttacaatacaaagaaggatcatcttgctgaccgccacctgcgccgcgccttcgacgcactactgaaccgcaaagaaatcgctgaaagcattttgaacggacatgctcagccggcagacggccccttcctagccgatttcccattttcctccgatacggttcaaaagccgagcggacttcaggctgcaaaagctgagctgaaaaaagccggctacgagcttgaaaacggtaaagccgtaaaggacggaaaagccttgtcttttacactgctaacctatcagtctcgtccggaattgcctttaatcgcgcaaattcttgaatcaaatgcgaaggaattgggcatttcgattaagattcagcaagtcgaaaatattgatgaatatttggcgaaaaacgatgactgggatttagcgacatacagctcaatgaccgcgccaagaggcgatgccagctatttgctgaacaccgcctatatgccgaacggcgctttaaactacagcggcatcgaaaatcaaaccttgatcaaatggattaaggaattcaaccgcacgatcgacaaagagaagcggaaccgacttgccaaaaaagcagctgaattgatcgagaaggagacattgaactcttttatcgtgactcccgaaaacatcacagcctaccgagacggtgtattaaattgggaaacgagcaaaagtgagtattatatgctgacgaaagatttggatgtgaaaacgaaatga

SEQ ID NO: 2421 - DNA, 942 bp, Bacillus licheniformis
atgaagcagatcgccaagcggctgtttgaactggtcctgttcttattcctgctttcatttatcagctttgtgtttatgaaagcggctcccggtgatccggtgaaacagatgcttcgcgtagatgatgttgcggtaacggacgagcagatcgaggcattcagagaggagctcggtttggacaaaccggtttatattcaatattggaactggttcaagcgctttttccaatttgatttgggaaaatcctatacaacacacgaacccgtcatcgacgagctcagccggaaattcccggcgacattgcttctaaccggcgcatcgcttctcgttatgctgctgattgccgtgccggtcggaacgctttccgctttataccgggatcggtggatcgatcatctcagccgcttgctcgctttagtgggagccgcgctcccgagcttttggctcggattgatactgatcgatctcttttccgtcaggctgaattggctgccgtcgatgggagccggaacgtttaaacatttgattctcccctctctcacgcttgggatcgcgatgtcgggcgtttatgtccgccttgtacggtcaagcctgatcgaaagccttggtcaggatttcatcagatctgccagggcacgcggcatcagcgaggcgagaattttcttctttcacgcgtttcgccattgtcttgtccctgtcatcacgatattcggggtcagcctcggcagcctgctcggcggcacggtgattattgaagtcctgtttgcatatcccggcgtcggcaagcttgtcgttgatgccatcgttcagcgtgattatccgatcattcaggggtacattcttttcatggggatcgcggttgtcctgatcaatcttttagtcgacctctcttatcggtacctcaatccggaaattcgcttaaaggaggctggtcgccgatga

SEQ ID NO: 2422 - DNA, 822 bp, Bacillus licheniformis
atgagaaaaaacgtatttcgatctaaaacaggactatggtttgtgctgctgttttccgcggcgctgttcaccgtccccttctttttgccgttcgatccgctccgcacagatatggccaaccgtcttcagccgatcagtatgcagcattggctcggaaccgaccatttgggcagagatatattttcccggatggtcgccggtgcgaaagcgacggtcggcaccgccttgggcgcgattctgatttccgttttcataggtgttcctgtcgggcttgtctccgggtttttcggcagacggctggaccggatgatgatgagaattgttgacgcggttatggcttttccggactatattgtcgcgattgttttaagcggtttgcttggtccggggctgatgaacttaatattggccgtcgtcgctgtcaaatgggtcggctatgcaaggctggtccgcagcacggttttttcggaaaaacaaaaagattacatcgccttggccgagcttaccggtttaagctccggggcgattttaaaaaagcacctgctgccccatgttctcggcaacctttccgtacttgcgacacttgatatcggaaaaacggtgttaatgattgctgccctgtcctatatcggcctgggtgctcagcctccatacccggaatggggcgccatgctgaacgacggaaaacattacttcttgcatgcgcctcagcttatggtgattcccggtcttgcgatcatgttcatcgttctgttgtccaacctgtacggtgatcgtttaagggacaggtttgacgtcaaacacaagaaaggagtttcttag

SEQ ID NO: 2423 - DNA, 843 bp, Bacillus licheniformis
atgccgatgttatccattgaggacttatcaatcagctcccggcagcacaccattgtcaaaaatgcctccttctcgattcatgaaggggaatggttcgcgctgctcggggaaagcggcagcggaaagagcctgaccgcttcggccatagccgggctgcttccggacggactaacggtgaccggcggagacgtgatatttgaaggccaacagatgcttcaagccggacgcaaagcactccgacgcgtgcgcggaaaggatatcgcctgtatttttcaggactgtcacggagcattcaccccttttatacggatcggcaaacaaattgacgaaatggtcaaaacgcatacaggttggtctaagaataagcgaagagaagcgattctccatgcttttcgggaggtttctctgccggaaaacagagtatatgaaagctacccgtttcaattgagcggagggcagctgcaaagggccgcgattgctcaagcgatggtgctccgccccaagcttctcatcgcagacgaaccgacgacggctttagacagcatcacggccgcggacgtcttgcaacagctcgccgcgatgcgcgccaaaacaaactgcgccatcctttttatcactcatgacctgcggcttgtcaaaagatacgccgatcaaaccgccgtcatgcaaaacggagaaatcgtcgaaagcggcttaaccgctgatttaattagacagccggcacatgaatatacgaggtgtttattcgcggccatcccgccgctgaaaaatcctccgccaaggctgacggcagccccgcctgaaacaaaggaagcggtgctggcgggaacaggaggtgcgtga

SEQ ID NO: 2424 - DNA, 786 bp, Bacillus licheniformis
atgacccattctgcagagaccgttctttttgtcagcaatctgacaaaacattacgcttgcggccacaaagcggttgacaacgtatcattctccattcgaaaaggcgaatgcctcgggctcgccggcgagagcggcagcgggaaaagcaccctcgcacgctgccttttgctgctcgaaaaaatcgatcacggagagattaggcttcatcaacatccgcttaccggcataaacaaaaaagagacccggagactgcgtcgaaaactgcaggctgttttccaaaatccagctgcatcattcaatccaaagctcaatattatcgattcagttatggagccgcttgatgtttccaaacaagacatgccgtcatttttaagggacttccgaggcagccgccgtctgacggctgagcgtctgttctcaatggtcggccttccctcgcgcctccttgaccgctatccgcacgaattaagcggcgggcagcgccagcgggccttgatcgccagagccatcagcactcatccgtctttaatcatctttgatgagcctacagcaagcctggatgtcaccagtcaggcgaagatcctggatcttctcaaagatttgcaggatgctatgggcctttcttatttatttatttcccacgatctggccgctgtccacttcatgagccatcgcatcatggtcatgaaagacgggcagattgccgatcaatttgaaaaagaagagcttttttctgccgaaaggcacccatatgccaaaaagctgcttcaggtgtttgaatcctaa

SEQ ID NO: 2425 - DNA, 1359 bp, Bacillus licheniformis
atgaatcacaagcaatatctagcactcgccgttccgctgatcatttcaacgatcaccactcctttattgggtgcggtcgatacggcggtcgccggccagctttcctcccctgcttacatcggcggtgttgcagtcggaacgatgatttttaatacgatgtattggctcctcggttttttgcgggtaagcacatccggattcgccgctcagtcactcggctcccaaaacagatcagagagcgttttggcccttgcccggcccgttttcatcgcgctgtttgccggactgatgttcatcatcttgcaaaaaccgcttgaatacgcagcgctgacgctcatacagcccgaccgccataccgctgaattcgcctcgcagtatttttcgctgaggatttggggagctccatttgctttaatcagctattgcattctcggctggctgatgggaatgtctctaatcaaagtgacattgcttttgcagatttcgatgaacgtcttgaatatcgtgcttgacatcgtttttgtctacgtctttcacatggaagtatacggcatcgctctagccactttgatttcggatgtgacgggctgcctgatcggctgctggcttgtgaaaacgaatgccgccatgccgtttaagctgccgtccgtcaagcttttattcgacccgaaaccgtttaaaaaaatgatggttgtcaaccgagatctattgattcggacattgtgccttttgacggttttcaatttatttacggctaaaggagccggcttcggcgctgaaattttagccgcaaatgcgatcttgattcaaattcattatttgatggcttatgtttttgacgggtttgccaatgcatcgagcatctttgccgggaaagccgttggaagaatggatcgggatctctattcccgtacgctttccctttcgatccagtggtcgctgatctcggccgcgctgctttcagtcggctactttctcttgagaaatgcgatccttccattgtttacaccgcttgaaagcgttctggaagcagcgaaaacttacgatgtttggatcgctctctttcctttggccgcaagtttcggactcgttttttacgggattttcacaggcgccaccgaaataggcccggtcagaaattcaatgtttttggctgttctcgtcttcctggccgccttttttaccgctgtccccgctttcggaaaccatgggctgtggctcgcttttcttttattcagccttgggcgttccgtattcttatgcatggctgttcccgggctgaccacccggcttttcggagagcgcagtgctgcgagagaggcaggccaaagaccgaaatcattaaaacaccccggctaa

SEQ ID NO: 2426 - DNA, 642 bp, Bacillus licheniformis
atgaagacaccttttatcagaaatgaccaatataattttattaagtttcaaacggacagcctcgtccagggacatgcgaacatcaatgacgaaaacgtccttgacgctttgaagtgcaatgcgctggatcaagtgttcaacctgtttcctgatctcagcagcgatcaaaagtctttgctggagaagctggcagaagtggaagacagcggtgaagcggtgcgctttttagctgaattaaaacttcatgtgattccatttcagaatgtaacggtaaagactgctaaaaagctgttctctaaagtgaaaaaactaaagacgcccgaatttgagcagatggatttcagcggatattcctacctgggatggaacgatgcaggatcaggcaggaaatacatgattgtggacgtcggcggaaagctgaccggaatccacggcaccatcaaatccagcaataaaaaaggaatctgctcgatatgcaacaggaccgaagagatcggactgttcatggcccgcgtgaaaagcgggaaagaaacctatacggacagaggcaattacatttgctgtgacagtgaaaaatgcaatcaaaatttgatgacgctggatcatctgaaccatttcgtcgcacaattaacgaaagaataa

SEQ ID NO: 2427 - DNA, 339 bp, Bacillus licheniformis
atgcttcgcgacagaggcagtatcaaatgggtttccatgatgctgcctgagcacgtggaattgctcagggaatatcatgaaagctttcaaaaaatcaaaaaaccgatcctggatgaacaaaaatatgaagaattcaatgaaatcatttgtgaagcgatggcagaaaacaggtttttgcaatttgcttattaccggcagggggaagtgaaaacgctcgccggccggattcactatgctgacgctctgaaaagggagctgcggatcgtaagccgggcggatgaaatttgcattttaaagatagaggatatcattgagattgaatacgattgtcgtttataa

SEQ ID NO: 2428 - DNA, 1263 bp, Bacillus licheniformis
atggattacagtcaatatccgtcgcgttcggttttgtgcgttgatatgcggagcttttatgcaagctgcgccggaaccctgctcggacttgacccgatgacttgcttcttggcggttgtcggaaacacggagcggcagggaagcatcgttctcgctgcttctccggctctgaaaagagagttcggcgttcaaacgggaacaaggctttatcagctgccggatgatccgcgcatcaagctggtcaatccgaagatggggctgtttgtccgtgtttctacagagctcacccggctgttctgccgctatgtgccgcctgatgccattcatacgtacagcgtggatgaaagctttattcaggtggacggtgttgaaagcatgtggggagacgcccgaacgattgcgatgaaaattcaagatgatatggaaagggagtttggccttccctgtgctgtcggaatcggaccgaatctgctgatggcaaagctgtgccttgaccttgaagcgaaaaaatcagcaggcggggtggccgtttggggctacgaagacgtgaaaacgaagctgtggccgctgtctccgctgcgccgcatgtggggaatcggctccaggctggaaaagacgttaaaccggatggggatttttacagtcggccagctggcgcactatgatctcagtcggcttgagaaaacattcggggtgatgggaaaccagctctattatcacgcttggggcatcgatctttcagcgattggagcgccgctcatggaggggcaggtcagctatggaaaaagccagattctgcttcgcgattatccgaatccggaggaagtcaagcatgtcattcttgaaatgtgtgaggaagtggccaaaagggcgcgcgcccaccgccaggcgggccggaccgtcagtctcggcatcgaatacagccgcgatgagcttggcggcggattttaccgttcaaaaacaatggaaagcccttcaaatgtcacgcttgatctttaccatacatgtctggcactgttcgagcggttttatgccggcaaaacggttcggaaaatttccgtctctttgtccaatattcaagatgacaccaatatgcagcttgatctttttcgccccgatcaggaaaagaagcggcagctcgggtatgtgatggacggcatcagagaacggtacggctcaacagcgcttttgcgggccgtttcctacacaaacgccgggacggcccgtctgcggtcaaaattggtcggaggccatcaggcatag

SEQ ID NO: 2429 - DNA, 213 bp, Bacillus licheniformis
atggatgagaaactgattgaaaaaatgctcggacaggcgctgaagcagtacggacgcaatgttgcaaccgatccgctcagccccggcgaaaaagaaatcctgaagctggctttgcaggaaaggcggatcgaggagccgaatgaagggctgcatgcccatatcgaggatgtcatctatgattatgtcacaaatcaaggcttgttctcatcataa

SEQ ID NO: 2430 - DNA, 1239 bp, Bacillus licheniformis
atgaaacaaaaatggcagaacatccacccgctcagctggaccattattgtcggaaccattttcggacgcatgggaacagccatgagcatcccttttttagcaatttatttgacacaagtgaaaggcgcctcttccggctttgcgggagctgtcattgcagcgagctctctgatcggaattgcggcaagcttttatggcgggtacttatcagacaggttcggccggaaaaccatcatgctcgtctcgattttcggctggacgttcgtgttcgccggttttgcactcgccgatcatgtctggacattctttatcatgaatgccttaaacggattatgccgcgctttgtttgaaccgacttcaagagcgctgctttcagacgtatccaaacccgaaacgcgccttttcgtctttaatctccgctataccgcgatcaacctcggcgtcgtcttcggcccgcttttaggcctgtatctcggatcttccaaaacgacgctgccgtttttcattgcggctttcatttattttatttatgcggcggtgctggtcattcaatttaaacaccacaccgtaccggcagctgagcgtaataagcgtataaaagtgcgggacgcgctggaggtgacaaaaacagaccgggtatttacgattacgctaatcggttcgattctttgtttgttcggatattcccacttcacatcgacgcttgcacaatacatggcggccagcccgttcattgaagacgggacgaaagtgttcggcatgatgctgacgctgaatgccttggccgttcttgccgtacagtacccgatcgtacatatcgccaaacggttttcaccgattttatcgctgattgcaggaaatgtgctgattagtggaagcctgttcagcctctcttttttccatgatctatggtccattgtcttgatcattatcgtgtttacgatcggggaggtgcttctcttttcgatgatggatttactggtcgaccggattgcccggcctgagctgaaaggcacttactttggggctatgggcttcacccagcttggaagcgtggtcggcccttgggcggggggaatgctgctggacacctttggagcggaaaaaccgtttttcacttttgcaatcctgtctgctgccaccatttgcggcgttcctttcctggtagcagcctaccggaaactcaaaatggatgaagcaaaagtcaatttaagttcgaaaaaaacgatgcagcattaa

SEQ ID NO: 2431 - DNA, 384 bp, Bacillus licheniformis
atgatccatcatattgaactgtacgtttcagatttggaagcgtcgaagcgcttttggggctggtttctcggggagctcggctatgaggtttttcaacaatgggaaggcggcatcagctggaaagcaaacggcgcctatctcgtgcttgtgcaggcgaaagagcagtttatcaaagcgggttatcacaggtgccgcgtcggcttaaaccatcttgctttttacgcggcatccaaagagcaggtcgacgaaatgacaatgaaactgagagagcggggatgccgcattttatatgaagacagacatccgtttgccggcggaaacgggcattatgccttgtataccgaagatccggaccgcatcaaagttgaacttgctgccccttga

SEQ ID NO: 2432 - DNA, 960 bp, Bacillus licheniformis
gtggcgaatcaggatttgaatttgcacacgttatatacgagtcatacccgtgatgcctgggcaaatctcggcgggcatatgtcggtaaagatgaccgaagaggaagtaaagaagcttgaaggtttaaatgactatctgtctttggaagaagtcgaaaccgtttatgttccgctggcgaggctgctttatttacaccgggcaactcaatatgaacggaacacccgggtaaacggttttttgaatcatcctcacgcggccaagattccgtttatcatcgggattgccggaagcgtcgcggttggaaaaagcacgacggcccgcatcattcagactgtgctctcccgtttgcaggaacggctgaaagtcagtctgatcacaaccgacggttttctttatcctaatgcggttctgacagaaaagcagatgatgtcgaggaaagggtttcccgaaagctatgatgtcaaagcgctgcttgagtttttgaacgatttaaaatcaggaaaggaaattgtccacgcacccgtttattcccatctaacgtatgacagattggaaggggtttatgaaacggtagaacaagcggatatcgtgatcatcgaaggcgttaatgtgctgcagacaccgacgatcgaagacgaccgtacaaaaccgcgggttttcgtttccgatttttttgacttctcgatttatgtggatgccgaagaagacctcattatcaaatggtatcttgaacgctttcgcatgctcagggagacggcttttcaagatccgagttcttatttccataaattcaaagacctcgcggacgaagaagcggaccatatggcaaagtcaatatgggagaccgtcaaccgtccgaatttgtatgagaacattctgcctacaaaattccggtctgatttaatcttgagaaaaggcgaaggccacaaggtggaagagattttggtcagacgggtatag

SEQ ID NO: 2433 - DNA, 966 bp, Bacillus licheniformis
atgtctataaagaatatttataatattttcaagaaagagcttgcatttcaatcgtattctaaattgctcatcattttattgcttcctctattattcatttcatccggatacatatatgttcactataaaaatacaatggacagctaccagcagttcaaaaagactgaaaatgaatataaagaactcggcatcgatattaagcaggcgctggagtcgcccgtcaaggtgaaggaaggtgagctgaaaagcgaggatggcgacggagagatcgtcgaaaatattttaaggttcgactatgagaatttcgtcttgtccctccatcacctggagccgaaacagtcagtcactatgacgcttgagctgatgggcttcatcatttttcccttggctttcacgctgtatgccatctatatctcctcatacgacatcagattcaagacgatgaaagtgaaagcggtcagccatgattggaaatccgttctgtttgccaaacagtgttcggtttacatggtgatggctgccgccgtgatcgccgttgtatgtacggcatatgtgtcaagcctcgtcttttattcccttgcttcaagggatataccggtcggcgagttcacaatacccgctgtttcaaaaagcaatatcctgcttcagctcgctgtcgttctggcggtcagcttcatcttttcgacgatcggattttatttgggcgtcctcttcagaagctttattacgcctgctttgctttatgtcgtttacagcctgctgatccctgctttgggcaggttcgatttaaaaaacctgctgtctaatctcgggcatgcggttttcagtttcagcggcggctttaaactgtttacaccggtgaaggtggacatgattccggtcatcatcattttagccgcatccgtcggcttgctgtctgcggtcacttattacatggcgcacaggcaaagcaaatatgtcgtttga

SEQ ID NO: 2434 - DNA, 663 bp, Bacillus licheniformis
ttgatcaaaatcgatgacctgacgaaatcttatggaagcaaatcggtattcaaccgtctcaacatgaatattgaaaaaaacaaagtcacctttctgatgggagaaaacggcgccggaaaaacgacgctcttgaaatgcctgctcaagcttgaacctttcgaaggcggcatactgtacgacggcgagccgcttgaagcagtcaggagcaaagtccacgtcatctatgacgattccccgttttacgatcatctgagcggctatcaaaatatcaaactactgatcaataaacctgccggcaaagaagagcttgaacaattgtcgcaaaagtttctcggcagggagctgctgaaaaaaaaggtcaagacctattcatacggacaaaagaaaaagctggccttaatgatcgctgcattaaacaaaccgtcattcttgtttttggatgagatatcaaacgggcttgactaccggtccatgatggagcttcaggagctcatcaatgactggtcaagcaggatgacgattgttgccgccggccatcagtttgagttttattcttcaatcgtcgatcaattatacgtgttgaaagacggttcagctatccacatagacaattttaaaacgaatggagcagaattgggcgatgtctataaagaatatttataa

SEQ ID NO: 2435 - DNA, 204 bp, Bacillus licheniformis
atgaaaaaagcgattttagggttttctttgtctgcggcgctcctggttccatcctcattcgctgcggctgctggggacgggcagctgacaagcgagcaaaaggaactgcttgaagccaagacagaatacgttcaatcacttcctgaacaggcatccgttcaaagcggtgtgacggcttatgcaggaaaaagggctgacaattaa

SEQ ID NO: 2436 - DNA, 261 bp, Bacillus licheniformis
atgtttcaaaacaaaatcaaaaaagcagtcggagcggttgcatttgcaggtgctttgttagtgtctggattgcccgtaagtgcggatacactgcctgaattaatatgggtgagggacaagtatcccggtgcgcaatacgaatataaggtaataaatggcgagagatatgtcgatgtttacagagtaataaatggtaaaacagatgtcacacgcgaaaaatgtgaaacgatgtaccaagaccgctgctatgtcaaaaaataa

SEQ ID NO: 2437 - DNA, 507 bp, Bacillus licheniformis
ttgatctatatatacaattgttacggcggcactcattcatctgcacttgccgctgcttatcatctgaaaaagctcccattcagcagaaaaccaacaagaaacgaaattttaagcaccgactgttttaatcaattaagtccgaaggaaatgggaaaattaatctttcacggacttgatgaagaaggcaaccaggtgtacacgatcggcagaggatcgtcaaaagctgtcattccagccatgcgaggcgttctcgagctgtttgaaaaaaacgggaaacttcaggagaaagtcattttttcaaacacgtctccgactgtgccaatagcgatgacattcggcggtttattttcgaggaggctgaaaatcgatccgatcggggttcctttgctggtgcttggagcgcagcaggcataccaagacatcatcaagcttgtgcagcaaacaaaaaaccatgcaaaaacgacttcttcgatgatcgaggtactcgataacggctttaaaggatag

SEQ ID NO: 2438 - DNA, 723 bp, Bacillus licheniformis
gtgcaggaagaatggaacccattgatgaaaaatcgttgcatcatctggttagtcacggggatttgcttaacggtcatctttcaatttccgctgaaaagcgtcgcttcatccgcagacaaatacgccaattttgccgagcttgccgaacatgaaacagaaggagaagattaccaaatcgaatacacagacatgggcaccgaactgttgattctttcaccgcacggcggaggaatcgaaggaggtgtcagtgaacttgtccgcgccttcagcgccgattattccacttatttatttgagggaatcaaaccctcgcaaaactgggatctccacatcacaagcaatcattttgatgaacctcaggccctcaaagcggtcaaagagcacagctatgtgctggcttttcatggatatcatgacatcgttgaacatacgcttgtggggggaacggatacaggaggggcgaaagcgattgtcagagcgctgctgaacaaaggtttttcggcggagctggtcagcccgagccaccggcttgcaggaggaaatcctgaaaatatcaataatcaatgcaaaacaggtcaaagcattcaattggaaatcagcacgcctcaacgagaggcttttttttcggagttcggcctgtggacgcgggcaagttctaaaaatgagacgtttcaagcgtatgtctcagctgttaaagaagttctggaaacgaggtataaataa

SEQ ID NO: 2439 - DNA, 783 bp, Bacillus licheniformis
atggagcagaagttgaaagcgcacaaagtgatgattacaggagcttcaggagggcttggcgaacggatcgcatatcatgctgcaggggaaggagcggagatcattctggctgcgcgcagaagagaccgcctcgatgctttgaagcaaaacatcgcggataaaaccggcgcaaagtgccgtataatcgtattggacgtcagccggacggatgaagttgaagcggcgtttcaagaggccggtccggttgatattcttgtcaataatgcggggttcggcatttttgaaagcgcgcttgacgcttcccttgaagatatgaaagcgatgtttgaggtcaacgtattcggtctgatcgcctgcacgaaaatggcactcccgcatatgatcaggcaagacaaaggccatattatcaatatcgcttcacaagcgggcaaaatagcgacgcccaagtcaagcctttatgcggcaacaaagcatgcggtgctcggatattcaaacagcttgagaatggagcttgcagaaacaggggtcaacgtgacaacggtcaatcctggaccgattcaaacagactttttcaagacggcagataaaaaaggcgattatgtaaaaagcgtcgggagatggatgctagatccggatcgggttgctaagaaaatcgtctcggcaatgatgacgaacaagcgcgaaatcaatcttccaggctggatgaacagcgtcagcaaactctaccagcttttcccttcgctggttgaacgaacaggtcgaagcgctttctataaaaaataa

SEQ ID NO: 2440 - DNA, 819 bp, Bacillus licheniformis
ttgaagagcgagctggccgaacagggactgtcattaagcgatatcgaccaggtcgtcctgacccaccatcacgctgatcacgccggactgctgaacgaattcccggcagaggtaaaaatcattggccatccgttcaatgaaccgtatatcagtcaaaatcccgattttattgaaaaacaaaagtccttttttacatacctgtttcaacgattcggcgttcccggcgatatgaagccgccaggccataccataaaagcgtcgtaccggtattcatgtaatcggacattgacagagaccgtttcagaaggtgggcaaattgaagggcttgacgggtggcgggttcttgagacgcccggacatgccgcttcgcatattgtcctttataatgaagaacttggaagcatgctcgggggagacttgctgctaaagccgtcttcttcaaatccgcttctggaagtgccgcaaaaaggagggaaacgcccgactccgctgctggattacctggaatctctcggcaggctgcaggagcttccgcttcacatgatttatcccggccatggggaggaaatcacaaaagtgaatgagcttgtcgccaaaaggctggaaaagcagcgaaacagagccgaagaggtgtaccgcatcctctctgaaaaaccgcattcaccttatcagatatgtcgaaaactgttccctgcagtctatgaaaaagagctgttcttaacactgtcagaaacgattgggcagcttgacgatctggaatcccaggggaggatcggagttgatgcggccgatggaatcgattactattatgcaaagtag

SEQ ID NO: 2441 - DNA, 822 bp, Bacillus licheniformis
atgaaacgaataggatttatcggagccggttcgatggctgaagcgatgattaaggggcttgtcaaaagcggtgcaatggaacctgaggcgatattcgttacgaatcagtcgaatacggccaggcttcgtgaattaagcgagacttacggggtatgcggagaagcagatacggcaaaagtcgccgcccggtcggatacactcgttttggcgatgaagccgaaagacgcggcaggaggaatagccgcactccgcccctatttgcgaaaagaacagctgctgatctctgttcttgcaggcattccgattcatacgatccagcactatgccgggcttgagctgcctgttgtgagagccatgccgaatacatcggccgccattcaaaaatcagccacagcctttgcggcaagcccgcttgtcacgaaagagcagatgcaggaagcggctgacctctttgcgacggtcggcagcgttacaatcgttgaggaatctgcccttgatgctgtgacagccgtagccggaagcgggcccgcttttgtttatcggtttgtcgaagccctgcaggcgtcggctgccgagctggggcttcctgaaaaaacggcgaaacagctgattatcgatatgatggcaggagcggctcaaatgcttgaaaccggcagagatccttctgtcatgaggaaagagatcacaagcgccggagggacaacggaagcaggccttaggatgcttgacgaccatcaatttgaacagaccgtcatatcctgcgtcaaagaagcggcgaatcgttctgcggaactcagggatatgtttgccgccaaaatttaa

SEQ ID NO: 2442 - DNA, 1605 bp, Bacillus licheniformis
gtgaagtggcagacagtggaagaactgaaacggctgctcatttctcttgttcaatacgaaagcatctcaggcacggccggagaagtggcgcttgcgaaatatatgcatgatgtcttaaaggaccgttcgtactttcaaaagaatcctgaatacttaaagcttcacccgatggaggatgggcgctattttttaaccgccctcgtcaaaaaggaaaagaaatcaaatacggtgctcctcttgagccattttgacgtggtcgatacggcagactacggagaattcaaacatatggcatgcaaagtcccggaactcatggacctattaaatgataaaaaagaacttttgcctgaacgggtcaaaaaagacctggaaagcggcgaatggctgttcggtaggggaagcatggatatgaaagcgggtcttgctgttcaattttctatgctggaacgggcgatgaacggagaatttgacggaaaccttctattaattacggttccggacgaagaagtcaactcgcaggggatgcttgaagcagtacctgtactgaaagctttagaaaaagaatttggccttcattatacagcgtgcttaaactgtgagccgatgtttgaaaaacatccgggtgatccgaagcagtacgtctattcaggcagcatcggcaaagcgcttgccggatttttctgcaaaggggttgagacgcatgtcggcgagccgtttgcaggggtgaatgcgaatctaatggtgtctgagatcaacaggctgctcgaattaaacgtcgactattgcgaagaagcggacggagaggtgacgcctcccccggccaatctgatgcaaaaagatctgaaggaggcctactcggttcagactcctcacacagcggtgtcgctctttaatgtgctgatgatgcagcgttccgccgccgagctccatcgcatgctgctcgacacagccagggaagcggccgccaatattcaaacaaatatcgaacgtaaaacggccgaatatcagcggtttgaagccttcacgccaattaacccggccgtttccgtgatgacgtttgaggagctgtggaacaaagcacaggaaaaagccgggaagcccgaggcggaacgcatcctcaactttgcatttgcgaacaggggggagcttggagaccgcgacttttcaacgaaaatcgtctctgaattggcttcactctgcaaagaagatgctccgatgatcgttctgttttacagtccgccgttttatccggctgtttcttcaaaggacgatcctctgatccgaaaggtgatgagagaagtgaagcagtatgcggccgacaggcacggaattgaatttacagaagtccaatatttccccggcctgtccgatttaagctacctgcagctgcaaaaacagtcagtcgatgcgttcacatccaatatgccgctttttcatcacggctattcacttccaaaaggacgcgaaaacgcactgtttgtgccggtcatcaatatcgggccggccggcaaagatcctcacaaatggacggaacgtctccatgtgccgttttcatttggaaagctgccagatatcctccggctcgcgatacacaagcttctctaa

SEQ ID NO: 2443 - DNA, 1020 bp, Bacillus licheniformis
ttgagtaatcgaaaactattcacaccatggagtttaaaaggagttacactaaaaaaccggattgtcatgtcgccgatgtgcatgtattcctcccatgaaaaggatggaaaagtgcagcctttccacatgacccactacatctcccgcgccgtcggacaagtcggactaatcatggtagaagctaccgccgtcactccgcagggaagaatctctgaccaggatctgggcatatgggatgacgcgcatattgacggacttgctgcattgacgtcacaaatcaagacgtacggcagcaaaacggcgattcagttggcgcacgccggaagaaaagccgaggtcgaaggtacaatctacggaccttcagcgattcctttcgacgaaaattcgcgaacgcctgttgaaatgacaaaagaggacataaaagaaaccgttcaggctttcaaaaaaggagctgaacgcgcgaaagccgccggctttgacatcatcgagattcatggagcccacggatacttgatcaacgaatttttatcaccgctttccaacaaacgcgaggatgaatacggaggttcaccggaaaaccgctacaggctgcttcgcgaagtcatcgacgctgtaaaagaagtctgggccggaccattattcgtacgcgtttcagcttcagactacaaaacaaaaggccttgatgtcgccgattatgtcggtttcgccaaatggatgaaggaacagggcgttgatttgatcgatgtcagctccggtgctgttgtgcctgctgatatcaacgtcttcccaggctaccaagtcggcttcgccgatacaattcgcgctcaagccgagattcagacaggagctgtcggattgatcactagtggccttcaagctgaggaaatcctccaaaatggacgcgctgatctcattttcgttgcacgggagctgctgagagatccatactggccgaaaaccgctgccaaacagttgaacacaaaaattgaagggcctgttcagtacgacagagcctggtaa

SEQ ID NO: 2444 - DNA, 762 bp, Bacillus licheniformis
atgaccataacggaaagaatatatactgttgaagggtgcatgttttatacaaagcagagaaaaggaaaaaagaacgcaacgattatttttgaagcgggctacggtttttcttcaacgacttggcagcccattttatccgatatagacgaagatctcggcttgtttgcatacgaccgtgcaggccttggcaaaagcgggccgagcaccagcaaacgaacagcggatcagatggtgaaagaactaaaagcgctgcttgcagcagcagacgtcaaaccgccctacctgtttgtcgcccattcgttcggcgccgtcattgcaaggctgtttgcaagccggtacagcgatgaagtcatcggcatggtgctgcttgatcccgcttgtgaagatcaggaggaaaaagtgctgccgctacttccggacacattaaaagaagattatgtcaaacagttttcgatcgaagggtcccatgaggactttaaacaaagcctggacatgctgaagcaggaaaagaaacacctcggttcggttcctttgctcgtcctctcggcgggaaaaaggacggaggcggcgaagcaagctcatcaagaatggctgaagcttcacagcagactgctgtctctatcgcatcaaagcggctggattcaggcgaaaaacagctcgcatttgatccatcatgatgagccgcacatcgtccagcttgcgatctatgatgtgtggtatgcggcacagcagcaaacatacgcctatcaagccgccaattaa

SEQ ID NO: 2445 - DNA, 150 bp, Bacillus licheniformis
atgagagtaaaaattacattggcgtgcaccgaaacaggggaccgcaattatattacgacaaaaaacaaacgcacaaatccggatcgcctggaattgaaaaaatattctccgcgtctgaaaaggcacacgattcaccgtgaaacaaaataa

SEQ ID NO: 2446 - DNA, 924 bp, Bacillus licheniformis
ttggagttattatttttaggaacgggagcgggcatccccgcaaaaacgaggaatgtcacatccgttgcattgaagcttttagaagaaaggcggtctgtttggctgtttgactgcggggaagccacacagcatcaaattctacatacatcgatcaaacctagaaaaattgaaaagatttttattacccatcttcacggcgatcatgtatacgggcttccgggtcttgtcagcagccgatctttccagggaggggaaggcccgctgaccgtatacggaccgcaaggaatcaaaacgtttcttgaaacggcgcttgacgtatcggggacgcatgtcacatatccgcttgtgattaaggagattggagaagggacagtctttgaggatgaccagtttatcgtgacggccagaagcgtatctcacggcattcccgcttttgggtaccgcgtgcaggaaaaagatgttccgggcgcccttgacgctgaagcactgaaagagatcggagtctcgccgggccctgtttatcaaaaactgaaaaacggggagacggtcacattggaagacggccggacgattcatggggcagactttatcggaccgccaaaaaaagggcggattgtcgccttttccggggatacgaggccatgcgagaatgtgaagaggcttgccgaaaaagccgatgttctcatccacgaagcaacatttgcgaaaggcgacagggagctcgccggagactattatcacagcacttcagaacaagctgctgaaacagcgcgggaagcctgtgcaaaaaaactgattttaacccatatcagtgcaagataccagggggaaaacgtgcttgaactggtcgatgaagcaaaagcgatctttcctgataccgtggcagcttttgacttttatgagcatgagatcaaaagaacttaa

SEQ ID NO: 2447 - DNA, 1479 bp, Bacillus licheniformis
ttgaaaaaagatcaaatggaaccaaaagcagttatcgtaatatttggcgcaacaggggatttggcaaaacgaaaactatatccttctatccacaggctctacgaaaacggacaaatcgggaatgaattcgcggttgtcggagtcggcagacgcccttggacaaatgaagactttcgcagtaccgtacagcaatcggtttcgaagtttccgttaaacgaaaaggatgtggacgagtttacatctcacttctactatcatccttttgatgttacaaattccggctcataccgggaattaaacgaacttatagagaagctggaaagtacatatgatattccgaataaccggatgttttacttagcgatggctcctgaatttttcggaacgattgcaaagttcctaaaatcagagggtgtcacttcaacaacaggctggtcaaggctcgttatcgaaaagcctttcgggcatgatctgccgagcgcaaaagccttgaaccaggaaatccgtgaagcttttacagaagatcaaatttatcggattgaccattatctaggaaagcaaatggtgcagaacatcgaagtcatccgctttgccaacgcgatttttgagccgctttggacaaacagatacatctcgaacattcaaattacgtcaagtgaagatttgggtgtggaagacagagcgagatattatgaaaaatcgggtgcgcttagagacatggtgcaaaaccacattcttcaaatggtggcgctgcttgcgatggaaccgccgatcaagctgaacacggaagagatccgcagcgaaaaagtgaaggttctcagagcccttcgtccgattcaaaaagacgatgtcgaccaattttttgtgcgcggccagtatgacgcaggagtcgtcgacgaaaaacatgttccggcttatcgcgatgagcaaaacgtagcaaaagattcgaatacggaaacgttcgttgccggcaaactgctgatcgacaacttcagatgggccggtgtgccgttctacatccggacaggcaaacggatgcagaaaaaatcaacgcagattgtcgtccaatttaaagacattccgatgaatctttattacggaaacggcaacacgatgcaccctaatctgctggtgattcatattcagccggatgaaggcatcacccttcatttaaacgcaaggaagcttggaggcggcacttttgcccagccgatcaagctcgactactgccataactgcggggacggcatcaacacgcctgaagcttatgaaaagctgattttggactgcttgcacggagacgcgacaaactttgcccactgggatgaagttgcgctttcctggagttttgttgatgcgatttctcaaaactgggaggaaaacaaaaccctttcccctaactataaggcgggctccatggggccgaaagcttctgacgacctgctcgcaaaagacggctttcattggtggccgctttaa

SEQ ID NO: 2448 - DNA, 1965 bp, Bacillus licheniformis
atgactgagcagctttcggaaaaagatcagcaggaactgctggagaaatacgatcctgaagcgggaacgagaaagctcaaaggattgacaggggccattgcatttgccggcctgctcgctttttctttgtttcaattatacacagccatttttggcgtttttccggctcaaattcaaaggtccgttcatttagggtttgcgctcggtctgatttttttgctgtttccggcgacaaaaggtttgcggaagaccggcaaattcaaagtcgcctggtatgacgcaattttagccgtgttaggagcaggcgtcggcgcttattgggtcgccaattatgaaacgattgtgggcgggatcggattgatcacggaaactgacttttatgtcgggctgttggccgtcctgctcgtattggaagcgacgagacgggctgtcggactgccgattacgatcatcgccggcctgtttcttttgtatggcctttacggctcgtatcttccgggctttttgtctcacaacggcctgacgatggaacggctcgttcagacgatgtattttacgacggaaggaatcctgggcacgccgctcgctgtgtcctcgactttcatcttcctgttcatcctgttcggttcttttcttgtcaggacaggagtggggcagtattttaatgaccttgccgtagcgatcgccggacgaagcacgggcggaccggcaaaagtcgcgattttttcaagcgcccttcagggaacgatcagcggcagctctgtcgccaatgtcgtcacttccggatcgtttacgattccgatgatgaaaaaactgggctataaaaaagaattcgccggtgcagtcgaagcttccgcatctaccggcggacagctgatgcctccgatcatgggagccgccgcctttttaatggttgagttcatcggcggaggcattacgtactgggatatcgcgaaagccgcggcgatcccggctgttttatactttacgggcatctggatcatgacgcactttgaagcgaagcgcctcggcctgcgcggactaacgaaagaagaaatgccgaaccgcaaggaagtattcaaaaagatttatttgctgcttccgatcatttcggtcgtcgttttgttaatgtcgggcatcacggtcatgcatgccgctttgtattcgatcgttctggcgatcctggtcggtttgttcaataaagaaacgcgaatgggcgttaaagggattgtgctggctcttgcggaaggagcgagaatggcgctttccgttgcggcggcaacggcagctgccggcatcatcgtcggagtcgtcacaaagacgggtctcggcctcaaacttgcaaacggcctgctcgatttggcaggaggcgcattattgccttcgctctttttgacaatgatcgccgctcttgttctcggaatggggtcgccgacgacggcaaactatgtcattacgtcgacgattgccgcgccagccttgattttgctgaatgttcctgatctgtcggcccacttgttcgtgttttatttcggcatcgtagctgacattacgccgcccgttgctttggcagcatttgcagctgcgggggttgcgggaggagagccgatcagaacggggatcaattcagcaaagcttgcgattgccgcttttatcatcccgtatatattcgtcctgtctccggagcttctcatgattgatgcgcattggtatgaaattctctgggtggtctttaccgcattgtccggaatgatcgccatcggcgctggcatgatcggattctggatgagaaaagtgttctggtttgaaagaatactggcggctgccagcggtcttctgctgatttatccagaaggctattccgatatgatcggcctcggcatattccttctgctgttcgtccttcagctgatgtggaagcgggacaaaagccatccggaagagatgcaggccttgaaagcataa

SEQ ID NO: 2449 - DNA, 519 bp, Bacillus licheniformis
atggggaaattaaaaatcataaaacggcttgtgccggcgctgatcattgccgtttttgcagcggcatgcctgattccttatcagaccgccgtcgtgttcgagaaagaggacagcggcgagatcatcgcttttcttcccctccaaaagaagaaaagctttgatgtggtctatacgcattccatccatcggacagaagtgatcgaatcgtatgtgtgggaaaaagggatgattcggcagaccgctctgacctatcatgatccggccgtcggaatgcccgcaaacgcagaacaaggtgaaaggctcgacatcaaaaacggcgtctacaccatttcgaacatgaagaggacctttccgttcatcgatatgcggatcggcagggtgagggcgaatcacaggatcaagtattcaggcgctgaacatgagttaaagcggtacatccgtcccggcacatggacaaggatgagtgtccgaaaactaaatgtcttgcaacaactgaggggagtgaagatcaatgactga

SEQ ID NO: 2450 - DNA, 990 bp, Bacillus licheniformis
atgaaaaagtggaaaagcctatcatggatggtattgctgctgacgctcgtcatgggattggctgcgtgcggaagcaacaatgcatcaggaaataaggacggcggatctgcgtcaaaaggatcaggaaactacagtctgctgacagggggaaccggcggtacatattatccgcttggcggtcagtttgcaaacctttgggaggatgccacaggagacaaatttacgacgcagactacaggggcttctgctgaaaacatggcaactctgcaaaaaggggaagctgaagtcgctttttcccagactgacattgccacttatgccatagaaggcaaagagatgtttaaagaaaaaattgagggaatcaaggcgattgccgccctgtatcctgaaactgtacagattgtgacaacagaaaaaagcggaatcaattcggttgaggatttaaaaggcaaaacggtttccgtgggtgctgcgggagcaggggtcaacattaatgccaagcagattttggaggttcacgggatgtcttttgacgacatcaaaccgcaaaacctgtcttttgaagaatcaaccgacggcattcagtcaggcgctatcgatgccgcattcatcacggctggaacgcctacaggcgctgtcgaagggctttccgcacaaaataaaatcaaaattataaacattgaaaaagacaagcagaaaaagctgattgaaaagtatccgttctatgcggaggatacgatcaaaaaaggaacctacggcatcgggagcgatgtgaacacggtcgctgtcaaagcgatgctcgtcgcatccgacaagatggatgaggacaccgtctataaaatgacgaaagcgctgtttgaagccgataaaatcaatcatgcgaaaggcgagtttatcaagcctgaaaccgcgcttgaaggattgggcgatatcgacattcatccgggagcggctaaatacttcaaagaaaaagggatcgaaaaatcgtaa

SEQ ID NO: 2451 - DNA, 714 bp, Bacillus licheniformis
atgagaaaatacgaatatatttcaaacgaaatgaggaggcggattcaggaggaatactatccgattgatcagcccatacctgatgagctttctctcgccaaggaattttcctgcagcagaatgacgatgaaaagagccctcgatattcttgtgtcagaaggcatgctgtaccgcaagcgcggacacggcaccttcattgtaaaatcatcgattcagcagcttcccgtcagtgtaacagaccgcgaaaaccttgggctgaccaagcttcttgccaacaaacaaatcgaaagccgcatcattcaatttgacgtcgaattcccttcagatgaagtggcaaagcaattgtcaatcgaaaagaccgttccggtgtatcatatcatcaggctcagaaaggttgaaggcgaaccgtatgtcattgaagaaacgtatatgccttcgaacgtcatctctgaattaaatgaagacgtccttcacggctccgtttaccggcacatcaccgagacgctgaaactgacaatcgccggatcgcaccggaagatcagggcggataagtcgagtgcactcgaccgagagtacttggaatgcgcccctgacgatccggttcttgaagtcgaacaggtcgcttttttaaatacgggggaaccgtttgaatattcttttgcaaggcatcgctatgataagtttgtgttttcgagcgtccatattcggaaatga

SEQ ID NO: 2452 - DNA, 1416 bp, Bacillus licheniformis
atgtcaaaaacagaaccgcagctagaacaaattcaataccgttttccaaatggcttctggtgggggtcggcggcttccgccactcagactgaaggagcggcggccgaaggaggcaaaggaaagaacatttgggatcactggtacgaaaaagagccaaaccgattttttgacggagtaggccctgagaagacttcgcgtttttacgagacttacagagaagatattcagctgatgaaagagcttggccaccactcttttcgtttctccatttcgtgggctcgtctgtttcctgatggaaaagggcggctgaacaaagaaggagctgccttttataaccgagtcatcgatgaactgcttgcggctggcatcgagccttttgtcaacctttatcattttgacatgccgcttgcgctccagcaaatcggcggatgggaaaacaggcaagtcgtcgatcactttgcttcatacgcggaaacgtgcttcaggctgtacggggaccgagtgaaaaaatggtttacccacaatgagccgatcgttcctgcagaaggcggctatctatacgattttcactatccgaacatcgtcgactttcaaaaagccgtccaggtcgcataccatgaaattctttcaaacgctaaagctgtcgaagcttatcgcagactcgggggcgacggcaaaatcggcatcattttaaatttaacgccgtcctacccgcgaagccagcatccggcagatgtaagagcatctgaaatagccgacgctttctttaaccgatcgtttcttgatcccgccgttaagggtgagtttccgcagcttttaacagatatattaaaagaagaaggctatttgcctgtcatggaagaaggagacttggagctgatcaaaaatcacactgtcgatctgctcggcatcaattattatcagccgagacgggtgaaagcgaaggagcacctgcctcatccggacgcgccttttatgccggaacggttttttgaccattatgaaatgcccggacgaaaaatgaaccgccaccgcggctgggagatatatgaaaaaggaatctatgatattttaatcaatgtcaaagaaaactacggaaatattgaatgctttatttctgaaaatgggatgggcgttgaaggagaagaacgtttccgcggcgaagacggcatgatccgcgatgactacagaatttcgtttataaaagaacacttaaaatgggtgcacagagccattcaggaaggagcgaatgtcaaaggctatcatctttggaccttcatggacaactggtcatggacgaacgcctataaaaaccgctacggttttgtatctgtcaaccttgacaaaaacggcgaacgaacgattaaaaaaagcggatactggtttaagaaagttgccgagaacaacggtttttaa

SEQ ID NO: 2453 - DNA, 387 bp, Bacillus licheniformis
atgaagcaggtcgcaaaactcggagcagccccgggaattttcaacgtaaatgaaccgatcattttcggtctgccgatcgtcatgaacccgctcatttttattccgtgggtcatctcgccgatgatcgtcactttgattacgtatttcgcgatggcgtccgggcttgtaccgccgccgaccggggtcacgattccttggactgtgccgatctttatcagcggaatgatggcgaccaattcgcttgccggcggcattcttcagattgtgaatttagccgttgtctttatgatctggttcccatttttgaaattcatcgaccggatgaatatgaaaaaagagcaggagatcaatgaagcggaacaagaaaagacaacactaggactttaa

SEQ ID NO: 2454 - DNA, 894 bp, Bacillus licheniformis
atgtttgaaaaattgagcaacctcttggtgccgattgccgggaagctgaataataaccggtatttaggcgtgctgagggatgcatttatgctggcttttccgctcaccattttcggatcgatcattgtcgttttaaccaatttgccgtttctcaataaaatgatgagcaaatccgcgcttgaaacgttccagtcggctttaagcatagcgccgagcgcaacgatcagcatcatgtccgttttcgtcgtattcgggatcgggtattatttgtccaaaacttatgaagtcgaagcggtttttggaggagtcgtcgctttggcatcgttccttctgctgactccgtttgtattaaacggcgaaggaggggaagtgattccgaacgtcatcccgattgacaggctcggtgcgaaagggatgttcctcggaatgattaccgcctttacatccgctgagattttcagattttttgtccagaaaaactatacgatcaaaatgcctgccggcgttccgcctgctgtagcaaaatcttttgccgcgctgattccggcggtgatgaccttgtccgtctacttggtgatcaatatccttgtaacccaagcgttcaatacgaatatgcacgatttaatttacaacctggtgcaggctccgcttgtcggtcttggaagcggtatcattccgaccttgattgccatatttttcactcagctgctctggtttttcggactccacggacaaattatcatcaactccgttatggatccgatctggaatacgctttcgatcgaaaatttgaatagctataccgcaacaggagaagtgccgcatattatcaataagcagtttatggaagtctacaccgtcggaatgggcggaaccggcatgaccttggcgtga

SEQ ID NO: 2455 - DNA, 342 bp, Bacillus licheniformis
ttgacgataatggaaaaattaaagctcgatgaattaacaggcgaacaaatttgctttcagctcattcttcacagcggaaacgcccgcagcaaggttattcagtccatcagggaataccgcgccggcagcgttcagaaagcagaggagctgctacaacaggcagaagacgatttgcagcagtcccacgatattcattttcaaatgatccaaaaagaagcgggcgggggaaaaaatgagttctctttgctgctcttgcatgccgaggaccatttgatgtcgacgctcacgatgaaggaactcgtttctgaattattggaattgttcaaagagaaaagtctatga

SEQ ID NO: 2456 - DNA, 309 bp, Bacillus licheniformis
atgaagaaaattttactcgcatgcagctctggaatgtcgacaagtctcctggttaccaagatgcaggaatacgcgcattcaatcggtgacgaggcaaaaatttgggcggtcggacaggaccaggcgaaaaaagagatggcagaggcgaacgtcgttctcatcggcccgcaaatgagctttttaaaaggcgagctgcagaaggaagctgaacagtacggtattaaggttgatgtgattgatatgctggcttacggaatggctgatggaaagaaagcttatgaacaggcgctaagcctgatcggggattga

SEQ ID NO: 2457 - DNA, 1662 bp, Bacillus licheniformis
atgggtttcttacgcaacagaatcgtcggcattacactggcaggcgcagtcgctttaggatcggcgggaacaggcagtgcggcaatggaaacagcgaaaaaaaaagaagagccgaaggtcaaaaacgtgatcatgatggtcatggatgggacaagctcttctgcaacaactttggcacgctggtataaaggcgaaccgctcgcaatggaccagatcgtcagcggcggtgtccggacgtattcggcagaatcggcgatcactgattctgcacctgcagcaactgcgatggcaacgggacgaaaatcaaattcttcctatatcggtgtgctgccttcaaaagtgaatacaccaggagtcgagaaggtccgtgaaaaagatcattaccggcctgtagcaaacgtgctggaaggcgcaaaacagaaggggaaagcaaccggcatcattgcaacatctgaaattcagcatgccacgcctgccggctattccggccatcataaagaccgcaataattttgaagtgctcggtgaacagcaggtttatcaaaacatggatgttgtccttggcggaggaaaagaatcgcttcagccgggtacaaaggataaaagccgcaaagacggtgaagaccttgtaaaagtgctcaaagataaaaagtacgatttcgttgaaacgaaagatcaactcctcaagtcaaaatcgaaaaaaatctggggcgccttctcacagcgcgatctcgcgtatgacatggaccgccgcgcaacgcatccagagcagccgactattgcagagatgacgaaaaaatcgattcagacgctttctaaagacaaggacggtttctttttattcgtggaaggaagcaagcctgactgggcagcgcatcaaaacgatccgatcggcatgatcagcgatgtattggcgtttgataacgcggtgaaagaagcgcttgatttcgctaaaaaagataaacatacaatggttattgccgtctcagaccatggcaacagcggcatctccatcggcaacagcaacacgacgaaaggctatgacacaacaccggtatcagcctatgtcgatccgctgaaaaaagctaaaatgacggtggaaggcgcaactggcaaattaaaagacgacttatcgaatatcgaagaagcggcgaagctttacggacttgatgatttaacgccggcagagaaggaacagctgaaaagcgtgaaaaacaaaaaagaagcggcttcattatttaccaagctgctcagcaaccgggccaacatcggattcacaacaggcggtcatacgggtgaagacgtcttcctgtattcgtatggtccagaaaagccgcagggtctcgtcgaaaacaccgatatcgccaaaacgatggcaaaggcaatgggcttcaacttagacaaattaacaaacgaattatttatcgaagcaaaacaggcatttaaaaaagccggagccagcgtaacgatcgatcaaaaagatccggctaacccagttcttgtcgcagcgcgcaaaaaagcaaaagccgaaatgcctgtgaacaaaaacattatcagaatcaacgggaaggaatacgaactagacagcgtgattgttgaaagcaatggatccttctacgtgcctaaagaagcagttcagctattcaaaaaatacgccagataa

SEQ ID NO: 2458 - DNA, 786 bp, Bacillus licheniformis
atgtatccaagtttagagggaaaaacggtcgttatcacaggggcgggtacaggccttggaaaagcgatggcactgcgcttcggtgctgaaaaagccaatgtagtgatcaattatttcaaggaagaagaaaatcctgaagagacggtggagaaaatagaaagcagcggagcgcgcgcgattgccgttcaaggagatgtctcaaaagaagatgatgtaaaagcgctgatcagacaggctgttgattcattcggttccgttgatgtgatggtgaacaacgcaggggtggaaaatgaagtaccttctgaggatttggctctagaggactggaaccgcgtcatatcaaccaatttgacggggatgtttctaggatgccgggaagcgatcggctatatgctcgaccataatattaaaggctcggtcatcaatatgtccagcgtccatcagcaaatcccgtggccgcattttgtccattatgcggcaagcaagggcggggcaaaactgctgacggaaacccttgcccttgaatatgccccgaaaggaatccgggtaaacgcgatcggccccggtgcaatcgatacgccgattaacgccgaaaaattcgctgatcccgaattgaaaaaaggcgttattgaattgattcctatagggtatatcggaaagccggaggaagtcgcagcctgcgcggcctggctagcatccgaagaagcaagctatgtgacgggcctgacgctgtatgtagacggcgggatgacaaaatacccgggattccaagcgggaaaagggtga

SEQ ID NO: 2459 - DNA, 1410 bp, Bacillus licheniformis
atggcaaaacaacaaataggtgtagttggtttagcagtaatgggaaaaaacttggctttaaacattgaaagccgcgggttttcagtttctgtctacaacagatcaagcgagaaaaccgaagagtttctgaaagaagccgaaggcaaaaacgttgtcggtacatacagcattgaagagtttgttgaatctcttgaaaaaccgcgcaaaattcttttaatggtcaaagctggaacaccgacagacgcaacgattcaatcgcttctgcctcatcttgaaaaaggcgacattttgattgacggcggaaatacatattataaagatacgcagagaagaaacagggagctggccgaaagcggcattcacttcatcggcaccggcgtttccggcggtgaagaaggcgctctgaaagggccgtctatcatgccaggcggacaaaaggaagcccatgagcttgtcaagccgattcttgaagctatttctgccaaggtggacggcgaaccgtgtacgacatacatcggtcctgacggcgccggccattatgtaaaaatggttcataacggcatcgaatacggcgatatgcagctgatctcagaatcctactttattttgaaacacattgtcggtctgtcatcagatgagcttcacgaagtcttttccgagtggaataagggagagcttgacagctatctgatcgaaatcacggctgatattttcacgaaaaaagacgaggaaaccggcaagccgcttgttgacgtcatcctcgataaagcaggtcaaaaaggcacaggaaaatggacaagccaaagcgctcttgacctgggcgttccgcttccaatcattacggaatctgttttcgcccgcttcatctcttccatgaaagaggagcgcgtcaaagcgagcaagcttctggcaggacctgaagcgaaacctgccgctgagaacaaagaagagctgatcgaagcggtcagaaaagcgctcttcatgagcaaaatctgttcttacgcccaaggctttgctcaaatgaaagccgcatcagaagaatacggctgggatttgaaatacggcgatatcgcgatgattttccgcggaggatgcatcatccgcgcggcgttcctgcaaaaaatcaaagaagcgtatgaccgcgatccagagcttgacaacctgcttcttgacccgtacttcaaaaatatcgttgaaagctatcagggagccctccgcaaaacgatttctcttgcggttgaacaaggaattcctgtaccttgcttctcaagcgctctcgcttactttgacagctaccgcactgcaaccctgccggccaacctgattcaggcgcagcgcgactactttggcgcccatacgtatgagcgtacagataaagaaggcattttccacactgagtggatgaaataa

SEQ ID NO: 2460 - DNA, 1257 bp, Bacillus licheniformis
ttgtctgctgataaacaaaaggggagagtcatctttcatatcgatatgaacagcttttacgcgtctgttgaaatggcgtatgacccttcgctgaaaggcaggccgctagccatcgcgggaaatgcgaaggagcggaaaggaatcgtcgtcacgtgcagctatgaggcgagagcacgcggcgtcaaaccgcccatgccgctctgggaagcgaagcggctctgtcccgagctgatcgtcaagccgccgaatttcgaccgctacagaagctcttcaagagaaatgtttcaagtgctcagggagtacacggaccttgtcgagcctgtttcgatcgacgaagggtacatggacttaacggatacgccatacagaaatcgggcatgcgaaacggcaaaggaaattcaggagcgccttcaaaaggaactgctgcttccgtcaagcatcgggatcgctccgaataaattcctggccaaaatggcttcggatatgaaaaagccgctcggcattacgattttgagaaagcgtgaagtgccccggattctttggcccatggacatcagcgagatgtacggagtcggccggaaaaccgccgaaaagcttaagacgctcgagatcgaaaagatcggcgatttggctgccgcagatgagtatgctttaaagcgcctcctcggcatcaacggcccccgtttaaaaagaagggcaaacggcatcgacacaggagaagtgaatcccgacagaatatacgaattcaaaagcgtcggcaattcctcgaccctcccgcatgacagcacagatgagaaagagctgttcggactgattgacaagctttcaatctcagtaagcgacaggctgaagcgaaaagaggtcatggcagcaaaagttttcatcatgatccgctttgcggactggacgaacataacaagaagcaagacccttctgaatccgaccgattcaaaagacgaaattgcgaaggaatcgaaagcccttttcaggcagcattggcacggaagccctgtcaggcttttgggcgtgacgggaacagacctcgtcaatcgaaaggaagccgtcaaacagcttgatttgttttcctttcatgaggatgccaaagatgagccgatccaaaaagtgatggccgaactgaatgaaaaatatggaacagacctcatcaaaaaaggggtcaggattgtgaaaaaagaaagcaaaacgagcggaacaagctttaacaaagattttttccaagacgagagacaagatcaatag

SEQ ID NO: 2461 - DNA, 288 bp, Bacillus licheniformis
atgattcttgaatctttcaacgatgctttttttctgattgagtttttcacaatcgtcctccccgcactgacggcgatcggtatcgccctgatcctgaaggattgcagtacgggagacagctggaaaacgaaacggtttgaagaatatcatgcaatacagtttgtttctgcagtcgattttctcatcatcctatatcatcgcattacggtatggataagtaaagtcattcgcatgaaagcttcatcgaacgacgatgaagaccaccgtttccttcttctttcaatttaa

SEQ ID NO: 2462 - DNA, 822 bp, Bacillus licheniformis
ttgaacacgaaactaaagcaattgtttgcgactgcaatgtttttgatcatgactatgtttataggtgaacaagcttcggcagccaccggcagcaccggaggaagcgacaacttcttccaccattatgtcgtggtgcctttttcagagctgattaagggaatcgccggaatcttccacggaaactacggattgtcgattatttttgtgaccatcatcgtccgggttctcgtttttccgctgtttgccaaccagtataaaaagcagcgggcgatgcaggaaaaaatggcgcttgtcaaacctgagctggatgcgattcaaagcaggttaaaaaagacgaaagaccccgtgaagcagagggaaatccagcaggagatgatgcagctttaccaaaagcacaacatcaatccgctggcgatgggctgtctgccgatgctgattcagtttccgattctgatcggtttctattatgcgatccgctcgacgcctgaaattgcttcgcactcttttctctggtttaacctcgggcattctgatattatcgtatctttaagcgccgggttcatgtattttatccagttctatgtgtctcaaaagctgaacgcacagaacgcccaatcaaatccggcggctcagcagtccgccaaaatcatgggcttctttttccctgtaatgatgacgatcttttcgatcaatgtccctgcagccctgccgctgtactggctgacaagcggactgcttctgacgattcaatcggtcgttcttcatcaagtttaccaaaaaaacaaaaaagccattcagcctgctgaatcggctacaaaataa

SEQ ID NO: 2463 - DNA, 1119 bp, Bacillus licheniformis
atgaataaaaaacgcttgttagaagagtttttagaacttgtgcaaattgattccgagacaaaacatgaagctgaaatctgcaaggtgctgaaagaaaaatttgcggcgcttggaatggatgtcgtggaagatgacacaaagccaaaaaccgggcacggagcaggcaacctcgtgtgcacgcttccgggaacgaaagaagcggacacgatttactttacatcccacatggatacggtcgtacccggaaaaggcgtaaagccggtcattgaagacggatatgtcaaaacagacggcacaacaattttgggagccgacgacaaaacaggccttgcagcgatgctagaagccgtaaaagtgctgaaagaaaaaaacattccgcacggaacgatccaatttatcattacggtcggtgaagaatcggggcttgtcggagcgaaggctctagaccgttcgctgatcaaagccgattacggatatgcgcttgattccgacgggaaggtcggcaatattatcgtggcagcgccgacacaggcgaaaattagagcaactgtctatggaaaaacggctcatgccggtgtagagccggaaaaaggagtctcagcgatcacgatcgcttcaaaagcgattgccaaaatgccgcttggccgcatcgacgaggaaacgacggctaacatcggccgctttgagggcggaacgcaaaccaatatcgtctgcgatcaagtcgacattcttgctgaagcccgttcgcttgttccggaaaaaatggaaaagcagacggaaaaaatgaagcaggcgtttgaatcggcagccgccgaaatggggggcagagccgaggtggaaatcgaagtcatgtacccgggctttaaatacaaagacggtgatcttgtcgttgaaattgccaaaaaagccgccgggaaaatcggccgtccgtacgagctgttgacgagcggcggaggaagcgatgcgaacgtcatcgcaggccacggcattccgactgtcaaccttgcagtcggatatgaacagatccatacgaaaaacgaaaaaatgccgattgaggaacttgtcaaaactgcagaaatggtcgttgccattattgaggaagtagcgaatcgttcataa

SEQ ID NO: 2464 - DNA, 1530 bp, Bacillus licheniformis
atgaatatgtttgaaagagtcgacgatttaaacaacagccgccaaaaagcttcgctcggaggcggccaggaacggatcgacaggcagaagcaaaaaggcaagctcaccgccagagaacgaattgatcttctgcttgatgaggggacgttcactgaactgaatgcctttgccagaagccggcagtccggcggcccgttaggcgacggggttgtcacgggattcggaaagatcgacgggcggcccgtttatctattttcccaggattttaccgtcaccggcggagcgctcggagaaatgcacgccaaaaaaatagcggccgtcatggatcttgccctcaaaaataaggcgccgttcatcggtctgaacgactcaggtggtgcgagaattcaagagggtgtgctatcattagatggatacggtcatattttttaccgaaatgtcctttgctcaggcatcattccgcaaatctctgtcattctcggcccttgtgcgggcggcgcggtttattcccccgctttgaccgacttcgttttcatgagcgaaaaaaccggacagatgtttattaccggtccgaaagtcatcaaaacggcgacaggcgaggctgtcagctccggtgaattggggggcgcctatatacataattcaatcagcgggaatgcccatttttccggggattccgatgaggccgtcctccatgaggtgcgcaagctcttgtcctacatcctccagaatcacgaagaaaagcctcccgccaaggcgagaaaggcgaaagatcatgagataaggcctgctttaatgacgatcctgcctgaagacggtcagcgtccgtatgacgtcaaacagatcatcgcggaaatcgcagacggcggaacattttttgaagtgcagtgccattttgccaaaaacgcggtgatcggttttgcaaggatagcgggggaaacggcggcggtcgtggccaaccagccgaagtatttagccggaagcctcagcatggatgcggctgacaaaatcgcccggtttatccgtttttgcgattcctttcagatcccgattttgactttggttgattgtcccggttttcttccgggaatacgcgaagagcacggcggggtgatcaggcacggcgccaaaatcctttacgcgtatgcggaagccactgtcagcaaggtgacggtcattttaagaaaagcatacggcggagcatatgtcgctttaaacagcaaggcgcttggagcggatgccgtgtttgcgtggccgaatgcagaaattgcagtgatgggcgcctcggaagctgcagacgtgctgtttgcgaaggaaatcgaacggtcagacgacccgcgggccgcccgggaggaaaaaatccggaagtgcatgcaggcttcaagcccttttaccgctgcaagatacggcatggttgacgatatcatcgatccgaaagagacgcggaagaagctgatccaaacgtttgacatgctgaagagcaaaaaagaaatccggctggacaaaaagcatggaaatataccgctttaa

SEQ ID NO: 2465 - DNA, 960 bp, Bacillus licheniformis
atgtttaaaataggttatcgcacattaaaaacagcgcttggaacagcatcggccatctatatcgcacagctgctcggcctccataattttgtgtcgacagggatcatcacgatcctctgtattcaagtgacgaaaaaacggtcccttcaggcatcatgggcacggtttgcagcatgcattcttgcgatcgtcttttcatacgcattttttgagctgatcggctatcatcctgctgtcatcggtctgatgctgctgttctttattccgacaaccgttcttctgaaaataaaagaaggaatcgtcacaagttcggtcatcattcttcacctttatatgtcggaagggatcaccctttctctcgtttggaacgaattccttatcatcattacgggaatcggcgtagccctgctgatgaatctgtacatgccgagcctcgataaagagctcaaacagtatcagcagaaaatagaagataactttgccaagatttttgaagaaatcgaacggtatttgctgaccggggagcaggattggacgggaaaagagattcctgagacgcaccgtttgatcaatgaagcgaagaccctggcataccgcgatgtggaaaatcattttctcaggcacgaaaacctctattatcactactttaaaatgagagaaaagcaatttgaaattatcgaaagggttctgccgaaaatcacgtcgatttcgatgacggttgaacaggggcagatgatcgcggcgtttctccatgatttaagaggagccatccatcccggaaatacggctcataaatttttgaagcggctcgtgaaaatgagagaggaaatcgaagagatggagctgccgacgacacgagaagaatttgaagcgcgcgctgctcttttcatttttctcggcgaaatggaacagtatcttgtgattaagagttactttaaaggtattaaatctcctgcataa

SEQ ID NO: 2466 - DNA, 723 bp, Bacillus licheniformis
atgattaatgttcgcaatctctcaaaatctttcggaaagcacgaggtgcttaaacatatttccgtttcctttgaaaaaggcgaagtagccgcagtcatcggcccgtcgggatcaggcaagtccacgtttctgcgttgcttaaacctgctcgaaaagccgacggagggcagcattttcattcaggatcaagagattacaagcccgaaaacaaatgtgctgaaaatcagagagaacatcggcatggtctttcagcattttcacttgtttccgcataaaacggttcttgaaaatattacgtatgcacctgtccatgtcaaaaaagaaagcaaacaggcggctgtgaaaaaagcggaagaactgcttgagaaagtggggcttctcgataaaaaagatgattatccgaaccgtttatcagggggacaaaagcagcgcgtcgcgattgcgagggcgctggcgatgaatccggatatcatgctgtttgacgaaccgacatcagctcttgatcccgagatggtcaaagaagtgctccaagtgatgcaggatttggcgaaaaccgggatgacgatggtgatcgtgacgcatgaaatgggatttgccaaagaagtcgccgacagagtgcttttcatggatgaaggaaccattgtagaagacgacgatcctaaagcgtttttttcttctccaaaatcgaaaagagctcaagactttttagagaaaatactataa

SEQ ID NO: 2467 - DNA, 663 bp, Bacillus licheniformis
atgaattttcttgatttttctagtacagtacccgaaatgcctttcatcctggaaggcttgggcgttaccttaaaagtggtcgcggctgcggccgtgcttggatttttgctgggggttttgattacgcttttaaaaatcagttcgatcaagcccctcgcatggattgcagacttttacacttccatattccgggggacaccgctcgttctgcagctgatgatcgtctattacggactgcctcaggtgctgggctttgatattgatgcttattgggcggccgtcatcgcattcggcttaaattccgctgcttatgtatcagaaatcatcagagcaggaatcaatgcgatcgacaaagggcaaaaagaggcggcgatggctctgggcgtcccgtatgcaaagatgatgaaggatctcttgctgccgcaggcctttaaaaatatcatgcccgcgctgatcaacgaatcgattacactgacaaaggaatcggctgttgtcaccgtcatcggactcggcgatataatgaggcgaagctatcaggcgggagctgcgatctacagcccgcttgagccgatgctgtttgcaggcctcatctactatgtgctcgttttgatcctgacgtttgtcggcaaagcgattgaaaggaagctgaatgtcaatgattaa

SEQ ID NO: 2468 - DNA, 769 bp, Bacillus licheniformis
atgaaaaaatggatgttactggtagtgacagcatgtgtcacatttgcattgactgcttgcgggacgagcagcagctctgatgataaaaaaacattggtgatgggaacttctgccgattacccgccttttgaatcgaaagacggggataagattgtcggttttgatgttgatctggccgaagcactggctgaaaagacgggccatgaaatcgaagtgaaagacatggacttcaacggcttggtgaccgctcttaaaacaaacaaagtcgacattgtgctttcaggaatgacgccgacgcctaaacgcaaaaaacaggtcgatttttcaaatgtctactatacggctcacaacatgatcgttacaaaaaaatcaagcggcatcaaatcgcttgacgatctgaaaggaaaaacggtcggcgtacagcttggctccatccaggaagaaaaagcaaaggagctcacgccggattacgatttaaaagttgaaaaccgcaaccgcatttcggatttaactgaagaaatcaaagcgggccacctttgacgctgcaatcattgaagatatcgttgccgaaaaatatattaataaaaatgaagaactggttggctacaatctgccgaaagaaccggatgaaaaagccggctccgcgatcgcctttaaaaagggaagcgatttgaccgagaagttcaacaaagcgcttgaagaaatggagaaaagcggagaacttgataaactgaaagaaaaatggttcggcggagaaacaaaaaagtaa

SEQ ID NO: 2469 - DNA, 438 bp, Bacillus licheniformis
gtgaacatggattttaatctgtttatgaacgatgtcgtacgccaggccagacaagaaataacggctgccggctacaccgaattgaaaacgcctgaagaggtcgatgaagcgctcacgaaaaaaggcactacgcttgtcatggtcaactccgtctgcggctgtgcaggggggattgcaagacctgccgcgcaccatgcggttcattacgataagcgccctgatcatctcgtcaccgtttttgccggacaagacaaagaagcgacggcaagagcaagagaatattttgaaggatatccgccttcttctccgtcattcgcccttttgaaagacggcaagattttaaaaatggtggagcgccatgaaattgaaggctatgagccgatggctgtcatcaccaagcttcaaggactgtttgaagaatactgtgaagaagtataa

SEQ ID NO: 2470 - DNA, 903 bp, Bacillus licheniformis
atgaaccgaaagaaagcaatgctgatttacaacgggaatgcagggcaaaaaaatgttgaaaaaacactcggtgctgccgtaccgattctttcacaagctatagacgaactcatcgtgaaaccgacgagaaaaaagcgcgatgcgttcgaattttgcctggagatcggggaggatatcgggcagttgtttatcttaggcggtgacgggacggtgcatgaatgcattaacgggattagccagcttcaaaccaagccagatatcggcatcctccctggcggtacatgcaacgacttttcgagggcgctccgcattccccagaacatagagaaagcggcggaagcgctcgccaatggaagtcccgtcccggtcgatgttttaaaagcgaatgatcattattgtctcaacttttggggcatcggattgatcacggaagcttccagccatatcaatcaaacggaaaaagcgctgctcgggagaatcagttattttacaagcgcactgcggacaatctccaatcttgagcccttctcttttcgtctgtcgatcgacggagaagagtttgctgacgaagcggtcatggtcgtcgtgctgaacggcccctttatcggaacgaacaagatcccccttccgcagctgagcatcaacgacggaaaagcggacattctcgtctgccggaatacgaatctggctgcattgaaagagctttttgcaatggatgatcccgaatgggattcctttaaaggcgagctatcctattatcaggggcaaaccgttcgaattgaaaccgcccttcccatggaagccgatacagacggcgaaatctgcacaaaaacgccggcttcaatcgaggtgctaaacgggcacctccgcatgctcacccccttagaaaaagaaaaaagctga

SEQ ID NO: 2471 - DNA, 1281 bp, Bacillus licheniformis
atggcagtggaacaaatgacaatgccgcagctcggggagagcgtgactgagggaaccatcagcaaatggctcgtcagcgtcggagatcacgtcaacaaatatgatccgattgctgaagtgatgacggataaggtcaatgctgaagtcccttcatcgttcacgggaacgattgccgagctagtcgggaaggaaggcgaaactctgcaagtcggagacgtcatctgcaaagtcgaaacaaatgaagaagcgaaaccggaggctgaggctgtttccaagccagatcaagaggaagcggagccggccaaaccggaggcgaaagatacatctcagaaaaaacgttattccccggcggtgctgagacttgccggagagcacaacatcgatttggagcaggtggaaggtacaggcgccggcggacggatcacaagaaaagacatccagcgcatcattgcttccggagctgttcctcaaactgatgcagcgccggaaaaacagccgggtgcaaatgccgcgggagcgattgaacctgatcaaaaaccggcgcaagccgcacctcaagctgcaccgcctcaaagtgcggccggagacgttgagattcctgtaactggaatccgcaatgcgattgcgaccaacatggtcagaagcaagcatgaaatccctcatgcctggacgatgatggaagtggatgtcacaggtcttgtgagctaccgcaacaaaataaaaaacgaattcaagaaaaaagaaggcttcagcctgacctttttcgcgttttttgtcaaagcagtcgcacaggcgctgaaggaattcccgcaaatgaacagcatgtgggccggagataaaatcattcagaaaaaagacatcaacatctcaattgcagtagcgactgaagatgcgttatatgttcctgtcatcaagcatgccgatgaaaaaacgattaaaggcatcgcaagggaaatctccgaactggctcataaggtcagaagcggcaagctgaccagcggggatatgagcggaggtacgtttacggtcaataataccggttcgtttggatcggttcagtcgatggggatcatcaaccatccgcaggctgccatcctgcaggttgaatcgatcgtcaagcgtcccgtcgtcatggagcacggcatgatcgcggtcagggatatggtgaacctatgcttatccctcgatcacagagtgcttgacggcctcatttgcggcagattccttgcccgtgtgaaagagattcttgaacagatcgatgatcatacgtccatctattaa

SEQ ID NO: 2472 - DNA, 984 bp, Bacillus licheniformis
atgccagttatgtcatatatagatgctgtcactttggctttgaaagaagaaatggaaaaggatccccgcgtctttgttttaggggaggatgtcggcaaaaaaggcggtgtattcaaggcgacagccggtctttacgaccagttcggcgaagagcgggtgatggacacgcctttggcggaatccgcaattgccggcgtcggaatcggggccgccatgtacgggatgagaccagtcgctgaaatgcagtttgctgattttattatgccggctgtcaaccagattatttcggaagcggcaaaaatccgctaccgctccaacaatgactggaactgtccgatcgtcatccgcgcaccttacggcggaggcgtgcacggcgcgctgtaccattcacagtcggttgaagccgtgtttgccaatcagcccggcctgaaaatcgtcatgccttcgacgccttatgatgtcaaagggcttttgaaagcggccatccgcgatgacgaccctgtgctgttcttcgaacataaacgggcataccggctgatcaagggcgaagtgccgagtgacgactatgtgctgccgatcggaaaggcggacgtgaagcgggaaggcgaagacattaccgtcatcacatacggattgtgcgtccatttcgcccttcaggctgccgaacggcttgccaaagacgggatttccgcacatatccttgatttaagaacggtatatccgctcgatcaggaagcgattattgaagcggcttccaaaacgggcaaagtgcttttgatgaccgaagatacgaaggaaggcagcattatgagtgaagtggccgcgatcatttcagagcattgcctgttcgatttggatgcgccgattaagcggttggcgggccctgatgtcccggcaatgccgtatgctcctacaatggaaaaattctttatggtcaatccggataaagcagaagcagcgatgagagaattggctgagttttaa

SEQ ID NO: 2473 - DNA, 993 bp, Bacillus licheniformis
atgggcaataaccgtcatgaagcagtgggattaacagatgaacaagcaatcgacatgtacaaaaccatgcttttagccagaaaactcgatgagcggatgtggctcttaaaccgttcaggcaaaattccttttgtcatctcttgtcaaggacaggaagcagcccaggtcggagcggctttcgctttagaccgggagaacgattatgtgcttccgtattacagagatatgggcgttgtgcttgcttttggaatgacggcaaaagatttaatgctgtcggcgtttgcaaaagccgaggatccgaattcaggaggaaagcagatgccaagccacttcggccaaaagaaaaaccggatcgtcacgggctcttcgccggtgaccacgcaagttccgcatgcggtgggcgtagcgcttgccggaaggcttgacaagaaagacattgcaacttttgtgacgttcggcgaaggctcttcaaaccaaggggacttccatgaaggggcaaactttgccgccgtgcataagcttcccgtcatttttatgtgtgaaaacaataaatacgcgatctcggttccttatgaaaagcaggtagcttgcgaaaacatttccgaccgcgccgtcggttacggcatgcctggcgtgaccgttgacggaaatgatccgcttgaagtctacaaagctgttaaagaagcaagggaacgggccggaagaggcgaagggccgacattaatcgaaacgatatcataccggctgaccccgcactccagcgatgatgacgaccgaagctacagagagcgcgaagaggtggcggaggcgaagaaaaatgatccgcttaacaaattcgcacaatacttaaaagaagcaggtcttctggacgaccagtctgagaagcaaatatcggatgagatcacaaaaatcgtcaatgaagcaacagattatgctgaacatgcaccttatgcagatccggaagatgcgctgcggcatgtttatgcggagtaa

SEQ ID NO: 2474 - DNA, 1422 bp, Bacillus licheniformis
atggcaactgaatacgatctcgtgattcttggagggggcacaggcggctatgtggccgccatcagagcctcgcagctggggctgaaaacagccgtcgttgaaaagcagaagctcggcggcacgtgccttcataaaggctgcatcccgtcgaaggcgctccttagaagcgcggaagtatacaggacagcaaaaaaggcggacgaattcggagtggtcattcctgaagtcggactgcggttttctcaagttcaaagcagaaaacaaaaaataattgaccagctgcacaacggtgtcaaacacttgatgaaaaaaggaaagatcgatgtttacgaaggaatcggacggattctcgggccgtcgattttttccccgatgcctgggacggtttccgttgagatggcgaacggggatgaaaatgagatgctcataccgaaaaacgtcatcatcgctacaggctcaaggcccaggtcgctgccagggcttgagcttgacggagaaaacgttctgtcatcagacgaagcgcttgaacttgagcagcttccggcttccatgctgatcgtcggaggaggtgtcatcgggatcgagtgggcttccatgctgaacgatttcggtgttgatgtcaccgtcattgagtatgcagaccggattttgccgactgaagatgccgatatttctagggaaatgcaggcgcagctcgcgaaaaaaggcatcacaatgatcacgggagcaaaagtgctgcccgacacattggagaaaggcgatgcggtcagcattcaagcggaaaaagacggagaaaaacaatcctattccgctgagaaaatgctcgtatcggtcggaaggcaggcaaatattgagggtatcggtctggaaaacacggatatccaggtggaaaacggctttatcgtgacaaacagcatgtaccagacaaaagaatcccacatctatgcgataggagatgtgatcggcggccttcagcttgcacatgtagcttctcacgaagggattacggccgttgagcatattgctggtgaaaacccgcacgccatcgattattcgcttgtttcaaaatgcatctattcaagccctgaagccgcatcggtcggcttgacagagggtgaggcgaaggcgcaggggaaaagcgttaaagtaggcaaatttccgtttcaggcgattggcaaagcgctcgtgtacggtgagacggacggctttgtcaaaatcgtcgccgatcgcgaaacagatgacattttgggcgttcacatgatcggcccgcatgtgacagacatgatatctgaagccggtctggcaaaggtgcttgacgccaccccgtgggaagtcggtcaaacgatccacccgcatccgacgctgtcggaggcgatcggagaagccgcccttgccgtggatggaaaagcgattcatttttag

SEQ ID NO: 2475 - DNA, 1107 bp, Bacillus licheniformis
atgcaggtacaggaaaaacgtattctcgtcatcaatccgggatctacatctacaaagatcggcgtttttcatgatgaccgttcgattttcgaaaaatcaatccgtcatgacgaggctgagctacagcaatatcagaccattattgatcaatattcgttcagaaaacaggcgatactcgaaaccctgcatgaacagggaatcaatatttctaaattggatgccgtttgcgccaggggagggctgcttcggccgattgaaggcggcacttacgaagtcaatgatgcgatgattgtcgatttgaaaaacggctatgcggggcagcatgcatcaaatctcgggggcatcatcgccagggagattgccgacgggttaaatattcccgcttttatcgtcgaccccgttgttgtggatgaaatggctcctatcgcaaaaatttccggcaccccggctattgaaaggcgcagcatttttcacgcgctcaaccaaaaagcagttgcaaggaaagcggcttggcagtttgggaagcgttatgaagatatgaaaatgatcatcacccacatgggaggcggcattacgatcggcgtccattgccgcggccgggtgatcgacgtcaacaacggcctccacggggaaggtccgctcagtccagagcgggccggaaccattcctgcgggtgatctgatcgatatgtgcttttccggcgaatatacgaaagacgagctgatgaaaatgcttgtcggcggcggagggcttgccggctatctcggcacgacggatgcggtaaaagttgagaaaatgatcaaggaaggcgatcaaaaagctgcgctcatctatgaagcgatggcttatcaaatcgccaaagaaatcggggcggccagcgccgtcttaaaaggcgaagtcgatgtcattattttgacaggaggactggcatatggaaaatcgtttatttcctcgatcagacaatacatagactggatttcggatgtcgtcgtctttccaggagaaaatgaacttcaagcattggctgaaggtgcatttcgcgtattgaacggcgaagaagaggcaaaacagtatccgaaccagaggagggaaagtcatggcaactga

SEQ ID NO: 2476 - DNA, 1095 bp, Bacillus licheniformis
atggaactatttcgatatatggaacagtatgactacgagcaattggtattttgccaagataaacagtccggtttaaaagcgatcatcgcgattcatgatacgacgctcgggccggctctcggcggcacaagaatgtggacatacgaaagtgaagaagccgcaattgaagatgcgctgcgccttgcgcggggaatgacctacaaaaatgcggcggccggactgaacctcggaggaggcaaaaccgttattatcggagatccgcgcaaagataaaaacgaagaaatgttccgcgctttcggccgctacattcaaggcttgaacggcagatacatcacagccgaagacgtcggtacaaccgttgaagatatggacatcattcatgacgaaaccgatttcgttacaggcatttcacctgctttcggttcatcaggaaatccttctccggtaacagcttacggggtatataaagggatgaaggcggcggcgaaagcggcattcggaacggattcgcttgaaggcaaaaccgttgcggttcaaggcgtcggaaacgtggcctacaacctgtgccggcacctccacgaagaaggcgcgaaactgatcgtgaccgacatcaacaaagaagcagttgaacgtgcagtcgccgaattcggcgcccgcgccgtcgatccggatgatatttattcgcaggaatgcgatatatatgcgccgtgtgccctcggagcgacaatcaacgatgatacgattccgcagctgaaagccaaagtgattgccggggcagccaacaaccagctgaaagaaacccgccacggtgatcaaatccacgacatgggcatcgtttatgccccggactatgtcatcaatgccggcggcgtcatcaatgtcgctgacgagctttacggctataattcggagcgcgcgctgaagaaagtcgaaggcatctacggaaacattgaacgcgtccttgaaatttcgaagcgcgaccgcattccgacatacttggccgcagaccgtctggcggaagaacgaattgagcgcatgcgccaatcgagaagccaatttttgcaaaacggccatcacattttaagcagacgttaa

SEQ ID NO: 2477 - DNA, 912 bp, Bacillus licheniformis
atgaagctgaaacaactattgcaaaaagcggcggagcttgacaataaaacggtcgccgtcgcacatgcggaagatgacgaagtgctgcaagcggtcaaacttgcggtcgacaaacaatttgcccggttcttgctgatcgggcacagagaaaaacttagacatatgatgacagagcagaatatttcaaaacggcacgtggatatcattcattcggaatcgccggcggattctgcgagaattgccgttcaagctgtcaaaagcggcaatgcggatgttcttatgaaggggaatgtcccgacagctgtgctattaaaagccgttttgaataaagagtacgggcttcgttcctcgcacgtgctgtcacatgtagcagcatttgaagtcagcgggtttgagaggctgatttatgtaacagatgcggcgatgaatatcagccccaagcttgatgagctgaagcagattttagaaaacgcagtcggcgtggcgaggtcggtcggcgtgcaaatgccgaaagtcgcttgtcttgccgcagtggaaacagtgaatcccgcgatggaagcgacattgaatgcagctgccttgacgcagatgaatcatcggggccaaatcaaaaactgcgttgttgacgggcctcttgcattggataacgcgatatcgccgcttgccgcccggcataaaaacatttccgggatcgtagcaggcgaggccgatatcctgcttgttccttcaattgaaacaggcaatgtcctttataaatcattgattcattttgcgggtgcaaaagtgggagccattttagcaggggcaaaagcacccatcgccttgacaagcagggccgattccgcagaaaacaagttgtattcgattgctttggcgctgtgtacgtctgaagcacgacatgaggaggaataa

SEQ ID NO: 2478 - DNA, 2067 bp, Bacillus licheniformis
atgcaaaaagtactgatcgttggtgctggaaaaggggggaccgccctcttggatttgctgctgaaaacaaagacgatgcatatcgaggcggtcatcgataaaaatccggaagctcccgggcttttcgtcgcgcagaaaaacgatatcgaaacggcactcgactggacgccatacatcacagaacagatcgacatcatcattgagacgaccggagacgccggcgtgttaaagcagctgatgcgaaaaaagcacgacagaacgatcgtggtgccgggatcgctcgcttatatcatctctcagctgatgaatgaaaagcagcagctcatccaaatgttaaaagagcagacgtataaacacgaccgtattttcaactcgatgaatgacggcatgatttttatcgacattaacgaagagatcattttgtttaacaaaatggcggaggttatgaccggaacaaagcgcagcgaagcgatcggccagcatattcaaagcgtgatcccgacgacgaagctgccgcgtattctcaacacgagagagcctgagtatcatcaaaaacaatttctccatccgaacaggcagattgtcacgacccgaattccgattattgatgacggaggaacgctcctcggggcgctcagcatatttaaggacattaccgatgcggtcgagctggctgaagaggtgaccaacctgaaggaagtcagaacgatgcttgaagcgatcattcaatcttccgatgaagcgatttcggtcgttgacgaaaacggaaacggaatgatgatcaacagggcatatacgaagatgacaggtctgacaaaagaccaggtgatcgggaagccggctaataccgacatatctgaaggcgagagcatgcatttgaaagtgctcgaaacgaggcgccctgtcagaggggtcagaatgaaagtcggcccgaataaaaaagaagtgatcgtcaatgttgcgccgattatcgtcgacggcattttaaaagggagcgtcggcgtcattcacgacgtatctgaaattcaatcgctcacaaacgagctgaacagagcacggcagattatccgtacacttgaggcgaaatatacatttgccgacatcatcgggtcaagcgagcagatgctcgtcgcgctggaacaggcgaaattgggggcgaagacgcctgcgacgattttgctgagaggcgaatcgggaacgggtaaagagctttttgcccatgccatacataacgaaagtgaccgaaagtataataagtttgtccgcgtcaattgtgcggccatatcggaatcactgcttgaatcagagcttttcggctatgaggaaggcgctttttcaggtgcgcgccgcggcgggaaaaaaggattctttgaagaagcgaacaacggaagcattttcttggatgaaatcggcgagctctcgctaaacacacaggcgaagctcctccgcgttcttcaggaaaaagaaatcgtcagagtcggcgggaccaaaccgatccctgtgaacgtccgggtcatcgcggcgactaacgtcaatattgaaaaggcgctcgctgaaggccggtttcgcgaagacttgtactaccggatcaatcgctatccgatatcgattccgccgctcagacagcggaaagaggacattgaagccttgagcaggcatttgatagggaagatcaaccaagagtacgggcgcaatgtaaaggggcttacgaaaaacgccctcaaatcgctaaaagcgcggaagtggccggggaatgtcagagagcttgaaaatgtcctcgagcgggcgatgatttttttaaaaccgcaaatggaatggattgatctagaacatcttcctgaagcggaccgtccgagaaaaaaggtggaagccggcgaagctttccctgaaattgaagatgaaaagctgtctgatgcggtcgaacggtttgaagctcatatcattaaagaaacgcttgaaaagcatcaatataacagaacgaaaacggcaaaagctcttggaatcagcattcgcaacctctattacaaaatggataaatacaaccttgcaaaagatagcatgcaataa

SEQ ID NO: 2479 - DNA, 255 bp, Bacillus licheniformis
atggggagaatgatcgcactgctcgttttgctgatcccgggaggcctggctgctctcggaattaaattgatgcgcgacacggttttcggcattttgatcggcccgtttcagatcctttggcttcaggggctggcggggttcatatgcttcgcaggcggcctttatttgttaggcggatttattctatacagagacagaaaacgcaaccaagtaagcccccgtttcagaaaaaagcagagcggccgcgaggtgtga

SEQ ID NO: 2480 - DNA, 726 bp, Bacillus licheniformis
atgacgaaaatatttgcacacagaggggcttcaggcacttttcccgaaaatacaatggcggcgtttaagcatgcggcggccattggtgccgacggcatcgaattggatgttcaaatggcaaaagacggacgtcttgttgtcattcatgatgaaaagcttgacaggacgacttcactgaaagggtatgtgaaagatcttacatatgaggaaataaaacatggagacgcaagccaccgttttgccgaaaaaaccggttctgtccctgtgccgacccttgaagaagtgtttgagtgggcggcagatgctgaatttcttcttaatgttgaattgaaaaacagcattatccgctatgaagggatggaagaaaaagtgatgtcgatgattgaagcgtacgaccttcaagaccggatcattctttcatcattcaatcatgaaagccttgcgttatgccacagactgaatccaagtattgaattggctgcgctttacatggatgtcatctacaagccggaggaatacattgagatgattccggcttcaggatttcatccgtatcgccgttcaatgtcggatgacacgatcaaaaacgcccatttgaaagaaaaagcggtcaggccgttcaccatcaaccgtgaagaggagatgaaaaagctgattgctgcgggaatagacggtttcttcaccgactttcccgaaaaagcgttaaaattaaaggccgagatgtga

SEQ ID NO: 2481 - DNA, 621 bp, Bacillus licheniformis
gtgaaactgttaataaagagttttgttttgctgctgttttcgtttatggcggcttttccagctgcttttgcggctgagccgctttccgggaagacggtatatgttgacgcaggtcacgggggtgaagacagcggtgctgtcggaaacgggctgcttgagaaagatgtcaaccttgaagtggcaatgctgattgatgaaaagctgaaagaagaaggagccgacacagtcgcctcaagaacggatgatacgtttttgacgctggaagaccgggtggccaaggcgagcaaaaatgcttcagacttgtttatcagcattcatgcaaactcggccgtccctgaagcgtccggtacagaaacatatttcgattccacgtatcaagccgctgacagcgaacggctggcatctgacattcaagagcggcttccggatgcgctgggcactcgggacagaggtgtaaaagaatcagggttttatgtcatcaaaaattctcaaatgccgagtgttttagtcgaactgggctttatcacaaacaaaactgatgcagataaactcgaaagtccggaatatcaggaaaaagctgcagacgcgattgctgacgctgtcgtatcttattatgaataa

SEQ ID NO: 2482 - DNA, 321 bp, Bacillus licheniformis
atgaggaaaggagtcatccttgttctgttcgctatgctgttattggcaggctgcggcacaacgcagcataatgggcaaagcggtgatgagagccgaaaaggaacaggcgaggaaacgctcgtgaaagaaggcacctttgtcggtttggcggaccagcataccgtcgccgtcaatattgacggcaaagaaacgatgtttcaggtccctcccgaaaaacgggacaaatataaagggatcgaggatgatacaaaggtggaagtggagtacacgaaagcagaggacggaacattacagcttgaagatatgaaaaagaaagaatga

SEQ ID NO: 2483 - DNA, 384 bp, Bacillus licheniformis
atgatctttacgaaaacagatcttcgctatccggtgaattttttcgggccagggttgaggattaaccattacggattgctcatcgtaaacagcaatgcaaaaataggtgcaaactgtgacattcatcaaggggttaatatcggacaaaatcacgctcgccgcgatgttcccacaatcggagacaatgtctggatcgggccgggggcaaagctctttggcgacattcacattgctgacggcatatcaattggcgcaaacgccgtggtcaacaaatctttcactgaggaaaatattacaatagccggcatgcctgccaaaaagattaaagaggcgccgtcaaataaagaccggaagcaagctgttcagcggcaaatacaagcatga

SEQ ID NO: 2484 - DNA, 297 bp, Bacillus licheniformis
atgaaggtcaataaattattaactggtacgactctggctgttggtttacttatttctgcagcgccggtatttgctgcatcgcattcatctgaggtgattgcacatccgactgctcaatatatcaattgtccaagtgacttgccaagctcattcaaaagcagtaaatcatcaaaatgtgtaaaatcatcttctggagttttcagtaacaaattttctgatagcgatggaacatggtatttcaaagggaaattttacagtaatgtttttaatacttgggttggtttttatgaaggatga

SEQ ID NO: 2485 - DNA, 801 bp, Bacillus licheniformis
gtggagaaaattaaagtatgtgttgctgatgataacagggagcttgtcggcctattaagcgaatatatcgagggacagagcgacatggaagtgcttggtgtcgcatacaacggacaggaatgcctttctttgtttaaagacaaggagcccgacgtgcttgtgctggatataatcatgcctcatctcgacggattggccgttcttgaaaggctgagggaatcgcagcttaaaaagcagccgaatgtcatcatgctgacggcgttcggccaggaagacgtgaccaaaaaagctgtagatttaggcgcgtcgtattttattttgaagccttttgacatggagaatttagtcggacatatccgccaggtcagcggaaacggatctcaattgacacaccgtgccccgtcctctcaaagcagtgtgcttcggccgcagcctgaatcgccgaagaaaaacctggacgccagcatcacgaccatcatccacgaaatcggcgtacctgctcatattaaaggctatttgtacttaagagaagccatctccatggtatataacgacatcgaactgctcggcagcattacaaaagtgctttatccggatatcgccaaaaaattcaacacgactgcaagccgcgtcgaacgggcgattcgccacgccatcgaagtcgcatggagcagaggcaacatcgactcgatttcgtcacttttcggctacacagtcagcatgtcaaaagcaaagccgaccaatagtgagttcatcgcgatggtcgcagacaagctgagactggagcataaggcttcttaa

SEQ ID NO: 2486 - DNA, 1341 bp, Bacillus licheniformis
atgaatgtagcgaaagaaatttatatggtgtgggttaggtgcgaggagagtgaaaaggtggatgttgaaaaaatcagaaaagctgtgggtataattctccttgtttctttaataagtgtaggattttacaaaccggtgaaagaatacattgtaataccaaaaaatttgaacatttttgagacgggtacccgtgcggttgaaacgagcttatccgtcagtactccgaaagatggatcatcagaagcattcacattgaaagaaaatcaaaacgaagtggaaataaaaggcgaaaagaatggaaaggcagaactcgtctatgactttgccggatttccggttaaaaaaacgaaagtaaatgtcctgcctgatttgaaagtggttcccggcgggcagtccattggtgtaaaacttcattccgttggtgtattggtcgtgggttttcatcaaatcaatacctctgaaggcaaaaaatcgcccggtgaagcagccggaatcgcggtaggcgacattatcaccgaaatcaacggcacgaaaatcgagaaaatgaatgacattaccccttttattcaaaaggccggaaaaacaggagaaaccttacatctgtcgataaaaagagataaacaggaaatcaaaacgaagctcgttccgaaaaaagaccaggctgaagacaaatacagaatcggcttatatatcagggactctgccgcaggaatcggcacaatgacttttttcgagccgaaatcgaaaaaatacggagcgcttggccacgtgatttcagatatggatacgaaaaaaccgatcgttgttgaaaaaggacaaatcgtgaaatcgaccgtcacctcgattgaaaaaggaacaggcggaaatcccggagagaaactggctcgtttcgcatcagaacgaaaagtgatcggcgatatcaacagaaacagtccattcgggatcttcggaacgcttcacgagtcaattaaaaaccgcatcgctgacaaagccattccgattgcattttcagatgaagtaaaagaaggccctgcccaaattttaacggttattgaaaacgacaaagtcgagaaattcgatattcaggtcgtcagtacgacacctcagaagtttccggccacaaagggcatggtgctgaaaatcaccgacccgaggctgttgagtaaaacaggaggcatcgttcaagggatgagcggaagcccgatcatccaaaacggaaagatcattggcgccgtaacccacgttttcgtcaatgatccgacgagcgggtacggtgtgcatattgaatggatgctgtctgaagcgggaatcgatatttataaaaaagaaaaagcaagctga

SEQ ID NO: 2487 - DNA, 1731 bp, Bacillus licheniformis
ttgttagctgaattatcgatcaaaaactttgcgattatcgaagaattaaccgtttcttttgaaaaagggctgacggttctaaccggtgaaacaggtgccggaaaatcgatcatcatcgacgccgtctctttgcttgtcggaggccgcggatcgtccgaatatgtcaggtatggcgaaaaaagggccgaattggaagggcttttcctccttgacggcggccatccggtttttgatttgtgcacagagctggggattgaagcctcggacgacatgatcgtcatgagaagagatattaacgcaaacggcaaaagcatctgccgcgtcaatggaaaacttgtcaccattgccgcattgcgggaagtcggcagactgctgcttgacattcacgggcagcacgacaatcagctgctgatggaggacgagcaccatcttcagcttctggacaggttcgcaggagaagaaatcgagaatgctttaaaagcgtatcaggaagtttacagccgctacatggatgtcatgaagaaggtgaaagagctttctgaaagcgagcaggaaatggctcacaggctcgatttaatacagttccagcttgacgaaatcgaatcagcaaaccttgagccgaaagaggacgagcttcttcaggaagagcgccgtcaaattgcaaatttcgaaaaaatatacgaagcgctgcaaaatgcctataatgcgcttcgcaatgagcaggccgggcttgactgggtcggcatggcttcaagcgagcttgaaaacgtctcaggcattaatgaagggctcaataaagtatctgaatcggtagccaacgcttactacattctcgaagattcaacctttcagatcagaaatatgctggatgaactcgaatacgaccccgagcgcctcgattatatcgaatcgcgtttaaacgaaatcaaacagctgaaacgcaaatacggcgctactgtcgaagacatccaagcttattcggctaagatagaggaagaaatcgaccggatcgaaaaccgggacagccacttgcaggctttaaaatcacgactcgaatcaatcggcaaggatgtggcgattgaagcagccaatgtgtccgaaatcagaaaaaaatgggcggaaaagctggccaaacagattcagcaggaattgaaagatctgtatatggaaaaatcgacatttgatacggaatttcatgtgaaaaaagcggaacgggatgatgatgcacccgtcgtcaacggaatgcctgttcagctcacaaagcacggcattgacaccgttcgtttcctgatctccacaaacacgggagaaccgcttaaatccttgtcaaaggttgcttcaggaggagagctctcaagaatcatgctggcgatgaaaagcattttctccgctcagcaggatgttacatcgatcattttcgatgaagtggacactggtgtaagcggaagagtcgcgcaggcgatcgctgaaaaaatacaccgcgtctctatcggctctcaagttttatgcattacccacttgccgcaggtggccgcgatggctgacacccaccttttgatcacgaaacagtcgaaagacgggagaacaacaacaagcgtcacacctttgtcaaaacaggaaaaaatagcggaaatcggccggatgattgccggcgttgaagtaacggatttgacgaagcgccatgcgaaagaacttttaaatcaagctaagctagtcaaaaccagcggataa

SEQ ID NO: 2488 - DNA, 450 bp, Bacillus licheniformis
atgaacaaaggtcaaaggcatattaaaatcagggagattatcaccgcgaatgaaattgaaacgcaggatgagcttgtcgatattttaaagaaagacggctataatgtgacgcaggccaccgtctcacgggatattaaagagcttcatttggtgaaggtgccgacaaacaacggttcctacaaatacagcctgcctgctgatcagcgctttaatcccctttccaaattaaaaagatcgttaatggacgcattcgtcaaaatcgactcagccagccatctgattgtgttaaaaacaatgccgggaaacgcgcaggcgatcggggcgctgatggacaatttggattgggaagaaatcatgggaacgatctgcggagatgataccattttgatcatctgccggacgcatgatgatacgaaagtcgtacagaagaaaatattggagcttttataa

SEQ ID NO: 2489 - DNA, 846 bp, Bacillus licheniformis
atgacaggaaaaaaagaacggctcgacgttttattagtagaaagagggttaatggaaacgcgggaaaaagcgaaaagagccatcatggccggcattgtctatacgaatgaaaacagactggacaagccgggcgaaaaggtcgaccgcacgatcccgctgaccgttaaaggaaacccgttaaaatacgtctcaagaggcggattaaaacttgaaaaagcattaaaggagtttcagctctccgttcaaggcaagctgatgattgacatcggctcgtccaccggcggctttacagactgtgcgctgcaaaacggcgctctttgctcatatgccgttgatgtcggttataatcagctcgcctggaagctgaggcaggatgagcgggttgttgtgatggaacgcaccaatttccggtattgcacacctgccgattttacggaagggctgccggagttcgcgacggtcgatgtctcttttatctcactgaaaatcatcctccctgtgctgaagaacattttagtgccgggaagcgactgcatcgctctcgtcaaaccgcagtttgaagcagggcgggaatccgtcgggaaaaaagggatcgtccgcgatcccctcgtccataaagctgtgcttgatgacatcagccggtttgcggctcgagaaggatacgactgccgaaacgcctcgttttctccgattaccggcggcgacggcaacatcgaattccttctccatttgcattgggacggagaggcgcaatccggaacgccgatagcggaagaaacgatcaatcaaattgtcgaagaggctcacaagacattaaaagcgaaaaaaccggatcagcgtgattaa

SEQ ID NO: 2490 - DNA, 1869 bp, Bacillus licheniformis
ttgaagaacctttcaaatgaagaactggaaagcttgagcgctgaaattcgccgttttttaattgaaacgctttctgaatccggagggcacattggtccgaatctcggcgttgtcgagcttaccattgcattgcataaagaatttgacagcccgaaagataagttcttgtgggatgtggggcatcaatcgtatgttcataaactgttgaccggccgcggaaaggacttcgccacgctgcgccagcataaagggctgtgcggttttccaaagcggaatgaaagcgaacatgatgtctgggaaacgggccacagctcgacttctctctccggtgcgatggggatggcggctgcgagagacttaaaaggcacaaacgaatatatcatcccgatcatcggagacggtgcactgaccggcggcatggctcttgaagcgcttaaccatatcggccatgaacaaaaagatatgattgtcattttgaatgacaacgaaatgagcatcgctccaaacgtcggagcgattcattccatgctcggaaggctgcgtacagccggaaaataccaatgggtcaaagatgagctcgagtatttgttcaagcggattcctgctgttggcggaaagcttgccgctacagccgaacggattaaagacagccttaaatatctgctcgtatccgggatgttctttgaagagcttggatttacgtatttagggcctgtagacggccattcctacgatgaactgtttgagaacttgcagtatgcgaagaaaacgaaaggcccggtactcctccatgttattacgaaaaaaggaaaaggctacaagcctgcggaaactgataaaaccggaacatggcacggaaccggcccatataaaatcgataccggtgactttgtcaaaccgaaagctgctgcaccatcatggagctcgctcgtaagcgaaacggtcaggaagcttgcccgcgaggatgaacggattgtggccattactccggccatgcctgtcggttcaaaacttgaagggtttgcgagcgaatttccggagcgcatgtttgatgtcggcattgcggaacagcatgcggcaacgatggcggcgggacttgcgacacagaatatgaagccgtttctggcgatctattcgacatttcttcagcgcgcctatgaccaggttgtccatgatatctgccggcaaaatctaaatgtatttatcggcattgacagagcaggtctcgtcggcgccgacggggaaacacaccagggcgtgtttgacattgcttttttacggcatattccgaatttggttctcatgatgccaaaagacgaaaacgaaggccagcacatggtcaacacggctgtcaaatacgacgacggcccgattgccatgcgctttccgcgcggaaacggactcggcgtcaaaatggataaagaattaaaaacgatcccgatcggaacgtgggaagtgctgcgacctgggacagacgcggtcattttaacgttcggcaccaccattccgatggcgcttgctgccgcggaggagctgcaaaaagaaggccgttcggtcagagtggtaaacgcccgttttatcaagccgctcgatgaaaacatgctgaaggaaatcctgaacgaggggcttccgattttaacgatcgaagaggctgtgcttcaaggcggattcggcagctcgatccttgagtttgcccatgaacatcagtcttacagtccgatcattgacagaatggggatacctgatcaatttattgaacacggcagcgtcgccaagcttctggaagagatcggaatgacaaaagaagacgtcatcagacgaataagacttttgacgcccgtaaagactcataaaggaattggatcatga

SEQ ID NO: 2491 - DNA, 891 bp, Bacillus licheniformis
gtgaccggtaaacttgaaggatttttaaaatcgagaaaaacagtaattgaagagcgccttccgatgtatattaaagacttgcaagcgccgtccatcctcaaggaatccatgctgtactcattggaagccggggggaaacggctgagaccgatattggttcttgcgcttcttcatgcgtacggaaaagacgaagaagccggaattccagtcggatgcgcggttgaaatgatccatacgtattcattaatccatgacgacctcccttgtatggatgacgatgacctcagaagaggtaagccgacaaaccacaaaatttacggggaggcgacggccattctcgcgggagacgccttattaaccgaaagcttcaaaatgatcacttccaatatgccttctgatgtatccgctgaaaagcgcatcagactggtgaacgagctgatttcggcagcgggggccgaaggcatggtcggcggtcagattttagatatggaagcggaatcaaagtctgtatctcttgatgaactgcagcgaatccacgaaggaaaaacggctaaactcctcagcttcagcgtcattgcgggagccattcttgcagatgcatctgaaaaagagatcgaaaagctgcgcgaattcagccatcatatcggcatcggctttcagatcagagatgacattttggaccttgaaggctcggaggataagatcggcaaacggatcggatccgacgcttcaaacggaaagtcgacgtatccgtcgctcctttcgcttgagggcgccagccaaaaacttgatgaacatattgaaaaagcaaaacagctgatttcagagcttccgcttgaaaaagagcttatgtacgagttctgcgatatgattgccgctagggatcattga

SEQ ID NO: 2492 - DNA, 261 bp, Bacillus licheniformis
atggctgaagaaaacaaaacaaaccgggatgacctgacatttgaagaggcgatgaaaggtttggaacagatcgtatcaaagcttgaagaaggggacgtgcctttggaaaaggcgatcgactatttccaggaggggatggctctttcgaaaatatgccacgaaaaactgcaaaatgtcgaaaaacagatggacttcattttgcgggaaaacggggaattagctcctttcagtgttcgggaggaggaaaaaggtgaccggtaa

SEQ ID NO: 2493 - DNA, 1350 bp, Bacillus licheniformis
atgagtgaaatatcatttgtcacggtcacggctttgacaaaatatattaagcgcaaatttgacgtggaccctcatcttgaagatatttggatcaagggcgagctgtcaaatgttaaaatacatagcagaggccatatttatttcacactgaaagatgataacgcccgcatccaatccgtcatgttcgccagacaaaacaggaatctcgcctttacccctgaaaacgggatgaaagtattggtgagaggcggcatttcggtatatgaaccgagcggcagctatcagctttatgcaaaagaaatccagccggacggcataggtgcgcttcatctcgcgtatgaggaacttaagaaaaagctatcgcaagaaggcttatttgatgaaaaatacaagaaacccatccccgcgttcccatccgtcgtcggtgttgtcacgtctccaactggagcggctgtacgcgatgtgatcaccaccattaaaagaagatatccccttgtaaaagtgatcgtccttcctacgctcgttcaaggagtaaacgcgggcgagtccatcgtaagcagcattgaagaggctaaccgcagagacttatgcgatgtattaatcgtcggtcgaggaggaggatcgatcgaagagctgtgggcatttaacgaagaggccgtcgccagggccattttttcttctgacattccgatcatttctgccgtcgggcatgaaacggattttacaatcagcgattttgtcgccgatttgcgcgcggcaaccccgacaggagcggccgaactggccgtacctaatatgcttgatttgctggagcgtctgaaaacgctcgaagcgagaatgacaaaatcgatgcagcaggacttaaaaaagcggcaggagcgggtgaaaaaccttcagtcctcctatgccttccgatacccgaagcggctatatgcccaaaaggaacaggaattcgacctgatattcgaccgtttccaaaaacagctggcgatgaccgtcgaccgcaaaaaacaaaaactgaacgaacagacatacaagctggagatgcttcatcccgaggagcagcttaaacaagcgcgaaaaaggcatgaagagcaaacagtccggctgaagcggaatatgaaagtgcagctgaagcagattcactcgcagtttcaaacggttcttggtaaactgaatgcattaagccctctccaagtgatggaaagagggtacagtttgacatataaagaaaacgaattgattaaaagtattgaacaggttcatgaaaaagacgagatccgcgtcacattaaacgatgggacgctgacctgtgaggtactgcaaaagagaggcgaaacaaatggctga

SEQ ID NO: 2494 - DNA, 855 bp, Bacillus licheniformis
atgacagcaaccatcatcgacgggaaagaaacagcaaaggaaaagcgcgggcagctggccaaggaagttgaagagctgaaaaaacaaggagttaccccgggactggccgttattttaattggtgatgatccggcgtctctttcatatgtacggggaaagaaaaaagcagctgaagcaatggggattcgttttcagctggatcatttcgatgcaagcttcactgaacaggagcttcttgaagtgattgaccagtacaatcaaaatgacgactttcacggaattcttgtccagctgcctcttccggatcatatttccgaacaagcggtgatcgagagaatatcccctgagaaagatgttgacggttttcatccattaaacgtagggaagatgctgcttggcgaagatacgtttctgccttgcacgcctgcggggatcgtggagcttttaaagaaaaccgagattgacctgtcgggaaaagaggttgttgtcgtcggacgaagcaatatcgtcggaaagccggtagggcagctgctcttgaacgaaaacgcaaccgttacgtactgccattcaagaacggccgacattacggctcatacaaaaaaagccgacattctgattgtcgctgtcggaaaggcgaatttcatcaaagcggatcaaattaaagagggagccgtcgtcatcgatgtcggcgtcaaccgccttgacaacggaaagctcgccggtgatgtcgattttgaagaagcgaaggaaaaggcttcctatattacacctgtaccgggcggtgtcggtccgatgacgattacaatgctggcccacaacacggttaaatcagcgaagcgtacaattcaactttaa

SEQ ID NO: 2495 - DNA, 390 bp, Bacillus licheniformis
atgaaaagaagaacagcaagagaaaaggctttgcagtcactattccagattgatgtcagtgatatagaaccgaatgaagcgatgcagcatgccttggacgggcaggaaagcgatgcttttttcgaacagctcgtttacggggtcttagagaacaaagagaaaatcgatgagatgatcaagcggcatctcgtcaattggaagcttgacaggctggcgaatgtcgaccgcgcgattttgcgtttgtccgcctacgaaatgatctttttagatgacatacctgtcaacgtctctatgaatgaagcgattgaactggcaaagcaatttggtgatgacaagtcggcgaagtttgtaaacggtgttctttctaacattaaatccgatcttgaataa

SEQ ID NO: 2496 - DNA, 411 bp, Bacillus licheniformis
ttgaaagacgacaacagcttattggaaatgagccatgaagacaatcatttgggaaaagtggaaatcgctccggaagtgattgaagtcattgccggaatcgcagcttccgaagttgaaggcgtagctgaaatgcgcggcaattttgcgacaggtgtcgtagaacggtttggaaaaaagaatcacggcaaaggcgtcaaagttgatttgtccgatgacggaattatcattgatgtttattgcgtgatgatgtttggcgtgtcgattcctaaagttgcgaatgccgttcaggataatatccgccagacgcttctcaatatgacagctctttcgattaatgaaatcaatattcacatcgttggcattcaattcgattcaaaaacgcacgaggtggaaatcgatcaagagatgtag

SEQ ID NO: 2497 - DNA, 1353 bp, Bacillus licheniformis
atgatcaaaaagctattaattgcgaacaggggagaaattgctgtcaggattatcagagcttgtaaagaactggggattgaaacggtagccgtcttttccgaggccgacagagaggcgctccatgttcagatggctgatgaagcattttgcatcggacctaagctttcaaaagacagctacttgaatataacgaacatcgtcagcgtcgccaaaatgaccggtgctgatgcgattcaccccggctacggcttcctggcagaaaacgccgattttgccgagctttgcgaagaggtaaatgtaacctttgtcgggccgacagcagacgcgatttccaagatgggacaaaggatgttgcaagggaaacaatgcagcaggccgggtgttccgatcgtaccgggctccaaaggaattattgaagatattgaagatgcggtttcattggcccgcgatatagggtatcctgtcattataaaggcaactgccgggggcggcggaaaaggaatcagggtcgcccggacggaagaagagctgatcaacggcattaaaatcactcagcaggaagctgccaccgctttcggcaacccgggtgtgtacattgaaaaatacattgaagatttcagacacgtcgaaatccaagtgcttgcagacacacacggaaacacgattcatttgggggaacgcgactgctcaatccaaagaaggctccaaaagctgcttgaagaaaccccttcacctgctctggatgaaggaatcagggagcagatggggcaggccgctgtcaaagcggctgaagccgtgaagtacacgggagcgggaacggtagaatttatttacgattaccgcgagcagaagttctactttatggaaatgaacacgcgcattcaggttgagcatccggtgacagagatggtgacgggcgttgatttgattaaagagcagatcagagtggcgtcaggcgaaaaattaaccctcacccaggatgaagtcacctttaacggatgggcaatcgaatgccggattaatgcggaaaaccctgagaaaaacttcatgccttctccgggaaaaatcgagatgtatctgcctccgggagggctcggcgtcagagtggactccgcggcttatccgggatactcgattcccccttattacgacagcatgattgccaaagtcatcacttacggaaagacgagggaagaagctgtttcaaggatgaaaagagcgctgagcgaattcgtcatcgaaggcgttcatacgacgataccgttccatctgaagctgcttgagcacgaaacattcgtaagcggagaatttaatacgaagtttttagaaatatatgatgtaatggggtcgtaa

SEQ ID NO: 2498 - DNA, 480 bp, Bacillus licheniformis
atgttaaacattgatgaaatcagacagttgataaaattaattgatgaatcttcgataaatgaatttacatacgaaaacgaaggatcgaaggttgaactgaaaaaacaaagcggaaccgtgcaaaccattcagcaagtggctgcggcgcctgttcaggcaccggctccggaagctcaggccaagcaagcgcctgttcaggatgcgcctgcaaaagaagaagcggcaaaagaaggcggaaacttccacaagatcacctctccgatggttggaacgttttatgcatcttcttcgcctgaagccgacccttacgtaacagtcggctcgaaggtaacagagtcctctgtcgtctgcattgtggaagcgatgaagctcttcaatgagatcgaagccgaagtgaaaggcgagatcgttgaagtattagttgaaaacggccagctggttgaatacggacaacctttatttttagtaaaagcagagtaa

SEQ ID NO: 2499 - DNA, 639 bp, Bacillus licheniformis
atgatgctgaaaaaacaaacggtttggcttttaaccatgttaagtctcgtcgttgtactgagtgtctactacattatgtcgcccgaaggagaaaatgtcgtcacggttgatgacaaggaacaagttgccgctgaaaaagaaaaaccgatgaaagaagagcctgccaaggatggcaaagatgataccgcgcctgctaaagacaaaactaaagggaaagatacaaaagataaagaaacgtctgcgagtgagcagaacggagaggttgtcacagaggaatcatcgggtgatgaagatttattcacaacataccgcatggaaatggacgatcagcgcagcagggagagggaggaattaaccgaaatcgtcagaagcgataaagcgacggcaaaagaaaaaagcgaagcttacgacaagatgacagagctcagcgaagctgaaggaacggaaaagacccttgaaaccctcatcaaaacaaaaggctataaagacgccttggtcaacgccgacggcgataaagtcaatattacggtgaaggcgaaggagcactcgaaagccgctgccaccgatatcatcgacatcgtcgcaaaagaagtgaaaaacttaaacgatgtggctgtaacgttcgagccagcagattaa

SEQ ID NO: 2500 - DNA, 696 bp, Bacillus licheniformis
atgaataaaagaacctggatcgaaaagctgatcggccacctgctcccgaaagacgagaaagacggaaaaaagctgacgaaatatcactactttctgctgctttttgttctcggcgtttccttcatgctcgtcagccagatcttctcttccgaaccttcccaagagccagcggcagatcagccggcggcttcacaaaaagctacgtctgaaagcaccgtacagagcggtgaaggagaaaaagaagtgttcaagcccgcctcagatgacaaaccgaaggaatcgatccaagattacgaacaggaatatgaaaatcagctcaaagacatattggaaaccatcatcggcgttgaggacgtgtcaatcgtcgtcaatgttgatgcaacctcattgaaaatattcgagaaaaacagaaaaacccaggaaacttcaacgaatgagacagataaacagggaggcaagcggacggtgtctgaaatgtcttcagacgaagaaatcgtcatcatcaaaaacggagataaagagacgcctgtcgtcgttcagacgaaaaagcccgatatcaggggtgttctcgttgtcgctcagggagtcgacaacgttcaaataaaaaagaccattattgaagcagtgacaagggttcttgatgttccgagccaccgcgtcgctgttgcccctaaaaaaatgaaggaggattcataa

SEQ ID NO: 2501 - DNA, 630 bp, Bacillus licheniformis
atggaatttctgacagagtggctcacgaatattattctatttattctgatggcgatcgtcatcgatatgcttctgccgaattcgagcatgcaaaaatacgcgaaaatggtgatcagcctgctcttgatcgttgtaatactgaacccgatcttctctttattcaggacagatccggatgtgatttttgagaagcttacaaaaaacggacaagttcagtcaaacgaaataaaaaatcagctgaattcagaaaaaaaagaaatacaagcctcacaacaagcatatatcttagaacagatggctgttcaattggaaaagaacgcagagggcaggtttacaagcgacaaatacaagatagaccgagtcgaggtctcttctgacagccagctgaaaacagagaaagacctcagtaagcatgcggaagtctcggtattcttgaaaccagcatcggaaaaaacggtccaagccgtcgctcctgtcgagatcaatacggaccggagctaccagtccatgcaggaaagagaaaagaaagagacgggggaagtcagagaacagctagcaggcatctgggaaataagccccgacaagattacagttcatatcgaagggggagaacgaagcggcaatgaataa

SEQ ID NO: 2502 - DNA, 1206 bp, Bacillus licheniformis
gtgaagcgttttctgttctggctcttggtcatcggaatcgtatgctttggagcgcataatgtacaagcttcgccaaaagaagcggagccggctggggaaaccgctgcagaagaatcggcagaagccattgcaagagagcaggctgaaggtttggaactagaccgggtcggggagttctggaacaacattttgacagagtatgggggacaccttcccgaaagtcaaaaaggaagcctgcttgaatttgtcaaaggagaaaagcacttttcgcctgaggaatggggcaaagcgctgttttcctacttgttccatgaagtgctggctaacgggaaactgctggggacgctgatcctgttgaccatcttctgcgtcctgcttcagcttttgcaaaacgcgtttcaacaaagcaccgtcagcaaagtggcgtatgcaattgtctacatggtgctgattattcttgcgctcaacagctttcgggttgccgtcacatatgcgaatgaagcgattcagacgatgacaagctttatcctgtcgctcgtacctctgcttctggcgctgatggcgacttcggggggagccgcctcagccgcattctttcatccggtcattctttttctcatgaacacgagcggcttgtttatccaatatatcgtgttgccgcttttatttttatcagcgattttaagcattgtcagcacgatgacggaccaatataaagtcacacagctggcccagctcctcagaaatgcggcgatcggcacgctggctgcatttttgaccgtattcctcggtgtcatctcggttcagggcgcctcagccgcagtgacggacggcattactttgcggacggcaaaattcattaccggaaacttcatccccgtattgggccgcatgtttaccgaagcgacagacacggtgatcagcgcgtctctcctgctgaaaaacaccgtcgggatactcggtgtggcaatcttaatttgcatcgcagcctttcccgcgatcaaaatcctttccctcgcgctcatatacaaaattgccgcggcggttctccagcctctcggaggcggcccggttatcagctgcctggatgtcatcagcaaaagcgtcatctacattttcgcggccatggccatcgtttcgctgatgtttttcttaagcttaaccgtgatcattacagcggggaatctgacgatgatgatgaagtag

SEQ ID NO: 2503 - DNA, 366 bp, Bacillus licheniformis
atgatcgccaccttcctcagcttgattgtgaaagagcaaaaaccgacgtttgcttttttgattgtcgtttttgccggctgcacgatttttttattcttagtagatcaggtctacgaaatcattcggatgattgaaaaaatagctgccaatgccaacatcaacatgatgtatgtcgaaacgattttgaagattatcgggattgcttatattgcggagtttggcgcccagctgacaaaggatgccggacagggtgcgattgcttcgaagatcgaattggcaggcaaaatcctcatcttagtcatggctgtgcctattttaaccgtgattatcgaaacgatcatcggactcatcccttccatgtcttag

SEQ ID NO: 2504 - DNA, 207 bp, Bacillus licheniformis
atgggagtagacgtaaatattatttttcaaattgccggcgtcgggatcgtcgtcgcttttcttcacaccatactggatcaaatggggaagaaggaatatgcccaatgggtcacgcttttaggattcatttatatattgttcatggtggcaactgttgtcgatgatctattccaaaagataaaagctgtctttctatttcaaggatag

SEQ ID NO: 2505 - DNA, 516 bp, Bacillus licheniformis
atgctgaagcttttaggtgccgtgcttattttggcagcagccacatggacaggatttgaaatggcgaagcctttcagggaaaggccgaagcaaatccgccagctgttggccgctttgcagtctttggaggctgaaatcatgtacgggcatacaccgctccgtcaggcatcaaaacagatcgcacaccagcttaccgagccggtagcctctttgtttcagacatttgcagaacagcttgaaaaaggcagcgcttcagcagggacggcatgggaagacagcctggagaaagtatggcccgaaacggctcttaaaaagaaagaatacgagattttacggcaattcggcgaaacgctgggccgtcatgatctgatttctcagcaaaaacatatcaaactggcgttaacccatttagagacagaggaagctgaagcaaatctcgcccaggcgaaaaatgaaaaaatggtcaaaagccttggatttttgacgggactgctactgattcttctattgatgtaa

SEQ ID NO: 2506 - DNA, 924 bp, Bacillus licheniformis
ttgcaccacatcacagagattctccccgatacgatcaaacgcgcgctcagcggtcttggcgaccatgaaatcgatcagatagaagaaattcgggttcggacaagtcgtccgctggaactggtgaacaaaggaaagccgcgctttctcccttatgtggcgacgcctgaagactcggcgcttcttttaaacagattgggaaattacagcatgtatacactggaagaggaattgaaaaaaggatatgtcacgatcagaggcggacaccgcgtggggcttgccggccgggttgtcgtcgaaaacggggccgtcaaaggaatcagagaaatatcatcatttaatattcgcattgccaaagaaaaaatcggcatttccaaaccgtatgtcccccatttatttcaaaactcgtggctgaacacgctgattatcggtccgccgcaaaccggaaaaacaacactgctcagagacctcgccaggctgatcagttcgggaagcggcaacgcccctgccaaaaaagtggggattgttgacgaaaggtctgaaatcgcaggctgtgtaaacggcataccgcaatatcggctcggcgaccgggcagacatccttgacgcctgtccaaaagcggaagggctgatgatgatgatcagatcgatgagtccggaggtaatgatcgccgatgagatcgggagaatggaagacgcagaagcgctcttggaagcggtccacgcgggggtgactgtcatcgtttcggctcacggctacacatatgcagatctcgccaggcgtccatcattgaaaatgcttcaagagcaccgggtttttgagcgaatcgtggaactttccagaaagaacggtcccggcagcctgagccgcatcctaaatgggaacggagagccgctcggggcagcaaagaggatgttatcatgctga

SEQ ID NO: 2507 - DNA, 282 bp, Bacillus licheniformis
atgaagcttttctttggacaagtcaatccgacggttttgacaatggcggcgttaagggtggtatcatctttgatcgaactgacggcggctgttgtgatgcttttgacaaacgacgtcagaaaagctgtggcggtcaacagcgtactggccatggtcgggccgctcatctttattattacaatgacaatcggcatctatcagattgcagggcagctttcttacgcaaagctgattttgatctttatgggagtggttttgatcatcgcggggatctataaatag

SEQ ID NO: 2508 - DNA, 558 bp, Bacillus licheniformis
atgatttcagtaaacgattttcgcacaggtttaacgattgaagtagacggagggatttggcgcgttgttgacttccagcacgttaagccgggaaaaggcgcggcatttgtccgctcaaaattgagaaatcttcgcacaggtgcgattcaggaaaaaacattccgcgcaggtgaaaaagtggcccgcgcccaaattgaaacaaaaacgatgcagtacttgtatgccaacggcgatcagcacgtttttatggatacgacatcttacgagcagcttgagctgaacgagaagcaaatcgaacacgagctcaaattcctgcttgaaaatatgtctgttcagatcatgatgtatcagacagagacgattggaatcgaacttccgaacacggtcgaactgaaagttgttgaaacagaaccgggcattaaaggcgacacagcctcaggcggaacaaaaccagcaaaaacagaaacaggccttgtcgtcaacgtgccattcttcgtaaacgaaggagatacgcttgttgtcaatacttctgacggttcttacgtatcaagagcataa

SEQ ID NO: 2509 - DNA, 1062 bp, Bacillus licheniformis
atgaaactaaacaaattgagagagcttttcggcggtttaggcattgacggtatattggtgacgagcggcgttaatttgcggtacatcaccggatttaccggatcttcaggactggcggtcatctcagacgatcaagcagtctttattacggatttccgctatacagaacaggcgaaggatcaaatcaaaagctttgacatcgttcagcatgccggcggaatcgttcaaaagaccgccgaagtgatcaaagagatggggataaacaaaatcggttttgaacaggataaaatgacatacggaacgtatgccgcctacaaagagcagcttggcgcagctgaactcgttcccgtttctcaatctgtggaaaagttgcgcttgattaagtcaagtgaagagattaagatattaaaggaagctgcaaagattgcagatgatgcattcagccatattctgacggtcatcaagcccggcatcaccgaaattgaagtcgccaatgagctcgagttttacatgcggagccagggagccgatcattcgtccttcgatatgatcgtggcgtcaggcgtacgctcaagtctgccgcacggagtggcaagcggcaaagcgatcgagaaaggcgaccttgtgacgctggactttggggcttactataaaggttactgctcggacattacgcgtacagtcgcggtaggagagccggatgatgagctgaaacgcatttatcaaaccgtgtttgaggcgcaggctatcggcatgcggagcatcaagccgggaatcaccgggaaacaggctgacgcatacacaagggactacatatcttcacaaggctacggcgattatttcggccattcaacaggccatggcctcggcatggaagttcatgaaagtccggcgctttcagcacgttctgaccagatgcttgaaaaaggcatggttgtaacggttgaaccgggaatttacataccgggcaaaggcggggtcaggatagaagatgatattgtcctgacagaggaaggaaacgaatcccttacccattccgcgaaagatttaattattttataa

SEQ ID NO: 2510 - DNA, 438 bp, Bacillus licheniformis
ttgccgcatattttaattttgaacggaccgaatttaaaccggcttggaaaacgcgaacccgatgtatacgggacagacacattaaccgatttggaacaaagactttttcaatttgccgaaggcattcagacagaattgactttttttcagtcaaaccacgaaggggacctgattgatgctcttcatgaggcagaggagcaatacgatggaatcgtcttgaatccgggggctttctcgcattacagctatgccctccgcgatgcggtggctgcaatcagcataccggtgattgaggttcatctttcaaatcctcatgcaagggaagagttccggcaccgctcggtcatcgctccggttgcaagaggccagatcaccggactcggctttgaaggttataagctggccatctcttattttatgaacacaaataacaaatag

SEQ ID NO: 2511 - DNA, 537 bp, Bacillus licheniformis
atgggtaatgaagacaatcaaaaacagccggaagagcttgagcagaataagcgtgaaaccccgatgactttcaccggaagggtgatcatgactggctttgtcggcggagtgctctggagtgcactcggtgagctggcgtacctttttaagttctccgaggtcaatgcgaacatgattctccagccttttgtcatcggcgactggaaaaacggatttctcggaacgtttatcagcatactcttgatcggagtgatttccatcggggctgccttgctttactacggcactttgaagcaggtcagaggcatgtgggcaggcattgtctatggagccgttttgtgggctgtcgtgttttacctgttcaatccgatgtttcccgatgttcagacagtggctgaattaaagagggaaacgattgtgacgacgctgtgcatttatctgctttacggtttattcgtcggctattccatttcgtttgaatacaatgagctcaattctgaaaaactgacgcgcgcccttggagaaacaagagaatag

SEQ ID NO: 2512 - DNA, 954 bp, Bacillus licheniformis
atgtcaaatcaaacaaaacagcccgcatacggagggcaggctgtcgtcgaaggcgtcatgttcggcggcaggcgccattatgtaaccgcgatccgcagaaaagacggaagcattgaatttttcaagctgcctcggaaaaccaatccgacgcttgaaaaattaaagaaaattccttttctcagagggattatcgcgattgttgaagcgagcgctaacggcaccaagcacttgaatttttcgagcgaacgctatgacctcgacccttctttagacgatcaattgaaagaagagaagccgtccaatctgacaatgatttttggtctcgccgcagtcggcgtcctgtcttttttgttcggcaagtttatttttacgctcgtgcccgtttttttagcggagctcacccgtccggtctttcagtcggacgtcgcgcagattatgatcgaaagcttctttaagctgctccttctcctaagctatatttacgctatatcatgcactccttttattaaaagagtttttcaatatcacggagcagaacacaaggtcataaactgttacgagcaaaatctgccggtcacggttgaaaacgttcagcggcagtcaagactgcactaccgttgcggaagcagctttattctattcaccgtcatcgtgggcatgtttgtttacttgcttgttcctactgaccctctctgggttcgtattttgaatagactcgcactgatacccgtcgttctcggcatttcatttgaagtcctgcagctgacaaacaaactgagagacatccctgtattgaaggcgctcggctacccgggcttatggctgcagcttttaacaacgaaagagccgtctgacgatcaggtggaagtggcaatcgcaagcttcaatgagcttcttcatatggaaaccaaagcagaggacgaacagaaggaaccttctaatatcgtaatgtaa

SEQ ID NO: 2513 - DNA, 387 bp, Bacillus licheniformis
atgaagcaacgcgtacatcctgtctcagctttaattattgcgtttggaatttttgggtttgtttatttcgccgtcacaagtccgggccgcctgctccaatacttgcttgtttttgccgcggtcggcgccatcatttatttcgtgatcaggcgcatttccaatcgcaatatgggcagtgagggagccgcttttaagaaagcagccaaacaatccaacaagcgttttcaggatcataaaaaacgctctgtaaaaggcagggtcaatcacctgagaagcgtaccgtctatcaataaatcgaagccggtattggtgaagaaaaaaagccagacccagctgacagtgattgaaggcaaaaaaagcaaaaagaaaaacagggctttcttttaa

SEQ ID NO: 2514 - DNA, 876 bp, Bacillus licheniformis
atgtacatcgacggggttttttcaggcggcggcatgaaaggggttgcgcttgtgggagcatacgaagcgcttgaaaaacggggcttccgatttaaaaggctggccggaacgagcgccggttcgatcattgcctcatttatcgcggccggctatacaagcgcggagatccgccaaatgatggaggaattaaatgaaagcgagctccttgacccgaggttttcactcttgcctttgaaattgctgcaatgggcatcgatttattggcggctcggtttatataaaggagataaattggaaaactggatttccgaaaagttgaaagcgaagggcatttcagtgttcggggatcttgaacagggaaagctgaagttgatcgcttccgacttatcgaacggcaagatgcttgtgctgcctgacgatttaaacaggtacggtttgaatccagggcgattttccgtcgccagggcggtccggatgagctgcagcatcccttatttttttgagccggtgaagctcaagtcacctctcggaatcagcgtcgtcgtagacggcggagttctgagcaattttccgatgtggctgtttacaacagaaaaaaaacggccggtattgggcatcacgctgatgcccaatgaaaaagagaggccgaagaaaacgattaaaaatgcgttcgagctgttcggggcgctgtttgagacgatgaaagaggcgcatgacgccaggcacattgccacgaaacatgagcggaacatcatttttttgcctgttgaggaagttttgtcgactgaattcgcgatgtcggcagaaaaaaaactagctctaatcgagctaggaaaaaaacgaacagaattatttttgaaacagtggacgttttaa

SEQ ID NO: 2515 - DNA, 429 bp, Bacillus licheniformis
atgacaacaccgagtatggaagattacatagaacaaatttatatgctgattgaagaaaaaggatatgcaagagtctcagatatagccgaagctctggccgtccatccctcctcggttacaaaaatggttcaaaaactcgataaagacgaatatttgatttatgaaaagtatcgcggcctcgtgctgacgcctaaaggaaagaaaataggcaagcgtttagtatacagacatgaattattggagcagtttttacgaatcattggtgttgacgaagagaaaatttatgatgatgttgaaggaatcgaacatcatttaagctggaacagcattgaccgtatcggagatcttgtgcagtattttgaagacgacagcaaaagaatcgacgatttgagaagcgtccaaaaaagaaacgaacaggaaaatcaataa

SEQ ID NO: 2516 - DNA, 837 bp, Bacillus licheniformis
atggaaaaagaaacatggcgttttatcgattcgggacgacgggatcccgcttttaatatggcgctcgacgaggcgctccttttttggcacagcgaaaataagattccgccgaccatccgcttttacggctggaatccgccaacgctttcagtcggctatttccaaaatatcgaaaaggaaatcaatctggatgccgtcaaaaaacacggtttgggctttgtgagaaggccgaccggaggaagaggcgtgcttcatgaccaagagctgacctacagcgtcattgtgtctgaagaacacccggaaatgccgaagacggtgacggaagcgtaccgcgtcatctctgaaggtattcttgaaggcttcagagagctggagcttgatgcgtatttcgccataccgagaacggaaaaagagaaacagagtctgaaaaacccgagatcttccgtctgctttgacgccccgtcgtggtacgagctcgttgtcgaaggcagaaaggtcgcaggaagcgcccagacaaggcagaaaggagtcattcttcagcacggttcgatccttcttgatctggatgaggacaagctctttgatttgtttatttacaaaaatgaccgcctcagagagcgcatgcagagaaacttcaaacaaaaagcggtcgccatcaatgagctgacgaaagaaaaagtcacgattgaagaagcgagcgaagcttttaaaaaagggtttgaaaaagggcttaacattcatttggagccttatgaactgacggaagaggaaacggaatttgtcgaagatctcgccaggacgaagtatgcgacagatgaatggaattatagaaggtaa

SEQ ID NO: 2517 - DNA, 387 bp, Bacillus licheniformis
ttgtctaccagcagcattgtcgttctcttgatttgcgccgcgctcatcatctacgcggtcgcttcatacatctatcagcagcgcattatgaaaaccttgacagaagaagaattccgggcaggctatcgcaaagcgcagctcatcgatgtgcgcgagccgaatgagtatgaaggcggccacattttgggtgcgagaaacattccgctttcacagcttaagcaaagaaaaagcgaaatccggcctgacaaaccggtttacctgtactgccaaaacaacgtcagaagcggaagggccgcccaaacgctccgcaaacacggctgtaaggagatttacaacctgaaaggcgggttcaaaaaatggggcggaaaaattaaaacgaaaaattaa

SEQ ID NO: 2518 - DNA, 885 bp, Bacillus licheniformis
atgtggaaaaagatagcgggaatcggcactgcagcggtactcacattgggtctggctgcctgcggaagcagcaataataatgaaaatgcgtcagtaggcgatcaagtcaattataaaattaccggcattgatcctggagcgggcattatgaatgcgacggaccaggcgctcaaggactacgatctcagcaagtggactgtaacgtcaggatcaagctcagcaatgacagccgcattgaaaaaagcttatgacaaaaaagatccgatcatcattacgggctggacgccgcattggatgtttgcaaaatacgatctgaaatatttaaaagatcctaaaggttcctacggcgatgccgaagaaatccatactgttacgcgcaaaggattcaaggacgaccatccgggcgcaaacaagctgctcagccaattcagctggacagaggatgatatgggagaagtcatgcttgccgttcaggaaggcaaaaaaccggaagaagctgcagcagacttcgtgaaaaaacatcaagatctagttaagaaatggacaaaaggcgtcgataaagcggacggtgaaaaaattaagctcggctatgtggcatgggacagcgaaattgcgagcacgaatgtcatcgcaaaagttcttgaagacttaggatacaacgttacgctcagccaagtagaagcaggcccgatgtggactggcattgcaaatggaagcgtcgatgcttcacttgctgcatggctgccgcaaacgcataaaacatatgctgaaaaatacaaaggcaaatacgaagatatcggtactagcatgacaggcgtaaaaattggccttgtcgttccgacatatatgaaagatgtcaattcaatcgaagacttgaaaaaataa

SEQ ID NO: 2519 - DNA, 855 bp, Bacillus licheniformis
atgtttactttatcatcgcttccccgcattcctttagccgattggatcgatcagtttgttgactggctgacggtgtcgttcggcggtgtatttaacggaattgccagcggagtggaatcgtttgttgatgagattgtccaagggctgggttttgttccgccggttatgttgaccgttatttttgccgcgctcgtctggctgatcagcaaaagaggcattgcgctgtttactttaatcggattttttatcattgattatttaggatattgggacgccatgctccagacattggcgcttgtcgtcacatccgttctgatttctgtcattatcggcattccggtcggaatctggggctcccaaaagaaaacggttcggagagtcgttacgcccatccttgacttaatgcagacaatgccggcattcgtttatttacttccggccatcttctttttcaatatcggggttgtgccgggtgttgtcgcttccgttatctttgcgatgcctccgacaatccggatgacgatcttagggatccagcaggtgcctgaagatctgattgaagctacagaagcatttggttcaacgacaagccagcggctctttaaagtgcagctgccgctcgcgacgaaaaccattctggccggtatcaatcaaagcatcatgcttgctttgtcaatggtcgttattgcatcaatggtaggcgcgcccggactcggagaagaagtttaccgggctgtgacccagctgcaaacgggtaccggtgtagaaaccggacttgcgattgttattattgcgatcgtacttgaccgggttacacaaaatataaaattgaaaaagagcagggggaatgcataa

SEQ ID NO: 2520 - DNA, 1248 bp, Bacillus licheniformis
atgaattcagacgaaaagcgaatcaagataaaagtagaaaaagtgtccaaagtgtttggaaagaatacaaagaaagcaacgcagctgcttgccgatggcaaaaccaaaaaagaaattctgaaagaaaccggggcgaccgtcggggtgaaccaagcagattttagcgtgtatgaaggtgagatatttgtcatcatgggtctatcagggagcggtaaatcaaccttggtgcggcttttaaaccgtttgattgaaccgactgcaggacatgtgcacatagatggtgacatgataacaaatatgtccaaagaccagcttcgggaaatccgccgaaaaaaaatcagcatggtctttcaaaaattcgctctgtttccgcacaaaacaattcttgaaaacacagagtacggattggaactgcaaaaagtggataaaagaaaacgccggctaaaagctatggaatcattaaagcttgtcgggcttgaagggtatgaacagcaatatccggatcagctgagcggcgggatgcagcagcgcgtcgggcttgcccgcgcattgacgaacgatccggacattctgctgatggacgaagcgttcagcgcgcttgaccccctgattcgcaaggatatgcaggatgaactcctcgatttgcatgaatcagtaggaaaaacgattattttcatcacccatgatcttgatgaagcgctgagaatcggcgatcgaatcgcattgatgaaagacggaaacatcgttcaaatcggtacgccggaagagatcttaatgaacccgtcgaacgaatatgttgaaaaattcgttgaagatgtcgacttatctaaagtgctgacggccggccacattatgaaacgggctgaaaccgtgcgcgtagacaaagggccgcgcgttgcactgacgctgatgaaaaacctggggatctcctcgatttatgctgttgacaaacacaataggctcctcggctccgtcgatgctgaaacagcgaagaaagcagccgaaaaaagccagacgctggagagcgtcatctcaagagaaatcacaaccgtagaagagaatgttgtcctgacggatatctttgaattggtctctgatgccagcattccgattgctgtcgtcgatgaaaaacagcggatgaaagggatcatcgtcaaaggcgcattaatcggagcgcttgccggaaatgaccggtatattaatgctcatgaaccagcccatgaagctgttattcaggaggtgagataa

SEQ ID NO: 2521 - DNA, 1458 bp, Bacillus licheniformis
atgaataatcaggatcaatcgcttatttttgaagtatcaaaagaagggcgggtcggctacagccttcctgagcttgacgtccctgaaacagatgtgacagacgtcattgacgaagcgtatatcagagacgaaccggcagatctccccgaagtgtccgagcttgatattatgcgccattatacggctttatctaggcgcaaccacggagtggattcgggattttatccgctcggttcgtgcacgatgaagtacaatccgaagattaacgaaaaaatcgcgagaatccctggattttctgcgatccatccgctccaggatgaagcgaccgtgcagggtgcgctggaacttttgtacgacttgagcgagcatttggaagagatcacaggaatggatgaggtcacccttcagccggctgccggcgcgcacggcgagtggaccgggctgatgatgatccgcgcgttccatgaggcaaacggcgatcataaaaggacgaaggttattgttcctgattcggcccacggtacaaatccggcgtctgcgactgttgccggatttgaaacggtcaccgtcaaatcgaatgacgacggccttgttgatctggaagatttaaagcgtgtcgtagacgaagaaactgccgcgttaatgctgaccaatccaaatacgctcggcctttttgaggaaaatattttagaaatggctgaaatcgtccatagtgccggaggaaagctgtactatgacggagcgaacctcaacgccgtactcagcaaagcaaggccgggtgacatgggattcgacgtcgtccatttgaatcttcacaaaacctttacgggaccgcacggaggcggaggacctgggtcaggtcctgtcggcgttaagaaggaattgataccgtatttgccgaagccggtgcttgtgaaaaaagacggacgctatacttttgaccatgaccgtccgcattcgatcggcagggtgaaaccttactacggaaacttcgggatcaatgtgagggcatatacgtacattcgttcaatggggccggacgggctcaaagaagtgacggaaaacgccgttttaaatgcgaattatatgatgagaaagcttgctccttactacgatctgccgtttgaccgacactccaagcacgaatttgtgctgtcgggaaggcgccagaaaaagctgggagtcagaacgcttgacattgcaaagcgccttttggacttcggcttccatccgccgaccatctatttcccgctcaatgtcgaggaatgcatcatgattgaaccgacagaaacagagtcgaaagaaacgctcgatgcgtttatcgatacgatgatccagatcgcaaaagaagcggaggaaacgcctgaagtcgttcaggaagcaccgcatacaaccgttgtgaaacgcatggatgaaacaaaagctgcgcggaagcccgtgctgcgctatgaaaaatga

SEQ ID NO: 2522 - DNA, 1347 bp, Bacillus licheniformis
atgaagcaccgttacctgccagctacagatcaggataaaaaggagatgcttgaggcaattggagtcgagagaatcgacgagctattctccgatatacccgaaagcgtcagatttaaaggggaataccaaattaaaaaggcaaagtccgagacggagcttacaaaagagctgacgaaactcgcggctaaaaataaagatacagtgacgtacgcctcttttttgggagcgggcgtatacgatcattaccagcccgtcatcgtggatcacgtgatttcgcggtcggaattttacacggcctacacaccgtatcagccagaaatttctcaaggggagctccaggcgattttcgaatttcaaacgatgatttgcgagctgacgggcatggatatcagcaactcgtcgatgtatgacggaggaacggcgttagccgaagcggcaatgcttgcttcaggacatacaaaaaagaaaaaaatcgtcgtttcggaaaccgtccatcccgaatcgcgcgaggttctaaaaacgtatgcgaaaggacagtacatcgatgtggtagaagtcccttccaaaaacggaacagcggatcttgaggctcttgatgaagccgtctgcgaagatacagcagcagtgatcgtccaatatcccaactttttcgggcgaattgagccgctgaaagacattaaaccgatcgcccataaagggaaaagcatgttcatcgtttccgccaatccgctggctctcgggcttttaacaccgcccggggcgttgggcgctgacatcgttgtcggagatgcccagccgttcggaatccctgctgctttcggcggtccgcactgcggattctttgccgtcacgaaaaaattgatgagaaaagtgcctggccgtctagtcggtcagacggaagatgaaaacgggaaaaggggattcgttctcaccctgcaggcccgcgagcagcatatcagacgggataaagcaacatcaaatatatgctccaaccaggcgctcaacgcgcttgctgcgtcagtcgccatgacggcgctcggaaaaaaaggcgtcaaggaaatcgcatggcagaacctgcaaaaagcggcttacgcaaaagaagcagctaaacgggccggtcttgaagtcgcgtttgaggggccgatgttcaacgagtttgtcatcagactcaatgaacctgtcgaaaaagcgaatgaacgcctgcttgagaaaaatattatcggaggctacgatctcggcgcttcatatccggatttaaaacggcacatgctgatcgccgtgacagagctcagaacaaaagaggaaatcgatacactcatgaatgaattgggggattgccatgaataa

SEQ ID NO: 2523 - DNA, 1095 bp, Bacillus licheniformis
atgcttaaacgtacgcctttatttgacctttataaggaatatggcgggaaaacgattgattttggcggctgggaactgccagtccaattttcttctattaaagaggagcacgaagccgtcaggacgaaagcggggctttttgacgtctcacacatgggagaggtcgaaatcacaggaacggacagccttccgttcttgcaaaagctgttgacaaacgatgtttcgacgctgaaagaaggcggcgcccagtatacggctatgtgctatgaagacggcggaacgatcgacgatctcctcgtctataaaaaagcggccaatgtctatatgctcgtcattaacgcagccaatatcgacaaggacgtcgattggatgaacaagcatataaagggtgacgtgtcggttcgaaacgtatctgacgagattgcgctccttgcccttcaagggccgaaggccgaagcaattttaaaacaggtcgcagatcatgaccttgcagaattaaagccgtttatgttccgggatgatgcagcggttggcagcgtgcaggcgcttgtgtccagaacgggatacacgggagaggacggctttgagatttactgccggaatgaagatgcagcctgcatttggaagctgctccttgaaacgggcaaggattcgggattggtgccgtgcggcctcggggctcgggatacgctgaggtttgaagcgaagctgccgctttacggacaggagctctcaaaagacattacgccgatcgaagccggcatcggatttgccgtcaaaacgaacaaagcctcggatttcatcggaaaagccgtcctggcaagccaaaaggaacatggagcggacagaaagctggttggccttgaaatgatcgataaaggcattccaagacacggatacgccgtctattatcaaggcgaacaagcaggcgaggtgacaaccggcacacagtcgccgactttaaagaaaaacgtcggcctcgcattgctgaaaaaagaagcctgcgccctcgacaccgtagttgaagtggagatcagaaataaacgtttgaaagccaaaatcgtgaaaaccccattttacaaacggcagccgtaa

SEQ ID NO: 2524 - DNA, 1680 bp, Bacillus licheniformis
atgagaccagacattcatttcgacaacgaatggccggaacagttcaaaaagcatcttgatgaagacggcccgtgggcgaattgggagctttaccagctttcctgtgaagtgcagaaaaggcttgcgattccgacgtttgaaggcttgcaggccccataccacctccccggcttcacaccgcttccccaccagctcgaagtcgcccggaaggtggtcgaacagatgaacggaaaagccatcttggcggatgaagtgggcctcggcaaaacagtcgaggcggggctgatattaaaagaatacatgattcgcgggctggccaagaaaatattaatccttgtccccgcctcgctcgtctcgcaatgggtaaaggaacttcgggaaaagtttttaattccggccgttgaacagaaaaaaagctatgtatgggagcaatgcgatgttgtcgtctcctcccttgacacggcaaagcggtcgccgcacagagagacggttttgtcgatccagtacgatgtggtgattattgatgaagctcacaaactgaaaaacaataaaacaaaaaattacgagtttgtccgcagcttaaagaaaaaatactgtctgatgctgacggcgacgccgatccaaaacaagatcgacgaaatatttaatctcgtctccctgctaaaacccggacacttgggaaatgaaagcaacttcaacaaagattatacaaaacagatcaattcagctgaagcacacgagcgcttgaagtcccttatcaataaagtcatgatcagaaacaggcggcatgataccggcatcacctggacaaagcgtcatgtcgaaaccgtgcctatttccttttcgcctacagaacaggctttgtatgacgagattaaaaagctgaagacaaatcatcagcattcatcaagcatgttctcaatcatgacattggagcgcgaatgctgttcaagcagggaggctgtctatatgacgctgaaaaacatgcttgaccgaaaggaccgcgaagcgccggtaatctctgaacctgtcatccaccatttgatcgaaaaggtcaacgaggtcgcacaaaattcaaaagcgctgaaagtcgttgaactcattcaagaactcgatgacaaagtcatcatctttaccgaatacagggcgacgcagatttatctgcaatggttcctccagcagaacggcatcagttccgtaccgttcagaggcggatttaaaagaggaaagaaagactggatgaaagatttgttcaggggcaaagtgcaagttctgatcgcgactgaagcaggcggcgaaggaatcaaccttcaattttgcaataaaatcatcaactatgaccttccgtggaacccgatgcgcctcgaacaaagaatcggcaggattcaccggctcggccaggaacgcgatgtctacatttacaatatggcaacaaagcataccgtagaagaacatattttaaagcttctttatgaaaagattcatttgttcgaaaaagtcgtcggagacttggatgatattttaacaaaaatcgaggtcggcaattttgaagagcacctccacgatattcttttttactctgcgacagacgaggaaatgaaaatcaaaatggaaaacttaacctctttcatctcttacggaaatgaagacgtttcaaaccatacacagataggaggctaa

SEQ ID NO: 2525 - DNA, 795 bp, Bacillus licheniformis
atgcgtcaggaagaaatctacctgtttttagaacgttttttcaccgcaaacggctgcacgatcaccgacaaaagtccaggccacatgaccgtgcagctgacggttgaggtcgataaacaaatcatgaacaggccgttttactggcactggcttgaaaagacgggaggagagccgaatccgatgaaaatcacgctgatcacgaatgaagacgaggccccttccgatatcgaaggggagtttattcattttggatcaccaagactttttcaaattttccaggcagtgcaaaaaaacggcaaatttattcgcctttatgagaaaatccgttccgaaggggctcatatccctctggaaccttggctcggcatgaatgtgacgatctcgtaccagtccgacatgaaaaaagataagcttctgtcccttggccttcacttaatcagcggccagctgaccgaatcgtttcaagagcaaatggaagcacgcgagctttcctcacagatctctgactactgttatacgatgtcgccgttgattaagccggaaagcggcataaaacggcttgagcgctatatcgaacaggcggccagaagcgaaccgcttgattgggctgaagcttccctgaaacgttggaataacgacctggcactcttaaaccaattttacgaggatactgaagaaaaaccggaggaatacgaaattgagaaaaaggccctccaaacgctttacgagcctaaaatcgatattaaagttcaaaacgggggattattttatctgcgtaaaaaaaattcaggataa

SEQ ID NO: 2526 - DNA, 177 bp, Bacillus licheniformis
atgaataaagataaaaatgagaaagaagaattggatgaggagtggacagacttgattaaacacgctcttgaacaaggcattagtccagaggaaatacgtatttttctcaatttgggaaagaagtcttcaaatccttccacatcaattgaaagaagtcattcaataaatcctttctga

SEQ ID NO: 2527 - DNA, 336 bp, Bacillus licheniformis
ttgattggccagcgtattaaacaatatcgaaaagaaaaaggctactcactatctgaactagctgaaaaggctggggtagcgaagtcttatttaagttcaatagaaagaaacttgcaaacaaacccctccattcaatttctagaaaaagtctccgctgttctggacgtctcggttcataccctgctcgatgagaaagatgaaaccgaatacgatggtcaattagatagtgaatgggaaaatctagttcgtgacgctatggcatcaggggtttctaaaaaacaatttcgagaatttttagattatcaaaagtggaagaaaagacaggaaaaggagtaa

SEQ ID NO: 2528 - DNA, 795 bp, Bacillus licheniformis
atgggtacaaagaaaaaactaggattaggcgttgcgtctgctgcgcttggactggcattagtaggaggaggaacttgggctgcgtttaacgacatcgaaacaactcaagcaacttatgcagcaggtacgcttgacttaaatgcgaaagatacatctgcaagagtgaacttgtccaacttaaaaccaggcgacaaattcactaaagatttcgagttcaaaaatgacggatcacttgcgattaaagaagtgctgatgcaggttggctacagcaatttcgttgacggaaacgcgaaaaacggcggaaaaagcacagcggaagacttcctgaaacaatttaaagtcagcgttctgactgtcggagttgaaggcggtaacggctatcctaaaaacatcattttagatgaagccaacctttatgatctgtacaatatgtccgcgaaaaaagataagaacgcatatgaaaaagtgaagaaagccattgagccagagttcctgcatgacaatggcaaaatcaatgtagcgacaatcaacggaaaaactgcgcctgaatacgacggcattccgaaagacccatatgactttgataaagttcaattggtgattgagtttgtaaatgacaaaacaacagacgccagcggcagaatggtacagaacaaatatcaaggtgattctgtacagcttgacttctcattcgaagctactcaatggaacggcttgacaatcgacggcaaaaaacatgccgatgaaaaaggttatgtgaaagagaacgaaagagcgcacagtgaagataaataa

SEQ ID NO: 2529 - DNA, 585 bp, Bacillus licheniformis
atgaaacatgtgatgaaatggatcagcaatttcttatatgtgattattttcacaatcatcatcgccgcggtcatcgtcgtgatttcgacaaagtcgtccggcggggagccgcagctcttcggctatcaattgaaaacggttttatccggatcgatggagccggagtttaaaacaggttctgtgattgccgttcaaaaagttgaaaatcccgggtctttgaaaaagggagatatcattacattcatgcaagacgaaaacaccatggttacccaccgaattatcggtataacaaaaaataaatcaaatctcatgttcaagacaaagggtgacaataaccaaaaccctgattccgatccggtactggcggaaaatgttgtcgctaagtattcgggcattacggttccgtatgccgggtatttgctggactttgcaagtaaaccgatcggcacagccattttgctgatcgtgccgggactcttgttgattctttatgcagtaattactgtatccgcggctttaagagagattgaccaaaaagctaaagcaattgaagccgctggaaaagatcaatcagtttccatgtaa

SEQ ID NO: 2530 - DNA, 729 bp, Bacillus licheniformis
atgttccgattatctcgaactaggagatgccgaaaaagagccggaaaaaacattatcgtttttcaaacgctgctgatcatatacctgttaattggattggggagtcagctgtcacagcatacaaacgcatcatttcatgatgtggaaacatacagcatgacaatgaaagcggcctcaacttttcctcaagatgagaagcagtgggacgggagcgatttgaagcttcaaaagcagacgaagacgaaaggaacggtctgtgcaccgctgacattgtttgcagaatataaaaaccgcggcagtcaaatcgccgactctgaatggaagtgggagcttcataaactcggtcattccaaaaagccgctagaggacgggactgtgatcgataaaggcgtgttcaaaaaagaagccgaaagcagcatctaccggatagagtcaaagcgggcagcaaaaggagggctatacgcttttaaattgatcagacctgaaggccatccagatgttaaaaagggcaaacctttcatttggtcaaatgtaatggagcttcaagactgcaatgaagaaacaccgaagcctcctaaaaaagcttcagcaaaaccaaagcaaactgaacagactcaaacaacgcaaaagtctgaacaggatatagaggaaacaccaaaggacagtgaatccgtagataaagaaaatagaaaagaagataattcattagaaagcggggaagcgtcatga

SEQ ID NO: 2531 - DNA, 321 bp, Bacillus licheniformis
gtgctgaaaaatgtcatattatgttcttttttactgctttctagcattgggccgctcaatgcccatgcggcagcttacgaaacagcccgcatgtctaagtgggaagaaaaagcggttgaggaagcaaaaaagagatatccggaagcagaagtgcgcctcacgaaaaaagtatgggatcgaaagcgggccgatgaagcggtcaaacaataccatgtcacattgagtgaaggaaataaaaatttcggagtgtttgtcacaatttcatttgaacctgcgacacacaaaattaacaaagtcgtcgttgtggaagaatataaataa

SEQ ID NO: 2532 - DNA, 183 bp, Bacillus licheniformis
atgaaaacgaacgattatgttaaatatatgacggaacagctcgtaaaatatatggacacgcctaagcaggaaagaaaagaaatgaaagaaaaacgtaaagaattaaagccgccgtccaggatatatcaatggttcggcattcttccccttggctgtatcatgttttttaaaaagcataaataa

SEQ ID NO: 2533 - DNA, 366 bp, Bacillus licheniformis
gtgaaaaattcaaaaggattcatttatcccgctgctgttttcgcagctgtgatttgcatgctctgcgcgagtcactcagccgctttattaacgaatcagcgaacgtttgcacagcaaacaaaagaatttcacattcagcaaaaccttctccaaaatggaattctccatgccttgtcccatattcacgaagagacaaaagaaaaagttcaaaaacagcatggcttgatatcgtattctgtcagcccggctcatcagcagctcacacgagtccagattcaggtaacgacagcttccggcacagaaacaagcgctcaatttcaatatgatttaagaaatcaaaaaatcacgcagtggaaggaatattaa

SEQ ID NO: 2534 - DNA, 489 bp, Bacillus licheniformis
atgattatgaagtatgcatctctattaaaaaaagagacagccaaaggcactgtttcaccattttgcgggcaaaggggatatacccttcttaatataatgttttccttaatggtgcacatgttcgttgcaggtacgatggcctcgatatttcatctgtttttatccccggaaagaaacggttcggatattcacccccgtgaatggacgattactgccgagcaaatattgaaggagtctaggaattcgattgacataagaagtgccggtgatcatcagtcactagcgatgacaaaccgccaaggtgacaccgttcgctatgagcaatatcagacagttattcgaaaaagggtcaatggaaaaggtcatgtgcctctattacagcatgtcaaaaaaatgaggtttatgattgaaaatcacctgctgatccttgaagcgacaagtctaagcggcaaatcataccgcacgtctattccgctctatcatatgtaa

SEQ ID NO: 2535 - DNA, 348 bp, Bacillus licheniformis
atgttcaaaaaaaataaaggctttacaacggttgaagctgtttccgcattcggcatatgggtaatgatcaccatgttattgatccctatgcttcatcagctgtcattgcagcgcgaagcgtccgaaaaagaagaagagacatatcgcatattggaggaaaagatcagccgctacacgctgaccggacggttccaggctaaagaagctgtgctttaccggaatacatcttactttattgaatggaaggagaagggagatgattatgaagtatgcatctctattaaaaaaagagacagccaaaggcactgtttcaccattttgcgggcaaaggggatatacccttcttaa

SEQ ID NO: 2536 - DNA, 438 bp, Bacillus licheniformis
atgaatcaaaaaggatttacgcttttggaaagtttaactgtattgatgatcggttctattatgttctctcttctctttgctctactgcctcccatttatgaaaaaagaatcgttcagcactttgtctcacagcttgaagaggatttgctttacgctcagcagacggctctcgtccgccatacgacggttaaggtgcagtttgactttgccggctgccgctatatcatgaagcattcggacgaaggctcatcgcctgaactggtcaggacatacagctgcaatatcgcaatcaaaaagtcgacgctcaaaccaattcttacttttaatccaagcggtgttccgaatcaagggggaaagatcgtgatcgatacacagcatgcctcttttatactgacgatctatttaggaagcggaaagattaatgttcaaaaaaaataa

SEQ ID NO: 2537 - DNA, 294 bp, Bacillus licheniformis
gtgaatgaaaagggatttacactgatagaaatgttagtcgtcatgctcgttatctccatcctgctgttgatcaccattccgaatgtgaccaagcataaccaaagcatccaaaagaaaggatgcgaaggattaatcaatatggttcaagcgcagatcacggcctatcagatggatcatgacgggaaaacgccgaacagggcggagcttgaatctgaaggttacataaaaaagaacttaaagtgtccgaatgggaaagcaattaaaatttcaaacggcaaagcacaggctgattga

SEQ ID NO: 2538 - DNA, 1035 bp, Bacillus licheniformis
atgaagattaaaatgaagtggcctgtccgggaacaggcggaccttctgaaaaaactaggagacatgatgcagagtggctatacgattttggatgctttaagtatgctgaaattgcaattgaatgaaagacgaagagcggatctgacatttgcgatggagaagctgacagaagggtgtcctgtgtttcaagttcttgaaatgatttcctttcacaaggatgctgtcaccattgtttactttgccgaacagcacgggaatttgccatttgcctttaggcagagcggagagctgcttcaccgcaagatcgctcaaagcgaaaaattaaagaaagccgccagataccccttgtttttagttttaacggtctgcgtcatcatctctattatgaaatcagcaatagttccgcaattttccgccatctatgaatcgatgaacgttgaaacgtcttttgcaacgactctcatcttttatgttttcgatcacttttatctttttttcgcgggactgccgctggttgccgcagctctatccctctattatctgtgttcattccgccataaacctccagaagacaaaatggcctttctcattacaattcccttgctgggccaaaccttcaaactattcaacagctattttttatcgctccagctgagcaatcttttgcaagcgggtctgtctgtatatgacagtttaaaagcatttgaaagccagccgtttttacgatttcataaaaatgaagcgaagcgcttgatcgagcggctgaaacagggggagagtctggagcagatgctggccggacatccgttttatgaaaatgatttagcaaaggctgttgcacacggccaactaaatgggcacttatacagagagctgtattcatatagtcagtttttgattgagcggcttgaaagaaaggccgaaaaatggacaggcctgatccagccattgatttacgggctaaccgcggcgatgatattaattctttatttgtccatgcttttgccaatgtatcaaatgatgaaccagctataa

SEQ ID NO: 2539 - DNA, 1065 bp, Bacillus licheniformis
ttgtacacgatcgaatcattaagcggaagattaattgacgaggcatatagaatgaaggcgtcagacattcatattgttcccggtgaaaaagaggcggtggtacgcttcaggattgatgacgaactgtttcaaaaagacggattaacgagaaatgagtgctctagactcatttctcactttaaatttctttcttcgatggacattggcgagagacggctgccgcaaagcggggctttaactctttatatcaaccgtgagcccgttcatttaaggatgtccactctgcccaccatccatgatgaaagcttggtcatcaggcttcttcccaagatgagcagcaagccgctcacaaagctctcattgttcccgagtgcaacattcaagctgctgtcttttctgaagcattcccacggattaatgcttttcaccggcccgacaggctcgggaaaaacgacaacactctattctttaattgactacgccaagcggcattttaagcgaaatatcattacgttggaagacccggtcgaatcaagaagcgaaaacattttgcaagtacaagtgaacgaaaaagcgggcatgacttattctgcggggttgaaggcggtgctgcgccacgatccggacatgatcatcctaggggaaattcgcgatgccgaaacagcccaaatcgcagtcagggcagctttgacgggacaccttgttctatcgagcatgcatgcgaaaaatgctaaaggtgcgatatacaggctgctcgagctcggcgttgatatgacagaaattgaacaaacattggtcgcagtcagcgcccagcgtcttgtcgatatcgtctgtccgttttgcggcgacagctgcactttgtattgcagattgtcgagaccagttagaagagcaagcgtctttgaacttttgtacggaaaaagccttaatctctgcatcgaagaagcaaaaggcagatgcggtggcatcaaaacagacaccttaaaaatgctgatccgcaagggaatagcactcggatatctgccgtcgaaaacttatgaacgctggataggccatgaagattaa

SEQ ID NO: 2540 - DNA, 840 bp, Bacillus licheniformis
atggaaaacaagcatgcagccctttatgagtatctggtcaaacaggcggacagaatcacagatgaatggctgtcccgaacagcgtctgaaaaagaaaaaacggcacagcaatacaaggactttatactggctgtttcaaaggtatttgccaaagatgaacaggcgctatgctggaataaagcttccgggtgcgccaaggaaattgcctacgacagggctgtcagccaaattccggttaccgaaagcataaatggttttaaagtgtgccgtgaacttttaatagatgagatcgagcaattttcagatgaacatgcaccagacagttcgaaaaaagatttttttatctggaataaacagcttcacttaatgatggatgaggtcatagagcagtttattcttgaatatgagcatacgacaaagagccaattgaaggcgcagaccgagatgattcgcgaactgagcgcaccggtcataccggtatcagagcacatcggtgtgctgccgctcattggtgaaattgatactcacagggcaacggtgatcattgaatctgcgctcacgcagtgtgctgagcttcatctctcgcatctttttattgatatttccggtgttcctgttgtcgatacgatggtcgcccatcagttgttcaaagtcgtagacagcacaaagctgcttggcgttgaaacggttctttcgggtttgagaccggagattgcccaaacagttgtgaagctcggcatggatttttcacatattaaaacagaacagagtcttgctaaggcgctttgcaataaaggcttctgcatccatgaagacggcaaggccgaagagcaggtttaa

SEQ ID NO: 2541 - DNA, 378 bp, Bacillus licheniformis
atggaagagctgaccttttattcatacccgagctgcacatcatgccgaaaaacgaaacattggctgaaagcgaaccaggttgattttacagaacggcatcttttcagggaaacgccgaaccaggatgaattgaaacatattttgtctctcacgaccgaaggaatcgatgaaatattggcgacaagaagccaggcatttaaagagttaaatcttgatattgaagaattaacggtaagcgaagtgctggaattgttaattcaaaagccaaagctgctgagacgcccgattatcgtaaacggcgataagctggtcgtcggatacaatcccggcgaactcttaaaattaaaaaaacacaccttacaccgttctgtttcctga

SEQ ID NO: 2542 - DNA, 246 bp, Bacillus licheniformis
atgaatcgcatgttccgtgtgttaggtttctggacaggtatctttgcggtcatgttttatttaggaaatatgaaagatgcatcactgctgttcttcggtcaaactgtattttttgtgttcttatcgtatctcaacttgaccgagcggatgtacatttatattttcggtgcttacttgacaatcttttttgccgcatttacatattattctgtgttcattatggttcccggacagggaggccattaa

SEQ ID NO: 2543 - DNA, 639 bp, Bacillus licheniformis
atgaaatggagaagaatgcctttagggcctatccagacgaacgcttatattttatccaatgatgacggcacctgcttaatatttgatccaggcagcgaatcagggaagctgaatgcatacataaaagaaaacgggctgaaacctcttgccgtattgctcactcacgctcattttgatcatatcggagctgtggacaatgtcagaaaagaatggaacattcctgtatacgtgcataaaaatgaagctgaatggctgactgatccttcattaaacggttcagcgctgcttacagggcagacgatcacagcagaaaaagcagatcatctgatcgaagaagagggagaccttaaaatcggcccttttacgctccgcatgctctttacgcctgggcattctccgggcagcgtctcgtattatgccgaagaggaaaacctgatcgtttccggcgatgttttgtttaaaggagggatcgggcgtacagacctgccggggggcaatcaaaaggtgctgatggacagtattcatcaaaaactgctgacacttccggaagagacgcttgtgttaagcgggcacggccccgagacggacattgcaacagaacaggaacaaaacccgttcatcaacggatttactttgtaa

SEQ ID NO: 2544 - DNA, 219 bp, Bacillus licheniformis
ttggaaatatactgcaggggatccaagcgaagggggtttatattgatgttgctcgtgatcattttcggtctagtcacgatattatctgctcttggggttcttcgttctcttaaacaaatcaacgttcttggcatcttgttcggcggggcggcttttttagtgttcggatggtttaccgtcatgacaattattaacagcgggtatccgacagtccactaa

SEQ ID NO: 2545 - DNA, 315 bp, Bacillus licheniformis
gtggccatagcagacgtcaccatcataccgatcggtaccgagactccgagcgtaagcgcgtatgtagcggagattcaaaccattttggaaggatttaaaaaagagggcaaaatcaattatcagctgacaccgatgaatactttgattgaaggggaactaagcgatttatttcaggtgattcagacgattcacgaagcgcctttccaaaaaggcatccacagagtagcgacaaatatcaggattgacgaccgccgtgataagaaaacgacgatggagggcaagcttgcaagcgttcagcgtcatttcagtcaataa

SEQ ID NO: 2546 - DNA, 1101 bp, Bacillus licheniformis
ttgagagtttcattattgattattgccgctctgatggccgtggctgcggctggttgcacgccgcagcatcaagaaggatcaaaaagcgttcatcatgaggagccggaagggaaaagagaaagcggtgcagcagtaaaagataaaaaagtgatagcgctgaaggaccggcactttgatgagacggcaggatggcttgataatgaaaccgttatatacaccgcaaccgatccggtcggaggaagtgaaatcaaatcatatgatatatttaaagggacgggcaaaacgatctacaagacagatgacaggctgatagcgtcggaagtcaacagtgaaaaaggcatgattcttatccaaaccgccggaaacggctctgaaatgaagttaactttgcttaatttacaggggaaacagctgtttgcaaaaaaatttcgcacgcatgagttgcaagtggactggaatcgattcgatccttctcttttatatgtcacaacattcacgaaagactggaattatgaatcaagcctaattgatgcaaaagaagagcaaacggaaaaaaacatcgcacaggccgcctttattcattggacttccgccgacacttttgaatatatcaaatggaatgaacgggaccgggaaaagccggctcctgtttattcctacagcacagcggacggacgggaaaagaagctcgcaggcgatgccgtacttctcgatattgtaggcgatatgcggctcatcgtaacgccttcatccgatcagcgccagggcacctacatattttcagacgtttcttcatcggaaaagaaaatctctttcaagttgccgctgttctcggaatatggcagcctgtcaccgatggaatacggttatgaccctcggcatgagctgttttatacgtatcagccaaatgagtcgggctccttgtatgatctgatttccgtcaacctcaaatcaggcaagcgggaagtcattcgtgaaaaagtggaaatgcttccgattaccttatctcctgacggggattatgcattgtacggctatactcaggatcaaatcatttcactcaactcaaaaacagcagcgccccttgtgaccaaagaatag

SEQ ID NO: 2547 - DNA, 1125 bp, Bacillus licheniformis
atggcattcatcaacatcaaaccggagttaaagcagaatatggaaagactgtctgacattctgaacatacccgaaccgcttttaatcagtgcaaatgcaaatgtatccgcggacgaactttattttccgggagtatcttttcatgcaggaaaaaacgttcaagcagcagaaacatatgaacagctgcaattattggcgaatcaatacacgtttgaagatgaacagtggctgacaaaaacagccgtttacgattcagcagaactgaaaaaggaaattggcagattgacggaatgctttccgtttgttacttcccgtatcatcggccgctcaagcatgggccagcctatatatgaactgctccttggagctgaaaatgccggaaaaagaacgcatatgaatgcctcttttcatgccaatgaatggatcaccacttctgttttgatgaaatggctcaaagaatactgttatcatttatgtacaggccagaccgctttaggtttttcgccgctcgatattttttcatcaacaaagctttccgtcgtgccgatcgttaatcccgacggtgttgaccttgtacttaacggccccggtcatcttgggatcgcgagagaagcgctggatgagatgaacgagcatcagccggatttccgggaatggaaagccaatataaacggagtggatttaaataatcagtttccgtctttctgggagatcgaaaaacaaagaaaaccgcctaaatccccttcctacagagactaccccggagatgaaccgctgacagaaccggaagcggcagcgatgagggatttaatcgcaaacgagccgcctgaccggcttgtggcgcttcacacacagggggaggaaatttattggggatacaagggattggagcctcctgaatcagctgatgtgatccaaacatttgagcgcctgagcggttataagggcgtcagatatatagacagctatgcaggatttagagattggtttattcattattacggaagagaaggatatactgttgaacttggcaaaggaaaaaatcctttaccgctgaaacaatttgacgatatatattgtaaaagcagaggaatactttgggcatcctgtttttttgaaagctga

SEQ ID NO: 2548 - DNA, 948 bp, Bacillus licheniformis
gtgaatattaaaggtaagacgatcgcggcagcgtgttttgtactattattgatcgcagcattgacagcatgcggcaatcaaacagagagcaaagattcttcttctaaatcaaaaagcgaagaaacgattacatacaaggctgaaaacggaacggttaaagtgccgaagcatccgaagcgggtggttgtcatggctgacgattatttcggctatttcaagacactcggtctcaatgtagtgggcgcccctgacagggttttcaagaatccttatttcaaggggaaaaccgatggtgtgacaaacataggtgaaggaaattctgctgaaaaggttattcaattaaaaccggacttgattgtcgtatggacgacccaaggcgctgatatcgaaaagctggaaaaaatcgctccgacggtcgcgttgaaatatgacagtctgaatagcactgaacggctgaaggatttcgcaaaaatgacaggcactgaagatcaagcggagaaatggctggctgaatgggacaaaaaagttgcggcggccaaatcaaaagttcaaaaagctgtcgggaacaaaacggtttccattatgcaaactaacggtaaagaaatctttgtattcggcgatcaattcggaaggggaggaagcattgtttaccaagatctcggcttaaaggcgacaaagctgacaaaggaaaaagcaatcgacgaaggcccgggctacacgagcatttccttagaaaagctgcctgatttcgctggagattatatatttataggaccttgggaatcaagcggagacgacagcgccgtgcttaatacatccatttggaagaaccttggggcggtcaaaaaccaacatgtctataaaatcgaccctgtcggcttctatttttccgatccgatttcattagagggccagctcgaatttattacagaaaacttaacaaaatag

SEQ ID NO: 2549 - DNA, 1899 bp, Bacillus licheniformis
atgcgaaagtcatttttttcaaaaatttcgtttttgttaatcgcgacattgctgatgtggctgaaaacgtatgtcgtctacaaaacaagcttcaacattaaaattgaaaacttcatgcaagagtttatattgttcatcaatcctttaagctttttgctgtttatattcggaatcggcctgttttttaaagaaaaaaacagaaaccggtttattatcggggcaagcatcgtcctgacgtttgtcttgcttgccaacatgattttctaccgtttttacaacgactttttaaccattcctgttttgttccagacgaataatatgggcgatttgggaagcagcatcaactctttgtttatgccggccgatttgcttctcatcgttgatattgccattttaatttggctgtacaagcgccagcctgccaaaacaggcggaaaggcgacaagaaaggagcgcgcggcttactatctatttgtcgctgccgttttcttttttaatttagggatttctgaaacagaaagaccgcagcttttgacaagatcgtttgatagggaagttcttgtgaaaaacatcagcctttacaacttccatatctatgacgggctgatccagtcgaagcagtctgcgcagcgtgcgctggccgacagcaacagcctcacggagattgaaaactatgtcaacgcaaaccgcacggacaccaacaaggatctggccgggatcgccaaaggacggaatgtgatcctcgtttctctggaatccacccaaagctttgtcgtaaaccaaaagttaaacggcaaagagattacgccgtatttaaatgacctgattaagaaaagctacagcttcgagaatttctatcatcagacaggccaaggcaaaacggctgattccgaattcattgtcgacaactctctctaccctcttggaaggggagcggtcttctttacaaatgcaggaaacgaatatacggcaatgcctgaaatattgaagaaccacggctactattcctcgattttccatgcgaacaacaaaagcttctggaatcgggatattatgtacgaaacgtttaaatacgataagttttacgatatcaaatcctatgatgtaaacgaagaaaattcagttggatggggattgaaagataaggaatttttcgaacaaacatcagagctgatgaaagaaatgcctcagcctttttatacccgtctgatcacgctgacaaaccattttccgtttgagcttgatgaggaagataaactgatcaatgaattcgattcaaaaagccgtacgttaaacagatatttcccgaccgtccgctatcaggatgaagcgcttaaacgtttcattgaaaagctgaaagaagacggcctctacgataattctgttatcgttttatacggtgaccattacgggatttccgaaaaccataacgaagcgatgagccaattcctcggcagagaagtaaccccttttgaggaagtgcagcttcaaagagtcccgcttgtgatccacattccgggagtgacggataaagagccgaaaaccattgacacggtcggcggccaaatcgacattcgaccgactatactgaatcttctcggaatcgattcaagcgatcagatccagtttggaaacgacctgtttgccaaagacaaaacggagttcacagtgctccgcgacggcagctttattacgaaagacaaagtatacacagacggcatatgctatgataaatcgacaggcgagccgtctaaagataaaaaaggctgtgagccgtacattgaaaaagccaaacaggagctttcatactcagatcaaatcatttacggcgacttgctgaggttttatgacagcgagcgcttaaaaaagcaatctgactccaagccaaaagacgagtaa

SEQ ID NO: 2550 - DNA, 975 bp, Bacillus licheniformis
atgaatgacagctggctggtcggggtcgaccttggaggaacaacagtaaaactcgcttttgtaagcgcttatggcgaaatcctgcacaagtgggaaatcccgaccgataaatcagggaaaacggttacggtaagcatcgcgaaagccatcgacagcaaattgaacgagctcggcaaaccgaagcacatcttaaaatggatcggcatgggcgctcccggacccgtcaatacggagaccggcatcgtttataaaacgacgaatatgggctgggaaaactacccgttgaaagaccatctggaagcagagacagggatagctgcggtcattgaaaatgacgcgaacatcgcagctctcggcgaaatgtggaagggagcgggagacggcgcgaaggatttgattcttgttacattgggaacgggcgttggaggcggcattattgtaaacggggaaatcgtccgcgggcaaaacggagcaggcggtgaaatcggccacatctgttctgttccagaaggcggagcgccgtgcaactgcggaaaaagcggctgtatcgaaacgatcgcttcggctaccggcatcgtcaggattgccaaagaaaaaatagaatctgaccatcgagatacaagcttgcgtgaatgtctggacataacggcgcgcgacatctttgaagccgccagaaaaaacgatcctgttgccggcgaagtcgtcgattatgtggcgggtcatttaggaatggtcctcgctaacttggcgagctcgcttaatccttcaaagatcgtaatcggcggaggcgtgtcaaaagcgggagaaatcctgcgctccaaagttgaacaatctttcaagcgctttgtattcccgcgggccggcgaggcggctgagatcgtaatcgcttcacttggaaacgacgcaggcgtgatcggcggtgcatggatcgcaaaaaaccaatggctgaaaagccaggcgcagcctgttttataa

SEQ ID NO: 2551 - DNA, 198 bp, Bacillus licheniformis
atgaaaacagcctatgatgtacagcttttgctgaagcagtttggatgttatgtttactttggagatcgcgagcttgaacttgaatacatgatggacgaactgaaggaaatgtttctttcaaatttgatagaaaaagaacaatgggttcaaggtgtttcaattttgcagaatgaactcacaaatataaagagaaaataa

SEQ ID NO: 2552 - DNA, 1455 bp, Bacillus licheniformis
atgaaaaaaaagcatgcggtccaaaaaaatttagcgaaaaatgttgaatatttaaatgaaaagcttggtgtcgacaaaagcttcgacatgatccggcttgatgtcgtttatgctgatagagacatgtcgctttatcttgtcgacggctttgtaaaagatgatattatgcatcatttgcttaaaaatctctcaaggctcacacctgaaaatctggaagacgatccgcttgaaaagctgatcaaaacgcatatcccatacatcgaaattgatacggaagatgacctcgacaaagcagccgaccaggtgctgtccgggccggctgtcctccttgctgacggagttgaccatgcgattattatcgatgcgcggacgtatccggcaagaaatccggaggaacccgacaatgaacgcgttgtcaggggttcaagagacggcttcgtcgaaacgatcgtgtttaacaccgcactgacgagacgaagaatccgcgaccgttccctcagaatggagttcctgcaggtcggcagaagaagcaaaacggatgtcgtcatctgttatttggaagatatcgccgacttggaaagtgtaaaaaagctgaaacaatcgcttgaagcgatcgacacggatgctttgacaatggcggaaaagacgctggaagaatacatcggcggccgtcattggaacccttatccgacggtccgctatacagaaagacctgatactgcggccgttcatttgtacgaagggcacattctcgtctttgtggacggctcgccaagcgcgctgattacccctgttactttttggcaccatctgcagcatgccgaagagtacagaaacaaacctcttgcgggtgcttatttgcgaatagtccgttttatatctgtcttggcatcgatctttttgctgccgctgtggtttctgctttccgtccatcccgatcttttgccggacgcccttgaatatatagggcctgaaaaaaaaggagcccttccgctgcttgcgcaattcatcattattgaaatcggcgtcgacatgatgcggatggctgcaatccacaccccgtcgtctcttgctacggctctcggactcgtagctgctttaatgatcggcgaagtggcggtgcaggtcgggcttttctcgcatgaagtcgtcttgtatctcgctgtcgcagccatcggcacgtttgctacgccgagctatgagctgagcatagcgaacaggcttgcaagaatcgttctcctgatcgccgcaggtgcattcggaccgatcggctttgtcattgcgatattctgctgggtgatttatctcgtcagaatgaagtcgtttcatgtgccgtatttatggccgtttattccttttgactacagagccttccgcgatatcgcaattcgcacgccgatgccgctgaaaaacagaagacccgtatttttggatccccaggatcccgaccgctga

SEQ ID NO: 2553 - DNA, 1539 bp, Bacillus licheniformis
atgtattcaatcgattatttgtattggaatttcatcgggaaccttttagacagggattttgagcttgtgcaggcacctgcttcattcggagaagcctggcttgaagcgagggggagcgcgccgtatgatttggttcgcgttttccggaaggatatcgacttcagacaggatctcgtccgcgacctggaatctctttatgaaagggcggagcgcctgagagcagcatcaggtcagcgaaagctctcgatattgaatgtctatttgtcgcaggaagcgcctgtagatgagtgggaagatgttgtcggtcatccggtcgcagataagcggatcagcatcgtgccggtttttattgatcacgcttcggctgaagaaggattacgcaaactcgccgtggctttaaacatggagccggatgagctgacaggccaaatgcaggatgccggatacgaaaatgtggaagagaagagagccgaagtattggcagcggctaaagcaagagaagaagaaaggcggcgggaagcggctgtatttgagaaaggcaaaccgatgtttacctggattttcgcagtgcttcaagtcttcatgtttctgcttctggaaatgtcgggcggcagccagaataccgaaacgctcgtccggttcggggcgaaggaaaacagcctcctgttagccggggaatggtggcggctagtcacgccgatcgttcttcatatcggattggtccatctcatgtttaatacatttgcattattgtctgttggagccgcagcagaaagggtgtttggatcattccgctttcttgtcatatacatatcagccgggatttttggatcgatcggcagctttctgttcagtccgtatccgtctgcaggggcttcgggagccatcttcggttgcttgggagcccttttgtacctggctttttcaaaccggaaagcttttttaaaaacgatcggaacaaatatcattgtgatcatcattctgaacctcggcctcggtttcaccatttcaaatgttgacaatgctggccatatcggcggattgatcggcggtctcctgacggccttggcggtcggaatccccggaaaaaaaaggccgctccagcggctggcaggctgggtcctcatctttgtcatcggaggaggggccctgtactttgggacacattcggctccggtgcaggaaaatgccatgctgcatcaggcggcgaaatggtatgaagagggagagtatgaaaaagtaaaggatgctttgaaggaagcgggctcaaaaccggacgcttccagcgacactttaaggctgctcgcttattccgaaattcggctcggcgagtatgaaaacgccgagaaaaggtttgaggccgtcgttgaaaaagatccatcggaccacgcctctctctatagtcttgcctggctttatacccaaagaggcgagcttgccaaagccgagcagtccattgaaagagcgttggcagaaaagcctgatgaagagatgtataaaaagcttcgggacgaaataaagaaagaaagcgcccggtaa

SEQ ID NO: 2554 - DNA, 174 bp, Bacillus licheniformis
atgagaaaagttacgtttattgtagtaggcgtcattgcagcccttgtattttttcaaaaccgttatcgtgttatcaatttcattcttggtcaaaaccaaatccgccactatttcatccatttgatgatgagaattccgttttttcgcaataagtttatccagcaggcattctga

SEQ ID NO: 2555 - DNA, 573 bp, Bacillus licheniformis
gtgaagcgttctttacgaagcgaggtcagaaagaggctggctaacatgccggaacaggagtttcacctaaaggcggaagcgattcaccggaagcttttccaatcaaaacagtggaaaaaagcgtctgttattgcccttacggtatccagaaatcgcgaagtaccgacaaaaccgattatcgaacaggcccggcttgaaggaaaaacggtgtgcattccgaaatgtatgcctgaaacaaaaaagatgcactttcgcagctatcaggatgaaagcgatcttgaagtcgtgtattttggcctgcaggaaccgatcgtacacaaaaccgagcggatggaacccgaagacatcgacttcatccttgtgccgggaatttgctatgaccggagaggatacagaatcggctatggaggcggctattatgacagatacctggccggctttacaaaagataccgcgtcgcttgccttcgagtgccaagtgatcggtcatgttccaaatgagccgcacgacatcccggtcaagcaggttttgaccgaagacgccgtttacaactgcctcgacactgctgaataa

SEQ ID NO: 2556 - DNA, 150 bp, Bacillus licheniformis
atgcgcgttaatattactttagcttgcactgaatgcggcgagcgtaactatatttctacaaagaacaagcgtaacaatccagatcgcgttgaattcaaaaagtattgcccacgtgacaaaaaatcaacattacaccgcgaaacaaagtaa

SEQ ID NO: 2557 - DNA, 1113 bp, Bacillus licheniformis
ttgatcaacgtattgctgctgtcgctggaaaatcccctttcatcgaagagcggagcggggcgctatgtgaaaagccaccttgaactattgcggaacgaagtcagctttaccgtctgcacgacggctgccgggcaaaacagcaatggatgggaaacgctggagattccgcttgatttaaaagcgttcgcttcttttgaagaggcggtagccgccatgaattttcagatgatcaaaatcgtgctggagcatagaggacaatttgatttcgtccatgcaaacgatggtgtcaccgcgcctgccgccgtttatctcagcgaggtgctggcggtgccgctgatttccacggtgcacggccttgaaagcggccgaaaaaaggcagcagacggatatgtccacccatacagggcaatcctcgaacggcttctggctgaaaaaagcgatcaaatcctcgtgctgagcagcatgatgaagtcagacatgcaaaaggcgttttcgctttcttttgagcaaatccgggtcattccacatccgcgcataaaaagccgcacggtgaaaaaacgaatgaaaagcgcgccctactttttttcctacggaagatttgttccggaaaaagggtttatcgaattgctgcacgtctttcagaagctacgcagccggcgtcctgatcttgaacttgtcattgccggggaagggccgcttcaaagcgggatcgagaccatagcaaaagaattgggcattaaggacagtgtgaccattcttcctttcctttgtgaagaggaaagagagagctggctggcattttgtgaaatggctgtttttccaagttcttatgagccgttcggcattgctgttcaagaaagcatggccgccggcgctgccgtcgctgccggaatcaacgggggctggaacgatttcgttatcgatcgggtgaccggctttcgaattgattttagtgatccgcataaggctgcaaatgcgctcgcagaaattgtcggcaataaggagcagctgctcaaggtcggacaaacggcaaaggcttatatatttgatttgcatgatcctggatatgtaaaaaatatgtttttgcatcatgtatatcatacgtctttttaa

SEQ ID NO: 2558 - DNA, 498 bp, Bacillus licheniformis
gtgaaaaggacaatcatcgggaaaaaaccttttcaacatagtattcgaggcgattcttcgttttgtaacgatattttaaaaataacttcgccggatcatgaaaccgttcggctgagctgggaaatctcagaggctgcgctttcagcggctgaagcggtgctgtttgaaaatattagagacgtcgaaaagcaaatccttcttttttgcgtaaaaaacggagagcgcagcgcacggacgatccataccggtgcatttaaaggggaggcctcggttttccccgctgcaggaaacgctttctacaaagcggaataccggatatacaattcgctcaacatgtcactggccgttctctcatccgactgcttctaccttggggaaaacggaatccattcaaacagcagctgttttcagcatcaagacaatcagcaggattggacgactcaattttccgcatatacgagatattctttaatagaaggaaaggagcggccccgttga

SEQ ID NO: 2559 - DNA, 366 bp, Bacillus licheniformis
ttgaaggtgatgaacgtggaaattgctatcattgcgctgctcgttgtcagtattgcgctgattgcattctcatattttcaaagagaaccgatcaaggaagttgaacaggagttggaaacccttcagctgtccgccatgcaggaaatctataaactgaaaaagaagatgaccgtgcttgaggaagagctcctcgattcaaatgtggtcgtccgcagaccgaatgccggaatcagccagcatattgcgaagcagattctttcaaaatatcaaaacggcatgtctgtagacgccatcgcaaaagctgagcacgtatctgtcgaagatgtcaaagcgatcattaaagacaatgagagggtgcttgtatga

SEQ ID NO: 2560 - DNA, 480 bp, Bacillus licheniformis
atgaccagacaaagtgtacaagcatttgccggaggaatgattttggctaccgccgttcttgcaggcgcattttatttgacggataacggaaaagctgaagcttccaaggaggctcaaaacatcagcgaagccgatgtcaaaacctatttaaaggacaatcagcaggtttcgctgaaacgcgaggaataccaacagctgctccactataaagagaccgcgctgaagcaggatgctgcgtctcaaaacaaaaaagagcaggatgatgcgaaaaaaggttccaagtacaagcttgaaatcaaaagcggcatgagcacggctgagatagcagacctccttgcaaaaggaaaagtaatttcttccgccgatgacttcaaagattatgtgaaaaagaccggaaacgaatctaaaatccgcgcaggtaaatacgaactgaagcgcggtgacagcttgaaaaacatcgtcaaaacgctgtccaaataa

SEQ ID NO: 2561 - DNA, 780 bp, Bacillus licheniformis
atgagcgctgtaacagctgtaaagccagaagatgtataccagatcaacgacttgaatttatggtacggcgaacatcacgcattaaagaacattaacttgacaatacccgagtacgaaattaccgccatcattggaccgtcagggtgcggaaagtcgacattcattaaaacgctgaatctcatgatcaatatggttccgaatgtcaaaatgaccggagagatcagctacaacggaacgaacgtactcaacagcaaagtcgaccttgtcgagttacggaaaaaagtcggcatggtgtttcaaaaaggaaacccgtttccccagtcgatctttgataatgtcgcatacggaccaagaatccatggattgaaaaacaaaaaagaactgaatgagagagtggaaaaggcgcttgtggatgtagcgctgtgggatgaagtgaaagaccgtcttcattcccaggcgctcggactttccggggggcagcagcagcgcctctgcatcgcaagggcgctggccaccaatcctgacgttctcttgatggatgaaccgacatccgcccttgatcccgtttcaactttgaaaatcgaagagctgatgctcaagctgaaagagaaatatacaattgccatcgtcacgcacaacatgcagcaggcctcgagaatttccgatcaaacggcgtttttcctgatgggcgagctgattgagtgcaatgatacggtcaaaatgttttcaagtcctgacgatcatcggacgaaagattatataacaggccggttcggatga

SEQ ID NO: 2562 - DNA, 828 bp, Bacillus licheniformis
atggctcaggttcagatgccggttttggaaaccgtgcgcgacaatatcggaatcgctccgttccctgaagcgaaagagcatattttagaagtgaaaaatttaaatatttactatggagaaaagcgggccgtcaacgacatttccatgcgtattgacaaacatgcggtcacggctttgatcggtccgtcaggctgcggaaaatcgacttttttaagaagcatcaaccggatgaacgatctgattccatcagccagaacatccggagaaatacggtatgaagggcttaacatccttgattccaatatcaatgtcgtcaatctgagaagggagatcggcatggtatttcagaagccgaacccctttccaaaatcgatttacagcaacattacccacgcattaaaatatgcgggcgaacggcggaaatccgtgcttgatgagatcgtggaagaaagcttgacgaaagccgcgctgtgggatgaagtgaaagacaggctgcatgagtcggctctttcgctgtcaggcgggcagcagcagcgtctctgcatcgcccggacgctcgcgatgaagcccgaagtcctgctcttggatgagcctgcttcagcgctcgacccgatttcaaacgcgaaaatagaggaattaatcgtcggtttaaaagaggaatactcgatcatcattgtcacgcataacatgcagcaagcttcaagaatttccgatcaaacggcgtttttccttaacggagatttaatcgaatacgatcgtacggaaaagatttttatgaatccttcagaaaaaaagacagaggattacatcaacggcagatttggataa

SEQ ID NO: 2563 - DNA, 888 bp, Bacillus licheniformis
atgaacagcaaagtaacagatcgtttagcaaccggtgtttttggattgattgctgcggtaatcgccgctattcttgtcggtttgttcgcttatatcatcatcaatggtgtttcgcatatcagcctcagctttttaacttcgcgttcaagtgcgctgtcaagcggcggaggaattcgagatcagctgttcaactcgttttatattctcgtgctgacgatgctgatcacggttcccctgggagtcggcgggggaatttatatggcggaatatgcgcccgcaaacaaattgaccgattttatccgtgtctgtattgaagttttgtcatcccttccttcgatcgttatggggatgttcggcatgctgatgtttgtaaatctgaccggatgggggtacagcattatcggaggagcgcttgctttgacgattttcaacctgcctgtcatggtcagggtgacagaagatgcgatccgctccgtacctaaggagcaaaaagaggcttcccttgctttaggcgtgtccaaatggcacacgattaaaacggtattgattcctggcgcggtgccgtccatcatcacaggcgcgattcttgcgtcgggccgtgtatttggcgaagctgccgctttgctgtttacagccggactaaccacgccgagactgaattttgccgattggaatccgttttctgagacatcgccgctcaatattttcagaccggctgaaacgctggccgttcatatttggaatgtaaacacacaggggatcatccccgatgctgaagcgatcgcaaacggcgcatccgccgttctcgttctgtccgtcttgatctttaacctggcagcccgatggctcggctcttttattcataaaaagttaacggcaaacaaataa

SEQ ID NO: 2564 - DNA, 930 bp, Bacillus licheniformis
atggttcaaaaaatagagaaactgtccgcgaaagagcggctgatcagctccaagcataatcgcaaaatggatgaaatccgcgggaggattttggttgcgtcgtgcgcctttatcatgatggcggcagcgatttcgatcacaatttttctcggaaataaggggttgcaatcttttctggccaatggtgtaagtccaattgagttcttaaccagtctagattggaatccaacgaacgaaaaccctgaatacggagcacttccgtttatactcggatcttttgcagtgacccttcttgcatctttgattgctgcaccgctaggaataggaggtgcgattttcatgacggaaatcgcgccatcatggggcagaaaagtgctgcagccggttgtcgaattgcttgttggcattccttccgtcgtttatggattcataggccttacagtgttagtgccgttcatttcacagtttaagtcaagcggatcgggccacagccttctggcgggaacgatcgtcctggctgtcatgattttgccgacggtcacttcgatttcaacggatgcgctcatgtcgctgccgaaaaatctccgcgaaggatcatacgcattaggcgcaacccgctggcagacgatccgcaaagtgctgataccggcagcgctgccttcgcttctgacagccgtcgtcttgggaatggcgagggcgttcggcgaagcgctggccgtgcagatggtcatcggaaattcccgaaatctgtttgagagccttttagaccctgcggggacattgacaacgatcattacgttgaacatgggccatacaacatacgggagcgtggaaaacaatacgctctggtcaatggggcttgtccttctgatcatgtcgttcttgttcatcctgctcatccgctatctgtcatccaggaggaaactgtaa

SEQ ID NO: 2565 - DNA, 918 bp, Bacillus licheniformis
gtgaaaccatttaaaaaaatcacactgatgttcatcatgtccgttttagttgtcttcgcagcagcttgtggaagcagcagtacaaacaacaatgcagacgaaggcaaacaaagcgataaaacagagaataaggcttcaggttctttgacgatttcgggttcttcggcgatgcagcctcttgtcttagcagcggctgaaaaattcatggatgaaaatcctgatgccgatattcaagttcaggctggaggttctggtacaggcctttcccaagtggctgaaggcacagtccaaatcggaaactccgatgtctttgccgaagaaaaagaaggcattcctgccaaagaacttaccgatcatcaagttgcggttgtcggaatggcagctgccgttaaccctgaagtaggcatcgatgacatttcgttagaagatctcaaaaaggtattcacaggtaaaatcaaaaactggaaagaactaggcgggaaagatcaaaagatcacccttgtcaaccgtcctgattcttcaggaacccgcgcgacttttgtcaaatatgcacttgatggagagactccagctgaaggaatcacggaagattcttcaaacacagtgaaaaagttaatcgctgaaacgcctggtgcaatcggatatcttgcgttctcgtatatcaaggatgatactgtcactccgctttcaatcgacggcgttaagccgacagccgaaaatgtacaaaaaggcaaattcccgatctgggcttaccagcattcttatacgaaaggcgaacctgaaggcttggcgaaagaattcctcgactatttgatgagcgatgacattcaaaaatccatcgtgacggagcagggctacattccagtaacagacatggaagtaaaacgcgacgcggatggaaagcaaactgataaataa

SEQ ID NO: 2566 - DNA, 2118 bp, Bacillus licheniformis
atgaacaaaaaaatgaaaaatgaaaaacgcaaatcgctccccatcaggttgaacatattgttccttctcgcttttattattttcaccatcgtcgtcgtgcgcctcggcatggtgcagatcgtctttggcgaagactatacgaacgaagtgcagaagcaggaagaagtcgatgtctcgacaagcgttccgcgggggaaaatatatgaccggaacttgaatacgatcgtgaaaaataaaccgatgaatgccattacatacacaaggacatcatcgacctctcaggaggacaggctcaaaatagcaaaaaaacttgcagaaatgatcaaaatcgatacagataaaataacggagcgcgataaaaaggactactggattttaacgcgcccgaaagaagccgagaagctcatcaccgatgaggaccggaaaaaagtcaaggacggcaagctgaaggaagacgatttataccagctgcagcttgacaggatcacggaagataaactgaatgaattgacagatcaagatttgaaagtcttggcaatcaagcgtcagatggattctggatacgcgctgactccgcagtatattaaaaacaaaggtgtaactgcaaaagaaatggcggttgtcagcgaacacctggacgagctcccgggagtcgatgtgacgtctgattggaagcgggattatccttataacggtctgctcagaacgatgatcggcagcatatccgattcaaatgaagggcttccgaaaagcctgcttgatcattatttgtcgctcggctacaaccggaatgaccgcgtcggaaaaagctacctcgaagccgaatatgaaaatgtgcttcagggacagaaagagaaagtgaaaaatattaccaataaatcaggggatatcgtcgatacggaagtcatttccgaggggaaaagcggaaaggatttagtcttgacgattgatgttgatatgcaaaaagcgattgaaaaaattgtcgaggatgaactgaagtctgccaaagccaagcatagcgctccgcttctcgaccgcgcattcgtcgttatgatggatccgcgaaacggggaagtgttatcgattgccggcaaacagcttaaaaacgaaagcggcaaattaaaggttgacgactatgcgctcggcgcgatgacgtcttcttatgcgatgggctcggctgtcaaaggggccactgttttaacaggtctgcagacgggagccattaatttaaatacgacttttcttgatgaaccgctctatatcggaaaaggaaaaccgaaaaaatcttgggcgagcaacttgggaacactgggtatccagggagctcttgaaaagtcttcaaacgtgttcatgtttaaaacggcgatcgcccttggtaaaggccaatataaggcgcatcagccgctcgaccttcaaacaaaagcatttgatacattcaggtattatttcagccagttcggcctcggcgtcaaaaccggaatcgatctgccaaatgaagcttcaggctacaaaggatctcaaagactgcccggtttcctgcttgacttttccatcggacagtatgacacatacacaccgctgcagctggctcagtacgtgtcaacgattgccaatgggggataccgcatgaagccgcagcttgtgaaagagatcagagagcccgattcgaaaaaaggaatcggagccgttacacagtctgtgcagcctgaagtattgaacaaagtggacatgagcgatgaatatataaaagaagtccagaaaggattcaggcgcgtaatgacaaaaggtacggcagcgggacagtttgcctctgcttcatataaaccagctggaaaaacaggaacggcccagtctttctatgacggaccggacaaatcgaaaacgggaacatcgacatacaatacaacgcttgttgcctacgcaccttacgataatccggaagtcgctatttccgtcgtcgttccttgggtttataatgactatggccagagatattcgatcacaaacgaaatcggccgaaaagtgcttgataagtattttgaactgaaatcaaaacaatcaaaagaaaatactgtcgaaaaaaataaagacaaaatcgaaaaagaagctacagaatag

SEQ ID NO: 2567 - DNA, 1287 bp, Bacillus licheniformis
atgagcagaatcaaaaacataataggcgatgtggaattaaacagggacctcctgctgctgcttgcagtcggcggcctttattctcttagcattgccctttccaatacgtttgtgaatgtatatctgtggaagcagtccggacagtttgtcgatttggccatttataatttgtcgatcgtcgtgatgcagccgattatctttatgttcgccggccgccttgccaaaaaaatcgacagggtttttatactcaggtttggcgtttcgtttttagctgtattttatttaactgtgctgttggcgggggaaaatgcgggatcacggctggtgctgctcggaagtgtgctcggaattggctacggattttattggcttgcgtttaatgtcctgacatttgaaatcactgagccggacacgagagatttttttaacgggttcctcggcattttaaattccggcgcgggaatgatcggtccgattgttgccggctatgtcatttcaaggcttgccgacaacacgggatacacggtgattttcagcctgtccttggctttattttcagtggccgtcattacgagcttttttttaaaaaggcgtgaatcgcgcggccgctacattttgaaaaaaatctggacggaacgaaattcagacccgaattggcgcagcattacaaatgctcatttttttcaggggctgagagaagggattttcgtttttttaatcaatgtctttgtctttatcacgacaaagagcgagttggcattggggaagttcggcttgattaattcagctgtttctttttttgcatactatttcgcaacgcggcttattaaaaagggagcgcgcaaaaaggcgattttaatgggcggtctcgtcctgttcggcgctctctttctgattttgtttcatatgacgtatgtgacgcttttgctgtatgctgttgcgattgcgatcggctatccgattttgctcgtaccgtattcatcgctcacatatgatgtgatcggtaaagcgaggtatgcccggaaagcgcggatcgaatacattgtcgtcagagaagtttttttaaacatcggacggattgtctcgattttggtttttttgctgctcgtgtcgcttctgaaggaggacttgggcattccggtttctctcgttttgctgggggcaggccacacgctgatctactatttcgtcaaagatatccgtctgacagagcccgcccgcgaaacggtcggaaaagatgcgcataaacaaacagctgaaccgaattatttagaaggaaaaaggtaa

SEQ ID NO: 2568 - DNA, 609 bp, Bacillus licheniformis
atggcttacaaacttccagaattaccttatgcttacgatgcgttagaacctcacatcgacaaagagacgatgaatattcaccatacgaagcaccataacacatatgttacaaaattgaacgaagcggtggcaggcaaacaggatcttgaaagcaaatctgttgaagagcttgttgcaaaccttgatgcagtaccggaaaacatccgtacagctgtccgcaacaatggcggagggcatgccaaccactcattgttctggaaacttctttctccaaacggaggaggcgctccaactggtgaattggcagaagccatcaacagcaaattcggcagcttcgatcaattcaaagaagactttgcggctgcagcagcaggccgtttcggctccggctgggcatggcttgttgtcaataacggagagcttgaaatcacaagcacgccaaaccaagattctcctctttcagaaggcaagactcctatcttaggtcttgatgtatgggagcacgcatactacctgaattatcaaaaccgccgtccagattacattaaagcattctggaacgtcgttaactgggatgaagttgcacgcctttacagcgaagcaaaataa

SEQ ID NO: 2569 - DNA, 483 bp, Bacillus licheniformis
atggatgttttgtattggatcatcattgcggcaatgttcgtcattgctttcatcggccttgtctatcccattattccgagcgtcgttttcatcgtagccggctttgttctatacggatttttatttacattcgggcattactcctacctattttggatcattgaaggcatttttacagccgtattgtttgccgccgactatattacaaatctcctcggcattaagcgctttggcggcagcagggcagcgatatggggcagcacgatcggccttctggccggaccgtttgtgataccggtggcgggcattattttgggtccgtttatcggggccttggcgggtgaggtgattgtccatcagaaggatttaaaaacggcggccagaatcggaatcggttcattgatcgggtttatttcaggcgtttttgcgaaaagcgtgattcagctgataatgatcggctactttttatatactgtgctctaa

SEQ ID NO: 2570 - DNA, 702 bp, Bacillus licheniformis
atgcgtttccaaggcataggaaaaacgattttatacgtatttttgctcagcgtgatcgccgctctcccgaacctttaccatatcagcagcggagtggtgaatacgatgaacagctttcagtcagctgtgaaagaattccccgctttctccataaaagacggcacactgcaaacagatgcaaagaaagcgattgaatcacagtcattcggatttgtcatcgtttttgatccgagcggctcttatgaaacaaaacagatcgaagacaaacgcaattccgtcggcatcctgaaagataagttcgtcatcgccattgacggccaagtccaggaaatgccgtacacaatgcttcccgaggacatgtctaaggatgatattctttctttagttgatcaaaataaagcggtgattgttcccgtcttgtgcgttctgctgttcctggcgacggcagccggaaaattcattgatgtctcggttctcgccgtcatcgggctgatcattcgcaacgggcagaagaaaatgctctcctataagcagctttgggtaatgtctgcttattccatcaccctcgcaaccgtgttttttgcaattatggacgcgctggaggcggtggttccaagtcagttcctcctgaactggtttgtgaactttatcatgctgtttctcgccattaaagaaacgccggcttctaaagcagcgaggtaa

SEQ ID NO: 2571 - DNA, 312 bp, Bacillus licheniformis
atgaaacgtgtcattgtgctgttttcgattttgctcgccctgttcattgtttattatgacttgaaatcaggcaccatccctcaaaacgccttaccggcttcaaccatggcagcggaagctccggctgcaagcctgcaatataagtccgttacggtaaagcccggacaaacggtattttcaatcatcgggaacagcgccgttccggctgacaaaatagccgaagattttgaagagttgaatccgaatgttgaggcgggccgcattcaagcaggtgtcacctacaagtttcccgtttatcctgataagcgttaa

SEQ ID NO: 2572 - DNA, 1113 bp, Bacillus licheniformis
gtgagtgaaatcacacatcgtacaaaaacgcgtcccgttaaagtgggacctttaacaataggcggcaataacgaagtcgtcattcaaagcatgacaacaacgaaaacacatgacgttgaagcaaccgtcgccgaaatcaacagactcgcggaagcaggatgtcaaatcgtccgcgtcgcctgtcctgatgaacgggctgccgacgccattccagagatcaaaaagcggatatccatccctcttgtcgtggatattcatttcaactataaattggcattaaaagcgatcgaaggcggagccgataaaatccgcatcaatccgggtaacatcggccgccgcgaaaaggttgaagcggtcgtcaacgcagcgaaggaaaagggcattccgatccggatcggcgtcaatgcaggctctctggaaaaacgaatccttgagaagtacggctatccgacagcagacggcatggtcgaaagcgccctgcaccacattaaaattcttgaggatctcgatttccacgatatcatcgtcagcatgaaggcgtctgatgtaaacctggcgattgaggcatatgaaaaagcggctaaagctttcgattatccgcttcatttaggcatcaccgaatcgggaacgctgtttgccggtacagtgaaaagcgccgcgggtctcggcgcgatcctttcaaaaggaatcggcaatacattgcggatttctttaagcgcggacccggtcgaagaagtaaaagtcgccagggagctcctgaaatctttcgggctcgcttccaatgcggcaacattgatttcctgcccgacttgcggccggatcgaaatcgatttgatcagcattgccaatgaagtcgaagattacatcgcgaaaatcaaggcgccgatcaaagttgccgttctcggctgtgccgtcaacggtcccggagaagcgcgcgaagccgatatcgggatcgccggcgcacgcggcgaaggacttctgttccgcaaaggcgaaatcgtccggaaagtgcctgaagaaacgatggtcgaggaattgaaaaaggaaatcgacaagctcgccgaagagcattatgccaaacaagcggcagaaaaagaaaaattaaacacataa

SEQ ID NO: 2573 - DNA, 372 bp, Bacillus licheniformis
atggaaagagatcaaaatgttcgcgatcgtaaccgagcaggttatgatgctgacttagtcgatgcgactttagataatgatgaatttttagaagaaacagcagcagaagttgccccgacctatcgtacggataacggggacaacggcgaagcgcgtaacgatgccgatgctgccggcggacgtgtaaccggatatattgcgcttgcgctttcgattatttccttgtttatgcttccagtgctgttaggaattgcagggatcattgtcggttatatagccagaagacaaggagcagctggcttaggagcatgggcaatgggtatcggtgcagtttccttggtgcttggcatattcatcaccccgtttttctaa

SEQ ID NO: 2574 - DNA, 585 bp, Bacillus licheniformis
atgttacatttaggaatcgatattgatggaacgatcactgcccaggatacttttgttccctatttgaacgagtcgttcagcctctccattacattggaagatattaaggaatatgacctgacaaagctgctgaatatatctcaagaagatttttggaaatggatgaacgaaaacgagccccgcatctatcaggaagcattgctggctcaatatgccaaacagacgctggatgagctgaaaaagcagcataagctgatatatattacagcaagaagacatcacctggaggatatcacctatgactggttcgagaaacgcgacattcattatgaccatatagaacttgtcggcggtcacgataaattggaagccgtcttcagacatgagatcgatgttttctttgaagaccaccacgggaatgcaaccatgatcgcaaaagaagcaggcattcctgttctgttgtttaatacgccgtacaatcagcttccgaccgattcaaacatcgtcagagtcgacagctggcttgaagccgccgaatggctgaaaaagaacgagaaaacgcttaaagccgcaaaaagcatgtaa

SEQ ID NO: 2575 - DNA, 432 bp, Bacillus licheniformis
gtgaacgtacaggaagcgcttgatttactgaaggaaaaaggatataaatatacaagcaaacgggaggatatgcttcagctgtttagtgattcagataaatatttaacggcgaaaaatgtcctttccgctttaaatgatgattatccggggctaagctttgatacaatctacaggaatttgtcgctgtttgaagaactcggcattttggaaacgactgagctttccggtgaaaagctgttccgttttaaatgttcttctgctcaccaccaccaccattttatttgcatggtgtgcggcaaaacgaaagaaattgagctatgtccgatggaaaagctgacagacgatcttgacggctatcagatcagcggccataagtttgaaatttacggaacctgcccgcgctgtgaagaagaaagcacggaagcgcagtaa

SEQ ID NO: 2576 - DNA, 861 bp, Bacillus licheniformis
atgctgacacctttttttcattatgagtttttgcaaaacgcttttatttcaggaatattaatcggcctcatcgcgcccttgctcggcgtattcatcgttgtcaggcggctgtcgctgatcgcagatgcgctcagccacgtctctttagccggcatagcagcgagcctgtatgcaggcaaacagtttgcagtgctcgcaggagtcagcccgatctatttcggaatggcgttttccgttgccggctctttaatcatcgagaggctgagaacggtttataaacattaccaggagctggcgatcccgattatcatgtcggggggaatcggcatttccgttatttttatttcgcttgcggacggattcaatacggatctgttcagctatttattcggcagcgtcagcgctgtttcacgggaagacatgctggtgatcgtcggcatttccgcagccgttttgatcgtggtgttttccctttttaaagagctgtttcttctgtcgtttgatgaagagcatgcaaaagcttcagggatttccgcaaagtggattcattttatttttattttgatcgttgcgcttgttatcgccgcctcaatgagaatcgtcggtacgcttctcgtttcagcgctgatgacgctccctgtcgctgcgagcatgcgcattgccaaaggatttaagcaggcgattttcttatcgatcctgttcggtgaactttccgtcatcgtcggccttgtgcttgcctatcatctcgatcttgcaccggggggaacgatcgtgatgctgtcgatctttatcctgatactgtgcatcagttataataaagtcaaaaggaggattcgccgtgaacgtacaggaagcgcttga

SEQ ID NO: 2577 - DNA, 702 bp, Bacillus licheniformis
ttgcaaattgaagaagggacttttctcggcctggttggtccaaacggatcgggaaagacgacattgctgaaatgcattttggggctgattaagccgcagacaggcgaacttaaactgtttggcgttcctctcagaaaatttaaggactggagcaaaatcggcttcgtatcccaaaaagcaaacagctttaacaccggttttcccgcttctgtttatgaagtggtggcaagcggtttaaccgcaaagctcggcttattcagacgcatgtccaaagccgataagcagaaggtggatgaagcgatcgaagctgtcggcatcacgtccctgaaagacagaaacatcggcgagctttcgggaggacagcagcagagaactttcatcgcgagagcgctggtgagcgaaccgaagctgctcattcttgacgagccgacggttggagtcgatcaaaaaacagttgaagggttttacaagctgctggagaaattgaatcgtgaaaaaggcattacgctcattcttgtcacccatgatgtcggcacggtttccgataaagtcacacacgttgcctgcatgaataagcatcttcattttcacggcaatacagaagagtttgagtccatgacagatcaagacttgtctcaattttacgggcatgatgttcaagccatcagccacaatcaccatcatcatggaggacacgaataa

SEQ ID NO: 2578 - DNA, 885 bp, Bacillus licheniformis
atggcaaagactcaaaaacagcataaaaaagaatcagcggtcaaaaaagcgtttaggatcgtcatgattcttatcggggctgcctgtgctgccgccagcatcgaattatttctagtgccgaataacatcatcgacgggggcattatcggcatttcattaatattggactacctctttaaagataacccgtatatcaacttcgctctgctcgtcgtcgttctcaacatcccgtttatgttttcaggctacaaacacatcggaaaaacgttcttaatttcaacactaatcggaatcgtcagcttgtcaattattgaaacactgttgcatcatgtagaaggggttacgactcagcccgtcctggcagccgtattcggcggtcttctgctcggattcggcgtagggcttgttattcgtaacggcggttctatggatggaactgagatactcggcattttgcttacgaaaaagctgccgttttctgtcggcgaatttgtcatgttcgtcaatgtctttatttttgcatgggcgagctttgtgtttggccttgagcaggctatgttttcggttatgacatattatattgcgatgaagacgattgatgccgtcattcaagggcttgaagagacgaaagcggtcatcatcgtttcagatcaatacgaggagatttccgattcgctgctgcatcgcctcggccggggaacgaccaagctcaaagggaaaggcggctattccgacgaggacacagaagtgatttatgccgttgtgaccaggcttgaagtgacgaagctgaaatcgattgtcttcgatattgatcacaatgcttttataacgattatggacacgcacgaaacgcgcggaggaaagtttaaaaacgccatccattag

SEQ ID NO: 2579 - DNA, 255 bp, Bacillus licheniformis
gtgattttatttcaaaagatcgtgctgcagcgtttaaatcaggtcacggctgacgaggtgctgaagtacgctaaacaatacggaattcaagtaacaagaaaacaggcgcttgaagtggaaaagcttgtgaaaggaaaaaacatcaatatttttaatgaagaagaacgcaataaactgctcaagcaagtggaagcggtcacttcaaaagaagcggtgcagctattgaaccagctgtttgctcaatacgtatcataa

SEQ ID NO: 2580 - DNA, 894 bp, Bacillus licheniformis
ttgttgaaaatcggttcacacgtctcaatgagcggaaaacatatgctgcttgcggccagtcaggaggcaagctcctacggcgccaatacatttatgatctatacgggagcgccgcagaacacgcgcaggaaaaaaatcgaggatttgaatattgaagcgggaagggctcacatggaagagaacggcatctctgatatcgtcgttcatgccccgtatattatcaatattgccaatacaacgaatccggccacatttgagctcggtgtcgagttcttgcgttctgaaattgaaaggacgtcggcgatcggcgccagacaaatcgttcttcacccgggagctcatgtaggcgcaggcgcagaaacgggcattcaaaaaatcatcgaaggattgaacgaggtcatcgacccgaatcagaatgtgcagatcgctttggaaacgatggccgggaaaggttcagaatgcgggcggacgtttgaggagcttgcacagatcatcgacggcgttacacacaacgagcatttatccgtctgcttcgatacatgccatacccatgacgcgggttacgatgtagtatccgactttgacggtgtcttaaacgaattcgataaaattgtcggaatcgaccgtttaaaagtgcttcatattaatgacagcaagaatgtcagaggtgcgagaaaggaccgccacgaaaacatcggattcggagaaatcggttttgatgcgctccaatacatcgttcaccacgatcagctgaaagatattccgaaaatccttgaaacgccttatgtaggagaagataaaaagaacaaaaagccgccttaccggtttgaaattgaaatgctcaaaaataaacagtttgatgaagagctgcttgaaaaaatcaagcagcaataa

SEQ ID NO: 2581 - DNA, 1320 bp, Bacillus licheniformis
atgaaacaaacgaaatttgaaatgtacgatttaaagccgtttattatagaggctgttcaccacttgggattttatgagccgactgatattcaaaagcggttaatccctgcggcgctgaaaggggagagcgcgatcgggcagtcgcagacaggtacgggaaaaacgcacgcctatctgctcccgcttttaagcaggatcgatcctgaaaaggagttcgttcaagtcgtgattacggctccgacaagggagctggccaaccagattcatcaggaagttctgaaaatcaccaagtttttagggcctgatgaagcgattcgttcgaaatgtttcatcggcggtaccgataaacaaaaatcgattgacaaattaaaaacgcagccccatctggtggtaggtacgccggggcgaattgcagacctgatcagggagcaggcgctcgatgttcataaagccggttcgttcgttattgacgaggcggacttaatgcttgatatgggatttttggaagatgtcgattttatcgggtcgcatatgccggaaggcttgcagatgcttgtattttccgcaacgattcccgaaaaattaaagcctttcctgaaaaaatacatggccaatccgaggtatgcacatgttgagccgaagcacatcacggctgaaaaaatcgaacacgtgctgataccttccaggcacagggataaaaatgagctgctgctcgaggtcatgacccatttaaatccgtatttggcgattgttttcgccaatacaaaaacaacggccgacgagatcgccgcttatctgacggacaaagggatgaaagtcggacttctgcacggggggcttacgccgcgggaacgaaaaaaagtgatgaagcaaatcggcgatctggaattcacctatatcatagccactgatttggctgcaaggggaatcgatattaaaggcgtcagccatgtcattaactatgaactgcctgatgatcttgacttttacgttcaccgcgtcggccgtacagcgcgcgccggaacatccggaacagcggtgacgttttatgatacatctgatgaagatgcacttgtgaagcttgaacagatggggatcgtgtttgaaaacatgaggattgaaaaaggcgagtggaaaaagatcgatgaccgcaagcgccgtcagaaccgaaaaagaacgcctgatgaaacggatgaggtcgccaagcggcttgtgaaaaaaccgagaaaagtcaagcctggatataagaagaaaatgcagacggaaatccaaaaaataaaaagacagcaaaaaagaaagcaatttagaaaaggaaagtag

SEQ ID NO: 2582 - DNA, 648 bp, Bacillus licheniformis
atgtttcagcaacagccgatgagaaatcagccaagaccgcaggcgccgcaaaggcccggcagagccttgatgccgagacatccggggatgggaatgcagccccctcaagcgcagcagcgtggcctgcagcagatgtttcagccaatgggcgccgcccagcagcaagcaggcgcgcgaggaggagggattcaggggttgctctcgaaatttcttcccggatctgccgcatccgggggaacaggagcgggtctcggcggaaccggaagcggccttggaggcattcagggtctggccaatccgtctaccatttcaaatatgctcggcaatgttcaaaaagcgctcggcgtagcccagcaagtaacaccgatgattcagcaatacggaccgctcgtccgcaatctccccggaatggtgaaaatgttcagacagctgaattccgatgatacggaagcagaagacggcgaacaacaaaaagacgaaccggaacacaagaccgaaacgagcggcgaaaagaaagaagaaattaaagtgtcatccaaaaaacccgaaaaatccaaacccgaagaaatcagaaaaaaacagagccgttcagcccctccgtctgcaaaaagaaaaaccggaggatctaaacctaaactgtatatataa

SEQ ID NO: 2583 - DNA, 945 bp, Bacillus licheniformis
atgaacgtaattaaaatatcgccgcgcggctattgctacggtgtcgtcgacgccatggtcatcgcaaaaaacgcggctctcgataaaagtctgccgagacctatttatattttaggaatgatcgttcacaataaacatgtcacagacgcatttgaaaaagagggcatttatacgcttgacggcccgaataggctcgagattttgaatcaggtcgacaaaggaacggtgatcttcaccgctcacggcgtttcgcccgaagtccgcaaaatagctgaggataaaggtcttgtcgcgattgacgccacctgccctgatgtgacaaaaacacacgatttaatccggaaaatgaaagccgaaggctatcacgtcatctacatcggaaaaaaaggacacccggagcctgaaggagcggtcggcgtcgccccggatatcgttcatcttgttgaaaccgaagaagatgtggaaaggctggacattgaagcggagaaactgattgtcacgaaccaaacgacgatgtcccaatgggatgtccacgatattatggaaaaggtaaaagaaaaatatccggatgttgaattccaccaggagatttgcctggccacccaagtgcgtcaggaagcggtgtccgaacaagcgaaaaaagccgatttgacgatcgttgtcggcgatccgaaaagcaataactcaaaccgcctcgcccaggtctccgaagaaatcgcgggcacgaaagcataccggatcggtgatttaagcgaattaaagctggaatggcttgacggcgtagaaaccgtcgctgtaacggccggcgcatcgacaccgaccccgattacaaaggaagtcatccgctttttagagcaattcgatcatgaagatccgtccacatggaagatcagtcacgaagtaccgctgcataaaatcttgcctaaagtaaaagcaaaaacctga

SEQ ID NO: 2584 - DNA, 1122 bp, Bacillus licheniformis
atgacaaaaacgataaacgggcatgaaatcattcaattgtttgaacagttctcgcctaagtctttagccgttgaaggagataaaatcggcctgcaaatcggcacgctgaacaaaacggtggccaatgtcatggtcacgcttgatgttctcgaagaaacggttgatgaagcgatcgcaaagaacgttgatttaattattgcgcaccatccccctgttttcaggccgctgaaacatgtcatcacagatcagcccggcggaaggctgatcgaaaagtgcatcaagcatgatatcgcggtttatgcggctcatacgaatctcgatgtcgctgacggcggtgtcaacgacatgctagcggaagcgctggaattaaagaacacaaaagttctggttccaacctatgaagagccgctgaaaaaacttgccgtctatgtcccgaaagattatgaagaacaggtacgcacagctcttggagacgctggagccggccatatcggcgcctacagccactgtgcgttttctgcagaaggagtcggcagcttcaagccgctatctgaagctgatccgtttatcggcaagcggggcgagcttgaacgggtcgaagaggtaagaatcgagaccgtttatccggcgggtattgaaaaatccgtgatcaaagcgatgagtgaggcccatccgtatgaagaagtggcctttgatatttatccggtcgagcagaatccgcttcaaaaagggctgggccgcatcggtgaattgaatgaagagatgacactcgaagcgtttgcccgatatgtgaaggaaaagttggatgcgaacggagcgcggatggtgggcaagtctgatgcgaaagtgaaaaaggtcgccgtattaggcggtgacggcaacaaatacatccatcatgcaaaacgtatgggcgctgatgtatatgtcacgggagacctgtatttccatacggcgcacgacgccatgatgatcgggctgaatgtagttgaccccggccattatgctgaacaaatcatgaaaaacggggttgcaaaaaagctgacagcgatgtgccgggagaaaaaatttgatgtctcggtctttccatcggatacgaatacgaatccgtttacgtttgtataa

SEQ ID NO: 2585 - DNA, 714 bp, Bacillus licheniformis
gtgaatgaattgaagttatcgaaaaggctgcagactgtggcggaatacataacaaaaggggctgttgtggctgatatcgggtctgatcatgcgtatttgccttgctattgtgtgctgaatcgcctggcaagcgccgcgatcgccggagaaatcacagatggtccgtttctttctgcgaaacagcaggttgagaaactgcagttaagttcgctcatatccgtcaggaaaggagacgggcttgaagtgattgaaaagggcgaagccgatgtgatcacgattgccggaatgggtggctcgctcattgctcacattctaaaaacgggcaaggataagctctcaggtaaggagcgtttggttttacagccgaatatccacgctcaccatattagagagtggctctaccaggaaggctatgcactgatcaatgaagagatccttgaagaagacggcaagtactatgaggttctcgtggctgaagcgggcgatcgggatgcggcttacgatggggtttcctttgcggcaggcatgcttgtcggcccatttttggtcaaagaacaaaatgatgtttttatcaaaaaatggtcgcaggagctgaaacatacggaaaacatctatcgacaaattgaagcggctcctccgagtgaagaaaatcgacaaaaattgcttgagctgtcagaacggatagagatcttaaaggaggtacttagaagatga

SEQ ID NO: 2586 - DNA, 725 bp, Bacillus licheniformis
atgaacatcaacaatatacacgattttaatttaaaccaagaaaatgacttcttaacgatacaaacaaaactaaaaaaacatatcaatctagaaaaccccatcagtaaagacgctctgcaaacctgtgcgggggttgatttagcttattgggagaaagatggtgaagcatttggtgtctgcagcatcatcgtgctggattttcatacgaagcgtgtcattgaaaaagtacattgtgcagggaaaatcgccgtgccttatatcgcagggtttcttgcttttagggagctgccgcttattattaaggcagctaaaaagctgacgattgaaccggatgtttttttatttgacgggaatggctatctccatattaaccatattggattgcgacacatgctgcgttttttctcgaaaacccaacgatcggcattgcgaaaacttacttgaaaataaaacaaactgattttgtgatgcctgataataaattcggcgcttatacagatattgtgattgatggcgaagtctacggacgtgcggtgcggacaaggcaagatgtcaaaccgatatttctatcatgcggacatttgattgatttagacagcagttatgacatcgcgatgagcttaatcaatcgagaaagcaggctgccgattccggttcggctcgcggatcttgagacccatactttacgtggatattacagagagaatccaaaattgaccgagtag

SEQ ID NO: 2587 - DNA, 225 bp, Bacillus licheniformis
atgaatagtaatgatacggtaaccatgttgaatgaggaatttgagaatgatcagacaggtgaaaaggtcgaaggcattacgattatcgtagatggacaatttaaacaagttttagatatcattaaagccaaaagcgacagttaccagaattacactgaaatcatacgggacgccctttttgaaggtgtaaacagcatgacgatgaagctgagaaataaagaataa

SEQ ID NO: 2588 - DNA, 660 bp, Bacillus licheniformis
gtgaacgatttgtctaattccataaaatcattagaacctataaatataccgtgcggctggttcgttaaatataatgacttaaccgacacacatgaaaaagttgaaccaaataccaaattattagaattagaaaaacaaagatatcatgctgcggtcaaaatcattaaaggccaggatgaatatcttattcatatttatgacaatcatagagaaacgattgacacaatcaatgttgaagatcgcaggcagctagtaaaagagctggaacggatcatttggaaaatagaagcggcggcatttggagggaactttttcatttttgaagggcctcctgactatttacgtcttagaattcctcaaggatggaccgtctcttataataaactaattgatatcgatccagatcagttagaggaggacagtgatgactggtttaactttacgtcatcattactacagttggagcataaagaaagccgcttgattttagatgtcggctggtacgtggatattgagccttcaggcactttttatatgctattaattaagaatttggactgggaaaacccgttagaagacatggaaacgagaagaccggaaaaattagtggaccacatagaagccgcccttcaaaaagcagccgaacatcaatataaatag

SEQ ID NO: 2589 - DNA, 405 bp, Bacillus licheniformis
atgatcacgtataatggaccggttgaagaaccaattgaaaacccgaatgatgattttataagaagtattgtatttgaaaaaggcgaggattattggaagcaaggaagcggggattcatgttttgaagtagagggctgtgatgaatggttaattttcttttatgatgaaccatatgggttctttataatgagacatccagactacctcgttccaatgaataaaaatgttgaaatagaaacggtggaacatttagtaggtggggagccaatgaagattccgtcttgcagctatgtagatcgtggtttagcttaccgtataattaatgagtttactaccactaaatcaatgccgacttttatagaatgggtagatttgtatgaaatagactttgaccatggattttga

SEQ ID NO: 2590 - DNA, 372 bp, Bacillus licheniformis
ttgattgccaagcacaggggatacgattcttatatggaagacccttttttggatcatgaagtgaaaaacgcggatttgaaaggggcggaaattgtctcggggctcaagctggaaatagataaaatcaccgtaagcatcagtgctatcgttcattggacaattgtacgctggacgattatattgataaaatatctaaagagcaaacaactaggcaaaacaccatcgactaaaagtagaactcattttgatgtaaattcaactgtcatattagaatcgcaaaaggccactatatttttaagggaagtacagtgggtcccgctcaaaaagagtacacctaaaactcttaggacatgctcaactaactcatgctga

SEQ ID NO: 2591 - DNA, 510 bp, Bacillus licheniformis
atgaataatatatttttggacaatttgcaaaataaagttaaagtaggctttgttttaacagttgccgaaagagtattttctgtaatcagcaaagatgatgaaaggcatccggaaggaagagaagcattggacaaatgttggttatgggttgaatctcatgccgttactggtgatgacttatacgagctaattgataacgcagactttacaggaatttcagaatttgctgaggaagaagaagactcgaatattgccaggctgtggtcgctactagttgatgctgtcgcttatacttcttgggaagcttataaaaaagaaaaagtaaaacatttgccacaagcgttagagggtataaataaagatagcattaccatctttttaaatagtacggtggaaactggttttatcacatcgaaagaggttgaaaagataagaaagggcattgaggtttatcagagtgcaaaagaggagatccccacaaatagagaagcgtttataaagttattttaa

SEQ ID NO: 2592 - DNA, 336 bp, Bacillus licheniformis
gtgtgggagcatgttaagtcattagaaactgaaaatattgcagaaaagatatacgatttagatttagctactcagcaagatgaattatacgagtatttcggtgactatgaaaattactctgaacattttcttccgtttgattatgtagatattcatgaggagattgaaggagacctcacaatgtgtgctttaaatcggttggtcaatggaaaaacaaataatttttatgaaaaggtttttgagttatataaagaaggcggatggccttgcggttggaagggaacatatcctaaaggggaatttattgtgtttgtcccatctaacagcaatgaataa

SEQ ID NO: 2593 - DNA, 510 bp, Bacillus licheniformis
atgtttcaagaatgggaagaattgaatgatgatttaaaatctgcatattatttaggactttgtgaagcaatagttcctacattaaaacaatcaaatgatttcaattttataaaagaagcattagatgcctgctggaagtggcttgaacacaagaatatagaagcagacgatctttatacttacctggaaaatttagatgacacagggattttaactttaatgcagcttgaatcaaatgaagatgatctagatgcttggatatgtattgctgatgcaatatcttatacaatttacaaagcatataaatatcagaaagatgagtatttacctgaaaccatcgaatctattgattcttacgagttatttgaggaatttcatagtcactttagtttattatctaaaaatccaggtcaaaaagaaaaagcttttttgaagtttttgaaaaaagagggggagaaaaaaatttccagggagagcattcaagattttttacttaatagtgtagaataa

SEQ ID NO: 2594 - DNA, 2010 bp, Bacillus licheniformis
atgaaagtatttgaagcgcattctttaattgaagcagcgaataaccgcaagaaacaatacgaaacctttgaggatcaactgcaaacgctcaaaaaagcgtttctcggagtcgccgatttaggtgatgattttcaggggaaaggtgcggataacattaaagacttctacaagggacaggccgagatcgttgacagctggttaaagcttgttgaagcgcagattgctttttttaatggtgtatcaggtgacataaaagacaaaaagctgtccgattcttatgtggaagtctcttttttggatcatgaactgaaaaacgctgatttgaaagcgacggaaatcgtctcggggctcaagctggaaatggataaaatcatcgcaagcatcagcgatatcgttgatttggacaattggacgcttgacgattatattgataaaatgtctaaagcgcaaacaactcggcaaaacaccatcgacgctgtgaataaactggatgaatcgctcaagaccgaatacacaaacttacaagcgctcgacagcgccgtgctcggcaaatattccgggctgatggaagctacaagtcatggaaaaaccgcctcaccgatgtattttagcttgaaatcgttccactcaagcgagatctataaaaatacgatagaagtcgaaaatcaagccgccaattatattgaattcaaaaatgaacaggcagaagcgcgcaggcttcaagaaaaacaagaagaagaagcgaacaagccttgggatttaaaagcgcttgacgctgccggaacatttgtcggagaagtcagcgggtattatgattataagagagccgctgaaggcgtcgacccggtcacaggagaaaagctgacagacggccagcgtgtcgccgccggagcaatggcggcagcaggatttattccgatcgtagggtgggcaggccgagccttcaaaggcggaaaagccatttataaaacaggaaaaggactcatcgccgctgatcacgcgcttgacgcctacaaagcctcaaaaacgttgaacgtcttgaaaatgacggaaatgggcgcctacggccttgtcgcttcaaatgggttctcagaagccgtcacgggcaaggacatgtttggaaacaaagtttctgaagagaggcggaaacaaggcctgatcgaagccaccttgagcctcgtcggtgcaggtgctgtcgcaaaaacggcaaaccacggcgctcaaacattggccaaaacggccggcaaaaacattccgctcgccaaatcgccaaaagcagctctggtgcaaaaaggaaacaacatccttgaaaaggtgaaatccttccaagtcccgacaaacgtccgcgtctacgtcgaacagcctgcctccgcaacaggccaccgcatcggcaccccaattgtccgcgtgaatgttgaaaaaacgccggtgaaagagcttggaattgtgaagatggtgagtggtggggggaacgtcagtaagggagccaggactggtagtaaaatagatgttggaaaagctgatttaggtgttctgcgccaaaaatggaatgttcctaaaactgacactgttgcggttggaaagacagatgtggaaggtttggaaaatttagtatttgagggtggatcccctaaagttagaaaagaagccgggcttcccgatttagactcagtaatgccagatagacctataaaatctccaggaaaaatcgcaagtgcaacaagacatgctgaagaaggcgtgttaaatgattttataagcaaagtagaagctttaggaaaaaatcctgctgaaataacaggaacattaaaaattcaccaatctaatcctaaaggggtttgtccaacctgtattcaaggactaaataatccgaatgtaccagctggagtatttaagcaatttagcgagatgtttcctaatttgacgatagaagtaacttctgagactattcaaggaatcaagccaaacggaagattgaatttagttattaaaaatggtgaatatatttaa

SEQ ID NO: 2595 - DNA, 264 bp, Bacillus licheniformis
atgacgacaatcaagctgaaacatgaaacggtcatcaaaaagctggaggccgtaagagcggcgattgatgccctagacctgccaaaccctccgaaagctgcagggaaaaataaattgacatatacgacaaagtgccacgaacgcgagcagaacattcatcagatggtggccgattacaaaaaagccgtacacaaaaacataaaggatacgaaggaaaatgtcgatttgctgaaagagcaggacaaagcaatcgccagaaaatag

SEQ ID NO: 2596 - DNA, 444 bp, Bacillus licheniformis
gtgaatcaaatgagtcatgcgagcacattgaatcatatccacagcacgattaaccaaaagctggccgatgtagaaaggcggattgaacgagttaaaacagcaaaaaaggggattgagaaagaacacgaaaccgggattgtcgagatcaggcaaatcttgcaccctcatctgaacagccactggacaggggacttcgccaacgattttgatggcgaacgggatgaggctcatacatctatgtacaacatcgtgaacggaaagtacgaaggctatatttcccagctggagagaaaaatttttgcgctcgaagttgaaaagcacagccttgaattggcgggagcggcagctaaagaggcggatcatttgctttctctgggggaaaaagcggttgatcagttgagcgataaaatccgctcaatcaaaaacagttggagctggttttaa

SEQ ID NO: 2597 - DNA, 360 bp, Bacillus licheniformis
atgaaccgcaatccattgataccatttttgttaatcgccattatgggcataggactggtttttatcttatctataaaaggcctttatgacgcaaaagaaattgcaggcgaagggaataaaacagctcaagaagacaaagccgatgcttcgcctgaagaaatttacaaagcgaactgtgtaacctgccacggcgagaattatgaaggtgtgtcaggccctaaactgaaaggcgtcggggaccggatggatacaggtgcgattaaagaaaagattgaaaaaggcggcaacggaatgccgggaggactggtcccggcggaaaagcttgatgatatggccaaatgggtgtcagagattaaatag

SEQ ID NO: 2598 - DNA, 1122 bp, Bacillus licheniformis
atggctgataaacaagctcacgagaccgaaactgaattcacatttgaacaggtgagggatcaattaacagaagccggcaaaaagcgcggagtgctcacatatgaagaaattgcagagcgcatgtccagcttcgatatcgaatcagaccaaatggatgagtattatgaatttttaggagaacaaggcgttgaattaattagcgagaacgaagaaactgaggatcctaatattcaacagctggccaaggccgaagaagaatttgaccttaacgatttaagcgtgcctccgggcgttaagataaacgaccctgtccgcatgtacctgaaagaaatcggacgggtaaaccttttgtctgcaaaagaagaaatcgaatacgcaaaaaaaatcgaggaaggcgacgaagagtcgaagcgccgtctcgctgaagccaacttgagacttgtcgtcagcatcgcaaaacggtatgtcggccgcggaatgcttttccttgaccttattcaggaaggaaacatgggcctgatgaaggcggtggaaaagtttgactaccgcaaaggatataagttcagcacatacgcgacatggtggatcagacaggcgattacaagggcgattgccgaccaggcgagaacgatcaggattcctgttcatatggttgaaaccatcaacaagctgattcgtgttcaaaggcagctccttcaggatctcggccgcgagccaacgcctgaagagattgcggaagatatggatctgacgcctgagaaagtccgtgaaatcctaaagatcgcccaggaaccgttttcactcgagactccgatcggtgaagaggacgattcacatctgggagacttcattgaggatcaggaagcgacttctccatcagatcatgcagcatatgaattgctgaaagaacagcttgaagatgtgctggatacattgacagaccgtgaagaaaatgtgctccgccttcgcttcggccttgatgatggtcgtacaagaacattagaagaagttggtaaggtgttcggggtaacaagagaacgaattcgtcaaatagaagctaaagcacttcgtaaattaagacatccaagcagaagcaaacgcttgaaagattttctcgaataa

SEQ ID NO: 2599 - DNA, 1824 bp, Bacillus licheniformis
atgggcaatcgtataccagacgaaattgtagaacaggtgcagaaatcagctgatatcgtagaagttatcggagagtacgtccagttaagaaaacaggggcgtaattattttgggctttgtccttttcatggtgagaacacaccatctttttctgtttctggagaaaaacagatttttcattgttttggctgcggagcgggagggaacgttttttcatttttaagacaaatggaaggctattcatttaccgaggctgtctctcacctggcggacaaatatcaaatagatctgccggagcaggtcgcagctgtatcagcatacagcacaggcagttcggatgaacagaaaatggcggaagctcatgatctgttaaagaaattttatcatcatttgctcgtcaatacaaaggaaggccaggcagcgctcgattatttgcttgaaagaggctttaagatggagcagatcgagcagtttgaaatcggatgcgcgcttgactcgtgggatttcatcacgaagtttttggaacggagaggttttgatcttgcgctgatggaaagagctggactcatcatcagacgcgagaacggcgacggatattttgaccgtttcagaaacaggattatgtttccgattcatgatcatcacggcacaacggtcgctttttccggaaggacgttcaccggggagcagccaaaatacatgaacagcccggaaacgccgctttttcgaaaaagcaagcttctctatcatttccatcaggcccgccttcacattcggaaagaagaaagggccgtcctttttgaaggatttgccgatgtcatttcagccgtcacctccggtgtgaaagaatcgatcgccacgatgggtacatcgctgacggaagaacatgcgaagatcatcaggcgaaatgtcggagaggtcatactgtgctatgactcggatcatgccggttatgaagccacgctgaaagcggcggagattcttcagaaaaaaggctgcaacgtcaaggtggccatgatacctgacgggctggatcccgatgactacatcaaaaaattcggcagcgagaaattcaaaaatgatgtaataggggccagcgttacgatgatgacgtttaaaatgaactatttccgcaagggcagaaacctgtctgatgaaggagaccgtttagcctatatcaacgatgtactgaaggaagtcagccttctcagcggtcctttggaacaggaaatatacatcaaacagctggcaaatgaattttcaatctcatttgaatccttgaaggatcagctttccgtatttgaaaagcaggctgcaagccgcagcagggaaagcagccgccaggactctaaagagcggcaggcggccgtatcgcgcgcccctcggagaaagacggggcttcggccggctcatgagaatgcggagcggatgctcctggcccacatgattcatgaccgggacgtcattcgaaaggttttggaacgggtgggctttgaattcaaccttgatcagcaccgagcgattgccgcttatttgtacgccatgtatgaagaaggagcggacatttccatccaggagctctttaagagagtcgaggatcaggaacttggccagcttctgacagatatcttaatgcttcaggtgaacgaagaattaagtgaagcggaattatctgattatgtaaaaaaagtgttgaattatcgaaattggtcaatgataaaagaaaaagaagctgcaagggcggaagccgagaggcaaaaagactttatcaaagcggcgactttggcgcaggaaattgttaagttgaaccgttcgctgaaataa

SEQ ID NO: 2600 - DNA, 492 bp, Bacillus licheniformis
atggagggatggagaattagtcttcttgaaaaagaaaggacgatttttgtcgatgcagacgcatgcccggtgaaagatgaagtgctcaaaacagcggcggatttcgacgtaaaggtggtattcgtggcttcattcgagcattttcaaatcacaaggaaagaagaagagaattggacatatgtcgatccgcacaaagaagcagcggatctgtacattgccaaccatgttcgacctggtgatgtcgtcgtcacacaagatatcgggctggcatcgcttttgcttggcaaaaaggtctatgtgatgtcggagagaggctatcttttcgaagagaactccatcgatcatgctcttttccgccgtcacgtcgcacaaaaattgagaagaagcggacgttacacgaaaggcccgaaaaaactggtcaaggaagaccgggagcgatttgtcaaagagctgcaaaaaatcttgtcgaaaattgaaggatttacgtactaa

SEQ ID NO: 2601 - DNA, 813 bp, Bacillus licheniformis
atgagtaatcggacgatttatgttgtatcagactctgtcggcgagaccgctgagctcgtagtcaaagcggctatcagccagtttaacggttcatccgagcagacaaatatcaggcggattccttatgtcgaagaccgcggaacaataaaagaagtgatctcgctggcagaagcggacggcggcatcatctgttttacgcttgttgtcccggagattcgtgaatttttaatcgccgaagccgaaaaggcgaatgtcgtgtattacgatatcatcggcccgctgattgagaaaatggagtcggtctacggcttcagtgcgaaatatgagccgggcagagtccgacagctggacgaagattattttaagaaggtagaggccatcgaatttgcggttaaatatgacgacggcagagatccaaggggcatcttaaaagcggatatcgtgctgatcggcgtgtcgagaacgtccaaaactccgttatcccaatacttggcgcataaacggttaaaagtggcaaacgttccgatcgttcccgaggtggaccctcccgaagagctctttaccgttgatccggctaaatgcatcgggttaaaaatcagcccggataaactgaaccatatccgcaaggagcgcctgaaatcgctcggcctcaacgacaaagccatttacgctaatatcaaccgcatcaaagaagagcttgaattctttgaaaagatcgtcggccgcattggctgcaatgtcgtagacgtatcaaataaagcggtggaggaaacggccaacattattcacaacatgatgacaaaaagggtctaa

SEQ ID NO: 2602 - DNA, 693 bp, Bacillus licheniformis
atgttatcgacttttatacataacgaacgaattgtgagcttcggcttaaaggtggtgagtacgatcgaactaaataaacgtcaggagcatattttgcagattgtcaaagagaacgggccgattaccggagaacatatcgcggaaaagctgaatctgacgagggctacccttcgtccggatttggcaatattgacgatgtcgggatttttggaagcaaggccgcgggtcggttatttctacacgggaaagacgggcacgcagctcttggctgataagctgaaaaaactgcaggtgaaagacttccagtccattccggtggtcattcatgaaaatgtctccgtttatgatgcgatttgcacgatgtttttagaggacgtaggaacgctttttgtcgttgatgataatgccatcttagtcggtgtactttcacgaaaagacttgctcagagccagcatcggcaaacaggagctcccttcaatacccgtccatatcattatgacgagaatgccgaacattacgctttgcaggcgcgacgatttcattttggacattgccaagatgctcatcgaaaaacaaattgacgcactgcctgttgtaaaagatacagaaaaaggctatgaagttgtgggaagaattacgaaaacgaacatgacaaaaattttagtcggcttatctgaaaatgaaatcatgtag

SEQ ID NO: 2603 - DNA, 2040 bp, Bacillus licheniformis
atgagtaatcaagatttgcttttagaaatcggattagaagaaatgccggcgcgcttcatgcatgacagcatgactcagctgggtgagaagctggaaagctggctcaaggaaaaaaatattgccttcggttccgtcaagctgtataactcccctagaagactggccgttcttgtcgagaacgtggcggagaagcaggatgatgtgaaagaagaagcgaaaggaccggcaaagaaaatcgcccttgacgaaaacggcgaatggacaaaggcggccatcggcttttcacgggggcaaggagcaagtccggaagatttgtattttaaagacatcaaaggaacggaatatgtatttgtgcaaaaattccaaaaaggccaggatacgttttcattgcttcctgagctccgcgatttggtgacaagcctccactttccgaaaaacatgcgctggggcagcgaagatttaaaatatatcaggccgattaaatggatcgtcgcgctgttcggaagtgaagtcgttccgttttcagtcgctcatgtcgaaaccggacgcacaacgcagggacaccgcttcctcggaaaagcagccgacttgagcgcaccttctgaatacgaagcgacactggaaagccagtttgtgattgccgatccggccaaacggaagcagctgatcgttaagcagcttgacgaactggctgctgagaagtcctgggacattccgagagacgaggatctgctggatgaggtcaaccatctggttgaatatccaacggtactgttcggttcttacgaagaggaatttctcgcaattcctgaagaggtgctcgtgacaacaatgaaagagcatcagcgttatttccctgtcaaagatgaaaacggcagcttgcttccttactttgtgaccgtccgcaacggagacagccgcgcccttgaaaacgtggcgagagggaatgaaaaagtgctgagagcaaggctttcagacgcttccttcttctataaagaagatcaaaaattaaacattgacgagaatgtgagaaagctcgaaaagatcgttttccatgaagaactggggtcgctcggagataaagtgagacgcactgaggcgcttgctgaacggatcgctgaagtcatcggtgccgatcaagagacggtgcagctgatcaagcgcgctgcgcacatttcaaaattcgaccttgtgacacacatggtttacgaatttcctgagctgcagggcatcatgggtgaaaaatatgcgcggatgctcggtgagaaagaagaagttgcgctcgcagtcaatgagcactatatgccgagacaagccggaggacaaacgccttcatcaatcgccggcgccgtcgtcgcattggcggacaaactcgatacggtcgcttcattcttcaaaatcggcgtcattccgacaggatctcaggatccgtatggactgagaagacaggcgagcggcatcgtccaaatcctgcttgaccggaactggggcatttcattcaaagaactggctgcgtttgccggacaggaagcaaacagcgaactgctcgaattctttaaacagcgcctcaaatatgtattaacagcggaaaacatccgatacgacgtcgtggatgccgtgctcgaaagcacgaaccttgagccgtattcggctgtcaaaaaagccgccgtccttgaatcggctgcagccaaaccggaatttaaagaaacggctgaagcgctggcaagggttatttcgatcagcaaaaagagcgaaacgagcgccattgacgcttcactgtttgaaaaccctcaagaagaggagcttttcaaagcttatgaggcgtgcaggcagcaaatagagaccctttaccaagcaaaagattatgagggcgccttcagtgagctgtccaagctgaaagagccgattgaagcgtattttgatcatacgatggtacatgccgaagatgaaagattaaaagcaaaccgcctggcgcaaatggcaagcttggcggagctgatccgatcttttgcaaacatcaatgccatcattgtaaaataa

SEQ ID NO: 2604 - DNA, 888 bp, Bacillus licheniformis
ttgaatattcaagaaatgattctgaccctgcaaaagcattggtccaatgaaggatgcgtacttttgcagtcgtatgatgtagagaagggtgcaggcacgatgagcccatatacatttttgcggagccttgggcctgagccttggaaagtcgcttatgtggagccgtcaaggcgccctgcggacggaagatacggtgacaatccgaacaggctttatcagcaccatcaatttcaggtgatcattaagccgtctccagacaacattcaagagctttatttagattcattaaaagcccttggaatcgaccctctggagcatgatatccgctttgtcgaggataactgggaaaatccgtcgctcggctgcgccgggcttggctgggaagtatggcttgacggcatggaaattacccagttcacctattttcagcaggtcggcgggcttgagtgcaaaccggtttccgtggaaatcacatacggtatcgaacgccttgcttcttatatccaagataaagaaaacgtctttgatcttgaatggacgaacggctatacgataaaagacctgttcaagatggctgaatacgagcattccgtctatacgtttgagacatctgacgtcgacatgctgttcgaattgtttgcaacgtacgaaaaagaagcaaatcgccagatggatcagggacttgtccatcctgcatatgattatgttttgaaatgctcgcatacgttcaacttgcttgacgcaaaaggggcgatttccgtcacggagcgcacaggatatatcgcaagggtgagaaacctggccagaaaagtggcgaaaacgtattatgatgaacgcgaaaagttgggtttcccaatgctgaaggaggaagaggcttcacatgagtaa

SEQ ID NO: 2605 - DNA, 771 bp, Bacillus licheniformis
atgctgacgaaatgtgaaggtatcgtccttcgtacaaacgactatggtgaaacaaataagatcattacgctattgacgagagaacacgggaaaatcggtgtgctggcaaggggcgccaaaaagccgaacagccgcttgtcagcgatttcccagccgttcctttatgcatcttttttattccgcaaatcatccggcctcggcacattggagcagggcgagatgatcgaaagcatgaggaatatccgcgaggatctgtttttaacagcttacgcggcctacatcgctgaattaatcgacaagggaacggaggaaaagaaaccgaatccgtttttatttgagctgctgcttcagtcaatgaggaggctgaatgacggtacagatcccgacattatcgccaacctcatcgaagtcaaaatgctcagcgtgatggggctgtatccggagctggatgaatgtgtgcactgcaaaagcaaagacggcacatttcatttttcgatccgcgacaacggctttatctgccaccgctgttttgcgaaagatccatacaggataccgctgtctcccgcatccgccaggctgttgagactgtttttttattttgacctgtcaaggctcggaaatgtctcggtcaaacaggagacgaaggatgagctgaaaagggttattcagacgtactatgacgagtactcagggatctacctgaaatcgcggcgcttcatggaacaaatggacaatatgaaaaagatgctgggcgatgaaaacaaaagttga

SEQ ID NO: 2606 - DNA, 144 bp, Bacillus licheniformis
atgttgaattttacttggaatgtattttcacaaacaggaagcgttgacacgtacctcctttttaaagaattggaaaaggagaacctggaaagacccgaagtacttgaagaagagctagcgcaaattgactttccaattttgtga

SEQ ID NO: 2607 - DNA, 906 bp, Bacillus licheniformis
atgacacaggaaagctttaaatcaggatttgtctcgattatcggacgaccaaacgtaggaaaatctacttttttgaatcgcgtaatcggccaaaaaatcgccatcatgagcgacaaaccgcaaacaacaagaaacaaagtgcaaggtgtgctgacaaccgatacatcccagacgatttttatcgatacgcccggcattcataaaccgaagcataaattgggcgattttatgatgaaggtggcgcacaacactttaaaggaagtcgacttgatcttgttcatgatcaatgcggaggaaggctacggaaaaggcgacgaatttatcattgagcgattaaaaggagtcaagacgccggtatttttgatcgtcaacaaaattgaccggattcatccggatgagcttcttgtgctgatcgatgagtacagaaccaggtatccgtttcaggaaatcgttccgatctccgcccttgagggaaataatatcgatacgcttttaaagcaaattgaggattatttgccggaaggtccgcagttttacccgagtgaccaggtgaccgatcatccggagcgatttatcatttctgagctgattcgggaaaaagtgctgcatctgacaagggaagagatccctcacagcattgcggtctcgatcgagtccattcaagaacgggaaaacggttctgtgtatgtgagcgcgaccatcgtcgtcgagcgagattcgcaaaaagggatcgtcatcggaaaaagaggcagcctgcttaaagaaatcggcaagcgggcaagaaccgatatcgaggcgctgctcgggtcatcggtgtttttagagctgtgggttaaagtgcagaaagactggcgcaacaagatgtctcagcttcgtgattttggatttagagaagacgagtattaa

SEQ ID NO: 2608 - DNA, 411 bp, Bacillus licheniformis
ttgactaaacaagaattgattgcagaagctttaaaagcaagggaatttgcatatgttccgtattcgaaattcaaagtcggcgctgcacttttaaccgaagacggcaaggtgtacaaaggctgcaacattgaaaatgctgcatacagcctgtgcaactgcgccgagcggacagcgctgttcaaggcttattcagaaggggaaaaatcctttaagatgcttgccgttgctgcggatacgccgggtccggtgtccccgtgcggcgcctgcagacaggtgatttccgaactttgttcgccaaacatgcctgtcatcttaaccaatctgaatggccaagtcaaagaaatgacggttcaagaattactgccaggagcattttcatcggaggacttacatgacacaggaaagctttaa

SEQ ID NO: 2609 - DNA, 450 bp, Bacillus licheniformis
atgagtttttcaaacgcctttacaggaattatcaagacgttcatatcagagcgcaattttagaattcactgcggagccgccatcctcgtgatcgcctgcggctttttcttcaggctgacgctgatcgaatggaccgtcatcttgatcctgatcggcggaatgctcgccttggagctgatgaatacggctgttgagcatacggtcgacctcttcacaaaagagaacccccccgcttgcaaaagctgcaaaggacgcggcagccggggcggtttgcgtgtttgcagccgtttcgtgtatgattgggttacttatctttttgtcaaaattgttttgatgcccgcccttcgtcgtgcgctattcttacaaaaattttacatttgcgatttgggcgtgaaaaagaagccatttttatgtaaaataaaagtgttagcggtaccatcactgctatag

SEQ ID NO: 2610 - DNA, 477 bp, Bacillus licheniformis
atgagtttaattctagatatcacagacgagaccggacgcgtccctgaagaccggcttgctgaaattgaaaagcttcttcaattcgcagcggcggaggaaggcgtcgcagacggcgccgaagtctcggttacgatcgtcaacaatgaagagatacaaaaaatcaacaaagagtacagaggcaaagattacccgactgacgtcatttcatttgccctcgaagaagacggcgaaggagaggttgaaattatcggcgctgatatgccgcccgttctcggagatatcatcatcagcgtcgataaagcccgggaacaggccgaagaatacggacattcactgatgagggagctgggttttctgacggttcacggctttttgcacctcctcggctatgaccatatgacagaggaagaagaaaaagagatgttcactaagcaaaaggaaattttgaatcgatatgggctctcaagatcctcataa

SEQ ID NO: 2611 - DNA, 2151 bp, Bacillus licheniformis
ttgaaaaagaaaaaaagaggcggaaagtttcggcttatccgcttgaataacgggggcttccttcccgtcattctttatgcggctttatccgcgctgatgttcatcctgctgtttttccatgtgaggccggagtccctcgacctcgatttattttcgatcagcgagaatacgatctatgcgccggcgacagttgaagaccaaaaggcaacggctaataaaaagcaggaagcgagagaggaagttcccgaccagtacactttgaaaaaagagtactctgacaacagggtcgaccttgtctcatcgattttcgacatcattaaagaagtgaaaaaagaaagcgcagaaaaagagaaaaaagacaagcaggccccatctgaaaaagaccagatcaaatctgttgaagaaaagctgacttccgatgtgacggactcgctgtcacaggattcagtcaaacacctgctgagggccagcgacggagagctttccatgacgcaggattcggtcatcaccgccgtcaatgacgtgatgagcaaagaaatccgcgcaggaaagctcgatgaagcgaaagaacatgtaacgaaagaactgaagggcaattcgataccttcaaaattaaaaaacgccgctgatgaaatcggacgctttgcgatcattcccaattacgtatacgatcctgacaagacggagcagaagcgtcaagaagcggctgacagcgtacagcaggtacagatcaagcaggggcagatactcgttgaggaaaatcagctgatcgacagggaagtctatcgaaagctcgaattgacagggctcttgagcggagccaacatcttcaaacctgtcggcggactgctgcttttaatcgcgcttttcatctcagctttggtttactatttcgaaaagcaatacagcagccggattccgaaaaacaagtcgctcatgctgttttcgttgatcacagggatcgttttaatcgtcatggaagtgatcagcctgtttcagcagcttgaaatcggccatatcggctatctcgtgccgattgcgatgggcgtgatgctcattaaactgctgatcaatgaaaggctggcgatcctgtcgagcatgattctttccatttgcggaagcatgatgtttaaccagggtgtgacaggcacgttcaactatggaatcggaacgtatttcttaatcagctcgatggcgggtatactgtttttagggaagcataacgcgagggcgaaaattctccaggccggtttatttgtctctctgatcaacatcgttgttctgtttaccctgcagctgattcaaaacacggcgcaaaccgggcttgagatgggtacatatcttgtcatgggggcggtgtccggcatcggatcgtcagttcttgttctcggactcatgccgttttttgaaagcggatttggcatcctgtccacgatgaagcttctcgagctttcaaatccgaatcatccgctgctccgcaaaattctgacggaaacaccgggcacataccatcacagcgttatggtcgcgaacttatctgaggcggcatgcgaagcggtcggagcaaacgggctgctggcaagggtcggcgcctattaccatgatatcggcaagacaaagcggccccaatattttatagaaaaccaaatgaatattgataacccgcatgacaagctttctccgcagctgagcaaaaacattatcattgcccatgtgacggacggcgccgatatgctgagggatcataaaatgccgaaggagcttgtcgacatagccgaacagcatcacggcacatcgctgctcaagtttttttactataaggcgaaagaaaaaggcgatcagacgactgaagaagagttccgctatcccggtccgaagccccagacaaaagaggcggcgatcatctcggtggccgacagcgtcgaagcggccgtccgctcaatgcataaccctaatcccgaaaggattgaaaagctggtgcgcgggatcatagcggataagctgcaggacgggcagtttgacgaatgtgatttgactttaaaagagctcaatactatcgcgaagacgctctgcgaaacgctgaaaggcatttttcattcccggatagaatatccggaagctaatcctaaacagaaggtgaaacatacatga

SEQ ID NO: 2612 - DNA, 960 bp, Bacillus licheniformis
atgacagaacacttacttgcgattcatcagcaactggaaagtccgaatgaggctcaagcgctgtttgggaaccaggattcccatttgaagttgatggaggaagagctgaacatttcaattgtcacgcgcggagaaaccgtgtatgtgacaggagatgaagaaacgtttgaaatcgcggacagcctgcttgcctctctcctaaatctgatccgcaaaggaatcgagatatccgaacgcgatgtcttgtatgcgatcaagatggcgaaaaagcagaagcttgagttttttgaaagcatgtatgaagaggaaattacgaaaaacgccaaaggaaaaccgatcagagtcaaaaccatcggtcaaagagaatacatcgccgccatgaaaaggcacgacttaatcttcggcatcggcccagcaggaacggggaaaacctatttggctgtcgtaaaggccgttcatgaactgaaaaacggacgcatcaaaaagatcattttgacaagaccagctgttgaagcaggggaaagcctcggatttttaccgggggatttaaaggagaaagtcgacccttatttaaggccgctgtacgatgcgctccatgatgtgctcggaacggaccatacggcacggctgcttgaaagaggaacgattgaaatcgcgccgcttgcttacatgagggggcggacgcttgacgacgcatttgtgattttggatgaagcgcagaatacgacaccggcacaaatgaaaatgtttttgacgagattgggttttggatctaaaatggtcattacaggcgacattacgcaaatcgatttgccaaagggcgtcacatcagggcttgccgttgcaaaaaagatgctccttgatatcgagggcatttcaattgttgaactggatcagacggacgtggtcagacacccgcttgtcgcccgtattattgaagcatacgaaaagtcaaaataa

SEQ ID NO: 2613 - DNA, 1197 bp, Bacillus licheniformis
gtgaagaataaatggctttcttttttttcaggaaagatccagcttaagataacgggaaaagggatcgaacggttattaaatgaatgcaccaggcgcaacatcccgatgtttaatgtaaagaaaaagaaagacgccgtctttctttatattccgctttctgatgtacatgccttccggaaggtcatcagaggcttcgactgcaagtgcaggttcatcaaacgaaaagggtttcctttcctcgtgcagaagtctaaacggaatagcggcttcacttttggagttgctgcattttttatcatcatgttcctattgtccaacatgctttggaaaattgatattacaggagccaatccagagacagaacatcaaatcagacagcaattggatcaaatcggcgtcaaaaaaggccgctttcagttttcaatgctgaccccggaaaaaattcagcaggcgctcacaaagcgggtcgaaaacatcacttgggtgggcattgagttaaacggtaccgcccttcacatgaaagtcgttgaaaagaatgaacctgacaaagaaaaatatatcggtccgaggcacatcgtcgccaaaaaaggggcgaccatctcgaaaatgttcgtggaaaaaggcgagccgctcgtcacggtgaaccagcacgttgaaaaagggcaaatgctcgtttccgggctgatcggaagcgaagaggaaaagcaaaaagtcggagcaaaagggaaaatctatggtgaaacctggtacaagtcaacagtaacggttcctcttgagacatcatttgacgtttttacgggtaaagtaaggacaagtcacaagctatccctcggatcattttccgtgccgatctggggcttttcatttaaaaaagaagacttctcgcgcccgaagacggagaccgaaaaacactcgctgcattttatgaattttaagcttcctgtcgcttatgaaaaggagcatatgagggagagcgaacaaatcaaaagggtgtactcgaaaaaagaagcagttcttgaaggaatcgaaatgggaaaaagagacatcaggaaaaaaatcggcagagacgggaacattatcagtgaaaaagttttgcacgaaacgagcgagaatggtaaagttaaattgatcatcctttaccaggttattgaaaacattgttcaaacaacaccaattgttcaggagactaaagaatga

SEQ ID NO: 2614 - DNA, 282 bp, Bacillus licheniformis
atggcgcaaagaaaaaaccgcatcaaagcgtggctgacaagaacactggaaattccccctgatgtcatgatggatcttccgagaattacgatgataggaagacttcacatatatattgaaaaccacagagggcttttgcttttcagcgatacggaagtaaggctgatgctcaaacaggggcagtgcatcattcaaggcaaagactttgtcatcaaaacgattttgcctgaggaaattctgcttgaaggcacgattgagcttgtccgctatatcgattcataa

SEQ ID NO: 2615 - DNA, 450 bp, Bacillus licheniformis
ttgcttgatatcctgttcgacaatccgattatcatggcggccatcatcgcagccatttccttcatattcaacaagctcggaaaaaacgatgaaaatgaagaagcgaagcgaaaaccggcgcctgaacagcagaggacgcagacgccgaagccgaaacagacggcgcagcaccgtcctgcaaaaaataaaaaccagcggccggcagcggcagctgcaaacagcgcagatatggaagcagagctccgcagaatcaaagaagatgccgagcgttccatgccggccgttgaacggaccattaaaaagcagagcagccgggtgatcaaccggaagcaagagctgctcgacatgaataaaaaaacaatagttcaaggcattgtcctcagtgaagtattcggccctccgcggtcgagaaagccgcattacacaatgaggcgccggcctaaaatttaa

SEQ ID NO: 2616 - DNA, 993 bp, Bacillus licheniformis
atggatccgtcaacactgtttcttttacttattatcgcagccggaatcatcctactagctgtcttctttacattcgtcccggtcatgctgtggatctcggctttggccgctggtgttaaaatcagcattttcacactgatcggaatgaggctccgccgcgtcattccaaaccgcgtggtgaacccgctcatcaaagcgcacaaagcgggacttgatgttgccatcaatcagctggaaagccactatcttgcagggggtaatgttgaccgggtcgtcaacgcgcttatcgctgcccaacgtgcaaacattgaacttacattcgccagatgtgcggccatcgatttagcgggccgtgacgtgcttgaagccgttcaaatgagcgttaatccgaaagtcatcgaaacgccgtttattgccggtgtagcaatggatggtatcgaagtgaaagcaaaagcgagaatcacggttcgcgctaacatcgaccgccttgtcgggggagcgggcgaagaaacgatcattgcccgtgtcggcgaagggatcgtttcgacaatcggttcttccgataatcataaaaaagtgcttgaaaacccagatatgatttcacaaaccgtattgagcaaagggttggattcaggtacagcgtttgaaattctatcgatcgatatcgctgacgttgacatcggcaaaaacatcggagcgattctgcaaaccgaccaggctgaagccgataaaaacatcgcccaggcgaaagcggaagagcgccgcgccatggcggttgcgcaagaacaggaaatgcgcgcccgcgtcgaagaaatgcgcgccaaagtcgtcgaagccgaagccgaagtgccgcttgcaatgtctgaagctctccgcagcggaaaaatcggcgtcatggactacctcaatatgaaaaacatcgacgccgacactgacatgcgcgattctttcggaaagatgacgaaagaccaaaatgaagaggatcataaataa

SEQ ID NO: 2617 - DNA, 1212 bp, Bacillus licheniformis
atgtcattccgatcgaagaaaccgttgaaaaaggctttcaaaattcttgagcgctcatttcaagaagcggaagatatgtatgccaaacatatcatactcgatatcaatacccccggcggagcggtcgacgcagtccttgacatggctgatacgatacataactccgacattccggtgaccgcttatgtgaatagaagggctctgtccgcaggcgcttacctcgccttgaatgcagacgatatttatatggcgcccggcggaaaaatgggagctgccgcgatcattgacacgcagggaaatgccgctgacaaaaagtcggaatcgctgtggctggctgaaatggaagacgcagccaaaaaaaacggacgtgatccgaaatacgctctcgcgatggccgatgcagacgtcgatgctaaagaagtaggggcgccaaagggcgagctgctcacattaagccctgacaaagcgctgaaagtcggctattccgaaggcacagtttcgagccttgatgatcttttgaaaaagctgaatttgaaggatgccaaaatcgagcgtgccgaggtaagctttgccgaaaaggtggccaggtttatcacgcatccggtcgtgattccgattcttctttcaatcggaagcctcgggctgattgtggagctttattctcctggttttgggatccccggctttatgggactcaccgcattgctgctctttttctacggtcatctcgtcgccgggcttgccggaatggaaacgatccttctgtttgcagcaggcattattttaatcattttagagatttttctgccgggcggaatagcagggattgccggcctgatcgcaattgttgcgagcctctttttagcttcgggaagctttaaggtcatggccgtctccattttgattgcaactgctgtttcgatagcggcatccattctattgacaagggtgttgggtaagcgtatgaaattttttaaaaaattgatcttaaccgactcgacaagcacagaaagcggatacgtgtcaaatgaaagccggcgcgatttaattggcaaaatcggcgtcacgtatacaccgctcagaccgtccggaacggtcatcatcgacgatgaacggcttgatgttgtatctgaaggctcgttcaccgcaaaggataagaaagtgaaagtggttaaagtggaaggctcacgcattgttgtgagagaattataa

SEQ ID NO: 2618 - DNA, 447 bp, Bacillus licheniformis
atgagtcttcttgagcggctgaatcaagatatgaagctctatatgaaaaaccgtgagaaagacaaactgactgtcattcgcatggtcaaagcttcgcttcaaaacgaagcaatcaagcttaagaaagacaggctgaccgatgatgaagaactgactgttctttctcgtgaattaaaacagcgtaaagactccctccatgaattttcaaacgctaatcgttcagatttagtagataaagttcaaaaagagttagacattctggaagcttatatgcctgaacagctgacggaagaagagctgctcgacatcgtcaacgagacgatcgccgaagtcggggcttcttcaaaagcggatatgggcaaagtgatgagcgctgtcatgccgaaagtcaaaggcaaggcggacggcggtctcgtcaataagcttgtcagcaaacaactgtcttga

SEQ ID NO: 2619 - DNA, 237 bp, Bacillus licheniformis
atgtttatatgtatgtctttttttaaagcagtcgattggtgtattcggagggagggaaagagaatgtcaaaaacggtcgttagaaaaaacgaatcgcttgaagatgctcttcgtcgcttcaaacgcagtgtatcaaagacaggtactttgcaggaagcaagaaagcgtgaattttatgaaaaacctagcgtaagacgcaagaaaaagtctgaagctgcaagaaagcgcaaatactaa

SEQ ID NO: 2620 - DNA, 936 bp, Bacillus licheniformis
atgatgatcttgatcttgttcgtattattgatcgttctttttctcaaaggcatgagcatgctgagaaaaggcctgatttcactaacatttgaaaaaatcgaaaagcggctgctgtttttcacggatcatccggtgaaagcttttttggtcagtattatatttacggggattttgcaaagcagctcggcatttatggtgatcgtcatagggtttgtctcagtaggcgctctttcatttaaacgttcgattccgctcattttagggacaaacatcgggtccactttcacaacggaatttttggcggtgaagctggaatttttgatttttgcccttttggccgcaggtgcagctcttttcattgccggaaaatccccttttcggcaagtcggcgtaagcatgatcggcttgggggttatttttttctgtatcagcggtttcagccggcttgccgtgccgttgtcacagctagactcgggcgcttatatcgtgcagcttgccgaagattcatcgctttacgctttgttcatcggcaccgttttgaccgcgatgattcattccagttcggcgtgtgtcggcatcctgatgagctttatggatcaaggtgtcgtcggattgaccgaagcgatgagcgttgttcttggctccaacatcgggacatgcattacggccgtgatggcatccttcaaaggcggagctgcagccaggcaaacagcttatgcccatgttctgtttaatgtcattggtgtagcagctgtataccctctgctctcatcaatcacaggctttatctccggactgtccgaaagccccgcccagcagattgcccatttcagcctgctgttcaacgtcgtcacgtccctattgtttttgccgctctcaaatctgtttcattcgctgatcatgtttctcattccaaacaaaaaccaggcccgataa

SEQ ID NO: 2621 - DNA, 672 bp, Bacillus licheniformis
atgacaaaacaaattgcgcgaatgatcgatcacactgcattgaagccagataccgtcaaatccgaaatcgaagcgctttgcaaagaagcgcgtgtttacggttttgcctccgtttgtgtcaacccttgctgggtgaagctttgcgccgagcttcttaaagagtcagaggtgaaagtatgtacagttatcggctttcctttaggtgcagcgtctccggaaacaaaagcctttgaaaccaggcaggcaattgcagacggtgccggtgaagttgatatggtgatcaacatcggtgcactaaaagaccgcgatacgggaacagtggaacatgacatcagggcggtgacagacgcggccgacggcaaagctcttgtaaaagtcatcatagagacgtcgcttttgacggatgaagaaaaaaggctggcttgtgaactggccgtaaaagcaggcgccgactttgtcaaaacatcgaccggtttttccggcggcggtgcgacagtccgggatataaaactgatgcgggaagctgtcggacctgatatcggcgttaaagcttcaggtggcgtccgcgataaggaaagcgcacttgccatgattgaagccggagcgacgagaatcggagcgagcgccggcgtgtcgattgtcaaagggttaacagcggatgaagactactaa

SEQ ID NO: 2622 - DNA, 1356 bp, Bacillus licheniformis
atggcaaccgttgcatttcatacacttggctgcaaggtcaaccattatgaaacagaagcaatctggcagctttttaaagaagccggctacgaaagaaaagaatttgaaagttcggcggacgtatacgtcattaatacatgcaccgtcacaaatacgggtgataaaaagagccgccaggtgatcagacgggcgatccgccaaaatcctgacgccgtcatttgcgtgacagggtgctacgcccagacttccccggcggaaatcatggcgatcccgggcgttgatatcgtcgtcggtacacaagaccgcgaaaaaatgctcggctatattaagcagtaccaggaagaaagacagccgattaacggcgtcagcaatattatgaaagcgagagtgtttgaggagcttgatgttcctgcatttaccgacagaacgcgtgcttctttgaaaattcaagaaggctgcaacaatttctgcacattctgcatcattccgtgggcgcgcggcctgcttcgttcccgcgaccctgaggaagtcatccgccaggcgcagcagctcgttgatgccggctataaagaaatcgttttgaccggtatccataccggcggttatggagaagatatgaaagactacaactttgcgcagctgttgaaagaattggacagccgtgtgaaaggtctgaaaagaatccgtatctcttcaatcgaagcgagccaaattacagacgaagtcatcgaagtgcttgaccgctcagacaagatcgtcagacaccttcacatcccgcttcaatccggctcaaacagcgttttaaagcggatgagaagaaagtatacgatggagtttttcgccgaccggctgacaaaactcaaaaaagctcttccggggcttgcagtcacctctgatgtgattgtcggcttcccgggtgaaacggaagaagaattcatggagacgtataactttatcaaagaacacaagttttccgagctccacgtcttcccgtacagcaaacggaccggaacccctgcagcacgcatggacggccaggttgacgaaaacgtgaaaaacgaaagggttcataaactgatcgctctttcagaccagcttgcgaaagaatatgcatcagactatgaaggcgacgttctggagatcattccggaagagccgttcacggaaacgggcgaaggcaacctgcttgtcggctacacggacaactatattaaagtcgttttcgaaggttcagaagacctgatcggccagcttgttaaagtgaagatcttaaaagccggctatccgtacaacaaaggacagttcgtccgcgtcgcggaagacgacgtccgcgaaaacatccgcttatcgtcataa

SEQ ID NO: 2623 - DNA, 768 bp, Bacillus licheniformis
atgcaacgatattttatcgaacaatcaaaacaagaggtcacagccgcacccgcattctcgatcaaaggcgaagacgttcatcacattgcgactgtgatgaggatgtctcccggagatgaggtcatttgctgtgcaaaagacggccatgaagcgaaatgccggatcgagtccgtcactaaagaagaggttttattgagcgttatcgaatggacgggggaaacacgcgaactgcccgtccagatccatattgcaaacggccttccaaaaggagataagctggaatggatcattcaaaaagggacagagctcggtgcaagctcgtttattccttttcaggcatcgcgctccgttgttaaacttgatgaaaaaaaggcaaagaaaaaacgggaaaggtgggcgaaaatcgccaaggaagcggcagaacagtcccacagaaacgcgattcccgatgtggcgccggttcacacgtttcaacgtttgcttgagagccttgaggacttcgataaatgtgtcgttgcatacgaagagtcatcaaagcaaggcgagacgagccggtttcaatccgtgctcaaaagcctttctgaaggatcatccgtactcatggtgtttggtcctgaaggcggatttacagaagaggaaattgaggcgctaaaagaaaaaggtgccctcgcctgcgggctcggtccgcggatcttaagggcggaaacagctccgctgtacgcgttggcggcagtttcttatcatacagagttattaagaggtgaataa

SEQ ID NO: 2624 - DNA, 936 bp, Bacillus licheniformis
atgaaatggtccgaaatctgcattcacacgacacatgaagcggttgagcccatctcgaatattttgcatgaagctggtgcgagtggagtagtgattgaagatccgcttgatttaattaaagagcgtgagaatgtatacggagaaatctaccagctcgatcccaatgattatcctgatgaaggagtcatcatcaaagcgtatcttccgatcaacagctttttgggggagaccgtagaaggaatcaaagaaacgatcaataatctgctgctgtatgatattgaccttggacgcaacaaaatcaccatcagcgaggttaacgaagaagaatgggcgacagcatggaaaaaatattatcatcccgtgaaaatttccgagaagtttacgattgttccgacttgggaagagtacacaccggttcatacggatgaactcatcatcgagatggacccgggaatggcgtttggaacaggcacccacccgacaaccgtcctttgcatacaggcgcttgaaaggtatgtgaaagaaggggattcggtcgtggacgtcggaacgggaaccggcattttgagcattgcttcagccatgcttcgcgccaaacaggttgaaggatatgatctcgatcctgtagccgttgaaagcgcccgcttgaactccaagctcaataaagtcagcgatcatatcgagattaagcaaaataatctgcttgacggcgtcgaaggcgaaaaagacatcatcgtcgccaatatcctggccgaggtcatcttgcgctttacggatcaagcatacagcctgttgaaagacggcggctatttcatcacttcggggatcatccagcagaaaaaacaggaagtcaaagatgcactggtgaaagaaggctttacgatcgttgaggttctttcaatggaggactgggtcagcatcatcgctaaaaaataa

SEQ ID NO: 2625 - DNA, 1128 bp, Bacillus licheniformis
atgagtaagcgtgattactatgaggtgcttggggtaggtaagagcgcttctaaagatgagattaaaaaagcttaccgcaagctttctaaaaaatatcacccggacatcaacaaagaagccggagcggctgaaaaattcaaagaagtcaaagaagcctatgaaacactttctgatgaccaaaaacgggcccattacgaccagttcggccacaccgacccaaatcaaggattcggaggcggaggtttcggcggaggcgacttcggcggctttgggtttgacgatattttctcaagcattttcggaggcggcgcaaggcggagagacccgaatgccccgaggcagggtgccgatctgcagtatacgatgacactgtcatttgaagaggcagccttcggaaaagagacgacgatcgaaattccgcgtgaagaaacgtgcgaaacatgcagcggctccggcgcaaaaccgggaacaaagccggaaacatgttcacactgcggcggatcaggccagctgaacatggagcagtcaacaccgttcggaaaagttgtcaacagaagagtatgtcattactgtaatggaacgggtaagcaaatcaagcacaaatgttcaacttgcggcggcacaggaaaagtgaaaaaacgcaagaaaatcaatgtcaccatcccggcgggtgtggacgacggccagcagcttcgagtagccggacagggcgaaccggggatcaacggcggtccgtcaggtgacttattcgtcgttttccgcgtccaagagcacgaatttttcgagcgcgatggagacgatatttactgcgaaatgccgctgacatttgcacaggctgcccttggagatgaaatcgaagtgcctactcttcacggaaaagtaaaattaaaagtgccggcgggcacccagacgggcaccaagttccgcttaaaaggaaaaggcgttgccaacgtgcgcgggtacggacaaggcgatcagcacatcgttgtccgcgtcgtgacaccgacgaatttaacagaaaaccagaaaaatattctccgcgaatttgcagaagtgagcggaaatatgccggatgaacaggaaatgagttttttcgataaagtaaagcgcgcctttaaaggcgattaa

SEQ ID NO: 2626 - DNA, 1962 bp, Bacillus licheniformis
atgagcaaagtaatcggaatcgacttgggaacaacgaactcatgcgttgcagtgcttgaaggcggagagccgaaagtcatcccaaatccagaaggagcccgcacgactccttcagttgtcgcatttaaaaacggagaacgccaggtgggtgaagtggcgaaacgccagtccatcacgaacccgaacacgatcatgtcgatcaagcgccacatgggcactgactatacagttgaaattgaaggcaaaaagtacacgccgcaagaagtgtctgccatcatccttcagcatttgaaatcatatgctgaaagctatttgggcgaaaccgtgtctaaagccgtgatcacagttcctgcatacttcaacgatgcagagcgtcaagcgactaaagatgccggtaaaatcgccggacttgaagttgagcggatcatcaacgagccgactgcagctgcgcttgcctacggtctggataaaacggaagaagatcagacgatcctcgtctacgaccttggcggcggtacattcgacgtttccatccttgaattgggagacggcgtattcgaagttcgctctacagcgggtgacaaccgccttggaggagacgactttgaccaagtgatcatcgatcatctcgtctcagaattcaaaaaagaaaacggcatcgacctttctaaagacaaaatggcgcttcagcgcttaaaagatgctgctgagaaagcgaaaaaagacctttccggcgtatcttctacgcaaatttccctgccgtttatcacagcgggtgaagcaggtccgctgcaccttgaattgacactgacccgcgcgaagtttgaagagctgtcttcacacttggtagagcgcacaatgggtcctgtacgccaggctcttcaagatgcgggactttctgcaagcgaaatcgacaaagtcatccttgtcggcggatcaacacgtattcctgccgttcaggaagcgatcaaaaaagaaactggaaaagaagcgcataaaggcgtcaaccctgacgaagtcgtagcccttggtgcagcaattcaaggcggcgtcatcacaggcgatgtcaaagatgttgtccttctggacgtaactccgctgtcacttggtatcgaaacgatgggcggcgtgttcacgaagctgattgagcgcaacacgacaatcccgacaagcaagtcccaagtgttctcaacagcggccgacaaccaaacagcggttgacatccacgtgctccaaggtgagcgcccaatggctgccgacaacaaaacgctcggacgcttccagcttacagatatcccgccggctcctcgcggcgtaccgcaaatcgaagtgtcatttgacattgataaaaacggtatcgtcaacgtcagcgcgaaagatctgggcactggcaaagagcaaaacatcacgatcaaatcttcttcaggcctttctgacgacgagatcgagcgtatggtgaaagaggctgaagaaaacgccgaagcagatgcgaagaaaaaagaagaaatcgagcttcgcaacgaagcggaccagcttgtcttcacaactgaaaaaacgctgaaagatcttgaaggcaaagccgatgaagcacaggtgaaaaaagcgaatgaagcaaaagacgcgctaaaagctgcgatcgagaaaaatgaccttgatgaaatcaaggcgaaaaaagatgagctgcaagcgatcgttcaagagctttcaatgaagctttacgaagaagccgcaaaacaggctcaggctcagcaagacggcggagctggcgctaaaaaagccgatgataatgtcgtggacgctgaatatgaagaagtaaacgacgacaaaagatcaaaaataatcgaaataaaatgtgctgtgcttaccccggtttgcacagcacatgaccttacaggcgatgaaagtcaaagtcaggatctcttgactttgacttttttcttcctaaaggacaaaaggaattga

SEQ ID NO: 2627 - DNA, 300 bp, Bacillus licheniformis
ttgctgccggcgcttgacaactttgagcgcgcacttcagatcgatcctgacaatgagcagacgaaaagcctgcttcaaggaatggaaatggtgcaccgtcaaattttggaggctcttaaaaatgaaggagttgaacagattccatcagtcggagagcaatttgacccgaacatgcaccaagctgttatgcaggttgaggatgaagcgtacgaatcaaacgcagtcgttgaggaactgcaaaaaggctataaacttaaggaccgggtgatccgtccttctatggtaaaagtcaatcaataa

SEQ ID NO: 2628 - DNA, 147 bp, Bacillus licheniformis
atggcagatgacaaacaaaacgaagagctaaacgaacaagaggaactgaccgagacagaagcggagacagtcgaatctgaacaaacggctgctgaagctgatgccccggcagaagaaactcaaacgaaatgcttgaaaaacaactaa

SEQ ID NO: 2629 - DNA, 1032 bp, Bacillus licheniformis
atgttaacaaatcgtcagctgttaatcttgcaggttatcgtcaacgatttcattcgttcagctcagccggtaggatcaagaacgctttccaaaaaggaagatatcacattcagctcggcaacgatcagaaacgaaatggctgacttggaagagctcggttttatcgaaaaaacccactcatcttcaggccggattccttctgaaaagggctatcgctattatgtcgatcatctgctttcacctggaaagctgtcaaaaacggacttaaacattattcattcgattttcaaagaaaaaatctttgaactcgaaaaagccgtgcagaagtcggcccaagtgctgtccgacctgacaaattatacatcgattgtcctcggtccgagactgagtgaaaaccatctcaaacagatccagattgtaccgattcagcccaagaaggccgttgccattctagtaacgaataccggccatgtggagaataaaacgattaatttcccggcggaggtcgatctttccgatctcgagaagctggtgaatatattaaatgaacgccttagaggcgtgccgatctcagaactgaaagacaggattttcaaagaggttgtcatcttcttgaagtcgcacattcaaaattacgatacgattttgcacgcgctcggcgcaacgctggattcatctgttcaaaccgaccggctgtttttcggcggcaagattaacatgctgaaccagcccgaatttcacgatattgacagagtgaaatcgctattgtcgctcattgagaaagaacaggagattctccggctctttcagtcgactgagtccggaattaccatcaaaatcggcaaagaaaacgactatgaagagatggaaaactgcagcctgattaccgcaacatacacggtcggctcaaaacagatcggctccattgcggtcatcggaccgacgcgcatggactactcccgcgtcgtcggcttgcttcagcacgtatcatctgacttgtcaaaagcgctgacaagtttgtatgatgggtaa

SEQ ID NO: 2630 - DNA, 1140 bp, Bacillus licheniformis
atgaaagcagcatatatacatattccgttttgcgagcacatttgccattattgcgacttcaacaagttttttattcaatctcagcccgttgatgaatatttgcgttccttagagaaggaaatggccaattcaatggaggcaaccggacatccggagctgaaaacgatctttatcgggggaggaacgccgacatcgctgtcggcagctcagctcgaacggctcctcgattccattcatcgcgttttgaaaccgtccgaaagccttgctgaatttgcagtggaagccaatcccgacgatttatcagctgaaaagctggatgttttaaaagctgccggtgtagacaggctgagctttggcgtgcagacgtttgaagacgagctgctgaaaaaaatcggcagggttcacgagcaaaaagacgtactcgtttcgtttgaaagagcgagaaaggcggggtttgataatatcagccttgatctgatgttcggtctgcccggacaaaccatcggccacctcgcttcatcgctcgatacggcgcttgccctcggtgctgaacactattcggtttattcgctgatcgtcgaaccgaaaaccgttttctacaacttgatgaaaaaaggccggcttcacctgccgccgcaggatcaggaagctgaaatgtacgaactcgttatgcggaaaatggaagaagcgggcatcggccaatacgaaatcagcaactacgccaaaaaaggatatgagagcaaacataacctcacatattggaacaatgaggattatttcggttttggcgcgggcgcacacggttatatcaatggtgaaagaacggtaaatgcgggccctgtcaaacattatatcgacctgattgaacaatccggctttccttataaggaaaagcacatggtcacaaaaaatgaacagattgaagaagaaatgtttctcggtcttcgaaaaactgagggagtaaacaaagagcgctttttcgaaacatatggaagatctgttgacgatctctttccgaaggtgctccattcgctggaagaaacagggttgattgtgaacacgaacaaaaacgtgtttctaacacataatggaaaactgttgggaaatgaagtatttcaggcattcctgggtgagttataa

SEQ ID NO: 2631 - DNA, 1704 bp, Bacillus licheniformis
atgaaagaacagctcctcgactcaatggatttggaacgtgaaagaggaatcaccattaaactgaactccgtacagctgaaatatcaggcgaaggacggagaggaatatatttttcatctgatcgataccccgggacacgtcgattttacgtatgaggtttcgagaagccttgccgcatgcgaaggcgcgattctcgtcgtagacgccgcccagggaatcgaggcgcaaacgctggcaaacgtttaccttgcgcttgacaacgaccttgaaatcctgccggtcattaataaaatcgaccttccgagcgcagaacccgaacgcgtccgccaggaagtcgaggatgttatcggtcttgacgcttcagaagccgtccttgcttcagcaaaagcaggcatcggaattgaggaaatattggagcagatcgttgaaaaggttcccgcaccaagcggagatccggaagcgccgcttcaggcgctgatctttgactccctgtatgatgcttaccgcggggtcgtcgcctatatcagagtcgtgcaaggtaccgtaaaagccggtcaaaaaatcaagatgatggcgaccggaaaggaatttgaagtcactgaagtcggcgttttcacaccgaaggccgttccggctgacgaactgactgtcggcgacgtcggattcctgacggccgcaatcaaaaacgtcggagacactcgtgtaggggatacgattacgagcgcggaaaaccctgcacccgaagccctgccaggctacagaaagctgaatccgatggtttattgcggcctgtatccgattgatacagcgaaatacaacgacttgcgggaagcgcttgaaaaacttgagctgaacgattcagccctgcagtacgaagcggaaacgtcccaagctctcggattcggcttccgctgcggtttcttagggatgctccacatggaaatcatccaggagcggattgaacgcgaattcaacatcgatttgattacgacggctccgagcgtaatctacgacgtgtacatgacagacggtgaaaaaatcgtcgtcgataacccgtcaaacatgcctgatccgcagaagatcgaccgggtggaagaaccgttcgtcaaagcgacgatgatggtgccgaacgactttgtcggagcggtcatggaactgtgccagggcaagcgcggccagtttattgatatgcagtaccttgatgcgaaccgcgtcagcattgtctacgaaattccgcttgcggaaatcgtctacgagtttttcgatcagcttaaatcaaatacgaaaggctatgcgtcatttgattacgaactcatcggatataaaccgtccaagctcgtgaaaatggatattatgctgaacggcgaaaaaatcgatgccctttcctttatcgttcaccgcgattatgcttatgaacgaggaaaagttatcgtcgaaaagctgaaagagctcattccgcgccagcagtttgaagtgcctgtccaggcagccatcggtacaaaaattgtcgcccgttcaaccatcaaagcaatgcgcaaaaacgttttggcgaagtgctacggcggggatatttccagaaagcgcaaactgcttgaaaagcaaaaggaaggaaagcgaagaatgaaacaggtcggctctgtcgaagttccgcaggaagcctttatggcagtcctgaaaatggacgacagcggcccgaaatcataa

SEQ ID NO: 2632 - DNA, 324 bp, Bacillus licheniformis
gtggcttcttttatgggaaaatgcatattggcttgcgctgtcatgtttttcggcgttcttctcggcatgcagcaggcgaacaacggaatgattgaaatgaaagggtacgaggaccctgatttaaaagcagcgctcagcatatctgaaggggatgcgaaagaggcgtcagtcctcggccatcaaatcgatttggaggaaaaacaaaaagagctggaacagctggaagctttcaacctcttttcctcggccggccgagccctggccgattcggtcacaaacacagcccgttcattgtatgactggataaaggaaaaaacggaatag

SEQ ID NO: 2633 - DNA, 1206 bp, Bacillus licheniformis
atgagaaaaagaggcaggaatcgtcagtttgtgctggctgtaaatggaagaagcgcggttaagacagtattcttatttatcgtcagcctgctgctcgtttttattttatcaggcgtgctcacatcgctgcgtcctgagttaaggccgtcttcatcgttgtaccgggtggctgatgaactgaagggcgagacctttgggctcattttgggaatggaaaaccactactttgcatcagaattgccggaaccgaataagcgctttgagctttcccccctcgtcctgaagctggcgaccagcattaatttgaaagatccgcgaagttttctcggacgggagcttccgggattctctcattttgactcggaaatcctcattgccgggcaagggacggattatacgaatatgccgtcagaatctccgccgccgactgaggtcttaaaagaggagagagaagcgaatcttgcagagcttgaagggaaacagaaaaagaaaacagacggggaaaaacctcctgaacaatcgacgggcggccgcaaagtcgtatttatctacaatacgcacaatacggaatcgtatcttccctttttaaaaggtgaggcagatcctgatcgggcgattcattcgaaagcaaatgttacgcttgtcagcgatatgctcgcaaatttgatgaaatcgcagggcgtcggggcgatggtggataaaaccgattttcaggcgaatttgcggaaaaaaggctgggcctatgcccgttcctatgatgaatcaaggccggtcgtcaaagaggcgatggcccagaacaaagacttgcagtattttatcgatattcacagggattcgcaacggaagaaagcgacaaccgcgactgtcaaaggaaaaagctatgcacgcgttgcgtttgtgctcggcaagaagagctctaatttcgaatcgaacttaaagctggcaaaagagctgcatgaacggatggaaaaaaaatatcccggtttgagccgcggagttatatctaagggagctgccggggataatggcatatataatcaggatttaaacgaaagatccgtcttaatcgaatttggcggcgtagataataaccgcgaagagctggagcgggctgcagaagcgatggcggatgtattcagcgagatgtactggaatgctgaaaaagttgatgcagactccggtgaagacgataagaaaaaacaatag

SEQ ID NO: 2634 - DNA, 1107 bp, Bacillus licheniformis
atggagaaaaagaagctcgatttaagtcaatatgcagtccggacagacttagccgtggaagcgagggatctggcagaggaaaaggaagcttctccaaagaaagagctgaaagggtttacagtcaaagaatacgaaaaagacgggatcaaaattcagacgatggatattgatgaagaaggagcgaagctgtcggggaaaaaagccggccgctatttaacctttgaaacacaagggatcagacagcaggattccgtattgcaggaaaaagtcgtcgatgtcttcgcaaaggaattttcctcgtttctcgattatttgggcattccgcgggatgccagctgcttaatagtcgggctcggcaactggaatgtcacgcccgactcgctcggccccctagtgacggagaaccttctcgtgacgaggcacctgtttcagctgcagcccgaaaatgtagaggaaggctaccgtccggtgagtgcgctttccccgggagtcatgggcttgaccggaattgaaacgagcgacattatccaaggggtgatcgatcgctcaaagcccgattttgtcattgccattgatgcgctggcatcaagagggatcgagcgtgtgaattctaccattcaaatttcagacagcgggatacaccccgggtctggtgtggggaataaaagaaaagagttaagcaaggatacgctcggcattccggtcatcgccatcggtgttccgacagtggtcgatgccgtcacgatcacgagcgacacgattgattacatgctgaagcattttggaagagagatgagagacgacagtccgtccaggtcgctcgttcccgcggggatgagctttgggaaaagaaaggtcctcaccgaagaagaccttcccgatgaagagcaccgcaaatcgtttctcggtatagtcggaggcctcgcagaggatgaaaaaaggcagctgatccatgaagtcctcgctccgctcggccataacttaatggtgacccctaaagaggtcgatacatttatcgatgatatggcaaatgtgattgcaaacggtctgaacacagcgctccatgaaaatgtatcgcaagacaataaaggaatgtataaccactaa

SEQ ID NO: 2635 - DNA, 267 bp, Bacillus licheniformis
ttgccaaacattaaatcagcgatcaaacgcacaaaaacaaacaacgagcgccgcgcgcacaacgcaacaatcaaatctgcaatgcgcactgctatgaaacaagttgaaactttcgtaagcaacaacgaagcagacaaagcgaaagcagctctatctgcagcagcaaagaaaatcgataaagcagctaaaaaaggtcttgtccacaaaaacaccgccgctcgttacaaatcaaacctagcgaaaaaagtgaacggactttctgcataa

SEQ ID NO: 2636 - DNA, 1065 bp, Bacillus licheniformis
atgaaagaggggaaagtgcagatgacggtatttgatgtttggaaaagcttgaaaaaaggcgacattcatcccgtttattgcttgtacgggaaagagacgcatcttctgcaggagacggttcaaaggatcagacaagccgttgttgatgaagagacgaaagactttaacttctcgatatttgatctggaagaagacgcgctcgatcttgccgtggaggatgcggaaacctttccgtttatgggggaaaggcgtcttgtcgtggcgaaaaacccggcgtttttaacagctgaaaaaaagaaggataagcttgagcataatctcggtgtactggaagcttacattacgcagccggcaccttattccgtgtttgttttgcttgcgccttatgaaaagctcgatgaacggaaaaagctgaccaagctcctgaaaaagcatgcgcacatggtggaagcgaaggaattaaccgccaaagaaacggctgactttatcgcaggcctcgcgaagtcggaaggcaaacaaatcgaaccggaagcggcggaggagcttgtcctgttatgtcatgcaagtctgtcagccattgcccaggaggttaaaaagctcagtacatataccggtgaccgcggagagatcaccatagaggatgtcagaaagcttgtagcgagagggcttgaacaaaatattttcgaactgatcaataaggtcgtcaatcggaaacgtacagaagcgctgcagattttctacgatctattaaagcaaaatgaagagccgattaaaatgatggcgctgattgctaatcagttcaggctgctgatgcagaccaaatatttttctgaccagggatacggacaaaagcaaatcgcctcaaaccttaaagtgcacccgttcagggtgaagctggcgatcgagcaggcgaggcttttttcagagcaggagcttaggaacattatcgagcagctcgccgtgatggattatgaaatgaagacaggcaaaaaagacaagcagctcctgcttgaactgtttttgctgaagctgctgcagcctcatgaaaaaaacggcctcctttaa

SEQ ID NO: 2637 - DNA, 132 bp, Bacillus licheniformis
gtgaatgaatttgaaaaagacgtgcaaagcaaacgtaacgatcttgtagattcaggtgtcggttttatcgtgtcttttggctttttcgctacaatgtttattatcgctactgttatacatctggccgcttaa

SEQ ID NO: 2638 - DNA, 2388 bp, Bacillus licheniformis
atggacagacatcgcatcttcccgtgcggagcgatttcagcggcagccggaatcgcctccgctcactcttctctttatctcttcctcgccgtcggtttttttctgttctttatcctctgtttcttcaaaaaacaaatactccttttcgctttatgtgcagcggtttgtattttatattttacttctttttacgtgatcgaccatttcaatacaacgatttatcatgaaggcaaatttcacacgctcgcttctgttcaggatattcccgtaatagacggagaccggctttctttcacagccgaaacagatgagggagaagctttgaaagcgggatatacgctccggtctccacaagaaaaacgggcgctctcagctcttcagccgggcagcctctgtgtcatgcaaggtgaattaaaagagccgaaaaaagagacggttcctggcacttttaatcaaaaagaatccatgtatcaaaaagggattcactggatttttgcagttcagtctattacaagctgcaagccgggcggcggcctgatgccatctctattgaaaatcagaaaagcgggccttgattttatagaggaaaatatggcggactcggctgccggtattggaagagcgctaattttcggagaccggtttctcattgaacaagatgtcctggacggctatcagcgtcttggaatcattcaccttttagcgatttccgggcttcatgtcggtctgctctcagccgctctgttttacatatttattcgcttcggcgtcacgagggaatgcgcaaaatggctgctcgtgatcggccttcccgttgccgcagttttgaccggaggcgccccgtcggtgatgagagcggttttcatgtctgaaatctatctgctggcatcactgtctaaaaagaacttcaaaagtgccgatgtgatcagcattgcctgcctcggactgctgctgtatcatccttatctgttatttcaagccggattccagctttcttttgctgtatccttcgttttcattctttcaaaggagatattgaccaggccgaaaagccgaatctctcagctgctattggggtcatttttggctcagctcgcttccctcccgattctgctttttcattttcaagagttttcatttctcagcacattaatgaatctattttttatacctctttatattttcatcatcatgccgctgtctttcggaagcctgcttgctttcatatgttttcatcccttgggggaggcggcagccgccgttcttgaccgtctgcttgtgtggagccatcaggctgttaaaacggtgtctgccgcggatgtttcggtcttttctgcggctaagccgccggatcttttgttgtttttctacttcacagccatttttctgtttttgctgttgctggaaaaagagatgtcgcttcgtgcggtcatgattccgtccggcctgcttgctgctgtgtttgtgattcacgcatgtcttcctcagcttgcaggtgagggagaggttacaatgcttgatatcggccaaggggacagcatgtatgtcagcgctcccggtcagaatggcacggtcttcattgatacgggaggaaccgtatccttccggaaagagcggtggagaaagcggaagaaggatttttcattgggggagagcgtgttaatgccttttctggcaaccaaaggggtcaagaagctcgatgctttaattttgacccatgctgatcaggatcatatcggtgaagcgcatgtgctgatccaaaaacataaagtgaagcaattgatcgtgccgaaaggcttcgcagccgaaccgtctgatgaaaagctgcttcgccttgccttgaaggaaggcgtcgaggtgaatgtagccaaaagaggtgacatccttcatattggcaatcttgaattttatgttctttcaccgaaagaggcggacaaaaacagcaaaaacaatggttccctcgtattgtggatgaaagcaggcggattttcgtggctgttaactggagatttggagaaggagggcgaaaaggagatgatggaagtgtatccgaatcttaaagcggatattctgaaagtcggtcaccatggaagcaaaggttcgacgggtgaagagctgatcaagcaaattgagccgaaaaccgccctcatttcggcgggggagcacaaccgctacgggcatccccacggggaagtgctggacatcctaaaccgccacgatgtgaaggtgttcagaacggatcggcacggttcgattcagcacctatttcgaggcgggaacggaacgtttttgctacatcctccatatgataaagtacattccccgcaagaaaaaatgactgctgaaaaacagcagtcgtcaaaaagccgcttgcctgacggagagtaa

SEQ ID NO: 2639 - DNA, 570 bp, Bacillus licheniformis
gtggaacggatttcttgggatcaatattttatggcgcaaagccatttgctggcgcttcgcagcacgtgtacaaggcttgctgtaggagcgacgattgtcagggataaacgaattatagcgggaggctacaacggatcgatcgccggaggcgttcactgtgcggatgaaggctgctatatggtggacgggcactgcattagaacgattcacgccgagatgaacgcgattcttcagtgtgcaaaattcggtgttccgaccgaaggcgctgaaatatatgtcacacattttccgtgcattcaatgctgtaaatcgatcattcaggcaggtattaaaacgatatactatgcgaaggattacaaaaaccatccttacgcggttgaacttttcgatcaggcttctgttaaagtggagcaggtagagctcgatgagatgattatcgacttgaaaaaccaggaaaagttggcgtttgtagccgatctgatcaaacagctggctgataaaggccttgaggaagaggagatcaggaaaatacacgaagaggccaacaaactgtttacaagctacgtgtaa

SEQ ID NO: 2640 - DNA, 630 bp, Bacillus licheniformis
ttgacagattggctaaaacaatataaatggcatgctgcgggaggcgttgcactcgtcttgatcatcagcgctgccttcatgctgttaagcggaaagcgtgaaacttcatccggcctctccattcccgaggaggcttctgcacagacgtatgacaagaaggaggaggtgaaacgggaaaaaagcgcgggaaaagaggcggttatcatcgatttgaaaggcgctgtgaaaaatccgggcgtctatcaaatgaaagagggagacagggtccacgatgtattgaaaaaagcaggcggcaccgagaaaaaagcggatcaaaagcaaattaaccttgcagccgttttgcaggacggtatggtggtttacattccatttgagggggaagaggctgctgattctttctcgaaagcgggttcaagggcagatggcgcttccgtcgatatcgtcaatatcaatacggcttcctctgaggagcttcaggcgattcccggcatcggcccttcaaaagcggaagcggttatcgaataccgcgaggagaacggaccgtttcacacggtagaagacataacaaacgtttcgggaattggagaaaagtcttttgaaagaataaaatctgcaatcacggtaaagtaa

SEQ ID NO: 2641 - DNA, 822 bp, Bacillus licheniformis
ttgaatatcggctttatcgggacaggaaatatggggaccattttaattgaggcgttgattgaatccagagcggtcattccctcatctttaacaattactaaccgaacgatcgacaaagcgttaaacataaaaaaacgattcccagacattcaggttgcagaacggccggaagaagtgattacggaaagtgatgccgtgtttatctgtgtaaagccgctggatatttatcctttgctaaaacggctttcacccgtcttcacccgcgatcagactgtggtaaccattacgagtccggtgcaggtcgaacagctggaaaccatcgtctcctgccaggcggcaagagtgatcccgagcattacgaacagagcgctgtccggcgtgtcattattgactttcggagaaagctgcacagctgaggcaaaagaaaaattgacggctttagtaagcaagatctcaatccctctcgaaatcgaaagcgagattacgagggtcgcctcagacattgtcagctgcggccctgcctttgtcagctatttggttcaggagtttattcaggcggctgtcgaagaaacatccgtgtcaaaagaggacgctattttaatgacgaaagagatgctggtcggtttgggaaggctcctcgaaacaggcctttacacactgcccgccctgcaggaaaaggtttgcgttaaaggcggtgtaaccggtgagggaattaaggcgctggaaagcggtgttcaggatatgttccgccagatgttccgaaacacccatttgaagtatgaagaagatatcgctctagtcaagaagcaattttccgtttga

SEQ ID NO: 2642 - DNA, 756 bp, Bacillus licheniformis
atgatctataaaggattttccagtatttatgacaagctgatgtctcatgctccttacgatcagtgggtcagctggattgaacaaacgatcggcgcgcagcagaaagaacgtatacgggtgcttgatctggcgtgcggaacgggtgaaatatctgtccgcctggctgaaaaaggctatgatgtcacaggaatcgatatcagcgaagacatgcttgcccaggcccagtacaaagcagccgtcaggcagctcgatattcagttctttcagcaggatatgcgcgaacttgccgggcacggacaagagtttgacgcggttgcgatctgctgtgactcgctgaattatctaaagagcgaaaaagacgttttcaatacttttaaaaacgttttttctctattaaaagagggcggtcttcttctgtttgatgttcattccgtttacaaaatggatgtcatttttccgggaagtacgtatgccgatcaggatgaagaagtgagcgtcatctggcaaagctatgcgggggaagagcctcattcagctgttcacgatttgaccttctttgtacaaaatagagacgtatacgaaaggtttgatgaatcgcatgaacagcggactttccagacggaaaagtacatcagtttattgcggcaagccggatttgaggtgcagtgcatcagtgctgatttttcaaaattggagcctagcgcagagtcggaacgtcatttttatacagcaaaaaaaacaaaaaccatcgtttaa

SEQ ID NO: 2643 - DNA, 357 bp, Bacillus licheniformis
atggatcaagcttcaattttaaaaattgccgcagaggcctgcgatgataaacgggcggaagatattatcgccttgaatatgcaggggatttccctcgtggctgactattttctgatttgccatgggaactctgacaaacaggttcaggccattgcccgggaaattaaggatcaagctgaagaaaatggaattgatgtgaagaaaatggagggctttgacgaagccagatgggttttaatcgatttgggcgacgtcgttgtccacgttttccacaaagaggaacgaggctattacaaccttgaaaagctgtggggagacgcgccgattgaagacctttcgttcggagttaatgaatga

SEQ ID NO: 2644 - DNA, 564 bp, Bacillus licheniformis
atgaaacgtgaggaagccttagcctgcgtgaaagaacagctgacagaacagcgctacatccatacggtcggcgtgatggagacggctgtcaaacttgctgaacggtttggcgcagatctgaaaaaagccgaaatcgccgcgatctttcatgactacgccaaatttcgcccaaaagaggagatgaaacaaatcatcctcgacggaggcgggccgcttgaagtgctcaattttcatcatgaactttggcatgcgccggcaggagcagcgcttgtcaaaacagaggtcggaattacggatgaagacatcctgtcagccattcggttccatacatctggaaggcccaatatgactcttcttgaaaaagtggtttatgtagcggattatatcgagccgggccgccgttttccgggggttgaagaggttcggactctcgctgaggaagatttggattcggcgctcatccaggcattgaaaaatacgattacctttttaatttcaaaaaatcaggccgtttatccggaaacggtcgccacatataatgctttagtaaacgatagacattag

SEQ ID NO: 2645 - DNA, 570 bp, Bacillus licheniformis
atgaggaaaatcgggatttttggagggacattcgatcctccgcacaacgggcatttattaatggcaaatgaagtcctgtacaaactggatcttgatgaaatctggtttatgcccaaccaaattccgccgcataaacaaaaaaactcgttttcactaagtatgcacagggttgaaatgctgaagctcgccatttcggggaaagagcaatttaaactggagacgatcgaactcgaaagggaaggcccttcttatacatttgataccgttcgcctgctgaaagaccgataccctgatcatgagttttactttattatcggcgcggatatggtggaatacctgccgaaatggtcaaacattgacaagcttgtcaacatgattcagtttgtcggggtgaagcggcccggctttcaaattgagacgccgtatccgctcgtttttgtcgatgtgcctatttttgaagtgtcatcatctttgctcagggaccgcattaaaaatcggcagccgacagattatttaatacctgacgaagtgaaggtctatgtgaaggagaatcgtttatatgaaacgtga

SEQ ID NO: 2646 - DNA, 291 bp, Bacillus licheniformis
atgctaacaggaaaacaaaaacgctatttgcgccgggaagcgcatcatctgtcaccgatttttcaagtcggcaaaggcggagtcaacgaaaatatggtcaaacaaatcagcgaagctcttgaagcaagagaattgatcaaggtgagcgtgctgcaaaactgcgagcagcctaaagaggaagtagccgaagcgctggcgggcggagcgcgcgccgaactggtgcagacgatcggaaacattattgtgctgtataaggagtcaaaagaaaataaaaaaattgagcttccttaa

SEQ ID NO: 2647 - DNA, 837 bp, Bacillus licheniformis
atgaaaccgatatacggactgattggcaatccggtggcccattccatgtctccggacatccataatgcggctttgaaggatctttctttagaagggcattatcacgcttttcgcgtggaaaacgaagatcttgaagatgctgtgaaaggtatgcgggcccttggcattcaagggtttaatgtgaccgtcccccacaaagtatcgatcatgaagcatctcgaccgtattgatgaaagcgccgaagctctcggggcggtaaacactgtcagaagagaaaaagaagggctggtcggatataatacagatggagcagggtttcttaaatcgctgaagccatcccttgatcgtccgctttctgagctctcgatactgttgatcggagcaggcggtgcggcgagggcgatatttaccactctggcagccgagacgcccaagcggcttgatgtggcgaatcgtacgcctgaaaaggcattagcattcactcagcgttttgatggagaggcacgcgccttgtcactgcaggaagcggaagcagacttgtcagcatatgatatcgtgattcaaacgacgtcggtcgggatgcatccgaatgtcgaagctgccccgctttcattggcgaatgcgaaagaaacgtgccttgtatgcgatattatctacaatccgctgaaaacggccctgctgcatgaggctgaagcaaaaggcttgaaaacattggacggagtcggcatgttcatcggccaggcagcccttgcttttgagctgtggacaggacatgagccgaatatggaaaaaatgaaatcaattgtgttgcagcaactaggaggaaaatcatgctaa

SEQ ID NO: 2648 - DNA, 1101 bp, Bacillus licheniformis
atggaaaaggtagtttgtatcggatgcggagtcgccattcaaaccgaagataaaaataaactgggctatgcgcctgaagcatcgctgttaaaagaagacgtcatctgccagcgctgcttcagattgaaaaattataacgaaattcaagatgtttcactgacggacgatgactttttgaagattctgcacggcatcggggaaacggattcactcatcgtgaaaatcgtcgacatctttgatttcaacggaagctggatcaacggactgaaccgctttgtcggaggtaatccgatcttattaataggaaacaaagcagatattctccctaaatcagtcaagcgcgagcgccttgtaaactggatgaagcgcgaggcgaaagagcttggcttaaggcctgttgatgtgctgctcgtcagcgccgggcgcgggcaggggatgaaagatgcgatcgacgcgatcgaacattacagacaaggcaaggacgtgtatgtcgtcggatgtacgaacgtcgggaaatcaacgttcatcaaccggattattaaagaggtttccggagaagacgacattatcacgacatcccaatatccggggacgacgcttgatgcgattgaaatccctctggatgatggatctgcgatgtatgatacgccgggaatcatcaaccatcatcaaatggcgcactatgtcgcgaaacgcgatctgaaaatattgacgccgaagaaggagctgaagccgcgcacctttcagctgaacgaggaacagacgctgtttttcggcggattatcgcggtttgattatgcaagcggaggcaggtcttcgtttgtatgctatatgccgaatgaactcaagatccatagaacaaagcttgaaaacgcggatcagctgtatgaaaagcacgctggggaaatgcttgctccccctgcaaaagaagatcttgactcgtttccggcgcttgtcaaacatacgtttacgattaaagagccgaaaacggacgttgtgttctcgggccttggctgggtaacggtccagggggcaaaccaaaaaattgtcgcccacgcccctaaaggcgttcacgtgtttttgcgcagatctctaatataa

SEQ ID NO: 2649 - DNA, 519 bp, Bacillus licheniformis
gtgttaaaaaagttttttttgccggatgaatttgtaaaaaatatttttcatattacccctgaaaaactaaaagagcgcaatgtaaaagggattattacagatttggacaatacgcttgtagaatgggacaggccgagtgctacaccgcgtcttatcgagtggtttgaagagatgaaagagcacgggattaaagtgacaattgtctctaataataatgaaaaacgcgtcaaaatattttctgaaccgcttaatattccgtttatttacaaagcgaaaaaaccgatgggcagagctttcagaaaagccgttaaaaatatgggtcttaaaaaagaagacgtcgttgtcataggagatcagctcatgacagatgtgcttggagggaaccgcaacgggttccataccattcttgtcgtgcctgtggctgcttccgacggcttttttacgcgtttcaaccgccaagtcgaacgcagaattctcagcgctctaaaacggaaaggccatattcagtgggaggaataa

SEQ ID NO: 2650 - DNA, 141 bp, Bacillus licheniformis
atgaaaaagctgtctgatgaacttttaatagaatcatacattaaagcaaatgagatgaatttgaaccgcgaattcatcgagctgattgaaaccgaaatcaaaagaaggtcgctcggtcatctgctttccgtctcttcatag

SEQ ID NO: 2651 - DNA, 156 bp, Bacillus licheniformis
atgggatatccttttcccgctggtccgtgttcgtacccggcttatcccggatatgcaggcgccgcatacggatatgcgttcgttgtcgtccttttagtcgtcctgctggtcatcggcgggttctactggcttagtcctcgcggattcttcaaatag

SEQ ID NO: 2652 - DNA, 747 bp, Bacillus licheniformis
ttggaggtggaacgaatgaaaaaaagcttggtgatggttctcgtttttctgcttctgctttcaggctgcggagaggacgatcccagaaaagtcgtagcatttggagacagcaatacacgcggctcaaattggcaatttcgcgattatccaaaagcggaaaagtgggtcaatttacttcagacttcccttcaagggcagtacaaaataaataatgcaggaataggcggagaaacgacggaagacgccaggtttcggttcaggaaggatgtgctggacaagcagccggcatatctttttatcatgttcggaacaaatgatgcagcaattcttacgaaagggctgccgcgcgtatccaaaaaaaggtttaaagaaaacctttattattttgttaaagaaagccgccgccgcgggatagagccggttttaatgacgtgcctgccgatcgtcgaaggaagcggggacaacatcttttattatgcaagataccgggcttcttcgtttgaaaaatacggtggagcgcgtaaatggcacgattcctataatgacgtcacaagggaaacggcgcgggaacttgatgttccgcttatcgacaactggaaaaacatcgtgaaaaaagcgggcggagctacagatgagaagctgatccattcgaggtttatcgacccatcgggaaatcacttaaccccaaaaggcgcgcgaattatttttgaaggaattaacaaaagcaaaatcataaaaacgtcttga

SEQ ID NO: 2653 - DNA, 762 bp, Bacillus licheniformis
atgattgaactgaaatcgagtgaaaaacgaaaagcaaaggctttgttagcggaagaaagcccgacattcgcgcatgcgatagccgaaggaatcatcgaaggaaacgtctatgtcgatgatttcctcacaccggccactgctctttttcgaacatcttccgggatttattatgtcgctggaaaccctccggacagcggaagaagcgagtggctccattatttaaatgaacagaggagcggagcgcgctttaccgtgttttcggcttctgaagagtgggacgcttttttaatcggggggcttggcgatcctctgcagcaaatggagcgcgtgtcatttttcctcggaaaagaggagcgtgattgcggcgcagcatttgccggggttgaaagatttactgaagatgaccttcaaaaaagcgcgaattttactgaaaaatacgctgatgagtattggggaggggccagccgttttttgaagaacggtttcgggtttaaagtgttgcatggaggtgtggtcgcaagcgaatgtgtcaccattttttgttcggaacgctttgccgaagttgatatcgcaacacacccggattacagggggcggggatttgcagtcagctgcgccagcgcctttatcgcacatgcaataaagaaccgtttgaaaccgcgttgggattgcgaccggcaaaaccgcgcatcgatccgcctcgctgaaaaattaggttttcgacctgtcaaaacttattctttatttgtcggaaaaccgtga

SEQ ID NO: 2654 - DNA, 372 bp, Bacillus licheniformis
atgtctaaaaaaatccatgaattcaacgatatgattcgcaagcttcgaaaagagctgtttggcaaggggcctgaacggatacgaacggtctttgtcgacaatatggcagtttcgacactgtacggcaatttgacggcgagcgagcagtttatcgcaagcacgccggagggaagggaaatggtgcatgcggcaaggacgaccctgattcagaaacactactccaatcacgtgccggaaggaatggaggagcttatcggagcgaagctagagcacctttttacggacatcaaaattcaggaggatattgcagtgtctgtttttatctttgaccgcaatattgaaggcgtcgccgaatcagccggcggggcttga

SEQ ID NO: 2655 - DNA, 2940 bp, Bacillus licheniformis
atggacggaaagccaatcagtatccggatagacggcaaagaatttgaagcagtggccggggcaaccgttttagacatattgaacaaaaacgggtttgaacacccgcaaatatgccatgtaccagagacggatcctattcaaacgtgtgatacgtgtattgtggaagcagacggaaaattaaaacgggcatgctccctgcgggctgaagacggaatgacgatcagcctgtcagcagaacgggtcaaagctgcacaaaaagaagcaatggaccgcctgctcgaaaatcatttgctctattgtacggtatgcgacaacaacaacgggaactgtaagctacataatacggcagaaatgatgggaatcgaagaccagaaatacccttacacgcctaaagaagacccgtcttgcgccgtcgatatgtcacaccccttttaccgctatgatccgaatcagtgcattgcttgcggacaatgtgttgaagtttgccaaaacctgcaggtcaatgagacgctctcgattgactgggagcttgaacggccgcgggtaatctgggatgaaggcgtatcaatcaacgaatcctcatgcgtcagctgcgggcagtgtgtcacggtctgtccgtgcaatgcgttaatggaaaaatcaatgcttggaaaagccggtttcatgacaggcatcaaaccggatgtcatggagccgatgatcgaccttgtcaaagatgtagagccgggatacagcagcatctttgccgtttcagaagtcgaggcggcgatgcgttcacagcggaccaaaaagacaaaaaccgtctgtacgttctgcggtgtcggctgttcatttgaagtatggacaaaaggccgtgacatcttaaaaattcagccggtttcagaagctccagtcaatgccatctcgacgtgtgtgaaagggaaattcggatgggatttcgtcaattcggaagaacgtttaaccaaaccgctgatccgcaaaaataacgaatttgtcgaatcgacttgggaagaagcgcttgactacgttgcccgcagattaggctcgattcgggagcagaacggaaaagacgcagtcggatttatttcgtcttcaaaaatcacgaatgaagaaaactacttaatgcaaaagctggcgcggcaagtatttggcactaacaatgtcgacaactgctcgcgctactgccagtctccggcaacagacggattgttccgcacggtcggcatgggcggcgatgcaggcaccattcaagacatcgcgaaagcaggcctcgtcatcatcgtcggcgccaacccggccgaaggccacccggtactggcgacccgcgtgaagcgcgcccataagcttcacggacaaaagctgatcgtcgccgatcttcgcaaaaacgaaatggccgaacgctcggatctgttcatcagaccgcggcaaggaactgatcaagtatggctgatggccgtgacaaagtatatgatcgaccagggctggcacgatcaggcgtttatcgatgaaaacgtcaatttctttgaggaatataagcaatctcttgagacatacacccttgaatatgcagaaaaaattacaggcatccataaacagacgctgattcaaatcgctgagatgatccgcgacgccgacggtacatgcattctttggggaatgggggtcacccaaaacacgggcggttccgacacgtccgcagcgatttcaaacctgcttttagctaccgggaattaccgccgcccgggcgcaggagcttacccgctccgcggccacaacaatgtccagggcgcctgcgacatggggacgcttcccggctggcttccgggatatcagcacattacagatgacaaagcgcggaaaaagttcgaacaagcttacggcacaacaatcgacgaggagcccggacttgacaacattgaaatgcttcacgccgttgaagaaggcaaaatgaaagccatgtatatcgtcggagaagatatggctttagtcgattcaaacgcaaaccgggtccatgacattttatcaagccttgaattccttgtggttcaggatgtgttcctttcgaaaacagctcaatacgccgacgtcgttctgcctgcgtcagcttctcttgaaaaagatggaacttttacaaacacggaaagacgtgtccagcggttgtatcaggcgctcccgccgctcggagatgcgaagccggactgggttatcattcaagacatcgcaaaccggcttggagctgactggagttacagccaccctggcgacattttttcagaaatggcaagcctgtctccgctgttctccaaggcggattatgacgcaattgaaggatggaacagcttcctgtggggcagcttgaccggagaaagcacgcctcttttgtatgaagacggctttaactttcctgaccggaaagcgcgctttgccatcgcagactgggcagagcccgccgaatttcctgaggagtacgaccttcacattaacaacggccgaatgctggagcattttcacgaaggcaatatgacaaacaaatcggcaggcatccaggcaaaagtgccggacgtctttgtggaagtctcgcctgagctcgccaaagaacggggcatctgcgacggatcgcaggtcaggctgatctcgccgtttggcgccgtaaaattaacggcgcttgtgacagaccgggtcagagcgaacgaactttatctgccgatgaactcgacagataaagaatcggcgatcaatttcttgaccggtcccgcagtagatgcgcgcaccaatacaccggcttacaagcagaccaaggttcgtatggaagtgctcggcggatgtgcagaaccgccgcttccgaaaacaaatccgcgcaataagaaacgccatccgcaaaacggggctgaagtcgagcggaaatggaagcgtccggggtacgttcatttaacagactaa

SEQ ID NO: 2656 - DNA, 480 bp, Bacillus licheniformis
atggcagctcccatcaccgccatccgcaaagaagaaaaatctgaggagcaaataaagcttgaaaaactcgaagaactcaaagcccttttggctgaacaggaagccgccgtttcaaaaacgatgaagcttctcggcgaactgaacggcctcgggatccttgatgccgcagacagcatgatcggcgcgaaggaagacatcgccaaaatcgtcctcggccagctgtccaaagagccggccaaaaacctgatgaatacagccattgcagcaggcggcgctctctccaaagccgaaccggaagtcatggggaaacttgtagaaagcatcgtcgccggcacaaaacaaggagaggactttttaaaaagcgataaaaaaaccggagtcctcgatctgctgaaagccatgaacgatccggacatcaaccgggccgtcggcttcggcctgcaatttttaaaaggcatgggaaaagcgctgaaagaataa

SEQ ID NO: 2657 - DNA, 243 bp, Bacillus licheniformis
gtgagggtgccggacggttcaccatatcgtaaacgctatcaaccagccggtccggtgcggcagatgaaaaacaaacgtctgttcatactttcgttgattgtgttgagcgtggtcatgatcggagttcaggaaaccttcccaaacctgctgacgacagggttaatgactgtcgttattgcggcggcagtttttaatattttaaaagaatcgctgaataaaaaagatgaaacacacagcaaatga

SEQ ID NO: 2658 - DNA, 726 bp, Bacillus licheniformis
atgacaggtgtttttgcagcgctcggttatgtcatcaaggaactcgtttttttagtatcatatgtgaaaaacaatgcctttccacaaccgctgtcaagcagtgacgaaaaaaagtacttggagctgatggcccagggggatgaacacgcgagaaacatgctgatcgaacataacctccggctggtcgcccacatcgtcaaaaaattcgaaaacacaggcgaggatgcagaagacctgatttccatcggaacgatcgggctgatcaaagcaatcgaaagctattcagccggaaaaggaactaagctcgccacttatgcggcgcgttgtatagaaaacgagatcctcatgcatttgcgcgcattgaaaaaaacgaaaaaagacgtctcactccatgacccgatcggccaggacaaagaaggcaacgaaatcagcctcattgatgtcctcaaatcggaaaacgaagacgtcatcgacaccatccagctcaacatggagcttgaaaaagtgaaaaaatacatcgacatcctggacggcagagaaaaagaagtcatcgtcggccgcttcggccttgatttgaagaaagagaaaacacagcgcgaaattgcgaaggagcttgggatttcgcggagctatgtgtcgcggattgagaaacgggcgctgatgaagatgtttcatgagttttatcgggcggagaaggagaaaaggaagaaggcgaaggggaagtga

SEQ ID NO: 2659 - DNA, 468 bp, Bacillus licheniformis
atgatcagtcttgtttttccgcttatcttaatcaccgataaaacaagtttgatctggatttccatcgtattgttcatccgctgcaccagtatcgggggaaatcttccgttggcgagtgacgcttatacagggcttgacagaaaacaacttccagaagcaggtgtcggtattaataatattgaaaaccctggttcaagcttcggttcagctgtgatcgcaaccgttggcgcaactgtcatggaaggattgcaaccaacgattgcgaatagcttaaaaggttatcatgccgggttcttagtttctacaattgtccttgccataatcttcatcccacacataaaaaagccaaataaacaaatgctcactggtgaagtttacacgctccaagagcattcaaaattggctgatttattccatacggggaaacttcatcaagcagaagacgcgcccgttacccagccaaattag

SEQ ID NO: 2660 - DNA, 525 bp, Bacillus licheniformis
atgattttaataagaaaagccaaagtgtcagacgctaattcaattgccaaagttcatgtggaaagttggaaaaccacatatcaaggagtattgcctgatgacacgttatctaagctttctgtcgaaaatcaggcaaagctttggagaacttcattaagtgatcctaaaaatcaagatattgtctatgttgcagaagaaaccgacggtaaaattataggctttgcttccggaggtccaaaccgcgatcatcttagcaaatataagggtgaagtttccgcgatttatctgttgttacagtatcagaaaaaaggaatcggatctcgactaatgaaggcgattgtagaggagcttgtaaagaaaaacataaaatcattattggtatgggttttagccggtaatccatcgataaatttttatgaaaagctaggtggaaggcagagcacaacaaaacaaatacaattcggtgaagattatttcaaagctattgctatcggctggacggatataaatggttttttgttataa

SEQ ID NO: 2661 - DNA, 351 bp, Bacillus licheniformis
ttgaatgaggcttgtcagcatacaaagaagtacaaggggactataacaaataacgtttcggcaggcactttggttggagcggcaatttctttgacaggtatagacaagggttcctgcgagcagagtaaaacaaacagttttgaccataacttcattagctgttcgaatgaagagttattgcaagaactgacagagataactcctgttgaggaatcaatggaaattagcattttaattcaagaccccgaaaccaatgttgcttattatatcaattcagggaagctaataaaatataaatgtaatctcccagaattttgggggagatatacctcaggaagctctagttcctag

SEQ ID NO: 2662 - DNA, 269 bp, Bacillus licheniformis
atgtcctcgggatcagaaaacgaagacgtcatcgacaccatccagctcaggcacaggcctgaaaaagtcaaaaaatacaacgacatcctcgacggcagagaaaaagaagtcatcgccggcgcctcagccttgatttgaagaaaaaaacgcagcgcgagatcgcgaaggagctcgggatttcgcgctgcgatgtgtcccggattgaaaagcgcgcattgttcaagatgtttcatgagttttaccaggcggagaaggggaaagggaaatga

SEQ ID NO: 2663 - DNA, 1233 bp, Bacillus licheniformis
atgagtccgaatcatcacaaactattttacaaagatccctatctaaaaacgtttgaaacgaaaatcttgaaacaacaacaggacaaaaaaggtgatgtttatattatcctagaggaaacagccttttatccaacaggcgggggccagcctcatgatacaggaacattgaacggagtcaaagttttaaacgttgatgagatagatggagaaattcgtcattatgtagaaaggcctttgccgcatttaaatgatcaggttgttggggttattgattgggagcggcgttttgatcacatgcaacagcacaccgggcagcatattttgtcggcggcattcgcgcagctgtatgatcttcatacagttggattccatcttggaaatgatacggttaccattgaccttgatgtatcagaattaacagaggaaatggcaggcaaagcagagaagcttgcaaacgagatcataacggaaaataggtccatagtcgcaaagtgggtagaatatgatgacttagtaaattatccgattcgtaaactcccatctgtaaaagaaaatattcgtcttgtcatgattgatgaatttgattacaacggatgcggcggaacacacccgagcgctacaggagaagtcggagcaataaaagtattgaattgggaaagacagaggaaaaaaattcgtctgtattttgtatgcggtaatcgggtcataacccaattcgatcaaaaacaaaaagcaatcgttgaattgactggattacttaatcgtcctgaaggggaattaagcgaagctatcaaacggttgcttgaaaatgtaaagaagctagacaaagcgcttctagaatcttatgaaaaaaaccttcagtatgaagccaatgaattattagcaaaaagcgcaattcaaaatgatactgtaatggtgatagaaacgttttcagatcgatcgattcaagaacttcaaaagctagcaaaaatgattgctgatcgagaaaaacgggcccttatttttttcttgtcagagaacgatcatcgcttccaattggtttgcgggcgaggtgaagcaaataaaatgaacatgagagacctaatgcaagaagctctttcccttattgatggaaaaggtgggggaaataaaatgttcgctcaaggtggagggactgcttcattcacaaaagagaaatttatgaaaaatgttatgaacattatagcaatacaaataaactcagaagaaaattaa

SEQ ID NO: 2664 - DNA, 1107 bp, Bacillus licheniformis
atgaatgatttacaattagatacaccagctcttttaatcgataaagacgtgatgttaagcaatatgaaggatatgcaaaattacgctaacgaacagaaggtaagcttacgccctcatacaaaaacacataaaatgcctaaattagctaaactgcaagaagagatgggagctgtaggaatcgctgtagcgaaagtaggagaagctgaagtgatggcgagaaatggcttaaaagatatctttatcgcaaatgaaattgttgggaaatcaaagcttgaacgtattagaaaactatctgaaacgattgatatctcttttggaatcgatagtgcgtatcaagtacgtgaaattgaagaagtatttgaaggagcttcaaagaaagcccaagtgttggtggaaattgaagtaggagaacaacgctccggaattattgaagaagatgattttcgtactttattagaattaatcaaaacgtgtcaaaatgtcgagctaaaaggaatcttctcacatgacggacattcttataaagcgaaaagtgtagcccattgtaaagaactctataaagaaagtgtagaacgaacattacatttcgcccgaattgcggaagaaatggatctaaagccgaaagtggttagtattggctctactcctcccttcatgtttaagtttgatattccagaaggggtgacagaaatcagacctggcacttacatttttatggacgcctcacaagcaaatgtaattggtacgtatgatcgctgtgctgcttctgtactcacaaccgtgattagtaaaccaacaaaagaacgagtcattacagacgtaggggccaagggaattaccgcccaaacacgaagcgaagggcttactgcaaccaaagggcttggccgtatcaaagaatacgaggacgtttatattcatggcgtattcgacgaacatgctattatttatcatgaagaattcaacaaaaaagtaagcattggagataaggtgcgaattattccaaatcatatctgcccagtatgcaacttgcacgataaagcctatttagtcgataatggagaggttgtagatgaattaaatattgaagctagaggaagacttcaataa

SEQ ID NO: 2665 - DNA, 390 bp, Bacillus licheniformis
ttgaagcctgtacacacgaagtattcaacacgggatgggggccattacgtgccagctatggaacacaatgatgttctctatatttcagggcagttgtcgatgaatccagaaacgggaaaaattccagctgggggcataaaagaagaagcaaaacaggcattggcaaatatggagcttgtcctcaaggaacggggattagccaaggaagatgtgatattatgcagactttataccccagatgtaaagtattggccggatatcaatgaggtctatgctcatttcttcggcaatcataaaccggcaagagtagttgttccatcaaatcatttatatgccgggtgtcttgttgaagttgaagccattgcagcgataaaggaggaggcacaatga

SEQ ID NO: 2666 - DNA, 975 bp, Bacillus licheniformis
atggaaaacaagaaaatcattttgctgagtaccggcggtacaattgcaagtaagcctgatcctgaaacaggtctattagaagcaggtgctatgacaggtgaagagctttctgaaatgtgtcgactgccttctcatatagagattgaaatcaagtcagccttttaaatgtcaagcagtcatatgacttttcatcaccttgacattctcaagcaaaatatagagagtttcttccggaatgaggatgttgccggaattgtgatatcgcatggaacagatacccttgaagagacttcgtatttccttcatctggttatttctgatgaaaggccggtcgtgttaacggggtcgcaaagaggaccgacacttgaaggtacagatgcgtttgtgaacctaagacaagctttcttattagcggcacatcctgatgcgcgaggcttaggggtaacagtgttgtttaatgagagggtttttgctgctcgatatgtgaaaaaacagcatgcgtcaaatgttgatggttttttctcaccgggattcggttatttgggaactgccgatcaagatgagatcgcaattcatcaaagattaatcaagcgtgagacgtatcagctgattcaaccattaccaaatgtggaacttattaagtgttcacttggatcagacggaaagtttatagattatgcagttaagtgcggaagtgcaggaatcattattgaggcgccgggaagagggcatacggctccagcaatattagaaagtgcaaagaaagccgcagagaaagggattcctgtcgttctgacaacaagtgctcacgaaggtgaagtcaagggagtatatggattcaaaggaagtgcttcaacatatgcagatgccggaatcatacttggcggcagctatgacagtaagaaagcaaggatcaaactcgctgttttgctggctgctggacagaagattgatgaggctagctttaaatattaa

SEQ ID NO: 2667 - DNA, 1104 bp, Bacillus licheniformis
atggaacagtatcaatgtcattcttgccgtacgaaatacaatgtgtctgaacaggtgtggaaatgccagtgtggcggagtgttagaccttgtaaaagaaaaagtagaatggtccgattcaaaagtgctcaaagatattccttctatgtggagatatattgaagctatgccatttgatcgcgactccgccatatggagcggcatcaccatgggggagggatacacgcctttaatcgtgttagacagcggggagccgaatactcttgtgaaagtggactatatgatgcctactttgtcttttaaagatcgcggtgcggctgtattaatagctaaggcaaaggagctgggagtgaagcatgtgatcgccgacagcagcggaaatgcagggacatctattgcagcttacgccaagcgggctgaaatcgcatgtgacatctttcttcgaaagggtacatcgcctaagaaaatcgcgcaggcgaaagcgcatggagccaacgttcgcgaaattgaaggcacaagagaagatgtggctgaagcagcgcaaaaggctgtggatatagagaaaaaattctatgccagtcacgtttttaatccatatttctatgaaggaacaaaaacgtatgcctttgagatttgggaacaaatgaatggagcgccggatacgcttattattccagttggcaatggtacgttattgcttggggtttactatggatttaaagagttattagagaacaaatgtatagacaaaatgccaaggctggttgcgatacaggcagagaattgtgcgccgttggcaaaggcatttatcaacaatcaaaaagctgctgaacccgtcaaaagcagcggaacacttgcagagggcatcgcgattgccaaaccggcaagatctgctcaaatattagaaaccatccgtgccacaaacggtcaaatcattacaaccaatgaggaagagattctaaaagctcgtacagcattagcaagtaaaggcttttatgttgagccaacaacagcggctaactatgcaggatatttaaaatacagtcattcttctgatgaaaaaatcgtgattccattatgcggggctgggattaaatctaattag

SEQ ID NO: 2668 - DNA, 375 bp, Bacillus licheniformis
gtggagagtatttttgaggcagggaatttaaaatcgaacggtcattatgccttagctgtgattcatcaaaacacggtctatgtatcagggcaatttgccattgatccaatcacgcaggaaaagaaatttggcaccattgaagaagagactttgcaggtattgtcaaatatagagtatatcttaaaaaaagccggcagtcataaaggaaaaattttaaagataaccttatatcttcacgatatcaatttgttagaccgtgttgacaatgtctgtcagggtttttttcacgattatcgcccagcacggtcagttgtttcgacgaccgagctgcattacggttttcaggttgaaattgaagcaatcgccagtctgtaa

SEQ ID NO: 2669 - DNA, 666 bp, Bacillus licheniformis
ttgactgaagcaaaacaggttttaaaaagttacataccatttgcaaaaacgataggggaaatgtttggtccaaattgtgaggttgtcattcatgatttgacaacccccgagtcttccgtcattttcacaatcaacaatcatgtaacaggaagagaggttggccaatcctttgaccatttggtgaaaaaagttcttttatccaatgaatttaaagaggattacttagctggatatgaaatccaagcagatgatgggagaacaataaaatcatcgactaccctcattagagatggccagcagcaggtgattggggctttttgcatcaattacgacatgaatgtaatgattcaaatgaaagaaatgttagatgcatttatgcctggtgttgaaaagaaaaatcaaatacaaacttcgaatacggcggagcaggaagcttcgattcagaatgtagaagagatcacgaaccagttaattgaacaaattgtagcgaaccgcaaacactctatgatgaaacgccgggaaaaaatcgagctgatcaggtttatggatgaaaaggggatattcctcatgaaaggtgcggttgataaagtggcagaacaattaggcatttcaaaggtaactgtctacagctatttagatgaagtaaaaaaaagacaatcggagtga

SEQ ID NO: 2670 - DNA, 381 bp, Bacillus licheniformis
ttgttcggtatctttttagttcagtccctcaacctattaaaacctgtgagtggcattgaaatcagcctcattgatgccctcaggatcggaaaacgaagacgtcatcgacaccattcagttcaagcacagagcttgaaaaagtcaaaaaattcattgacatcctggacggcagagaaaaagaagtttattgccggccgctttagccttgatttgaagaaagaaaaaacgcagcgggaaattgcgaaggagctcgggatttcacggagctatgtgtcgcggatagagaagcgggcgctgatgaaggtgtttcacgagttttaccgggagaagaaggagctttttcctaatttggaatataaaaagaccgcaaagctttcttaa

SEQ ID NO: 2671 - DNA, 570 bp, Bacillus licheniformis
atgagagcaccgattgatgaacccatttggtacgcctatcccggcatggtagctgtcgttacggctcaatatgaaggtgaaaaaaacgccatggcctccgggtggcatacgtatatcggatcttctcccggaatgtatgggatatcgttaaataatgagacatttacttacaaattgattgagaaaagtggcgttttcggtgtgaattttcttccggggagatgctcggaattaattcaagcattaggcacccacagcggcagagatatcaataagtttgaagcatttcatattcaatacgaagaagggctaaaagccgaggtaccgattttaactgatgcatattttgcttatgagtgtaaagtacacagtatttccactttgggcgatcaagagtggattgcgggagaagttttacagagatatcaagataaagagcttttcttaaaaaaaggcatgccgaatttagaaaaattggatgttccgcttcatattggagggtccagctatcgcatattaaatagtcaagcagaggaacatcaacacgcatttaattccgaagctgattga

SEQ ID NO: 2672 - DNA, 846 bp, Bacillus licheniformis
atgaaggaatatttttcaatcggggaaacagcccgtctaaataacatttccattcaaacattgcgctattatgataagatcggaattttcaagcctcaatgtacagaccgggataacggctatcgatattaccatgttaaacagttcttttatttggatattataaaatatctcaaatccattaaaacgcctttggaagaaattaagcgcattatctcacatacatctgcccctgaactgatgcaaacctttcttgaggagcaagaaaacgttattgagcgtgaaatggaaaaactcgaacgtgccaggcaattgcttcaaagaagaaaggaccagcttcatgaacaattggagatacgcgctaaaaaagaagaaggtctggtgtatgttcggcatatagaaggccaaaccattttaaaagcagcgacacctcaagtgaatcctcatgaccaatcagatttgtattaccgaaaactggctgaggtcctggaagaaagaggagatatggtcgataactattatggactgatttatgatttaaagccttataaaaattcaggtgacatttattgcaacagtgtttatacgacgatttacgatggagcaaagatagatacagaagaacaaaatattgggatggatacgatcccatccggtgaatatgtgtgtatttcatttgattgctcttcaacaaattatttttcatactatcaaaaactgtaccattttattgaaactcatggcattcaaacggatggaaaagtatatcaagtttcttttccaaacagctataactcattaaaagaagaagacttcctcacagaattcagagtgctgaaaaaataa

SEQ ID NO: 2673 - DNA, 1434 bp, Bacillus licheniformis
atgttattgcgctatttttacgataaaaaactggcccatgcatcctatctggttggctgccaaaaaacaggggaagccattgtgattgaccccggccgcaatctaaaaccatatttgcaagcagccaaggaagaagggctaaacatcacagcggccgcagaaacccatattcacgccgactttgtttccggtgcccgcgaactcggcgctacacatcaagcgaagctgtatctttccgatgaaggagacgcaaattggaaataccaatatgtcgatgaatcgaaacatcaacttgtgaaagacggcgatcgcttttccattggtaacctgatgtttgaggttatgcatactcccggccataccccggaaagcatttctttcctgttgacggacggcggaggaaatgcggatcgtccaatcggcatctttactggagatttcgtctttgcaggcgacatcggcagacccgatttgcttgaaaaggcggcggggattaagggaacgtcagagtcgggggcaagagcgatgttcaagtccctcatgaagtttaaacagctcccggattacttgcaggtttggccggctcacggcgcagggagcgcttgcggcaaggcattgggagccattccaactacgactgtcggctacgaaaagatgtttaactgggcaatggcttacaccgatgaagaggaattcgtaaatgccttgcttgatggacaaccagaaccgccgaagtattttgctgagatgaaacgagtgaataaagaaggccctgcattgctcaaagatctttctgccgttttagagattatgtcgattgaacaagtgaaagatttgcaggggaaagagcaaattgtggatacccgctcctcccgggaatttgctgaagggcacctcaaaggcacgatcaacattccattcaacaaggggtttacaaactgggcaggctggctcatcgactacaatcgtcctgtgtacttaatcgcgaatccggcagaagtgaacgaactcctggaagcgctgcgctccgtaggcattgacaacgcggcagggtttatcgatcgtgacaaaatcttggcagacggtgctttttcacttgaatcgtacgctgagatcacaccacgtgagatcgcaaaattagtggaagacggctttgtgcaagtgcttgatgttcgcaatctgactgaatggcaggaaggtcacattccgaatgcgcaacacatcatgctgggaacgctcccagaacggctcgatgaaattagaaaagactgtccgattcttgtgcaatgccattccggagcccgatctgcaataggagccagcatcctgcaagctaacggtagtttcaaacaagtattgagtttaagcggcggcattgtccaatggcagaaagacgggcttgcaatttcaaccccttgcagcgaattaaaatga

SEQ ID NO: 2674 - DNA, 1200 bp, Bacillus licheniformis
atggcaagacatgctcgttattccattgtcattgtaggagccgggactgctggcatctctgtcgccgcccgtctcgtaaggatttctaaaaaactcaaaggacaaattgccatcattgacccgcaaacaaagcactactaccagcctttgtggacattagttggaggcggcgcagcgaagaaggaagagtccgagcgagatctggcttctttaattcccgctggtgtcgacttgatcggcgatgctgtaacggagtttcggccgaatcagaacacacttcttacaaaacaaggaacgatcgtttcctatgattatcttgttgcagcagccggtttgcaaatcgattgggacggggtcaaaggcttgaaagatgcggtcggaaaaaacggggtttgcagcaactattcatatcatacggtagacagcacttgggaaaacatccgcaattttaaaggcggaaccgccattttcactcatcctgattctcccgtaaaatgcgggggagctccacagaaaattatgtacttagcagacgactatttccgcaagtcaaatgtccgccatcagtcggagattatttttgcatcggcgaaatcgatcatttttgatgtcaccaaatacgcaaatgcgctcgaaaaagtcgtcctgcgcaaggatatccaaacgatgtacaagagaaacttaatcgaaattcggcctgattcaaaagaagccttgttcgaacatttggagacgggggagcaggaagtattcacatatgatcttcttcatgtgactccaccgatgaaagcaccttcatgtataaaagaaagcgcattggcggatgccggcggctgggtcgatgttgatccgtacactctgcagcacaaaaagtttgccaatgttttcggaattggtgactgtgccaacctgccgacgtccaaaacaggggcggcagttcgcaaacaggctccggttgtcgtgcgaaatctgatgtccttgataaaaggctcttcattagatgcaaagtacgatggatatacctcgtgccccttggttacagggtacaacaaactcgtgctggccgagtttgactatcacaaggtgccgcaagaaacgtttccatttgatcagtccaaggaacgattcagcatgtacctgttaaaaagaagactgcttcccatcatgtattggaatggcatgttaaaaggactgatgtaa

SEQ ID NO: 2675 - DNA, 645 bp, Bacillus licheniformis
gtgatcagggtattgctggtcgatgaccatatgatgattcgcaagggcatccgtgtccttttggaaggcttttctggaattgaaattgcgggagaaagcaataatggcaacgaagccgttcttagcgccggacagttaaagccggatgtcgtgctgatggatttgtcgatgccgaacgggttggacggattcacagcgagcagtgagatccgaaagttgaatccttctgttaaaatcgtgattttgacaatgcatgatgaggaaatttttgtccaaaaagcaatagaggcgggggcgcatggctacgtcttgaaaaacagccattatcggttgctttatcaggcgattgtcgaagtgtacaggagcaatctcttttacaaaacatctgtatcgcaagacatcattgatcaatggctcaattcagagcccaaaaagccgacctctgtattaactgtccgcgaaaaggagattctcagattcattgtgctgggttatgccaataaggagattgccgataaactctcaatcagcgtcaaaaccgtcgaaaaccacaaaacgaatatgatgcagaagttagatctggactcgaaacacgaattgattcaatatgcgatcaaaaataaatatctcgatctgtcgttgtaa

SEQ ID NO: 2676 - DNA, 1080 bp, Bacillus licheniformis
atgtgtcaaaacccggctcggtatacagaagaaggaatgtcaaatgaaagcggctatttaaggcagatcttcgaccatttgcaggatgggatcatcatgatggatcaggaacgcacaattctggtgattaatccgtccgcagagaagatgacgggatggaaactaggggataaggttccgtactgttcctactgccaaacgagaaaactggaagcgggagaagagcgttgttatttgctggccaagcgggaaattccttattttctctcctcgatgcccacctatgaagggcgattcgtcgacatggagatgagtacggctgtcatttccgaaaacggcgatcaaatggaagttcttttggtcctgaaagatttaacaatgaagaaaaaggaggaagaagcgaagatctccaagctggttctgcaaaaaacgttagaggcccaggaaaacgaacacaagcggcttgcccaggaactgcacgatggtgtagggcaatcgctttattcggtttcagtaggcattcaagcgattcaatcgcgcatggagcaggaagaaacatttaaagattacatgcaggacatcatcgatgaactggaaaaagcaatccaagacgtcaagctctactctctccagctgcgcccgcacagtctcgatcaattggggctgatccctgctgtcaagcatcttgtttccagcttaaacaagacgcatcaggatgtttctattacgtttgcctcaagcgatatcagcaatcgcttgctgccgatttttgaaatcaatttgtaccgcatcattcaggaggcgcttcataatgccctgaaatattcgcaggcgacacttattgaagtcatactttacaaagaagacggcgagctcgttttgatcattcaggacgatggcattggttttgaacgcgggctgacagaggaaggcctggggttcaaacatatgaaagagagagtcgatcagatggatggaagtcttcgaattcactctgcacttcagagtggcacgacgattaaagtgaaagtacaggacaaggaggggaaggagagtgatcagggtattgctggtcgatga

SEQ ID NO: 2677 - DNA, 336 bp, Bacillus licheniformis
atgaaagaagctgcagaactaacttcaatggtgtcaattgagaaatttataactgatcatcaattaagttttatatatatatcaagacctcaatgcacagtctgtcacgctgttctgcctcagcttagagcactgttggcccgctttccaaagatcaaattaggacatataaatgctgacatagtggaagaggttgccggcaggttttcagtcttcacagttcctgtgcttcttttgtttattgagggaaccgaatgtctacgagaagcgcgttttattcattttgaacagcttgaacagaagttaaaaagagtctatcagttgtacgaggaatag

SEQ ID NO: 2678 - DNA, 783 bp, Bacillus licheniformis
gtggacatatcttttattcttcttatatttttcatcggattcattggctcttttatgtccggaatgcttggtgtcgggggagcaattattaattacccgttgctattatatatacctgctttattagggtttacaggctttaacgcacaccaggtttcaggtatagtggcagtccaggtttttattgctgcattttccggtgtgtgggcttaccggaaagacggttacttaaataaagaactgatcttcatcatggggttaagtattttgcttggaagtctaatcggcggctatgggtcacattttttctccgaagatgccataaacatggtttacggattattggcgatcattgcagccatcatcatgttgattccaaagacaggaacagaaggtaatcaaagtgatcacattcgctttccaaagatattaacctcaatcatgacttttgtggtcggtttggcttcaggtatagtcggtgcgggcggagcttttctgcttgttccgctcatgttagtcattataaaaatacctgcacgaatcacaatcgcaacatcactcgcagttacatttatttcatcgattggaacaacagctacaaagctcgtcattggacaggtgcctattatgccggctttggttgtaatggctgccagtctgattgcatccccgctaggtgttttcattggcaagaaagtgaatgctaaagttcttcaaggtattttgatattcgttatttttcttacaacagtgaaaatttgggttgatatcttactgtattga

SEQ ID NO: 2679 - DNA, 228 bp, Bacillus licheniformis
atgaaatcagataaagtaatagatgctaaaggatttgcgtgcccgatgccaattgtgaaaacaaaaaaagcgatggatgaattgcaatccggagaagtgttagaagtacatgccactgataaaggggcaaaaagcgatctaacagcatgggcgaagtcaggcggtcatgagttgcttaaagatacagaggaagatggtatattaaagttttggcttaaaaaaggttaa

SEQ ID NO: 2680 - DNA, 1131 bp, Bacillus licheniformis
gtgaattttacattcgtttcaccaaaagaagtagctgaaaagctattaagaaaagaatcattttttattttagacgtacgaaataaagaggcccttagtgattggaaaatcgagggaagccgggttgaacatttaaatgttccgtattttgatttaattgatggtatagaaaaaattgatggccaagttcctaaagatcaagatgttctagtcgtttgcgccaaacaagggtcttcagagatggttgcacagcatttagtggatgccggttttgaaagagtgctggtacttaaaggcggtatgaaggcgtggagcaaatttttacatccagtcaaaatcggagacttgaaagaaggagggacgatctatcaattcgtaagaatggggaaaggctgtttatcctattttatcgaaaccgacggagaagcaattgtagttgaccctgctcgttctgttgatgcatatatagattttgcgaaagagagaaacgttacgattaaacatgtggtcgatacacacttacatgcggatcatatttcgggcggacgtttactgcgtaagcgtacaggagctgcatactacctgccgccaaaagatgcggaggaagtgctattttcatatgaaccgctagttgaagatgaaaatatttctgtaggaagcgcaggtatgaaagcagaacctatttactcacctggacatacgattggtagcacctctttaatgattgataatcgctatttgttaacaggagatattttatttgttgaatcgattggccggccggacttagctggaaaagccggggattgggcagaggatttgcgtaacacattgtatgtaaaatacaaacaaatatcaggtgacttgattgttcttccagctcacttttcgacagtcagtgaattaggcgatcaggggcaagtccaagctaagctgagtgatttatataaaaagaatgccggtttaaatctggatgaaaatgaattcaaaggggctgtatcagaaaatctgccgccacagccaaatgcatatcaggaaatccgtcaaaccaacatgggcaaaataatgcctgatgctgacaggcaaagcgagatggaaatgggaccgaaccgttgtgcggttcatggatga

SEQ ID NO: 2681 - DNA, 573 bp, Bacillus licheniformis
atgaacatcaaaactgatcgcgtattagatgcaaaagggcttgcttgtccaatgcccgtcgtaaaaacgaaaaaagccatgaatgagttaaaaccggggcaggtaattgaagtgcatgctactgataaagggtctcttgctgatatacgggcatgggcaaagggaagcggtcaccagtatctcggtacaacagaagacggagatatattaaagcattatcttcgaaaagcgggtcactctgaaataaagaaagtaaaaacgtttccttatacgattcaaaatgaagagcttcaaaaaaaggtagaggcgggcgagcggctaacagtagttgatgttcgggaacctgcagaataccgtttcggccatattcccggagcgatttcaattccattaggtgaacttgaaaaaagagcgcacgaactgaatagagacgggaaaatttatgttgtttgccgtacgggtaatagaagcgatctggcagctaaacagcttgcggataatggctttaaagatgttgaaaatgttgtccaaggtatggcggagtggtcaggccctgttgaaaaaaatcaataa

SEQ ID NO: 2682 - DNA, 483 bp, Bacillus licheniformis
atgtcagaccaaaaagaaaaaacgaccattgttttatttagcggtgacctagataaggcgattgccgcttttattattgcaaatggcgccgctgcttatgatcatgaggtaacagtttttcatactttttgggggcttaacgctttaagaaaagatgaaccggtgccagtaaagaaaggaccgcttgaaaaagcgttcggctttatgatgccccgtggttcaaagaaactcggattatctaaaatgaattttgccggtatcgggcctaaaatgatcaaacatgtcatgaaaaagcacggcgtactgtctctgcctcaactgattgaaatggcgcaagaacaaggagttaagcttgttgcctgtacaatgacaatggacttgttaggcttgcaaaaagaagaactcatcgacggccttgattatgcaggtgttgccgcttatctaggcgatgccaacgaagcaaaggtgaatttatttatataa

SEQ ID NO: 2683 - DNA, 261 bp, Bacillus licheniformis
atggaatacgatgatcaattaaaaaataggatcaaacgagttgaaggtcaagttcgagggatattaaagatgatggatgaaggaaaagagtgtaaagaactcgtaagccaaatgtcagctgttcgttctgcattagatcgggccatcggtgttgttgtaagcagtaacttggagaaatgcgtccgccttcaaattgaaagaggagaagataccgaagacctcatccaagaagccgttaatttattggttaaaagcagataa

SEQ ID NO: 2684 - DNA, 597 bp, Bacillus licheniformis
atggaaaataacgtttttgaacagatcgcaaagcgatatgatacagaagaaagaattgaattagctaaagtgatcgtgaatgaagtaagaccggaattgcgaaacagtcaatcaaaatctttaattgactatgggagcggtacgggtctcattagtttagaattatcagatttagtacattctattttgctggtcgattcatccaaacaaatgctggaggtggcgaaagctaaaatttctcgcaaaggaatcgccaacgcaaagacgctttattcagatttcacccaagaaactcctgaactgaaggcagacatcgttttaatgtcactagtccttcttcatattccggatacaaataaaattttacaagaactgttcggcattttaaatgatggcggcaagctcataattattgattttgacaaaaatgacaaaatacaacatccgaaagttcacaacggtttttcgcacgaagaattgaaaaaaagattatccgatgttggatttaaatcaactgaaatgaagacattttttcacggccggcgtatttttatgaatcaagatgcttcaatgtttatatccagcagcataaagtga

SEQ ID NO: 2685 - DNA, 708 bp, Bacillus licheniformis
atggatcttgaaacggttatgaaagaactggaagcgctgggtacggaaaacatgaaaaaaagatacataacgaatggtgcacacgaaccgctgtttggcgtggctacaggcaaaatgaagccgctcgcaaagaaaatcaagaaaaatcagcccttggcggagcagctttacgctaccgggaactacgatgccatgtattttgccggcattattgctgacccaatgacaatgactgaagcggattttgagcggtggatagatgcggcgtatttctatatgctatctgattatgttgttgccgtaactttggcagaaaccgattttgcgcaggctgttgctgataaatggatctcaagcggtgaagagcttaaaatgtcggcaggctggagctgttactgctggcttttaggtaatcgaccggacgatgaatttaatgtagctaaaattgccagtatgcttgatcaggtggaacgtacgattcacgattctccagatcgaacaaaatcggctatgaatcattttatctacacagtcgggatttcatatttgccgcttcatgaaaaggcggttgaaaccgcaaaagcagtaggcccggtcgaactcaggcggggcaagaaaaaaagcagtatcctgaatgcttccaaaaatattcaaaaagatattgatagaggccgtctcggtttcaaacggaaatatgtaaggtgttag

SEQ ID NO: 2686 - DNA, 156 bp, Bacillus licheniformis
catagcgtaccattcaacaaagataaaaaagtcatttaaaaggaagcaaaaaaattaggaaaaaaagcttcccatggatgtatcaggcttgcgattccagatgcaaaatggatgtatgaaaacatacctgaaaaaacaaaagctgtgatcagctga

SEQ ID NO: 2687 - DNA, 843 bp, Bacillus licheniformis
atgataaagtcttttttaatgttggggcagtcgaatatggcaggccgtggatttttgaatgaagtagaccctatctataatgaaaaaataaaaatgctgcgcaatgggcagtggcagatgatgacagagccgattaattacgaccgtccggtttccggcgttggcctggcggcatcttttgcagatgcatggtcgaaagctcatcccgatgaagaaattggcttgatcccttgtgcggaaggtggcagttcattgaatgactggcatccggaaggcatcctttttcagcatgctttggccgaagcccgcttcgccctccgctccagtcaaatttgtggaatcctttggcaccagggtgagagtgacagttatcgttcgctacatgaaacttattacgagaaattaacccttatcatcgagacgctaagaaacgagttgaaacttgatgaggtaccgttgattattggagggcttggtgactttcttgggaagaccggttttggacagcacgcgaccgaatttcgacaggttaatgaacaattgctgcgttttgctaatgaacaacagaattgttattttgttgctgcggcaggtttgactgcgaatcctgatggcattcatttagacgcagcttcacaacgcaaattcggttaccgctatttcgaggctttttcgaaaaagtaccatatcctgaaacccatttcgggagaggagcaatcactgaaagtgaatggtgactattctaaaacagaacagatttaccttcacagcatggatttggcttcgggtaaaatcacgtacgcggaattcgaggcgcggatggcgatggtgatgaaaccataa

SEQ ID NO: 2688 - DNA, 246 bp, Bacillus licheniformis
atgaaacgggcagcgatcatattcattcgattctaccaaaaggcgatatcccctcttttcccgccgacttgcagattttatccaacatgctccaactatgggcttgaagcgattcaaaggttcgggtttatcaaaggcagttatctgcttattaaacgattactgaaatgccaccctcttcatccgggaggctttgatcctgttccaaaccaaacagatcaaaaaaaggaaggggattcagattaa

SEQ ID NO: 2689 - DNA, 204 bp, Bacillus licheniformis
atgcgaaattctctccagattccgctggtttcatatcaagtaagcggagaatatgcccaaataaaagccgcatcgcaaaacggctggattgacgaaaaaaatacagtgttggaaagcatgcttgcgatgaagagggccggtgcggatcttattgttacatattttgcaaaagatatagcaaaatttcttcgggaggaatcatga

SEQ ID NO: 2690 - DNA, 393 bp, Bacillus licheniformis
atgagattaatgcacctgggtatcaatgcatttgtaacaggagaaaccgtaacacctgcatttaccgaaaacgacttgcttatcgtgggcacaggatcagggaaaacagaaagtttgcttcatatggcggaaaaggcaaaagatatcggaggcactgtagcggcagttacgacctcttcagattcgccaatcgctgaaatagctgatctgatcctgcagctgccgggttcacccaaggatcaaacgacgggcagtaaacagactatacaaccgatgggatcgctttttgaacagactcttttattgatttatgatgctatcatattgcgaataatggaaataaaagggctgaatactcataacatgtacgcaaatcatgcaaatcttgaataa

SEQ ID NO: 2691 - DNA, 633 bp, Bacillus licheniformis
gtggaattacagttagcattagatttagtcaatataccggaagcaatcaaagtggtaaaagaagtagaagaatacattgacattgtagaaatcggtacgccggttgtgataaatgaaggccttcgtgcagtaaaagagatgaaagatgctttcccgaatttgaaagtgctggcagaccttaaaattatggatgcggccgggtatgaagtaatgaaagcctcagaagcaggagccgatatcatcaccattttaggagccgctgaagatatgtctattaaaggcgctgtagaagaggcaaaagctcaaggaaaaaaaatcctggtggatatgattggaattaaggacatcgaatcacgcgctgccgagttggatgtacttggtgtggattatatttgtgtgcatacgggttatgatcttcaagccattggccaaaattcatttgcagacttaatgaccattaagaatgtagtaaaaaacgctaaaacggctattgcaggcggaattaaattggacacattgcccgaagtcgttaaattaaagcccgatttgattattgttgggggcggtattgcaaatcaagatgataaagctgcggcagccgcaaaaatgaagcagatgatccagcaatcatga

SEQ ID NO: 2692 - DNA, 348 bp, Bacillus licheniformis
atgtcacgaatggagaataaaacatttaattgtgaaaaggagttgacgctcaacattatcggaggaaagtggaaaatgctgattttgtggtttttaggaaaagaaggtacgaaaagattcggagaattaaaagccctgatgcccggcattacgcaaagaatgctggtgaatcagctgcgtgaattggaagaagatcatattgtacatagggaagtatatccggttgttcccccaaaagttgaatattcccttacaaaacagggagaaagtttaatgcctatattagaggcgatgtatgagtggggtaaaaattatatagaaaccaacttttcaaaagatgacaaatag

SEQ ID NO: 2693 - DNA, 1059 bp, Bacillus licheniformis
atgactgaacaaaccattgcccataaacaaaaacagttgacaaaacaggttgctgcgtttgcacagcctgataccaagaacagtctgcttcagcttttgaatacgtttattcctttcttcggactgtggtttcttgcctatttcagcctcaatgtctcctatctccttactttaggaataacggtgattgccgcagggtttttgacgagaattttcattatttttcacgactgctgccatttatcctttttcaaacaaaaacgccttaaccatattctcggttttttgacaggcgttctgactttatttccttatcttcaatggcagcacagccattcgattcatcatgcgacaagcagcaacctggataaacggggaacgggtgacatctggctgctgacggtaaatgaatataaagccgcacctctgcgcacaaaaatcgcatacagactttacagaaatccgtttatcatgtttattctcggaccgatttatgtctttctgatcacaaaccgctttaacaaaaaaggagcaagacggaaagagcgtgtgaacacatacctcaccaaccttgcaatcgcggcattggctgctgtctgctgcctgatttttggctggcaatcatttttgctcgtacaaggtccgatctttctgatctcaggttcgatcggcgtttggctgttttatgttcagcacacatttgaagattcttattttgaagcggatgaaaattggagctatgttcaggccgctgtggaaggaagttcgttttataaactcccgaaactgcttcaatggcttacaggcaatatcgggtaccaccatgttcaccatctcagtccaaaggtgcctaactataaacttgaaaccgcacatgaacagcacgaacctttaaaaaacgtcccgaccatcactttgaaaacaagcctgcaatcactcgcgttccggctttgggatgaagaaaaaaagcaatttgtaacctttcgggacatgaaacaaacatcttcccatccttcgccggattcaacgaaaaaacagaagctgcggaagaacgcctga

SEQ ID NO: 2694 - DNA, 1113 bp, Bacillus licheniformis
atgttcaaaaaacattttacatttcaaaaactgaacgggatctcgccgtatatatggacaatatttttcatccttcccttctactttatcatgcaatcatcatctacacttgttatcgtcgtcggcatcattttgacgcttttattttttgcggtatacagatttgcttttgtctcaaaaggctgggacgtttatttgtgggcgtttattttaatcggcatttcaaccgcttcgattatgatgttcagttatatttattttgctttttttatcgcatattttatagggaacattaaaaaacgggccccttttcatattttatattacgtccacttaataagcgcagccgtcgctgccaacttcagtctcgtgttaaaaaaggaattttttctgacacaaattccctttgtggtcatcaccctcatcagtgcgattttattgccgttcagcattagaagccgcaaggagcgtgaacgcctggaagaaaagctcgagtatgctaatgaacggattgccaatttggtaaaattagaagaacggcagcggattgcccgcgacctccatgatacacttggacaaaagctgtctcttatcggtttaaaaagcgacttggcgagaaaattaatttacaaagatcccgatcaagccgcgcgtgaactgaaaagcgttcagcaaactgcgagaacttctttaaatgaagtcagaaaaatcgtatcctccatgaaaggcatccggctcaaggatgaaatcataaacatcaaacaaattcttgaagcagccggcattgcgttcatctatgaagaagataaattgccggaaaatatctcattgcttaatgaaaacatattgagcatgtgcttgaaggaagctgtcactaatgtcgtcaaacacagccaggctaagacctgccgcgttgacatccagcagctctggaaggaggttgtcattacagtgactgacgatggaacgtttcaaggtgaagagaagtgcttttcaaaaggacacggcttgcttggcatgagagaacggcttgaatttgcaaacggaagcctacacattgatacaaaaaacggcaccaagcttaccatgtcaattcctaacaactcaaaataa

SEQ ID NO: 2695 - DNA, 600 bp, Bacillus licheniformis
atgattagtatatttattgcggaagatcagcagatgctcttgggcgctttaggatcgcttctgaacttagaagatgatatggaagtcgtcggcaaaggcactaccggacaagatgccgttgatttcacaaaaaaacatcggcctgatatatgcattatggacattgaaatgcccggaaagacggggcttgaagctgctgaggaattaaaggatacaggctgcaacattattatcttaaccacttttgcccgccccggctattttcagcgagccattaaagcaggtgttaaaggctatttgttaaaggacagcccaagcgaagagcttgcgagcgccatccgcagcgtcatgaaaggaaagcggatctatgcgcctgaactgatggaagacatgtacagtgaggccaatcccctcacagatagagaaaaagaagtgcttgaacttgtggctgacggaaaaaacacaaaagaaatcgcccaagaactcagcatcaaaagcggaaccgtacgaaattatatctcaatgattcttgaaaagcttgaggtgaaaaatcggattgaagccattactcgttcaaaggaaaaaggctggtttaaataa

SEQ ID NO: 2696 - DNA, 1050 bp, Bacillus licheniformis
atgagcagaaatgaattgtttgatgtgaccgttatcggcggaggtccggctgggttatattccgccttttacagcggactgcggggaatgaaggcaaagattattgaatatcagccgatgctgggcggaaaggttcacgtttatcctgaaaaaatgatctgggatgtcgggggattaacgcctatttccggagccaagctgatagaacagctggtgcagcaggggttaacgtttcatcctgaagtgctgctgaatgagaaagtcgaatcgattgcccgcaatgaagaagggttgtttgaattacatacggctgcctcaggtgtgcatctttccaagacggtcatcgttgccgtgggcggcggcatcctcaatccgcaaaagcttcagatagaaggcgcagagcgttttgaagtgtccaatctgaattatacggttaagtcactgcagcattttaaagataaaacggtcattgtatccggcggcggcaattcggctgtcgattgggccaacgaactcgaacctgtagcgaaaaaggtctacctcgcttaccgcaaagatgcgctcagcgggcatgaggcccaggtggatcagcttctgaacagctcggtgagctgcttctttcatacagagattaccaagctgatcgcttcggaagatcatgaggtgatcgaacgggtcgagctcacgaacgctcaaacaggtgaggtgatggaactgcctgtcgacgaggtggttatcaaccacggatatgaacgcgacacctcacttctggagaacagccgccttgatgttacccgagtggatgactattatattgcaggtacttccaactgccagtcttccgtgcccggtctgtatgcggcgggggatattgtgcattacgaaggcaagctgcacctgatcgccggagcgtttcaagatgcggcaaacgcggtcaacagcgccaagcgatttatcgatcccgaagcgcacaagagtgcgatggtgtcgtcgcataatgaggttttcaaagagcgcaaccgcgagcttgtcaagaagatgttcgtgtag

SEQ ID NO: 2697 - DNA, 1623 bp, Bacillus licheniformis
atgatgagcggaaggattagtttgaaaattaaaattatttttatattaatgctcgccttttctattttattagccggatgtacaacctcaggaaattcaacagagaaaactcatgaaaacttggtcacaatggcttggcctagagatataggcgaaatgaatccgcatgtgtataatccttcccaattatttgcccagtcgatggtatatgaacctttggttacctatgaagcgggaggaaagcttaaaccgcatttagccgaatcttgggatatatcaagtgacggtaaagtatatacgtttcatttgcgtaagaatgtaacattttcagatggaacgaagtttgatgcgaaaattgtgaaaaagaattttgactccattttaaaacatactgaattacatagctggttagggtttatttcaaaaatagcccaaacagaagtgatcgatgaccatacatttaaattaaaattgactgaaccatactacccgaccattcaggaactagccgttgtacggccggtccggtttttgggagaagcgggcttccctgaggacggcgatacatcaaagggtgtcgaaaaaccggttggtacgggcccatgggtattggaagagcataaagctgatgaatatgcggtttttaaacgcaatgaacattattggggtgaaaagccaaaagtcgagaaaatcaaagtgaaagttatcccagatgccgaaacaagggtgctagcatttgaaaaaggcgagcttgacctcatttacggcgaaggcgttatcagtttggatgcatacaagcagctgcaatcgacaggtcaatatgaaacaagcctttctgaacccgtggcgacgagacagctcgtcatgaatacgaaaaaagaacagctttctgatgagcgcgtgcggcaggccctgcaatacggttttgacaaagaagccatggtgaaaggcatcacctcagggttagaagaaaaagcagatcatattttgccgacagacttcccatacacgtctgatattgatgtaaagcaaatcaactatgatacagaaaaagcaaaagagttattagatgcggccggctggaagcttccgaatggcaagaccgtgcgcgagaaagacggaaagcctcttgaatttagtttaatgtatgattcagctgaatccattcaaaaaacaatggctgaaacgctgcaggcagaatgggcagcgatcggggtaaagctgaatcttgaaggcgtagaattggcaacccaagtcaaacggtttaaggcaaatgagtttgatatgaacttctttagcaactatggtgcgccttatgacccgcatacatttttaaacattgtcgcgtccaaaggattcggatttaatgaagcgatctcagcctatccaaacaaggacgagctaatcaaacagatggcaaaggtgcctcaaacgactgatgaaaaagagcggcaggagcattactcatctattttaaaatcacttcaagaccagggagccatcgtacctgtttcttacattaaaaagacggcgatatatcaaaagaatatcaccgactttacgttccctgctaaccgtgacgaacatccatttacaggcattcgcgtcaagcagcaacactag

SEQ ID NO: 2698 - DNA, 945 bp, Bacillus licheniformis
atgggcaactatatattgaaacgaatcatgtcgattattccagtttttcttttagctgcacttctgacaactggaatgattcatctctcgccggttgacccagctgaagcatacttagccgcagcgcatatccagccaactgatgaaattttagcgcaaaaaagacatgagtttggcttggatcagccattttttattcaatatgtaaactctgttttgaagatatgccagcttgattttggcatatcttatgtttcaaaccagccggtttgggacgaagtggcacaccgaatgccggcaacggtcgaacttgcgcttgggagtttattgattgcggtgcttgtcagtgtgccgctcggcttcttagcgggaatcaaaagaaatggtgcagttgatcatatcagccgcttcatttcctttttcggggcatccatcccaactttttggttagggtatatgctggtttttttcttttctgttcaattagaccttttcccggtagagggcgctgggacatggcagcatctcgtactgccgtctatgacattggcgcttcctttaattgcgatgtatacaaggctgctccgtgcaagcgtcatcgaaaacctgcaggaaccatatgttcaatttgcacgcataagaggaatagcgaagttgaacattatggccaaacatgtattgcgaatggccatttctccgatgattacgggtctgggaatgaatcttggcaagctgcttaccggcacaattattgttgaagtcgttttttcttggcccggctttggccgttattttattgaggccattttcaatcgggacatccctgtcattcaatgctatgtgttcttagccgctaccttttttatattgagcaacttaattgttgatctcattcaaatgtatattgacccgcgcatttcaaggaaagaagggcagcatcgatga

SEQ ID NO: 2699 - DNA, 834 bp, Bacillus licheniformis
atgatgataagtatacgcaggatattcaaaggccaaaaagtgattacggtatgcaccactatattaaccatcctttttattatcgctgtattcgccccttggattgcgccgcaccatcctgctgatgtccatatggtatataagctgcagcctccatcctgggaatttcctttaggaactgatcatctgggaagatgcaacttatcccgccttttgtacggcgcccggatttctttgggattcgcgatgcttattttcatttcctccctcgttatcggcctcattgtcgggacgatttcagggtataaaggcggctggattgaccagctgttaatgagatgctgcgatggtgtaatggcctttccgaacttaattttagttcttggcctcgtgggcattttcggccccggacttcctcaagtcattctggccctcatgcttgtgcaatgggtctattatgcgagaattttcagaggaatggtgctgagtctgaaagaggagaactttattgcggcggcaaaaatcaatggatcttcacaatggaaaatcattaaaaatcatatcatccctaatgtcctccctcccctcgtcgtcatcggtacgttggaaatgggctgggccattatggatatctcggctatgtcttttctcggcttgggcgtccagcccccggcggctgaatggggagcgatgattcatgaaggtaaatcgtatattcggtcgaatcccgagttaatgatttatccaggggtgatgatcatgattgtggttgtgacattcaatttattgggcgaagccttatcagatcaatacggtgtcaaacgtcgattttaa

SEQ ID NO: 2700 - DNA, 819 bp, Bacillus licheniformis
ttgggaacagaacaatcaacggtgcttcgagtcagagatttgcatgtacaggttaacaaccaaaaaggacattcaacccttgtgcaagacatcaattttgatttgaagcgcggccaagtccttggtctgattggtgagagcggttgcggaaaaacggtaacaagcatgtctattcttcagacgcttgatccaaaaacaactaaggtggaaggaagtattgcattgcgaggccgtgaattgaacggattagcagataaggaaatgcgtaaaatccgcggcaaagatattgcctatatcatgcaaaatccgatgaacgcttttacacccgtttttacgataggacagcaaatgaccgaatcgattcgctctcatacatcttttagcaagaaacaggcgaaagagcttgcgaccgaagcattgcatcatgtgaacctaccccaccctgctaaacttttacattcttatccttttcaattaagcggcggaatgcttcaacgggtcatgattgcaattgcatcatgcttaaagcctgccattctcatcgcggatgagcctaccactgcgctcgacgtgtataatcagaagacggtgctgaaatatttagacggcatgcgttctgacttcggcacggcgattttgcttatatctcatgacctcggcgttattgctgaaatggcggatgaagttgctgtgatgcagaatgggagaattgtagaaaatagagatgtgtttcagctgtttgatgaaccaaagcatgaatatactaagaagctattaagtgcacggttgacattgccggtggatcaacttgcgacttga

SEQ ID NO: 2701 - DNA, 819 bp, Bacillus licheniformis
gtgagtttattacaagtgaaagaagtcactcatcattatacagcgcgcaaattattcaagtggaaaattcaatcgaaacaagtcctttccaatgtcagcttttcgattgaggaaggcgcatgcttaggcatggttggaccgagcggagccgggaaaagcacattgggaaaagtgatgcttggtttggagcggccgcaatcggggcaaatcttttttcaaggacatgatctctataaagcagatcagtcaatccggcggaaaatccgccgcgaccttcaagctgtttttcaagactcctattcttccgtcaacccgagaatgacggctgaacaaattctagcagaaccgctagaaaactatgaaaggctcacaatcgctgagaaaaaacggaccattatcgagctcttggaaagagtaggcttaactgaaaaggatttaacaaaatatccgcaccagttcagcggcggccaattgcagcggattaatattgcaagagcggtctcgctcaagccgaagctgatcgtattagacgagtctgtcagcagcctggacatggtaacccaaacgcttatattgggtttattaaaagagctcaaagacgatttcggaatgtcttatttttttatcacacatgatttaaaagccgcctatcaattgagtgatacactaggtgtattagaccacggccaattggccggactttacgataaacatcgttttttaaagtcagaccacccggttgtacaagaaatgaagcgttccatactggcagaacacccgcgctttcgttcgatcagaacaagagcggttcggcaataa

SEQ ID NO: 2702 - DNA, 834 bp, Bacillus licheniformis
atgaacaatcgattccgtgtaggagaagtagcaagacttttcaagctgcctgcatcgactctgcgttactatgatgaaatcgggctgttcaggccaaagtataccgatcctgaaacatcttatcgatattatggtgttgaacaatttcagatcctggatacgattatttttttaaggaaaaatggattttcgttaaaagatattcagcatcagttagatcaaaggactccggaaacaacgatggaaattttgaagaaaaagcttgaggaagtcagagcggaaatttttcgtctccaacgcaacgcggcgagaatcgagaacaaaatttccacaatcgaagaaggaataaaacttgccgaacatcctgctttaacatttcagtatttcccaaaacgggctatttcctacctgtattttgacaagcctgtcgacctgatggaggaaggcgacgacatttatttaaaggataaagaaacgctttcaagccagtcgattgagaataacggcttcttcaccggagacattggaacaatcgttgatatggagagcttgaagcaagaaggaccggtaaaatatatcggcgtatttgaattgctgcacgaggaagacagtgaagactatttaaacgaagggttgtatgcgagttacccccatattggtccctacgaggacatcaggaaaagttatcagctcgttttaagccagctgaaagagaaggaatacgagctggcgggaatccctgttgaaatctcatttcttgatgatgctgtgatcaaggagtcagctcgttatgtcactttaatccaaattccggtaacaaagagttttgattga

SEQ ID NO: 2703 - DNA, 1353 bp, Bacillus licheniformis
atgacagaaacacatcagcagctcatgaaattaccagtaaatcaagtgttttttaaatatttcgtccctgcaacgcttggattaatcctgatgtcagcgaatattttaattgatggcctgttcgtaggcaatggcattggaaccgcagcactggctggagtgaacctttcctatccggttatttcactcattatggccatcgctctttggattgggataggcggagcaacaaagtactccatcagcatcggggagaatcgccccaagaaggccagcagcattttttcattggctctcttcttggcgcttatcatcagcgtgcttttaggagtattcgggattctcaacattcaaaccatttcgatatggcttggtgccaactccgacacctcttcttttgtcatagagtacttaagtgtcatgtttttattcggctgggtcattacattagaacaggtcttaagtatttttgtaaggaatgacggcagtccgaagctttcgatgatggctcttgcaacgacatcgattgtgaatatcattctgaatttttatacgatcatgattttggacatgggggtaacaggcgctgcgatttcaacggtgcttggcggattcgccggactgcttgtattatccctgcacttcttcaaccgtcaagcgcaactgagaaggccggcgtttcagtggtcttggaaatcccttatgcacatctttgccatcgggtttccaagctttctggcagaggccgggctcctcgtatttgttacaggatacaacttggcaatggcaagcctggcaggcacggaaggagtcgctgccttctcggtcattaactaccttcacgggttcatgttcctgtccttcttcggcattgaaatggcacttcagcccatgattagctattatcatggtgctgaagaaaccgaacaaatcaaaagcagcatgaagattggggagaagaccgccgtaatcctgggcatacttttgctcgttatcggctggggggctgccccattccttgtaggcttattcggaatagaatcaaccgaaatccagcagctggccatcgatggaatccgcctgttttttatcggctataccttccttggctataactttgtctatatgagttactttcaatctattggccgggccggctcatcggttgttatcattatattgcgaagcttcgtgtccctgttcatcctgctttggattttgccaaagtttattggcgtcacgggagtttggctatccttgccgctttccgagttttttgttgccgtcctcctctttttcattgcaagaaaacatgtgatgggaaaaggaaatcccgctatcgggaagggatga

SEQ ID NO: 2704 - DNA, 1008 bp, Bacillus licheniformis
atgtctcatactcgaattaaattcccggcaggattttgggcaggattgcgtcaattaggaattaacgcccctgatgtgcttcgaaaagcccggctgccgctcaccgtgatgactgaaccagttgtcaccgccgcccaatacttcgcgatctggcaggcgtattccgaccttgttgatgacgtttccaaaggaatcatcaagcttgcgaccggctttgagccggcacattaccctccggccgtattagcggcttaccatgcccgtgactaccgcggcgcgctaaaacgaatggcccgctacaaacaattatgccctcctgaaagcctgcgtatcaccgaagaagatgagcactgcgcaatcgaactggaatggttggatgataagctacccggtccgccgctcttgattggcattacactggcatttcttctggaactcgggcgccggggcacaggtcagccgttgacagcgaagtcggtcgagtttgcacacccaatgggcgacatgcaggcgcttgaagcatacttcggctgccgcatccggagcggtgcagctcggaaccggctgacgctgaatcgaggagatcttgaccgcccttttgtctcgtataacgcggagttgctggagattttgactcccgtgctggatcaatcgttgaatgatcagcaaaatagcctttcaatcagcggagcggtcaagtggatcatgaaacgcacgcttccaggagggcaccccgacattcagactgttgcgagcgagttgggaatgagcggccgcaccttgcagcgccggcttactgacgaaggcactagcttcaaacagctgttgatccaagtcagacatgagcaggcgcgggagtacttggcagacccttcgctcgatattaaagaagtggccattctgatcggatatgaagatcagaactcgttctaccgggccttccgcctttgggaaggcgagactccttctaattggcgtaagaagacccggctgaatggatttaactag

SEQ ID NO: 2705 - DNA, 795 bp, Bacillus licheniformis
atggatatgggattaaaaaataaaacagctttagttaccggatcgacgaaaggtataggaaaagccatcgctattgaacttgccaaagaaggtgttcatgtactcattaacggacgaaatgaggaagaggcagaacgaacagtcaatgaaataaaatcagcttttcctgacacctttccccaaaacgccgcggctgatattgtggatattaggcaaagggaagctttatttaaaaaacaccctcaaatcgatattttagtaaacaatatgggcatttatgaactgatgcaatatgaggacgttgacgatgaagtatgggaaaaatacttccgcaccaatgtgctggctgcaaacggtttatctaaattttatttgcctaaaatgctgaaaagtgattttggccgcatcatctttatcgcaagtgaagaagcgatgatgccttcaggccagatgcctcagtattgtatgacaaaatcaatgctattatcattgtcaaaaagcttatcaaaattaacaatcggaacagaagtgacagtcaatacgatcatgccggggccgacgctctctgagaatgtgaagcaaatcattgagggaatgtaccccgatgaagggatgactttttcagaaaaagagaagaaatttatgacgacaaacctgcctcaatccgaaatacagcgatttatcaagcctattgaaatcggcagactggctgcatttgtatgcagtccctatgcatccgcatttaaagggtccccgatccgtatggacgggggaatggtgccgactattttttaa

SEQ ID NO: 2706 - DNA, 1791 bp, Bacillus licheniformis
gtgagaatgaaacgattaaggatgaggaagcatttactgatagctgtctgtactttggcacttcttctaagttccccgattgtaagcgatgcgagcccggcaactaaaccaacaactgcagattcgccgcaatcttccggatttttcgtagaccattacaaaaataatatctctgccaatacgacggcggaatccaatcctgtcatcggcctgctttccgaatttaataaactttggactcccggaaagacatggaataccggtactaaactgaacagcagggtgctggatgccaacattcaaaaagtcgtggatattgctgaacgccgcacgatgcttgaggaaaatgctgcctattttgatgatcggcggagccagagctacagtataattgacggcctcggcaagcttgccggcgtctatcgaatgaacgcgggagcgacgacaacgatcaccagcattccggcagatgcctcgattagaaaatacaatgatgaaggaaccaattcgggcagcaccagctctgaacttggaaatgtcgtaagtttggtcaatactttacgcggcaactattcttcatcgaatccggctaaaagctatttcaactatccccgcccgtttcgctggaaagacaattcgatcattgttccaacgcttatccccgtcatcaatcctgatccgaacaaagacggaggttttccaagcggacacacgaacgccgcatatctcagcgcttttgctatggcctatgcgataccggagcgttatcaggagctgctgactcgcgcttcagaactcggtcataaccggattgttgccggtatgcattccccgctggacgtcatggggggacgagtaatggcaacagctttgtctgcagcaatcctgtctgaccccgcaaatgaaagattgaagaaaacggcttttgatgaagcccgccgtaaattattaacgcaaaccggtacagctgaagacagatacagcgattatgagaagaataaaaaacaatatacggaacgattgacatatggatttcgacaaatgaacaaaaccgccaaaccaatggcagttccaaagggagccgaagtcctgctggaaacacgttttccttaccttgacaaaaagcagcgccgttcggttttagccactaccggtcttccggccggctaccctgttcttgatgatcgagaaggatggggaaggcttaatctcttttccgcggcagatgggtatggggcttttaccaaaaatgttaccgtgaccatggattccgcaaaaggcggcttccatacagccgatcgctggcgcaacgacatctccggcaccggaaagctgaccaaaaaagggacaggcgctttgaagctggaaggggataatacatattccggcggtacacggattgatcaaggaacacttgagggcggttcggagacagctttcgggagaggtgatgttgcactaaacggaggcatccttaaggaagatgcgccgggaaaactgatcatcgaaggagactacaaacaatctgctaaaggaatacttgaacttcagctcagcggcaaaaaagatcagttgaaaattaagggaaaagcaagattgaaagggacattgcgtctcaattttacggacaattacgtaccggctgacggatcggcgatcataaccttccgcaagcgtcatggatcattttcttccgtcgagaccagtggattgccaagcaagtataaagtgaagatcatctataaatccaacagtattcagttgaaagttgagcaaaaggggagaagctga

SEQ ID NO: 2707 - DNA, 828 bp, Bacillus licheniformis
ttgagaggattcatcaaatgggcaggattggcgattctgtgtattggcttgtttgcgtgtacttctaacaggaatgccgaaaatgttcattatgcaaaagacgacagacaaacattggatatttatacaccgcagtcaaacgagggcgaaaaacatcccgttctcatctaccttcacggcggaggatggacaagcggcgacaaaagcagggctgcttcgaagccggcattttttacggataacggctatgtttttgtatctgtcaactatcggcttcatcccgatgttcagtatgatgaaatggctgatgatgcggccaaggccgtaaaatgggtgatggatcatgcggacgagtatcaaatcgatccgtcaaaaatcaacgtcatgggacattcggcagggggacacttggccggattaattgccgcagattcaacatatttaaatcgtgtcggcctcacgccggccgcactcaattcgattgttgttttagatggccccttggatatgaaacgattcatcgaagcgatcccgtcttataaagaagtgtttggcacagacgaaaaggtgtggacaaaagcatcgccgctctcatacataaacaactcaaaattgccgccggcctatcttgtgacccgctgggaagaccctgccgtttacaagttcgcggaaaccgcaaacaaagcgaaggcaacggaatttgtgtatcaagtcaacagcttatctcacagtgatttaaacaagatgttcggctctccagatgcaccggcagaagcgcagaatctgacaaaagcggttatggcgtttttagagaaggaaaataaatag

SEQ ID NO: 2708 - DNA, 1236 bp, Bacillus licheniformis
atgtcttcaaaacaagaggagagcttcgccatattaactgagagagaattgtcttctgcagcatttaaagatgaggcgtatgaattttacaagcgattacgcgcttcccgtcctgtctgtcccgtatcgatgggggagctgggcgaaggctggctcattacgaggtacgatgatgcggtccatatattaaaggatgcaagagtgaaaaaaaattacgaaaatgcgtttaccgaagaagaattagagaacttctccgctctggaaaatgaagaacctttatcaaagcatatgctcaacgcagatccccccgaccacggccgtttgcggtctcttgttcagaaagcatttactccccggatggttttacagctcgaaaacagaatccaaaaaatagctgattccttattggatcaagtagaaccgaatcattccatgaatcttgtagacgacttcgctttcccgctgccgatcattgtcatcagcgagatgcttggtattccgcttgaagatcggcaaaaattcagagtttggtcccaggcggttattgatttttctgacacgcccgaaagcctggaggaatacaagtataaaataggcgaattcgctgaatacctggaatatttggtacgcaaaaaaagggacgagccggctgaggatttagtcagtgcattaattcaggcagaaagcgaaggaacgaaattaagcatagaagagctgtatgcgacgattatgcttcttatcgtcgcaggacatgagacaacggtaaacttaataaccaatatgaccttggccttgctgaaccaccctgagcaactggaaaagcttcgccaaaacgcagatttaatcgactcagccattgaagaggcgctcagattttacagccccgtggaattaaccaccctccgctgggcggccgaaccgtttacattgcacggccaggagattaagagaaaagatgtggtcatcatttcattagcctcggccaaccgcgattatatggtcttttcgaatgccgaccgctttgatattgaaagaaaggataaccgccacctagcctttggccatggcagccatttttgcctgggcgcaccgcttgcccgattggaagccaaaatcgccattcaaaccttgctgcgccgctttgaacatatagagattaaaggcgaaagggagcagatcaaatggaaaggcaactttttgatgagagctttagaagagctgccattatctttttaa

SEQ ID NO: 2709 - DNA, 888 bp, Bacillus licheniformis
atgaaaaagctgattgtgtttgtcttgataggattatttgcgcagctgatagatggcgccttagggatggcgtacggggtgacatcgtcatcattgctgcttgccttcggcatcgcaccggcggttgcgtcagcatccgttcacctggcggaagtcgttacaaccgcggcatctggtgtgtcgcatataaagtttggaaacgtcgataaacaaacggtcaaacgactcgtcatcccaggatcgctcggggcatttctcggcgcttcctttttaagcaacattccgggtgagcttgcgaaaccttatatttcaatgtttctgcttgttctcggcgtgtatgtgctcattcgatttctattcatgtttaaaataggagagcaaaaaaacaatatcagcctttcgagaaaaaaagccgttcccctgggattgatcgcgggttttgccgatgcaaccggagggggcggctgggggccgattgccactcctgttttgttatccaaaaaaggcgtcagtgcgagaaaagtagtgggaactgttgacacaagcgagtttgccattgccgtttcggcaacgttaggatttttcatttcgctcggctgggaagaagtcaattggctgtgggttggtgcattgatgattggcggaattattgcggcaccgattgccgcctggctggtgcagaaggtgcatgcccgattaatgggcgttctggtcggcgggctgatcatcctcgtcaacacaagaacgcttatccattcgtggatcgatcaaacagcattatatccggttatttatattggaattatcgcagtttggatatcagctattgtctatattgttgtaaaaataagaacaagtgatcaaactgctcaagcgttcaatcagtaa

SEQ ID NO: 2710 - DNA, 381 bp, Bacillus licheniformis
atgaaattcagcaaaatcggtgccttactgctcactttggcgtgtttgcttttgcctttttcttcggcgactgcagcaggtgccggtgtatgggataatatcggcacatacggcatgacgtcgcaaactccgatcatcaaatcaagcggaggggaattttattttcacaacaacagcttttacggctttacatttacgctgtatgaagttgacggggcgggaagcacgcctgaaatcgcaagaaaaaatttctacgtcggaccgaaaagcaacagtccggcgatcgatgtcagcagttttgcagatggtgcgaataaacaagcagaactcgtcctgtttaaagggaatgatacatatatcaccgttacttgttatgattga

SEQ ID NO: 2711 - DNA, 795 bp, Bacillus licheniformis
atgaacttggatttacggggaaaaagagcgttggtgaccggatcgacgtccggaatcggcaaagcgattgccgcttcacttgcgaaagaaggtgcgtctgtcatcattaacggacgccggcaagaaaaggtcaaccaaacaatagacgaattgaaaggccaatttcccgaggctgttcttcaagcggccccttatgaccttggcactgaaaaagggtgtcaaagcctattagcagcattcccggatgttgatattctggtcaataatttagggatctttgaaccggcggaatatttcgagataccggatgaggattggttccgctttttcgaagtgaatattatgagcggggtaaggctctcgcggaggtatttgcaaagcatgatcgagaaaaaagaaggccgggtcatttttattgcgagcgaagccgcggttatgccgtcacaggaaatggctcattacagcgcaacaaaaacgatgcagctttcgatttcccggagcctggcagagcttgcggcaggtacaaatgtgaccgtcaatacggttatgccgggctcaaccttaaccgaaggcgttgaaacgatgctgaagaccctctatccggatgaaaacctgacagtcgaagaagcggaaaagcggtttatgaaagaaaaccggccgacctctatcatacaaaggctgattcggccggaagaaatcgcgcactttgtcacatttttaagcagtccgctttcttcgccgatcaatggtgcagccttgcgtgcggacggcggattggtccgcagcgtcttttaa

SEQ ID NO: 2712 - DNA, 2034 bp, Bacillus licheniformis
atgaaaaagagaatgattcagatggggatcataggggctatgatgttcccggaagccttttccgcagctgctgccgacccggactactataacgaggatcatcggcccaagtatcatttcacgccggaagcaaactggatgaatgacccgaacgggatggtgtattacgcgggggaatatcatctgttttatcaatatcatccatatggcttgcgctgggggccaatgcattgggggcacgcggtaagcaaagatttagtcaagtgggagcatttgccggtcgcactgtatccggatgaaaaaggaacgattttttcgggcagcgctgtcgccgatcggcataatactacagggtttcaaacagggacggagaagccgctcgttgccatttatacgcaggaccggagcggggaacaagtgcaaagcatcgcctacagcaatgacaaaggcaggacatggacgaagtactcaggcaaccctgtcattccaaatccgggaaaaagagatttccgcgatccgaaagtcatttggcatgaacagacaaaaaagtgggtgatgttgcttgcggggggcgatcgaattctgatctatacatcgcctgacttgaagcggtggacatatgcgagcgaattcggcgaaggagagggcagccatggaggcgtgtgggaatgtccggatctgtttgagcttcctgtagagggcaggccgaatgaaacgaaatgggtgatgcaagtcagtgttggagacggtgctgtctcaggaggatcaggcatgcaatatttcgtcggcagttttgacggaacaacctttaaaaatgaaaacccgccgaatcgcgtactatggacagattacggcaaagacttctacgcagctgtcagctggtctgatatcccgaagtcagacggacgaaggctttggttagggtggatgagcaattggcaatacgcaaacgatgttcccacttccccgtggagaagcgcaatgtcgatcccgagagaagtaaaattgaaagcgttttccgaagggcttagaatgattcaagctccggtagcggagctgcagtcgatacggggagcatcgcaaacgtggaaaaacaagatcatttcgcctcgaaacggaaatttgctgaaagggctgtcaggcgatgcttatgaaatcaatgcggaatttcaagtaaataccggagctgcggccgaattcggctttaaagtccgaacaggggaaaacgagtatacgaaaatcggctacagcaaaaacagcgcttcactgttcgtcgaccggagccaatcaggaaacgtctcctttaatccgaactttaacactggaaagcatgcggccccgctggaaccggtcgctgggaaggtgaagatgcgcatttatgtcgaccgctcttcagtcgaagtattcggcaacgacgggaggcaggtgatcaccgacattattttgccggaccaatccagcaaagggctagaagtatacgcatcaaacgggtttgtcaagctgaattccatgacggttcatcctctgaaaaaagtatggggagcgtcgccctttcaatcaaatttgaccggctggacgaccgtaaacggtgtatgggccgatacgattgatggaaaacaagggcgctctgaaggagattcgttcattttatcttcagcaaaagcaacagatttcacatatgaagcagatgtcgcgataaaggatggaaatggaagaggggcaggggctctcgtgtttcgggccgatcaggatgttaaaaacggataccttgccaatgtggatgccaagcatgacgtggtgaagtttttcaaatttgaagacggctcggcctctgttattgccgaacaccgcacaccgatagaaaccggccggaaatatcacctgaaaacggtggcccgcggtgcaaacttttatatttaccttgatgatcaattggtgataagcgcccgggattcaacgtttgccgatggagccttcggtttgaatgcatgggatgcgaccgcagtcttccaacatgtttatgccaaacgatga

SEQ ID NO: 2713 - DNA, 828 bp, Bacillus licheniformis
atgggcacagaaaaaagattaacgaagagagagattttcagtatgtttatccgctcaaactttttgctcggatcttttaactttgagcgtgtacaggcgctcggctactgctacgtcatgattccggcgatcaaaaaactgtacggtccgggagcaaaacggagcgaagcgctccagcgccatttggaatggtttaatacacatccgtggctgacagcgccgatatttggcgtaaccgctgcgatggaagaagaaatggccaacaataaaaagattgatgccaaagcaattaatggaatgaaaatcggcttaatgggcccgttggcaggcgtgggcgacccgattttctgggggacgttgcgcccggttttggcggccttgggagcgtcgcttgctttaagcggaaacatcgccggcccgcttttgtttttctttttaatcaacgccgtcagattaagcactaaatactacggattaaagtacggctatgtgaaaggcatggaaatattgcaggacttggtggggaaccgcattcaaaaactgacggaaggcgcttcaatactcgggctgtttgtgatgggagctctcgtttccaagtggaccacaatcaatatcccgatcgtcgtgtcgagaattaaggatgatgcaggcaaagtcgatgtacagaccgtgcaaaacattttagacagcatcatgcctggtgtgctgcctttaggattgacattgctcgctgcctggatgcttcgcaaaggggtgaatcctctgctcatgattttcggtatttttatcatcgggattgtcggctattgggcaggttttttggcataa

SEQ ID NO: 2714 - DNA, 804 bp, Bacillus licheniformis
atgtcaacgattcaaatcattttgctgcttgtcatcgctgctataacaggtatcggtagtgtattggacgaagggcagacacatcgcccgctgattgcctgcactttggtcggccttgtcctcggggatctgaaaacaggcatcattctcggcggaacgctggagctgatggcgcttggctggatgaatgtcggtcttgcaatggcccccgatacggccatcgcttccgtgatttcgactatcttagtgattaccgccgatcagggaatcggcgaagggatcgccgtcgcggtggctttggcagctgcgggtcaggcgctgacgattttcgtccggacgatcaccgtatttttaattcaccgcgccgacaaatacgcaaaggatggcaattttaaaggaattgaaattatgcatataactgccatggcgtttcaggcgctgcgcgttatgattccgacattgatcgtggctctgatcagtgtcagcgctgttcaggcgtttttgggaaatattccggaagtcatcacaaaaggcttgcaaataggcggaggcattatcgttgttgtcgggtatgcgatggtcatcaacatgatgaacattccgtatttgaagccgtttttctatatcggttttttgctggccgcgttcaccgatttcaatttagtcggcttcggcgccctcgggctctgtctggcatttttatatcagcaagtgatgcaaaaaaatcatgctcaaggggcggttgctgccgccagtgacggcagcatggccgcttatgatgatgacgatgatctggatgcttaa

SEQ ID NO: 2715 - DNA, 492 bp, Bacillus licheniformis
atgaaaatcgttttggcaagaattgatgaccgctttattcacggccaagtattaacaagatggatcaaaatccacgctgctgatcgcattatcgttgtctccaatgaggtggcacaggacgaaatgagaaaaacgctgatcctttctgttgcaccttcaaatgtaaaagccagcgccgtttcgatttccaaaatggccaaagcgttccacagtccgcggtacgaagatacgacggcaatgctgttattcgaaaatccgggcgacattgtttccttaatcgaagcaggcgttccgatcgaaatagtcaatgtcggcgggatgcgtttcgagaataaccgcaggcaaatcacgaaatcggtaagcgttactgaaaaggacatcaaatcgttcgaacaattgcatgaattgggcgtgaagctggaactgaggcagctgccgtcagattcgagcgaagactttatgcagatgttaagaaacgcaacaaaatcctag

SEQ ID NO: 2716 - DNA, 438 bp, Bacillus licheniformis
atgattacagtcattatcagcggccacggaaactttcccatagcattaaaagaatcttcagggatgatattcggagaagaggagagcctgatcgcggtgccgtttctgaaaggggaaggcattcagacactgcaagaaaaatatcatcagacgctgaaggatgttccggaggaacacgaggtgctttttttagtggatattttcggcgggacgccatataacgcagcgaccccttacatcgcgaaagagcggagattcgatatggcagccggagtgaacctgccgattttgttagaggcattgagcttgagggagcatatgccgctcaaacaactgctgaaccagttgaaaaagatgagccgggaatgcttccaaatatgcagcgagcaattggaaaaattcagtcagtccaatcagggaagagaggatgaattgtaa

SEQ ID NO: 2717 - DNA, 2787 bp, Bacillus licheniformis
atgaaaagaatagataaaatctaccatcagctgctggataattttcgcgaaaagaatatcaatcagcttttaaagatacaagggaattcggctaaagaaatcgccgggcagctgcaaatggagcgttccaatgtcagctttgaattaaacaatctcgttcgggccaaaaaggtgatcaagattaaaacgttccccgtccgctacatcccggtggaaattgttgaaaacgtcttgaacatcaaatggaattcagagttgatggaggttgaagaactgaggcggctggctgacggccaaaaaaagccggcgcgcaatatatccgccgatcccctcgagctcatgatcggggctaaagggagcttgaaaaaggcaatttctcaggcgaaagcggcagtcttttatcctccgcacggcttgcatatgctgctgctcgggccgacgggttcggggaaatcgctgtttgcgaatcggatctaccagttcgccgtttattctgacatattgaagcccgattccccgttcatcacattcaactgtgcagattactataacaaccctcaattattgctctctcaattgttcggacataaaaaagggtcttttacaggtgcgggtgaagacaaagcaggattagtcgagcaggcggacgggggcattctgtttatggatgaaatccatcgcctcccgccggaggggcaggaaatgctgttttatttcatagacagcggcacatacaacaggcttggtgaaacagagcataaacgaacggcaaaagtcctgtttatctgtgcgacaacagaaaatccgagctctgcattgctgaagacatttttgcggagaattccgatgaccgtacatatcccttcgctcaatgaacggtcccttggagaaagagtggagctgacaacgtttttattggggaaagaagcagagcggatcaaaaaaaacttaaatgtgcacatcgatgtctataatgcactgattcattctgcaaaattcggaaatgtcgggcagctgaaatcaaatgtacagctggtctgtgcgcacgggtttttaaataaccttgacaaagacgaggttgttgaactgaccgtccgggatcttccggacgagatcaaagaggactggatgtccagcagcaaaaatattgaacggagcaaaatgatttctgaatatgtcaacattacaacgatcatctctccgattgtggaagatgaagcaacgaaaatcgatgactcctttaacttgtatcatgtcatagaagaaaaagcgaaaatcctcaataaagaaggcttaacaaaaaagcaaatcaatcaatatatattaacggatattcatttgcacgtcagaagcttttttaatcagaaaatgcttcaaaaccacagtttactcaaattcgttgaagacgacgtgattcagatgacgaaagaattaaagggagtcgccgaacatgagcttgactgcaagttcgaccgtaaattcatctatttcctgagcatgcacatcgccgcatttttaaagcgcggaaagcagattgatgtcttaaattcgcaggaaacagatgaaatcagggaaacccatgtgaaagaatacgaggtcgcactcattttcaaagataaaattcaagcatatttcaaagtaaccgttccggaaatcgaagtcatctacttgacgatgctcattcagtcgattaaatcatggaaagaaaacaaaaggacgggcattgtcgtggccgcccatggaaacagcacggcaagctctatggttgaagtagccactgaactgctgggaagcaccccgatcgctgcggttgatatgcctttgaccgtttcaccctcggaaatcgtcagctgcctagcggagaaagtgaagcaggttgatgaaggagaaggcgttttaatgcttgtcgacatgggatcgcttgcgatgctggaaagcaggcttgaacaacaaacgggcgttaaaataaaaacgatcagcaatgttacgacatctatggtgctcgatgccgtccgcaaggtgaattatttgaatttgaatttgcacgccatctacgattcggttacaaaggatttcatcgatttatgggccgataaaccgcgggtctcaggcaaaaagaaggcgatcgtctccatttgcacaacaggcggcggaacggcgaagaagctcgaagagattttaacatcaatcgtgagcaggacatctgatgaacaaatcagcattttgacggtgccatcgatcaaattagcaagccgcatcaaagaaattgaaaaagcgtatgagattcttgccacggttggcacgaagaaccctaaaatcgatgctccgcacgtccctttagaagtattgattgaaggcgaaggggaaaaagtgattcagcaggtgattgcaaccggcgatatcccgatgagcggcggattatccggtgaaaatgtggttgtaaaggagctttgcgaagacagcctgaagaagtatcttgtctttttgaatccctatcatgtgatagacatgctgttggagtggcttcagacggttcaagacgaactgcgtatgacattcagcaacgctgtgctgatcaaagtcatcatgcataccgcttttgcttttgaaagggtgatcaaacagaacccgatcgcttttccggaggaggaagagatgaatgatcagcttgaaaacgttcttcacatcacagagaaaacattaaagccttacgaagaaaagcttggtcttgcgatcagcgaagatgaaaaaatgtttatcgcgtccatctttgctgaagagttatag

SEQ ID NO: 2718 - DNA, 465 bp, Bacillus licheniformis
atgcggttattcatatgtgcatcgtgcctgttcggcttgattgttccgtcatttgaaacgaaagcgctgacgtttgaagaattgccggttaaacaagcttcaaaacaatgggaagttcaaatcggtaaagccgaagccggaaacggaatggcgaaaccggaaaaaggagcgtttcatacttatgctgtcgaaatcaaaaacattggacacgatgtggcttcggcggaaatttttgtctatcggaacgagcctaattcttcaacgaaattttcgctttggaacattcctcacgaaaatccggtttctttagccaaaagcttaaatcacggaagctctgtcaagcaccgcaatctgcttatggcagagaatgcgaccgaattggaagtggacatgatttggacggaaaaaggaagcgaaggcagacttttaaaggaaacgttcattttcaagggagatgaatcatga

SEQ ID NO: 2719 - DNA, 261 bp, Bacillus licheniformis
atgccgcaaaacaataacaaacgatatgaactctttttcaaaaaaagatacaaagttctacatacattaaacgattttctcatcggccttttattccttgtcgggagcttctgctttttctccgaggaactgaagccggcgggactatggatgtttgtgatcggcagctttcagctgttaatcaggccgacgatccgtttggttcatgattttcactacagaaagtttgttgagagccggcgttccaaatgccgtgagtaa

SEQ ID NO: 2720 - DNA, 651 bp, Bacillus licheniformis
atgaattttcaaacaatcgagcttgacacatggtatagaaaatcttattttgaccattacatgaaggaagcgaaatgttctttcagcatcacggcaaacgtcaatgtgacaaatttgctcgccgtgctcaagaaaaagaagctcaagctgtatccggcttttatttatatcgtatcaagggtcattcattcgcgccctgagtttagaacaacgtttgatgacaaaggacagctgggttattgggaacaaatgcatccgtgctatgcgatttttcatcaggacgaccaaacgttttccgccctctggacggaatactcagacgatttttcgcagttttatcatcaatatcttctggacgccgagcgctttggagacaaaaggggcctttgggctaagccggacatcccgcccaatacgttttcagtttcttctattccatgggtgcgcttttcaaacttcaatttaaaccttgataacagcgaacacttgctgccgattattacaaacgggaaatacttttcagaaggcagggaaacatttttgcccgtttccttgcaagttcaccatgcagtgtgtgacggctatcatgccggcgcttttataaacgagttggaacggcttgccgccgattgtgaggagtggcttgtgtga

SEQ ID NO: 2721 - DNA, 411 bp, Bacillus licheniformis
gtgcagatctttttcaatgcaaaagatgctttatcagaagggtaccgcccctgcaaacgctgcaatccggccggggcgctgctgccggatgaagagctggcacagcgtgtggtggaaatcatcgaggaatcttatcgcgatccgctgtctctgcaagctttggctgacaggtgccatatcagcccttttcacctgcagcggacatttaaacgaatcaaaggcgtctcgccggcagaatacatcctgcagaaaaggattgagaaagcggtcgatttgcttgctcattcagaacgatcgatcgcagaaatcgcttcaatggtaggcattgcgaatgcggaatattttgcctctttgtttaaaaagaagactgggcaatcgccgacgtcgtaccggcaaatgaaacggaggtaa

SEQ ID NO: 2722 - DNA, 528 bp, Bacillus licheniformis
atggacgatcaaatcgtatactggcgtacgcttatttgccgaggttggcagattcacattggggcgactgcccgcgggctctgttttacagggggatggaatcaaggcttcgaggatttggccgcttgggctgaaaaaagatttacacagccagttttcattcgggatgacaaaggattggcagaatacgccgagcagctgcaggcgtatttgaacggcaagcgaactcatttcagctttcctgtcgaccttgccggcacgccttttcagctggcagtgtggaaggcgctctccgaaatcccttacggcagcacttgctcctattccgatatcgccgagcatattgaaaagcaggccgctgtgcgggcagtaggcgcggcgatcggcgcaaatccgctgttaatggtggtgccttgccatcgggttatcggtaaaagcgggcagctcacgggataccggggcggattggatatgaaaaaagaactgatgatgatggagtccggcggtgtaaccgcacaattcaattaa

SEQ ID NO: 2723 - DNA, 849 bp, Bacillus licheniformis
atgatgacagcaaaaaatttgcaagatcgaatcaaattgaataacgggacagctatgccttggtttggacttggcgtatttaaagtagaagaagggcccgaactggtacaagccgtaaaaacggcgattaaacacggctaccgcagtattgataccgcagccatctacggtaatgaagagggggttgggcaaggaatccgcgaggggttgaaagaagccggcatttcaagagaagacctgtttgttacatcaaaggtctggaatgacgatttaggctatgacgaaacgattgcagcctatgaggcgagtctcgaaaagctcggacttgactaccttgatttatacctgatccactggcctgttgaaggacgctacaaagcggcgtggaaagcgcttgaaacactttatgaacaaggacgcgtaaaagcaatcggagtgagcaattttcagattcaccatctggaagacttgctgaaagatgccgccgtcaaaccggcgatcaaccaggttgagtatcatccgcggctgacgcagaaagagctgcaagcgttttgccgtgcgcacggcatccagctgcaagcatggtcgccgctgatgcaaggccaattgctcagccatccactgctgaaagatatcgcggacaagtacggcaagacaccggcccaagtcattttgcgctgggatttgcaaaacggggtcgttacgattccgaagtcgactaaagcggagcggattgcccaaaacgcggacatatttgattttgaactgaccaccgaggaaatgaagcaaattgacgcgctgaatgaaaacacccgtgtcggccctgatcccgataactttgacttttaa

SEQ ID NO: 2724 - DNA, 1236 bp, Bacillus licheniformis
atgacctctgttcatgataaaaaacgcagtatattagcgcttttagccttggcggccagcgcatttgccatcggcacgaccgaattcatcagcgtggggcttctgcctttaattgctgaagacatgaatatttcggtgacgacggcaggactgaccgtatcattatacgcactgggcgtaacagtcggcgcacctgttctgacgtctgtcacatccagtatgccgagaaaagcgctgctgctggtgattatgctcatttttatgatcggcaacgggcttgcggcatgtgccggaagcatcggtgttttattaaccgcccgcgtgatttcggcgttttctcatggcgtatttatgtcaatcggttcaacgattgcggcaagcctagtcccggcggataaaagagccggagcgatatcgatcatgtttaccgggctgacgattgcaatgattaccggagttcccatcggcacgttcctcggtcagcagttcggctggcggattgcttttgcggcgatcgtcgctgtcggcgcactggcgtttatcgccaacagcttacttgttccgggcgatttgccgaaaggcgtccgaacgtctttcaagagccagttgaagcttgtgaccaatgggcggctgctgcttttattcatcattacggcgcttggttatggagggacatttgttgtctttacgtatttatccccgctgcttcagcatgtgacgggctttaaacaggaagctgttgccgtcattttgcttgcttacggcattgccgtcgcgctcggaaatattatcggaggtaaagcggccaacaaaaaaccgcttactgcattattctatatgttcatcgcccaggcggctgtgcttctcatcttaacggcggctgctccttatcaggcagcgggctttatcgtcatcatgctgatgggatttttagccttcatgaatgtccccgggctccagtcctatgtggtgattctggctgaacggtttgttccaggggcggttgatgtcgcatcagctgtcaatattgcggcgttcaacgtcggtatagcgatcggttcttatacaggaggcgccatcacacaatcgatcggattgattcacactccatgggtgggagctttgatggtgctcggcgccgtcgtgctgacaggctggagcagggcgctggaacgaaatgatcaaaaacaaaatgatcaaaaacaaaatcaagctttaaaggaaaactgcgcatga

SEQ ID NO: 2725 - DNA, 378 bp, Bacillus licheniformis
atgaagccgaaaaagtataatatatctgtcgaagctacacttgaagtgatcggcgggaaatggaaatgcgtgattttgtgtcacttgacgcacggcaaaaaacgcacgagcgagctcaagcggctgatgccgaacattacgcagaaaatgctgacccagcagctgcgcgaactggaggaggacggcgtcatcaaccggatcgtgtaccagcaggtgccgccgaaggtcgaatacgaactcagcgaatacggatggacgcttaaagacattttggattcgctgtgctcctggggcgaaaaacacattacaaaagtgtatggagacaaatttgctgttttggaggacagcgtgctgaatgaacaattacaggaaacatga

SEQ ID NO: 2726 - DNA, 666 bp, Bacillus licheniformis
atgggaaaatggtttctttccggaggcggagatgcacaccaaaccgaacagctggatcggcattttgcccggagcatctgtcctcataagccattattgtatattccgattgccatggacgccgacaggtatgatgacggcttcgactggatcagccggctctttcacccgctcggcatcaaaaacattgtcatgtggacggatgtcaaaggtaaaaccgtacacgatttagacgtgttttctgccgtatatatcggcggaggaaacacgtttcgtctgctaaaacaattcatcgaatcgcattttaccgcggttttaaagcgctatgccgaaagcggcggcgccatttacggcggaagcgccggcgccgtcattctcggaaagaacattatgacttgctcttatatggatcgcaacgcttgcggattgcgggattttaacggcttaaagctcctcggagactattcggtttggtgccactacaaggctgaacatgatccgctgattaaaaggtttaggaatgcttttggcactcccgtcatcgccttgccagaggaaacaggaatcgcagcaagcacttcagacatccgggtcatcggaacaaagcccgcccgtatgtttaaagaagacggcgcagtattcgtctcagatcaatttgttttataa

SEQ ID NO: 2727 - DNA, 828 bp, Bacillus licheniformis
ttgggaaaaggattgaacggcagaagaattgccatcggagcatcgcgaaaaacggatgaaatgagcacgctgatcaaaaagcaaggcggggttcccctcattcgctcccttcagggtaccgtgtttttggccgaaaaagaagtaggccctgatttgcgtgccttcgttgaaacgggagccgactgggtgattttcacgaccggaatcgggacggaaacgcttgtcagcctagctgagaaacttgggatcggagagcgctatttacaagcgatccgcagggcgaaagcggcatcgagaggctacaaaacaatcgccgctttaaaaaagctcggcattacgcccgttgcggcggatgaagacggcacgaccaagggactgatcgactcgctccaatcccacgatttttccggcaaacgggtgatggttcagctccacggcgaaaacgctccgtcactgcttcagtttttggaagagaaaggtgcagacgttgttccgcttctgccgtatcggcatgttgctccagaccgggaaaccgtcgctttattgtgcagcgagatcatcaaccgtgaagtggatgcggtttgctttacaacggctgtccaagtccgctcgctttttcatttcgcgaaagaaaacggctatgcggagaaaattgttcaatcttttcaagacagcgtgttggcggccgctgtcggaaaagtgacggcagaagctttaagagaagaaggagtcgaacgccttctcgctccggatctcgaacggatgggagcgatgattgtggagctagcgcggttttatgaaacggaagaggggataagaacacagtaa

SEQ ID NO: 2728 - DNA, 945 bp, Bacillus licheniformis
atgcattctcaattcgaaacccgagccgagcatttgacgaaacatgcccgttttttcgagtataccactgcctctgacccgattggaagcggaataatcagcccggttcctgtgaaagagttcgggcctgaattgtatgagacaggtgaaacgcggatcatcccgctggacatttccgaagaactgaagacggattatcccgcttcaagcccttcccttctcgcccacttcatcaagattcgttcaggcgacacgatacacactgccccccgtgcgacaagcgaactatattacattgtcagcggcgcagggaaaaccgaaacgggcgaagatacgattcactggcagaaaggcgattttttgactttgcctgccggttcaggcagccggcataccgcagcagaagatgcagccatttattacatcaccgattcacctctcctgaattatttgggcgtaaagccgtcggaatcccgctttcaaccaactctctacaccgctgaacagtcaaaagcaaaattggctgaagcggccgccgctcctgacgcccgttatcgcaaccgcatttccgttctcttgaacaatgaaatattcgatcaaacgctgacgatcacccatgtattgtgggcaatgttcggcatcgtgcctcccggctccaatcaagctcctcacagccacaagtcggtggctctcgattttgtcgcctatgccgcacccggcacgtatacattagtcggaagcaaaatcgatccggccacaaaggaaatcattgatccgaaacgaattgactgggtaaccggaaaagccttcattacaccgccgggattatggcattcccaccataatgagtcagatgaagccgcctatatcatccccatccaagatgcgggcctgcaaacgtacctccggacactggatattcaatttcagcattatgaaaaatga

SEQ ID NO: 2729 - DNA, 957 bp, Bacillus licheniformis
atgacgaaaaagcaatattcttatatattcacccttttactcgctttcgctgtatttctttcaggctgtcaaagcggccagaaacaggctgcatcagagaaaaatgaagagaaaacaagagtggtgaaaaccatcaacggaaatgtcactgtaccggctaatccgaagcgcgtcgtgacgattggctatgcgggaaccatgcttgcattcgggatcaagccgcttggagaaacgggaaagtacctcggaagtccttatattaaagatcaagtttcaggaataaaggatatcgggggaaaagacggtttttcagtatctgtggaaaaagttcttgaacttaaacccgatttaatcgtatcgatgacgaacgattcaaaagaatatgaaaagctgtcaaaaatcgctcccactgtcgtctatccgttcggcacatttaaagatgcacgcgatgaaatgaaaacgtttggcaagctgctcggcaaggaaaaggaagctcgggagtggacgaaaacgtttaatcaaaaaatgaaagccgcccgcgcgaaaattaaagatgcatctgtaaaaggtgaaacgttctctttaatcggcgcatatgcaaaatctttatatgtctacggggcatacgggtatcggggcggagaagcgatctatacgcagctgggactgacgccgcctgaatctgttaaaaaggatgccattgatacagctgacggatataaagccatatctttcgaggtcctgccgaaatatgccggagactacatatttgtcgacgaatcatacaacggaaagcttgatcaggacaatccggtttgggcatcgcttgacgcggtgaaaaaaggcaaggtctttttcctcgatccggacagattttggccgtatgatccaaacgctgttcaggcacaggccgaagaaatcgccgacatgatttccaagaaagcgaaaaataaatag

SEQ ID NO: 2730 - DNA, 900 bp, Bacillus licheniformis
ttggaactctatcaaattgaccattttattgccgtgagcaggcataaacactttacaaaagcagccttggaacaacggatttcccagccggctttgagcaggtcgatcaaaaagcttgaagaagaattgggcgtcccgctgtttattcgaaaaacaaaatcgatccgcctgacaaagtacggcgagcagttcctcatcaaagcgaagcaggcccgccttgcccttgacgaaggcgttcagcaaatcagggaaagcgtcaatccgaatgccggggaaatctcggtatcatttttgcatacgcttggttcgcggctcatgccgcagctgattgccgaatttaaaaagaaatacccgaatgttgctttccgtctgtatcaggccgcaaatgaacatcttcagcacatggtggagacgggcgaagctgatatctgcctcagctctccgccgcttccaaacgagcatcttgaatggacggtgttggatactgagccgctttatctggtgcttccagccgaccacccgcttgcagatcggaaagaagtcgcgatccggtcgattgcacacgaagactttgtctgttttaagccgggctatggtcttcgatatgtgtttgatcaaatgtgccggggactgtccatcagcccgaagcttgcttttgaaggggaagaagtgtcgacgattttgggactagtatcagcagggctcggtgtagcaatcctgccgaaaacggcggagcacgtccattctccagtggcattttgccgagtgtcagactaccgttctgagaggacgatcggtctcgccgtcctgaaagaccattatttgtcgccggcggcacgcaactttaaagaatttgtaattgaatactatcgccggaacgaacggtctgatcagccgtaa

SEQ ID NO: 2731 - DNA, 1218 bp, Bacillus licheniformis
atgacctacatacagccgcattcgaaggattatcacaaagcgagcatcgccttattcatcagcggttttgtgacatttgccacactttacaccacacagccgctcatgcctctgtttgcggaggaattcggcatatcggcggcagctgcaagcttaactttatccatttcaacaggcatattggcttttgcattgctcacggcagcagctttatctgacgggttcggccggaaaacgattatggcaatatccctgtttgcgacatcagtgctcggcctcttgaccgcctttagtccgaacttcgcggcgctcttggcgatgagagggctgcttggctttttccttgcaggcgtgcccgcgatcgccatggcttatgtcggagaggaatttgatccgcgagggctcggcaaaatgatggggctatacattagcggcacaagcctcggaggaatgagcggaaggcttttgaccggccttttgacagacttgttcagctggcgcgcggcgctaggaatcatcggggcattatcagtactattaagctatttgttttggattttgctgccccggccgcagcactccgctaagcgaaaaacaagtgtgaaaaaagcgagcttggcctacggcgccgtcttgatgaacaaacggctgctgtcaatcatttcacttggatttctattaatgggaagctttgttacgctgttcaattatatcgggtttcagttgatgggacctccgtacagactctctcaaactgtcatcgggttcatctttatcgtttatttggcggggacgctcagttctgtctatatggggaagaaagccgatcgttttggcagcccgttgatgctgaaaatcgggattgccattatcgcaggaggcgcattgcttacgcttctgcctcagcttcctcttaaaattgccggaatcgctgtttttacatttggatttttcgggtcgcattcgatcgcaagctcctgggtcgggcagacggccggcgaacagcgcgttcaagcttcctccctttatttgctgagctattatctcggctcaagcttagcggggtctttcggaggcttcttctggacccattttaaatggccgggaatcatctcattcattatcgggctgcttttgatcgcttatccggtcattttctttgccgaagccaaaagaaacaaacggcaagacaattcacaggtccgaaataaaagctaa

SEQ ID NO: 2732 - DNA, 384 bp, Bacillus licheniformis
ttgcttaaaacaatcggattttatggatttttggcatctgtatgtttaaatctttttctcaggtttgggctcaagataaacggcacagcgaatgatatcatctcaacggcctccctcgtattcgtgctggtgtacgtatgggacgacttgaaaaaacgaagtgcaaaaacgctcatcttacagggaatcactctcatcatctttgtggcgttattggtgtttgtcatcatgaaaggacaaacattcattgcttctctgccttttttcgagggttgggaaacgccggcaaaatgggtgtatattttgctcgttttgttcttgggatcaaaccttttcatctatatcaatgaaaaaataacaaactctaaaaaagaggcatcctga

SEQ ID NO: 2733 - DNA, 3225 bp, Bacillus licheniformis
atgaacaagttagatggaattccaatccctaaaacttacgggccgctcggcaacctgcctttgcttgacaaaaacagggtctcccagtcactttggaaaatcgcggatgagatggggcctatctttcaatttaagtttgcggatgcgattggggtttttgtgtccagccatgaactggttaaagaagtctctgaagaatcccgttttgacaaaaacatggggaaggggctattgaaagttcgcgagttcagcggagacgggctctttacaagctggacggaagaacccaattggcggaaagcccacaacatccttctgccgagcttcagccagaaagcgatgaagggataccatcccatgatgcaggatatcgccgtccagctcattcaaaagtggtcccgtctcaatcaggatgaaagcattgatgtgccggacgatatgacgcggctgacgctggacacgatcggcttatgcgggtttaactaccgctttaacagcttctaccgtgaagggcagcatccgtttattgagagcatggtccggggtttgagcgaagcgatgagacagacgaagcgcttcccgctgcaggataagctgatgattcaaacgaagcgccggtttaacagcgatgtcgagtcgatgttttctcttgttgaccggatcatcgctgaccggaagcaggccgagagtgaaagcggaaatgacctcttgtcgcttatgcttcatgcgaaagaccctgagaccggcgaaaaactggatgatgagaatatccgctatcaaattattacatttttgattgccggacacgagacgacgagcggtttattatcgtttgcaatctatctgctcctgaagcatccggataagcttaagaaagcgtatgaagaagcagaccgcgtgctgaccgatcccgtcccatcctacaaacaggttcagcagctgaaatacatccgaatgattttgaatgaatcgataaggctttggccgacggcaccggctttctctctttatgcaaaagaagaaacggttatcgggggaaaatatttgattccaaaaggacagagcgttacagtgctcatcccaaaactgcacagagatcaaagcgtctggggagaagatgccgaggcattccggcctgaacggttcgagcagatggacagcattccggcgcacgcatacaaaccgtttggcaacggccaaagggcatgcatcggcatgcagttcgcccttcatgaagcgacgcttgtgctcggcatgattcttcagtactttgatcttgaagatcatgcaaactaccaattgaagatcaaagaatcgctgacattaaaaccggatggtttcacaatccgggtgaggccgaggaaaaaagaagcaatgacggcgatgccgggcgctcagcctgaagagaacggacggcaggaagaacggccttccgcaccggcggcggaaaatacgcacggaacccctcttcttgtgctctacggttcaaatctcggcacagccgaagagattgcgaaggagcttgctgaagaagcgcgtgagcaagggtttcacagccggacggcggagcttgatcaatacgcaggcgccatcccggcagaaggggctgttatcattgtgacggcttcctataacggaaacccgcccgattgcgcaaaggaatttgtcaattggcttgagcatgatcagacagacgatttgcgtggtgtcaaatatgcggtattcggctgcggtaaccgcagctgggccagcacctaccagcggattccgcgcctgattgacagcgtattggaaaaaaaaggcgcccaaaggctgcacaagcttggagaaggggatgcaggcgatgattttgaaggacagtttgagtcatggaaatatgatctgtggccgcttttaagaaccgaattttcattggccgaacccgagccgaatcaaacagaaacagacaggcaagccttatctgtcgagttcgtaaacgcacctgcggcttcgccgctggctaaagcttatcaggtgttcacagcgaagatatcggcaaaccgagaactgcagtgtgaaaagagcgggagaagcacaaggcatattgaaatatcgcttcctgaaggcgccgcatatcaggagggagaccatctcggtgtgctaccgcaaaacagcgaagtgctgattggccgcgtttttcagcggtttgggctgaacggaaatgaacaaattctgattagcggccggaatcaagcatcacatttgcctttggagaggcccgttcatgtcaaagacctttttcaacattgcgtcgagctccaggaaccggccacaagggcccagatacgcgagctggcggctcatactgtttgtccgcctcatcagcgcgagcttgaagacctgctgaaagatgacgtctataaggatcaagtgttgaataagcggctgacaatgcttgacctgcttgagcaatacccggcctgtgaactgccgttcgcccgttttctggcgcttcttcctccgctaaaaccgaggtactattcgatttccagttcgccgcagcttaacccgcggcaaacaagcatcaccgtctctgtcgtaagtggcccggcgttgagcggccgcgggcattataagggagttgcatcgaactatctcgccggccttgagccgggagacgcgatttcgtgtttcatcagagagcctcagtcaggcttccggcttcccgaagatcctgaaacaccggtgatcatggtcgggccgggcaccggaatcgccccttaccgcggatttcttcaggcgcgccgcatccagcgcgatgccggtgtgaagctcggtgaagcgcatttgtacttcggctgccgccgtccgaacgaagattttctgtatcgagacgagttggagcaagcggaaaaggacggaatcgtccatctgcatacagcgttttcccggcttgagggccggccgaaaacatatgtgcaagatttgctcagagaggatgcagccttgctgattcacttgttgaacgaaggcggccgcctgtatgtgtgcggagacggaagccgcatggctccagctgttgaacaagctttgtgcgaggcgtatcgcatagtacagggtgcgagtcgggaagagtcgcaaagctggctgtccgcacttttagaagaagggcgctatgcaaaggatgtatgggacggcggcgtttcccaacataatgtgaaggcggactgcattgcaagaacgtaa

SEQ ID NO: 2734 - DNA, 576 bp, Bacillus licheniformis
atggaatcggaaagcaaatatcagaagattatcgaggcttcgctcgtccttttcgcggacagaggctttgacgccgcaaccattccgatgatcgccgataaggcaaacgtcggtgcaggcaccatctaccgctactttgacagcaaggaagcacttgtaaacgtcttgttccaagacagtgtgaagagatttaaagaaaagatagaggagggctatcctgaagattcagcaggcataaaaaaacaatttcagcacattttccgctgccttttcgagttttctcaggaaaatatccatgcgctgtattttttggaaattgacaagacctctcattacttgactgagaaaagccgcgaggtcttgaacgaactgctggatttcatctatttattttttgaaaaagggaaagcggccggcatgattcgccctttgccttcccacattttgtcggctgttgtattcggagcgttcgttcatattcagaagttggtaagagcaggggaattcgaggaccctaccgaactgatggaggagattgaagaatgttcctgggatgctgttaaacatcatggatga

SEQ ID NO: 2735 - DNA, 3060 bp, Bacillus licheniformis
atggcagccgaagacagcgttccgaataacgaaaccacattgaccagcgcgtcccctgttgaagcttcgtttcaaagcgatgacgaggtgcattggtataaagtcaatccttcaaatcaggaaatcgcaaactatacgcacttccgcgtcaaattgaaatcagatgcagagctgaacatttccgtctactccagcctggaaaatgcaactggtcatcaaacgtttgaccgatacaacggctactcctatgaaaataatcctgctttaatcgattttccgattgcctggaaaggtccttactacataaaagtagaaaatcaccatgatgaggaaaacgaaaccacttcaattacagatatttcttacaccatcagctatgaaggcgtcaccctgcctccgtcaatccaagaggcagaagaagagtgtccggcagaattaagcgtttccgaaagggaaacaggcaagggcatattaaaacagttaagaacgatcagggatgaagttctttcaaaaactgaaaaaggaaaagagctgtcttccctttactataaagcagctccattcatcagcgcaaaaatgctctttaacaaatcgatgagagacagtgtctacaaagacctggtgcagctgaagccgctgtttgcagatgtcgctaaaaacggacaagtgagcgcatactcgattacgaatgatgatcaaaaagcgatcagtcgcctgtacgaaacagctcgcgcgtccgttcccgagccgttgaaaaaacagctggatcaagtcgcgaaagacatcggcatcgaacaattaacaggcagcaaagtatcggctgtgcttgaaaaagcggggatggcgacagcttcatcaagcgcgcccgaaaaccgttacatcgtaaaattgaaagaaggcaaaaaaccgggatctttcaaatctaaagcccaatcatccggcgtccaggcattagagcccctcggtaaaagcaaaacggcatttaaagatatgtacgttgtggaaatgaaggaaagccgttcttccggattcaaagcggcggcaaagcaatatcaggcggcagcctccaagatcgccaagatgcctgaagtggaattcgtcgaacaggttcagcaatatgaagcactgtcaagagacacccaatatccatatcaatggtcgctcaaaaataacggcaaaaaccgtgctgcgaatgctgacatacaatttgaacagcttcagaagctgatgaaaggcaaaaagctgaaagatacagtaatcgccgtcgttgacacaggcgttgatcatacccttgcggatttaagcggcagcgtcaaaaaagacgaaggctataactatgtcggccgcacggcggatgcgatggatgacaatggccacggcacacacgtgtcaggcatcattgcagccgcgcaagacaaccatttttcgatggcgggaatcaatgcttatgccaaaattctgcctgtcaaagtgctggattcttcaggcagtggagatacggaacagattgcaaacggcatcatctatgccgccgaccacggtgcaaaagtcatcaatttaagtcttggcgggccatacagccgggtgatggaatatgcgcttaaatatgcggcttctaaaaatgtgacgatcgttgccgccaccggaaatgacggagtatcggagatttcctaccctgcatcttcgaaatatacgctttcagtcggggcgaccaataatctcgatcttgtctcggactactccaattatggaaaaggtctcgatatggtggcgccgggaaccgatattccaagcctcgttccggacgggaatgtcacttatatgagcggaacatcgatggcggcgccgcacgtggcagctgcagcaggacttcttttgtcacagaatccgtccttgaaaccaaagcaaatcgcaagcctattgaccgagacgacagcagatgtggcatttgaagagcaggataatccaaacccggattatgacctggatatagaaccggctgcacaaattcccggatatgacttcgtctccgggtggggaaggctgaatgtttttcatgcagccagcgtttttgagctgaacatgaaggttcatcccgttttaaaccgccatacggcagtgacaggcacagccaaaagcggtgtgacggtcaaaatcttgcgagggaagcaagtattggggacgggcacggccggaaaatcaggcgcgttttcagtgaaaattccggcccagaaggcggggcaagttcttcatgtcgcggcatcgggccatcaggcggaaacctcgctcagaaccgtcgtggaaaaagcgccgaaaaacccgtccgtcaaacgcatcacgaacaaagatactgccgtaacgggtagaacggcagccggctacacgatcaaagtgaaaaacgcgtccaaaaaagtgatcgcgcaaggcaaagcggatgcatccggagcgtttaaagtgaaaatcaacaagcaaaaagaatatgccgttttgtatgtctccgcatctgctgatgaccacagagaaagcggcgatgtcaaaatgacggtggctgacgtcatcccgccaggcgccccgaaagtttatcaggtttccgataaaagtacggtgattcagggaaaaacagaagcaaacgcgcaagtcagcgcaaaagctaaaggaaagacgatcgcttccggcaaagcgaacggaaaaggtgaatacaagctgaaaatcagcaggcaaaaagccggaaccgtcatcggtgtaacagcaaaggataaagccggaaatgtcagcaaagcgacagccgtcactgtgcttgacaaaaccccgccgtctgcgccgaaggtgaatccggtgacaaacaagagcacggccgttaaggggaaagcagaagcgaacgccgccatcatcgtcaaatcaggaaagaaaacgatcggaaccggcaaggccgataaaaaaggcgcgttttttgtcaaaataaaaaaacaaaaggcaaacaccgttttagcggtcactgcaaaagataaagccggcaatacgagcaaagtgagcaaaataaaagtcaaaaaggcaaaataa

SEQ ID NO: 2736 - DNA, 606 bp, Bacillus licheniformis
gtgtttgaacaatggcttggaaaacaattgcggagcccgagaggcattttgtcgaaatgggtcgcgtcatatatggaaaacgggaatcatgatataaacgaatggaccatcaacttgatggatatctgtccgcatgagcgcatccttgaaatcggaacgggaagcggagcggcactttatcggattgcggagatgcttgagggcggcaaggcctgcggcatagacgcatcaaaaagcatggtcaagcagggaatgcggcgaatccgtcatgtgaaagaagaaggaaaagccgaattaaagcttggccatgccgaacaaattccttatccggatcgttcttttcataaagtattttcagtccacaccatttatttttggacggatttcaaacaggcattaaaagaaatttaccgtgttttacaggttgacggcacgctgtttctcgctgtgcatctggaagggcaaatgaaaaaatcgaaaaaaacaaaaggcttttccttatactcagaagagcaaatcaagcaactgcttgaggaaagccatttcagagacatcacggtacatatgaacaaaaattactgctgcatttctgcggtaaaatcatga

SEQ ID NO: 2737 - DNA, 150 bp, Bacillus licheniformis
atgggctttggttacggcggcggatgctgcggcggctggggtggctaccctggcggatacggcggcggatacggctatggaggcggattcgcgcttgttgtggttctattcattcttttaattatcatcggcgcttgttacgtctgctaa

SEQ ID NO: 2738 - DNA, 150 bp, Bacillus licheniformis
gtgaccattaatctattcttcttaacactaaccattcagagacgatttaaaagtccggaagagtacgagcgagaatacgaaattgaacaaatgtacaatgaaatgaaagatctgcagctaaaatatctttacctgaacagccagcgctaa

SEQ ID NO: 2739 - DNA, 234 bp, Bacillus licheniformis
atgcagaagaaaaaagtcaaatcgctgatggaagactataagcagtttgcttttacgcttctcagcgtaagcgcatttttatatatcggatctgtcattccgggacaaggtttggaaacagcccaaaagatgacaatgatgctcgcgacgtgcggctttttaggaggagctttctattgtgtgaagcgctcgctcaaatataaaagacaattagacgaaatggaagaatcataa

SEQ ID NO: 2740 - DNA, 1143 bp, Bacillus licheniformis
atgaagccaaaaacgaaaatgattcacggcggaattacaggagacgaaaaaacaggagcggtatcggttcctatctatcaggtcagcacgtacaaacagcctcgcgccggccagcatacaggatacgaatattcccggacgggaaatccgacgagaacggcgctcgaatccttgatcgcggatgttgaaggcggtgcagcaggctatgcgttcggctctgggatggcggcgatcacagccgtcatgatgctttttaaaagcggcgatcacatcgtattgacagatgatgtatacggcggcacctaccgcgtgatgacaaaggtattgaatcgcatcggcattgaagcgaccttcagtgatacgagcagcatcgaagacatcgaaaaagcgatcaagccgaatacaaaagcgatttatgttgagacgccgacaaatcctttattgaaaatcactgacatcaagaaaactgctgaaacagcgaaaaagcacgacttattgctgattgtcgacaacaccttctacacgccgtactttcaaaatccaatctcgttgggagccgatatcgtcctccacagcgcgacgaagtacttgggcggacacagcgatgtcgtcggcggacttgtcgtagcagcctcgaaggaactcgcagaagagatccatttcattcaaaactctacaggcgggattctcgggcctcaggattcctggctcttaatgagggggatgaaaacccttggcttgagaatggaagcccatgagcaaaatgcccggaaaatcgcggcgtttttagacgatcatcccgccgtcaaaaaggtttattacccagggctgccgtcccatccgggacatgagcttgccaagcggcaaagtacgggcttcggaggcatgatctcgtttgatatcggaaaagaagagaacgtggaccttgtccttggccgtttgaaatggtttacgatcgccgaaagccttggtgcggttgaaagtctgatatcggtgccggcgcgaatgactcatgcttcgatcccgcctgaacgcaggctggagcttggcatcacagacggattaatccgtatttccgccggggttgaggatattgacgatctgttggaagacttgcagcaagcgctggcccctctttcttaa

SEQ ID NO: 2741 - DNA, 924 bp, Bacillus licheniformis
atgaatgtgatcaaggatatcaccgaattgatcggcaaaacgccgcttctgcagattttggattttcgaatccctaaaggcgttaacatatatgcaaaacttgaaatgatgaatccgggaggcagcattaaagaccggctcggagaagtgctgattgctgaagcgatcggttcgggaaagctgaaacccggtggaacggtcattgaggcaacagcaggcaatacgggaatcggtctggctctcgccgccagaaagcacggcattcgacccgttttttgcgtacccgagcatttcagcatggaaaaacagtcgattatgaaagcgctcggcgctcggatagttcatacccccagaagtgccgggatgaagggtgcgattgaaaaagcacttgaacttgagaaggagattcccgattcttattgcgttttgcagtttaaaaacccagtaaatccattggcttactataaaacgattgccccggaaatatggaatgatcttggcggccggattgacgtcttcgtcgccggagcggggtcaggcggcacatttgcgggaaccgccaagtttctgaaagaaaaaaatccgtccattaaaacggttattgttgaaccggaaggctcgattttaaacggaggggaaccgcatgggcataagaccgaaggaatcggaatggaattcatcccggaatacatggaggaaagctatttcgatgagatttacacagtgcttgacgaagatgcgtttcgactcgtaaaagaagccgcggaaaaggaagggcttctgattggaagctcatcaggcgccgcgttgtttgccgcattgaaagaagccgaaaaagcgaaagccggcacaaacattgtgacgatttttcccgacagcagcgaccgctatttaagcaaaaaaatttacgaaggaggaatatga

SEQ ID NO: 2742 - DNA, 696 bp, Bacillus licheniformis
atgaaaatcgcagttatcggagcaatggaagaagaagtcacgattttgcgaagcaaactcgaacagacgaaccgggaagtcatcgcaaactgtgaatttaccagcgggttttatgaaggaaaagaggtcgtgcttttaaagtccggcatcggcaaagtcaatgcagccatgagcacgacgattctgcttgaccgctttaaaccggacgttgtcatcaacaccggatcagccggcggctttcatcattcgcttaatgtcggagatatcgtcatctcgaccgaagtccgccatcacgatgtcgatgtcacggcatttgattatgaatatggacaggttccgaatctgccggctgcatacaaagccgacaatgcattgatccaagcggcggaagacgaagcgtctgaactggggcacattcaggttgtcaaaggaacgatagcaacaggcgattcctttatgagcgatcctgaccgcgtcgcattcatccgcggcaagtttgaagacctttacgcggttgaaatggaagctgcggctgtcgcgcaggtttcttatcaatttaatacgccgtttgttgtcatcagggcgctctcagacatcgccggaaaagaatctgaaatttcatttgaccaatttttggaacaggctgccaagcattcgacagatcttgtgcttcgcatgattaaaagaatcaattaa

SEQ ID NO: 2743 - DNA, 642 bp, Bacillus licheniformis
atgggaagagagttcattcctttatttgagaactgggcaaattcttatgatgatacagtagttggccgcgatcttcaatacaaagaagtgtttcgcgactacgacggcattttggatgatgtcgtcagccgctcggggcataaagttcttgaattcggcgtcggcacaggcaatctgactgcaaaattgctggcggccggaaaggcagtcaccggtgtagagccttcaaaagcgatgagggaaattgccgaggcaaagctgccggagaatgcagtgatcgttgacggagactttattgactttccggaccctccgttttctcccgacacgattgtcagttcttatgcgtttcaccatctgacaaacgaagagaagcgggaagctgtgaagcgatatggaaaaatgctcgggaagcatggtaaaatagtgtttgctgataccgtcttcaagaatcgggaagccttctctgccgctgttaaaaaagcgaaggaaaacgggtttctgcaattggcggaagaccttgaaacggaacattatccgacgatttcggagatggaaacgatctttacctcagaacatttcagtatcgcctttcaaaagcataatgattttgtctgggtaatggaagcggcaaaattgtaa

SEQ ID NO: 2744 - DNA, 219 bp, Bacillus licheniformis
atggaggattggtttatgaacttcggcctcgatctgatcaaagataaaattgagttttttgaggcactgagcttagaggagcttgaaaaaaagatcagtcagcagattgaaaacaaccaggcgattttgctgagggtccattcggtttcccaccatacggcggttattgacggacggatccactacagcgcagtcgttcattttaaagccgaatcataa

SEQ ID NO: 2745 - DNA, 687 bp, Bacillus licheniformis
ttgagcgaaacaagggaatctcgttttgaaaatcgtgataagcgcaggaaagcgaatcttgtgcttaacattttaataggcatcgtattggtattaatcgttgtcgttgccagcagtctgatgatgaacagtccgaaggagcaggcgcagcaagatgtctcgaaaaacgattctgaacagacgacagaagcgcctgcttccgacaataagaaacaaacatctgatgaagatgtaaaagatgaggacaaaggaaaaagcgattctgccgataaagaagacagcgattccgactcagacaaggataaagaatctgcttcagacgaggacaagtcaacatcagatgatccgtttgaaggagccgaagtgacagaaggcggttcaagcgccaatgttgaaaaaacgatcatcaatcctgactgggagcctgtcggcacacaacagagcggacagcataccgcaacatatgattcctcttcacaagactggaaggaaatgcttgaagccatttcatatgcgacaggggtttctaaggataacatgacggtgatctggctcggaaacaacggcagcccgcaagatgcgaaaggaaccattcgggcgaaggacactggcgtcaaataccaggtagccattacttgggttgacggaaaaggctggaagccgacaaaagttgaacaattgaaataa

SEQ ID NO: 2746 - DNA, 1755 bp, Bacillus licheniformis
atgaaatggcaaaagcgtatgaagtgggtatcgattatcatttcggctgctcttttatttctgctgatcaggctggctgaaattcaactgttttttaccgagtccttttctaaacggaatgtgaacttaatccaggaaagcgtcaaacagcgcacggaggaagttcggatttcagacgggagaggatcttttttagatcggaacggcgaacatttgtccgtcagccaaaaaccggccatcgtcttgttcccttttttaaaaaatcagccgtggccggccaaagaagcagccgaaattttaaacatgacagaagatgagcttggaagcaagctggaccatgcaaaaaaacccgtgattctcacaaaacatgacggagcgtccgtttcaaagacggctctcgaaaaaatcaataaactgaaatatccgggcgtttacggcgtatacatagaagaaacagaaaagaacaggctggcttcgcatacgctcggtatgaccaatcaagacccggacctcctcagacgcaaatatcccgataaagagggcctctccatcagcacgaaaatcggcaccttcggcatggagcggacgtttgatgaattcctgctgcctgaacaagacacaaaactgttgtatcatgtggacggattgggaaaccctttgttcggcatggacgtcaaatatacagcagacgcaaatccgttttacccgctgcaagtcaaaacaacgctcgataaaaaggttcagcaggcaatggaagatgtacttgatgaccatcagctcgataaaggctgggcggtcctgcttgacatcgagacgaacggcgtggtggcgattgcgagcaagcccgacttaaacatggctgcgcaaaaaacaaggcagaactatatgctgactccggtatatcccggctcggtttttaaaaccgtgattgccgctgcagcgattgaaaacggcttggatcatccgtctaaaacctttaactgcaatttgaacctgtacggtgaggccggagaggacaaaggaaagctcagcctggaagacagttttgcggaaagctgcaactacacgtttacaaatcttgccggacagctcgtagaaaaaaacagctccgtgatcgaagatactgctgcaaagcttgggctgaccggacgggtcggctgggaaggaaagctgtatcatgaagatgagttcagacagttttatcatgaaactgcaggatcaatctggggggatgaaaaggacaaaaaagttaaaaaagctgtagcccagaccgctatcggccaaaagaatgtgaagctgactccgttggaaatcgtcaacatgatggcgaccatcgcaagaggcggagagaaaaaacaagtcaagatcgcagaccagatcgaatataaaaacggcacattgatgacggcttttaaagatcacgagctcccaggagagaaaatcgaccagtatacagcgcaaaagctgcaaaaactgctcagaaaagttgtcacatctgaaaaggggacgggccggcgcttcagcgatcttccgtacgatgtagcgggaaaatcgggcacagcgcagacaggcaggacgacagatgacaaaaaaacgctctatcataaatggtttgccggttattttccggcggacaagccgaaatatgcgctcgtcgtcgtccatatggatacgccggatagcaaggctgcgacaaatgccgtattttatgatattgttaaaaaagtatatgaaattgaaaagaaccagacatag

SEQ ID NO: 2747 - DNA, 477 bp, Bacillus licheniformis
atggcacaagagaaagtatttcctatgacagaaacgggaaagaaaaaactggaagaagaacttgagtatttgaaaacggttaaacgtaaagaagttgttgaacgtattaaagtggcaagaagcttcggagacctttccgaaaactccgaatacgattcagcaaaagaagaacaagcttttgtagaagggcgcatcacaacccttgacaatatgatccgcaacgcaaagatcatcgaagatgacggtgcaaactcagacatcgtcagccttggaaaaaccgttacatttacggagcttcctgacggtgaagaagaatcttatacgattgtgggcagcgcggaagccgatccgtttgaaggaaaaatctcgaacgattccccaatcgcgaaaagccttctcggcaagcaggttggagacgaagtaaccgttcaaacacctggcggcgaaatgcttgtaaaaattgtgaaaatttcataa

SEQ ID NO: 2748 - DNA, 636 bp, Bacillus licheniformis
atggggaaaaaaccggtagttatcggcatagcgggaggctccggatcaggaaaaacgagcgtcaccagatccatttatgaacagtttaaaggtcattcgatcttaatgctcgaacaggatttatattataaagatcagagccatctgccgtttgaagagcggctgaatacgaactacgaccatccgcttgcatttgacaatgactatttgatcgagcatttaaacgaattgctcgcgtacaggccgatcaaaaagccgatttacgattacaagctgcatacgcgttcagaggaagtcgtgcacgtcgatccgaaagatgttattattttggaaggaatccttgttctcgaggatgaaaggctccgcgacttaatggacatcaagctgtatgtcgatacggacgccgacctgcggatcatcagaaggatgctcagagacataaaagaaagaggacgttcgatcgattctgtcatcgagcagtacatctcagtcgtcagaccgatgcataaccagtttgtcgaaccgacgaaacgctatgccgatatcattattccggagggcggccaaaaccgcgtcgccatcgacctgatggtaacaaaaatacaaactattcttgaacaaaacgcgattttataa

SEQ ID NO: 2749 - DNA, 1269 bp, Bacillus licheniformis
atgtctgcagtaaaagataaaatttccaaaatcgttaatggaaaacgcgtcattacgaaaaagccagaacttcttgctccggcggggaatttggaaaaactgaaaatcgctgtccactatggagcagacgctgtatttatcggcggacgtgaatatggactccgctcaaacgcagataacttttcaattgaagaaatggctgaaggtgtcgaattcgcgaaaaaatacggcgcaagaatttatgtcacgacaaacatttttgcgcatgaagaaaatatcgacggactggaagactatttgcgcgatctcgagggagcaggcgtgtcaggcattatcgtcgctgatcccctgatcattgaaacgtgccgcagggttgcgccgaagctggaagtgcatttgagcacacagcagtccctttcaaactggaaagccgttcagttctggaaggaagaaggccttgagcgggttgtgctcgcacgtgaaacgagcgcacttgaaatcagggaaatgaaagaaaaagtggatattgaaatcgaaacgtttattcacggtgcgatgtgtatcgcttattccggccgctgcgtgctcagcaaccatatgacggcaagggactccaaccgcggaggctgctgccagtcatgccgctgggactatgatttgtatcagacggacgggacgaatgcactgccgctatatgaagaaggcgatgctccatttgcgatgagcccgaaagatctgaagctggtcgaatcgataccgcaaatgattgaaatgggcatcgacagcctgaaaatcgaaggccggatgaaatcgatccactacattgcgacagtcgtcagtgtgtacagaaaagtgatcgatgcttattgcgctgatcctgaaaacttcgtcatcaaagaagaatggctgaaagaactggacaaatgcgccaatagagacacggcgcctgctttctttgaaggaacgccaggatatgaagagcagatgttcggcgtccacggcaaaaagacaacatacgactttgtcggacttgtccttgactatgatgaagagacaaaaatggtcacgctccagcagcggaacttctttaaatccggagatgaagtcgaatttttcggtccggaaatcgaaaatttcacatgcaaaattgacacgatttgggacgaaaaaggcaatgtgcttgacgcagcccgccatcccctgcagatcgtcaaatttagagtggacaacaagatttatcctagcaacatgatgagaaaggggcagtaa

SEQ ID NO: 2750 - DNA, 930 bp, Bacillus licheniformis
atgaaaaagcctgaactgcttgtcacgccgacttctgtttcggatattaagcctttggcagaggcgggcgccgatgcgtttatcatcggtgaacaaaggtacggtctgcgtttagccggggagttttccagagaagaagtaaaagaagccatcattcaggctcatgaaaaaggcgcaaaagtatatgttgctgtgaacgcgatttttcacaatgaccgggttccggaactgaatgactacctttcattcttggacgaggcaggcgcggatgcggttgtcttcggcgatcccgccgtactgatggctgcacgggaatcagcgccgaacatgaagcttcactggaatacggaaacgaccgcaaccaatcattattcctgcaactattgggggcgcaagggcgcgaagcgcgcggtgcttgcaagagagctcaacatggacagtatcgttgagattaaagagaaagcagaagtcgagattgaaattcaggttcacggcatgacatgcatgttccagtcaaagcgctccctgatcggcaactattttgaataccagggaaaagtcatggatatcgaaggcaagaaaaaagaaaaaggcatgtatctccatgataaagaacgcggaaataaatatccgattttcgaagacgaaaacggcacgcacatcatgagtccgaatgacgtctgcatcattgatgagcttgaagatttaatcgatgccggcatcgattcatttaaaatcgacggaattttaaaatcggtcgaatacatgactgaagtaacggccatgtaccgcgaagccatcgacctttgcatcgcagacagggaagcatatgaagacaagaaagaacaatggatcgagcggatcgaacagctgcagcctgcaaaccgcagcattgataccggattctttttcaaagaaacagtatactaa

SEQ ID NO: 2751 - DNA, 663 bp, Bacillus licheniformis
gtgaagattggacacgaagaattgaccggctatcttgaaaagctgctaaagccgcggccggctgaaattatgaaactggaggcctatgccgaagagcatggcgtgcccattatggaaccgacaggaatcgaagtgctcctgcagcttctttcattcaaaaatccgaaaaaaattcttgaaatcggtaccgccatcggctattcggcgattcggatggcgcttgcccttcccgaagccgagatttttacaatcgagcgcgatgaggacaggtatcgggaagcgctgaaaaacatccggtcattccagcttgaaaacagaattcacgtgttcttcggcgatgcgctcagcgagtctgaccccgttcaatcgatggctccctatgatgcgctgtttatcgatgccgcaaaaggccagtatcagaagtttttcagtatatatgaaaaaatgcttgccgatgacggcatcatttttacggacaatgtccttttcaaaggccttgtcgcatcagaatacaatcagatcgaaagcaagcgcatcaaaaagcttgtatcgaaaatagatcattacaatcattggctgatggagcatcctgactaccacacggcgatcctgcctgtgggcgacggattggccgtcagtcaaaaaagaggtgaacggatatga

SEQ ID NO: 2752 - DNA, 1113 bp, Bacillus licheniformis
atgtttgaagatcagacaaagaaaccgtttataaaaagactccttaaacataaaataaagttttggctgactgtggttgcggttctgctgattttaaccgcaggcgctgtttcgctctacgttaaatcggcgctcgaaccggtcgataaaaataatgcaaaaacggtcaatgtctatattccggaaggatcgaccgttacgtccatcgccgccaaactgaaaaaagaggacctaattaaaaatgaaaaagtatttatcgcttatgtgaaatttaaaaatgcctccggctttcaagcggggaactttcagctcagccagtcgatggatgcggcaggcatgattaataagctgacaaccgcttcacatgtgccggcatttaaaattaccgttcctgaaggaaggcagctccaggaaatcgcagacatcatcgccggacaaacgaactactcggcaaaggacattatgaaaaagctggatgacagggaattcatcagccgattaaaacagaagtatccgaaactgatcacagacgacgtgttgaacaagaacatcaagcatccgctcgaaggatacctgcatcctgcgacatatccattttacgaccctgagacgaagcttgatgccattatcgaagcgatgatcaaacaaacagatcagctggctgaaaagtatgaaaagcagatgaaagacaaaaagatgtccgtccacaaagccttgacgatggcttcgttaattgaagaagaagctaccgaaaaagcggaccggcacaaaatctcaagcgttttctacaaccgcatcagcaaaaatatgccattgcaaacggatccgaccgtcttatatgcactgggagaacataaaaaccgcgtcatgtacaaagaccttgaagcggattccccatataatacgtacaaacataccggtcttccgcccgggccgattgcaaacgctggagagacttcctgggaggcggcattaaatccggagcaaacagactatgtttattttcttgcaaagaaaaacggggaagtcgtctttacaaaaacgcttgaagaacacaataaagcaaaagccaaatatattacgaacacgcaggacgaggaaaaaggagagtaa

SEQ ID NO: 2753 - DNA, 294 bp, Bacillus licheniformis
gtgattacgatggaacacggagaaaaaaacattacaattgtagacgataaagggaatgaacagctgtgtgaagtgctctttacatttgacagcgatcagtttaacaagtcatacgtgctttattatccgattgaagcacaggacgatgaagagatcgagatccatgcttcaagcttcgtaccgaatgaagcaggagaagacggcgaactgatgccgattgaaacagaagaagagtgggatatgattgaggagacgctgaacacgtttttagcggatgaagacgaagaagaataa

SEQ ID NO: 2754 - DNA, 420 bp, Bacillus licheniformis
atgcgaatattaggtctggatttaggttcgaaaacgctcggcgtagcgctgagcgatgaaatgggctggacggctcaagggatagaaacgattaaaatcgacgaggcgggcggtgactacggcttgaaccgccttgccgaattgacgaaagactatgtaatagacaagattgtactcggttttcccaaaaacatgaacggaaccgtcggcccgaggggggaagcgagccagaagttcgcggaagtgcttgaagaaacgtttcaagttcccgtcgtgctttgggacgagcgcctctcgacaatggcggccgaaagaatgctgatttcagcagatgtaagcaggcaaaagagaaaaaaagtaattgataaaatggcggccgtgatgatccttcaaggatatctcgacagcctaaactcatga

SEQ ID NO: 2755 - DNA, 267 bp, Bacillus licheniformis
gtgagctcatttgataagacgatgaaattcaacttttccgacgattcgatggaaaccaatgtaaatgaagtgctgataaccgtccatgacgcgcttcaggaaaaaggctacaacccgatcaaccaaattgtcggatatctgctgtcaggagatcccgcttacattccaaggcatcgagatgcacgcaacctgattcggaaaatagaaagagacgagataatcgaagaattggttaaatcgtacttagaacagcataaagaggcgtaa

SEQ ID NO: 2756 - DNA, 2637 bp, Bacillus licheniformis
atgaagacattaacatccgcacaagtgcgccaaatgtttttagacttttttaaagaaaaagggcatgccgttgaaccgagcgcctctcttattccgcatgaagatccctccctgctttggatcaacagcggagtcgcgacgctgaaaaaatattttgacggacgggttgtgccggagaatccgcgcatctgcaacgctcaaaaatcaatcaggacgaacgatattgagaatgtcgggaaaacagcccgccaccatacgttctttgagatgctcggcaacttttcgatcggcgattatttcaaagaagaagcgatcgagtgggcatgggaatttttaaccgatcaaaaatggatcggcttcgatcccgaacgcctgtcagtcacggtgcatccggaagatgacgaagcgtatgaattatggtcaaaaaaaatcggcatacctgaggaacggatcatcagactggaaggaaacttctgggatatcggcgaaggcccgagcggaccaaataccgaaatcttctatgaccgcggtgaagattatggaaatgatccgtctgatccggagctttacccgggcggggagaacgagcgttacctagaagtatggaaccttgtgttctccgagttcaaccacaatcctgacggaacatacacaccgcttccgaagaaaaacattgataccgggatgggtcttgaacggatggtatctgttattcaagacgccaagacgaactatgatacggatttgtttatgccgatcatcaaggcgacagaagccatttcaggagaaaagtacggcacatctgctgaaaaagatacggcgtttaaggttgtggccgatcatatccggacggctgcgtttgcggtcggcgacggagcgcttccgtcaaacgaggggcgcggctatgtcatcagaaggctgcttcgccgcgctgtccgctatgcgaagtccatcaatatcaaccgtccgtttatgtatgagctcgtaccggtagttgccgacatcatggccgctttctacggcgaagtcaaagaaaaagcggactttatcgcgaaagtcatcaaaacagaggaagaacgcttccatgaaacattgcacgaaggcttggcgattctctcagaagttattcaaaaggaaaaagcaaaaggaaaccgcatcatttccggggaagatgtctttaaactgtatgatacgtatggattccctgttgaactgaccgaagaatacgccgaagatgaaggcatggaagtcgatcatgaaggatttgagcgcgagatggacaagcagcgcgaacgggcccggcaggcgcgccaggacgtcggcagcatgcaggttcaaggcggcgctctccgcgatatcatgacagaaagcgagttcatcggctattccgatatcaaaacggaaacgaaaatcgccgagcttcttcaagacggagaacttgtcgatctcgttcaggaaggccaaaaggttcagttcattctggaaaaaacgccgttctatgctgaaagcggcggacaaatcggtgataaaggctgggttaaaagcggtgatgcggctattcgcgtcacagacgttaaaaaagcgccaaacggccagcacctgcatgaagggatcgtggaaagcggcgcaattaaaaaaggcatgagcgtgaccgcagaagtcacggagcggctcagaaaagacatcgtcaaaaaccataccgcgacacacctgcttcaccaggcgctgaaagatgtgctcggtacgcatgtcaaccaggccggctcgctagtcactgacagccgtctgcgctttgacttctctcactttggacaggtgacaaaggaagaactcgaacaaatcgaaacaaaagtgaacgagaaaatttgggcatcgattccggttcaaatcgacttaaaaccgattgctgaagcgaaagcgatgggagccatggcactgttcggcgaaaaatacggggacatcgtccgcgttgttcaagtcggcgactacagcatcgagctgtgcggaggctgccatgtgagaaatacggctgaaatcggcctctttaagatcgtatccgaatcaggaatcggggctggcacccgcaggatcgaagctgtaacagggcagggcgcttacgaagagatgaacgccaaactggagcttctcgaacaggcggcagaagtcctgaaaaccaacgtgaaggaagtgccgaaacggatcgaagcgctccagtctgatctgaaagatgctcagagagaaaacgaatctttattggcgaaactgggcaataaagaagccggagagattttggaaaaagtaaaagaaattgacggaatcaaactgctcgcagaaaaagtgaatgccaaagatatgaatcacctgcgcacaatggttgacgatctgaaggcgaaactgggctcagccgttattgttctcggggcggttcaaaacgaaaaagtgaatatttccgccggagttacaaaagatttaatagagcggggtttccacgcaggcaagcttgtcaagcaagtcgcagaagcatgcggaggcggcggaggcggccgtcctgacatggcgcaggcgggaggaaaacagcctgagcggctggcagaagcattagcatctgcggaagaatgggtaaaatccgttttataa

SEQ ID NO: 2757 - DNA, 1059 bp, Bacillus licheniformis
atgctgaaaaaaccgctgcagcttttaatgtgggtctcgatctttatgcttttgctattaaccgtctatatctttttgcagctgagaatgatttgggagcctgtctgcgtgctgctcaagtcgattctgatcccgctggcgatcgcggtttttatcacctatctgcttttgcctgtcgtggaaaagatacaccgggcaggcgtgccgagaacattgagtattttgctgatttattttctgttttttgcaggtctcggctacgctttttacaaaggggtgccgatcctcattaaacagctgacagagctttcagagggaattccggttcttgccgcatcatacgaaaacatgctggatcagctgcatcatcatacagacggctggcctgacggcatgcacgacagagtcgacaggttcgtcaatcagacggaagaattcgttgcaagctgggtagaacggacgatacgaagcatccgattcgtttttgattatatgctcttggcggcgatcattccgtttttagtattctacatggtgaaagatattgatacgatgaaaaaggcggtatggtatttgacgccttcttcatggagagcaagaggcagcgaattcatccgggatgtcgatgattctctcggggactacatcagaggccagctttttgtctgccttgtcatcggcttgggagcgagcctgtcattttggttttttgacctgccctatccgctgatcctcggccttgtcatcggcgcgacaaatgtcattccgtatttcggccctgtcatcggcgcgattccggctgtcatggtagcagccgctttatcgacgaggctcgttttcgtggtgatcattacgattttgattcttcagtttattgaaggcaatatcctcgggccccttgtcgtcggcaaaagcctgcatatgcatccggttgtcattatgcttggattgctggcgggcggggagcttgccggcatcatcggcatgattctggctgtgcctgtcatggctgttatcaaagtgatgctcgtccattttttagcggcaagaaaagcgtaa

SEQ ID NO: 2758 - DNA, 132 bp, Bacillus licheniformis
ttgaatcgtacaatgacttctctcatttctttaggagccggggctttaatgtactacatggcgtctcagaacgatatgatgaacaagcgaaacatgagaaagctgagaagacgcgtcatgaaaatgttttaa

SEQ ID NO: 2759 - DNA, 192 bp, Bacillus licheniformis
atgctcgtttgcccgaattgcaaaagcaaaaacatcggcaaaatcggtgtaaatcaatattactgctggggatgctttattgagctgaccctatcaaaaggaaaaatttcgacccatcaagtcgaagaggacggaacattgagcagcctggacgatctgtttacagatgacgaacgaacgatcaacctttga

SEQ ID NO: 2760 - DNA, 465 bp, Bacillus licheniformis
ttgagaacatgcaatgagctggaaggactcaatgtttacgacagacagtcttctctcccgcttggggtggtaacggatatctgtttttctcacgaagggacatgtctcggattgattatggaagagaagcggcgcttttacaatccccgttcgcttcttccgcttcccgcggtcaccgaaatcggacgtgacggcgtatacgttgatttcaccgagttcaagccgatgcaagttccgaagcagagtctttcttatgaccagatgaagcaaaaaatggtcaaaaacggagcaggagatacgctgggcatgctggaagatgtatacttttcttccgacacgggcataatcgtagcatatgaactatcagacggtttttttgccgatttgtcaggcgacaaaaagcagattcactcatctggggaaccgcttgaagtaggcagaagcacaatcgtcttgaacgaataa

SEQ ID NO: 2761 - DNA, 2400 bp, Bacillus licheniformis
gtgatgcagcgccataacccggaccagatcgaaatggaagaagcttcatttgtaaaaggaacggtaacggctgtcatatatcataatgaaacaaacctgtataccgtactgaaagtaaaagtggaagaaacatcagagtcttttgaagacaaaaccgtttctgtcaccggttactttcctttgatccatgaagacgatatctacacattttacggaaaaaccgcctcccatccgaaatttggcctgcaatttcaagcggatcatttcaaaaaggaagtgccgacaacgaaagaaggcgtgatccaatacttggccagcgatttatttgaaggaatcggcaagaaaacggccgaggaaattgtcaataagctgggggaaggggcaatcaacaaaattttaagcgacggcgccgtcctgtatgatgtcccgaagctctccaaaaaaaaggcggataagcttgccgctgcccttcagcagcatcaggggctcgagcagattatgatctccttgagcgaattcggcttcggcccccagctgtccatgaaaatttatcaggcgtacgaagcggaaacgctcgataaaatccgcgaaaatccgtaccagcttgtcaaagatgttgaaggaatcggctttatcaaagcagacgaactgggcggcagaatggggatctcaggcaaacatgaagagcggatcaaagcggcgattttatacacggttgaagcgacatgccttcaagaagggcatacgtacatagaaacgagacagctcatcatcgagacgcaaaagctgttaaaccagtcagcaggcgatgaaaaagtaaccgagatggatgtggcggacgcgatcatttccttaggggagcaaaaagagctgttcattgaagatgaaaggtgttattatccgtccctttactacgctgaacaaagctttgccaaaagggtgcagaaaatcgccggacagaccgaatacgatgaccagtttcccgaatcggaattcctgctcgctttaggggagcttgaagaacggatgaaagtgcagtacgcgccaagccaaaaagaagccatacaaaaagcgctgatgtcgccgatgctgcttttgacgggcggaccgggaaccgggaaaacgaccgtcatcaggggaatcgtcgagttgtacagcgagctgcacggcttaagcttaaatccggctgattacaaaaaagatgaaacgtttccgtttgtgctggcagcaccgaccggccgggccgctaagcggatgagcgagtcgaccggtctgccggccgttacgattcacaggcttctcggctggaacggagccgaaggatttacgcacgatgaagacaatccgattgaaggacggctgctcattattgatgaaacgagcatgcttgatatatggcttgccaaccaattattcaaggcgatccccgatcggatacaggtgatcatggtcggagatgaagaccagcttccgtccgtcggtcccggacaggtgctaagggatctgttggcatcgaatgtgattccttctgtcagattaaccgacatttacagacaggctgaaggctcttcaatcgttgaactggcgcacgaaatgaaacagggaaagcttccggaaaacttggccgccccgacaaaagaccgttcttttattcgctgccgccagcagcagatcaaagaagtcgtcgaaaaagtcgtcaaaaacgcgctgcaaaaaggatattcggccagggatattcaggttttggctccgatgtacagaggagcggccggcatcaatgagttgaacgcccttttgcagggcatactgaatccgccgaagccgaaaggcagggaaatgaagtacggagatgtcgtgtaccgtaccggagataaagtgctccagctcgtcaaccagccggagcataacgtgtttaacggtgacatgggcgagatcgtctcgattttttatgcgaaagaaaatacggaaaaagaagatatggccgttgtctctttcgacgggaatgaaatcacgtttgcaaaaaaagatttcaaccagtttacgcacgcctattgctgttcgatccacaaatcgcaaggcagcgaatttccgatcgtcatccttccggtcgtcaaaagctattaccggatgctgagaaggaacttgctttacacggctattacaagaagcaaaaaattcctgattctgtgcggcgaagaggaagcccttgaatggggcgtgaaaaataaggaatcatcagaaaggcagacatcgcttaaaagacggcttcagcaggcggcacatgaagaggatgaagagctcatggcgcttcaaaaagagctgccattcagcgtctatgacgccaatatcgggatggaaggcattacaccttttgattttatggaaaaggaagcagaataa

SEQ ID NO: 2762 - DNA, 651 bp, Bacillus licheniformis
ttggattacaatcaaattggaatagatgcaatgcaaaaaggcgactttgaaaaagccgctgaagcctttacaaaggcaattgatgaaaacagcggagatccggtgccttatatcaactttgccaacctgctttctgcagtcggcgaattggacagggcgcttaagttttacgacagggcggctgctttggatgagaaagcaggagcggcttattatggagcagggaatgtctatgtcatgaaagagcggtatcaagaagcgaaggacatgttcgaaaaagcgcatcggacgggcatggaaaacagcgacttatattatatgctcggaaccacgctcgtgaagcttgagcagccgaagctcgcaatgccgtatttgcaaagagccgccgagctgaacgatgcggatgtcgaagcccgttttcattacgcgatgtgccttgccaatgaagggatgctggacgaagcgatcacggaattttcaaatgtaacggagcgcgacccgtcccatgccgatgcattttataatttaggcgttgcctatgcgtttaaggaagatcggaaaacagcgctcgacatgctgaacaaggcgctggacattcagccggatcatatgctcagcattcgcgccaagcagcttttagaagaagcttga

SEQ ID NO: 2763 - DNA, 1119 bp, Bacillus licheniformis
atggcgaagcggcctgaagatacacgggtggtcgtcggaatgtccggaggcgttgattcctctgtggcggctttgcttttgaaagagcagggctatgatgtcatcggaatttttatgaaaaactgggatgacacagatgagaacggtttttgcacagcgacggaagattacgaagatgtcataaaggtatgtaatcaaatcggcataccgtattatgcggtgaattttgaaaagcagtattgggaaaaggtttttcaatatttccttgatgaatataaagcgggcagaacgccgaatccagatgtcatgtgcaataaagaaattaaattcaaagcctttttggagcatgctttgtcgcttggagccgattatttggccaccggccactatgcgcgggtcgaccgtacggacgggcgtgttaaaatgctcagagggcttgatgaaaataaagatcaaacctattttctaaaccagctgacagaagagcaactgagcaaagtgctgtttccgatcgggcagcttcaaaaaagccgcgtcagggaaattgcaaaagaagcggggcttgcgacagctgccaaaaaagacagcacaggcatctgctttatcggggaacggaatttcaaaacgtttctcagccagtaccttccagcacagccgggagatatgcggacgatggaaggcgaatttaaaggccgccacgacggtttaatgtactatacgattggacaaaggcacggcctcggcatcggcggaagcggagagccgtggttcgtcgtcggaaaagaccttgaaaaaaacatcttgtatgtagatcaaggtttcgacaatccgctgcttttctccgataagattacggcgacaaacgtaagctttgtgcataagggcgtcttcggcggcgaagaggagctcgcctgcacggccaaattccgctaccgccaagccgatcatgaagtcactgtcagaatgaccgggacggatgaagcggaggtcgtctttaaagagccggtccgcgccgtgacgccgggacaagcggttgtcttttacaaaggcgaagaatgcctcggcggcggaacgattgatgatgtgtttaaagacggacaacaactttggtatgtataa

SEQ ID NO: 2764 - DNA, 1140 bp, Bacillus licheniformis
atggaacggatttacttagaccatgcagcgacttctccgactgacccccgggtagtggaaaaaatgctgccttacttaacggaaaacttcggaaacccttcaagcattcattcctttggaagggagagccggaaatggcttgacagcacgagggagctgatcgctcaggaaatcggagcgcatcccaatgaaatcgtttttacgagcgggggaaccgaagccgacaatatggcgattctcggaagcgcgctggcgagagagaagcagggccgccacatcatcacgacaaagatcgagcaccatgccgttctgcatacgtgcaacaggcttgaagaaatgggatttgacgtcacatatctagacgtcgacgaaagcggaagaatctccgccgagcaggtgaaagacgcactgcgagacgataccatcctggtgacggttatgtatgggaacaatgaagtgggaacgattcagccgatagatgagatcggcgatctgctaaaggaccatcccgcgctgtttcatacagatgcggttcaagccttcggttttttgccgattgatgtgcaaaaaagccgtatcgatatgatgtctgtctccggacataaacttaacgggccgaagggaacaggctttttatacgtcaacgaaaacgtgaagctcagccagcttcttttcggaggagagcaggaacgcaaacgccgggcgggaacggaaaatgtcccgggaatcgcggggctcggtgaagctgttttgctctcgggtcgggaaagagaagaaaaatcggatctttaccgccggtttaaagacatcatcacccgtacgctggaagcagaaggcgtctcattcgatgtgaacggcagcaggcggcacagtctgccgcatattttgaatctgtatttcccgggagtatctgttgaatcgctgctcgtcaatctcgatatggcgggaatcgcagtatcgagcggatcggcgtgcacggccgggtctgtgcttccgtctcatgttctctccgccatgtttggcgaagaagacgatcggctcacgtcatccgtccggatcagcttcggctttggcaatacagaggaacaggttgagcgcgccgcgaaagaacttgctaaagttgttaagcgtctgtcataa

SEQ ID NO: 2765 - DNA, 417 bp, Bacillus licheniformis
ttgaaaatatcaactaaaggcagatacgggctgacgattatgattgagcttgcgaaaaagcatggggaaggcccgacttctttgaaaagtattgctcagacaaacgatttatcggaacattatttggaacagcttgtttcacctttgcggaacgccgggcttgtgaaaagcattcgcggggcctacggcggctacattcttggtgaggagcctgcggcgattacggcgggcgatatcattcgcgtcctggaagggccgatcagcccggtggaagtgcttgaaaatgaggagccggcaaagcgcgaactgtggatcaagattcgcgatgctgtcaaggaagtgctggactccacgacgcttgaagacttggccagctatacagagggcgagcaggaagcgtatatgttttacatttaa

SEQ ID NO: 2766 - DNA, 1266 bp, Bacillus licheniformis
atgaaaccactcgcatttcgaatgcgccctacaaaaatcgaagaggttctcggccaggatcacctggtcggggaaggaaagatcattcatcggatggtgcaggccaaacacctttcatcgatgattctgtacggccccccgggcatcggcaaaacgtcgatcgccacggcgattgccggcagcacgagcatcgctttccgaaagctgaacgcagtcatcaataataaaaaggatatggaagccattgccgccgaagcaaaaatgtcggggcaggttatcttaatccttgatgaggtgcaccggcttgacaaaggcaagcaggactttctccttccgtatttggaaaacggcatgattatcatgatcggggcgacgacagccaacccgtaccatgcgatcaatccggcgatcagaagcagaacgcagattttcgagctgcatccgttagaccctgaacaaatcaaaacggccattaaacgggcgcttgaagataaacacagaggcctcggttcgtatgacgttgccgtcgatgatgaggcgcttgaccatttggcccgcggctgcggcggagatgtccgctcagctttgaatgcgctcgaacttgccgtattgtccacaaaggaaaacagtgagggagcgatacgcattacattggaaatcgcagaagaatgcctgcagaaaaaaagctttgtccatgacaaagatggagacgcgcattatgatgtcatttccgccttccaaaaatcaatcagaggctctgatgtcaatgctgcactgcactacatggcaaggcttattgaagcgggggatttggaaagccttgcacggaggctgcttgttatcgcctatgaggatgtcgggctggcgagtccgcaggctggtggaagaacgcttcaagccattcaaacggcggaacgaatcggatttccggaagcgaggattccgctggccaacgccgtgattgagctctgcctgtctcctaaatcgaactcggcgatccttgcagttgacgaagcgctgtcagacgtccgctccggaaagatcggcgatgtgccgaaccatttaaaggacgcccattacaaaggagccgctgagcttggcagaggtgtggaatacaaatatccgcacgattacgagaacggctgggtcaaacagcagtacctgcctgatccgctgaaaaacaaagtttactatcagccgaagcagacgggaaaatttgaactcgcactgaaacaagtatacgacaagctgatgaaacaaaaataa

SEQ ID NO: 2767 - DNA, 765 bp, Bacillus licheniformis
ttgttacatcagttttcacgcaacgaattagcgattggaaaagaaggtttaaatattttaaaaaacagcacggtcgccgttttgggcgtcggcggggtcggttctttcgccgcggaagcgctcgcccgttcaggtgtcggcagaatcgtgatggtcgataaagacgatgttgacatcacgaatgtcaaccgtcagctgcctgctttactttcaacggtcggacagccgaaagttgacttaatgaaagcgagaatcgccgatattaatccggaatgcgacgtcatcgctttaaaaatgttctataccgaagagacgtatgaacagttttttgcatatgaaccggattatgtaatcgacgcttcagacacgattcattataaaatccacttaatgaaagagtgcctgaagcgcggcatcaacatcatctcaagcatgggagcggccaataaaacagatccgacaaggtttcaagtggccgatatttcaaaaacccacaccgatccgattgcaaaagtcatccggacgaggcttcgcaaggaaggcattacgaaaggcattaaagtcgtcttttctgacgaaagtccgatcgtgatccgtgaagacgtacgccaagtcgtcggaaatgatgaagcgaaaatccgcaaagcgcagatgccgccgtcttcaaatgcttttgttccgtcagtcgcaggcttgattatgggcggccatgtgatcatggagcttttgaaagatattccgatcaaaagggtgaaagataagtaa

SEQ ID NO: 2768 - DNA, 1779 bp, Bacillus licheniformis
ttgtttggacgaacgtattattgtggcgaaataacggagaaggcgatcggagaaaccgtcgttttaaaaggatgggttcaaaaaagacgcgatcttggaggcttgatttttattgatttgagagatcgtaccggcattgtgcaggtcgtatttaatccagacgtttccaaagacgccctggaaacagctgaaagcatccgcagcgaatatgtgcttgacattacaggcaaagtcgttgcccgtgaagaagcaacagtcaatccaaacttgaagaccggaaggatcgaaattcaggcggaatcggtagatgtgctgagtgcggccaaaacgcctccttttgcgatcagcgaccaggctgcagaagtatctgaagacatcagattaaagcaccgctatctcgacttgcgccgtccggagatgttcaactccctgaaaatgcgccataacgtcacaaaagctgtccgccgctttttggatgacaacggctttcttgatattgaaacgcctgttttaacaaaaagcacgcctgaaggcgcgcgcgactatcttgtaccgagccgggtgcatgaaggggaattttatgcgcttccgcaatctccgcaaatctttaagcagctcttgatggtgtcagggtttgaccgctattatcaaatcgcccgctgcttcagggatgaggacctgcgcgccgaccgtcagcctgagtttacgcaaatcgatatcgaaatgtcatttatgagccaggaagacatcatgaagctctcagaagaaatgatggcgcatgtgatgcgtgaaacgcacggcattgaaatctcgcttccgcttcctagaatgtcgtatgaggatgcaatgaaccgatacggctcagacaaaccggatacgcgcttcggcatgctgttgacggatgtgtcagaagcagtgaaggattcggactttaaagtgttcgcttcggctgtggcgaacggcggagcggtcaaggcgatcaatgtaaaaggagccgctgcaaactactctcgcaaagatatcgatgcgcttggagagttcgctgcaaactatggagcaaaagggctggcttggctgaaaacagaagcggatggacttaaaggaccgattgcgaagttttttgccggcgaaaaacaggaggcacttgttcaggcgcttgacgccgcagacggggatctgcttctctttgtggccgacaagctcgaagtcgccaatgacgcgctgggagcgcttcgtttaaagcttggtaaagagctgaacctgatcgatgaaagcttgtttaacttcttatgggttgtcgactggccgcttcttgagtacgatgctgaggaaggccgctactatgccgcacaccacccgttcacaatgcctgtcagagaggatctcaagctgatcgagacgaatccgcaggacatgaaagcgcaggcttacgaccttgtcctaaacggctatgaacttggcggcggctcgatccgtatttttgaaaaagacgttcaggagaaaatgtttggccttctcggcttttcagaagaagaagcgaaggagcaattcgggttcctgctcgaggcttttgattacggggctcctccgcatggcggaattgcgctcggtcttgacaggctggtgatgctgctcagcggccgtacgaatttgagggatacgatcgcatttccgaaaacggccagcgcaagctgcctgatgaccgaagcgccaagcgaggtcgacaatgctcagcttgatgagctgcaccttgaaatcaaacgcaaaattcgacagtaa

SEQ ID NO: 2769 - DNA, 1275 bp, Bacillus licheniformis
atgggatttaatattccaaggggaacacaagatattctccccggagaatcggaacgctggcaatatgtcgaaaagattgcgagagaaacgtgtcatgcgtatcaatataaagaaatccggacgcctatttttgaacatacagaactattttcccgcggggtgggagaatcgaccgatattgtgcaaaaagaaatgtatacattcgcagacaaaaaaggaagaagcctgacgcttcgtcctgaaggcactgcatctgcagtacgctcttttgtggaaaacaaactttttgcaaatccggttcagccgacgaagctttactacattggaccgatgttccgctatgaaaggccgcagacgggccgctaccgccaattttatcaattcggcatcgaagcgatcggttcgaacgatccggcgattgacgcggaggtcattgctttggcgatgagtgtataccggaaagcgggtctcagcaacctgaagcttgtcattaacagcctcggcgacaaagagagccgaaccgctcacagagaagcgctgatccgccactttgagccgcggatcgacgagttttgttcagactgtcaaaaacggctccggcaaaacccgctgcggattctggactgcaaaaaagacagggatcatgaactgctgaaaacggctccgtcgattcttgactacttaaatgaagaatctaaagcatattttgcaaaggtacagcaatatctgacggacatcggcattgcatttgaggtcgatccgaatctggtgagagggcttgactattacaatcacacggcctttgaaatcatgagcaatgccgaaggcttcggagcgattacgacgcttgccggcggggggcgctatgacggccttaccgaggagttcggcggtccgaaagcgccgggcatcggctttgcgatgagcatcgaacgccttctcgccgcactggatgctgaaaatgtaaaagtcggagcggatgaaggcattgactgctatatcgtgacacttggcgacaaagccaaagactattccgtatcccttctctataaactgagagaagcggggatatccgcggaaatcgactatgaacagaaaaaaatgaaaggccagtttaaatccgccgaccgtctcaatgcgaaatatatcgctgttttgggcgaggatgaactgaaccaaaatcaaattaatgtcaaagatgggaaaacaggagatcaacaggccatcggccttgatgatttcatccgttttttgaaaacaaacactgaaagttaa

SEQ ID NO: 2770 - DNA, 219 bp, Bacillus licheniformis
atgaaaatgatttgtttatactatagaaaaaagatatcaaaaggatgttgctgcatgaggtataatcaaagaatgggcagggcgatccatgagcaagatgcgaatctgcatctaaaggagcatgcggacccggagcgcgccggcttcatggaagaaacggccactgagctggggctgacgtccaaagaatcaattcagaataaaaagaaccgcaaatag

SEQ ID NO: 2771 - DNA, 1572 bp, Bacillus licheniformis
atgaaaaaaagagcggtattgatcctatcgatgatgctggcagcacaagcagccttttatacatcgtcaaacacagcttctgcagccatcggggaagccgtgattgccaccgatgaaatcaatgtcagaagcgggcctggactgagccacgaaatcgtcagcgtcgtcagcaggaatgaaagctatccgattcttgaagaacgcggggattgggtgcaaatccagctgaacggcgggcaaaaaggctgggtcgtatcctggctgatcaagaaaaagagccaagtctccagcggatctgattccgcatcgggaaaagtcacatcttccgaagcaaacttgagaatcagaaaaggccccggcacttcatatgaagtccaaggcgtattccctgaaggagaacaggctgacctgctaaagaccgacggaaaatggataaagatttcctatcagaacatcacaggctgggtctattcagattatgtcaatcaaggttcaggcgcgaaacagtctcaatcgtcttcatcacatgcttcatcatcaaaatcgggaacggtcggcgtatccaccttaaatgtcaggagcacagcttcccatcaaggccggattattgccacgctccaacggaatgcaagtgtgacgattttaaacgaacagcacggctggtatgaaatcgaatttaatggacaaaaaggctgggccgcaagccactatattctcgaaggaaacacacagaacagcggaacctcggaaacaagcagcagctccgaagcaaaacggcaggccaccatcgtgtatgaaggcacaaatgttagaagcgggccttcgacatcctcagcgatcgtcaaacgcacgggaaaaggcgagtcttacccgatcgtctctacaaaaggagactggtatgaaatcaaactgtcaaacggcgattccgcttatgtcgcaagctgggtcgttcagactgttgaccaggcaggctcagccggagattcgaaaagcgcagcaccgcctttggcaaagcggtcaagctcgggaggcacaatcaaaaataaaacggttgtcatcgatgccggacatggaggacatgacagcgggacaatcggaacgcgggggacgctcgaaaaacggctgaccatcaaaacggcaacgcttcttgccgcgaaactgagagccgatggcgtcaacgtctatatgacgcggaatgacgattctttcgtcagccttcagtcgcgggtcgcgacctctcattaccgaaacgccgacgcttttatcagcattcattatgatagctttccaaatgcgtccgtcaggggaaatacggcctattactacagcccgtccaaagaccggaagctcgcagcagacgtgcagtccgagatcgaaaggcactcgcctctgccaagccgcggcgtactattcggggactacttcgtattaagagaaaataaacagcccgccgcattgtttgaactcggctacttgagccatcctcaagaagaagcggtagtcagcacgaacgcttacagagaaagagtgacagacggcatcagaagcggtctagaaaactattttgactaa

SEQ ID NO: 2772 - DNA, 444 bp, Bacillus licheniformis
atgagattagttgttcagcgcgtcacagatgcaagcgtttcggtaggaggcgagactgtcggcgaaatcggcctcggcttgatggtgcttgtcggcgtgacgcacgaagatacgagcgaggatgccgcatatttggcggagaagcttgtcaatctgcgaatttttgaggatgaaggcgaaaagatgaacctgtcgcttttagatgtcgggggctccgttttatcggtttctcagtttaccttgtacggcgacacgaaaaaaggaagacggccgaattttacaaaagcggcaaagcccgatcaggcgcttcaattgtacgaagagtggaacagcatgcttcgcgcaaaaggcgtcactgtcgaaacgggaagatttggagaaatgatggatgtcaagctgacaaattcgggtcccgtcacgtttattatggattcgaaagcataa

SEQ ID NO: 2773 - DNA, 2202 bp, Bacillus licheniformis
atggcgaacgaacaagtattaaccgctgagcaagtcattgagaaggcgaaaagttacctttccgatgaacatgttgcttttataaaaaaggcttatcagtacgcggaagacgcacatcgcgaacaataccgcaaatcgggcgagccgtatattatccatccgatccaggtcgcgggaatcctcgtcgatttagaaatggaccccgccacaatagcgggaggatttctccatgatgtggtggaagatacgagcgtaacgcttgaagatttaaaggaagcattcaacgaagaagttgcgatgcttgtcgacggcgtcacgaagcttgggaaaattaaatataaatcacaggaagaacagcaggcagaaaatcatcggaaaatgtttgtggctatggctcaggacatccgcgtcattttgatcaagctggcggaccgccttcacaacatgagaaccctgaagcatctgccgcaggaaaagcagcgcagaatttcaaatgagacgcttgaaatatttgctccgctggctcatcgccttgggatttcaaaaataaagtgggagcttgaggataccgctttacggtatttaaatccgcagcaatattaccggatcgtcaatttgatgaagaaaaagcgggccgaaagggaattgtacgtcgaagaggtcgtaaacgaagtgaaaagccgcgtcgaagaggtcaatattaaagcggacttttccggccggccgaagcatatttacagcatctacagaaaaatggcgatgcaaaacaagcaattcaacgaaatttacgacttgctcgcagtccggatcctcgtcaacagcatcaaggactgctacgcggttttaggcatcattcatacgtgctggaagccgatgccgggcagatttaaagactatatcgcaatgccgaagccgaacatgtaccaatcgctccacaccacggtcatcggtccgaagggcgatccgctggaagtccagatcaggacgtttgaaatgcatgaaattgcggagtacggaatcgctgcccactgggcttacaaagaaggcaaaaatgccaatgaagattcaagctttgataaaaagctttcctggttccgcgaaattttggaatttcagaatgagtcgagcgatgccgaagaatttatggaatctcttaaaatcgatttgttttcggacatggtattcgtttttacgccgaaaggggacgtcatcgaattgccgtcaggatccgtgccgatcgacttttcgtaccgaatccattcagaaataggcaataaaacgatcggggccaaagtaaacggcaaaatggtcacccttgattacaagctgcgcacaggggatatcgtagaaattctgacgtccaagcattcgtacggtccgagtcaggactggatcaaccttgcgcagacatctcaagcgaagcataaaatccgtcagttctttaaaaagcagcgcagagaggaaaatgtcgaaaaaggcagagaactggttgaaaaagaaattaaaaacctggactttgaagtgaaggacgtcttaacagccgagaatctgcagaaggtcgccgacaaattcaactttgccaatgaagaagacatgtatgccgctgtcggctataacggcattacagccgctcaagttgcaaaccgccttacggaaaaagaacggaagatcagagatcaggaagaacaggtgaaaagcgttcaggacgtaacgcctgaagtgaaaccttaccaagggaagaaacgcgaagcgggtgttcgcgtcaaaggcgttgacaaccttttgatcaggctgtcaaaatgctgcaaccctgttccgggagatccgatcgtcggattcattacaaaaggcaggggcgtatccgtccatcgcgaggactgcccgaatgttttaacaaatgaagcgctcgaccggctcattcaagtagaatgggagcatgaaccgcagacccagcggagaaaagaatataacgtcgaaattgagattctcggctatgaccgccgcggtcttcttaatgaagttctacaggcagttaatgagacaaaaacaaatatttcatctgtttcaggtaaatcggaccgcaataaagtggcgacgatccatatggcgatcttcattcaaaatattaaccatttgcataaagtagttgaacggattaagcagatcaaagatatttactccgtgcgcagggtgatgaattag

SEQ ID NO: 2774 - DNA, 513 bp, Bacillus licheniformis
atggatttgaagaagtatgtgacaattgtgccggattacccgaaggaaggcgtacaatttaaagatattacaacattgatggacaaaggcgacgtctatcgctacgcgacagatcaaattgtaacgtatgcgaaggaaaaagagatcgatctcgtcgtgggacctgaagcgagaggatttatcatcggctgccctgtcgcatatgcgcttggggtagggtttgcgcctgtccgcaaagaaggcaaactgccgcgcgaagtcatcaaagtcgattacggattggaatatggaaaagatgtcctgaccatccataaagatgccattaaaccggggcagcgcgtcttgatcactgacgacctgcttgcaaccggcgggacgattgaagcaacgatcaagcttgttgaagagctcggcggcgtcgtggccggaatcgctttcctgatcgaactgacatatcttgaaggaagaaataaactggacggatatgatattttaaccttgatgcaatactaa

SEQ ID NO: 2775 - DNA, 2349 bp, Bacillus licheniformis
atgttagcgtcaaaaatgcgttgggacgtgcaaacgcccgacaaagaaaaggtggagcagctcgccggaaggttaggcattactccccttgccgcctcattgcttgtcatgagaggttacgatacagccgacaaagcatcttcatttttatatggcaatgatgcacgttttcacgatccttatctgctgaaagatatggaaaaagctgtacggcgaatcaaacaggcaatttcagatcaagaaaagattatgatttacggcgattatgatgcggacggtgtgacaagcacgactgtccttttgcaaatgttgaaaaaatgttcagcacaagccgatttttatatacctgaccgctttaaagaagggtacggtccgaatgaagcggcctttcgcgggatcaaagaatcaggctattcattgatcattacagttgacacaggcattgccggcgttcatgaagctgaagtcgctaaagagctcggcatcgacctgatcattacggatcaccatgagccgggtcccgttttgccggatgcttatgcgatcattcatccgaaacagccgggctgcggctatccatttaaagagcttgccggcgtcggtgtggcatttaagcttgcccatgccttgaacggagagcttccggaagatttgctcgacctttgtgcgatcggtacgattgccgatcttgtgccgcttcatgatgaaaacaggcagatagccaagcgcggcatggaacagttcaggaaaacgaagcgtccaggattaaaagcgctggcgaaaattgccggagcggagatacataacgcggatgaagagaccatcggttttcaaatcgcgccccgcttaaacgcggtcggcagaattgaacaggctgacccggccgtttacctcctgaacacagaagacgaaagagaagcggaagagcttgctgaggacatcaacgccttgaacaaggagcgccaaaaaatcgtcaatcagatgacagaggaagccgttcagatgatcgaggaggaaggccttgaccagcctgtgatcgtcgtagcgcggccgggctggaatcctggcgtcgtgggaatcgtggcttcaaagcttgtcgagcggttttacaggcccgccatcgtccttggcgtcgatgaagaaaaaggaattgccaaaggatctgcgcgcagcatcaaaggatttgatttatttcaaaacctttccgagtgccgggatattctcccgcacttcggcggccacccgatggcagccggaatgacgctcaacctggaagacgtttcggctctgagggagagaatcaaccgtcaggctgaagcggttctgaccgaggcagattttatccccgtccaagacgtcgatttgtgctgccggctcgaagatatatcggttgacagcattgccgaaatgaacttgctggcgccgttcggcacgggaaacccgaagccgttcgttcttgtcagcgacgtaaaaattgatgacgccagaaaaatcggcgccaacaagaatcatttgaagcttgtgcttgcagacgacgggaacaagctcgattgcatcggattttataaaggcgatatcgaagaaggaatcgttcctggagcaaagatctcgattgtcggggaactgtcgattaacgaatggaataacagaaaaaaaccgcagctgatgatcaaagatgcggccgtcaatgaatggcagctgtttgatctgcggggaaaacggtcatgggaagaaaaaatattgaagctggaccctgcgaaacgggcgtgcatctgcttccgcgaggaaacaaaagcaaagctggcagggacaggccttgaagaagagctgaccgtcatcagcggccctgaagatgcagagcggctcgaccttgagagccgttatgcggtatttatagatattccgcagtcgctcgacatctttgatcatgtaataaacggcaaaaagctggagcgcatttatctgattttttatcaatcagacgaacattttttctcaacattcccaacaagggaatattttaaatggtactatgctttcctcctgaaaagaggttcttttgacttgccgaaatacggcggagagcttgccagacataaaggctggacaaaagacacaattgattttatgacaaaggtgttttttgagctcggttttgttacaatagagaatggtgttttatctgttgtttatcatgccgaaaagcgcgatttaacagattctgaaacctaccgggaaaaacagcgcctgattgaattggagcaaaagctcatttattcttcggcggatgagcttaaacagtggctggataagcggatggcggaaaaagccggcgcttataaagtatga

SEQ ID NO: 2776 - DNA, 294 bp, Bacillus licheniformis
atgaacaaacaatggacgttaattgctgcacttatttttacattaattgttgctgttttcgcggtcattaatgttgaaccggtgaaggttgattttctttttggtacagcagaatggcctttgatcctggtgattttggtgtcggtattgatgggggcgcttatcatcggctcggccggcgctttccagatcatgcggctgaaaaaagagctcaaggcgctcaagaaagaagaacgggcaaagcatcctgaactcgaagccgaaccggcggcgcccgaaaaccagaaagactag

SEQ ID NO: 2777 - DNA, 2226 bp, Bacillus licheniformis
atgaaaaaaggacgcttgattgcgtttttccttaccgttctcttgatcggtacaggactgggaatgttcacgaagccggctgcagacaacatcagcctcggccttgatcttcagggcggttttgaggttctgtatgaagtccagcctgccaaacagggcgacaaaattgacagggatgccctcatcagcacggttgaagcgctgaaccgccgggcgaatgtattaggcgtcagcgagccgaacattcaaattgaaggaaacaaccggatcagggttcagcttgccggcgtcgacaaccagaacagggcgcgggaaatcttatcgacacaggctcaacttacgttcagggatacgaatgacaaagagcttttgaacggtgcggatcttgtcgaaaacggcgccaaacagtcgttcaagcaggatacgaatgagccgatcgtgacgatcaagctgaaggatgccgataaattcggcgaagtgacgaagaaagtgctcgatatgaagccgaacaaccagctcgtcatctggcttgattacaaaaaaggcgactcttttaaaaaggaatcgcaaaaagcggatcataaatacatttccgctccgaatgtcagccaggtgctgaatacgtcagacgtgatgattgaaggcaactttacgattcaggaagcaaaagacatggcgagcattttaaatgcgggagctcttcctgtcaaactcgttgaaaagtattcgacatccgtcggagcgcagtttggggagcaggctttgaatgataccgtgtttgcgggaatcattggtattgctattattttcttatttatgcttctttactatcgcttgcctggttttattgcggtcattacgctttcggtctacatctacattacactgcagatattcgactggatgaatgcggttctgacccttccggggatcgcggctcttatattgggcgtcgggatggcggttgacgccaacatcattacgtatgaacgcataaaagaagagctgaagctcggcaaatcggtccgttcggcttttaaagcaggaaacagaagatcgtttgcaacgatttttgatgccaatattacgacgatgcttgccggaatcgtgcttttcatatttggtacaagctctgtcaaaggcttcgcgaccatgctgatcctatccattttgacaagctttattacagctgtcttcctgtcgcgcttcctgctcggcctgctggtcgaaagccgctggcttgaccggaaaaaaggctggtttggggtgcgcaaaaaagacattttggatatcagaaagacagacgaaaatacggagcctccgaacccgttttccaaatgggatttcgtcgggaagcgcaaatggttctttgcattttcgggcgttcttctggccgctggtcttatcgtcttgcttgtgtttaagctgaacctcggcatcgatttctcaagcggatcgagaatcgaagttcaaagcgatcataagctgacaacccagcagctcgaaaaggactttgaacaagtcgggcttgatcctgactcgatcgttctttcaggcgaaaaaaatgatcatggcgtcgccaggtttgtcggcgtgccgaatcagaaaaagatcgctgaagtgaaagattattttaaagacaaatacggaagcgaaccaaatgtcagcaccgtatcgcctaccgtcggcaaggagctggcgagaaatgcgctttatgcggtgatcatcgcgtcaatcgggatcattttgtatgtctcgatccgctttgaatacaagatggcgattgcggctattacttcattgctgtatgacgcgtttttcatcattgccgtcttcagcctgacaaggcttgaggttgatgttactttcattgctgccgtgctgacgatcatcggctattcgataaatgatacaattgtaacgtttgacaggatcagggagcatatgaaaaagcgcaaaccgaaaaccttcagcgacttgtcgcatattgtgaatttgagcttgcagcagacgttcacgcgttcgattaatacggtgctgactgtcgtcattgtcgtcattgcacttctcatcttcggcgctgcatcgatttcgaacttctctgttgcgctgttggtcggacttttgagcggagtatattcatcactctacatcgcagctcaactatggcttgtctggaaagggcgcgaactgaaaaagccgaagcgcaagcctgcagaagaataa

SEQ ID NO: 2778 - DNA, 297 bp, Bacillus licheniformis
atgggcaaacatccggctgatctgtacaaggatcatttaaaaccctttcttcgcagcaagacggaagagtttagaatactcggttatgacgatattgaaatagaggaattgtggtcatacttattgaataagaaatggaagaaccggaaggatgttcaaattcaccagctggccggtgatattttatctgtgaaaattggcgaatttatgaactatgcaaccgtagaatcgtttaaaacgtctaatttactcgacagcaaagaagggcaggatatgctcgatgagctgctgaggtag

SEQ ID NO: 2779 - DNA, 1554 bp, Bacillus licheniformis
atgacgaagcagacgtttttaaaaggaacgctcattttaatagcggcgggtttgattacgagaatgctcggctttatcaaccggattgtcatcgcaaggttcatcggtggtgaaggcgtcgggctttacatgatggcggccccgactttttttctggccgtcaccctcacccagttcggcctcccggtcgccatcagcaagctggtcgctgaagcggaagcgcgccgagaccataggaagacaaaacagattttagtgatgtctcttgcgatcaccgggacgctcagcgccatcatcactccggtgtttctcatttacgccccgctgatggccgatacgctgctcacagacaaaagaacgctttatccgcttttggcggttacgccggtcgtgccgatcattgccgtttccagcgtgctgaggggctattttcaagggaagcaaaatatgcggccgcttgccgtgtcccaggttctcgaacaaattgtccggatatcgctcgtcgccgtctgcacgacagcattccttccgctcggcatcgagtatgcagcagcgggcgccatgctgtcttccgtgtttggcgaattggcttcactcctttatttgttcgtcgcctttaaatacaaaaagaaaatccgcatcagaaaacgttttttccaatcgcttaaagcggggcgaacgacttttttcgagctgatgagcgtctcgctcccaacgacgggcagccgttttatcgggaacctgtcatggttttttgagccgattgtcgtagcgcaaagccttgcgatagcaggggtcgccgcttccgccgcaacgagccagtacggggagttgaccggctttgccctgacgcttctcaccctcccgagctttatcacatattcgctgtctaccgcgctcgttcccgccatcagcgaaggaatcgagcagaaaaaaatgcaggttgtggaatacaggcttgagcaggcgatgaggctttgcctattaagcggcggaatatcagcggtcattttattttcgtatgctgatgagctggtcagcgtgatgtacgggtcgtcaaatgccgccatttacgtcaaaatcatggctccattctttttgttctactatttccaaggccccctgcaggccgtcctgcaggctttaaacctggccggcgcggcaatgatgaacagcttggtcggcgccgttgtgaaaaccggtctcatttttgttctcgcttcacggccttcgcttggcattatgggggctgcgcttgcgatcttgacgggaatcatccttgtcactttgctgcacgctgcaaccgtcagcaaagtgcttcccatcagcattaacctgaaagaatatatcgtatccttcggcgtcattttgatatcagggtggggcagccttctgatgaaagaacacctttttttagcccagtccgagccgatgcgcctgcttttatgtatcgcggttacaagctgtctctacgttttccttctgattgccttcaagctggtcaaaaaggaagaaatccagcggtttccgctgttcggccgctggatttcatag

SEQ ID NO: 2780 - DNA, 651 bp, Bacillus licheniformis
atggatgaaatcttagctcttacgtttcggacgatcgttttgtatttcatcatctttattttgtttcgcttgatggggaagagggaaataggcgagctgagcatactggatcttgtcgtttttatcatgatggccgaaatcgcggttttggctattgaaaatctcgatgaccaccttctccatacgatcatcccgattctcgttttgacgctgatccaggttatatttgcatatctgtcattgaaaaatcaaaaaatccgccggcttctcgatggaaaaccgacgattatcatagaccgcggaaaaattgatgaacacgccatgaggacacagcgctataattacgatgatttgatgacgcagctgagagataagaatgtggaacgaatcggggatgtttcatatgcgattttggagccgaccgggaagctttcagtgtttacaaaagacgggccgaacaaaatgatcgaactgccgttgattgttgacggagttgttcagaaagaagaattggaaaagatcgggaaggatcaagagtggcttgagcaaaagcttgaaaaaagaggacaccgcgatctttccaaaatttcttattgcacttacaataaaggttctttttttattgacataaaggatgaattcaagccttaa

SEQ ID NO: 2781 - DNA, 384 bp, Bacillus licheniformis
atgaacgaaccaaaacaagtcggcaaagggattttatacagcttggtggtcattttcgctttgatgtttgcaggaagcctgcttatttcgctgctccttaccttcacatcattaaccgaaagttcattcagctggttgattaccgccatatcttttattaccttgttcatcggcggttttattgcgggaggaaaatcgaaggaaaaggggtggctgagcggagggttgacagcgctttgcttctcccttacggtgcttttgtttcaatatctcggctttggagaggccttcaatttgaagcagctcctctatcattccggctttttgggagtcagcatgctgggcggggttttcggggtcaatctgcaggggagccgtgcataa

SEQ ID NO: 2782 - DNA, 261 bp, Bacillus licheniformis
atggagatgcttggaacattacttccgattattttaatgtttgcggttctttatttccttttgatccgtccgcagcaaaagcagcagaaggctgtccgccagatgcaggaggagctgaaaaaaggggataaggtcgtaacgatcggcggcctgcacggcatcgtggattcaattgacgaaagcaaggttgtcatcaaaacaggcgacaatacccgtctgacattcgaccgccgcgcaatcagagaggcgtcagcagaatag

SEQ ID NO: 2783 - DNA, 1146 bp, Bacillus licheniformis
ttgtcgcagcaaccgatacgctatgagttcataaaagcatgtaaacaaacaggagcaaggctggggagagtgcacaccccgcacggctcttttgaaacgccggtgtttatgcccgtaggaacgctcgccaccgttaaaacgatgtcgccggaagagctgaaagaaatgggtgcagacattattttaagcaatacgtaccacctttggctgagaccgggccatgacatcgtcaaagaggcgggggggcttcatcagtttatgaattggaaccgcgccatcttgacggattcaggcggctttcaggtgttttccctgagcgagttccgcaaaatcgaagaggaaggcgttcatttccgcaatcatttaaacggagacaagctgtttttatctcctgaaaaagcgatggaaatccaaaacgccctcggctcggatattatgatggcgtttgacgaatgcccgccatacccggcagagtacgattatatgaagaagtctgttgaacgcacgagccgctgggcggaaaggtgcctgaaagctcacaatcgccctgacgagcaggggcttttcggaatcgttcaaggcggcgagtacgaaaatttgagaaaacaaagtgcgaaagacttgatttcattggatttcccgggatatgctataggtggactatccgtcggagagccaaaagacgtgatgaaccgtgtgctggagtttacaactccgctgcttccagcggataaaccgcgctacttaatgggtgtcggttcaccggactcactgattgacggagccatccgcggagtggatatgttcgattgcgtgctgccgacaaggatagcgagaaacggtacgctcatgacgagcgaagggcgcctcgtcgtcaaaaatgcaaaatatgaaagagatttcaggccgattgatgagcagtgcgactgctatacgtgccgcaattactcgcgcgcttatatcagacatttaatccgctgcaacgaaacgtttggaattcgtttaacttcttatcataatctttattttctgttaaaattaatggggcaagtgagagatgccattcgtgaagatcgtttaggtgatttccgggaagagttttttgagcgctacggttttaataaaccaaatgctaaaagtttctga

SEQ ID NO: 2784 - DNA, 1029 bp, Bacillus licheniformis
atgaaagtagaattattcgattttgacttgcctgaacgcctcatcgcacaggttcctttaaaagagcgggatgcgtccaggctgatggtgctggataaaaaaacaggggagatcactcacagcacgtttaagcacgtgattgattttctgaacgcgggcgattgcatcgttctgaacgatacgagggtgctgccggcccgcttgtacggagtcaaggaagagacgggagcaaaggttgaagttcttctgttaaaacaggaggaaggggacgtctgggaaacgcttgtcaagcccgcaaagcgggtcaagcgcggaactgttctttcgttcggtgacggccgtctaacggcggtctgcacagaagagctcgagcacggcggcagaaaaattgaattccgctatgaagggattttttacgaggtgctcgagtcgctcggtgaaatgcctctgcctccttatattaaagaacagctcgatgacagggagcgctatcagacggtttactcaaagaaacaaggatcggcggctgcgccgacggccgggctgcattttacggaagagattctcgatgcgctcagggaaaaaggcgtgcatattgcgtttatcacccttcatgtcggtcttgggacattccggcctgtcagtgcggaaaatgtagaggaacacgacatgcatgccgagttttatgaaatgtcggaagaaacggcagcattgttaaaccgcgtcagacaggaaggcggaaggatcatttccgtcggcacgacatcgacgagaacgcttgagacaatcgcttccgagcatgacggccgcttccgggaagcgagcggctggacatcgatttttatctatcccggctacacattccgggcaatagacgggatgattaccaattttcatcttccgaaatcgtccctcattatgcttgtcagcgcgctcgcaggcagagagcatgtgctttccgcctaccggaccgcagtggaacacgaataccgcttcttcagctttggagacgccatgttgatcaaataa

SEQ ID NO: 2785 - DNA, 201 bp, Bacillus licheniformis
atgactgaatttccaaagattttaatggtgctgggcgccgtcatttttggcatcggtttattcatgcaagtcatcggcaggcttcccggcgacatttttgtgaaaaagggaaacgtgacgtttttctttccggttgttacatgcattgtcatcagcatcattctgtccgtcgtgttttcattcttcggacgaatgaaatga

SEQ ID NO: 2786 - DNA, 1005 bp, Bacillus licheniformis
atggatgagcggcttgtatcaagtgaactagacaaccatgaatcagcgattgagcaaagtctgcgtccgcaaagacttgctcagtatatcggccaggaaaaagtgaaagataacctcaaggttttcatcgaagctgcgaaaatgcgggaggaaacccttgaccatgtcttattgtacgggccgccgggattgggaaaaacgacgctcgccgcgatcatcgccaacgaaatgggagtcaatctcagaacgacgtcaggtccggcgatcgagcgccccggtgatttggcggcgatattaacggctctggagccaggtgacgttttatttatagacgagatccaccgcctgcaccgttcgatcgaagaggtgctgtatcctgcgatggaagatttctgccttgatatcgtgatcggcaaaggaccgtcggcacgttctgtgaggctcgatcttcctccttttaccctcgtcggcgcgaccacaagggttgggcttttaaccgcgcctctcagggacaggttcggcgttctgtcgaggcttgagtattacacgcgtgatgagctttcagagatcgtgatcagaacggcagagctgtttgaagtcgacatcgattcgctctcggctctcgaaatcgcgagacggtcaagagggacgccgcggattgccaacaggcttttaaggagggtcagggattttgcccaggtgcttggaaacagctccatcacagaggaagtggcggttgatgcgcttgaacgcctccaggttgataaactcgggcttgaccatatcgaccgcaagcttttgatgggcatgatcgaaaaatttggcggcggccccgtcggcatcgatacgatttcggctactatcggtgaggagtctcacacgattgaggatgtgtatgagccgtatcttcttcaaatcggttttattcaaagaacgccgcgggggcgcatcgtaacccctgatgtttacagccactttaaaatggaggttccgaaccatgactga

SEQ ID NO: 2787 - DNA, 606 bp, Bacillus licheniformis
ttgatcgaattcgtaaaagggacgattgattatgtatcgccccaatatattgtcattgaaaacggcgggatcggctatcagatcttcacgccaaatccgtttatttataagaaaaacagcaaagaaacaatctatacataccattatgtaagagaagacacgaatgcgctgtacggcttttcgacaagggaagaaaaaatgctgtttacgaaaatgctgaatgttacggggatcggcccaaaaggagcgcttgcgatcctcgcttccggcgatccgggagcggtgattgaagcgatcgagaatgaggacgaagcatttctcgtcaaatttcccggcgtaggcaaaaaaacggcaaggcagatcatccttgacctgaaagggaagcttgcggatgccgttcctgaaatcgctgccgatctgtttaaccatgaagagcgggagcaaattcatgaagcggcaacggctcttgaggaagcgcttgaagcattgagggcgctcggctattccgatcgggaaattaaaaaagtccagcctcatttgaaaaaggaagaggcgctttcgacagatcaatacgttaaaaaagcattgcaaaaattgttaaagtaa

SEQ ID NO: 2788 - DNA, 522 bp, Bacillus licheniformis
atgtacagccgaagcaagttcaaaatcggtttattgcttattggaagtctgctggccgcgctcagctttcacctggaggccttggccgaaaagccggctaaagttcaaatccagcttgaaaaggtttatctggacggagacgttggaattgagaataaagtagaggccgctcgcacactggaagactttaaagctgcttataaagggtggcagctcatcgatcagaaaaaggggtttattctgtttcgcaaacaggtggacgacatttctcccctcagcaaaacaaacggttatatcggagtgactgaagatggcgtgatttcgacttttcacggtcgcccgggcatcttatcagaacccattcaatcgttttttcagattgatataaagcggctggaaagccggatggcggatgatctgcgcaaagggataccataccgcacgaaaaaggaatttgaacatgtcattgaagccgtaaaatcatccggaagccaacatcatgtagaagatatgaagacatga

SEQ ID NO: 2789 - DNA, 651 bp, Bacillus licheniformis
gtgaaaaaggcgcatacctatgcagaagccgtaaagtatgatacgaaaaaaaagttcaacaagcttatccaaaaacccgatgacttggaattgatcgggaaaggcaggagcgcatacgtttttaagctgactgaagagggcggcagggaaatggctcttaaagtcttttttcctgaatttaagaacatcgccgcaagggaagcggagatttacaaaaagctttctgattcgaattattatcctgatatatatgaaacagggccatcatatattttaatggagtatattaaaggatatactttttatgagtgtttaaacaaaggcattcggatcgatgatgacatgatctgcgaggtcgaccgcgcattgaacgatgcgaggcggaaaggattgaatccatccgatatccacctccgaaacctgatactgacgccgtctggaacaatcaaagtcatcgatgtcgccagatttttgcagacgaaagaatgcaggcagtgggatgacttaaaaacagcctatcaaaccctttacaaaaaaagccgtttcccgcagaggcttcctaagatgtggatggaattgatcgcttatctttataaaaaaagctggcttcaaaaacaatgggcctccagaaaaaacaaatttcacccgtaa

SEQ ID NO: 2790 - DNA, 174 bp, Bacillus licheniformis
atgctcgtatatgaaataaccccattaccgtcaagaaaggagaaacattcgttgaagaaaaaaaataaacgtaatgatgacaaatgggattatctttatctcgtcgatttgcttgagccattgttttatgtgctgaggctggcagtaagaggacttgcgaaaattataaattaa

SEQ ID NO: 2791 - DNA, 180 bp, Bacillus licheniformis
gtgaatacgcagcgtgcccaggaaatcgtcgaatcacccgatatggttgatgttacttataacggcaggccgatttatattcagcgtgtcgacgaacaaaatgaaaccgcaagaatctttccgctcggccagccggagaacgagcaggaagtgccgctcgcaaatttgaaagaacattaa

SEQ ID NO: 2792 - DNA, 465 bp, Bacillus licheniformis
atggaacggaaagaccgcatcgttcaggaatttatgtcccaccgccttgtgacagaagaactcattcaaaaaattgatgaaaaacatctcgattacaaaccgactgaaacgtcgatgccagcaaaggaacttgtcacgcatatgctgcaatctttctatacctttgcttcggcggcaaaggaagggaacggagagccttttaaaaagaagcccgaagaaacagggacaagcttgagcgagcttgccaaaacgtatacagaaaaaacaaaaacgctgcttgaatcctttacggatgaagaattggatcgtgaagtcgatttgaccggcgtcttcggacgaaaagtagccggcgaacagctactgcagctcgcgatcggacacgaaattcaccacaaaggcaatctgtttgtttatgtccgtgaaatgggacacacggatctgcctttgtatgtaaagattcattga

SEQ ID NO: 2793 - DNA, 711 bp, Bacillus licheniformis
atgaagaaaaaagtactcatctacttggtgatcgcagcagtgatgataaatggtgtatacaggtggtccgaaaaaacaacccgggaaagctatcagatccaggccggggacaaatacaagaacttcaaggaattgcaggaaaacgaaaaaagcggctatgacattgattatcacgaaaaagcgggaagcgactgtttaatcttttcgccccatggaggaagaatagaaggcggagtgagcgagcttgtccgagcttttaatgatgattattcaacttatttattcgaaggaaaaaaggatgagaacaactccgatcttcatattaccagcacaaactttgacgagcctctggcattgcagaaaataaaagaacaccgctataccatcgcattccacggctattcgggcgaccgtccgcacacgcttgtgggaggaacggacagaaagctggcaaaagccatcgtcaaatctctgaaaaagtctgacttttccgcagaattggtcaaagtggacgggaaatttgccggaactgctgaggaaaacatcaataatgaaagccagacaggaatgagcgtgcagcttgaaatcagcacggctcagaggaaagagtttttcgaagacttttcctataaagagagggaagagacaaaaacgagaacattccgaaaatatgtcaaggcggtccgcaaggtgctgcaggacagatgctga

SEQ ID NO: 2794 - DNA, 180 bp, Bacillus licheniformis
atggaaacagaatatgaaacaaaaggctacgacctgacaaaagtttatgattacaatcaatatccggatgtccgccacggacggtgcgacaattgcgattacaccctttttaaaagctctgtgaaaaacgggcagtttttgcgcgaatgccggcgctgcgggatgaaaaaaagcatttga

SEQ ID NO: 2795 - DNA, 327 bp, Bacillus licheniformis
atggctgaacagcaaggaaatgagaagcctttcacggctatgggcgccggtgcgcaagatcaggaaaccgctcaaatcatcgagagagtcggcagccttatcaccggatttggcgaatccatctatgagctggtacagaaaaacagcggcatcgatctgagagaggctgacttcacaaaaagcgagaatgcggaactgaatcaagcgatccaaaatattatcagcgaatacattcaaaatctcaacaatctgaatgccgatctcagcggaaagatcggtgaatcgatccaaggcatcgtcacaagcaaagatcaaaaagacgcttaa

SEQ ID NO: 2796 - DNA, 723 bp, Bacillus licheniformis
atggctggccattctaaatggaaaaatattcagagacgaaaaaatgcccaagatgctaaacgcggcaaaattttcatgaagcttgccaaagaaatatatgtagccgcgaaagaagggggaccagatcccgaatctaacgcaagtctgcgtctcgtcatcgataaagccaaaaatgcaaacatgccaaatgacaacatcgaccgcgccatcaaaaaagcttccggcagccaggatggaaaaagctatgaggaaattacgtatgagggctacggaccaagcggtgtggctgtcatggtcaaatgtttgacagataataaaaaccggacggcgacaagcgtcagaaccgctttcagcaaaaacggcggcagcttgggagaaacaggatgcgtttcttatatgttcgaccggaaaggatatattgcaatcgaacgtgaagatcttgagatagatgaagaagagtttatgcttgaggtcattgatgccggtgctgaggagcttgaaacgagcgaagagctgttcgagatttatacagagcccgaacagtttgaagaagtgaagaaaagcttggaggagcgcggctacaagctggcaacatccgaaattacaatggttccgcaaacctatgcagaagtcgatgaagcgcttcaggaaaaagtcgaaaagctcattgacgtgcttgaagatgatgacgatgtgcaggaagtgtatacgaacgttcattaa

SEQ ID NO: 2797 - DNA, 636 bp, Bacillus licheniformis
ttggacagcaagctgaaagtgttttcggggattttgcttttgacagcaggtctatctgcatgcggaacgaacgacgctatagataatggaaacaatacgcgcccgatcggatattattcaaatgatgcagatcgtaatgcaggtcttgataatgacggtcctgttacagaaatgcttgaaaacatgaacgggagaaacggtgcaacaaacgtaaacaatcgagcgggcaacggcaatcccgttccaacaggcgatggaacttacagccggggagacatgaattatcacaaccatttggtgaatacggcggatacaggctatgacagaccggaaaaccgtaaaatctcaaggaatatcactgggcgcgtcaacaaattgaattatgttgacgaaagccaggcagtcgtaacgaatgaaacggtcatcatcgccgtacggtctgataaaaggctgacaaataacgagagaactcaaattagaaaagcagccaaaacatttgccggagaccggaccgttcaagttgtcgaggacgacggcgcatttacaaggctgcgcgaaatgaacgatgatcctcagaacattagggatcgcggagacacgacgaataacaatttgaaccgcttgcggaaccaataa

SEQ ID NO: 2798 - DNA, 1053 bp, Bacillus licheniformis
ttgaaaattcatattgtccaaaagggcgattctctggaaaaaatcgcggaaagatatgaagtggactttgaagaactgaaaaagctgaattcgcagctgagcaatccagacttgatcatgccgggcatgaaaatcaaagtaccgtcagggggagtgccggtcaaaaaagaagaacagctcaatatgcgaaaggaattaccgaaaaaacagcaggaacatccatttgcaaaagaaaagccgaaaagcaagcttgatgttgaagatataaaaccgaaagaaaagccttcggttccttatgttccgcctgtcccgaacatcggacaatcaagtttgcctgaaggcgacatttcgaatttgtatcaaagcgtcaatcagcttcatcagccgtacgtacctccaaaaccttatgaacatcaagagaaaggccccaacatgtataatccatggacaaatgaggaggaaaaccatatggaaaatgtcaattatccgaatgttccgcagccgccaaatgtcggtgcagcaggtgatgaaaataagcagtttcacggcatgccgaatgtagctgcagcgggatatcatcaccatccatatccttatccgttctatcctggaggctgctggattcctgtttcaccggtgctgcctggatcgggattgtgccatccttggtatccatatcctgctcaaatgccttatatgcatcagcctagctatgtatctcctgctgaatatgacgatgatgacaacatggggcatgacaatgccggtcatcacggataccatcatcagccgatgactgccccggcatatgcgccttaccagccgttcccgggatttgcaccgccaaacgtcggtcacgccggggaccctaatatggcacacggcaaagaagatgactgcgggtgcgggccgggccaattcccgggaggttttccaggtgcggcgccatatggacagatgccgcaaatgggagctccgtacggtatggggggatacggacagcagcctgcagggggacagatgtttaacagaccggaagatgatgaagactga

SEQ ID NO: 2799 - DNA, 1110 bp, Bacillus licheniformis
atgtctattttaaaagtgattcatgacaggaacgccggcatgatgccggaggtgtataaagaattgactgaggaagaaatggccggaaggattttgaaaatcaaaaagaaattcggagcaaggctgtttatcccggggcatcactaccaaaaagacgaagtgattcaatttgcggacgcgacgggcgattcgctccagctggcacaggtcgcccaaaaaaataaaaaagcggaatatatcgtgttctgcggcgtacattttatggcggaaacagccgatatgctcacttcggacgaacagattgtcgttttgccggacatgcgcgcaggctgttcgatggccgatatggccaatatgcggcagacaaatcgcgcctgggaagagctgacgaagctgtttggcgatacggtcattccgctcacatatgtcaattcgacagctgaaattaaggcttttgtgggaagaaacggaggagcgtccgtgacatcctcaaatgcggcgcgcatgttgacatgggcgctatcgcaaaaggagaggattttatttcttccggatcagcacttgggacgcaacacggcatttgacctcggcattcctctaagcaggatggcggtatgggatccaattgcagaaaaacttgagtataacggcgatatgaaagacataataatcattttgtggaaggggcattgttcagttcacgaaaaatttaccgtggcgaatatcaaaagtgttaaagagcgggatccggacatcaatgttatcgttcatccggaatgcacccacgaagtcgttgcgctcagcgatttcagcggatctacaaaaaaaatcatcgactccattaatgaagcaaaaccggggagcaaatgggcgattggaacagagatgaaccttgtttcacgcatcattcaagaacatcctgataaacaaatcgaatcccttaaccctgatatgtgtccttgtttgacaatgaacagaatcgacatgccgcatttgctgtggtcgctggagcagatcgacaaaggtgaaccgacaggcgtgatcaaagtggatcaagatattgcaaaagatgccattcttgcgctgaatcggatgttaacgatccgttaa

SEQ ID NO: 2800 - DNA, 840 bp, Bacillus licheniformis
atgcagcggttcatacttaggaacatgcttaaggaatttttcaaggaagatatcggccggggggatctcacttcagaagccgtttttgatgacaatcatcaatgcgaagctgtcatcacagcgaaggatgacggcttgtttgcaggagaattagtgattctggaaggctttcggctgcttgatgaaacgatcgccgtccacatgctgaaaacagatggcgaagcggttcgtaaaggggaaacgatcgcgcgactcaaaggccgtgcagcttccctcatgaccggtgaacgggttgtgctgaatctcattcaaagaatgtccgggatcgccacattaacaaagcagtccattatcaggctgaatgatccgaatatcgcgatttgcgatacgagaaagacgaccccgggcctgcgcatccttgaaaaatacgcggtcaaaaccggcgggggcagcaatcaccgctttggattggacggcggcatcatgattaaagacaaccatattgccgcctgcggctcgatttcaaaagcggttgaaaaagcgcggtcagcgtgcggccatatggtcaagatcgaagtggagatcgaatctgaacaagagcttcatgaagcgattgaggccggcgccgatatcattatgttcgacaattgcccgcccgagacggtgaaagcatttgctgaaatgacacccgccggcattataacggaggcttcaggcggaatttcatttgaaaatctccccgcttacaggggaacaggggtgcactgtatttcattgggctacttgactcattcggcgaaaagccttgatatcagcatgaatgttgatctgaaaaaataa

SEQ ID NO: 2801 - DNA, 1575 bp, Bacillus licheniformis
atgtctcatcagacgattattgttgtcggagcaggtgccgcagcgttgtcttttgctgcatccattccgccgtcttatgaagtggttgtgatgacaaaagcatctgtaaaagacagcaattcaaccctcgctcagggaggaattgcatctgctgtattgcctcgcgattcctggtcgcttcatgcggacgacacgttgtatgccgggtgcggccacaatcaaatcgaagcggtccatgatgccattaaagacggacagcgccttgttgatgagctgatccttcagcatttcccttttgatactgacgaatcaggaaagctgagcctcggaaaagaaggcgcgcattcggtgaacagaattttgcatgccgggggagacgcaacaggacaggagttgatccggcacttaatcggacggctcggtccgcacgtcgtgctgaaagaatacgaaacggcggcggatttatggattgaagacggacgctgctgtggcgtctggacgaaagacagccgtgggaagacgtttctcagaaaagccgattttgtcgtgctggcggcaggaggctgcggaaatctatttcaaatcaacacgaataaccgttctgtgacaagcgatgcgatttctttggcgtatcgggcaggagcagagctcgcagacttggaattcgttcaatttcatcctacattgcttgtcaaagacgggcgcgcgcacggacttgtttcagaagctgtgcgcggagaaggtgctgtgttgattgatgaaaacggacagcgggtgatggaaggcatacattctttgctggatttagcgccgcgggacgttgtatctcgggcgatacaccaaaagcttgcctgcggaagcagcgtatttttagatatttcccgcatatcagactttaaaagccgcttccctacgatttcttctctttgcgaaaaagccggtatttccattgaagagggccggattccggtttcaccgggcatgcattttttaatggggggcgtttctgtgaataaatggggagaaacggctgttccaaacctttttgtgatcggggaagccgcttgcaccggctttcacggtgccaaccgtctggcaagcaattctctcttggaatgcatcgtcttcggaaggagagcggcggagcggattcaagcctgccaaaaaccggagcctgtcagaggccaatctcctcagcctgagaatgtgacgtattctgttcctttgacagatgtgaaggatattcagaaacaaatgacagattatgcggcgatcgtgcgtacggaggatgaattgacgaaggtgaaagaatggcttgagcgaatgccggttcaaatcgtaaatgtgaaagaaatcacaatagaacagctcgagctagctcatttatggcagactgccaaacagatgacggcctcggcactgcttcgtacagaaagcaggggcggccattaccgttcggattgtccggcgcctgatgataaaaactggcacggcaagcaaatcgttcacacaaaaggcgggatcaagatcagacaaaacgaagggattgtgaaatatgcagcggttcatacttag

SEQ ID NO: 2802 - DNA, 1179 bp, Bacillus licheniformis
gtgatttatcttgattatgcagcgacgacaccggcatcaaaagaagccttggacgcgtttcaaaaacttagcacagacgtatacggaaattcgagcagtctgcacgatgcaggagggaaagccgaaaacattttgcgctgctgccgccaaaggatggcagaacttttatccggagaagaagaaggcgtttattttacgagcggaggcaccgaagccaactttttagcgattcactccatcttaaatggacttcccgccgggaaaaagcgctttttaatgacagaaatggagcatcagtcgatccatattttgaaacggcatctcgagatgctgggatttgatgtcgacttgatgaagccgaatgcttcaggcatcattacaacggatatacttgaacggcacctccgcccggatacgggtctggtttcgattcagcatgccaattcagaaacaggcgtcatccagcctctggcaaagctctcggcttacctgcataagcgggacgtgctcttgcacagcgactgcgtacagacatttgccaagattccggtccgcattgatgagctcggcgctgatgccttatcggtctcaagccacaaagtatacggcccaaaaggagttggggctgtctatattcggccgggtgtaaactggaaacccgtctacccgggcactttgcatgaaaacggctttaaaagcggcaccgtcaatgtccctggaatcggcgctttcattaccgctgcagattcgacaataaaccgcatggatgccgcgcatctcaaattccaggagctgcgcgcaggttttctggaaggagtaaaagaccggaagcttcccgtctcccttgctgtgcccgattcggcaaattcgcatgttctgccgcatattataggttgtttttttcattcctttgaaggacaatatactatgctggaatgtaatcggagaggaatttgcatttctaccggaagcgcgtgttcagcgggctatcatgagccttcgaatacgatgaaagcccttttgatccctagggagctcgcgcttcaattcgtccggatttcattcggatgcgatacgacaagcgaacatgttgataggctgttggacgttcttgaagatatgatgaatgagaaaggagaccatcggattgacagacggattaaaacttacgggagctga

SEQ ID NO: 2803 - DNA, 564 bp, Bacillus licheniformis
atgagaaaggagaccatcggattgacagacggattaaaacttacgggagctgagcggcgccagcagctgctggcttggctgaaggagtcagaggctccgcttacaggaagcgagctggccaaaagagcatctgtttcacggcaggtaatagtacaggatatttctttattaaaagcaaaaaacgaaccgatcatcgcaacaagccaagggtacatgtatttgcggtcagccctcggcaaaaaacagccggttcagcggatcatcgcctgtgaccacgaacccgaaaaaacggaagaagagctgaatctgatcgtcgactttggcgtaacggtgaaagatgtaacgattgaacatccggtctacggagacttaacagcttcgatcagggtcagcacaagaaaagaagtcgcggatttcgtcaaaaaaatctcttcgacaaacgccgcttatctgtctcagctgacaaacggcatccatctccacacattggaggcagatgatgaagagaagatcgaacaagcttgcggcgccctgcaaaaagcgggcatcctcattcccgaataa

SEQ ID NO: 2804 - DNA, 858 bp, Bacillus licheniformis
atgagtatgagagtaggttatttaggtccagaagcaacttttacgcaccttgccgtctgctcctgcttttcagatgcagaccagcaagcatttaacacgataccggcctgcatggatgcggcgatgaacggggagatcgatctggctgtcgtcccgcttgaaaatgcgattgaaggatcggtgaatctgacaatagactacttaattcacgaacagcctctttatattgtcggagaaatcaccgctcccatccgtcagcatttgcttgtgcatcctaccagaaaagaggcttgggaagacattcagaaggtttattcccattcccatgccatcgcgcaatgccataaatttttgcacagccggttccgctccattccgtttgaatatgcgacatccaccggagcagctgcaaaatacgtgagcgaaaatccggaagagaacatcggcgtgatcgccaatgaaatggcagcagatacttacggattagacatcgtcaaaagagatgtgcatgactatgaatacaatcacacgagatttgtgatgcttcatccggatcgcgaggcatcccctccggtcaaccctcaactcaagggaagaccgaaaacgactttgctggtgacccttccttcggacagatcgggagctctccaccaagtgctgtcggctttcgcctggagaaatttgaatctttctaaaattgaatcgcggccgacaaaaaccggtctcggcaattatttcttcattattgatattgaaatggccctggatgacgtgctgattccaggtgcaatagctgagcttgaagctttgggctgcaaggtgaaaatgctcggtgcctacaacgcatatacactataa

SEQ ID NO: 2805 - DNA, 444 bp, Bacillus licheniformis
gtgaaagaggagaccttttatcttgtcagggaagacgtgctgccggaggcaatgcggaaaacacttgaggtcaaaaagctgattgagcggaaaaaagcggaatctgtagctgaagccgtacaaaaggtagatttgagccgaagcgctttttataagtacagagatgcggtttttcctttttatacgatggtcaaggaacagattatcacgcttttttttcatttggaggaccgctcaggaacgctgtcccatctgctgcaagtggtagctgaatcgggctgcaatgtgctgtcgatccaccagaccatccctcttcaaggaagagcgaatgtcacgctctctgtcagtacgagaggcatggatgaaaatatcgatttgctgatgaacaaattaagaaagctggaattcgtagaaaaggtcgaaatactaggttcgggcgcttaa

SEQ ID NO: 2806 - DNA, 1287 bp, Bacillus licheniformis
atgtttgttgatcaggtgaaaatatacgtaaaaggcggagacggaggcaacggtatggttgctttccgccgcgaaaaatatgtgccaaaaggaggccctgccggaggtgacggcggaaaaggcggagacgtcgttttcaaagttgacgaaggtctcagcacgctgatggattttagatatcaaagacattttaaggcagcgcgcggagaacacggcatgtctaaaaaccagcacggccgaaatgccgaagacatggttgtgaaagtcccgcccggcacggttgtcattgacgatgatacaaaacaggtcatcgctgatttaacggagcacggacaggaagccgtcatcgcaaaagggggacgcggcggacggggcaatacacgttttgcgacgcctgccaacccggcgccgcagctttctgaaaacggcgaacccggcaaggagcgctatattgttctcgagctgaaagttttggcagatgtcggtcttgtcggcttcccaagcgtcggaaaatcaacgctcctgtctgtcgtgtcttcggccaagccgaaaattgccgattaccactttacaacgctgaacccgaatctcggaatggtcgaaacggaagacggccgcagctttgtaatggcggatcttccgggactgattgagggggcgcacgaaggagttggcctcggacaccaattcctcaggcatatcgaaagaacgcgcgtcatcgtgcacgttattgacatgtcgggtcttgaagggcgcgacccgtatgaagattatgtgaccattaataaagagcttgaacagtataatctcaggctgacagaacgtcctcaaattattgtcgccaataaaatggatatgccggatgcggaagaaaatctgaaggctttcaaagaaaagctcacagatgattatcctgtttttccaatcagcgcggtgaccagacaaggcttgagggatctgctgtttgaaattgccgaccgtttggaaacgacgccggaattcccgctctacgacgaagaagacatggctgaaaacagagtcatgtataagcttgaggatgaggaagcgccgtttgagatcagccgtgatcctgacggcaccttcgtgctcagcggagccaagcttgaacgcttatttaaaatgacggacttttcaagagatgagtctgttaagcgttttgccagacagcttcgcggaatgggcgtcgatgatgcgcttcgggcccgcggtgcaaaagacggggatacgatccgtcttctcgaatttgaatttgaatttatcgactga

SEQ ID NO: 2807 - DNA, 579 bp, Bacillus licheniformis
atggaagaaacttcgaaaaaacgagaaaagaatatggacgataaggctttgacccatgagcttatccatctgctcagccactcaaggcacgactggatgaataaactgcaattgattaaaggaaacttaacattaaaaaagtatgaccgcgtatttgaaattatcgatgaagtggtcatcgaagctcagcatgaatcaaagctttcaaaccttagaatcccgcgcgcggcgtatgagctgcttacatttaactggatggcccattcgctgacgcttgaatatgaggtgatcggtcaagtcaaggatttgtcagcttatgaagaaaggctcgtcgttctcatcagaaagctgtttgggatttttgacgatgccgttttgaaaggcagcgacaatcatctgacgatcacgctgcagacggacggtccggacgaccgcctcgtcatctttctcgatttccacggcgtattcacaaagctgaccggtatcaaagactttcatcattcactggccgacttttatgaaatcaagcggtttgatgtaacagaccgtgagtgcatcgccgaaattcatatcaagtaa

SEQ ID NO: 2808 - DNA, 282 bp, Bacillus licheniformis
atgctaagattagatcttcagttttttgcatctaaaaaaggagtaggttcaacgaaaaacggacgtgactctgaggcgaagcgcctaggtgctaaacgtgcagacggtcaattcgtatctggcggttcaatcctttatcgtcagcgcggaacaaaaatctatccaggtgaaaacgttgggcgcggcggagatgacactctatatgcaaaagtcgacggaactgttaaattcgaacgtttcggccgtaaccgcaaaaaagtgagcgtatatcctgtagcctaa

SEQ ID NO: 2809 - DNA, 390 bp, Bacillus licheniformis
atgattcatgcaaagattacaagatcccgatcgaacaaagacatcttgggctttgaaatgtcgggacatgcgaattttgctgaacatggtcaggatctcgtttgcgcaggggcgtcggcggtcgcctttggagccgtcaatgccgtaatgaagctgacgggcattgagccggtcattgacctcggggaagacggggggtttttatctttccgcttcccggacggtacggatcgtgaggcttttgaaaaggcgcagctccttctcgaaggcatgatcgtcttttttttattcgatcgaactattttttttttgttacttaaaagtaacgacgaacaaaatataggaggtgagctacatgctaagattagatcttcagttttttgcatctaa

SEQ ID NO: 2810 - DNA, 309 bp, Bacillus licheniformis
atgtacgcaattattcaaacaggcggaaaacaaatcaaagttgaagaaggccaaactgtatacgtcgaaaagcttgctgctgaagccggcgaaacagttacttttgacaacgtattgtttgtcggcggtgaaaatgttaaagttggcagccctacggttgaaggtgctacggtaacaggcaaagttgaaaaacaaggccgcgctaaaaaaattaccgtatttaagtacaagccgaagaaaaaccaacacaaaaaacaaggtcatcgtcaaccttacactaaagttgttatcgaaaaaatcaacgcttaa

SEQ ID NO: 2811 - DNA, 867 bp, Bacillus licheniformis
ttgagtaaatggacggagctcttcaccaagcttcacattcatccgctgctgtggcttgtcatggcgatcggtatcatgacaggacatattaaagcgctgttttgtttaatgatcattattttgatccacgagcttggccacgctgctgctgccgtttatttttcatggagaattaaaggcattttcctgctgccttttggaggaacgctggaagtcgatgaacacggcaacagaccgttaaaggaagagcttgccgtcatcgccgcggggcctgttcagcacatttggcttcaatttgcagcctggcttttggcggtcaattcgctcatcagccctcatatatttgaaacgtttactttttacaatctgaccatcctcttgataaatctgtttcctatttggccgcttgacggcgggaagctgctgtttctgctgttttcaaaacaccttccgtatcagaaagcgcagcggatgatgctggctgtatcgtgcttttgctgcgctgttctaatcgcggcgactctgctggtctccccgtcgcagctgagcgcttgggtgcttctcgtatttttggctgcatccctttaccaggaatatcgcaatcggcattacgcccatatccgttttttgcttgagcgctactatggaaatgagagggaagtgcggcgactcgcaccgatcacggtgtgcgccgaacagcagatttatgaggtcatgctcatgtttaaaaggggctgcaaacacccgatcattattgagaaggacggacaaaaactgagccagctggatgaaaatgaagttctccacgcttattttacagacaagcgcacgacttcctcaatggaagatctgcttctggtttattga

SEQ ID NO: 2812 - DNA, 792 bp, Bacillus licheniformis
atgagtcatagagcagatgagattcgaaaaagaatggccaggaaaagaaagcggaaaacaccggacaaacagcccttttcatcagacggcaaaaagcggccgctcaagccgcctgcatggacagccttttcggaagatgaaaaaggaggagacttccctccgcctgaaggaagttccctgctgataaacgggaagcacccgcttgtcaaggcggatgcgctcatcttgaaatgtcttctgtcggcatgccttgttcttgtgtccgccattgcctacaaaggccagtttgaacccgcaaaccaaatcaaaccggttatcagccaggtgtttactgaagagttccaatttgcggccctccagaattggtatgaatccaagttcggcgatcccctcgcattctttcagccgaaaggcgccaaaccgtccggccaggtcgaggtgaatcaggatctcgctgtacctgccgtaggaaaggttcaggagaaattctcagggcagggcattaaggtagaaacagaagacgaaacgatccgcagcatgaaggaaggctatgtcattgaagtggacaaaaatccggaaacaggcctgacggtggtcttgcagcatgcggacaacagctatacctactacggccagctgaaaaaagcggatgtcgctttatacgattatatagataaaggaacgaagctcggaacgattgagcaggataaaaatcaaaaaggcatctattactttgcgatcaaacaaggagaggaatttgttgatccgatacaggtgatcacatttgagtaa

SEQ ID NO: 2813 - DNA, 429 bp, Bacillus licheniformis
atgagcaatcaactagtgcctgatatacataaacaggctgtttttcacgcatcgatagaaaaagtgtgggaggccgtcgccaccagtgaaggcatcgccgcctggtttatgcctaatgatttccgcccggagatcggctgcgaattcaccctgcagtctcctttcggcccctccccgtgcaaagtgatcgagcttgatgcgccgcatcgactcgctttcagctgggatacgtcgggatggatcgtcacatttgaattgaaagagctttctgcagaaaaaaccgaatttaccctgattcattcaggatggggtgcgccggaagaaacggtttcaaaagcgggagaaaagcaagcggatgtccgcaatcggatgaatggcggctgggaaacaatcgtcaatcaaaagctgcgtcaggcagttgagggctag

SEQ ID NO: 2814 - DNA, 321 bp, Bacillus licheniformis
gtgacatccgccgcaaaacatgatgtgttccaagccgtttccgatccctcccggcgaaaaatgctggagctcctcgccggcaaagaattgcctgtcacagatatcagcagccatttcccgatgagccggacggctgtttcaaagcatctcagagttttgtccgaagcaggcctagtcagcgggagaaaagcgggcagagaaaaactgtacaggcttcatcccgaacctctcgccgagctgcagcagtggctcgcctacttcgacatgtattgggacaataagctttccttgctaaagcataaagtagaaaacgatcaataa

SEQ ID NO: 2815 - DNA, 807 bp, Bacillus licheniformis
ttgggtgaagctatcgtaataacctcggggaaaggcggagtaggcaaaacgacgacgtctgcaaatcttggcaccgccttggccattttggggaaacgggtatgtctcgttgacacggatatcggcctgcgcaatcttgatgttgtcatgggccttgaaaatagaatcatatatgatttggtggatgtcgttgaggaacgatgcaaaatccatcaggcgcttgtgaaagataagcgctttgatgatttgctttatttgctgccggccgctcagacaagcgataagtcggctgttttgcccgagcagatggtcaagctgatccagcagctcaaacaagacttcgactacattgtcattgactgccctgcagggattgagcaaggttataaaaatgcggtctcgggcgcagacaaggcgattgtcgtgacaacaccggaaatctccgctgttcgtgacgctgaccggatcatcggcctgcttgaaaaggaagaaaatattgagccgccgagacttgtcgtcaaccggatccgcaaccacttaatgaaaaacggcgatacgctggatgttgatgaagtcattcagcacttgtcgatcgaactgatcggtattgttgcggatgatgatgaagtgattaaagcttccaataacggggagcctgtcgtcatggacccgaataataaagcttcaatcgcataccggaacatcgcccgccgcgtgctgggcgaatctgtgcctttacagtcgtttgaagaagaaaataaaggcgttttcgcaaagattaaatcatttttcggcgtacgcgcttaa

SEQ ID NO: 2816 - DNA, 681 bp, Bacillus licheniformis
gtgaagacccaaaagcagcaatacgtaacaattaaaggaacgaaaaatggattgacgcttcatcttgatgacacatgctcttttgaagaattattgtacggtcttcaggatatgctgtcactcgaacattatatggatggaaaaggccagaaaatcaatgttctcgttaagctcggccaccgctatgtgaccgaggagcaagaacagatcctgaccgatgtgatcactgagaaacaaaatctgttcatccactccattgaaagtgaagtcatgaccaaagatgaagcaaaccgcttaaaagcggaaagcgaaattatttctgtcgctaagattgtccgttccgggcaagtccttgaaacggagggtgatttgcttctcattggggatgtgaatccgggaggaatggtgaaagccggagggaatattttcatcctcggctcattaagagggattgcccacgccggttttaatggaaataaacgagctgttattgcggcttcggatatgagaccgactcaattgcgtatcaatcatgtgctcaatcgctccccagacaacatccaagaagggaacgacatggaatgtgcttatttagatgaaaatgagaatatggtcattgaccgccttcagcaattagctcatttaagacctagtttaacaaggcttgagggaggaatgtaa

SEQ ID NO: 2817 - DNA, 519 bp, Bacillus licheniformis
gtgaaacgcttccttcttcccgtcgtcatgatgtttgttttagtatctgacagcgtctatgcggattttgtcaacttgccttttgtgacggaagaacagcagctcatcccgcgttttctgctgcttgtcttagtttttatgacggcttatgtcaatcagccttttgccattacatatggatttattttcggactgttatatgatattaattacaccgaccttttaggtgtatatatgtttggttttgccggtatttgctatttatcgtcaaaagcgttcaaagtattgcagacaaacgcgctggtcgtcatttttatttcgctgctcgccgtctgtgttcttgaattttaccaatatggcgtgcagatgctgatacgtccggaaattatgccgttccatcaatttgtgctcggcaggctcctgcccacgcttgcgctgaacgccgttggcggccttctgctcatttacccgttcaaatggttttttaccagtcttaagaaagagctgaggaatgagtaa

SEQ ID NO: 2818 - DNA, 909 bp, Bacillus licheniformis
atgccgcagttttttacaaataaacggttgatgcttttactcctttgtatcatcattttagtggcaatgattggattttcgttaaagaatgaccggaatgcaacttggcccgaaaaatttattggcgatacaactggtgtattccagacgatttttcatacgcccgctcaattttttgcgggcttctttgaaaatatcgaagacttaaaaaatacgtacagcgaaaatgagcgcctgcggaaaaagctcgacggccagacacaatacgaggcaaagctgcaggagcttgaaaatgaaaataagtctttaagaaaagagctcggccatctgaaatcaattaaagactacacgccgattctggcgaccgttatcgccagaaatcccgataagtatgagtggtggaacctgattacgatcaacaaaggttcaaagcacggcgttgagaaggatatggcggtaacagatgaaaacggcaacttgatcggaaaaatcaaaagcacaaaagtgaacaatttcacttccaccgtccagcttttaagcgcaacagacagaaacaacagaatctccacagttatcgctgcagataaaggcaagaaaacggtgaacggaatcatcaacggctacgactcagataaaaaggcgctttccatggaaatcatcgagcctgatgaagacagggaagtgaaaaaaggtgacctcgtcgaaacttccggtgcgggcggcgtttttcctaaaggcctgacaatcggaaaagtgacagaggttgaaccagattcctacggtttgacgaaaatcgcttatgtagagccggcagccgatatgtataaccttgataacgtcatcgtcgtcgacagaacgcttgatacggtggatgtcgacaagatggacgatgaggaggaagggtcgtga

SEQ ID NO: 2819 - DNA, 1011 bp, Bacillus licheniformis
atgtttggaattggtgcgagagaccttggaatagatttaggaacggcgaatacgcttgtttttgtgaaaggtaaaggaattgtcgtcagggagccttctgtcgttgcactgcaaacagacacaaagcagattgtcgcagtcggaaatgatgcgaaaaacatgatcggacgtacgcccggcaatgtcgttgccctccgcccgatgaaggatggcgtaatcgctgattatgaaacaacagcgacaatgatgaagcattatattagcaaagcagttaaaaacaaaggcttatttgcgagaaagccgtatgtcatggtctgtgtcccgtcgggaattacggccgtcgagcagcgtgcggttatcgacgccacgcgccaggccggagcgagagatgcatatccgattgaagaaccgtttgcagcggcgatcggtgcaaaccttcctgtttgggagccgactggaagcatggtggtcgacatcggaggcggaacgaccgaagtcgcgattatttccctcggcggcatcgtcacatcccagtctatccgcgttgccggagatgaaatggatgaagcaatcattacttatattagaaaaacatataacttgatgatcggtgaccggactgcagaagcgatcaaacttgaaatcggttctgccgaagcttctgaaaacggagaaagcatggagatccgcggccgcgatcttttaacaggcctgccgaaaacgattgaaatcactgaaaaagaaattacagcggctcttcgcgacactgtgaccgccattgtcgatgccgtaaaaaatacgcttgaaaaaactccgcctgaactcgcggctgatattatggaccgcggaatcgtccttacgggaggcggcgcactgctgcgccacctggacaaagtcatcagcgaagaaacgaaaatgccggttttaattgcggaagaccctcttgactgtgtagcgatcggaacaggcaaagctctcgagcaaattcatctatttaaaggcaaaaattaa

SEQ ID NO: 2820 - DNA, 675 bp, Bacillus licheniformis
ttgaaattaaaagattttcctgatgaagaaaggccaagggagcgccttctcaacacaggcgccgaaagtttgtcaaaccatgaactgcttgcgatactgctcagaaccggtacgaaaaaagaatcggttcttcagctttcaagccggctgcttcaaacgtttgacggcctccgtttgttaaaagaagcatccgccgaggagctttcaagcatttccgggatcggccgcgcaaaagccgtgcagattttggcggcccttgagcttggccggcgcattcacagtctggcttgcaaagaccgttatgtgattcgttttcccgaagatgcggccaattttttaatgggggatatgcgctttctctctcaggagcacttcgtatgtgtgtatctgaacacgaaaaaccaggtgatccacaagcgcacggtttttatagggagcctgaactcttcaatcgtccatccgagggaagtgtttaaagaagctttaaagcgctccgcagcttcattcatctgcgtccacaatcatccgtccggagatccggctccaagccgcgaagacatagaagttacacagcgccttcacgagtccggacagctgctcggaatcgaattgctcgatcatatcatcatcggtgatcaaaaatttgtgagcttaaaagaaaaaggatatttgtaa

SEQ ID NO: 2821 - DNA, 573 bp, Bacillus licheniformis
atgacccgacagctcatattggcttcacaatcaccccgcagaaaggaactcctcgatctcctgcagattccgtacagcatcgttacgagcaatgcggaagaaaaattaattcgaaacttttcaccagcagaaaacgtcaaatggttggcggaacaaaaagtgcgtgcagtagccgaacaatatcctgatgccgtcgtgcttggcgccgacaccattgtttattatgacggagcttatttgggcaagcccaaagatgccgaagatgcagaacggatgctgagcatgctttcgggacagacccattcagtgctcaccggcgtctgcattaaggacggcgaaagatgcgaaacattttttgaggaaaccgaagtctctttttggcctcttgaagaaaaggaaatcagcgcttacatcgctacgggagaaccgtttgataaagccggttcatacggaatacaaggaaaaggcgcgctttttgtcaaacagataaaaggagactattatacagttgtgggccttccgatttccaaaacgatgagaatgctgaaaacgtttgatctccactccttttga

SEQ ID NO: 2822 - DNA, 1032 bp, Bacillus licheniformis
atgaaaaaacggaaaagcaagaaaaactcagctaaaaaagcgcccgaacaagacccgcttaaagtgatgatcaacggcagagaagagactatctacggaaatgaaaaagagttttccaacagaaatgaagaaaagaagtttaccttttcgaactgggaagaaaagagaaaggcagaacgggaaatatcggcttcaaaagaggacggcacacatgaaacaggtgaatttacatggacgccaccggacgaagaagaaaccgtctacaaagacgatcctaaagtggtggcgccttatcaaaagaaaaacgagcccaaaaacaaccgcaaaacgaaaacgtctcttacgtatcctgtgaagcgatttgccgcgaccatcgtctttgctgttttgctcgggacgggactcggtctgtttgcgctgaatctcgcaacgcataaagaaggagtgccggcttccggcagtcttggggcggatgctgaaaacggccagaccgttaaagccggtgactccggtgccgaggagaaaaagagcggagaaaaaaatagcggacaagcgggagaatcttttaacagcttcgccgttcaggccggaaagttttcgtctaaagaaggagcggatacgctggcctctcaaatcgcagacaaggggtatgccgccgtgtcgattgccaaggacgacgggttttatgtaatcgccggaataacgggagaaaagcagatgacatctgaacttggcaaaatattaatcgaaaacgattttgaagcgtggggcggaaaagagcttccggttgcaatcgagtccggtttgctggagccttttaaagaagcggctgagctgtcggcaaaagcgattctcggcgcggaggttacatctcaaaacatagccgatgtcaaagctcaacttgacggggcccaatcaaaaggctctgaagaggtaaagaagagcatactggaagccgtcaaccttctggagaaaccgaccgcagccaacggctggaagagccagcagctattgctgggccaaattaaataa

SEQ ID NO: 2823 - DNA, 780 bp, Bacillus licheniformis
atgaaatttgattctgcgaggttgataacgatgttcatcttttacctttttacggcaggtttagtgctcggctctttttttaattcggccgggcgccgcattcctgaaaagatatcattgattgctccgcgttccctctgccgcgtctgcaaaaggcagctgggcttctcggagctgataccggttttgtcctatttgatgcagcgggggaggtgcaaaggatgtcaaaccccgctctcgatcgtgtatccggcagttgagctctccgccgccatcctgtttgcgtttgccggcatgcacgttgggcatgagggggagctggtgattgtgcttgctcttatatctctgcttttgatcgtctttgtatctgatgtgacacacatgatcattccggatgctgttctttgttttttcctgcctgtctttgccgtcggacgattccttgttcctctggaacagtggcactcaagtttgagcggtgcgatggccggcggtatgctgcccctcttgacgctgcttttgacgaaaggggggatcggctggggagacgtaaagctgtttgcggtaatcggcatggcgctcggcagccgcctcctcgttctcgcttttttcctctcggcagccgcaggaacggtgcttggtcttattgcactcctggcaggcaaactgaagaaaaatgaaccaatgccgtttgctcccgcgattctggccgggacgctgacgagctgcttctatggcgaaccaatgatcgagtggtaccttcaaacggcatggtggtga

SEQ ID NO: 2824 - DNA, 1299 bp, Bacillus licheniformis
ttgttcaaaacgtttgatgaagcactcagctggattaacggaaggcttaaattcggcgtgaagccgggtttggaacgaatggaatggctgctgagaaagctcgggcaccccgagaaaaagctcaatgcggttcatgtcgccggaacaaacggaaaaggttcaacgatcgcttttctccgttcggtattaaatgaagccggttatacagcaggcaccttcacatcaccgtatatcatcacctttaacgaacggatcagcgttgacggcgccccgatctcagatgaagaatggacggcgctctttaatgaggtcgggcctcttgtccttgagcttgaaaaaaccgaattcggagccgccacagaatttgaaattattacggcatgcgcatttttatattttgctaaatacaggcggacagattttgttatttttgaaacgggcttaggcggccgtttggattcgacaaacgtcgtgaagccgatgttaacggtcatcacttcgatcggccatgaccatacggcgatattaggcggtacattgaaagagattgccgcggaaaaggcagggatcatcaaacgcggcgttcctgttatcacagccgttcatcagcatgaagcggctgaggtgataaagcgaaaggcgatggagacagaatctgcttttatatcccttcacgaggattgccagctgtacggggagctttcattgcctgagggagagcagttttcgttgaaaacaccgttacatcattatgaaggaattgaaacaagcctgatcggcacccatcagcggcaaaacgcgtctttggccatacttgcggccgaatggctgacagccgaaaaacatgcggcgatcggcgaaaaagagctgaaacgcggcattcgtaacgcgggatggcccggccggtttgagaaggtattgaacaagcctcttgtttatatcgacggcgctcataacaaagaagggatggagcggctggccgagacgatctcctcccacttcgccgggcggaatattcacgtatgcttcagcgctcttaaagataagccgtacagagacatgatccgcaaaatcgagtcgtttgcgtcatcgattcacttcacatcctttgatttcccgagggcggaatccgctcaaaagctgtttgagcaaagtaccgctgattataaaacatttgatgaagacatcgcctctgttttccggtatatcgaagaaaaagctgaagaggaaaaagcggtggtcgttatcaccgggtcgctttattttatttccgccgtcagggcagctttaactgaataa

SEQ ID NO: 2825 - DNA, 2643 bp, Bacillus licheniformis
atggataatcaagaactgacgatgccgacaaaatacgatccgtctgcagttgaaaaagacagatacgactattgggtgaacggcaaatttttcgaagcgaaaaacgatcctgaaaaagaaccgtacaccgttgtcattcccccgccgaatgtgacgggtaagctgcacttggggcatgcttgggattccaccttgcaggatatcgtgacaagaatgaaacggatgcagggctatgacgtgctctggctgccgggtatggaccacgccggtattgcaacccaggcaaaagtagaagcgaagcttcgtgaagaaggaaaaacgcgctatgatctcggacgcgaaaaattccttgaagaaacatggaattggaaagaggaatatgccgattttattcgcagccagtgggcaaagctcggtctcggcctcgattattctagggagcggttcaccctcgatgaggggctttctaaagcggtgcgcgaagtatttgtaaagctttatgaaaaagggctgatttaccgcggagaatatatcattaactgggatccggcaaccaaaacggctttgtcagacatcgaagtcatctataaagacgtacaaggtgcgttctatcatatgcgatatccgctgaaagacggttcaggctcgattgaaattgcgacgacccgtccggaaacaatgctcggcgatacagcggttgcggtgcatccggaagacgagcggtacaaacacctaatcggaaaaacggtcattctgccgatcacgggcagagaaatcccgattgtcggagacgactatgtcgatatggaattcggttcaggcgccgtcaaaattacgcctgcccatgatccgaacgactttgaaatcggaaaccgccacaaccttgaacgcattctcgtcatgaatgaagacggcacgatgaatgacaatgcccttcaatataaaggcatggaccgttttgaatgccgcaagcagatcgtgaaagatcttcaggaagagggcgtgctgttcaagattgaagaacatacgcattcggtcggccacagcgaacgaagcggagcagtcgttgagccgtatttgtcaacacagtggttcgtgcaaatgcagccgcttgccgacgccgccatcgaattgcaaaaaagcgaaggcaaagtcaacttcgtccctgaccgttttgaaaaaacgtatctgcactggatggaaaatatccgcgactggtgcatttcccgccagctctggtggggccatcggattccggcatggtaccataaagaaaccggtgaaatctatgtcggcgttgaagcgccggaagatgcagaaaactgggagcaggacaaagacgttcttgatacatggttcagttccgctctttggccgttttcaacgatgggctggcctgatatcgatgaggaagatttcaagcgctactatccgacgaacgtccttgtcacaggctacgatattattttcttctgggtatcgagaatgatcttccaaggtatcgaatttaccggagaacgtccgtttaaagatgtcttgatccacgggctcatccgcgacgaccagggccgcaaaatgagcaaatcgctcggaaacggcgtcgatccgatggatgtaatcgacaagtacggagcggattcgctgcgctacttccttgcaacaggaagctctccgggtcaggatttacgcttcagctttgaaaaagtagagtcaacatggaattttgcgaacaagatttggaacgcatcaaggttcgctctgatgaacatggacggcatgacatacgaagagcttgacctgtcaggggaaaaatccgttgccgataagtggattttaacaaggttgaatgaaacgattgaaaccgtgacacagctggccgacaagtacgaattcggcgaggttggccgccatctctacaattttatctgggatgatttctgtgactggtacatcgaaatggctaaacttccgctttacggcgaagatgaagcggcgaagaagacaacccgctccattttagcgtatgtgctggatcaaacgatgcgcctcctgcatccgtttatgccgttcctgacggaagagatttggcagcatcttcctcacgaaggggaatccattacagtcgccaaatggcctgaggccgtcaaagaatatacggacaccgaggccgcggcggatatgaagcttctcgttgaagtcatccgcgccgtacggaacatccgcagcgaagttaacacgccgctcagcaagcagattgaactttatattaaaacgagcacgccggaaatcgctgaacgacttgaagaaaaccgttcgtacgtagaacgctttacgaatccgagccttcttcagatcggaacggatattcaagcggtcgataaagcgatgaccgctgtcgtatctggcgccgagctgatcttgccgctcgaaggtctgattaacattgacgaagaaatcagccgccttcaaaaagaactcgataagctgacgaaggaagttgaacgggttcagaagaaattaagcaatgaaggatttatgaaaaaagcacctgcacatgtcattgaagaagagcgggcgaaagaagccgattatacggcgaagcgtgaagctgtagaaaaaagaatcgccgaattgaaaaactga

SEQ ID NO: 2826 - DNA, 192 bp, Bacillus licheniformis
atgcgaaaaaaattcaacacatattcattccagccgtggctgaagcaagtcaggcttgttgctgttcaagtcgtcctcccgattacgatattccagggcatccgcacgatcatctttcctaccacatttgatgtcctccttttgggcattctcatattccttgcgtgcgcctttcaccttgactggatttaa

SEQ ID NO: 2827 - DNA, 1023 bp, Bacillus licheniformis
atggaaggcatccagtctgttttaaatgagtacggtcttacgcctgaatatatggagtccgtcagttcaaaggtgtggaaagtgtatacggatcacggtgtatttgctctgaaaaaattggcggcttcaagaaacacccgcttcacggaacagatgatcatgctggaggaaaaaggctacaggcagttcgttcctgtctatcgaaaccgcacaggcgaatttttaacgcaagccggagaagatgtctgctatctcatgccctggcttactcttgaaagggaggaagagcgggatcaaaaacacgaatatatgtttaaagaaatcgctcttcttcaccagcggacggaaaaagagctcggcgtgaggcgggaagaaatactcggacactatgaacggacaaaacggaaatgggaacagcaaaaacagaaatatgaagcattcatcatgaaagcggaaaacgaatggtatatgtccccgttccagcttcaggcggccatgtatttcaaagagacgatatcagctgccgactttgcgctcgcccgccttgaagattggcatgaagccatgagagaaaaagagtctgccagaatggtcttaaaccacgggcacctgtccgttcggcattttctctataacgataccggaacgggttactttacgaactttgagaaagcgggacatgcgccgcctgcaaatgatctcatcgtattttttactagaatgtttaagacgaaccccgttatgtgcacggaatgtgtaaactggttttatacgtatcacaatgtctatcctttgcgggaggaagaaatcggcttattcctcagctatatggcttacccggggcctgtattcggcgtactgaaccgctacgaacatgagaaggggctcggggaaaaagaagcctgtacaaggcttttaaaggcgtactggcaaatgaaaaacgctgagccgcttgtgatgagcattcacgagacggaagaaaacagaaaactgcaggaagaaacagagtccccatcatcatga

SEQ ID NO: 2828 - DNA, 1374 bp, Bacillus licheniformis
ttgccgcaaaacaatcgtttgcaattttctgtagaagagtcaatctgttttcaaaaaggacaggaagtatccgaattattatcgatttcattggatcctgacattaccgttcaggaagtaaatgattatgtatccatacgagggtcattagagctgacaggcgaatacaacatagatcaaacccgggagtatgcagagctgcctgcgacaagccgatttgtagaagatgtaaagctgaaaggggacggcagcgcagagctgacgcattgtttcccagtggatatcaccatcccgaaagacaaagtcaatcatttaaacgacgtatttgtttttattgacgctttcgattatcagctgacagatgcgaggatgctgacgattcaggctgatttggcgattgaaggcctcttgaatgtgagcggtgaagcgggtgaagaagaaccgcgcactatgcctgcggccgtccatccggaagaggagctcgaacctgcctacagatcaccttcaaacgacgaagatcagggtgaagagaaagaatatttgatccagcttgacagaccttacgaagagcaggacgaagaacaggcggaagaacatgataccggtgaggaaacggttccgatttaccagtcgtttctcggaaacgacacagaggaagctaaaccgttttttacagcgtctttgtcggcggcagagcgtacgaagcgcgaaatagaaaatcaaaaagaagcctctcttgaacagccggaagaagaatataagctgaaaagagagaaagtggaagaggaaccggaagaatatgagctgaaaagagagaaagtggaagaggaaccggaagaatatgagctgaaaagagaagaagcggaagaagagccggagctgtcgcacagctcttatcaacctcacgaggaactgaaagagaacccgttctacagtgttcctcctcttctgaaggaagaccagaatgacagggagcctgaggcttttgaggttgaggtgacacaggaagcagaagcgattgatgaagaagaggaagccgggcatacgattgaaatcccggaatattcgtttcatgagcagacggagcccgaagaagaaagagatgaaatgcaggcagcggatgaacaggaagtgtcagcaaaggaaaacgacaacgcactctatttgacaaagctgtttacaaagcagggagaggaggagtttactcgaatgaggatgtgcatcgttcagcaaaatgatacgattgatcttctgtgcgagcgctatgatattaacgtccagcagctcatccggatgaattccctttcccttgacgaggaattaaaagagggacagatcctttatataccggattatcaaaacagccatgcctaa

SEQ ID NO: 2829 - DNA, 1296 bp, Bacillus licheniformis
atgcggagctatgagaagtctaaagcggcattcgaagaggcgcaacgagtcatgccgggcggggtgaacagcccggtcagagcctttaaatcagtcaacatggacccgatttttatggagcggggaaaaggatcaaaaatctatgatattgacggaaacgaatacatcgattatgtcctgtcatggggaccgcttattttgggccacagcaatgaaaaagtggtgaaagagattcaaaaggcggcagaacacgggacaagcttcggtgcgccgacagaactggaaaccgagcttgccgagcttgtcatcgaccgcgttccttccatagaaatcgtccggatggtgagctccggtacggaggcgacgatgagcgccttgcggctggcgcgcggatacacaggccgtaacaaaatcgtaaaatttgaaggctgctaccatggacacggtgattccctgctgattaaagcgggctcgggagtagcgacactcggcctccctgacagccccggagttccggaaagcattgcaaaaaacacgattaccgttccttacaatgatctggaaagcatgaaacttgtctttcaagaattcggagatgacattgcaggcgtcatcgttgaacctgtcgctggcaatatgggcgtcgtaccgccggttaaagggttcctcgaagggcttcgcgagctgactgagacgcatggcgccctgctgatatttgatgaagtgatgacaggattcagggtggattacaactgtgcccaaggctatttcggggtgacgcctgatttgacatgcctcggaaaagtgatcggcggcggtcttcctgtcggcgcttatggaggaaaggcggaaatcatggagaagatcgcgccgagcggtccgatctatcaggccgggacgctgtccggcaacccgcttgccatgacagccggacttgaaacgttgaaacagctgacccctgaatcctaccgggaattctcccgcaaagctgaccgcttggaaaaaggaatttctgaagctgcagagaaaaatggcattccgtgtacattcaacagggcggggtctatgatcggctttttcttcacaaatggaccggtcatcaattatgatacagcgaaacagtctgacctcggactgtttgccgaatattataaaggaatggccgatgaaggcgtgtttctgccgccttcacagtttgaagggctgttcttgtcaaccgctcatacggatgacgacattgagcatacgattaaagctgctgaacgcgtattcgaaagaatcagccgctccagataa

SEQ ID NO: 2830 - DNA, 975 bp, Bacillus licheniformis
atggaagcatcatttcaaagacaccgccgcctgcggacgacagcaggtatgcggaaattggtaagggaaaccgagttaagagcatctgatttcatttatccgatatttgttaccgaggaagagaacgtcaaaagcgaagttccttctatgccgggcgtgtaccagctgtctttggaccgtttgaaagaggagatggaggaagtcgcaagcctcggcattcaatctgtgatcgtcttcggcgtgcctgagcacaaagatgatgtgggaagcggagcctatcacgatcacggcatcgtccaaaaagcgattgcacaaattaaacaggactttcctgaacttgtcgttatcgccgatacgtgcctatgcgagtacacggaccacggtcactgcggcctggtggaaaacggtgaaattttaaatgacgaatcgcttgttcttttggcaaaaaccgctgtcagccaagcccgtgcaggtgctgacattattgcgccgtcaaacatgatggacggtttcgttgccgctatcagggaagcgcttgatcaggaaggatttacaaatgtgccgatcatgtcgtacgctgtaaaatatgcgagcgctttttacggaccgttccgcgatgctgcgggaagcagtccgcagtttggcgaccgcaagacgtaccaaatggattatgccaaccgcagggaagctctccgggaggcaaaatccgatgtggaagaaggcgccgatgttctgatcgtcaagccgacgctttcatatcttgatatcgtcagagaagtgaagaacgaatttaacctgcctgttgtcggatacaatgtgagcggggagtatgctatggtcaaagccgccgcccaaaacggatggattgaagaaaaagctcttgttctcgaaatgctgacaagcatgaagcgggctggcgccgatttgatcattacgtactttgcaaaagacgcggcaaaatggatttcggaataa

SEQ ID NO: 2831 - DNA, 792 bp, Bacillus licheniformis
atgaagcatgatcttcctttagagggaaagaaagtgctcgtcacccgcaataaagcgcaagcccaatctttcagggaaaaggtggaggctttgggcggggaagctgttttaacgtcattgatttcgtttcggcccgcccttccgccagaacaggcccggcgctttcgagcagatcttgaaagtgcggactggcttgtttttacaagcgtgaacggggcaaaattctttttttcttatttaaaggacgccgggttgtgcgatcctcccgcatcaaaggcgaaggttgctgctgtcggtgaaaaaacagcccggtatttgcgcgacaggggtctttctgtcgatctgatgccggagttatacgtggctgaacatttggcggaggcacttaagcaaaatgccggacgtcatgacaaagtggtcgttttaaaagggaatttatcccgggacgtcatcaagaaaaccatctctcctctcggaattcaagtttcggaatggattttgtatgaaaccgtgcgtgatgaaaggggaattctggacctgaaggaagcagcaaagcacgcgtcttttgattttgtgacgtttaccagttcttcgacggtacatacattcatgtccattctgaaagaggagagcttagcgtgggccgaaaagaaccggacggcttttattacgatcgggcctttgacaaagaaggcgctgtcggactacggaattccatcatatatgccggacgtctatacaatcgacggaatgctgcgcgaaatgtgccgcatttcaagaaagggagaatga

SEQ ID NO: 2832 - DNA, 942 bp, Bacillus licheniformis
atgagaaacatcattgtaggctcaagaagaagcaaattggcgatgacccagacaaaatgggtgatcaaaaagctggaggaattaaatccggatttcacgtttgaaataaaggaaatcgttacaaaaggcgaccggatattggatgttacgctgtcaaaggtcggcggaaaaggtctgttcgtcaaagaaatcgaacaggcgatgctctccggggaaattgatatggccgttcacagcatgaaggacatgccgtcggtgcttcccgaagggctgatggtcggctgcattccaaaacgggaagacgccagggatgttctcatttcaaaaggccgtcaaaagctggctgacttgaaacaaggcgcagttgtcggaacgagcagcctcagaagaagcgcacagcttttgcaaatgcgccccgaccttgagatcaagtggatcaggggaaatatcgatacaaggctgaaaaaacttgaaaccgaagattacgacgcgattattttagctgcggccggcctgtcaagaatggggtggaaggacgatgtcgtcactgaatttcttgatccggaaagctgccttcccgccgttgggcaaggcgctttggcgatcgagtgcagaggctctgatgaggagctgctgtctctcttttcgcgcctgaacgaccgctacacacagctgaccgtcacggctgagcgcgcttttcttcatgcgatggaaggcggctgccaagtgccgatcgcaggatttgcaaagatggacgaagacggcgtcatcgaactgaccggtcttgtggcatcgcctgacggaaaaaccgtatacagagaaacagtaaaaggaaaagatccggaggctgtcggcagagaatgcgccgcagtcatgtcggaaaaaggagcaaaggcactgattgaccgggtgaaacaggagctggaagaccatgaagcatga

SEQ ID NO: 2833 - DNA, 831 bp, Bacillus licheniformis
atgacagacacattgttagcaaggcttaacgaagttacaatcgtgttgtacgcgttcaccgttctcttttattttatagactttttacagcacaaccggaaggcgggaaaagcggccttctggttgctttctattgtctggattctccagacggtataccttttttatttcatgcagtacacagatcagtttcctgttttgaataatgcgcaggggctttatttttacgcgtgggtgctcgtcacgctgtctctcgttttgacgaagcttttgaaagtggaatttctcgtttttttcaccaatctcatcggcttctcaatggcggcgatccacacatttactccaacggctcagcagtcggcggagctttcgggcaggctcgtgtccgagctcttgatcatccacattacaatggcgattctttcgtatggagcattttcattgtcctttgtcttttccgtgctgtatctttttcagtatcgcttattgaaaaagaagaagtgggggaaatggctcttgagaatcgaagatttgtcaaaacttgatcatatggcttatgtcctcaatatcatcggcgttcccatgcttctgctgagcctgattctggggattatctggtcgtatgtatcgcttgaaaccctgtattgggccgatccgaaagtgctcggatcgatcgtgctgctttttttatacggatactatttatttatcaggattgtcaaagagctgcagggaaggatcgcggccatgtggaatgccgcgtcttttcttgttcttttaatcaatttctttttgctcggcagcttttcgcagtttcattggtttagttag

SEQ ID NO: 2834 - DNA, 1362 bp, Bacillus licheniformis
atgcatatacttgtcgtgggattggattacaaatcagcccctgttgatatacgtgaaaagttaacctttcagccggatgagctggggcaggcgatggcgcaattgaaagaagaaaaaagcatacttgagaacatcatcgtgtcgacatgcaaccggacagagctgtatgcagtcgttgatcagctgcacaccggacgttattatatgaaaatgtttttggcgaactggttcggattaagcaaagaggacatttcgccttacttgaagttttatgaaaacgacggggccgttgaacacctgttccgcgtatcgtgcggattggattcgatggttattggagaaacgcagattttgggccaagtgcgtacaagttttaagctggctcaggaagagaagacaattggtaccgttttcaactatttgtttaagcaggcggtcacggtcgcaaagcgctgccatgccgaaacggacattgcttcaaatgctgtatccgtcagctatgccgccgtcgagcttgccaggaaaatcttcggcgacctttccgataaacacgtgctgattctcggggcgggcaaaatgggtgagcttgcggttcaaaacctgcacggccacggaatcggacaggttacggtgatcaacagaacattttcaaaagcgaaggagcttgccggccgtttttcaggcgcggcgaaaagcttgaatgagctgcaatgcgctttgatggaagccgatattctcatcagttcgaccggcgccagcggctatgtcgtcacaaaagagatgatcgaacatgtcaataagcttcgcaaaggctgtccgctttttatggtggacattgccgtgccgcgggatcttgacccggctctcagcgaagtggaaggcgtcttcctgtacgatattgacgatcttgaagggatcgtcgaagaaaatttgaaggaacgccaggccgttgccgaagaggtggagctgattattgaagctgagatcgtttcttttaaacaatggctgaatacgctcggcgtcgtgccggtcatctcggctctcagggaaaaagccttgacgatccaggcggaaacgatgcagagcatcgaacggaagctccctcatttgagcacaagggagaaaaaacttttaaacaagcatacgaaaagcattatcaaccagcttttgcgcgacccgattttaaaagtgaaggagtttgcgtcagaagctgatgccgaagaaaagcttgcactgttcacgcagatttttgatattgaagaagcggcttttcctgacggtgagagacaagacgaacgtcagccggttcatgcgtttaagcggcaaaatccgcagggtttgacttctatcgcgagcgagtga

SEQ ID NO: 2835 - DNA, 486 bp, Bacillus licheniformis
ttgaaaaagaaatctgttttgcttccattgctgttgatagccgttgctgtctacgcctttttgcggtcgggccggatcagcctgtttgacggccaggaagaatggtctgtacttgcaggtctcgtcggactggctcttttttatcagggacagaaggaagccgattccgcccattcctttgcagggctcttaatgacagcgatcggcgtttatttcacatttaaagaggactatttcagccgcgcggatgattttgcggtcatcgtgctgatcttcggtgcggcgctgcttgtcaaatcgtttaagacaaaagaatatcaatatgaaagtctgctgatgatcgcggtcgccctctatctttactttttccggcaaattgccgcctggctgaagtcggtgaatatcgagacggcatatgtagaagcttattggccggccgcttttatcgcggttagtctgctcttattattcttaaaaagaaaatag

SEQ ID NO: 2836 - DNA, 588 bp, Bacillus licheniformis
atgaaagtaacgaaatcagagattgtcatcagtgcggtgaaacccgagcagtaccctgaagggggactgccggaaatcgcccttgcagggagatctaatgtcggaaaatcgtcattcatcaatacaatgatcaaccgtaaaaacttagcgaggacatcttcaaaaccgggcaaaacacagacattaaacttttatatcattaacgatgtccttcactttgtcgatgtgcccggctacggatttgcaaaagtctccaaaacggagcgcgaggcttggggccgtatgatagagacgtatttgacatcccgcgaagaactgaaagcggtcgttcaaatcgtcgacctcaggcatgctccttcacaggatgatgtgatgatgtacgactttttaaagcattatgaaattcctgtgatcgtgattgcgacaaaagcggataaaatccctaaaggcaaatgggaaaagcatgccaaagtcgtcaaagagacgcttaatatagaaaaagaagaccggctcatattgttttcctccgaaacgaaaaagggtaaacaagaagcatggtcggcgatcgagcaaatgatcgcgagataa

SEQ ID NO: 2837 - DNA, 2325 bp, Bacillus licheniformis
atggcagatgaaacgaaacgaaacatcccgctcctccctttaagaggtttactcgtctatccgacgatggttttgcaccttgacgtcgggcgtgaaaagtcggttcaggcacttgaacaggcgatgatgaatgaccatatgatctttttggcaacgcaaaaggacatatccatagacgaaccggatgaagacgagatttttacattcggaacctatacgaaaatcaagcagatgctcaagctgccgaacggaacaatccgcgttttggtggaggggttgcagcgcgcccgcattcttgagtaccatgacttagatgaatatacgtctgtaaaaatcgagcgaatcgatgaagagactgaaaaagatgttgaagatgaagcactcatgcgcacattgcttgaccacttcgatcaatacataaagatttcgaaaaaaatatcggcggaaacatttgccgctgtgacagatattgaagagccgggaagaatggccgatattgtcgcctcccacctcccgctcaagctgaaagacaagcaggaagtgctggaaacgatcgatgtcaaagccagattgaacaaagtaatcgacctgattcacaatgaaaaagaagtccttgagattgaaaagaagatcgggcagcgcgtcaagcgttcaatggaaagaacacaaaaggagtattacctgcgcgagcagatgaaagccatccaaaaagaacttggcgataaagaaggaaaaacgggtgaggtccaaaagctgactgaaaaaatcgagcaggccggaatgcctgacaatgtgaaagaaaccgcgcttaaagagctgaaccggtacgaaaaaattccgtccagctcagctgaaagctctgtcatccgcaattatatcgaatggcttatttctctcccatggaacgatgcaacagaagacaggctggatttaaagctcgccagtcaaattctcgatgaagaacaccacggccttgaaaaagtgaaggagcgggttctcgaatatttggctgtccagaagctgacccgctcgttaaaaggaccgatcttatgcttggccggccctccgggtgttggaaaaacctctctggcgaaatcgatcgccaaatcgctcggacgcaaattcgtccgcatttcccttggcggcgtgagggatgaatctgaaatccgcggtcaccgccgcacatatgtaggcgccatgccgggccgtatcattcaggggatgaaaaaagcaggcaagaacaatcccgtattccttttggacgagattgacaaaatggcgtcggatttcaggggagatcccgcttcagcgatgctggaagtgctcgatcctgaacaaaaccatacgttcagcgaccattatattgaagagacatttgacttatcaaaggttttgtttatcgcaaccgcgaacaacctggccacaatccccggcccgctcagagaccgcatggagatcatcacgatcgccggctatacggaagtggaaaaggtcgaaatcgtcaaagaccatctgcttccaaaacagctgaaagaacacggtttgaaaaaatccaatctgcaaatacgggagcaggctgtcctggacgtcattcgctattatacgagggaagccggcgtcagaaatcttgaacgccaaatcgcagcgatatgcagaaaagcggcgaagctgatcgtatcaggggaaagaaaaagaattacggtcacagacaaaaaccttgaagactatttaggaaaaagaatgttcaggtacggacaggctgagctcgacgatcagatcggcgttgtcacaggtcttgcctacacgacggtcggcggtgatacgctgtccatcgaagtgtctctttcccccgggaaaggcaagctcattttgaccggaaagctcggcgatgtcatgagagagtcggcgcaggccgcattcagctatgtccgttcaaaggcggaagagttgaacatcagccctgattttcacgaaaaacacgatattcacattcacgtgccggaaggagccgttccgaaggacggcccatccgcggggatcacaatggcgacggctcttgtctcggcgctgacgggccgacctgtttcgcgaaatgtcggcatgaccggcgaaatcacgttaagaggccgcgttcttccgatcggcggcttgaaggaaaaggcgctcggcgcacaccgtgccggcttaaagactgtcattatgccgaaagataatgaaaaagacattgaggacattccaaacagcgtgcgggaaggcttgaccttcattcccgtcgctcacctggacgaagttctaaagcatgcgctagtaggagaagagaaatga

SEQ ID NO: 2838 - DNA, 1656 bp, Bacillus licheniformis
ttgagctggacgagcattgcactttttgtacaactatttttcgggatcatcatcggattatatttttggaatttgctcaaaaatcaaagaacccaaaaggttacgatagacagagagtccaaaaaagagatggaacagctccggaaaatgagatcaatccatttatcagaacctttatcggaaaaggtgaggccgacggcttttaaagacatcgtcggccaggaggacggcattaaagcgctgaaagccgccctttgcggaccgaatccgcagcatgtcattatttacggccctccaggtgtgggaaaaacggcagctgcaaggcttgtccttgaagaagcgaaaaagaacaagcgctcaccgttccaggaacattccgcctttgtcgagcttgacgcgacaacggcccgtttcgacgagcggggaatcgccgacccgttgatcggttcggtccacgatccgatttatcagggcgccggagcgatggggcaggccggaattccccagccaaagcagggagccgtcacgcatgcacacggtggagtattattcatcgatgaaatcggagagcttcatccgattcaaatgaataaaatgctgaaggtgctcgaagatcggaaagtttttttggaaagcgcctattacagtgaagaaaacacgcaaatccccaagcatattcacgacatttttcaaaacgggctgccggcggatttcagactgatcggcgcgacgacaaggatgcctgatgaaatcccgcctgccattcggtcgagatgtttggaagtgttcttccgcgaccttgaaaagcacgaattaaaaacggtcgccaaaaaagcggcagataagattcaaaagaaagtcgcagaggaaggactcgacctgttgacgcggtatgcgagaaacggccgcgaagtcgtcaatatgatgcaaatcgccgccggaatggctttgactgaagagcgcgacgaggtgacggttgaagatatcgaatgggtgatccattcgagccagctgacaccgaaatacgaacaaaaaatcgcctctaaaccgcaggtcggcatcgtcaacggacttgccgtccacgggcctaacagcggttcgctgctcgaaattgaggtcacagtcaatcaggcggctgataaaggatcgattaatatcacaggcattgcagaagaagagaatatcggcaaccagtcaaaatcgatccgccggaaaagcatggcgaaaggatcggtcgaaaacgtcatgactgtattgcggacaatgggagtcaaagcttcggattatgatattcacgtgaatttccccggcggtatcccggttgacggaccatctgcagggattgcaatggcggcgggcatattctccgctattcataagattccgatagaccatactgtcgccatgacgggtgaaatcagcctgaacggccgggtaaagccgatcggcggcgtgattccgaaaatcaaagcggccaagcatgcgggggcaaaaacagtcattattccgcacgaaaatgttcagtcgattttaaagcggatagaaggcatacatatcgttcccgtcaaaaccttgcaggaagtactcgacctcgtattggtcaaccctccttcagaaatgcccgacggcgttcaaatgaaaagagaatccgtttaa

SEQ ID NO: 2839 - DNA, 1266 bp, Bacillus licheniformis
atgtttaaattcaacgaggaaaaaggacaattgaaatgctcgttttgcggtaaaacacaagatcaggtacgcaagcttgtcgccggaccaggcgtatatatatgtgacgagtgcatcgaactttgcactgaaattgtagaagaggaactcggctctgaagaagaagtggagttcaaagatgttccgaagccaaaggaaatccgcgagattcttgatgaatacgtcatcggccaggaccaggcaaaaaaatcccttgccgtggccgtctacaatcattacaagcggatcaattcgaacagcaaagtcgacgacgtcgagctgtcaaaaagtaacatttccatgatcggaccgactggaagcggaaaaacgcttcttgctcaaacgcttgcccgcatcctgaatgtgccgttcgccattgcggatgccacgtcgcttactgaagcaggctatgtcggtgaagatgtggagaacattttgcttaagctgatccaggcagctgactacgatgttgaaaaagcggaaaaaggcattatctacatcgatgaaatcgataaagtggccagaaagtccgagaacccttcgattacacgcgatgtatcaggcgaaggcgttcagcaggcattgcttaaaattcttgaaggtacggttgccagcgttcctccacaaggcggaagaaagcatcctcatcaagagttcatccaaattgacacaaccaacatcctgttcatttgcggcggagcttttgacggaatcgagcagatcatcaagcgccgtctcggccagaaggtcatcggcttcggctctgacaacaagcatgaagaccttgaaaaagaagcgcttctttccaaagtgcttccggaagacttgcttcgcttcgggctgatccctgaattcatcggccgtctcccgatcatcgcaagccttgagccgctggatgaaaaagcgctggttgaaattttaacaaaaccgaaaaacgcgcttgttaaacaatatagaaaaatgcttgaattggatgatgtggagcttgtgtttgaagacgaagcgctcacagaaatcgctaaaaaagcaattgaacgtaaaacaggagcacgcggacttcgttccattatcgaaggaatcatgctcgacgtgatgtttgatctgccgtctcgcgaggatattgaaaaatgcgtgatcacaggcaaaaccgtcactgacggcgaaccgccgcgtctcattatgaaagacggcacggtcgtcaataaagacaaaaaaacttcagcataa

SEQ ID NO: 2840 - DNA, 1275 bp, Bacillus licheniformis
atgtcagtaaaatgggaaaagcaagaaggaaacgaaggcgttttaacggttgaggtagatgccgatacctttaataaagcccttgatgatgcatttaaaaaagtagtaaagcaagtatccattcctggattccgcaaagggaaagtgccgcgcggtttgtttgaacagcgttttggcgtagaggcgctttatcaggatgcgctggacatcctgcttcctgtcgaatatccgaaagcggtagaggaagcaggcattgagcctgttgaccgtccggaaatcgatgtggaaaaaatcgaaaaaggcgaaaacctgatcttcactgcgaaggtaacggttaagcctgaagtgaaacttggcgaatacaaaggccttggcattgaaaaagacgatactgccgtaacggatgaggacgttcaaaacgaacttaagtctctccaagagcgccaggctgaactcgttgtaaaagaagacggcaaagttgaagaaggggacactgttgttcttgacttcgaaggattcgtagacggcgaagcattcgaaggcggaaaagcggaaaactattcccttgaagtcggttcaggctctttcatcccgggctttgaagatcagcttgtcggacttgaagccggtgctgaaaaagacgttgaagtgacattcccagaggaataccacgcggaagagcttgcgggcaaacctgcggtattcaaagtgaaaattcacgaaatcaaagcgaaggagcttcctgagcttgatgacgagtttgcgaaagatgtcgacgaggaagttggaacgcttgccgagctgactgaaaaaacgaaaaaacgtctcgaagaagcaaaggaaaacgaagcggacgctaaacttcgcgaagagcttgtcttgaaagcagctgaaaacgctgaggctgacattcctcaagcgatgatcgacacagagcttgaccgcatgatgaaagaattcgaacagcgtctgcaaatgcagggcatgaaccttgagctttacttccaattctcaggacaggatgaaaacgcgctgaaagagcaaatgaaagaggatgctgaaaaacgcgtgaaatccaacctgacactggaagcgatcgccaaagcggaaaaccttcaagtcactgacgaagaagtcgaagaagagctttctaaaatggctgaagcatacaacatgcctgttgaaaacatcaaacaagcaatcggttctacagacggaatgaaagaggacttaaaagttcgcaaagcaattgattttcttgtagaaaaccgttaa

SEQ ID NO: 2841 - DNA, 1008 bp, Bacillus licheniformis
atgaagcatgacaagaagaactcgaagatcataccgttcccgaacgtaaaggagcgtttagtgcacaaagggatgggtgcgctcaaagaaaagaattaccatgaagcgctcaggctgttttctgaagcgaagcgctataatgatgaggaatctgatatttatctgggaatggccatctgcctgcttgaaatcggcgagcttgaagaagcgaaaggcatctgcgaaaaaatgctgaaggaaggccacggccactattttaccgttttacaagtctatatgacgattttaatccagctcagacaatacgaaaaagttaaagaaacgatcgaagctgtactcgaagaaaacaagcttcctcctgaaagcgcggaacagttttataaactccttgatttcagccgcaagatgacggaagacccggggcctgaggacatcaccgaagaccttcccgagacggaggaggttgatcaggaaaggcttttgaatgacacggaagagcaggttaagcttcttcacgggctgaaggaccgcaatctgacaagctatatcggcttgttgaaaacgattctgcaaaacccgagcgcacatcctgtcgtaaaaacgatgattcttcagcttttagccgagtcagaccatgaaaagccgacgcttgtcgcaaaatttggcgattcgatgacaattaatccgacagagacggtcaagcctgatgacatgccgatattaaagcatgttctgagcgtgctcgatgatacgctggggaatgaaaatcccacgctgtaccaggcggtcgaagagctgtggagaaggcatatttacgtcctctatccgtttcagccgaaatactcaaaccgcgagctctgggctgctgcactgcataaagtcggatatgagatgcacgggatcgacatcgataaagaggagcttcatattctctatgaattcaatgacagacagcttgacgaagcctgcgcgctgatcaaagacatagaagaaatttcttatttgtaa

SEQ ID NO: 2842 - DNA, 600 bp, Bacillus licheniformis
atggagccattaaagacccataacggaatagcggcggtgctaaacagaatcaacgtagacacggaccagatcattccgaagcaatttttaaaaaggatcgaaagaacgggatacggccgttttgctttctttgactggcgctatctggataacggcgatcccaatcctgattttgaactgaaccggccggaatacaaaggcgcttcgattttaatcgccggcgaaaacttcggctgcggctcttcaagggaacacgcgccatgggcgcttgacgactacggatttaaaatcattatcgcgccgtcttttgccgatatctttcaccaaaactgttttaaaaacggcatgctgccgatccgccttccttatgaggcgtggaaagagcttgctgaacagtatgagtatcaatctttgacgatgacggtcgatctcgaaaaacagacgataacagatcatgccgggcggcagattgcctttgaggtcgatccgcattggaaagagatgctgctgaacggttacgacgaaatttctttaacattgctccttgaagaagaaatcgaacaatttgagaaacagagaagttcttggctgcaagcataa

SEQ ID NO: 2843 - DNA, 1419 bp, Bacillus licheniformis
atgatgcctcgaacgatcatcgaaaaaatttgggatcaacacgtgattaaaaaaggtgaagggaagcctgaccttctctatatcgatctgcatctgatacatgaggtaacgtcgcctcaggcctttgaaggcctgaggcaaaagaacagaaaagtcagacggcctcaaaatacgtttgccacgatggaccacaacattccgactgtcaatcggtttgagattaaagatgatgtcgctaaacggcaggtcagtgcgctcgaacggaattgcgaagaattcggcatccgccttgcagacttgtcaagcgtagaccaggggatcgtccatgtcatcgggcctgaactgggattgacgctcccgggcaaaacgatcgtttgcggagacagccatacatccacacacggagcgtttggcgcgctcgctttcggaatcggaacgagcgaagtcgaacacgtcttgtcaacgcagacgctttggcagcaaaaaccgaagacgctggaaatccgcgttgacggcaaactgcaaaaaggagtgacggctaaagacgtcattctggcgatcatcggaaaatacggggttaaattcggtgcgggctatgtcattgaatataccggcgaagtgttccgaaacatgtcgatggacgaacggatgacggtttgcaacatgtcaatcgaagctggggcaagagctggattgattgcaccggatgagacgacgtttgaatatgtcaaaacaaaaaaatatgcgccaaaaggcgaggattttgagaaagctgtagaagaatggaagaacctgaaaaccgatccgggggcggtctacgaccggacgatcgtgatggacggaagcgccatttctccgatggtgacgtggggcatcaaccctggcatggtgctgccggttgatgaaacgattccggggcctgaggctttcttgcaggaagacgataaaaaagaagcgcagcgcgcatatgaatatatgggtcttgaaccatataaaaaaatcgaggacattacaattgagcatgtctttatcggttcatgcaccaactcgcgtatgacagatcttcgccaggcggccgaaatgattaaaggtcaaaaagtcgccgacggcgtcagagcgatcgtcgtacccggctcgcaaagcgtcaaaatccaagcggaaaaagaagggcttcacaagattttcatcgaagcgggctttgaatggagagaatcgggatgcagcatgtgtttgagcatgaacaatgatgttgtccctgaaggagagcgctgcgcttcgacttccaaccgcaattttgaaggcaggcagggcaaaggagccagaacgcatctcgtcagcccggcgatggctgcgatggccgcgattcacggccgctttgtcgatgtcagaaaatattaccaagagacaacagctgtatag

SEQ ID NO: 2844 - DNA, 1113 bp, Bacillus licheniformis
ttgaaaaaacgaatcgcacttttgcccggtgacggaattggtcccgaagtattggacgcggctgttgatgtgctgaaaagcgttgctgaacattatcagcatgaattcgaatttgaatacggcctgatcggcggggcggcaattgatgaggcaggagcgccgcttcctgaggaaactgtcgccgcctgcaaagctgcggacgccattttgctcggagctgtaggcgggccgaaatgggatcaaaatccttctgagctgcggcctgaaaaagggctgctcgccatccgcaagcagctcgatctttttgccaatctgcggcctgttaaagtatttgaaagccttgcgggagcttctccgttaaaaaccgaatatatcgaaggtgttgactttgtcatcgttcgcgagctgacgggcggcttgtattttggaaagccgagcgagcagtacgtcaatcagaacggcgaggaagaagcggttgacacgctgttttataaaaagtcggaaatggaaagggtcatcagggaagccttccaaatggcgcagagtcgaaaaggcaaagtgacctccgttgataaagccaacgtccttgagtcaagcaaactatggcgcaagacggcggaagaagtggcgaaagagtttcctgacgtcaagcttgagcacatgctcgtcgacaatgcagccatgcagctcatctatgcgcctggacagtttgatattatcgtgacagaaaacatgttcggcgatattttaagcgatgaagcatcgatgctgaccggatcgctcggcatgctgccgtcggccagcttatcaagctctggacttcatttatacgaacctgtgcacggctcggctcctgatatcgcgggacagaacattgccaatccgcttgcggcgatcttgtccgcggctatgatgctcaggacgtcattcggtcttgaagctgaagcgcaagctgttgaacatgcagtcgatcaagttctccgggcaggaaaacggacgaaggacctggcaaaaggctcggaacattgcacaactcaatcgattacaggggaagtaaaagccgcgctggcagacgacaatgccatttcaaacatcatgaccgcttacgtttaa

SEQ ID NO: 2845 - DNA, 1557 bp, Bacillus licheniformis
gtgcgaaaaattaacttttttgatacgacactccgtgacggtgaacagtcgccgggcgttaatttaaacacgcaggagaagctggcgatcgcccagcagcttgaaaaactcggggtcaacattatggaagcgggctttcccgcttcatcccccggggatttcaatgcagtaaaagaaatcgcaaggacgattaaaaactgttcggtaacagggcttgcccgctctgtcaaaggagatatcgactcggcgtgggaagcgctcaaagacggagctgaaccaaggcttcacatttttatcgccacttctgacatccacttaaaatataagctgaaaaaaacgcgcgaacaggttctggaacaggcggtcgcaatggtgaaatacgccaaagaacgcttcccgatcgtccagtggtctgccgaagatgcgtgccggactgatcttccgtttttagccgagattgtaagcgaagtgatcgccgcgggagcggatgtcgtcaatctgccggatacggtcggttatttagcgcctgccgagtacggaaatatcttccgctatattaaagaaaatgcccgcaatgccgacaaagtccagctttcagcccattgccacgatgacttgggcatggctgtcgccaactctttggctgcgattgaaaacggagcggatcaagtcgaatcggtcatcaacggcataggcgaaagagcggggaacgcctcgcttgaagaaatcgccgtcgccctccatatccgaaaagatttctaccaggcggaatcaacgattcagctgaatgagattaaacggacaagtgatttagtgagcaagctgaccggcatggccgtgccgcggaacaaagcggttgtcggcgataatgcctttgcccacgaatcaggcattcaccaggacggcttcttaaaagaaaaaacaacatatgaaattatttctccggaacttgtcggcgtgaaaacggatgcgcttgtgctcggaaagcattcagggcgccacgcatttaaagataagctgcaaaacctcggattccagcttggagaagaagaaatcaataaattcttcaacatttttaaagagcttaccggaaagaaaaaggaatttacggatgaagatctcatctcgctgatactcgaagagaaaacggcagaccgcaaaatcggctatgattttatttcactgcaggttcattacggcacctcccaggttccgacagcaacagtctcccttaaagatcaggaaacggatcaggtcatccaggaagcggcgaccggagcgggaagcgttgaagcggtgtacaacacgctgaagcgctgtatggataaagaagtccagctccttgattaccggattcaatccaaccgcaagggacaggatgcattcgcgcaagtatacgtcagggtgatgatcgatggaaaagaatcgggaggacgcggggttgcccaggatgttctcgaagcatctgccaaagcctacttgaatgctgtgaaccgctatctcgtattgaagacgaatacggaaggattgtcaaaacaggcggctgtaggatcataa

SEQ ID NO: 2846 - DNA, 1029 bp, Bacillus licheniformis
atggtaaaagtatattataacggtgatatcaaagaaaacgtattagcaggcaaaaaagtagcggtgatcggatacggctcacaaggccatgcgcacgcactgaacctgaaagaaagcggagtggacgtcattgtcggcgtcagaaaagggaaatcctttgcaaaagcagaggaagacggccatcaagttttcacggtaagagaagcggcagaacaggccgacatcgtcatggtgcttcttccggatgaacagcagcaaaaagtgtatgaagcggaaattaaagacggacttcaagctggcaattcacttgtattcgcccacggattcaacgttcatttccatcagatcgtgcctccggcggatgttgacgtattccttgtcgctcctaaaggaccgggacatcttgtcagaagaacgtttgaacaaggtgcgggggttccggcgctgtttgcgatctatcaggatgtgacaggggaagcgaaagacaaagcccttgcttatgctaaagcgatcggcggcgcaagagccggtgttcttgaaacaacatttaaagaagaaactgaaaccgatcttttcggagaacaggcggtgctgtgcggaggattgacttcccttgtcaaagccgggttcgaaacgctgacagaagcgggctatcagcctgaactcgcatacttcgagtgtctgcacgagctgaagctcatcgtcgacttgatgtatgaagaaggtttggcagggatgagatattcgatttccgacacagcgcagtggggagacttcgtatcaggtccgcgcgttgtcgatgagaaggtaaaagaatcaatgaaagaagtattgaaagacatccaaaacggtacattcgcaaaagagtggatcgtcgaaaaccaagtcaaccgtccgcgtttcaacgccatcaatgcaagcgaaaacgaacaccaaatcgaagtggtcggcagaaagcttcgcgaaatgatgccgtttgtcaagcagggcaagaaaaaggaagcggtggtagccggtgcgaaaaattaa

SEQ ID NO: 2847 - DNA, 519 bp, Bacillus licheniformis
ttgaaaagaatcatcacgctgacggttttgaaccaaagcggcgtcttaaacagaatcacagggttgtttacaaaacggcattacaacattgaaagcattacggtcggccacaccgaaaccgcgggaatttccagaatcacgtttgttgttcatgtggcagatgaaaaagaaacggaacagctgacaaaacaattaaacaagcagattgatgtactgaaagtcacggacattacgaatcaatcgatcgtccaaagagagctggcgttaatcagggtggtttcccctccgtcgagcaggacggaaataaacggcgtcatcgaaccgtttcgggcgtctgtcgtcgatgtcgcaaaagacagcgtcgtgattcaagtgacaggggaatcgagcaagatcgaagccctgatcgaactattgaaaccatacgggattaaagaggtagccagaacaggcaccacggcctttgcgaggggaactcagcaaaagccggcctctattaaaacaatatctattgtataa

SEQ ID NO: 2848 - DNA, 1725 bp, Bacillus licheniformis
atggggacgaatgtacagttggatgctgaaaatgcccaatgtacacaaacaatggcaggggcgtcaatgctgatcgaggctttaaaacaggaaaatgttgaagtgatctacgggtatccgggcggtgcggtcctgccgatttatgacaaactctacggatcgggaatgtttcatgtgctgacgcgccatgaacaaggcgccatccacgcagccgaaggatatgcaaggatttccgggaaaccgggtgtcgtcatcgctacatccggaccgggagcgaccaaccttgtaacgggtctggccgacgcgatgatcgattcattgcctctcgtcgtattcaccggtcaggttgcgacatcggttatcggatctgacgcattccaagaagcggacgtcatcggaattacgatgccgattacaaagcacagctaccaggtacgcaatgccgaagatttgccgagaattattaaagaagcattccatatcgcaacaacaggaagaccgggccccgttttaatcgatattcctaaagacatcgccgttgtagaaggagaattccgctatgaccacgacattcaccttccgggctatcagccgacgaaggaaccgaattatctgcagatcagaaagcttgtggaagcggtcagtgcagcgaaaaagccggttattttagcgggtgcgggcgtcttgcacgggaaagcgtcagaagaattaaaaaattatgtcgaacagcagcagattccggtggcacatacgctgttaggcttgggaggatttccggccgatcatccgcttttcctcgggatggccggaatgcacggaacgtatgcggccaacatggctctgtatgaaagcgatctgttaatcagcatcggtgccaggtttgatgaccgggtcacagggaacttgaagcattttgcaaaatatgcgaaagtcgctcacattgacatcgatccggctgaaatcggcaaaaacgttcatacgcacattccggttgtcggcgacagcaagcttgtactgacggagctgatcaagcaaaacggcaagccgagcgcttctgatgagtggaaaaagcagcttgcggcatggaaaaccgaatatccgctctggtatgaagaaaatgaaacagaaggattcaaaccgcagaagctgatcgaatatatccaccgctatacaaagggcgaagctattgtaacaacagacgtcggacagcaccaaatgtgggccgcgcaattttatcagttccaaaaagccgacagatgggtcacttccggcgggctcggcacaatgggcttcggacttccggcggcaatcggagcacagcttgcggataaggatgcgacggttgtatcgatactcggcgacggaggattccagatgacgctgcaggagctgtctgttattcacgatctgaaccttccgatcaaggtcgtggtcttaaacaaccgctgcctcggaatggtccggcaatggcaggaaatcttttacgatgagcgctattcgcactccaagttcacatcacagcctgatttcatcaagctgtctgaagcttacggcatcaaaggcgtccgaatcacatccgaagaagaagcggaagaaaagctggaagcggcgctaacgtcgaatgaaccgatggtcattgatgttcaagttgcacaagctgaaaaagtatttccaatggttgcgcctggaaaagggctgcacgaaatggtgggggtgaaaccttga

SEQ ID NO: 2849 - DNA, 915 bp, Bacillus licheniformis
atgggggaccagaaagaccagtggatcttcctaaacgacaaactcgttaaaaaagaagacgctaaaatatcagtctatgatcacggatttttatacggggacggcgtgtttgaagggatcagggtatacgacggcaacatcttcagaatgcaagagcacatggaccgcctctacgattctgcgagatcgatcatgctggagattccatatccacaggaagaactgacacagcacgtactcaaaacagtcgaaaaaaacgggctgaaagacgcttacatccgcttggtcgtttcaagaggagcaggtgacctcggactcgatccaaacaattgttcaaacccgagtgtcatcataattgtcgaaccattggcaatattcccgaaacatttatatgaaacggggattgacattgttacggttccgacaagaaggaacagacccgatgtgctgagccctaaagtaaaatcgctgaactacttaaacaatattcttgtccggatcgaggcgcatatggcgggtgtgacggaagcgctcatgctcaatgatcaaggctatgtcgccgaagggtctgcggataacgtatttatttataaaaacggaaagctcttgacgcctccgggctatatcggagcgcttgaaggaatcacccggaatgccatcatcgaaatagcgcgagagctcggctatgaagtgaaagaagagccgtttacccgccatgacgtatacacagccgaggaagtgtttttaaccggaacggctgcagaagtcatcgcggtcgtaaaagttgacggccgcaagatcggggacggcaaaccgggagtccacacaaaccggatgcttgaaaagttccgcgagcgcgtcgtccgtgaagggttaaaagtcagcctcaaagatcaaagcttaagtgtcagctga

SEQ ID NO: 2850 - DNA, 228 bp, Bacillus licheniformis
atgtaccgcacttttcctgcgcactctgttccccgcgtgcgccaatacccgggatacttcggctacccggttacttatgtctataatccttcagcacacgggccatatacctattatccgtacggcggggtgttcaccactccgacgctcggattcggcatcggctacccgggaatttccgttccggctgtacacgcctttaccggtggattcagagacaatgaataa

SEQ ID NO: 2851 - DNA, 1383 bp, Bacillus licheniformis
gtgcatacgctagaaaaaatggagcaaacaaatttccagacggcgagagattatgtgacacaagcatacgagacagtacagaagcgaaatttttacgaaagcgaatttcttcaagctgtaaaggaaatatttgattcccttgtccctgtattggcaaggcatccaaagtatatcgaacaccgcattcttgagaggatcgcagagccggaacggatgatcaccttcagggtgccgtgggtcgatgatgaaggcaatatccgggttaaccgagggttccgggttcaatttaacagtgcaatcggtccgtataaaggcggcatccgctttcacccttctgtgaacgcgagcattattaaatttttgggttttgagcagatttttaaaaattctttgaccggactgccgatcggaggcggaaaaggcggggctgattttgatccgaagggcaaatcggacagggagattatgagttttacgcagagcttcatgaatgaactgtacagacatatcggaccggacacggatatccctgccggcgatattggtgtcggagcaagggaagtcgggtttatgttcggacagtataaaaagattcggggccgctatgatgcaggcgtgttaacaggcaaaggccttgaatacgggggcagtttaacgaggaaagaagcgacagggtacggtctggtttatttcgtggaagaaatgctgaaggatcaggggatgcgctttgaaaacagcaccgttgtcgtctccggttcagggaatgtggcgctgtacgcgatggaaaaagccgctcaattcggtgcgaaggtggtggcctgcagcgattctgacggctatgtctatgacgaaaaaggcatctgtcttgagacggtgaagcggctcaaagaagacgggaacggaaggattcgcgagtatgtcagcgagcatccggaagcacactatttcgagggatgtaccggcatttggtctattccatgcgatatcgcgcttccgtgcgcgacccagaacgaaattgacgaagaggcggccgaagtgctcatttcaaatggggtcaaagctgtcggagaaggagcaaatatgccgtctgaagagggcgccgtcaaacgctttttggatgcgggagttctattcggaccggctaaggctgcaaatgccggcggtgtagccgtttcagcgctcgaaatggcgcagaacagcgcacggcttcactggacggcggaagaaacggatgcgaagctcagggcgatcatggctgatattcacaagagaagcgttgaagcggcttcagaatacggacggcccggaaatctgctcgacggctgcaatatagccggatttatcaaagtggcggatgcgatgatcgctcagggagtcgtttaa

SEQ ID NO: 2852 - DNA, 255 bp, Bacillus licheniformis
atggacgacaaaaaagaaatgtcgaacgttgaaacgcaaagaaactttttaacagctgaagaatttcctgaaggtgcgtatggagctgcacagggcaaagacgagcccgttgagaacaaaagcacgccatggaaggaaggccagcaatactacagcaatttcgcatacgaattccgcaatcttcatcaaggaacgccgcgtcaatatcccggagcgcatccaacccatgacgaagaggatcaaaacgaggaatga

SEQ ID NO: 2853 - DNA, 492 bp, Bacillus licheniformis
atgacaaaacaacagcaaaatcagcagcaaaagcagaagcaacaaaaacaaaagcatgagcagctgctcggggccaacatcacagataccgaacttgctcaggaattcggaaacatccagcagcagcttgcccagctggagcaaactgttaatcaaatggggtcacagcagcagggccaaagcggccagcagagctctcaattgagccagggaatcaatcagctgaaacagcaaattcagcagttcagctcccaatctcagcagcaaatgcagcagacggatcagcaaattcagcaaagcattcagcaggctgtccagcagctgaatcaggctcttcaagggatccagacaaaccaggccatgaaccaaatgagccaggcgcttcagcaggcgcagcagtcatttaaccagcaagggcaacaaggacaacagggtcagcaaaatcaacaaaaccagcagcaaaatcaaaattttcaacagcctctacaataa

SEQ ID NO: 2854 - DNA, 222 bp, Bacillus licheniformis
atggctcaacaatctgtgaaagccaccgtgttcaaggcaaatgccccaagtgaaacgaccaaacagatttacgaagatcaattcgactataaaggaaatgacatcatcgagccgccttatagtttgaaggaattgaaaagcaccgcagagtattcaacgatcctgcagcagtgcatccatgcctataagaccaaatattctcggtttttggttttgatgtag

SEQ ID NO: 2855 - DNA, 1296 bp, Bacillus licheniformis
atgacggtaaaagaagtcaatccgcattttgaagattttctctttgactggaaccaaaaatttcagctgctcgttggcggttacggatcatccaaaagctatcacattgctctcaagctcattttgaagcttcttgaagaaaaacggacagtcttagtcattcgtgaagtgtacgacactcatcgggattctacattctctcattttgaagggatcatcaatgacttagagattgatcatattgtgaggtgtatgacatctccgatgcaagtcaggttcccaaatggcagccggatcatcttcaaggggctggacaaaccggccaaactgaaatcgatcaacaacatctcaataatatggattgaggaatgttcagaggtcaaatatgaaggctttaaagagcttctcggccgtctgcggcatcctacactgccgcttcatatgattttttccacgaacccggtcggggaagacaactggacatacaagcatttctttaaagacgatctgaacaatcgatttgtcctagatgataaggagctgtacgaaaagcgaacgatcgtcttaaatgacacatactatcatcattccacggcggaagataatttgtttctgccagaaagctatgtaaggcagctggatgaactgaaagaatacgatccagacctttaccgcatcgccaggaaaggtcattttggcgtgaatggggttcgggtttttcctcagcttgaagagtggccacacgatgaagtaatgcaggccgtctcgaacattgactgccccatcaagcgggtaggaatggactttggttttgaagaatcctataacgccgttgtccggcttgcggtggatcataagaaaaagtacctctatatctattgggagtattacaaaagaggaatgacggatgacaggacagcagaggagctccaagaatttaagaacacccaagagcttatcaaagctgattcagcggagcctaaaacgattcagtatttccggcagcagggtttcaatatggtgggagctcataagtaccagggttcgcgcctgcagtatacgaaaaagatcaagcggtttaaaaagatcatttgttccggccaatgcaggaacaccatttttgaactcaagccgctgacctataaaaaggacaagctgggtagcatcattgaagatgaattcaagatcgatccccacactctttcggccatctggtatgccctcgatgattacgaggtcaccgatctgaaggagaaaccgaaaatccggcagcggccaaatagagagaggaggtaa

SEQ ID NO: 2856 - DNA, 411 bp, Bacillus licheniformis
atgcagcggatcagtcggatagaaaacggcctatctgaaaaacagcgccgcgtgctgcaacaaatgcgcaaggtcaaggacatcgttcaaaccccggataagaatggactagtcaaacctgttccggttatgaatgagcgtcttgttgtgactgaaattgaagaaaccgagatgcgggctattgatgatattttgaatatcgaggaggcgctcactcgtgtaacggataaacggttgaaagccattcgccagaaatacgatatgatccgcttaatggatgagcaagaattgaagctccgcggcatctatctttcaaacgagacgaaacaggcagagcttgaacgccttaccgcccgccctgtggacaattctgtgaatatcacaattactcgtaagggtgacggcaaatga

SEQ ID NO: 2857 - DNA, 387 bp, Bacillus licheniformis
atggccagaccgcgtgatccaagacgtgacgaagcgttccgtttatggaaagaaagcagcggaaccaagaaattaaaagacatcgcggatgaattgggcgtctcaagcagtaccgtccgcaagtggaaagcaatagataaatgggaagataaaatcaaagggagcgctcctaaatcgaatgggagcgctccttttcgtcccagcgctccaataggcaataaaaacgccaaaggaaacaagggcgggaatgcaccgcctggaaacgaaaatgcgaaagggaatgccgcaccaaaaggaaataaaaattccgcccgtaccggcgaatatgaaacgatcatgtgggattttttaaacgaggatgagagacagctgttcggagaaatctaa

SEQ ID NO: 2858 - DNA, 249 bp, Bacillus licheniformis
atggcaacagaaaatacaaacatacgttcctgcgatgataaagaaaaagagaaactgcttctcctgcatagcgctgaattgcttgaaaacatcagtcaatctaaagagaaatatcgaaaaattattcaggcaggtatcacccaatgggtcaaagattttcaaagcggtcatattaaggtgaacactgttgaagatttaaaaaagctcatcgagctcgatatacagcttcagaaagatgaagaaatttaa

SEQ ID NO: 2859 - DNA, 774 bp, Bacillus licheniformis
atgaccgttgtgccggagaaattgtactgtagagcttgtaagagaaaaacaaaccatcagatagttaaaaatgagcatgacaatgaactaaagtattcaataagtaatttagattatgatgaagaaattgattttcaatttaatgaggattatgcaatagttcaatgtagaggttgtgacgctattgcttttctaaaaatatacggcgatgaagatatgtttcatatagtcggttcaaattatcatactgatagagaatactttgtcgaatacactgtctttccagaagagccaaaaaaggaggatccggtagaacagttattacaattcaaagaaaaatatgaattcgatcacttacctaacttaataaatggaattagaaatgaaacaattaatgcttatcgccaacgtatgaatttattatgcaatacgggaattagaatgcttattgaatcaatatgtatggtaaatggaattgataaaagaccgaagattaagaagggagaaccagtgttagatggtcataaaaacccggtaatggtcaatttaaatttggttcaaaagataaatgaacttaaagaaaagaatataattgatgaggaacaacgaaggatactcttggaaattaaagatgtaggaaatcagacagtacatgaaatatttcgaccgaaacggagagatttattgttatatctagaaacattagatttaatactatttaatatttatgaattacctcatattaaaataacaaattcaccaagccctagttag

SEQ ID NO: 2860 - DNA, 276 bp, Bacillus licheniformis
atgggagacatcacgaaaaggattgaagggaaagaatctaatttcaatacgatattagtgaaaaatagccttgtcccgcctactctcgggagtggttcggtatttgtccgttatgatgagccctactatatctctgaacgggatatcattttaatgcaatctttcccactcgattatgattttatggacgcatctgttcaatatgtttgtgggatgagtgttcctccggtcatgatgaaaaaaatatcggaacagatttacaatcagtggttttaa

SEQ ID NO: 2861 - DNA, 717 bp, Bacillus licheniformis
atggccttaaagtattcagtacattctcttggggcgggggttcctctatggggctataagctcgccggttacgatcttttggggaactgtgagatcgatccgcaaatgatgaagatttacaggaagaatcataatccgatatatccttttcttatggacatcagagactttaacaaaatggaaaatctgcctgatgaattgttcgatttagatatttttgatggttccccgccctgcagcgtgttttctattgcgggggatcgggaaaaggcttggggaaaagaaaaagcctttcgtaaaggacaggcaaaacagtcacttgatgatctattttttcattaccttgatgctgttgaaaggctgcggccaaaaatctttgtggccgagaatgtcaaaggaatggtcagcggaaatgcaaaaggttatgtgaagctggtgattgaacggaccaaggaaattggatatgatgttcaactgttcttgttgaatgctgccacaatgggagccccgcaacgtagagagcgggtcttttttatttgccgaaggaaggacttgaatttactaccgcttaaattgtccttcaatgagccaccgattgtatataaagaattcagaagcggccatggtgcaaggcttaaagaaacatcaaagctttataaaagatgggtgaagcgacggccgtcggataataatgggagacatcacgaaaaggattga

SEQ ID NO: 2862 - DNA, 357 bp, Bacillus licheniformis
atggcttcctataatctttgcgtcctcatggaagaaaatccaaagactctcctggtttcagttgtaaattttgatgaggctgaggaaaaagcgctcaacctggctttaaataagatcagcggtgactgggatgattacaaacttgaacaggttttggaagacctgcagcacaataattttgatctatcccttacaggcttctcagaaagtgaaatagatgaaatcttgggagagctggctgagcatgaaggcaacgaaggaaaaatcaatgacagccaggaattagacctggatgattatgaagatgatcatttccaacatacctgccccaaatgcggattttcatttaatgaatag

SEQ ID NO: 2863 - DNA, 1838 bp, Bacillus licheniformis
atggatgctttacgtggtggacaagacacagcgatgggcgtcatgttggataagctggataagagatcaaagcttgaaaaagaggccagcaaaatagaacctatgagtcatactgatacgttgaagaaaaaacttgaaaagttgtatgatgatccggatgagtttctcaaagttgctagagagattggatatgataatcttacatctgaacagatgaattatgttactgccattgaagaagcttatgagttcagagcagatccaattaaaggaactctggaagatggaaaacatgtcttagaaagtatgaaaggctttgtggttggaggatatgaatttgcaaaagatacgatccaaggaacgattgaaacaggtaaagctcttattggacaagcagacgactttattaaaaacccaaaagcaactgtaaattcagtacttgagtatgattacaaagccgctttcgaaagtatgttgcaatcaatcgcagattcttgggatgaaaagatggtacatggggattcatattctcgcggacactatattgcttatgcgattgggacgatatgggggttggcagaggccggtcctactgtcgtatcaggctcaaaaagtcttggcaaagctggcaaggctgcagcccaaacagcaaagaaaaatattaactctgttaaacagcatttcaatccgcctaaaaaccgctatactcctgcattagaagggatgctccaaagagcgggagaggcccctaatgtgaaaaatacgcctttgctgaaggagctgcttgaggataaaaagaaaagtgtgctttttaaagctaatagtgggaaaaaacctggaaaagcagatagtcatgcagtacatacagtaaaatacggagaccagtataccagattaaatcgtaaaaaagttttgaagccaaacgttgtgtatgaaacaaaacagggctatacgtttaaaacggatcaaaagggtcgaattaatagtgtaaatgccgatttgcaacttggaaaagcaaaaagaaatctgtatgctcaatctaacgttggtaaaccagatagactgccagatgatgacggaggacatttaattgcttctcaatttaaaggttcaggggacatagataatcttgtgcctatgaattctcaggttaatagaagaggcggaaagtggtatgagatggaacaagaatggaggaacgctttaaaagaagttcccccaaaaaaagttaaggtcaagatcagccctatatataaaaatgactctttaagaccggattattttaaagtcgaatataaaattgggaatgaaaaaatcaaaaaaataagaattaaaaatgagaatggaggttaatatttatggaaactgaaaagatggaaaaattataccaagagatagcagaggggattaacgaaatcatccctactgaatgggaaaaggtctatctctatgctgaaatattagatgattcatcagaggttttcttttattttaatgtaccgcaaaataaggattatatttattctcataacatacctgaacatttcaatgttagtgaagatatctatgatgagttattgtttgagcttcatgatttatttgaggatctgcaaaatgagtttaaacaaaataattccgaagtttggacaaatctcactttaacactcgagagaaatggaaagttttcaatggattataattatgatgatgtaattaaatcagatttaaatggttctcaacgacaaattatctgggaatataagaacttaggcatttttcctaatgatgaagataatattagattcttggaagagtatttaaattcaaataataattaa

SEQ ID NO: 2864 - DNA, 630 bp, Bacillus licheniformis
atgaagactcttgatgtccatgcgttgcaccatgcaattgatcaaacgctggaacaattaaaacagcagtcagacgaattatccaaagtcaaaaaagccgtagagggcattacatcacttgatgatgctttaaaaggaaaaggcggcgacgcgatccgcgccttttacgaggaatgccacaccccttttctacagttctatgatactttcatagaggaatacagttccacgctgaagaaaatgaaaagcgcgctgaattcgctggaaccaaaccacaacgggtttatttcgcaaagctttcttgagcacgagctggaacaaggattgaatgcggccgaccgcactacgaagcgtttggtttctaaaacaaatgccacgatcgcaaaagtcagccacattgtcgatttgcctgatttgaatgacagcggttttcacgaacagaatcagaaagctttaaaggaaatcaatcagacaattgaaaagctgcacgccttcgaccgcgaacagacaagcgctcttaaaaccgctgaaaacgacctggaaacgatgcagagatacataagccggcttgaaaaaatgtacacaggccctaaaattgaaattaccggttaccaaaaaggctcgatttaa

SEQ ID NO: 2865 - DNA, 1191 bp, Bacillus licheniformis
atgaaaggtatgcagaaaaaggaaatggatacttatttttttgaatatttcaaatcaattatacgaaaggaatggtgggaattggttgttaaaatacgatccgaaaaggtcgggaatatgttgaatcaatggtatgcaacaattaagttacagcaagttcataaagcaactcaaatgaagaaagaaattcagaaggctattgataatatggagaagaatcaagatgttttgctttatttcaatatgatagattctcggtataaattattgatcgaaaaatataacgaatccggaagcatcttaaaaagtcttaagtatagagctgaagaaaagaagacggacgacatgcttcagtattacttttactttttcagcgggctgtatcagttttacataaagaactttacgaaagccattaatttttatcgcattgctgaaaattggataaataaaataccagacgaagcagaacgagcagaattcaattatcaaattgctattgcatattatgaaattcaccaaaattttttctcgttaacacacgcagaaaaagcgctcgaaagctttttagcccttggaaattatgaaaatagggcagcaaccactcaaatgataattgcggcaaacagactggatctacatcaatacgaattaactgagtccgtatataaaaaagcaataaaaatggctgctgatacccgacaaaattacgttgagggactcggacatcacaatctcggtcttgcttacgaacgacaagaaaaactcgatttagcgcgtgaatccttcgaaatagctctcgacatttttgaaaatctacattccaaaatcgcaatcatcagaacttcttatatgctggcaagggttttattcaagaaaggtttattcgaagaagggacacattggtatcaaaaagccctcaatctcgcaaaagaaataaacgaaaaaacgtacgaagccaagttattagtcatacactcaatatataaagagttggataagaccttattagataaaggattgaatatgctaagagacaaaaagctttggtcagacgtagcagatttagctatcattgcagcaagacacttcaaaaagaaggaatatcatgaattagcggcgaaatacttcgatgaaggagtagtcgctcgcgacaaaattcaaacatggacggaggaacttgtctcatga

SEQ ID NO: 2866 - DNA, 132 bp, Bacillus licheniformis
atgaaaaaattacttttaggtgcagtaataacaggtgtatttttaactggtattttaaactttactactcaaggaaaagctgaattcggtactggagactttaaagttgctgaaaatgcgttttttggttaa

SEQ ID NO: 2867 - DNA, 249 bp, Bacillus licheniformis
atgaataaccttttcctgcagctcagggatcagcactctttaaatgaattgaaagtttgtcagatggacagggcgcttaaacaaagccttgatggtgatgaattaaagatcataaaggccaagtatctctctccccaaaaaataaaggacattgagatttatatggagatggggttgaaaaaggacaaatgctatcaggtcaaacggcgggccatttacaatcttgcgacagctctcgggataatctga

SEQ ID NO: 2868 - DNA, 150 bp, Bacillus licheniformis
ttgttgacgaaaaagaaaccgattttcacaatcgacgaagatttttccgatttgactacggcgcagaagcctccggtaaatacgccgaaaaagcgagtgagggatcgaattaccatcgaaatgaaattatttgagagaaacaacaattaa

SEQ ID NO: 2869 - DNA, 522 bp, Bacillus licheniformis
atgaaggttctgattgtcagcgacagccacggccttgaagacgaactggaaatgatcgctgagcggcacgggaaggaaacagatctcatcatccattgcggggattctgaattggacccttcccatcccgcgctttcctcttacttaacggtaaaaggaaactgcgatttttacggggagttcaaagacgaaatcgtcgttcccgccggatcgagaaagctttttttcacacacgggcatttatacggcattaaacagtcgcttttaaatgtgtactaccgggctgaagagctcggcgccgatatcatctgtttcggccattcccacatcgcgggaagcgagctgatggacggaaaactgctgatcaaccccggcagcatccgccttccgcgggtgcggaaagaaaaaacttatgctatactaaacattgacaaagacaatgcaacggttcgctattatgacttggacggccgggaagtcgaaagcctgacgaaccatgtacaattgccagcacattcatga

SEQ ID NO: 2870 - DNA, 591 bp, Bacillus licheniformis
atgaaggaagtcatcattgccacgaaaaacgaagggaaagtcagggaattcaaagcgatgcttgaaccgaggggctacgatgtcaaatctttactggacatcggctatacacccgaaatcgaagaaaccgggcagacttttgaagaaaacgctgtgattaaagcggaaacaatttcgaaagaaaccggaaaaatcgtgattgccgacgactccggcctgtctgtcgactatctcggcggcagccccggcgtatactcggcccgctatgcaggagaagagaaaaacgatctcgccaatctgaaaaagctattgaaagagctcgaaggggtggaaaaagaagaccgttccgcgaggttcagatgcgcgctcgcaatatgcattcccggacaggaaacgaaaacggtcgaaggttctgtggaagggtacattaccgaagagccgcgcggcacaaacggcttcggctacgacccggtttttctcgtcaaagacaaagatcaaacgatggccgagctctcaagcggcgaaaagaacaaaatcagccacagagcggaagcgctgaaaaagctgtccgctttattggatcaagcgtaa

SEQ ID NO: 2871 - DNA, 1389 bp, Bacillus licheniformis
atgagatacgatggaagaaaaaacaatgaactgcgccctgtcacaatggacctcgactttattacgcatccggaaggatcggtcctgattacagtcggcgggacaaaggtgatatgcaacgcgtctgtggaagaccgcgtaccgccctttttgagaggagaagggaagggctggatcaccgcggaatacagcatgctgccgcgggccacgaaccaaaggacgatcagggaatcgtcaaaagggaaaatctccgggcggacgatggaaatccaacggctgatcggacgagctcttcgggcggttgttgatttggaaaagctcggtgagcggacgatctggatcgactgcgacgtcattcaggcggacggaggtacgagaactgcgtcgattaccggagcattcaccgccatggcgcttgccgtcggaagactcgtcgaaaaaggcgcgctgaaggagatgccgatcaccgactttttggctgccacttcagtgggcatcgataaggaaaaaggattgatccttgatttgaactaccaggaagattctgcagctgaggttgatatgaacgtcgtcatgacaggcgaaggccgctttgtcgaacttcagggaacaggagaggaagcgacattctcaagaagtgaactgaaaatgagatacgatggaagaaaaaacaatgaactgcgccctgtcacaatggacctcgactttattacgcatccggaaggatcggtcctgattacagtcggcgggacaaaggtgatatgcaacgcgtctgtggaagaccgcgtaccgccctttttgagaggagaagggaagggctggatcaccgcggaatacagcatgctgccgcgggccacgaaccaaaggacgatcagggaatcgtcaaaagggaaaatctccgggcggacgatggaaatccaacggctgatcggacgagctcttcgggcggttgttgatttggaaaagctcggtgagcggacgatctggatcgactgcgacgtcattcaggcggacggaggtacgagaactgcgtcgattaccggagcattcaccgccatggcgcttgccgtcggaagactcgtcgaaaaaggcgcgctgaaggagatgccgatcaccgactttttggctgccacttcagtgggcatcgataaggaaaaaggattgatccttgatttgaactaccaggaagattctgcagctgaggttgatatgaacgtcgtcatgacaggcgaaggccgctttgtcgaacttcagggaacaggagaggaagcgacattctcaagaagtgaactggacgggcttttagagctggctgaaaaagggatcgccgaactcctcgaaaagcagaaagaagtgctcggcgacgttgcattatctattcaacaataa

SEQ ID NO: 2872 - DNA, 1110 bp, Bacillus licheniformis
atgctgaaaaaaggaatgaaaggaatcgcggttacggttacggcctccgcgctgcttctttccgggtgcggaatatttcagtcagatcaagcctcagaggagatagatccgccgcaggacatcacatatgtaaaagaggagaaggagcaagacaaaacagacaaaaccaaagataaaacagaagacaaaggcagcaaaacgacaagcgacgataaagccgctcaaacgggcgatacggtcatgagagagctttatctcattgataagaacggctatgtgacagcgcagacgctgccgctgccaaagcaggaagggacggctaaacaagcgcttgaatacctcgttgaaggcggccctgtttcaaacatcctgccaaacggattcagagccgtgctgccggcggatacaacggtcaatgttgatattaaagaagacggaacagcgatcgctgatttctcaaatgaatttaaaaactataaagctgaagatgagcaaaaaatcgtacaggcgattacatggacgttaacgcagtttaactcgattgataaagtgaagctccgcatgaacggccatgatttgaaagaaatgcctgttaacggcacgccgatttcagaagaactcagccgcgaggacggcattaacctcgacacggcgggtgtgacagatataacggcgacacagccggtcaccgtctattatttggctgaatcagataaaggcacatattacgttccggtgacaaagcggacgtctgcaaaagaaaaagatcaggtgacggcggcgattaaagagctgactgaaggaccggacaataaaagcggcctgctctccgatttccagggcgacgtcaagcttgaaaacaagccgaagattgaagacggccatgtaaccctcgactttaacgaagcgatctacggaagtgccgacggccagaaaaaagtgatatcggatgaagtgttaaacagtatcgtgttgacattaaccgaactgcctgatgtgaaaagtgtgtcggttaccgtgaacggaaaatccgagctcgtgaatgaaaaaggagaaaagctttccaagccggtttcaagaccgagcaaggtgaacacaggtagtttttaa

SEQ ID NO: 2873 - DNA, 816 bp, Bacillus licheniformis
ttggatcaaccgataggagtcattgattcgggagtcggcggtttaaccgttgcaaaagaaatcatgaggcagctgccgaaagaaaaaattatatatcttggagacacgaaaaggtgtccatacggaccgagggacagaaaagaagtcctgtcatatacatgggaaatgacaaattatctgttatcccgccaccatattaaaatgctcgtgatcgcctgcaatacagcaacggccatcgcgctagaggaaatcagcagggaagttgcgatacccgtcatcggcgtggtgcagcccggagccagaaccgcgattaaagtgacggaaaaccagcgaatcggcgtaatcggaacggaaaacacgatcaaaagcggcgcatacgaagaagcgcttctttcgctgaacggagatttaacggtggaaaatctggcttgcccaatgtttgtcccgtttgtggaaagcggcaaatttttggatgagacggctgatgaaatcgtcaggacgtcactgcacccgctcagagattcatcaatcgatacgctgattctcggatgtacgcattatccgattttaaaagagccgattcagcgctatatgggagagcgcgtcaacatcatttcctccggagatgaaacggccagggaagtcagcacgatcttgtcatacaacggtttattaagcaaaacggcggaaccgccggaacacttgtttttaacaactggggagcgtgcccgcttcacaaaaattgcaaacgattggtttggatacgaagtgaaaaatgtggaaagcatttctcttcaggagaccgctgtaaaataa

SEQ ID NO: 2874 - DNA, 444 bp, Bacillus licheniformis
atgaattcgaatgcttctttgaatcacatagcggacattgaaaaatcactccgccatattgcgggcatcattaaacaaaaaggaagagaaattctcacccaatatacgattacccctccccagtttgtcggtcttcaatggctgtatgaatacggggatatgacgatcggcgagttatcacaaaagatgtacctggcgtgcagcaccacaacggatttaattgaccgaatggagaaaaacaacctcgttgaacgggttaaagatccgtccgacaggcgcgtagtccgcattcatcttctatcggaaggagagcggatcatccaggaggtcattcaaaaaaggcaggactatttagaagacatgttagaggcgttttccgaggaagaaacagccgcgtttgaaaaattattaattaaacttcagcaggaaatgaacagaaaatga

SEQ ID NO: 2875 - DNA, 225 bp, Bacillus licheniformis
ttgaaggagaaagagtttcaatcaaagccgctgctaacaaaaagagaaagagaagtgttcgaattgctcgttcaagacaagacaacaaaggaaatcgcaagcgagctctttataagtgaaaagactgtacgtaatcacatttccaatgcaatgcaaaaattgggagtgaaaggccgttcgcaagctgttgttgaacttcttcgaatgggtgagctagagctctaa

SEQ ID NO: 2876 - DNA, 699 bp, Bacillus licheniformis
atgaaaaaagcgataatcatcggcgcgagttccggaattggcaatgcgcttgccaagcagctgtcagccggaggagtggaggtcggtcttgctgcaagacggtatgagctgctagccaaattgcgcgacgacctccctggaccttcatacattaaaaagatcgatacagccgacagcgaacactcgcctatactgttgaaagaactgcttgatgagatgaatggggcagacgcagtcttcatctgttcaggtgttggatatttggaaagcgaaatggattggagcaaagaaaaggaaacgatcgatgtcaatgtgacgggatttgtgtcctgctcgaacgtgttgatggagcattttatcaaaaacgggagagggcatttagtcggcatttcatccatcgccgcgctgagaggaaacggaggggccgtcacctacgccgcttcaaaagcattcgtttcaaattatttaaaaggacttcgtcaaaaagtgaaaaaactcggttgcgatgaaattgcggtcaccgaaattcagcccggcttcgtggacacggctcttgcaaaaggtgatcatctgttttggacggcttcgcccgaaaaagcggctgcacaaatcatcagcgctgtgcagaagaagaagacgcacgcatatattacgaagagatggcggctgatctcctggattttaaaatgtcttccttag

SEQ ID NO: 2877 - DNA, 471 bp, Bacillus licheniformis
ttgaaattgccgggatatatcgaagaaccgtttgacacatggtgtcagtcattttctttttttgatgaagtttccgtccgtttttcagaaacggacatgttcggtcatatgaacaatgtcacaccgtttgtctacttcgaagaagcgaggatttcctatttcaagcacctgggcgtcatggaccgcctttcagacgggaagagcgcggccattcccgtcgtggcgagccagcaatgcgactattttcagcaggtcatgcttcatgaacgtttaaaaatcggcgtcaaaacagcatctgtcggcaacgcctcgctcaccctccattacgcagcgaaaaatggggaaggcggcctttgctttacaggactggcggttatggtgcaaattgcgaaagatacgggtaaacccgtgaaatggacagacgaacaaaaagcaaaactgcttggcaataactcatttcctgagaaataa

SEQ ID NO: 2878 - DNA, 765 bp, Bacillus licheniformis
atgagtgaaaataagacaatcaagtttatcatcactcgtcaggatacatcggattctaatccttaccaggaagagtttgaaattccataccgtccgaatatgaacgtgatttccgctttgatggaaatcagaaggaacccggtgaatgcaaagggagaaaaaacgtcgccgattgcttgggatatgaactgtctcgaggaagtgtgcggcgcttgctccatggtgatcaacggcaagccgagacagtcctgtacagcgctgatcgaccagcttgagcagccgatccgccttgaaccgatgaaaacattcccggttgtccgcgaccttcaagtggatcggagccgcatgtttgattcgttaaagaaagtcaaagcatgggtgccgatcgacggcacatatgatctcggaccgggaccgagaatgcctgaaagaagacgtcagtgggcttatgagctgtcaaaatgcatgacttgcggcgtgtgtcttgaagcttgtccgaacgtgaacgataaaacaaactttatgggacctgcaccgctctcgcaagttcgcttattcaacacccatccgacgggagcgatgaacaaatctgaacggcttgaagcgattatgggagacggcggactggccgaatgcggcaactcgcaaaactgcgtgcagtcgtgtccgaaaggcatcccgctcacaacctcaatcgctgcattaaacagggatacgaccgttcaggcgtttaaaaacttcttcggaagcgacaacacggaataa

SEQ ID NO: 2879 - DNA, 1470 bp, Bacillus licheniformis
atgggcgtcatgtttaacagaacgcctgaagggctgcttgacttccggcgcttcggaggaacccagcatcacagaacggcatatgcgggggcgacgaccggacagcagctcttgtacgcgctggatgagcaggttcgccgcttcgaagttgaagggctcgtttcgaaatatgaaggctgggagtttctcggagccgttcttgatgatgacaatacgtgcaggggcatcgtcgcccaaaacttaacgacgatggaaatcgagtcgttccgttcggacgcagtcatcatggcgaccggggggccgggcatcatcttcggaaaatcgacgaactcgatgatcaataccggatcagccgcttcgatcgtttaccagcagggtgcttactatgcgaacggagagttcatccagatccatccgaccgccattcctggagacgacaagctgcggctgatgagcgaatcggcgcgcggtgaaggcggacgagtctggacgtataaagacggcaagccttggtatttcctcgaagagaaatatccggcatatggaaaccttgtgccgcgtgatattgcgacgcgtgaaatatttgatgtgtgcgtcagacaaaagctcggcatcaacggcgaaaacatggtttatctcgatctttcccacaaagatccgaaggaattggacatcaagctgggcggaatcattgaaatctatgaaaaattcatgggtgacgatccgcgcaagctgccgatgaaaatcttccctgcggttcactactcaatgggcggactttgggtcgactacgatcagatgaccaacattcctggactgtttgccgcgggagaatgcgactattcgatgcacggcggaaaccgcctgggagcgaactcgctcttgtcagccatttacggcggcatggtggcaggtccgaaagccgttgaatacattcaaggtctcgaaacatccgcagaagatctgtcttcttccgttttcgatgcatacgtcaaaaaggaagaagaaaagtgggctgacataatgaaaatggacggcaatgaaaatgcttatgtccttcataaagagctcggcgaatggatgacagacaacgtgacggtcgtgcgctacaatgacaagctgctgaaaacggatgaaaaaatccaagagcttgccgagcgctaccgaaacatcaatatcaacgatacggcaaaatggagcaaccagggcgccgtattcacgcgccagctgcacaacatgctgcaattggcacgggtgatcacgctcggtgcatacaaccggaatgagagccgcggcgcccattataaaccggatttccctgaacgtaatgacgaggaatggctgaaaacaacaatggcgaaacatgcaggcgattttgaagccccgaaattccattatgaggatgtcgatgtttcattaatcgcaccgcgtaaacgggattactcgaagaaaaaggtggcgaaatcatga

SEQ ID NO: 2880 - DNA, 174 bp, Bacillus licheniformis
atgagcaattcaagcatcatcgttgtcggcggaggactagcgggtctgatggcgaccattaaagctgcggaagcaggaacaaatgtaaaactattttcgatcgttcccgttaagcgctcacattccgtatgtgcgcaggggcggaatcaacggagcggtcaatacaaaaggtga

SEQ ID NO: 2881 - DNA, 609 bp, Bacillus licheniformis
atggccgggaacagagagtttgtttatcgaagactgcattctttgcttggcgtcataccggtgggcatatttttaatccagcatttggttgtcaaccattttgcggcaagcggagaagaggcgtttaataacgccgctcactttatggaaaacctgccgttcaggtacgctttggaaatcttcgtgattttccttccgctgatttatcatgctgtttatggagtatacatagcttttacagcgaaaaacaatgcgaacagattcggcttttttagaaactggatgttcgttctgcagcggattacaggaatcattaccttgatttttgtcagctggcacgtgtgggaaacacggattgccgcccaaatgggggcagaggtgaactttgacatgatggctgatattttgagctccccgatcatgctcggcttttacattgtaggtgtcctctcaacaatcttccacttttcaaacggtttatggtcgtttgctgtcacttggggaatcactgtttctcctcgctcacagcgaatcgccacgtttgtgacaatgggagtctttgttgtgctgtcctatgtagggctgagagcgattttggcatttgtgtaa

SEQ ID NO: 2882 - DNA, 444 bp, Bacillus licheniformis
atgaataaatatgaagcaaacttagcgcaattaaaagagctggaagtctccgcatatggctatgagttgatcagggaagtgctgcttcccgatatgctgggacaagactacgcagatatgatgtactgggcgggaaaaaagctcgcccgcaagttcccgcttgaatcccgggaggatcttcccgctttctttcaggatgcaggctggggaacgcttgcgatcgtccattcaaaaaaacaggagcttgagtttgaactcgaaggcccgctggtttcaaaccgcctcaagtatcaaaaggagccctgctttcagcttgaagccgggtttatcgccgagcaaatccagctgatgaacgaacaaattgccgaatcttatgaacaggtgaaaaaaagagccggaaaagtggttttaacggtgaaatgggatttgaaagacccggcataa

SEQ ID NO: 2883 - DNA, 1230 bp, Bacillus licheniformis
atgggtctcatcgtccaaaaatttggcggaacttccgtagggtcagtggaaaaaatattgaatgtcgcataccgcgtcatcgaagaaaaacagcgcggtcatgatgttgtcgtcgtcgtttcggcgatgggcaaatcgacggactccctcgtcgcgcttgccaaggaaatcaccgagcagccgagcagcagggaaatggacatgctgctgacaacaggagagcaggtgacgatttcgctgttgacaatggctttgcagaacaaggggtatgatgcggtttcctatacaggctggcaggccggcatcgaaaccgaaaatattcacggcaacgcaagaattacgaacattgatacagccaagctgaaagagcgcctgaatgaagggaaaatcgccgttgtcgccggattccagggcgtcacagcggaaggcgaaatcacaacgctcggcagaggcggatcagatacgacagccgttgccctcgcagcagccctgaaagctgataaatgcgacatttacaccgatgtgccgggggttttcacgacggatccccgctatgtgaaaacagcgcggaagctggccggaatctcctacgatgaaatgctggagcttgccaatcttggagcaggcgtccttcatccgagagctgttgaatttgcgaaaaactaccaggtgcctttggaagtccgttcaagcaccgaaaaagaagccggcacattaatcgaggaggaatcatcaatggaacagaatttaatcgtaagaggcattgcatttgaagatcagatcacacgcgtgaccgtatgcggcctggcgagcggcctgacgacgctgtcaacgatttttacaacgctcgccaaacagaacatcaacgttgacatcatcattcaatcggtgacaggcacaagcaaaacgtcgatttctttctcagtgaaaacggaagacttaaaacggacggttgaagttctcgaagaatacaaagacgcgctcgactatgaacagattgaaacggaaaacaggcttgccaaagtgtcgatcgtcggttctggcatgatctccaacccgggagtagcagcggaaatgttcgctgtgctggcggaaaaaaacatccaggtcaaaatggtcagcacatccgaaatcaaagtttcgactgtcgtcaacgaaggcgatatggtgaaagccgttgaagcgctgcatgatgcttttgaactgtcgaagcagacagcagtcatttaa

SEQ ID NO: 2884 - DNA, 1773 bp, Bacillus licheniformis
atgaacaaaaaaatcaaagaaaagctggcccttcttccggatcagcctggctgctacttgatgaaagacaggcaggataccgtcatctacgtcgggaaagcgaaaatcttaaaaaacagggtccgctcctatttcagcgggtcccatgatgccaaaacacagcgtcttgtcagtgaaattgaagacttcgaatacattgtcacatcctcgaacatcgaagcgctcattcttgaaatgaatttaatcaaaaagtacgacccgaaatataacgtgatgcttaaagatgataaaagctacccgttcattaaaatcacgaacgagcggcatccgaagctggttgtcacaaggaaggtcaaaaaagacaaaggccgctatttcgggccgtaccccaatgtccaggctgcgagggaaacaaaaaagctgctggaccgcctctatccgctcagaaagtgcgccaagctgcctgaccgcgtctgtttgtactatcatctcggacaatgtctggcgccatgcgtatatgatgtgtctgaggagacaaacagacagctcacagaagaaattacccgctttttaaaaggcggctacaatgaagtgaagaaagagcttgaagcaaaaatgctcgaagcctcggaaaacctgcagtttgaacgggcgaaagaattccgcgatcaaattgcccatatcgagtcaacgatggaaaaacagaaaatgatgctgaatgacatggttgaccgcgatgtatttgcctattcgtatgacaagggctggatgtgcgtccaggtcttcttcatcaggcagggcaaattgattgaaagagatgtcagcatgtttcctttatacagggaagcagacgaggaatttctgacattcatcgggcaattttactccaaaaacaaccattttcttccgaaggaaattttggtgcctgacagcgtcgacaaggacatgattgaggagcttttggacgtgaacgtgcgccagccgaaaagaggagcgaaaaaagacctgctgctccttgcccataaaaatgcaaagctcgctttgaaggagaagttttcgctcattgaacgggatgaagagcggacgatcggcgcgattgaaaagctcggaaaagcgctggacatctacacgccatacagaattgaagcgtttgataactcaaatattcaaggaacggaccctgtttcggccatggttgtatttctcgatggaaaaccgcataaaaaagagtaccgcaaatataagatcaagacggttgaaggtcctgacgactacggatcaatgcgcgaagtcatcagaagaagatatacaagggtgctgaaagagaatctgccgctgcctgatttaattttgatcgacggcggaaaggggcaggtgtctgccgcccttgacgttctggaaaatgaactgggtctcgatgtccctgttgccggtctggtgaaagacgataagcacagaacatccaaccttttgatcggcgatccccttgagatcgtccagcttgagcggaacagccaggaattttacctgcttcagcgcattcaggacgaagtgcacaggtttgcgatcagcttccacaggcagctcaggggaaaaagcgcatttcaatcggtgctggacggcataccgggcgtcggcgaacagcggaaaaaactgctgttaaaacatttcggttccgttaagaaaatgaaggaagcgagcgccgaagatatccgcaagctcggcatacctctgaaaacggcgcagctgatcgaagaggcattgaaaaaataa

SEQ ID NO: 2885 - DNA, 315 bp, Bacillus licheniformis
atggctatcgtaaaagcaactgatcaaacattctcatctgaaacaagcgaaggcgtagttcttgccgacttttgggctccttggtgcggaccttgtaaaatgatcgcgccggtacttgaagagcttgatcaagaaatgggagacaaactgaaaatcgtaaaaatcgatgttgacgaaaaccaagaaactgccggcaaatacggcgtgatgagcatcccgactctcctcgtactaaaagacggcgaagtggtcgaaacatctgtcggctttaaaccgaaagaagcgcttgaagaactggtcaacaaacatttgtaa

SEQ ID NO: 2886 - DNA, 978 bp, Bacillus licheniformis
atgagcaaaaaagttatcgtattgggagagttcagagacggttcgttgaggaatgtgactttcgaagcgatagccgcaggaaaaacggttgccgaagggggagaggtgatcggcgtactgttcggtgaaagcgtttcaagtcatgcggcagaactgatccattacggcgctgacagagtgcttacagccgaaaacccgctcttgaaaaactatacgtctgacggctatgttcaagccttgttgccgatcatagaacgcgagaatccggacgtcatcattttcggacatacgtcaatgggaaaagacttgtcgccgaagctttcagcccgtatgggaacagggctgatatcggatgccgtcgatgtcgaagtggccggcggcaacatcgtgtttacaaggccgatttactcgggcaaagcgtttgaacggatcatttccgaagatgaaacgatttttgcaacgatcagaccgaataatatcgccccgcttgacaaagatgagacgcggacaggagcggtcgaaagcatcgaagcagatattcgggacatcagaacggtcatcaaggacattgtcaaaaaaacgtccgaaggcgtcgatttgtctgaagcgaaaattatcgtagccggcggtcgcggcgtcaaaagcgaggaaggctttaaaccgctgcaggagctcgccgatgtattgggcggggcggtcggcgcttcaaggggagcctgtgacgcagactactgcgactattcgcttcaaatcggccagaccggcaaagttgtgacacctgacttatatattgcctgcggcatttcaggagcgattcagcacctcgcagggatgtcaaacagcaaaatcatcgttgccatcaacaaagatccggaagctgatatatttaaaattgccgactacgggatcgtcggcgacttatttgaaatcgttccgctgctcacggaggaatttaaaaagctgagcgtcagcacatga

SEQ ID NO: 2887 - DNA, 774 bp, Bacillus licheniformis
atgaacatttatgtcttaatgaagcgcacgtttgatacagaggagaaaattcagatcgaacaaggggaaatcaacacggacggagcggaattcatcatcaatccgtacgatgagtacgccattgaagaagcgctccagttgaaagagaagcacggcggtgaaattacggtcgtgacagtcggcgaggaagaagctgaaaaagaactcaggacggctctggcgatggggtgcgacaaagccgttctgatcaacattgaagacgacgtggaagaagcggaccaatatacggcttcagccatcctttacaactatttgaaagaccgcgagtacgacattatactcggcgggaatgtggcgatcgacgggggatcgggacaggttgcgcctcgtttggccgaactgctgggcattccttgtattacgacgattacaaagctgacggtaaacggcggagatgttgaagcggaacgcgacgccgagggcgatcttgaagtgatccaaacatcgcttccaatcgtagcgactgcacagcaggggttgaacgagccgcgttatccgtctcttccgggaatcatgaaggcaaagaaaaagcctctcgaggagcttgagcttgatgatctcgacatcgacgaagaagacgtggctgcgaaaacaaaaacgatcgaacggttcctgcctccgaaaaaagaagccgggaaaatccttgaaggggagccggagcagcaggcggcagaacttgtatcactgctgagaagcgaagcaaaggtcgtatga

SEQ ID NO: 2888 - DNA, 777 bp, Bacillus licheniformis
atggcagcattatcatacgccgtagacggccatgttgcgacgattacgattcagcacccgccggcaaatgcgctatcgacgcaagtgcttgaagatctttcggcatgccttgatgaactttcagaacgtcaggatgtcagaagcgtcgttattcacggggaaggaagatttttctcggcaggcgctgatattaaagagtttacatcattgatggacgggtctgattatgcaaatttggctgataagggccagcagattttcgaaaaagtagaatcttttccaaaaccggtgatcgccgcgattcacggggccgctcttggaggcggtcttgagctagcgatggcatgccacatccggattgccgaggaaagcgcaaagctcggccttcccgaactgaatctcggaatcattcccggctttgcgggaacgcagcgccttcccaagtatgtgggcaccgccaaagcgcttgaaatgatcgggacatcagagccgatatccggcaaggaagcttttgaatacggtcttgtcacgattttggcggcgaatgaagaagaagtgctgcaaaaggcaaaagagctcgcacaaaaattcgctgaaaaaagtccgcagacgatggcttatgtcattgaactcctgaattcgagcaaagtgtattcgtatgaaggaggcctcaagctagaagggaaatacttcggcgaagtgttccaatccgaggatgcgaaggaagggattcaggcatttcttgaaaagcggaagccgcattttaaagggaaataa

SEQ ID NO: 2889 - DNA, 579 bp, Bacillus licheniformis
atgcagattatcgacgcagctgtcattgtgattgcagaaaacggataccatcaggcgcaggtttcaaaaatcgccaagcaggccggggtggcggacggcaccatttatctttattttaaaaacaaagaagacattctcatctcattattcaaagagaaaatgggacagtttatcgagcagatgagcgaagaaatgacagcgaaaaattcggcgacagaaaagctttcgctgttcatcaaaaagcactttgaactgctcagcagcgatcgccacctcgcgattgtcacccagctggagctgaggcagtcgaatcttgagctgaggctgaaaatcaatgagattctcaaagggtacttaacgatcctggaagacatcatcaccgaaggaaaagaagctggagaatttaaaagcacgcttgacgtccgccttgcgaagcagatgattttcggtacggtggatgagacggttacaacctgggtgatgaatgatcaaaaatacgatctcccaaacctggcagacagcattcatgaattgctgatccacgggttcagcagccaaaagacgaaggaggaggaataa

SEQ ID NO: 2890 - DNA, 1680 bp, Bacillus licheniformis
atgccgactgaaaaaccgtggctgcgtcattatcccgaacaaattcctcacgagctgcaatttgaagatcaaacactccattccatcctgcaacaatccgcccagcagttttcagaaaaaacagcgattcattttctaggaaaaaaacgttcgtaccgggaagtttacgaggatgctttaaaaatggcagattacctgctgtcgctcggcattcaaaaaggagacagagtatcgatcatgctgccgaactgcccgcaggcggttatcgcgtattacggcgttcttttctccggcggcatcgtcgtccagacaaatccgctgtatacggaaagggagcttgaacatctgcttcatgacagcggggcaaccatcatcattacgctcgacatgctgtacccggcggcatataaaatgaaagcgctaacaagcattaggcacatcattgcgacaagcataaaagattacctgcctttccctaaaaatctgctgtacccgatcgttcaaaaaaaagagaatcaaatgtccgttgagatcaatgaaaatgagacgacccaccttttccgcaccatcatgaaacgccccgttccaagcggaccgcccggtattgaaattgatccggcccacgacattgccgtcctgcagtataccggaggaacgacaggcacgccaaaaggcgtcatgctcagccaccgcaacatactagccaacatggagatgtgcgccgcctggttttatcaattgaataaaggggaggagaaggtgctggggatcgttccgttttttcacgtctacggaatgacggccgtcttgaatttcacgatcaggcaggggtatgaaatgatcctgctgccgagatttgacgcgcgcgcagcgctgaaaacgatcgataaagaaaagccgacgatatttccgggggcgccgacgatttatatcgccctgttgaaccatcccgaccttcaccaatacgatctgtcatcgattaagagctgtttgagcggatctgcggcgcttcctgttgaagtcaaacagcagtttgaaaaggtgacgggcggaaggcttgtcgaaggttatggaatgtctgaaacgtcgccggtcactcacgccaattttatttgggatttgaataaagcgggcagtatcgggtgtccttggcctggtacagacgctgctatctattcggaagaaaccggcggttttctcgggccttatgagcatggagaaatcgctgtcaaaggaccgcaggtgatgaaaggctactggaacaatgatgaagaaaccgctcagagtctaagggacggctggttttttaccggagacatcggctacatggataaagacggcttcttttatatcgtcgaccgcaaaaaagacgtgatcattgccgggggatacaacatctacccgcgcgaaatcgaagaagtgctctacgagcatgaagccgttcaggaggcggtcgttgccggcatccctgatgaatacaggggggaaacggttaaggcttttgttgtgctgaaagatcatgttacaataacggagaaggaattggacgaatatgccagatcgcgtctcgctccttataaagtgccaaaagtatacgagttcagggacgaacttccgaaaacggcggtcggaaagattttaagaagagcgctcgttcaagaggaaaagaccggcgtctga

SEQ ID NO: 2891 - DNA, 405 bp, Bacillus licheniformis
atgaaagagttttgggagaacaaccttgtggaaatcgccgcgtactacagtgtttccgttttgtgtcttgtgatatttttatctgtgtttgaactcgtcaccacgtataaaaattgggaggagattcaaaaaggaaacatggcggttgcgatggcaacaggcggaaaaattttaggcatcgccaacgtgctgcaaaaatcgatcagccagcataattccctgctgcaaatgatggggtgggggctgttcggttttatcctgcttttgatcggctacttcatttttgaatttctgacgccgcgctttaaaattgacaaggagattgaaaacgacaaccgcgcagtcggcttcatttcattcgtcatttcagtaggcctgtcatttgtcgtggcttcgggtatctaa

SEQ ID NO: 2892 - DNA, 2358 bp, Bacillus licheniformis
ttgcagcaaaaagcgctatcagcacttgaatttcataaagtaaaagaacagctcacagagcatgcggcatcttctttggggaaggaaatgcttttggaactcaaaccttcccgttcgctcgaagaagttaaaaagctgcaggaagaagtcgatgaagcaggaaccgtcctgcgtttaaaaggaagcgcccctttcggcggccttacggacattagaaaagcgttaagaagggcagaaatcggcagcattttaagcccggcggaattgactgaaatatcgggtctgctatacgcagcaaaacagatgaagcactttcttgaaggcctgttcgaagacggggttgagattccttatcttcatcaatatgcagaaaagctcataccgctttccgaattggaaagggacatcaattcgtgcatcgatgatcatggggaagtgcttgatcatgcatcagagacgttaaggggaatcaggacccagctgcggacgcttgaatcaagaatcagggaccggctggaatcgatgctgcgttcttcatctgcgcaaaaaatgctgtcggatacgatcatcacgattcgcaacgaccgcttcgtcatccctgtcaaacaggagtacagatcaagctacggaggaatcgtgcacgatcagtcttcttccggtgcgacattgtttatcgagcctcaggcgattgtcgatatgaacaatgcgcttcgccaggcaaaagtaaacgaaaaacaggagattgaacggattttgcgcgtcctgacagaaaagacggcagagcacacaaatgagctctttcacgatgtcaaagtgcttcagacgctggactttatttttgcaaaagcaaaatatgcaaaagcgacaaaagcggttaaaccggctgtcaacgctgacggctatgtccgcctgattcaagcccgccacccgcttttgcccctggatgaggtcgttccgaatgatattgagctcggcggagagtatacgacaattgtcatcacgggcccgaacacgggggggaaaacggtgacgctcaaaacgctcgggcttttgaccatgatggcgcagtcgggattgcacgtaccggcggaagaaggatcagagaccgccgtatttgatcaagtatttgccgatatcggcgatgaacagtcaatcgaacaaagcttaagtacgttctcgtcgcatatggtcaacatcgtcgatattttgaaagacatgacggaaaacagccttgtgctttttgacgagctcggtgccggaacagacccgcaggaaggcgcggcccttgcgatcagcatccttgatgaggtgtgccagacaggcgcacgcgtcattgccacgacccattacccggagctgaaggcatacggctacaatcgcgaaaatgtcattaatgcaagcgtcgaatttgatatcgatacactatcaccgacatacaagcttttaattggagtgcccggccgaagcaatgcgttcgaaatctcgaagcgcctcgggctgcctgattacctgatcggccgcgcaaaagcggagatgacggccgaacataatgaagttgatacgatgatcgcatcgctggaagacagcaaaaagcgcgcagaagcggagctcaaggagaccgaagccatccgcgcggaagctgaagcccttcaccgcgacctgcagcagcagatcagcgaatggcaggagaaaaaagacaagctctacgaagaagcggagcaaaaagcggctgaaaaagtcaaagcagcgatgaaagaagcagacgacatcatccagtcgctccgcatgatcaaagaagaccataaagcatttaaagaccatgagctgatcgaggcgaaaaagcgccttgaagaagccgtgccttcgtttgaaaaagcgaaaaagccggctcagaaaaaaacggacaagcgcgaattaaaaccgggcgatgaagtcaaagttttaacctttggccaaaaagggacgctgctcgaaaaaacgggtgcggccgaatggaatgtgcaaatcggcatcctgaaaatgaaggtcaaggaaaaggatctggaattcctgaaatcggcacccgaacccgagaaacaaaaaacgatcgccgccgtcaaagggaaagattatcacgtctcgctcgaactcgaccttaggggggagcggtttgaaaatgcgcttcaccgggttgaaaaatacttggatgatgcggtgcttgcgggctatccgagagtctcgatcattcacggaaaaggaaccggcgccctccgaaaaggcgtccaggacctattgaaatcccaccgcaatgtgaaaaactcccggttcggcgaagcgggagagggaggatcaggagtcaccattgtcgaattaaaataa

SEQ ID NO: 2893 - DNA, 1725 bp, Bacillus licheniformis
gtgaacaacatgcataaaaaagatatcatcaaattgcttgaaacgattgcgatatatatggaactaaaaggggacaacccgtttaaaatctccgctttcagaaaggctgcggcagctcttgaacaagacgaccggagcctctcggaaatcgatgatatgacgtccctgtccgggatcggcaaaggcacatacgctgtcatcaaggaatatatggacacgggagcatccggaacgctggaacgattaaaggaagaggttccggaaggacttgtcccgcttttgaagcttccgggtctcggcggcaaaaaaatcgccaagctgtatcaggagctcggcgtctgtgatgcggcatctttaaaagaggcctgcgaacagcaaaaggttcaggggcttgccggattcggcaaaaagacggaggaaaaaatcctgcaggctttgggtgaagcgggaaaacgccctgaacggtacccgatcgcggtcgctttggccgtcgctgacatcatcgaagagcagcttgaagggctcccgggcctcattaagttttcacgggccggaagcctgcgccgcgccaaagaaacggtgaaagacctcgattacattatggctgtcactgatccggaacttgtccgggaagggctcttaaagctttcgaacatcaaggaggtcattgccgcaggagatacgaaagtgtctctcacatttgcgtttgaatacgaaatcagtgcggatttccggctggtgacagaggaacagttcccaacgacgcttcatcattttaccggatcaaaagaccacaatatcaaaatgcgccagcttgccaaagaaaaaggcgaaagaatcagtgaatacggcgtcgaaaccgttgaaactggagaaattaaaactttctcaagcgaaaaagagtttttcgcccatttcgggcttccgtttattccgcccgaactgcgggagacaggaagagaagtcgaggactacagcgttgacatcggactcgtttccgccgaggatattcaaggagaccttcacatgcactcggcttggagcgacggtgctttttcgatcagggaaatggcggaagcatgcatggcaaaagggtaccgctatatggcgatcacagaccattcccaatatttaaaagtcgcaggcggtttgacgcctgagcgccttcgcatgcaggcgaaggaaattgatgaactgaataaggaatttaccgattttcatatttttaaaggcgtggaaatggacatcctgcctgacggaacactggattatgacgacgagctgctggcggaaatggatcttgtcattgcttccatccattcaagcttttcacagccgcagcatgtcatcatgaagcggcttgaaaccgcgctgctgaatcagcacgttgacattatcgctcatccgaccggccgtctgatcggaagaagggcggggtatgaagtcgatattgaccagctgatcgaacttgcgaaaaaaacgaatacagcattggagctgaacgcaaatccagcgcggctcgatctcagaatggagcacttgatcaaagcgaatgctgccggagtgacactcgttattaatacggatgcccacaacacagcgatgcttgatgatatgaaaacgggcgttacggcagcgagaaaaggatggacgccaaaggccaatgtattaaacacccgctcctttgaagaagtccaggcatttttgtcgcgccatcgatcttaa

SEQ ID NO: 2894 - DNA, 537 bp, Bacillus licheniformis
atgttagatatcatcattatcattttgcttttgtccggtttgtttattggactcaaaagagggtttatccgccagtttatccgtttggttacgtttatcgcagcgatcgctgtggccgcaacctattacggcgaccttgcgcctaagctcggctggattccgtctcccgactttacgggcggccaggctgcgctggcgtttgtaaacggaagccttgaaggcgcttattacaatatgattgcgtttttgattctctttatcctgacgattatccttttgagagttgccgcatcgtttttggatgccgtcgcaagcataccggttctcaaacagatcaaccaaatactcggagccgtgctcggttttgcggaaatctatctgtccgtgtttgtcgtcctgtccatcggaacgcttctgccgattgatgtcctgcaaaacatgatggccggttcagtcatggctgatttgatcattcataaaacaccgtttttatcaaacatgttaaacaatctgctgcatcagtacggatctttgtaa

SEQ ID NO: 2895 - DNA, 258 bp, Bacillus licheniformis
ttgtctgatggtcaaaaaacgagaacaacagttgacatctacggtcagcaattcacaattgtcggcgatgagagcaagagccatatgaggcacgttgcctcgattgtggatgataaaatgagagaaatcaacgaaaaaaatccgtatcttgatataaataaactggccgttttgacggctgtaaatgtggttcacgattatttgaagcttaaggaagagcttgagagattaaaaggacaaataaaagaaaaggattga

SEQ ID NO: 2896 - DNA, 942 bp, Bacillus licheniformis
gtgtcacattctgttttaaaagttcccccgtctgttattgaacggatgcaaagccactacgggcctgacattacttcactttccgtacagggcgcagttttccaagccaaaccccaagggtgcaccattacagcataccggtcggggaaggtgctgttccaaggaaaaaacgcggaaaaggaagcggagcgctggacggcggatgctgaaacaccggctcccaaaaagcccgcatcgaaaaaaagcatcccgtccgtctatcagccgcctgaaggcatcggttccatgtctgtgatcggctccgatgaagtcgggacaggcgattatttcggcccgatcaccgtcgcgtgcgtatacgctgacaaggcgaagcttccgctgttaaaagaactcggtgttaaagactcgaaaaacttaaaagatccgcaaatcgttcagatcgcgcgcgacttaatcaagacagtcccttacagcctgctcgttttaagaaacgaaaagtataatgaaatgcaggaaaaagggatgagccaaggaaaaatgaaagctcttctccacaaccaggcgatcggcaaccttctcaaaaaattggacggaacccggcctgaagcgattttaatcgaccagttcgccgaaccggccgtatacttcaagcatctggcaggcaaaaccgccgtcaaagaacgtacatatttcagcacaaaagcggaaggcatccatctttcagttgcagcagcctcgatcattgcacgctattcatttttaatggaaatggataagctgtcaaaacaagccggcattacgcttccgaaaggagcgggcccgctcgtcgatgaagccggcgccaagctgatcaagaaacacggcgaagacgcattgcgggtattcacaaagctgcattttgccaatacgcagaaggcgaagcggattgcgtcgaaacggtaa

SEQ ID NO: 2897 - DNA, 111 bp, Bacillus licheniformis
ttggatgaagaaatcaggttcatttggcattcttttaattatttcagctctcataatatcaatgtattttatgttaaatacaaaggctttgatcttcaggatatgacttag

SEQ ID NO: 2898 - DNA, 804 bp, Bacillus licheniformis
atgtcaaaaataaaatggatcatcacgctcaccatatgcacagctctggcattttctctctttattttcttcaacaaggcgaactttacagaggccagcgaaaataaagaaaccgggcttttctttgcccgaaactacatcagccatatgatggaaaacgagacgatgtcgtttaacattttcggcctgcaaaaagcaaacgccggcgttcctctaagcggtgagacggttacgtcgctcgcttttgataacaatcatatacaaatcagcgattacaaggttgaaacagggattcgccataaaggctatacgctcgtcaacatcatcgtagatgtccgagtctcaagcgataaaccggaaaaagcggatcagctgctgatatcttttaacggacgtgatagagaagcatttcaaatcggaaagatcacccttcaaaaccatcacaatgttcgaagcggcgatctgtcgcctgccggtcaatatactgcaggatatccaaaaccgtccttggacgttcggctgaaaaacaatctcgcaaaagatatttcccttgaaaagatcaccgatctaaacggcgtcatggcgtatacatttgacaaggggaccgccattcaagcgaaacaaagcaaacacatcgtcgtcccgtcttttcatatgacaggcgaatatgatttttatacggtcacccctgttttacgttatactgcagcagggaagcggaatcaatacagcatgcccggtgtactgtacggagctttagactccgatgaagagaaaatcgaacggatgctgaagcgtcaatag

SEQ ID NO: 2899 - DNA, 141 bp, Bacillus licheniformis
atgactcaattctcaagaattctggaaaaaggcatttatagcccgcatattaaaatcctagccaaggaagaagtgacaaaagttcacgaccaagtgctgaaggcacttgaggatacgtatcaggctgtattgagaggataa

SEQ ID NO: 2900 - DNA, 1443 bp, Bacillus licheniformis
atgaataataaatacttaatttattcaaaaattcttttaaccaacgacattcgaaaatttaatactaaaagcaaatggcttgcattattcgtattgatattgtcattcgttgttttccctttaataattggcagctttgctgggtacatcattaaaaatctagtcatcattcatctttctttttttctgtttatccttactgtaaatattgataaaagtattttcagagttatgttttcctccgacaaaaaacaaatggccattctgggaatcaaattggatcaatttatattaggaaaagatattagtaaattttatagttcatttttatctttaatatctttttatgttggttcatcgattgtatattatctcattcatcagtctttggaagaagtcttcgcgattgctgtgattggtttattgtccgctatactaggatatttgcttagacttcattttataaggctattagtattgcctaaattcataaatgtctcaagcattattggctttttcacaaatggaattttaattctttggatcttttttatactcaaatataatttgttatttctaaacatcaataatatgcgaattttttcaatatctataccaataatggtatctttaacaatcctgttaattatagtgtggtataaaagtttaagaaacctttccatttttaatgatcatttaaatagcaagactgatacaaatttgaagaagtctagagagagcagaagccttctatattacgagctgatccttctatataggaacccgcctgtaaggtggtcggttttattatttattttaagtttatcagcaggtttactaacaatcattttgtatggttttaacactgatcgatttgcagacactggaatttccaacgaattcagctttatgttcagcgtgctgttcccgttagtctttatctctatcatgattcaatcattggtttcttttgatattgatggtcttattatacctttgaatcagcacaagccaaactttattaaaaacaaaataaaagcaaaaaccaaaatctctgtcttagcacatgtgttatttgttttaatctatgctgcgatttcaaatttttatataaaaccggatcattttattgcattatccattatcttattgatgatagctgttactttggggttaagctgtctcacttcaactatattgtttccatattttaaatgggattacatttatcaagttcccagtactttaagcaaaatctttcttaatttagtatttggattactaatagggttagccattgtttcaacttacaacaaagttttgtatgttgttatttttatcactttgttatgtatcataacgctactgcactccataaacaagcaaatatggaaatcaacaatcaacaaaaattacatatcaataaaatctttattcgagtga

SEQ ID NO: 2901 - DNA, 795 bp, Bacillus licheniformis
atgtatcataacgctactgcactccataaacaagcaaatatggaaatcaacaatcaacaaaaattacatatcaataaaatctttattcgagtgagtgattatatgcttaaactgcaaaatatatcaaaagaatatcctcaatccaattttagcatgaagaatttagaattcgcttgcgggcgaaatcagattattggattgctcggtaaaaacggagcaggaaaaacgaccctattagaaattattgcaggcctcattcctccggatagcggtgaggtagtcgttgatggacatcttaccaattatttagagaaaatcggatacctagaagacgatccaaaattatttgagaatttaacgtgttatgaattaatcaagtaccaatctttattaattgaaaaaccattatcccaagaacaaatcattgaaaccttagacatgttcagtctaaaagaacaaaaagaccaaatggcatcttcgctatcaagaggaatgcgtcaaagaatgtcttttattctttccactttgcatcaacctgatgttatcttgcttgatgagccttttacaggacttgatccaaaaaacatggcggatatgaaaaagattttaattaatattagaaatcaaaatagaattattattttatccacgcatatcttacagtttgcagcagatctttgtgatgagatattatttattaataacggaaatattatccacactgaaaaaaaattagccggggagacatttaatgaagccagccttgaaaaaaaattccttgaatacctatgctaa

SEQ ID NO: 2902 - DNA, 549 bp, Bacillus licheniformis
atgaagaagactaaattcaacttaatatgtatttgtctattatctggagctgcagccttatgtgtttccattttaaaaatgaatgagatcgatgctagcttacatgaattaaacgaagatgaatatggaaatcttattactatcagtaaatggattggcattacaatagcagtaattggcgaagcgataaaaccccttcttgagcttttatttttcactttaatcatttggctcgctattatgatttttggagcaaaggattcctttaaaaacattttttcaaaaggtgttctttcctactatttcaatcttgtaggcagtgtcttagttattgtcttttatctatttggcttaaaagatgctgaaagtcttttttctattccttttttaagaaatttaaacattttttctttaatttcgttatttttttggtgctatttatgtctagaaaagaaagaaaactcactaaaaattaaatactctttttcttttttcatattgtttttattttctattgccatatctattttctccgatattcttgcatag

SEQ ID NO: 2903 - DNA, 2415 bp, Bacillus licheniformis
atgtttgtttcatataaatggctgcaagaatacgtgaatttagacgggatgactcccgagattctcgctgaaaagattacaagaagcggaattgaagtggaaggcatcgaatataagggagaaggaattaaaggtgttgtcattggacatgtgctggagcgcgaacagcatccgaacgccgacaaattaaacaaatgcctcgtcgatatcggcgaagaagagcctgtccagatcatctgcggggctccgaatgtggacaaagggcaaaaagttgccgtcgccacggttggcgcggtattgcccggcaattttaaaatcaaaaaggcgaagctccgcggggaagcgtctaacggcatgatatgctctttgcaggagcttggcattcaaggcaagcttgtgccgaaagaatatgcggaaggcatcttcgttttcccgggcgatgctgaaaccggggcggacgcccttcaaagcctggcgctcgacgatgcggttctcgaactgggactgacgccaaaccgcgccgacgccatgaacatgctcggcgttgcctatgaagtggctgcgattctcggccgcgaagtcaagctccctgagacggcttatcaggcaggcgccgaaaaagcggcggactatatttccgtcaaaattgaagatcctgaagccaatcctttatacgcggcgaaaatcattaaagacgtcaaaatcggcccgtcgccgctttggatgcagacgaagctgatcaacgccggcatcagaccgcacaacaatgtcgtcgacgttacgaactttgtgctgctcgaatacggccagccgctccacgcgtttgattatgaccgcttcggctcaaaagaggtcgtcatccgcaaagcgtacgagaacgaaacgataacgacgctcgacgaacaagaaagaacgctgaccactgagcaccttgtcatcacaaacggctcttctccgcaggctgtcgcaggcgtaatgggcggagcggaatcagaagtccgcgaagatactgcgacagtgctgctggaagcggcgtatttcaacggccagaccgttcgcaaagcatcaaaggacctcggtcttcgcagcgaatcaagcgtccgctttgaaaaaggcatcgatcctgcacgggtgcgcctcgctgcagaacgcgcggcagatttgatcagccggtatgccggaggaaccgtcttggaaggtacggtcgaagaaaaccatcttgacatcaaagagaatgtcatccgcctttccgttgataaagtgacgaaggttctcggcatgtccatcagcaaagaagaaatggtcaacatttttgaaaggctcggctttgcagttgaagacgctgaacgtgaactggtcgtgacggttccgtcaagaagaggcgatattgcgattgaagaagatttgatcgaagaggtcgcaagactgtacggatatgacaacattccgtcgacactgccggaagtaacaggctttgcgggcggactgacaccttatcaggacaagcgcagaaaagtaagacgcttcctggaaggagcagggctttcccaggcgatcacatactcattaacaaacgataaaaaagcgacggcttacgcattggaaaaatcgtttaaaacgatcctttcactgccgatgagcgaggaaagaagcgtgctgaggcacagcctgctccctaatctgctcgattcggttgcatacaacttggcaaggcaggccgattcagctgctttttatgaaatcggttctgttttcttgaaagccgaagaacatacgaaaccggtcgaaaaagaacacgtcgccggagccgtgacaggcctgtggcacaaaaacctctggcagggcgagaaaaagccggttgatttcttcgtcgtaaaaggcatcgtcgaaggtctgttggaaaagctcggaatcaccgaaggcatcgaattcgctcaatctgaaagaaaagagcttcatcctgggcggacagccaatattttgcacaacggctcattagtcggcttcatcggccagctgcatccgtcagttgaaaaagagctggacctgagcgacacgtatgtgtttgaactggacctgcacgagctcctccgattggatgtaccggagatcacgtatacaccaattccgaagtatccttctgttacaagggacatcgcgcttgttgtagacaaacaaacaacggccggccagcttgaggacgtcatcaaaacagcaggcggcaaatggctgaaagaagtccatgtctttgacgtctatgaaggcgagcacatggaagaaggcaagaagtccgtcgccttcagcctgcaatatttgaatcctgaacagacattgacagaagaagaagtgacaaaagtccacgaccaagtgctgaaagcgctggaagataaatatcaggctgtattgagaggataa

SEQ ID NO: 2904 - DNA, 1035 bp, Bacillus licheniformis
atgcaggaagagctgaaacggcttgaaaaagaagcggttgaaaaagtggaagccgctggttcattaaaagaagtcaacgatgtccgcgttgcgtatctgggaaaaaagggaccgatcacagaagtgcttcggggaatgggaaagctgtccgctgaagaaaggccgaaaatgggggccttggcgaacgaagtaagagagaaaatcgccgcggcgatcgccgaaaaaaatgcccgccttgaggaagaagaggtgaaaaggaagctgaaagagcagacgattgacgtgacgcttccgggaagccctgtgaaaacaggagcgcggcatccgctgacgatcgttattgaagaaatcgaagacttgtttatcagcatgggatattcggtggaagaggggcctgaagtggaaaccgactattataacttcgaagcgctcaaccttccgaaagagcacccggcccgggatatgcaagacagcttttatattacggaagatacgctgatgagaacacagacatctcctgttcagacgcgcacgatggaaaaacataaaggcaaaggccctgtcaaaatcatctgccccggcaaagtgtaccgccgcgacaacgatgatgcgacacattcccatcagtttatgcagattgaagggctctgcgttgaccgtgatatcagcatgagcgacttaaaaggaaccctggaaacggtcgcgaaaaagatgttcggcgaagagcgcgaaatcagactgcgtccaagcttcttcccgtttacagagccgtctgtcgaagtcgatgtttcctgctttaaatgcggaggcaaaggctgctccgtttgtaaacaaacgggctggatcgaaattctcggcgccggaatggtgcatccgaacgtgctcgaaatggccggattcgattccaaacaatatcagggatttgcttttgggatgggcgttgaacggatcgcaatgctgaagtacggcattgacgacattcgtcatttctatacgaacgatgtcagatttttatctcaatttaaacaagcttaa

SEQ ID NO: 2905 - DNA, 747 bp, Bacillus licheniformis
ttgaaacgaattgaatcagccaaaaatcaaaaagtgaaggactggaaaaaacttcatgcaaaaaaagagcggacaaaaacgaatactttcttaatagaaggcgagcatctcgttgaggaagcgctgaagacaccgggtgttgtgaaagaaatcatggtcgcagacgaagcggacttcccggctatgattgatgagtctgttgcccgctatgttttgagcgccgatgctttttcagcgattgccgaaacggagacgcctcaggcggtcgccgctgtatgccgaatgcccgaaagcggaccttttcaatacgaaaagctgctgctagctgatgctgtgcaggacccgggcaatttagggacgatcatccggacggcagacgcggcggggatcgatgccgttgttatcggacaagggactgtcgacccttacaatgccaaaacgctcaggtcggctcaaggctcgcattttcacatcccgattttaaaacgcgagctttcagagctgattgaagagctgaagggaaaaagcgtcccggtttacggcacagcgctgcagggtgccgtgccatttagagaagcggagccgtcgcagtcgtttgcgctattgatcggaaacgaaggatctggggtcgatccggccctcctcgcacagaccgaccaaaatctgtacgttccgatctacggaaaagcggagtcgctcaatgtggcggccgcagccgcggtccttctttatcatctccgcggataa

SEQ ID NO: 2906 - DNA, 213 bp, Bacillus licheniformis
atggatttgaatttgcgccatgccgttattgccaatgtatcagggaactcgcaagaagagcttgaacatacgatcgtcgatgcgatccaaagcggtgaagaaaaaatgcttccgggattgggtgtgttgttcgaggtcatctggcagcacgcaactgaatcagacaaaaccgaaatgctcgagacattggaacaaggattaaaagcgaaataa

SEQ ID NO: 2907 - DNA, 1797 bp, Bacillus licheniformis
atgaatgcaataacaattgtgatcgcttccatctgtattttggcgatcgcctatcgtttgtacggaacatttatgatggtgaaagtgttgaaggttgatgacgacaagccgactcctgcccatcttcagaaagacggcaaagattatgtgccgacgaacaaatgggtgtctttcggccaccactttgcggccatcgcagccgcggggccgcttgtcgggccgatcttggcggcgcagttcggctacttgccggggctgttgtggctcctgatcggagcggtcatcgggggcgccgtgcatgatattgttgttttatttgcgtcgatgcggaggaagggaaagtcgctttcagaagtggcgaaagaagagctcgggcctgttgcgggattttgcacggggcttgcgatgctgtttattattacaatcacgatggcggggctgtcgatggttgtgcttcatgcgcttgaacgcaatccgtgggggacgttcgccgttgcgattacaattccgatcgcgatgggggtcggcttattttataaaaagacaggcaacttaaaattagcgtctaccggcggatttattttgctgatggccggtgtcttcatcgggccctccattgcagagacgccgcttggagacgccttgacgctcgatacgaaaacgcttgctgtcgcacttcctgtctatgcattttttgcagcggcgctgcctgtatggctgctgctcgcaccgcgcgattatttgagcagctttatgaaaatcggggtgtttatcgctttgattgccggggttttcgttgtcaatccggcgattccgtttccggcgtttaccgagttcacgggcggagggggacctgtttcgcctggtccggtctggccgttcatttcaattacgatcgcctgcggtgcgatttccggtttccatgcgtttgtcggttcaggcacgacgccgaagatgcttgacaagtggagcgacatgaaattcgtcggcttcggagcgatgctcgttgagtgtcttgtcggcatcatggctttaatcgcggcaacggcgttgcagccgggcgattattttgccatcaacagttcgccagaagtctttcggacgcttggcatgaatgtcgtccatctgcctgaactcagccgcgaaatcggtctcgatcttgaaggaagaacaggcggagctgttacccttgccgtcggcatggcttatattttcacggatattccgtttttcagccatttggcctcttactttttccaatttgtcatcatgtttgaagctgtctttattttaacggcgatcgatgccggtacaagggtggcgcgttatttgattcaagactttttcggggaagtgtacaaaccgctgaaaaaaacggactggcttccgggttcggtcgcagcgagcgcccttgcctgtttcatgtggggatatttgctgtactcaggcgatatcagctcgatttgggcgctgtttggcgtatccaaccagctgatggcatccgtcggtttaattatcggagcgacggtcattttaaaaattgcggacaaacggcgttatatgctgacatgtctcattccgctcgcttatttgtatgtgacggtcaactatgcgggatactggatgatcaaaaacgtttattttaatgcggaagctgccggtttcagcgttttaaacggcattttatcgatcattatgcttgtgttgggacttgtgatcatggctgcagccattaaaaaatggacggagatttggcgcgatccggcattgcggatggagccttctatacctggatga

SEQ ID NO: 2908 - DNA, 1509 bp, Bacillus licheniformis
atgactgtacacaaagcgaagatgacgattgacaaggaatataaggtggcagagattgataagcgaatttacggctcctttatcgagcatctcggcagagccgtttatgaaggcatttatgagcctgatcatcctgaagctgacgaatcaggctttcggaaagatgtcattaaactagtcagagaactaaaggtgccgtttatcaggtatcccggcggaaactttgtatctggatataactgggaggatggagtcggacctgtcgaacagcggccgacaagacttgatttggcgtgggcgacaaccgagccgaacttaatcggtacgaacgaatttatggattgggcaaagcttgtcggggcagaggtgaatatggccgtcaacctcggaacgagaggaattgatgccgcacgcaacctagtagaatattgcaaccatccgtcaggatcgtactacagcgacttgagaaaatcccacggatataaggaaccgcataaaattaaaacatggtgcctcggcaatgaaatggacggtccatggcaaatcggccataaaacagcggccgaatacggaagacttgctgctgaagccgcgaaggtgatgaaatggacggacccgtcgatcgagcttgtcgcctgcggaagttcgggaagcggaatgccgacattcatcgactgggaaacgaccgtgcttgaccatacgtacgaacacgtcgagtacatctcgcttcactcgtattacggcaaccgcgacaatgatcttccaaactatttggcgagatcgctagacatggatcactttatcaaaacggtcatctcagtctgcgactatatgaaagcgaaaaagaaaagcaagaaaacgattcacctttcatatgatgagtggaatgtctggtatcactcgaatgaaaaagacaaagaagctgaacgctgggcgaaagcgccgcaccttcttgaagacatctacaactttgaggatgcgcttctcgtcggctgtatgctgattacgatgctcaagcatgccgaccgcgtgaaaatcgcctgtctggctcagcttgtcaatgtcatcgcgccgattatgacagacaaagggggagaagcatggcgtcagaccattttctatccgtttatgcacgcttccgtctacggcagaggaacggtactgcagacggcggtatcgtctccaaagtatgatgcgaaagactttacggatgtgccgtacttggagtccgtgtctgttttcaatgaagaagccgaggaattaaccgtttttgccgtcaaccgcgcaacagacgccggccttgaaatggaagccgatatgagaagctttgaagggtacagtgtctctgagcacatcgttctggaacacgaagatcataaagcgacgaatgaaaaagaccgcaacaacgtcgttccgcacagcggcggagacgccaaagtatgtgacggcaggctgacggctcaccttccgaagctttcctggaatgtgatcagaatgaagaaacaatga

SEQ ID NO: 2909 - DNA, 843 bp, Bacillus licheniformis
atgcgtcctgccggaggcctcaacattgcgaaagtagctctgtttctgctgtttgcgatattaagctttttgtttgtgtttccgctcttctgccttgtactcggctcgctcaagccatcttcggaattgctgcgcttcggcctgaatttaaagctgagccctgaaatcctgagccttgacaattacacttacttgtttaacggaggcagcatttattttcaatggttttcgaacagcttgattctcgtggtgatatccaccgtgctgacgctcttgttttcttcaatggtcggatacgggcttgccgtctacgactttaaaggaaaaaatctcttgttcgtagccgtgctcctgatcatgatggtgccgatcgaaattctcatgctgcctttgtttaaaatgacggtttctcttcatattgtcgacacatacgccggtgtgatcctgccgtttatcgtctcgcctgtagccgtgtttttcttcagacagtatgcgctcggcctgccgagagatttgcttgattccgcgagaatggacggctgcacagagttcggcatttacttcaggatcatggcgcccttgatgaagccggcatttggagcgatgatcattcttcaatccttaaacagctggaacaacttcttatggccgctgatcgttttgcgatcgaaagaaatgtttacgctcccaatcggactgtccgctttgctcagtccgtacgggaacaattatgacatgttgatttcgggttctgtgctggcgattctgcccgtgattctcatcttcctgttcttccagaagtactttatatcaggtttgacggcgggcggaatcaaaggctga

SEQ ID NO: 2910 - DNA, 945 bp, Bacillus licheniformis
ttgaagactgttaaaacagatacagtgcattcgtttccgccggtgagcagaaaaagaaagatcagacgtttattatattcagcaaaagccgcaccctacatttttacagcaccttttgtactctccttttgcatattttttctttatccgcttatcagcgtcgtcatcatgagttttcaaagcattctccccggggaagtccgcttcatcgggacggagaactataaagcattaaacaatcctacattttataccgcactattcaacaccgtaaaatacaccttttggacattgctgattttaatacctgttcctcttattctggcagtctttttagattctaaactcgtaaagtttaaaaacgtgttcaaatcggctttattcatcccggctctgacttcaaccattgtggcggggattattttcaggctgatttttggagaaatggatacatccctggcgaattcgatattggctaagctcggaggttcgccgtacaactggctgaacaatgaacataccggcatgtttttaatggtgatgctcgcatcttggagatggatggggatcaatgtcctgtactttttggcgggcttgcagaacgttccgaaagaattgtatgaagctgccgaaatcgacggggcaggcacgttcaagaagttttaccatattacgcttccgtttttaaagcccgtcagcgtctacgtgctgacgatcagcatcatcggcggcttccggatgtttgaagaaagctacgtgctgtggcagaacaactctccgggcaacatcggcctgacgatggtcggatacatttatcagcaggggcttgcctacaacaacatgggctacggatcggcgctcggcatcgtgctcttgatcatcattttcatctgcagcctcatttcattaaagctgtctggatcttttaaaaaggagggctattaa

SEQ ID NO: 2911 - DNA, 1305 bp, Bacillus licheniformis
gtgaaaaggttcctttcatctatctttatggtcacggtcgctgtatgtttgcttttatcggggtgcaaggcgagtcctgcctccgatcaagcggacggcaccgaactgacattttggacattcaacggccttcatgaacagttttatgctgagatggtgaaagaatggaacaaaaagtatcccgagcgaaaaatcaaattaaatacagtggtgtatccgtatggacagatgcatgacaatttatctatctcgcttttagccgggaaaggggttccagatattgccgatgttgagctggggcgctattcgaactttttgaagggctctgacattcctcttaccgatttaacgccgcttgtggaggacgaacgcgacaagtttgttgaagcgaggctgacgctctacagcaagaacggcaagctttacggacttgacacacatgtcggaactaccgtgatgtattacaacatggaaatgatgaataaagcaggcgttgatccggacgacatcaaaacatgggaagattacagggaagcgggcaaaaaggtcgtcaaagctctcggaaagccgatgacgacgattgaaacgaccgacccgaattcatttctgccgctggtttcccagcagggatccggttactttgatgagcaggggcggttgacattaaacaatgagacaaacgtgaaaacgctcgaatttttaaagactttaattgagaaagacaaaattgccgtcacaacgcccggaggcaatcatcacagtgaagagtattacggatttatgaaccaaggcggcgcggcgtctgtcttaatgccgatctggtatatgggccgttttttggattatatgcctgacttgaaagggaaaatcgcgatcagaccgctgccggcatgggaagaagggggagaccgctcagcgggaatgggcggaacggccaccgtgattccaaaacaggcgaaacaggtcgatctggccaaggatttcttgaaatttgccaaagcgtcaaaagaaggcaacatcaagctgtggaccgtgctcgggttcgatccgctcagatgggatgtgtgggactcggacgaattgaaaaaaccaaatcaatatacagaatactttcaaaacggacaacacatcttttccgtgcttcttgacataaaggatgagatcaatccgctttaccttactgaggattatgcgaagacttccgatctcgtcaacagaaacatactgtacgaagcgctcaaaacgaagagcaaaacaccgaaagaagcattggacaaagcagcagctgaagtgaaagggcaatag

SEQ ID NO: 2912 - DNA, 1206 bp, Bacillus licheniformis
atgaatgacttgatctcttatgtgaaaaaaactttgggcgcatgcgaatgcggaaccgtccaccacccgcttacagtcgaaaaaatcgcgatcggcgacaatgctgttgagcaagagctgcccgctttcgtgaaatcggcttcctataaaaaagccgctgtcatttatgatgaaacaaccggacggttagccggcaagcggattgcctctcttcttgaggaaacggctgaaacggttccggtgctgctggaagctaatgaagcgggcgatgtgacggcggatgagcaaacattggtgagtgcattgatcggtgtaccgattgatgcggatgtactaattgcggccggagcgggcacgattcacgacatcgtcaggttttgcgcctatcagcgcggcattccgtttatttcagttcctacggctccgtcggttgacggttttacttcagccggcgcaccgctgattttaaaaggaaagaaacagacggttcaaacgacagcgccgatcgcgctttttgccgatttggagctcttgtgtcaagcgccgcagaacatggtagccgcaggttttggcgatatgctcggcaaggtgacgtcgcttgcggattgggagatttcccgcttgcttgccggcgagccgtattgtccggccgccagccggctcacgagggaagcgcttgatcaatgtcttgaccgaaaagatgacatcgccgccaagatgcgggatgggattgagaaattgatggaatcgctgatcctttctggcctagtcatgctggttctcgaccattcaaggccggcttccggcggcgagcaccatctttcccactaccttgaaatgaaagcgctggagaacaataagcggcaagtgctccacggtgctaaagtcggctgcagcgcgattatgctgactgacatttaccgatctcttatcggtgcaagcctgggtgatcaacacgctgagcaagcgattcgctccgtttatgaaaagctccctgacggtaagaaaatggcagagtggatgaggcgtatcggcgggcctgtatcattcaaagaactcgatgttgaagaagagctggtgagagaagcgctcgcatacgcccatcagctcagagaccggtatacgggactgaaaatcatcaatcaatacggccttttgccggggcttttaggcaaaggaccaggcgtgaaaggggttaaaatgtga

SEQ ID NO: 2913 - DNA, 687 bp, Bacillus licheniformis
gtgctggaatctttgaaagaacaagtattaaaagcgaatttgcagcttgaagaataccggcttgtcacctttacatggggaaatgtcagcggtattgaccgggagaataagctggtcgtcatcaagccgagcggtgtcaaatacagcgatttgaaagccgaagatttagtggttctgaatatggacggcgagattgtggaaggggatctgaagccatcttccgatacgccgacacacctctatctttaccggcagtttcaatcgatcggcgggatcgtccatacgcattccccgtgggcgacaagctgggctcagtcagggaaggacattccgtcgctcggaacgactcatgccgactactaccacggcgacattccgtgtacacgggaaatggatcccgatgaaatcaggagtcaatacgagctgaatacaggaaaagtgattgtagagacgttccggcatcttgaccccctggcggtgcccgccgttctcgtgaacaatcacgggccgttttgctggggaaaagacgccttaactgccgtacacaatgccgtcgtcctggaagaagtcgccaagatggcgtaccgctccctgatgctgaatccgtctcttaagcggattaagagcgctttgcaggataagcattattttcgaaagcacggggcagacgcctattacggccaatag

SEQ ID NO: 2914 - DNA, 1659 bp, Bacillus licheniformis
ttgtcagggcgtgcagttctcgtcgatgtccggacaggtgaggaaatcgcgacagctgtcaaagagtacacgcacggggtgatagaccgggagcttccggtctcaaagcgaaagcttccgagagactgggcgctccagcatccggccgattacattgaagtgctggaggaaacgattccgagccttttgaaacagtcaaaagcggatccgaaagaaatcatcggaatcggaatcgatttcacggcttgcacgattttgcccgttgacgagaacgggactcctctttgtatgagggaagagtatgcgtcggaaccgcacagctatgtgaagctttggaagcaccatgctgcacaggagcaggcgaatcgcttaaatcaaatcgcggaagaaagaaatgaaccttttcttcaaacatacggcgggaaaatttcttccgagtggctcgttccaaaagtgatgcaaatcgcggaagaagcgcctgacatttatgatgccgcagccgagatcatggaagcggccgactggatcgtctatatgctgtgcggaaccagaaagcgcaacaattgcacagcgggttataaagcgatttggaacaataagagcggctatccttccgacgatttcttcgcaagcctgcatccgaagctgaaaaatatcgttcgggaaaaactaacggaggatatttattctgtaggcgaaaaagcgggcggactgactgaagaaatggccgggaaaacagggcttctggcaggtacggcggtcgctgtcgcaaatgttgatgctcatgtgtcggttccggcggtcggcatcacagagccgggcaagatgctgatgatcatgggaacgtctacctgtcatatgctgctcggcgaggatgtcaggatggtgccgggaatgtgcggcgtcgttgaagacgggattctgccgggctatgtcggctatgaagcgggccaatcgtgcgttggcgaccattttcattggctgattcaacactttgttccagaagcgtatttgaaagaagctgaagccgaagggatttccatttacgaactgctgtctcaaaaggccggcagtctccaaatcggtgaaagcggtttgcttgcattggattggtggaacggaaaccgttcaacactcgttgatgccgatctgacgggaatgctgctcggtatgacccttgccactaagcctgaagagatataccgtgcattggttgaagcgactgcctacgggacgaggatcattattgaaacgttcagacaaagcggcgtgccgatcgaggagctgtatgccgcaggaggaatcgccgaaaaaaatccgtttatcatgcaggtttacgcggatgtcaccaacatggaaatcaaaatttccggatctccgcaggcgccggctttaggttcagcgatattcggagcgctcgcggccggaagcatgaacggcggttacgaccatatcgaagaagcagtcgcacatatgggcaagatcaaggataaaacgtacaaaccaattcctgaaaacgtttccttatacgatcagctttatgcggaatataaggagctttacacgtacttcggaaagcaaaacaatgtgatgaaacgccttaaaaaattgaaaaacatccagtcccttagttctgacaccggtaaagcgatggcttag

SEQ ID NO: 2915 - DNA, 1482 bp, Bacillus licheniformis
ttgattcaggcaaagacgcatgtgttttggtttgtgacaggcagccagcatttatatggcgaagaggcggtacaagaggtagaagagcattccaaaatgatctgcaacggattaaatgacggagatttaaggtttcaagtcgagtacaaagcggtggccacttcgctggacggcgtcagaaaactgtttgaagaggcgaaccgggacgaagagtgcgcaggcatcatcacctggatgcatacgttttcaccggccaaaatgtggattcccggcctttccgagctgaataagccgctgctccattttcatacccagtttaaccgggacattccgtgggataaaatcgacatggatttcatgaatattaatcagtctgcccacggcgaccgcgaatacggttttatcggagcgagattgggcattcctcgaaaagtaatcgccggatattgggaagacagagaagtaaagcgctcgatcgacaaatggatgagcgcagcggtcgcatatattgaaagccgccatatcaaagtcgcccgatttggggacaacatgcggaatgtggcggtaacagaaggagataagattgaagcgcagattcagcttggctggtctgtcgacggatatggaatcggcgatctcgtcacggagatcaatgctgtatcagaacagagtctaagcgagctcatctccgaatatgaggagctttatgagtggccggaaggcgaagcggcaagggaatccgtcaaggagcaggcgcggattgagcttggattaaagcgctttctttcgagcggaggctatacggcctttacgacaacctttgaagacctccacggcatgaagcagcttccgggtttggctgttcagcggctgatggctgaaggctatggctttggaggagaaggagattggaaaacggctgcgcttgtcaggatgatgaaaatgatggccggcggaaaagaaacgtcatttatggaggattacacgtaccattttgaaccgggcaatgaaatgatcctcggctcccacatgcttgaagtgtgcccttcgattgccgaacacaaaccgagaattgaagtccatccgctgtcaatgggtgcaaaggatgatccggcgcggctcgtgtttgacggaattgcaggtcctgcggtcaatgtctcccttattgatttgggcggacgtttcaggcttgtcatcaataaagtggaagctgtgaaggttccgcatgatatgccgaatcttccggtggcgcgcgtactttggaagcctcagccgtctctgagaacatcggctgaagcgtggattttggctggcggtgctcaccatacatgcctttcgtaccagctgacagccgagcagatgctcgattgggccgaaatgtcgggcattgaagcggtgttgatcaatcgtgatacaacgattttaaatcttcgcaatgaactcaaatggagtgaagctgcatatcggcttcgcaagttttaa

SEQ ID NO: 2916 - DNA, 963 bp, Bacillus licheniformis
atgaaaaatgtgttgcggaaaatgtctttggcggccttgatattcggactgctgctgtctttttcgatgcctgaatcaggcaaagcggcgttttgggacacaaaaggggacaatttcatccatgacccttctatcattaaagagggaaatacatggtatacatttggaacagggctcggcacagggctgcgtgtcattaagtcaacagacgggagaaactggagtgctgccccgagtatttttccaactccattgtcatggtggaagatgtacgtaccaaatcatgaaccgcatcaatgggcaccggatatcagctactataacggccggtattggctgtactactcggtttcgtctttcggttcaaacacatcagcgatagggctcgcatcgacagaccggatttcatccggccaatggcgggatgacgggctggtcatcaggtcgacatccggcgatcagtttaatgccattgaccctgatctggtcattgacaaagacggaaacccctggctctcattcggttccttctggagcggcattaagctgacaaggcttgataaaaacacgatgaaaccgacgggaagcctgtattcgatcgcctcaaggccgaataacggaggagcggttgaagccccgaacattacctacaaagacggctactattacttatttgtctcgtttgacagctgctgcaaaggggtggacagcacatataaaatagcctatggccgttcaacgagcattacgggaccctattatgataaaagcggcaaaaatatgatgaacggcggagggacgatcctggactccggcaatgaccgctggaaagggccgggacatcaggatgttctgaacaactcgatccttgtcaggcatgcttacgacgcgctggacaatggtgtatcaaagctgctcatcaatgacttgtactgggattcccaagggtggccgacttattaa

SEQ ID NO: 2917 - DNA, 1086 bp, Bacillus licheniformis
atggcaaagcttgatgaaacattgatgatgctaaaggaattaactgatgcaaaaggaattccggcgaatgaaaaagaacccagacaagtcatgaaatcgtacatagaaccgtttgccgacgaggttacgacagacagactgggaagcttaatcgcaaaaaagactggacaggctgacggaccgaagattatgattgccggccatcttgatgaggtcggttttatggttacgcggatcgatgacaggggctatctccgctttcagacggtcggaggctggtggagccaggtcatgctggcgcagcgtgtgacggtcgtgacaaagaaaggcgacatcaccggtatcatcggttcaaagcctcctcatgtcctgtctcaggaggcgagaaaaaaatcggtcgatattaaagatatgtttatcgacatcggggcgtcgagcagggaggaagcgatggaatggggcgttcttccgggagaccaggtcgtcccttactttgaatttacggtgatgaataatgaaaaaatgctgcttgccaaagcatgggacaaccgtatcggctgcgcgatcgcaatcgacgtgctgaaaaacctgaaaggagccgatcatccgaatgtcgtctacggcgtcggaaccgtacaagaggaagtagggctgagaggcgcgaaaacagccgcgcatacgatcaagcctgatatcgctttcggtgtcgacgtgggaattgcgggtgatacgcctggtattaccgaaaaagagtcggcaagcaaaatgggaaaaggcccgcagatcatactttatgatgcatcaatggtgtcccataaagggcttcgcgactttgtaacgaatgtggcagatgaagccggcattccgtatcaatttgacgccctctcaggcggaggaacagattcaggatcaatccaccttaccgcgaacggagtgcctgccctgtcgatcacgatcgcgacgaggtatatccatacgcacgcggccatgcttcaccgggatgactatgaacatgcggtaaaattaattaccgaagtcattaaacgactggataaagagacggttcaaaacattacgtttgactga

SEQ ID NO: 2918 - DNA, 402 bp, Bacillus licheniformis
atgattgtcatcatattgagactggctttgctggcgcttttggtctacgtcgtgtacagggccgttcaatttttggggagcccggacagaaggctgaaatcagcacaggcaaaaaagcacttttatgttttggacgaacaaaagaatacacgcaaaaatctcaagctgacatttaaaggcgtgcttttcgaaggagaaaaacacattccttcaaaagaccatccgctgttcatccatacgatttttgtatggacggaagcgcctgaagaaaagctcagctcttttacggaagaagacttcgcggaacttgaagaaaatattaaagagcactatcccgattgcaaaatcgactgggattcgaacatccaaaagtggaaaaacaaaaaagcagaagagcaataa

SEQ ID NO: 2919 - DNA, 264 bp, Bacillus licheniformis
ttgactctcatatggatatacatgatcctcataaacggatacggttttttcttaatgaaagccgataagcaaaaagcggtcagaggcaaatggagggtgtctgagcgccgcatctggctcgttgcggctgcttttggctccgcaggcgtctggttcgggatgatgcggttcagacataagacaaaacacctttccttcaggctcggcattccttttttgctcggcgtgcaagctgttttgaccggcttttatatgatgaattaa

SEQ ID NO: 2920 - DNA, 360 bp, Bacillus licheniformis
atgccaagagtaaaaggcggaactgttacacgcaaacgtcgtaaaaaggttctcaaattagcaaaaggttattttggttcaaaacatacattatataaagtagctaaccagcaggttatgaaatcaggaaactacgctttccgcgaccgtcgtcagaaaaagcgcgatttccgcaaactttggatcactcgtatcaatgctgcagcgcgcatgaacggtctttcttacagccgtttaatgcacggtcttaagctttccggtatcgaagtaaaccgcaaaatgcttgctgaccttgctgtaaacgatctgaacgcattcaatcagcttgcagacgctgctaaagcgcaattgaataaataa

SEQ ID NO: 2921 - DNA, 201 bp, Bacillus licheniformis
atgccaaaaatgaaaactcaccgcggatctgcgaaacgttttaaaaagacaggttccgggaaactgaaacgttctcatgcatatacaagtcacttgttcgcaaataaatctcaaaaacaaaagcgcaagcttcgcaaaagcgcagtcgtaagcgccggcgatttcaaacgcatcaagcagcagcttgccaacattaagtaa

SEQ ID NO: 2922 - DNA, 561 bp, Bacillus licheniformis
atgagttgtgaaatcaattcaaagattctatggaggtggctcattattagcaaagatcaattggttaatgagggtatccgtgcgcgtgaagttcgtttgatcggacaaaatggcgatcagcttgggatcaaatcccgccaggaagcactggaaattgcgggtcgcgcaaatcttgaccttgtgttggttgcagcgaatgcaaaaccgcctgtctgccggatcatggactatggaaagtacagattcgagcagcagaagaaggaaaaggaagcacgcaaaaatcaaaaaatcattaacttaaaagaagttcggctgagccctggtattgaagaacacgacttcaatacaaagcttcgcaacgccatcaagttcctgcaaaaaggggacaaagtgaaagcgtccatccgctttaaaggccgtgcgatcacgcataaagaaatcgggcagcgcgtgctggaccgtttttcagaagcctgcgcggaagtggcgactgttgaaacgaagccgaaaatggacggccgcagcatgttcctggtgctcgcgcctaaaactgaaaagtaa

SEQ ID NO: 2923 - DNA, 684 bp, Bacillus licheniformis
atgacaccttatttcggtatcgtcgtttcactggccgcatttggcaccggcacttttttatttaaaaaatcaaatggttttttcttattcacgcctctgtttgtcgcgatgattcttgggatcgcgtttttaaaaatcggcggtttttcatatgaggactacaagagcggcggagacatcattaagttctttttggagcccgccacaattgcgttcgccattcctttatataaacaggcggacaagttgaaaaagtattggctgcaaatccttggtgccattattgcaggctccgtctgctcggttgccgtcgtctatctgatcgcaaacgcgctccatcttgacggagccgtcatgaaaagcatgctgccccaggccgccacaacggcgattgctcttcctttatcaaaagggatcggcgggattcaagatattacggccttcgccgtcatctttaacgcagtgatcgtctatgcgctcggcgcgctttttttgaaaatcttcaaagtgcagcatccgatcgccaaagggttggcgctcggaacatcaggacatgccctcggcgtcgccgtcggaattgagatgggggaagtcgaagcggcaatggcgagtattgcagttgtcgtcgtcggcgtcgtgaccgtgtttgtcgttccgttatgtgttcaaatgatcggcggatag

SEQ ID NO: 2924 - DNA, 414 bp, Bacillus licheniformis
atgaagggtaaaaaagaatacggctttttaactcaggcatttatttttgctgttatgatgtttatttcaaacggaatcgccgcggttctgcccatcccgattcctccatctgtcatcggtttggtgctgttgtttgcattgctgtgtacgaaagtgctgaagcttgaacaagttgaatcgctcggcacggcgctcacttcgctgatcggctttttgttcgttccgtcgggaatatcagtgatgaattcgctcggcgtcatggagaaatacggattgccgatcgtcctcgtgattttcctggccaccgtcattctgcttgcagcgacaggattgttttcacagttcattctgtctgtcggcaaaaaggaccgtcaagacacacgagttgaaccagccaaaaaaacagcatcttga

SEQ ID NO: 2925 - DNA, 1557 bp, Bacillus licheniformis
atggaccattcaagaggaggccgctttgttccgtctggcgaatttgcatctttggcaaggcgcggcttgatgcctgaagacgcttcaatcgccgcaggcgcgccccgatttgcagattatccattcaagcttggagtggcttcaggagacccgcatcccaacgggtttgtcatctggacgaggcttgcccccgatccgcttgccgaagacggattagggggaatgcctgacaaagctgtccctgttcagtgggaagtagctgaagatgaacattttcacaaagtggtgaagcgcgggacgtcctctgcgctcgctgagcttgcccactccgttcatgttgaagtgcacggtttaaagccgggaagctattattggtacaggtttaaagcgggcagggaaatcagccggacaggccgtacaaaaaccgcgcctgccccgcacgccgacatcaaggggatgtcgttcgccctcgcctcgtgccaagcttggtaccacgggtattttacggcttaccggcatatggccgaagaccatccggacgttgtttttttcctcggagactatatttacgaatatgccattaatgctaaaaatcttttccgcgatgtgactttatccgctgcccacaacgcaaaaaccgtcaccctcagccaatacagactcagatattctctttttaagacagatccggaccttcaggccattcatgcgctggctccctgggttgtgacgatggatgaccatgaggttgaaaacaattatgccggcatccattcgcaatacaacacttttccggacgattttctccggcagcgcgcagcggcgtatcaagctttctatgaaaatatcccgatccgcagcacatcgattccaaaggggcctgacatgctgatgtacaggcggttccgctatggaaacctggctgaattcaatgttttggacacccggcagtaccgcaataattttccggcaaatgaggctgaacggcttgagccatcccgctccatactcggatttgaccaggagcgctggctttttcacggcttgagccggtctgacacgatttggaactttttagtccagcaagtcgtgctggctcaaatcgaccgcgacacaggtcctggagttgagtacagcacagaccagtgggacggctttcccgcttgccgcgacaggcttttttccgcatacaaggcatacggcatccaaaaccccgttgtactgacaggggatatccacagacatgccgccgccgacttaaaagcggacttcgatgatgcggggtcagcgacaatcggaaccgagctgatcacaacttcgatatcttcggacgctgacggcagcgagaccgattctttggcgccgatctggctcggaaacccgcatgtcaaactgtacaatgcacagcgcggctatgttcgctgccgcttgacgccccggcagctcgaagccgactttcaggttcttccttatatcacacgtcccggcgctccagcctcaacttatgccaagttcgccgttgaagcaggacgccccgggctccagcgcatgttttag

SEQ ID NO: 2926 - DNA, 723 bp, Bacillus licheniformis
atgctcaaggtattaatcgtggatgatgaaatgtttgcgcgggacgagctgagatatttactagagcagactgaagaagtggatgcgattgacgaagctgaacatatcgaagaagcgtttgacaaaatggcggatcgcaaacccgatatcctcttcctggacatcgatctgtcaggggagaacggttttgacattgcgcagcggctgaaaaaaatgtcggcgcctccggctgtcgtttttgcgaccgcttatgatgaatatgcgctgaaagcatttgaagtggatgcgattgattatttgacaaagccgtttgatgaggagcgaatcagacagacaatccacaaatataaaaggatgcgccccggcaaacaggaggagcggcagcttgcaggccaccacaggctggctctcagcattgacgaatcgatcgtcgtgctcgatcccgatgaaatcgtatacgccgggttagaaggcggacacgtcacagtgaagacttttgatcaggcatacacggttcacgatacattggttgtactcgaacaaaagctttcgcagacggcattgatcagggtgcacagaagttttctcgcaaatatggatcatattaaacaggtcaaaccctggttcaattcgacatacaacctcctgatgaaagacggctccacgatccctgtcagccgtacatacgcgaaagagctgaaaaaacggctgcatatggtgtga

SEQ ID NO: 2927 - DNA, 1785 bp, Bacillus licheniformis
atggtccaactcatgattatgatgctggagagagtggggatcatcgtcattctgggctttatgttggcccatatgaaggtgttccgtcagcacctacagcatccggaagggtataagggcaagggagttctcatctttattttttccttgttcagcatcatcagcaactatacaggcattgaaatccgggagcgcgagattttgaacaatgactggattttcgcaatcgacccgtcaagctcgattgccaatacgagaattctcggcgtcgaaatcggcggcttgatcggagggccgtttgtcggagcgggtgtcggactgctctcaggcattcaccgtttttcactgggagggacgacggctttgagctgcgcggtttcttcactgctggcaggtgtcattgcgggttatatcggcagctttttcaggaatcggcaccagatggtgacaccgcgggtagccgctcttgcgggcatttgtatggagggcctgcagatgcttatgattctcgtgcttgcaaaaccgcaggctgaggcacttgcgcttgttcagatgatcggcattccaatgatgattgtcaacgggacgggcagctttatttttctatcgatcattcagtctattatccgcaaagaggaacaggcgcgggccgttcagacccataaggtattttcgatagcggatcagacgcttccttttttccgccggggactgaatgaggattcctgcaaaagcgccgctctcattatacaccgcatgacagggacggatgccgtatcgattacggatagagagaacattctcgctcatgtcggagatggagcagatcatcatattccttcgaaaaatctgatcaccggtttatcgaaaaaagtcattcaaaccggaaaggtcatgaaagtgaagtcgcgcgatgaaatcgagtgtgcgcaccgttcctgtccgctgcaggcggcgatcgtactgccgctcttctccaaccgcgaaacaatcggcacgctgaagctgtacttcaagcacccgtccggtcttaaccgtgtgacggaagagctggccgaagggcttgccatgcttttttccactcagctagaactcggtgaggctgagctgcaaagcaagcttttgaaagatgccgaaatcaaggcgcttcaagcgcaggtcaatccgcactttttatttaatgccatccatacgatttctgctctgtgcaggacagatccggaaaaaacgcgaaaacttctcttgcagctgagcgtttattttcgttccaatctgcagggagccaggcagctgatgattccgctttcaaaagagctgaaccatctggaagcctatttatcattggagcaggcccgatttccgggcaagtatcatattgattttcatatcgaggacggccttgaaaatatggaaatccctccttttatcttgcagctgctcgttgaaaatgcgcttcgccatgcatttccgagaaaacaaaaggtatgcacggtaaaagtatccgctgtgagagagcgggacggcgttttgatgaaggtgtcagacaacggcaggggaattaatccggagatgcttggacagctggggcaggcgcccgccccttcaaaggaaggaaatgggacggcgctttacaatgtgaaccagcggctcaccggtttgttcgggcaccaggctgctctgcagattgccagcgaacttgataaaggaacagagatatccttcaagattccttttcaaaccgaaagagaggggaacagagatgctcaaggtattaatcgtggatga

SEQ ID NO: 2928 - DNA, 228 bp, Bacillus licheniformis
gtgaaaaaacgctgggtattttggtggatttgcaacatattgtggacggccgtttttgtaatcggagcagctgttgtttggctgagagatgttgatggcgctggtgttgctcaaacacctgaacttaaattaatagcatttatcgttttgttaattgcatttatatttccattcatcattcaagttgtgtggctgattgttaatttcaaagtgggaagcagcaaataa

SEQ ID NO: 2929 - DNA, 831 bp, Bacillus licheniformis
atggcagaggagaagatgatgaaagccgtattttttgatttagacgatacattgctctgggatgaaaaaagcgtcagcacagcattttccaaaacgtgccttaaagctgaagaaaaatacggaatccatgcggaagaatttgaagcagccgtgcgcgaagcagcgcgaaagctttacatgtcttatgaaacatatccatacaccgtcatgatcggcatcaacccatttgaaggactgtggtcaaacttcagcgagccgatcagcgaagggtttcaaaaactgaacaaaattgttcccgaatacagaagaaacgcatggacaaacggattgaaggcgtttggcatcgacgatcccgccttcggggaagaactcggcgaatattttgcggcagtgcgccgaaagagcccttttgtttatgaagaaacatttgccgttttagatgagctgaaaggaaaagtagagcttcttttgctgacaaacggcgatccgagcctgcagaaagaaaagttggcaggcgtaccggaacttgctccttattttaatgaaatcgtgatttccggtgaatttggaaaaggaaagcctgatccaagcatatttgaacactgcctcaccctcctcggcatgacaaaagatgatgccgtgatggtcggagacaacttgaacaccgacattctcggggcttccagagcaggcatccaaaccgtctgggtcaaccgcaaaggcaaaaagaatgaaactgatgttgcacctgatcacgaaatcagccatttaagcgaactgttcgatatcctccgcggacaagcagcggacaagctaagcaaaaaagcatga

SEQ ID NO: 2930 - DNA, 1932 bp, Bacillus licheniformis
atgtcagatatggtaaaaatcaaatttcctgacggagcggttaaggagtttgcaaaagcgacgacaacagaagatatcgcggcatcaatcagtcccggcttaaagaaaaaagcgatagcggggaaattaaacggcaaagaaatcgatctgcgcgcaccgatccttgaggacggcgccatcgaaatcattacagaaggcagcgaagaagcgcttgaaatcatgcgccacagtactgcacacttaatggcccaggcgatcaagcgcctgtataaaaacgtgaagctcggggtcggcccggttatcgaaaacggcttctactacgacgtggatttggaagaagcgctgactccggaagaccttccgaagattgagaaggaaatgaaaaaaatcgtcggggaaaatctgccgatcgtaagaaaagaagtcagccgagaggaagccagagccctgtttgccgaaatcggcgatgatctgaaattggaactgcttgatgcgattccggaaggcgagacggtatcgatctatgagcagggcgaattcttcgatctgtgccgcggtgttcacgttccttcgacgggcaaaatcaaggagttcaagctgctgagccttgcgggggcatactggcgcggagacagcaacaacaagatgctccagcgcatctatgggacggctttcttcaaaaaagccgagcttgaagagcatcttcgcctccttgaggaagcgaaagaacgcgaccacagaaaactcggaaaagaactgaagctgttcgccaattcgcaaaaagtcggccagggtctgccgctttggctgccaaagggtgcgaccatcagacgcgtcatcgagcgctatatcgttgacaaagagctcgcgctcggctatgagcacgtgtacacccctgtcctcggcagcaaagacctgtatgaaacatcaggccactgggatcattatcaagacggcatgttcccgccgatggagatggacaatgaaacacttgtgcttcgtccgatgaactgtccgcaccatatgatgatttataaaaacgacattcacagctaccgtgagcttccgatccggatcgccgagctcggaacgatgcaccgctatgaaatgtcaggggctctttcagggctgcagcgcgtccgcggaatgacgctgaatgacgcccacattttcgtccgtccagatcaaatcaaagacgagttcattcgaactgtccgcctgattcaggatgtatacgaagacttcggactggaagagtattcattccgcttgtcttaccgcgaccctgaagatacagagaaatactacgatgacgatgaaatgtggaacaaagcgcaatcgatgctgaaggaggcgatggacgagatcggccatgattattacgaagctgaaggggaagcggccttctacggaccgaagcttgacgttcaggtcaaaacagcaatcggcaaagaggaaactctgtcaactgttcagctggacttccttcttcctgaaaaattcgatctgacatatgtcggggaagacggaaaacctcatcgtccggtcgtcattcacagaggtgtcgtatcgacaatggaacgctttgtcgctttcttaattgaggagcataaaggcgcattgccgacatggcttgcccctgttcagttccaggtcatccctgtatcgccgtctgtgcatcttgactacgccaaaaaagttcaagagcgcctgcagcgtgaagggcttcgcgttgaagtcgatacccgcgacgagaaaatcggctataaaatccgtgaagcgcagatgcaaaaaatcccttacatgcttgtcgtcggcgaccaggaagttgaaaacgaagccgtcaacgtccgcaaatacggagagcaaaaatcagaaacggttgcaattgcagactttatcaaaaaagccgttgctgaagcaaagaaataa

SEQ ID NO: 2931 - DNA, 843 bp, Bacillus licheniformis
atgcttgaaattacatttgaagatgattatgatacagccgcgtttttgcatctccttcgcaatgcggatgcgaatcggcatatcaggattcacgaagcgccagggaagatcggaattgaaaagacccattcctctgtcagtattcaggcctatattgagccggttctgacgagattttttacagaatgcaaagaagatgaatacatgctttcggtcattgaaggcgattattactttttggaccgggatgaacagcagcagattcttcaattggcccacagcattatggagggcgaacttgaagggcttcctctcaacaaggacgacacccctcgcgaacattacatcattcaggagctccaagcgatctgtcttgaggaaaacgtcttttcgattcggtcatttatgacgtttcgccttgcgaagtattatgaacgcctcagatcttatgtggaggcggcgatcgacgagtataaaatggagcaggaatatcagacattcattcaatcgctgagagactacgtcatgtcgaaagagccgatgcttgaccatgtccacattgtgcacgacggttactttgtattgtgggaattaaagtatatttctgaacgggaacaaaaaaaatacatagacaggcggttcgtaagagaacacccaatgtatattgattcccatctcctggctccgctcgtatcgattgcgccggaaaaaatagacctctatacagaagaccgggaacacgccatggttcagaccattcaaaatatttttcaggagagggtgcggattcttccgcttggcgcctttcatccgcgggaaaacattttggaagagcattcttga

SEQ ID NO: 2932 - DNA, 633 bp, Bacillus licheniformis
atgcgaaaaagaaccttggccaaatggacggtaatcgccgtaatcgcggcggccggactatggctgaatgcgaaatacctgaatctgagccctgctcatataagagaaggcgtcttatcctttgggattttcgccccgttgatctatatcggactattgatgatccggccgtttttgctgcttcctgcttccgttttcgccgtcagcggcggcctcgcattcggtccgctgtttggctctttgtattcttttatcggtgcggcaggcggtgcatttttatcattcgctcttgcatacaggctcggcggatactttcagcacatgccgctgaagctcgacagcctgcggacgcttttgcggaaaaacggctttttctgcattttgctcttgaggctggcgccgattcattttgacgcggtcagctatgcggcaggcgtttccaaagtgaagcctctgtcgtttgccctggcgacggccgcgggtatcataccgggcaccattattttaaacgtgctcgggtcaagcctcttgaccggcgacatcctagcgattgcggttacagccgcaatttacctgatattcattacagtgccgcttttgttcagaaaaaaagtgcaggcgctcctcgattaa

SEQ ID NO: 2933 - DNA, 933 bp, Bacillus licheniformis
atggagccgattaaacgcgctttgcaaggcgtgacgacgagacccgattttaaaaaacgccttgaagatatgaaagaaaaagtgctctctgacaaggatgttcaggcgtttttaaacagccgccagtcagaagtggatcaaggaatgatcgacaggagccttaacaagctttatgaatatacacagcaaagcaaagcatgccaagactgcccgggtctgaaagaatgcaaaaacctgatacagggttatcatccaaagcttgtgctgaacggaaaaacaatcgatgttcaatacgataggtgtccggaaaaaaagaaagcggacgagagggaaagacagaggtcgctgattaaaagcatctatattcaacaggatcttctgaatgctacgtttgccgatattgacggagatgacccgagcagattgaaggtccttcagcttgtgacgggattcttgcatgactataacgaaacgggaaagggaaaaggcatttacgtctacgggaagttcggggtcggaaagacctttatgctggccgccattgcaaatgagcttgccgcaaaggatcatccgtccattctcgtctatgtccctgaatttgtcagggagctgaaaaatgcgatacatgatcagtcgcttgaggaaaagcttgatatggtcaagtctacgccgattctgatgctcgatgacatcggtgcggagtccatgtcaagctgggtgagggatgaggtgctcggcgccatccttcagcacagaatgtcccagcagctgccgacgtttttctcttcaaactttgatcctgatgaactgaaacaccatttcacctattcgcaaaggggagaaaaagaagaagtaaaagcggcaaggctgatggaaagggtgctgtatttagcgacgcctgtccggctggacgggaaaaaccggcgtcagtaa

SEQ ID NO: 2934 - DNA, 1425 bp, Bacillus licheniformis
atgagtaattattggaaagatttgcttcctgtcgatccgtatgttgtcaaaagcagcggattgctgcaggatttggaccggcaaattgtcacgctattgtatcagcctttaatcggctctttttcgttcagcttgtttctcacgctgtggggagagctggagcaaaacagagtctggggaaaaagctcgactcacagacagctgatggcggcgatgcagaccagcctgaagacgatccactcagaaaaggaaaagcttgaggggatcggactgttgaaaacttatataaaagaaacggaacacgaacgtttgtttatatatgaattgattccgccgctcagaccggacgagttctttcaggacggcatgctgaatgtcttcttgtacaaccgcgtcggaaaggcgaggtttcagcagctgaaagaatatttttcccacccgtctgttcctgaagaagcacgggacatcacccgttctttcaatgaagtttttgcatctgtccagccgagcgaatggaagatgtccgacgatatgatcgaagcgatggagcttcgcgaagatcatgaatggatgaaagaagggaatagccaaccggcagcagtcacagacggcgcctttgactttcaactgtttctcgccggtttatctgacacgcttatcccgagaaaagcgctgacagaccaagtgaaggaaacgattaaaaagctggcctttctctacggtatcgaaccgcttcagatgcaaaacgtcgtcatgtcagccgttgacgaacacgatatgatcacgacagaggcgctcagaaaagcggcgagcgactggtatcagatcgagcgcggcggcccgcttccggaactcgtcgacaaagtgcagccgatgaatctccgcgaacagccgaatcaacagtcgtccacaaacgccaaggaagacaatttgatcgctttgcttgagcaagtatcgccaagaaagctgctgcaggatattggcggcggagcggaaccatccaaagccgatctgaaaattatagaagaaattatgcttgaccaaaaattagagcccggcgtcatcaatgttctgatttattatgtcatgctgaaaaccgatatgaagctttcgaaaaattacacgcaaaaaatcgcttcccactgggccagaaaaaaagttcgtacggttagagaggccatgaagcttgcgaaagaagaaaaccgccaatatcttgaatgggcggaagggaagaaaaagacttcccggaacaagaaagtcatcagagaagaaaagctgcctgattggcttcgggaaagtgacgatgctgacagcaaaccgctggaaacagagcaggctggtcctgcaaccagagaaggctttgaccagcagaaacagaagctgctcgaagaagtaaaaaaactgaaaaaccattccgctctttaa

SEQ ID NO: 2935 - DNA, 459 bp, Bacillus licheniformis
atgaaatgtccagcatgtcagcataatgggacgagggttttggactcccgtccggttgacgaaggcagatcgattcgcagaagacgcgaatgcgaatcgtgcaactatcgatttactacatttgaaaaagtggaagaaattccgctcatcgtcgtaaaaaaagaaggaatccgggaagaattcagccgcgagaaaatgctccgcggtttgatcaaagcgtgcgaaaagcgccctgtcgccttgaagcagcttgaggatatttgctttgaaattgaaaaagagcttagaaatcaaggcgtttctgaagtgaagagcgacatgatcggagaaatggtgatggacaggcttgcgaaaatcgacgaagtcgcatatgtccgatttgcttcagtataccgccaatttaaagatattaacgtatttatcgacgagctgaaagatttaataaagaaagaacggtaa

SEQ ID NO: 2936 - DNA, 396 bp, Bacillus licheniformis
atgagtctttttcaaaacattcaacggtttttttctacacacgccgaaacgtctgaccgccatccttcggaagagctgaagagccgctattataaagcggcgtcaaaagaagcgctcaatgctgtaaaggaagtgctggaaggccttgacggctgcaaggtgacgtcagtgtcggaggaaagaggagaaatcagcgccgaaattaaaaaaacgagaaaagcttttgtggtggcgacagtcgtttcgattcggccttttgatacagcggtggactttaatgtgtcagcggaaacgtttttgccgaccgattttggctacagccgcgggctgtctagacgctatacatcgagctggtcggaaagctgcaggaatctgttcattcaaacaattgaatag

SEQ ID NO: 2937 - DNA, 573 bp, Bacillus licheniformis
atggaaacaatggggcgtcacgttatctccgaactgtggggatgcgattttgataagctgaatgacatggattttattgaaaaaacgtttgtaaatgcggcactgaagtcaggtgctgaggtacgtgaggtagcctttcataagtttgcgcctcaaggtgtaagcggggtcgtgattatttcagaatctcacttgaccattcacagttttcctgaacacggatatgccagcattgatgtttatacttgcggagatttagatccgaacgtagctgccgattatatcgcagaagagttaagagcggaaacaagagagaacattgaaataccgagaggcatgggacctgttcaggtgaaacaggccaaagccaaagcacaggcacctttaatgccgatagaggagctggatgaaaaagcggacaccgcttttaaaatccgctcctttttctttccctctcccgaaaatcccaaaacatattccccggcattctcttgctgttttgttttcccttggaaatcaaccatttttttaataaaatatagagaagaaagacaaaggggacaggggatatga

SEQ ID NO: 2938 - DNA, 1023 bp, Bacillus licheniformis
atgaaagtgaaagttgcgataaacggattcggccggatcggcagaatggtgtttagaaaagcgatgcttgatgaacagattgacattgcggcgatcaatgcgagctaccctccggaaacgctcgctcatttaataaagtatgacacaaatcacggccgttatgaacttgatgtaaaggctggagaagactgcctgttcgttaacggtaaaaaggtcatgctgaccaatcagagggaccctaagcttcttccgtgggcacaatacggaatcgacatcgccgtggaagcgacggggaaattcaactcaaaggaaaaagcggaagcacatattgaagccggcgcgaaaaaagttattttgacggcgccgggcaaaaatgaagacatcacaatcgtgatgggcgtcaacgaacgcgattttgatgcggagcgtcatacgattatttcaaacgcttcctgtacgacgaattgtctcgctccagtcgcaaaagtgcttgatgatgcattcggcattgaaaacggcctggtgacaaccgtacacgcttttacaaatgatcaaaaaaatattgataatccgcacaaagacttgaggagggcgcgcgcctgcggatcttcgatcattccgacaacgacaggcgccgcgaaagcgctgtcacttgtcatgccccatttaaagggtagaatgcacggcctggccctgcgcgttcccgtctcaaatgtgtcgctcgttgaccttgtggctgatttgaaaagcgatgtgacggcggaggatattaatgaggcgttccgcatggcggcggcaggctccatgtccgggatcatcgatgtatgcgatgaaccgctcgtttcatccgattttaatacgaatccatactcggcggtgatcgacagtctttcgacaatggtgcttgaaaacagaaaggtgaaagtgcttgcatggtatgacaatgaatggggatattcgtgcagggttgtcgatttgatcagatacgcggcttcaagaatgaaacacccctcagctgtataa

SEQ ID NO: 2939 - DNA, 1485 bp, Bacillus licheniformis
atgaaactgatcaaaaacgcatcttttatcatttcttttttggctgcggccggcatttattttttattaggtacagtcgctgcttctgcggcaaacgaagattatccggaacagatgatcaggctggaaagctcatcaggcttaaatattacgcccgccgggaatcaagacaacgcaccgctaacagcaaaacagacgagcggagaaaaagaagaaagatggaggcttgatacgtctgacggcaaacaattcaaaatcagaaatatggatagcggcaaaattatcatccctgcccattacgcactgtcagacaataatccggctgtggtctactatgacaattcacggaaggaagagttgtggaatatcatcggggccgacaaagacggaaacggagattttatcacgtataaaatcgtcagtgcacaaaacagcagccttgcactgacactggacggcagcggagtgaagcttgccaaatatacgggcagctccgtccaaaagtggaagcttccaagcgacgggctcgaaggtttcgcaggctatgcaagggaaacgaacggcaagcagaaaacaggcacaaccggcggcctgcttggaaaagtcgtctatgtcaataatctgggcgaactgaaggccaatattgaagattcaacgccgcgcacgattgtcgtctccagcaatatcggcgcttcagccaaaacggtattaacggtgggcgccaataaaacaatcatcggctcgtatgaaaaacataagctgaataacatttactttaaaacaaaagcggactctggcaacgttattttcaaaaatctggtcattgcacatgatgcatccataaatgaaaacaatgacatccctgtttacattaccgattcgagaaactactggattgaccatgtcacattccaaggccacagctatacggcaaacggccacgatctcgacaagctcttatacgtcggcgctaaagccgattacgtcacactgtcgcacagcacattcacagaccacaggtacggcctgattctcggctggcctcaagatgacaagcaataccacagtatatataatggctatccgcggatgacaatcagccacaatcgctttgagaatctctatgtcagggcgcccgggttgatgcgttacggctattatcacgtgaaaagcaattatatcaacaattaccaccttggcttcacgattacgacattggcgaaaatatattctgaagccaattacttcggcacgggcaatgagaaaggcatactggatgattacggagacggcgcgtttaaagatgtcgggtcatatccggcgataaaggggcagaaatcgcctgagacaagctggacaccttcatccaactacagctatcggacgatgaaggccggcaatgccaaagcttttgccaaacggtacgcaggtgcgcagcgcaccgctctgtactatgcgaattacagccagtttaaaaaagactaa

SEQ ID NO: 2940 - DNA, 606 bp, Bacillus licheniformis
ttgacattggtcatcgggttaaccggggggattgccagcggcaaaagcactgtcgcgcaaatgttccagcagtgcggcatcacggtcgtcgatgcggacgtgatcgcgaaagaggccgttgaacaggggatgcccgcttatcagaaaatcgctgagacatttggtgaaggcgtgctgcttgaaacaggcgatatcgaccggagaaaacttggagaaattgtttttgctaatgaagaaaaaaggctgcagttaaatgcaatcgtccatcccgaagtgagaaaaatgatgatcaagcagcgcgacgaagccatccgggccggtgaacggtttgttgttctcgatattccgcttttatatgaaagcgggctcgaacatttgacagataaagtgatcgttgtctgggttccgatggagcttcagcttgagcggctgatgaaaagaaaccggcttaataaagacgaggcgctgaacagaattcacgcccagcaatctcttgacgaaaaaaagaaaagggcagacgcggtgatcgataacagcggcagtctgaaagatacagaagcgcagcttcatcagctgcttgatacatggtcaaatattgaaaagtga

SEQ ID NO: 2941 - DNA, 633 bp, Bacillus licheniformis
atgatgtttgcatctttcttgctgctggcatttgccgtcagcttggacagtttttcagtcggatttacttacggattgcgaaagctgaaaatcccatttaaagcgattttgattattgctttttgctctggtgccgtgatgtatattgccatgatgatcggaacccttttggcgaaattcctgcccgttgtcgtaacagaaaggctcggagccgtcatcttaatggggatcggcgcatgggtgctgtatcagtttttcaggccggagaaagaacaggatctcgtcttctctgaaaaaacgctcattaaccttgaattgaaatcgctcggaatcgtgatacacatattaagaaaaccgacaagcgccgacattgataaatcaggaatcattaccggtatagaagctttccttctcggtttcgccctctctattgacgcgttcggcgcagggatcggcgcggccgcgctgggcttttcccctgtaccgatgagcattacggtaggcatcatgagctcattgttcgtattttgcggaatacaggcaggccgatttttatcgaaatggaactggatggataaactgacctttcttcccggtatattgctgattatgatcggcatctggaaactgtaa

SEQ ID NO: 2942 - DNA, 828 bp, Bacillus licheniformis
gtgccggaattaccagaagtcgaaacggtccggcgcactcttgccgggcttgtaagagggaaaacgatcgatgcggttgatgtcagatggacaaaaatcataaaacgtccggaggagcctgaggaattcgcaaggctcctggccggccagacgattcagtcgatcggaagaaggggaaaattcctgttgtttcatcttgatgattgtgtcatggtttcccatttgagaatggaaggaaagtacgggcttcatcaaaacgatgaaccccttgataaacatgtgcacgtcattttcaggttcacggacggaagcgagctgcgctaccgggatgtcagaaagttcggcaccatgcatttgtttaagccgggagaggaactgacagagctgcctctcaggcagctcggccccgagcccttcagcagcgaatttacagccgattacttaagagagcgcctgaagaaaacaaaccgctcggtgaaaaccgcgctgctcgatcagcggacagtcgtcggactgggcaatatttatgtcgacgaggctttgttcagagccggtatccatcccgaggcaacagcgaacaagctcacaaaaaaacagacggttcttctccataaagagatcattcaaacgttaaaggaagctgttgaagcagggggaagcacagtcagatcttacatcaattcacaaggtgagatcggcatgttccagctcaaacttttcgtttacggcaggaaagatgaaccttgtaaaaaatgcggatctccaattgaaaaaacagtcgttggcggaaggggcacgcatttttgcataaagtgccagaaaaaatga

SEQ ID NO: 2943 - DNA, 2640 bp, Bacillus licheniformis
atgactgaaagaaaaaaattagtattggttgacggaaacagcctggcttaccgtgcgtttttcgccctgcctcttctcagcaatgaaaaagggatacatacaaacgcggtgtacggttttaccacgatcttaatgaagatgcttgaagaggaaaaaccgacccacatgctcgtcgcttttgatgcggggaaaacgacattcagacataaaacgtttaaagaatataaaggcggcagacaaaaaacgccgccggagctgtcagagcaattgccgtttatccgcgagctgctcgacgcatatagaatctcaaggtatgagcttgaaaactacgaggccgatgatattatcggcacccttgccaaatcagcggaaaaagacggatttgaagtgaagattttttccggcgacaaggacctgacacagctggctacagaaggaacgacggtcgccatcacaaaaaagggcattacagatgtcgaatactatacgcctgaacatgtccgggaaaagtacggacttacccctgaacagatcattgatatgaaagggctgatgggagactcgtcagacaatattccaggcgtgccgggagtcggcgaaaagacggcgatcaagcttttgaaacagttccatacagtagaggagctgctgtcgtcaatagacgaagtcagcggaaaaaaactgaaagaaaagcttgaagaatttaaagaacaggctttgatgagcaaagagcttgcgacgattacgacagaagcgccgcttgaagtcagcctcgattccctcggatatgaaggttttgacagggaagcggtcgtcaagatttttaaagatctcggctttcattctttgctcgaaaggattggcgaagaggcgggagagaaagaagaagaacagttggaagagatcgatgtcatgatcaaaacagacatcacggatgacttgtttgcgtcaccggcttcactcgtagtcgaacagctcggcgacaattatcacgaggcgccgatcctcggtttttcgatcgtcaacgaacacggcgctttcttcattccggaagagacggccgttcagtcggactgttttaaagaatgggccgaagatgagtcgaaaaagaaatgggtgtttgatgcaaaacgtgcggcggtcgctttgcgctggcggggcattgaactgaaaggcgctgagtttgacgttcttcttgcggcctatatcatcaacccggggcactcctacgatgatgtggcaagcgttgcgaaagaacatcaattacacatcgtttcagcagatgaagcggtctacggaaaaggagcgaaacaggcggttccggatgagaaggagcttgccgaccatttagccagaaaggcgaaggcgatatcgctgctgcgcgaaaagctccttgatgaactggaagaaaacgagcagctcgaactgtttgaagcgctcgaaatgcccctcgcccacattctcggtgagatggaatcgatcggtgtccaagtcgatgtcgacagactgaaaaaaatgggtgaagaactgtccgctaaattagcggaatacgagaaaaaaatccacgagtcagcaggtgaaaccttcaacattaattcaccaaagcagctcggtgtgattttgtttgataaactcgggctgcctgtcgtcaaaaaaacaaaaacgggctattcaacttcagccgatgtgcttgaaaagctgcgcgataaacatgtcattatcgaagatatcctgcactacaggcagattggcaagctccagtccacatacgtagaagggcttttgaaagtgatcaaaaaagacagccataaagtgcatacccgctttaatcaagctttaacacagacgggaaggctcagctcaaccgatccgaatctgcaaaatataccgatccgccttgaggagggccgcaaaatccggcaggcgtttgtcccttcgcaaaaaggctggctcatatttgcggcggattactcacagatcgagctgagggttctcgcccacatttcaaaggataaaaatttgattgaagcgttcacgaacgatatggacgttcacacaaaaacggcgatggacgtttttcatgtatcagaagaagaagtcacccctgcgatgagaaggcaggcgaaagcagtcaatttcggaatcgtctacggaatcagcgactacggcttgtcgcaaaacctgggaattacaagaaaggaagcggcagcgtttattgagcgctatttccacagcttccagggagtcaaagaatacatggaagagaccgttcaggaagcgaagcagcgaggctatgtaacgactcttttaagccggaggcggtatataccggaattgacgagccggaatttcaatctgcgcagctttgccgaacggacggcgatgaacacaccgatccagggaagcgccgcagatattattaaaaaagcgatgatcgacatggcggacaagctgaaagaaaaaaatctccaggccaaactgctgctgcaggttcatgacgaattgatttttgaagcgcctgaagatgaaatcaaagtgcttgaaaaactggttccggaagtcatggaacatgcattggagctcgatgttccactgaaagtggactgcgcttcagggccttcatggtacgatgcaaaatag

SEQ ID NO: 2944 - DNA, 1746 bp, Bacillus licheniformis
atgattaaattccggacccggcttttagctgccctgctgacgcttttgattctcgtatttgcttcactcggttttctgctcgttcacttgtttcactcctcttacgatgccaaactgagcagccatattgaaaaagaggccgctttggtcgcttcattggcaaatggtgaaaacatgaagtcttcggagcaaggagctattttagagaaggcaagccgtgaactggacagtcgtgtatcgcttattgatacaaaaggtcaggttctttttcattttgggggccgcgccgaagagcaatccgttatcaaggaagcgcttgagtcggatttaaacggtgaaggaggaggcttcaggatcaaccctgatgacgagtccgtttaccgttacgtgcagccgctcaaagatgacgggaatgtgaatggatatattctgatcagcactcctgtcgattcattgcaagacatcaatcaaaagatctggattctcctcggcgtgagccttggaacggcctttttaatcatcgccgggcttggggcgagaataacctctcaatatacgaatccgattgagtctgcgacacaagtggcgattgagcttgccaaaggaaactataaagcaagaacattcaacgaagatgaaacgatgctgagccagtccatcaatatgctggcgcagaacctgcaggacatgacaagagcccaggaaatgcagcgcgaccgtctgcaaaccgtcatcgaaaatatcgattccggtctgatcttaatcgacggaaagggttatattcaccttgtgaaccgcgcttatcaaaagcaatttcacgtagaagccgatcagcttctttaccatttctatcacgaagtgctcgaacacgaagagatcattaatctcattgaagaaatttttatgacggaagcaaaggtccgcaaaatgtttaaactgccgatcaaaattgaaagaaggtattttgaagtcgacggggttccgattatcggcatcaatgatgagtggaaaggcatcgttctcgttttccatgacatgacggaaagaaagcagcttgaagaaatgaggaaggactttgtcgccaatgtctcccatgagctgaaaacgccgattacatcaatcaaagggttcaccgaaacgcttctggacggagcgatgaacgaacgggagacgctgttgcagtttctatcgatcatcttaaaagagagcagccgtctgcaaaccttgatccaggacctgttggatctgtcgaaaatcgaacagcaaaacttcaccctgaatattcaaaattgcaatatcggtgaaatcctcgccgaaattgagatgcttttgaagaataaagcggaggaaaaaggaatcaccttgacactggaaaagccggataagccggccgttgcttccggagacccgcacagactaaagcagatctttttgaatttggtgaacaatgcgctcacatatacgcctgaagatggaagcgtgacgatttcggctgatgttctggaagatgcagtgcaagtcaaagtgagggatacgggcatcgggatcaagcagtccgaaatcccgaggatatttgaacggttctacaggatcgataaagacaggagcagaaattcaggaggaaccggtctcggtcttgcgatcgtcaagcatttagtcgaagcccaccaaggcgaaatcgacgtcgaaagcgagcggggaaaaggcaccgaattcacggtccgcttaaaacgcgcatccgagtag

SEQ ID NO: 2945 - DNA, 756 bp, Bacillus licheniformis
atgtcggggaaatctgaagcctggaggcatgtcatgagcaaaaagatattagttgtagatgatgaggaatcgattgttacccttctaaaatataaccttgaacggtcgggctatcatgtggtgaccgccatggacggagaggccggcttattaaaggcgattgaagagaagccggatctgatcgtgctcgatctgatgcttcctaaaatggacggcattgaagtatgcaaggaactcagacagaagaagctgatgtatccgattttgatgctgaccgcaaaggatgatgaatttgataaagtgctcggtctcgagctgggtgccgatgactatatgacaaagccgttcagcccgagagaggtgacggcaagggtcaaagcgattttaagaagaacacagacgctgtccgttcagccggaggagacggaagaaccggatgcaggcgagctgatcataggcgaactgaaaatactgcctgaacattatgaggtttattttcaaaacgaacgcctcgagctgacgccgaaggaattcgaacttctcttatatttgggaaggcataaagggagggtgctgacgagagaccttctcctcaacgctgtctggaactacgacttcgcgggcgatacgcgcatcgtcgatgtccacatcagccaccttcgcgataagatcgaaaaaaatacaaaaaaaccggaatacattaaaacaatcagaggtcttggctacaaaatggaggagccgaaactgaatgattaa

SEQ ID NO: 2946 - DNA, 939 bp, Bacillus licheniformis
atgggaaagaagcgaaataaagtatctgtcatcggagcgggttttacaggtgcaacaactgcgtttttaacggctcaaaaagaattggctgatgtcgtgctagtcgacattccgcagcttgaaaaccctacaaaagggaaagcgctcgatatgctggaagcgagccctgtccaaggatttgacgcgaatattacaggaacggcaaactatgaagatacggctggttcagatatcgtcgtcatcacggcggggatcgcaagaaagccgggaatgagccgggacgacctcgtggctacaaatgaaaagatcatgaggagcgtaacgaaggaagttgttaaatactcacctgattgtatcatcatcgttctgacaaaccctgtagatgcgatgacatacgccgtctataaagaatcgggcttcccgaaagagcgggtcatcggccagtcgggaattttggatacggcaagattcagaacgtttgtcgctcaggagctcaacctttccgtcaaagacattacaggttttgtactgggcggacacggggacgatatggttccgctcgttcgctactcttatgcaggcggcattccgcttgaaacgcttcttccgaaagaccggatcgatgcgattgttgaaagaacgagaaaaggcgggggagaaattgtcaacctgttaggaaacggaagcgcgtactatgcgcctgccgcttccctgacagaaatggttgaagcaatcttaaaagaccagcgccgcgtgctgccgaccattgcctaccttgaaggcgaatacggctatgaaggcatttatctcggcgttccgacgattatcggcggaaacggtcttgaacagatcattgaacttgaactgactgaaaccgaaaaaagtcagctcgataaatccgttgaatcagtcaaaaacgtcatgaaagtattatcataa

SEQ ID NO: 2947 - DNA, 1317 bp, Bacillus licheniformis
atgtttttctatattgaagaattacatattatgggaggttttattgtggcacaaggcgaaaaaattacagtctccggcggagtattaaacgttccaaacaacccggtcatcccgtttattgaaggggacggaacaggtcctgatatttggagagcggcttccagggttcttgaagcggctgtggagaaagcgtataacggcgaaaagaaaatcacttggaaagaagtctacgccggggaaaaagcgtacaacaaaaccggcgaatggcttccggaagaaacgcttgatacgatccgcgaatacctgatcgcgattaaaggtcctttaacaactcctgtaggcgggggaatccgctcattaaacgtagcgctcagacaagagcttgacttgtttacatgcctgcgtcctgtccgctatttcacaggcgttccttcaccggttaagcgccctgaagatacggacatggtcatcttccgtgagaatactgaagatatctacgccggcatcgagtacgcgaaaggctctgaagaagtgcaaaagctgatttcattcctgaaaaacgagcttggcgttaacaaaatccgcttccctgaaacatcgggcatcggcatcaagccggtttctgaagaaggaacatcaaggcttgtcagagctgcgatcgagtatgcgatcgagcacggccgcaaatctgtgacgctcgtccataaaggaaacatcatgaaattcacggaaggcgcctttaaaaactggggctatgaagtggctgaaaaagaattcggcgataaagtattcacttgggccgaatacgaccgcatcgctgaaaaagacggcaaagacgctgcaaacaaagcgcaaagcgaagctgaagctgccggcaaaatcatcatcaaagacagcatcgccgacatcttcctgcagcagattctgacacgtcctgccgagtttgacgttgtggcgacaatgaacctgaacggggactacatttcagatgcgctggctgcccaagtcggcggaatcggcatcgcacctggagcaaacatcaactatgagacaggacatgccatctttgaggcgacacatggtacagcgcctaaatacgccggcctcgacaaagtaaacccgtcttcagtcatcctatccggcgtgctgcttcttgagcatttgggctggaatgaggcggccgaccttgtcattaaatcaatggagaaaacaatcgcatccaaagtcgtcacatacgatttcgctcgtttgatggacggcgcgactgaagtcaaatgctctgaattcggtgatgagcttatcaaaaacatgtcttaa

SEQ ID NO: 2948 - DNA, 1119 bp, Bacillus licheniformis
atgacagcaacacgcggccttgaaggggtagtcgccactacatcatcagtaagttcaattattgatgatactcttacatatgtagggtataacatcgatgatttgacagaaaaagctagctttgaagaagttgtttatctgctttggcatttaaagctgccgaacaaagaggagcttgccgagcttaaaaaacagctttctgaaaatgccggtatccccaaagaagtcattgaccatttcaaatcctacccgaatggaaaagtccacccgatggcagctcttcggacagccgtttctttactcgggctgtttgacgaagaagcagatcaaatggatgcggaagcaaactacagaaaagcggtgcgtctccaagcgaagatgcctgcgcttgtcgctgctttttcaagaatccgcaaagggcttgagccgattgagccgaatccggaactcggctttgcagccaactttctctacatgctgaatggaaaagaaccttcacctgtcgaagtggaagcgtttgacaaagctttgatccttcatgcggatcatgagctgaacgcatctacgttcacagccagagtatgcgtcgcgacgctttcagacgtttactcagggataacggccgcaatcggagccttgaaaggtccgcttcacggcggagcaaacgaagcagttatgaaaatgctttcagagattggcgaggttgaaaacgtagattcatatattcacgccaagcttgaaaagaaagaaaagatcatggggttcggccaccgcgtataccgccagggcgatccccgcgcaaaacatttgaaggaaatgagcaggcgtttgacgaatttaacgggtgaaagcaaatggtatgagatttcagagcggactgaggaaatcgtcacgtctcagaaaaagctgccgccaaacgtagacttttattctgcgtcggtttatcatagcttaggaatcgaccatgatctgtttacgccgatttttgcgatcagcagggtatcaggctggctcgctcacattcttgaacagtatgaaaataaccgcctgattcgtccgcgggctgactacaccggccctgacatgcagaggttcattccgattgaagaaagaagctga

SEQ ID NO: 2949 - DNA, 465 bp, Bacillus licheniformis
atgtttactcaagctaatttatttttgatcctgcttttggccatcgctttaatcgcgaaaaatcagtcgttgatcatcgctgtatccgtcctgcttttgatcaagctgatcggcctcgatcaaaagctgtttccagccatccaatccaaagggatcaactggggcgttaccgttattacaattgcggttcttgtgccgatcgcaacaggagagatcggctttaaacagcttggcgaagcgatgaagtcatattacgcatggattgcactcggagcgggcattctcgtagcattgatcgccaaaaacgggatcacattgcttgcagaagacccgcatatcacgaccgctcttgtatttggaacgattttagcggtcgctttattcaaaggcgttgccgtcggcccgctgatcggtgccgggattgcctatcttgtcatgcaggccgtccagcatttcacatcttag

SEQ ID NO: 2950 - DNA, 1116 bp, Bacillus licheniformis
ttgaaccaatcctatctcacagctgcgcttcgggcagtgtatgtgctgtttttgaccgctgtttgcggagcggtcggctactactcttttccgttaacctatccttttgtgattgcgcttattctcgccatcatgatcaatccttttgtggaatggctcgataagctgaccgggttcccgagaggcgtcaatgtcggaatcgttctgttcggctttttgaccgccggagccggctttttgacactggtcgttgccgagatcgtctctggaacggcctatttggctaaaatacttcccctccagtttaataaagccgctctttatatcgaatcgttttttacgaatcaaatcatgccgctgtataatgagctggccgctttttttgacggccttgaagccgcccagcaggaatcgatcattacacaggtccaaaatttgggcagtgaacttgcttcaggcacggctttattgctttcaaaaattcttgagacggtgcccctttttttcgcctttctgccgaatatggcggccgtgctgatcttttcgctcctggccactttttttatcagcaaagatctgcataaaatacaaaacaaggcacggtctgttcttcctgatcgtctgatctcgggtgcagcggctgtctatgcagaattgaaaagagcactggcaggctttgtgaaggcccagcttacccttgtggcgatgacgatggtgctcgtgttgatcgggctttccgtgttgaaggtcaatcatgctgtggcgatcgcttttctgatcgggctggtcgacctgctgccgtatttgggaacagggtctgtatttgtgccgtggattgtctatttagcagcggccaaacagctgccgctggcgatcggccttggaattctgtacatcgtcgtacttgtcttcaggcagcttgccgaaccgaagattttaagccggtcaatcggacttcaccctttgggaacattaatcgcgctgtttgccggtttcaaattgtttggctttctcggattgatcatgggccccgcccttctcgttcttattcaggctctctttacaacaggtatttttagagacatatggctgtttattaaaggaaatgaaaaataa

SEQ ID NO: 2951 - DNA, 387 bp, Bacillus licheniformis
atgaagtttttcttattatttctcgtcatttttccagcgagtgaaatcggtctgttcctcttgtccgctaattggatcggtgtgctgccgaccgttttgctgatcattttgacgggctttctcggggccgctctcgccaaaaaacaaggaatcgaagtctactacaaagtccagcgcgatcttcagtacggaaagatgcctggggccgcgattttggacgggctttgtattttcatagggggcatgctgcttttgctgcccggttttttatcggatatcatcggtttactgctgctgctgccggcaacgcgcggccgtttcaaaccatttatctcccgcaagctgaagagaatgtctgaaggcaggcggatcaacattatcaaataa

SEQ ID NO: 2952 - DNA, 1758 bp, Bacillus licheniformis
atgagaaagactaaaatagtttgtacaattggaccggccagcgaaagtgttgaaaagctcacccagctgatggaagccggaatgaacgtggcgcgcctgaacttttcccatggagatttcgaagagcacggcgcaagaattaaaaacattcgtgaagcagccggcaagctgggaaaagatatcggcatccttcttgacacgaaagggcctgaaatccgcacgcacacaatggaaaacggttcgatcgaactggcagcgggttctcagctgatcgtttcaatggacgaagtcatcggtacgcctgataaaatctcagttacatatgatgggttgattcacgatgtgtcagtcggttcaacgattttgcttgacgatggattggtcggacttgaagtcactgacataaacaaggacaagcgtgaaatcgtcacgaaagtgatgaacagcggaacgttgaaaaacaaaaaaggcgtgaatgtgccgggcgtcagcgtcaatcttccgggaattacggaaaaagatgcaaacgacatcgtattcggcatcgagcagggcgttgatttcatcgcggcatcctttgtgcgccgtccgtcggatgtccttgaaatccgcgaacttcttgaagagcacaatgcggcagatattcaaatcattccaaaaatcgaaaaccaggaaggcgttgacaacatcgatgccattcttgaagtatcagacggtctgatggttgcgcgtggagacctgggtgtagaaatccctgccgaagaagtgccgctcgttcaaaaagaactgatcaaaaaatgcaatgcgcttggcaagcctgtcatcacggctacccaaatgctcgacagcatgcagcgcaatccgcgcccgacacgcgcggaagcgagcgacgttgccaatgcgatctttgacggaactgacgcaatcatgctttcaggtgaaacggcagcgggaaattatcctgttgaagccgttcagacgatgcacaatatcgcttcccgttcagaagaagcgctcaaccataaaaagatcctttccgcacgaagcaagcaagtcagcatgtcaattacggatgcgatcggccaatctgtggcgcatacggcaatcaaccttgatgtgaatgccatcgtcacaccgacggaaagcggccatacggcgagaatgatttccaaatatcgcccgcaggcgccgattgtcgcagttacggtaaacgatgcggtgtcaagaaagctgtcacttgtgttcggggttttcgcaacaagcggacaaaaccacagctccactgacgaaatgcttgaaaaagcggtgcaaaaatctctcgatacaggcatcgtacgccacggcgacttgatcgttatcacggccggagctgtcggtgaagccggtacaacaaacttgatgaaagtgtatgttgtcggagacgtggtcgcaaaaggccagggcatcggacgcaaatccgcatttggtgaagtggtcatcgctcaaaacgcacaagaagcggccaaaaaaatgaaagatggcgccgttttagttacaaaaagcacggatcgtgacatgatggcatcccttgaaaaagccggctgcgctgattacggaagaaggcggcttaacaagccacgcgcagtcgtaggcttaagcctcggcatccctgtcatcgtcggaatggaaaatgcgacttccattctgaaagagggagaagacatcacggtcgactccgcccgcggagctgtatacaaaggacgtgcaagcgtgctttaa

SEQ ID NO: 2953 - DNA, 969 bp, Bacillus licheniformis
gtgaaaaagatgaaacgtatcggagtattgacaagcggcggagattccccgggaatgaacgcggcggtccgcgcggttgtcaggaaagcgatctaccatgacgtagaagtatacggaatttacaacgggtattcaggtttaatcagcggaaaaatagaaaagcttgaaatcggttctgtcggagatatcattcaccgcggaggaacgaagctatatacagcaaggtgtcctgagtttaaaacggtagaaggacgggaaaaaggaatagcgaatttaaaaaaatatggtatagaaggattagtcgtcattggcggcgacggttcttatatgggagccaaaaagctcacagaacacggttttccttgtgtgggagtgccgggaacgatcgacaatgacatcccaggcactgatctgacgatcggattcgatacggcgctaaataccgttattgacgccatcgataaaatcagggatacagctacatcccatgaacgtacatacgtgattgaagtaatgggccgccatgccggggacattgctttatggtcaggtttggccggaggcgcggaatccattttgattcctgaagcagactacgatatggaagaaattattgcaaggctgaaaagagggcatgagcgcggcaagaaacacagcatcatcattgtggcggaaggcgtcggcagcggcgttgaattcggaaaaagaattgaagaagccacaaatctcgaaactagagtatcggtgcttggacatatccagcgcggcggttccccgactgcagcagaccgcgtattggcaagccgtctaggggcatttgcggttgaactgcttcttgaaggaaaaggcggacgttgtgtaggaattcaaaataaccagcttgtgcatcatgatatcattgaaatactcgagcaaaaacatacaattgatcaaagcatgtaccgcttgtctcaagaactgtcaatctag

SEQ ID NO: 2954 - DNA, 978 bp, Bacillus licheniformis
gtggctggagaattagaatttgaaaaaccggtggtcgaactgcgtgaaaagatctccgaattgaaaaagttcacacaggattccgatatggatttgagctctgaaattacgaagcttgaagctcgtcttgaaaggcttgaagaagacatttatacaaatctgaaagcctgggacagagtccagattgcaaggcacccgaaccgtccgacaacgctcgattatatcgaacatctctttaccgatttttttgaatgccacggagatcgttatttcggtgatgatgaagcaattgtcggcggaattgccaagttccggggtcttcctgtgacagtaatcggtcagcagcgcggcaaggatacaaaagaaaacatccgccgcaatttcggaatgccgcatcctgaaggctaccgcaaagcgctcaggctgatgaagcaggccgacaaatttaacaggccgatcatctgctttattgatacaaaaggagcatacccgggcaaagcagctgaagagcgggggcaaagcgaagcgattgccaagaatctttttgaaatggcgggactctccgtgccggtcatctcgatcgtcatcggggaaggcggcagcgggggagcgcttgcgctcggcgtcgcaaaccgcttattgatgctggaaaactcaacttattcggtgatctctcccgagggagctgctgctatcctctggaaggattcaggactcgcgaaaaaagcggcagaaacaatgaaaatcaccgctccggaccttaaagaattggatattatagatcatgttataaaagaagtaagaggcggagcacaccgcgatgtggagcagcaggctgcctacatcgacgaagcgctgaaaggcgagcttaaatccctgctgaaactggataagaacgagctgatccaacaaagatataacaagtataagtcaattggaaaaatttcgactgaaaaccaatatgttgggataaaataa

SEQ ID NO: 2955 - DNA, 876 bp, Bacillus licheniformis
ttgttaaaagatatattcagcaaaaagaaaaaaaaatacgcttccgttcccgcggaatcagcgaagcaagatgtaccggaagggatcatgacaaagtgcccggattgtaaaaaaatcatgctcacaaaagagctggataaaaatttaagggtctgcatgaattgcggttaccatcttcaaatgaacgcgaagcagcgtataaaaagcctgctggacgatggctcctttgaagaattcaatcaggatatgatgtctgaaaacccgctggagttcccgggataccttgaaaaattgcaaaaagaccgggaaaaaacgtcgctgaatgaagcggttgttaccgggaaagggacgattgacggatctccggcggtcgtggccgtgatggattcatctttcagaatgggaagcatgggatctgtcgttggcgaaaaaattacgcttgcaatcgaaaaggcaagagaagaaaaagtacctttcatcatttttaccgcatcaggcggtgcaagaatgcaggaaggccttctcagcttgatgcaaatggctaaaacaagctccgctttgaagctgttcagcgaagagcagggcttgatcatttcagtgatgacgcatccgacaacaggcggcgtatccgcaagcttcgcatccctcggcgattacaaccttgccgaaccgggcgcgctgataggctttgccggaagaagaattatcgaacaaaccatccgtgaagaactgcccgaggattttcagactgcggaatttctgttaaagcatggccagcttgattccgtcgttcacagagctgacatgaaaaaaacgctcggcagcattttgaaaatgcaccaaactggaggtgatctcgagtggctggagaattag

SEQ ID NO: 2956 - DNA, 1221 bp, Bacillus licheniformis
atgtcattgaaagaaaaagcactgcatatgcacaaagtaaaccagggcaaattggaatcaaaatcaaaagtgcaggttcgcaatgcggacgatttaagccttgcatattctccgggtgtggctgaaccctgcaaagcgatttacgatgataacagcaaagtatatgattatacaatgaagggaaacatggtagcagtcgtctcggacggaacggctgtgctcggcctcggcaatatcggccctgaagccgccctccctgtgatggaaggaaaagcggttcttttcaaaagctttgccggtgtggacgctttcccaatctgtttaaatacatctgatgtcgataaaattgttgagacggtcaagctgcttgagccgacattcggcggcgtcaaccttgaagacattgcagctccaaactgttttgtcattgaagaacgcctcaaaaaagaaacgaaaattccggtgtttcacgatgaccagcacggtacagcaatcgtaacggtagccggtctcgtcaatgcgcttaagctgtccggcaaaacgatgtcttccgtcaaagttgtggcgaacggcgccggcgcagcgggaattgccatcattaagcttctttatcatttcggcgtgcgcgacatcatcatgtgcgacacgaaaggcgcgatctacgaaggccgtccgaacggcatgaacgcagttaaagaagaagtcgcaaaatatacgaacaaaaaccgcatagacggttcgctcaaagacgtgatcaaagacgccgatgtctttatcggggtttccgtcgaaggcgctctgacaaaagaaatggttgaaagcatggctgacaaaccgatcatcttcgccatggcgaatccaaatcctgagatcatgcctgccgaagcgcatgaagccggagcaagcgtcgttggaacgggacgctctgacttccctaaccaagtgaacaacgttctcgcttttcctggcatcttccgcggggcgctcgacgtccgcgcgacacatatcaacgaggagatgaaaatcgccgcggttgatgcgatcgcgtcactcgtttccgacgaagagctgagacctgaatatgtcattccggctccgttcgatccaagggtcgcaccagctgttgccaaagcggtagccaaagccgcgatggaaacaggcgtgcacgaatcgatgtcgatccagaagaagtcgctgaaaaaacaagaaagcttgcagtga

SEQ ID NO: 2957 - DNA, 3345 bp, Bacillus licheniformis
atgccttttgttcacctgcaagtacatagcggttacagcttattaaacagcgccgcttccgtagaggatctcacggccaaagccaaagagctgggctacagcgcaatggcgctgacggatgacgaggtcatgtacggggcggtggaattttataaatcatgcaaaaaacgcggcatcaagccgattatcgggctgacggcttctgttttaacagatgaaaaagagcagctatcatatccgctcgttcttttggcgaaaacaaacaaaggctatcaaaacctgctgaaaatcagcagcgtgttgcagtcaaaatcaaaaaccggcatcaaggaaaaatggctcaaaagctatcatgaaggcctcatcgcgctgacaacgggcgggacaagccatgttgaagcgctgttgaaagaagggctgatcgaagaggcgaaggacgctgccctccgctgcctttcgatctttggagagggcagcttctatttgtcgtatcagccgtacaagggagacccgcttctttctgaacgcattttagagctaagcgaacatacgggaattccgattgccgcaaccggcgatgtacgctacatcgaaaaggaggacgcggcagcttacacgtgtttaaaagcgattaaagcgggcgagaagctgaacgaagacatgaaggccgaaggagatctgcatcttgagctcaagccgcccgctgaaatgctggacatttacagagatcgtccggacgcgttggagaatacagtcaaaatcgcggaccgatgccaggtggacctgagccttggccagacgcgcctgccgaaatatccggcgccttccggcaagaatgccgacgattatttggccgagctttgctttctcggactgaaaaaacggttcgaagccgctccgaaggagtatgtcgagcggcttaagtatgagctgaaagtgattcgcgacatggctttcagcgactattttttgatcgtctgggatttcatgaagttcgcccacgataacggcattatcacagggccggggcgcggatcggcggccggttctctcgtcgcttatacgctgtttatcacagatgtcgatccgcttaagcacaaattgctgtttgaacggtttttaaatccggagcgcatcagcatgcccgatatcgatatcgattttcccgatacgagaagggatgaagttattcagtacgtgaaaaataagtacggggcactgcacgtagcacaaataaccacgttcggtacattggccgcaaaagcggcgctccgagacgtcggcagggtgatgggcatcagtccgaaagaagccgaccagctggcgaagctgattccctccaaacccggagtgacgctgaaagaggcgagagcactttcacctgaacttgacaagcgcctaaacggctcaaaaaagcttcaggacatatttaaaacggcgcagaaaatcgaagggcttccccggcatacgtccattcatgcggctggcgtcgtattgagcgaggagccgctgacgaatatcataccggtacaggaaggtcatggcggcgtatatttaacgcaatattcgatgggctatctcgaagacttgggacttttgaaaatggattttctcggcttgcgcaatttaacgctcattgaatcgatcaaaacgctgatcgaaaaaagcgagcgggtcactatcgatttctcggcgattccctatgatgatgaacagacgtttaagctgctggctgaaggagatacgacaggtattttccagctcgaatcagccggcatgagaaacgttttaaaaaggctcaagccatcgagccttgaagatattgtcgccgtcaatgccttgtaccgcccgggcccgatggaaaacatcccgctgtatatcgaaaggaagcacggacgggttcctgtgtcttatccgcacgaggatttggccgatatcctgaaagatacgtacggcgtgatcgtttatcaggaacaaatcatgatgatcgcatcccggatggcgggtttcaggcttggagaagccgaccttttgcgaagggcggtcggcaaaaaaaacaaggaaattctcgatacagagagaaatcattttattagtggatgtttgaaaaaaggatattccgtacaggcggctaatgaagtatacgatctgattgtgaaattcgccaattacggttttaaccggagccatgccgttgcatacagcatgatcggctaccagctcgcttatttaaaagcgcattatcccctctactttatgtgcggcctcttgacgagtgcgatcggaaatgaggaaaagcttgctcagtacatctatgaagcaaaagggaaagggctgaatgttctaggtccttccatcaataagagcggctatccgtttgtcgtggaaaacggggcgctgcgctacagtttaagagctgttaaaggcgtcgggatagcggctgtaaaagagatctacagagccagaaaagaaaagccgttcgcagatttgtttgatttttgtgtgaggacttctgtgaaaagcgtaaatcggaaaacgattgaagccttaatttttgccggagcaatggatgaattcggtgaaaaccgggctactttgctcgcttctgtcgatgtcgcgctggagcatgccgaattgtttgcaggagacaatgatcagctaggcttctttctcgatgaaggcttgacaatcaagccgaagtacgccgagacggaggaaatgccgctcgtcgacctgctggcacacgagaaggaaacgcttggcatttacttttctgaccatccgctgagcgtccaccgcaagaaactggaccgtgcaggtgcgctgccgattattcagctgctcgcctctggccgcaaaaaagcggctctgggcggacttttgacgaggatgaagacgatccgcacaaaaacgggacagacgatggcttttctggagctgagcgatgaaagcggggaaatggaggcggttgtttttcctgaacagttcaggcagctttccccgatcctggaagaaggcgtatcgctttttgcagaaggacgccttgagacaaggaatgaaaaacgccagctgattatttccggggcatcgctcgtcgaatcgcttcatgcgaaaaagcagccgtccgtctatattaaagtggaggaaagccagcacacccacgatattttcaagaagatcagcagcatcctgcttgaacacaaaggggaaacgccggtctgcgtctattatgaaaaacggaagcagacgatgcagctgccggaaagctataatatcaaggctgatcacgctgctctatacaggcttaaaagcgttgtaggtgagaaaaatgtcgtgctcagatag

SEQ ID NO: 2958 - DNA, 342 bp, Bacillus licheniformis
atggatcctgaacagccctttttcccaaactttatcagctgttattttattgcgcttggagtgcttctcggcggttgtttaatcggggggatcggcgcctatctgtcggggcagccgcctttaacgatcattacaagtctcgcaaaccgcctgaaaatctgggcgctggttgcggcaatcggcggcacgtttgatgcggtctacagctttgaaaggggcattatcgaaggcaatacgagagacatcgtaaaacagcttctcctgattctttcggcgatgggaggagcgcagaccggttatctgatcatcaactggctcacacaggagcatatttcctcatga

SEQ ID NO: 2959 - DNA, 504 bp, Bacillus licheniformis
atgagaatccctccatattataaaaagcctgggtggcagcgtttttttgcgggaatgatgtgcggagccatcatcagctggttcgtgttcctgtttacatacggaacctttcaggagaagcaggtcgtcttgatcagggaacagaaagagcgcatcaatgatttaaatgaccagatcaccatttaccgcgaggatctgcataagctgaatgaagacaataaaagaaaactgctgattcaaagcgtcgacgtcaagctgatcaacggcaagcaatacaagctgtcacagccggacatgatgaactttgaggagcatatccgggataacatttcagatgtcattacaaaggatatcgaaagcgtctaccggacgaaggagcttttaaagcggacgattgaaaataaagagtatacgataaacgataaaaagtacaaggcgaaagtcaccgaactgacgatttatacgcggctttccgttgaaatcaaaatctctttttccgaataa

SEQ ID NO: 2960 - DNA, 180 bp, Bacillus licheniformis
atgtacatttacagttaccatcagctggcaagagataaagtcaaccggatcaagctgggctactcggcttatgcggaaactgaaagtctcgcgtcccttatcaaaaaagagttaaaggcccaaaacatccatgtttatgaggatgtaacagatatcggatcatggtttatacctgaataa

SEQ ID NO: 2961 - DNA, 945 bp, Bacillus licheniformis
atgaaaaaagaaatcatcagaaccatatcattatatgacacgatcattatacatagacatgtgagaccggatcctgacgcctacggatcccaatgcggccttacggaaatcctgagggcaacctaccccgaaaaaaatattttcgcggtcggagctcctgaaccttctctcgcttttttgtatactccagatgtgattgaagacccggtgtatgaaaatgcacttgtcatcgtttgcgacacggcaaatcaagcgagaatttcagattcgcgctacaacctgggcgacaagctgatcaaaatcgaccaccatccgaatgaagaccggtacggcgaccttttatgggtggatacgagtgcgagctcgacgagcgagatgatttacgaactgtatttagcgggtaaagaacaagcgggatgggcgcttccaacaaagggcgccgaactgatctatgccggcattgtgggggatacagggcgcttcttatttccgaacacgacaaaaaagacattgaaatatgccggagagctgatcgagtatcctttttcttcccaggcgctttttgatcaattatatgagacgaaattaaatgttgtgaggctgaatggctatatttaccagaatgtttctctgtccgaaaacggtgttgcgtcggttttcatcacccgcgatattttacatcaatacaatattacgccgtctgaagcttcacagcttgtcagcacgctcggcaatatttcggggatcaaagcatgggtgttttttgtggaggaagccgatcaaatcagggtaaggcttcgttcaaaggggccgattgtcaatgaagtcgctaaaaaatacaacggcgggggccatccgctcgcagccggcgcttccatctatgactggaaagacgctgatcttgtcatcgctgacctggagcgtatatgcaaagaaaacaaataa

SEQ ID NO: 2962 - DNA, 303 bp, Bacillus licheniformis
atgccgttttttgttttttttattgtggtttcagcgatagcttatgtgtacttcaaagtaaggtatgtgcgcaccaaaaaagcggttgaacgggaatactattcggccaagtcaagcatgagtctgggcctgtttatcatgttcttcggcgccaatcagctgattttaaaccgcggcacgctggctgtcgtcatcggcgttatttttatgctgaccgggctcgggagcatgtgggccggctacaaggcctataagcactatgtccctttgcttgcgaaagaaaacgaacgggagaacgcataa

SEQ ID NO: 2963 - DNA, 1338 bp, Bacillus licheniformis
atgaaggtgaaacgattggcgacaaaacacgaacagattttaaaatatattgattctttgtctgtcggcgaaaaaatctccgtcaggcggattgccaaagaaatgaaagtcagtgaaggaactgcttacagagcgataaaagaagccgagaataaagggtttgtcagcacgattgaaagggtcggaacgatcaggatcgagcaaaagaaaaaagagaatattgaaaaactgacatatgctgaagtggtgaatgtcattgacggccatgtgcttggcggaaaagcagggcttcataaaacgctcaacaaattcgtcatcggagcgatgaagcttgatgcgatgatgagatataccggagcgggcaacctgctgattgtcggcaaccgaatcgatgcgcaccgccaggctttggaagcgggtgctgccgtactggtgacgggcggttttgatacggagccggagattattgagcttgccgacaggctcgagctcccggtcatttctacaagctatgatacgtttactgtagcggcgatgatcaacagggcgatttatgaccagctcatcaaaaaagaagtcgtgcttgttgaggatattttgactcctttagaaaaaacagtctgcttatcacctcatgaaaagctggaaagatggtatgagaaaaactttgaaactgggcacggacgctttcccatcgttgacgagcagatgaaaatccacggcattttaacttcgaaggacgttgccggatatgaccgcagtgtattgattgaaaaagtcatgacgaaaaacccgattacagtgatcggaaaaacgtctgttgcttcagccgcgcagatgatggtctgggaagggatcgaagtgcttcccgtcgttgacgagcggcaaaagctgatcggcatgatcagcaggcaggatgtattaaaggcgcttcaaatgatccaaaaacagccgcaggtcggagaaaaactcgatgacatcgtgaccggcggtttcaaagaatcggaccatgacaaaaacaagccggctccggtctatcaatacgaagtaacgccgcaaatgacaaaccacttggggacgatttcctacggcgtgtttacgacgattttgaccgaagctgcaaaccgctttttgcggtcgcgcaaaaaaggcgagctcgtgatagagagcatgacgatttattttttaaagcctgtgcaaatggagtctgtcattgaaataaaaccgaacattctcgaagccgggagaaagttcgggaaaatggatatagaagtttttcaccagggtgctctagtcggcaaagcgatgatgatggttcagctgatggaaagaagctaa

SEQ ID NO: 2964 - DNA, 354 bp, Bacillus licheniformis
atgtattccatcacagaagccggaaagcgtgaacttcacgggtggcttacggaatttaagccggttccagatacggtaaaagatgaatttatgctgaaagcttattttatctcttcgatggaacctgatgaagcgaaaaggctttttaacgatcagcttcaaaagagacaggaaaaagctgcttttttaaacaccaagctcgatgaattgaagcgcgaagcgggtgattcaataacgttccgctcgcctcatttcggccattaccttgtattgacccgggcgcttgagcgggaaaaaggctattgctcatggcttgaaaaagcgcttctcctgatggaggatgataaggcttag

SEQ ID NO: 2965 - DNA, 687 bp, Bacillus licheniformis
atgaaagtggcatatcatggtcattcagtggtaacagttgatacgggagatcatcagttgatcttcgatccgtttattacaggaaactcattaaccgatttaaagcccgaagatgtcaaagcggacgtcatcttgctgactcacggacataacgatcatgtcggcgataccatcgaaatcgccaagcgaaacaattcgctcgttgtagctccgaatgaactcgcggtctatctaggatggaaaggcctgaatgtacatccgatgcacatcggcggctcccaccagttcgattttggaaaagtcaagctgacgcaggctttccacggatcggcttatacggaagaagacagccaaaagatcgtctataccggcatgccggcggggatccttctgactgtggaaggaaggacgatttttcatgccggcgacaccgggcttttctcagatatgaagctgatcggtgaattaaatcatatcgaccttgccttcttgccgatcggcgataattttacgatgggccctgaggacgccaaactggccgcagaatggctcagagcgaaacaggttgtcccggttcactactcgacgttccccgtcatcgaacaggatccgcatgcatttgcggacagccttcctggaggcgtcggaaaagtgcttgaggtcggtgagtcaatcgaatttaagtaa

SEQ ID NO: 2966 - DNA, 675 bp, Bacillus licheniformis
gtgaattacaggcaagacgaagaagctgtccgccgcctcaaagaaaaatggcggtcatcccttgaccgtttgcagtttgttaagggtgatgtcaccaggaaagaagacctgctccggatggtgaatgccgctcttgagcgatttggaaaaattgatcttctgatcaataatgccggcccatacatatttgaacgaaaaaagcttgcggattatactgatgatgaatggtatgacatgcttgaaggcaacttaagctctgtcttccatctgtttaaagcggttgttccgatcatgaggcgccagcggttcggccgaatcatcacttacggatttcagggggccgaccatgcgcctggctggctgcatcgttccgcttttggagcggcaaaagtagggctggcttctttaacaaagacgatcgccattgaagaagcgggctccggcatcacagccaacatggtctgtccaggcaacattgtcggggatatgaaagaggcctcgatttcagaagcgagggcgtcacttgatgaggaaacgccgatcggcaggtcgggaaccggtgaagacatcgcaaggatcatcacttttctatgcgatgaacattccgactacattacgggaacagtcattgaagccacaggcggcttgaatgtgattaaccgtcattctctctag

SEQ ID NO: 2967 - DNA, 144 bp, Bacillus licheniformis
atgaaacaagatcagtcaaaacacggatatatgtatgatgccgacggagataaagaaaccgttcagcagatctctgatgcttatttcagcgggtttgtcgcgcacgatgacgcacagccgttagctgacgcagataaacaatag

SEQ ID NO: 2968 - DNA, 1380 bp, Bacillus licheniformis
atgaaaaagctgtggggaggccggttccaaaaaacaccggaaaaatgggtcgatgagttcggcgcatcgatccactttgacaaaacgcttgtaaaagaagatatcgcagggtctctcgctcatgcttccatgcttgaaaaatgcggcattttaaccgaagcagaagcggtcaaaataaaggaaggcctgacatcccttttgcacaaagcggaaaaaaacgaactcgatttttcagtcgattgcgaagatattcacctcaacctagaaaaaatgctcattgatgaaatcgggccgctcggcggaaagcttcatacggccagaagccgaaacgaccaggtggcgacggatatgcacctgtatttaaaagggcacactgagcatatcatcgagctgattacggcttttcaacacgttctgatcgaaaaagcggaagaacacgtggagacgatactgccgggatacacccatttgcagcgggcccagccgatctcgttcgcgcatcatttgctggcttatttctggatgctggagcgcgataaagaacgctatcatgattcattcaagcggattaacaagtctcctctcggatgcggggcgctcgccggaacgacgtttccgatcgaccgtgaatattccgcagacctgctcggctttgattcgatatatgaaaacagcctggacggcgtcagcgacagggatttcatccttgaatttttaagcgcgagcagcattctgatgatgcatctgtcaagattctccgaagaaatcattctttggtgctcgcaggaatttaaattcattgagcttgatgacacctacgcgacgggaagcagcatgatgccgcaaaagaaaaacccggacatggcggagctcatccgcgggaaaacaggacgcgtatacggtgatctgatcggactcctcacgattatgaaggggctcccgttagcatacaataaagatttgcaggaagacaaagaaggtatgtttgatactgtgaaaacggtcgaaggaagccttgagatttttgccggcatgattaaaacgatgacagtgaacaaaaatatgatgaaaaaagcaacggagcaggatttttcaaatgcaactgaacttgccgactatctggcgaaaaagggcatgcccttcagagaagcgcacgaagtcgtcggaagacttgtcttcacctgcatcgaaaagggcatttatctcagcggcctgccgtttgaagagttcaaaaaggcaagcgggctgtttgaagaagacgtctacatcgtgctcgacccgcaccatgccgtcgaaaaaagaatgagcgaaggcgggacgggattcaaaaaggtgacagaagccattcaaaaggcgaagcagtgtttgaacaatttttaa

SEQ ID NO: 2969 - DNA, 1212 bp, Bacillus licheniformis
atgacgcaaaagaaaaaagtggtattagcatattcaggaggacttgatacttctgtcgcgataaagtggcttcaggaacagggatatgatgtagtggcctgctgccttgacgtcggagagggaaaggatctcgcctttgttcagcaaaaagcgcttcaagtcggagcctctaattcttatgttatcgatgcaaaagaagaatttgcgaaagagtttgcgctgaccgccctccaggcccacacgctttatgaaggaaagtatccgctcgtatcagccctgtccagaccgctgatcgccaaaaagctcgtcgaagtggctgagaaagaaaacgcgcaagccgtggctcacggctgcacaggcaaagggaatgaccaagtgcgcttcgaggtgtcgattaaatcgctcaatccggatttggaggtgctggcacctgtgcgcgaatggaaatggtctcgcgacgaagagatcgcgtatgcagaaaagcatggcattccaattccgatcaatcttgacagcccgtattcaatcgaccagaacctgtggggcagaagcaatgaatgcggagtcctggaagatccttgggccgcgcctcctgaaggagcgtatgatttgacgaagcctcttgaaaaaacaccggatactcctgatgtgatcgaaatcgcttttgaagaaggcgttcccgtatccattgacgggactcactacccgctgtcagacttgattttaaagctgaatgaactggcgggcgcacatggagtggggcgcatcgaccatgttgaaaaccgccttgtcggcatcaaatcgcgcgaagtttacgaatgcccgggcgcgatgactttgattaaggcgcacaaggagcttgaagatttgacattggtaaaagaagtggcgcatttcaaacctataatcgaacaaaaaatggctgaagtgatctataacggcctctggttttctccgcttaaagacgcgctttccggtttcctgaaagaaacgcagaagcatgtcacgggcgtcgtccgcgtcaagctgtttaaaggccatgcgatcgttgaagggcgtaagtccgaatactccctgtatgatgaaaagcttgcgacgtatacaaaagacgatgcattcgatcatcacgctgcagtcggctttatcgagctgtggggactgccgacgaaagtaaacagcatcgtccaaaaaaaggagcagattaaagcatga

SEQ ID NO: 2970 - DNA, 519 bp, Bacillus licheniformis
atgagtgttgaagagcataaaaaagaagcgccggactgcgtcaactgcaaagtcattactgtcagcgatacaagaacggaagacacggataaaagcggccggctcatgaaagagtttttagcggaagccggtcatgagatcgtttcctatgagattgtaaaggacgaaaaggaaataattcaaaaagctgtgctgaaaggctgtctcgacgaccggatcgatgccgtcctattaaacggagggactggcattgcctcaagagatgtaacaatcgagtcgatcgttcctcttttttcgaaagaaattccggggttcggggagatattccgcatgctgagttatacagaggatatcggagcggctgcgatcctctcaagggctgcagcaggtgttattcaaaacaaagccgtatttgcaacaccgggttcaagcggtgccgtaaagcttgcaatgtcaaagctgattgtgcctgagcttgcccatgtcatcagagaactgagaaaagatatgaaaaagtaa

SEQ ID NO: 2971 - DNA, 1188 bp, Bacillus licheniformis
atgtccaaaattattgcaatcaatgctggaagctcatcactgaaatttcaactgttcgaaatgcccagcgaaaaagtattaacaaaaggccttgttgagcgaatcgggctggataacggcatcttcacgatttccgtcaacgacgaaaaaaagactgaaacaacagatattccggatcattccgtagctgtaaaaatgctgctggataaactgacaaaattcggcattatcaaggatttaaatgaaatcgacggaatcggtcaccgcgtcgtacacggcggcgaaaagttcagcgactccgttttattgacggatgaaatgatccatgagatcgaagagatttcagagcttgcaccgcttcataacccggccaatattgtcggaattaaagcgtttaaagaagttcttccgaatgttcctgccgtggccgtttttgatacggcattccatcaaacgatgccggaacaatcttatctgtacagtctgccatatgaatattatgagaaattcggcatccgtaaatacggtttccatggtacatctcataaatatgtgactgaacgcgcggcagagctgcttggccgtccgattgaagaacttcgcctgatttcctgccaccttggaaacggagcgagcatcgcagctgttgaaggcggcaaatcaatcgatacatcaatgggcttcacaccgcttgcaggtgtagcgatgggtacgcgttcaggtaacatcgatcctgcgcttatcccgttcattatggaaaaaacgggtcaaacagccgacgaagtcctggacacgctcaataagaagagcggtcttttgggtatttctggattctcaagcgatttgcgcgatatcgttgaagcaactaaagaaggcaatgaacgtgcggaaacagcactcgaagtattcgcaagcagaattcataaatacatcggttcttatgcagcgcgaatgagcggagtagacgcgattattttcactgccggcatcggggaaaacagcgttgaagtcagagagcgcgttcttcatggtttggaattcatgggcgtctattgggaccctgccttgaataacgtccgcggaaaagaagcgtttatcagctacccgcattcgcctgtaaaagtcatcgtcattccgacgaatgaagaagtaatgattgcaagagacgtcgtcagactggcacactaa

SEQ ID NO: 2972 - DNA, 987 bp, Bacillus licheniformis
atgcaaaactatccagtcgaaacgatttatgaatggcttgacaaaggagcggaagtcatcgcacgcgatcggcagatcccttacatagaaggattggcggaagccggagaggcattctttacaggttctgcggaccgcgggctttccgaagaagccgaacaaaaggtgaaggatctgatcggccgtgcgcgcttttcagagtgcagtcatgagtcgatacggaaagccttccagcttgccatactgaaaggccagaaagatattcctcatccgaacaggcagatgacgcccgatacgatcggattatttatcggatatcttgtgaacaaatttatggagcggaaaaaaggattgacgctgtttgatccggcggtcggcactggaaacctgctgcttgccgttttgaaccagctggctgaggaagcgggaaaagcgttcggctcagagattgatgacgtcctgatcaagctggcctatgtccaggcaaacctgcaggaaaaggaaatcgagctttttaaccaggacagcctgcagccgatttttatggaacatgccgatgcggtcatctgcgatcttcctgtcggatattatcctgatgacgaaagtgcgcgcgctttcgaattaaaggcagatgaaggccactctttttcacaccatttgtttattgaacaaagcttgacctatacgaaaccgggcggctatttattttttatgattccgaaccatttgtttgaaagcggtcaaagcgaaaagctgcgtacctttttaaagaacaatgcgcatattaatgcagtgcttcagcttccgctgtccattttcaaagatgaagcacacgcgaagagcattttggttttacaaaagcatggggaacaggcgaaagcgcctaaacaggttctgctcgcgcaagtcccgtcattcgccaatcaggatgcgatgctgaacatgacagccaaactcgacagctggttccaggctgaaaaaagataa

SEQ ID NO: 2973 - DNA, 504 bp, Bacillus licheniformis
atggcttcaattacatttaagggaaacccggtgacactggtgggttcagaagtgaaagtcggagaccaggcgcctgatttcacggttttgtccaattcgcttgaggaagtcacacttcaggacatcaaaggcaaaccggcggttatttcggtgattccgtctatcgatacaggtgtttgtgacgcacagacccgccgctttaacgaagaagccgcaggcctcggttcggtgaaagtgtatacgatcagcgctgacctgccgtttgcacaggcgcgctggtgcggagcaaacggaattgaaaatgtggaaacattgtcagatcacagggagatgtcttttggggaagcattcggggtttacattaaagaattgagattgcttgcccgcgccgtatttgttttagatgaaaacggaaaagttgtctacactgaatacgtcagcgaagcgacaaaccatccggactacgacaaagccatcgaagctgccaaatcactcgttaagtaa

SEQ ID NO: 2974 - DNA, 459 bp, Bacillus licheniformis
atggctgaacatccaattcaaggtttgatgaaaaccgcaatggaaaacttaaaagaaatgattgatgtcaataccattatcggagatcctgtggaaacacctgacggcagcgtcatcctaaccgtctccagagtgggattcggctttgcggctggcggaagcgagttcggcggcaataaaccggccgaatccaaagcgagcgatggagaccgcgaacgaaaagaatcgaagctcccgtttggcgggggaagcggaggaggcgtatcgattacgccgattgcttttttgattgtcggatcatcaggcgttaaagtactgcatttggatgaaaacacgcacgtcatcgataagattttagactcagctccgcaaacgatcgaacggattcagcatatgtttaagaaaaacgataagcagaagcaaaatatgaaccgtcaaaaccagacgcctcctttttaa

SEQ ID NO: 2975 - DNA, 684 bp, Bacillus licheniformis
atgatttacatatggattgcgggagtattcattcttttggcagcattgatgataatgaaaatccgcgtagcgatcgagtatcttcatacagacgatgacgaccggctgaccgtcaaagttcggacggcttttggcattctgcgcattaaaagggagattccggtgattaaaatcaaccaggaggatatgaccgttgatgtgaaagaacagacgaattcggctctgaaaaaagataaaaagaggagaaaaatcggctatcgggaagtgttcgatagtacgaagcaaatcaaaaaattggtggaacagatcatcaatatgcagccgatcatccgccggtttatgaagcggattcacgtcacgaagctcgaatggacctctgtcctcggctttcctgacgcggctttaaccgggattgtcacaggcggcgcctggtccctgaaagccggcacggtggctctcttgcatcagcttttttgctttgacagccagccggaatacgaggtgattccagcctttaacagccgttcctccaaaacgcatctgacatgtatattccattttcgggttggacatgctataaccgcagctttcagaatcgtggtgaactggaaagggaaaatgcgcggcttatttaagctgccaaaaaatctgtcaggttcaacaaagaatgattcatcagtatag

SEQ ID NO: 2976 - DNA, 519 bp, Bacillus licheniformis
atggatgtgacttatgatggaaaggatcataatgaattatcgccgaatgtcggcgtttccagggaagaatcggccccgcatgtagagcatgcctatgccggtttttggatcaggctgtttgcttttctgcttgacggggttgttatcggcagcatcaacaacttagcggtttcacccgttttcagcctgctgaacctccctaaagaatcagggtttttcaccttttcgctttattcttttgtgacggcggcagtattttttgcttactttgtcctgatgacgaagtatttcggacagacgttgggcaagatggtattcgggctgaaggtcgtgtcgcttgtcccggaaaaagggctgacatgggatgtggtcctgtttagggagtttatcggccgctatatcaacagtttatatattacgtatctcgtagcagcgttttcgcctaagaaacaagggattcacgatttctttgcggacactgcggttatccatgaaaaactgtatcgaaaaaaagactga

SEQ ID NO: 2977 - DNA, 1008 bp, Bacillus licheniformis
atgaatgcgaaaagatggatcgcacttgtcatcgcgctgggcgtttttgcgttatctgcggtgatgagccttttgcttgcagtatttgacacgatggggaatgacggaaagatgcagtttggcctcaatgacacccaggaagaaacggtgcttgaacaaggaaacagctcaagaaaaatcgccgttcttgaagtgaacggaacgatttccgacaatggcggcgcttcaggcctgttcagctctgaaggctacaaccacagatcgtttttgcaaatgcttgaaaaagcaaaagacgattctgccgtaaagggcattgttctgcgcgtcaattctccgggtggcggagtatacgagagcgctgagatacataagaagcttgaagagatcaaaaaagatacgaaaaaaccgatttacgtatcaatgggatcgatggctgcgtccggcggctattacatttcaacgcctgccgacaaaatctttgcagcgcctgacacgctgacgggttcactcggggtcatcatggaaagccttaactacagcaagcttgcagagaagcttggattaaaaacggagacgattaaaagcggtgagtttaaagatatcatgtcaccgacgcgcgatatgacgaaaaaagaaagagaaatcatgcagtcaatggtcgatgacgcgtacgaagggtttgtagatgttattgccgaagggcgcggcatgtccgaaaatgacgtgaaaaaaattgccgacggacgtgtctatgacggccgccaggcgaaacagaaccatctcattgatgagctcggctattatgaagatgcggtcaaagcgatgaaaaaggaccacaaaaaccttgccggcgcatctgttgtcagctatgaagaatcagccggccttgcctcgctgttttcaatgactgcaaataagatgtttaaaagcgaagctgatttcttaaacattaaagaagcgatttctcaatccggtgcaccgagactcatgtatttatatgccaaatag

SEQ ID NO: 2978 - DNA, 798 bp, Bacillus licheniformis
gtgacagaccgccgaaacatttatttcttttacaaaaaaagcgaagaaaccgacgagcagtgcaaaaaactgaaacagcttgccgaagaacacggatttcgcgtcgttcaccatcacaatgaagccaatattatcgcaagcatcggcggcgacgggacatttttgcaggctgttcgaaagacgaacttcagggatgactgcctgtacgtaggcgtggccaaaaaggggaaagctcatttgtatgcggattttaatatatatgataccgataaaatgattgaagcgacaaactcggagcaaatcgaggtcagaaaatatcctctgatcgatgtaaccgttgacgggaccagctttcaatgtctaaatgaagtatccatccgttcaagcattattaaaacatttgtaatggacgtctatatagatgatcttcattttgaaacattccggggggacggaatgatcgtgtccactccgaccggaagcaccgcttataacaaatcggttgatggggcaatcgttgatccgctgattccatgcatacaggtgacagagctcgcttcattgaacaacaacacatacagaaccctcggctcgccgtttattttaagcgcggatcgaaagctgacattaaaaatcgtccaggacgggaacgactatccgatcatcggccttgataacgaagccttcagtacgatgaatgtgaaagaagtcgaagtcagcctctccggcaagatgatcaaaaccattaaattaaaagataattcgttctgggaaaaagtaaggcgcacatttctataa

SEQ ID NO: 2979 - DNA, 636 bp, Bacillus licheniformis
atgagtaaaggacgtttgatgatcatcaatatgattggtattatcgcaactttagcgcttgtcgctgtatgcggatattactattatcaaaataaacattatgtcacgacggatgaagcaagggtttccgcaaatatgacaaaaataacggcgcctgcttccggaaaattaagcggctgggatgcaaaagaaggcgaccatatatcagacggcgacaacctcggaaaaatatcggacgggcagcagtcggtagctgtcaaagccatttccgacggaacactggtcaaaaatacagccgtcaatcataaaatcgtaaatgcgggggttgtcatcggtcaaactgccgatatggataacatatatattacggctcatattaaagaaacggaattacgcgatatcgaaaaagacgacaaagtggacatcaaagtcgacggggaccctgatacaacgtttgaagggaaggtcgaagagatcggatatgcgacagattcggtattttcaatgtttccggaaatgaaccaaagcggagactatacgaaagtcaccgagaaagttcaagtcaagatttcgattcaaaatccgtccgccaaattgcttcccggcatgaatgcggaagtgaaaatttcgttatag

SEQ ID NO: 2980 - DNA, 1623 bp, Bacillus licheniformis
atgagtcaatctgatgtggcgatcccgagctctaaaaaaatcggcattccgaagtatttgatcatttcggttttaacgatactggccattgggccgcaatattttcttaatctttcctatacgctcagtcaagtcgtcattcaaaacggacttcatttgtcaccggacgatatgcggattccgtccattttgacaaatcttgcttttgctctcggtgttccgcttggacgtatattttcaaggaggttcggcattcggaacagctacctgacactcatcaccttatttttatgcggctcgctgatcgacgcattttcagcaggcttgttttcgcttcttatcggaagggtgatacaaggattatgctccggaatgttatttttgacgattcttcctgtcaaattgatttcgtttccgaacaaggtccgcaatttgtttttgtttttcgtcattagcggattgttcggcgcttctgccatcggagcggtttttggttccctgtcactcagcgcggatgcatggcgctgggtgtttatattaaatatttgttcgcctgtcctttgccttgtgatcggcttcttttctttgccgaaacaagcagcggatgagcgggagcatcattcgattgataagacgggcgtttttatgctctcattgctcatggttgttttgacggtgccgcttatcaatttgcagaagacgggtgttcattctttttatgtgtggccgttctttttggccggattcatcattttggcgttgtttgtcattacagacttgcgcgcccgggaacctcttgtgccgtttcgttcactgtggtccgcaaaagctgtttccgggacagtcatggccgttgcttcacacattgcaatcattgtttcccttgccgggataaacggatttttggaaaacattgcagaggcttcttttgaaagcatgacacgcttttatttgtgttttttcgcagggattttagctactgccgtgctcagcacgcttttgtatgatcattttggcgccggattgctcggctgtatcggcgctttggaaatgatcatcgtcggtatggaatggagatcggttcaacccggtgtttcgatggagtcgttatatcttcatgctgttttgctgggcagcggcgtcagcatggtattggtatcgggagcgctgggcacggcgcttgccggagatattcaccaagcttcaaaacgctcggtttcgcttcactttatccgcaatttcgccggtgcctgggctgcaccggtgatcggctggtttgcttcaatgaagaatgcggtgcactacgagatgataagaggacatatcagtgaagctgatcctgaaattcagctggaattgtcaaaaatgattcgtgattttgtcagcagcgggctttctgttggtgatgcgaagaacatggcggcctatacgattgttgcaaatgccagaaaagcttcagcccttggcgcatatcacgatttgtttacgatactgctctggctaagcatcatcatgcttgcggcttcaattggaaaggcagcgaccggaaaaggaagatcgctcgttcagaagcgccttcgcctgccagacccttcagcaagtcaacaaaaggagataggataa

SEQ ID NO: 2981 - DNA, 429 bp, Bacillus licheniformis
ttgggtcatgactcactccgaaacatagagaaagaaatcgcgcttttggtccgtctgacgacggcctacagcccgcgctttggaagtctggaccgctcggaatatctgctgttaagcgagcttgataagcaaagtcctctcgccatcaactcgctggctgaaaccttaatgctgaatctgtcgacagcaagcagacaagtttcagccttggaacggaaaaagctcatcagacgttttcctgatcccaacaacggccggatcagccttgtggagatgacttcggagggcattgatgctctgaaaaaagtgcaaaaggcccgctatcatgtatacacggaggttcttcaagactggacaacagaagaactgaacacgttggaaacccgcttgatcagactgaatcaggattttaaaaagtggagcaaataa

SEQ ID NO: 2982 - DNA, 1590 bp, Bacillus licheniformis
ttgagaagagaagatttgattgcgccggagaagtataatgcggttgatgaaattgaaaaatttaaatcttcccgcgataagaccgcattgatctgggaagatgaatcagggcgtcaagtgtcatggtcctatgaaaaattgattgaaaaggcttacaaaatcggcagcatattgacccgttctggactgaaaaaaggtgacaagcttatcgtgatgatgccgcggataccggaaacgtatgccgtgtacatggccattttaaaagctggaatggtggtcatcccatgttccgaaatgcttcgggcgaaagacttggattacaggatcaagcatgcaggcgtcaaaggagccgtcgtatattcagcatttcttgatgcttttctagatgttcgttcaaaagaggcactgtcgttatttgccgtcggagaaagcagcgaagggtggatcaatctgctcgaaaaaatgaatcaggccattgcagcggattttcaagcggcggatacctctcgcgatgacatcgcatttttatcttacacatccggcacgaccggtcagccaaaaggggttgtacatacacacggctgggcttatgctcacttaagaacgacagcttccgcatggcttgacatttcggaaggggatctcgtctgggcgacagcagggccgggctggcaaaaatgggtatggagcccgtttttagcagtgctcggtagcggtgcaaccggctttatctatcatggaaaattcacgccggaaacgtatttgcggctgattgagcgccatcaagtcaatgtgctgtgctgtacgccgacagagtaccggttcatggcgaaagtcaatgatttgtcccgatttgacctgtcttctctgcacagcgctgtttcggccggagagccgttgaacagggaagtcatcgatacatttaaaaagcattttcatattgctgtgcgggacggatacggacaaacggagagcacgctgttggtggggattttaaaaggtatgaaaatcaagcctggaagcatgggaaaaccgacgcctggaaacttggttgatattattgacgggaatggaaagagctgtcccccgggcgaaacaggcgatattgccgttcacttaagcacgccggctctttttaaagaatattacaaagatcaagaacgaacgctccgacaaagaagaggggattactttataacaggggataaggcgcgaaaggatgaagacggctatttttggtttgaaagccgcaatgacgatgtgatcatcagctcaggatatacaatcggcccgtttgaagttgaagatgcgctgatcaagcatcctgaggtcaaagaatgtgctgttgtggcaagccctgatgaaatcaggggatcgatcgtgaaagcatacgttgtcttaaaggacccatcccgcggaaatgaacacctgacaaaggaattacaagaccatgtaaaagccatgacggccccttataaatacccccgggagatagaattcatcgaagaactgccgaaaacgccttcggcgaaaatcaagcgctttgaactaagacaacgggaaatcgcacttaaaacgaaagctgaataa

SEQ ID NO: 2983 - DNA, 213 bp, Bacillus licheniformis
atggctcaaaacaacagacaaagcagttctaaccaactattggttcctggtgctgctcaagctatcgaccaaatgaaattcgaaatcgcttctgaatttggcgttaaccttggagcagaaactacttctcgtgcaaacggttcagttggaggagaaatcactaagcgtttagtttctttcgctcaacagcaaatgggtggaacacaacaataa

SEQ ID NO: 2984 - DNA, 1206 bp, Bacillus licheniformis
atgaatgaggactacattttaatcagatttggcgaaatttcaacaaaaggaaagaatagaaagctttttgtcgatcgcctgaaaagaaatatcaaaatggtcttgcgcgatttccgcaacgtccgttatgaatcaacacgcgacagaatgactctcgtattaaacggagaagacgctgaagctgtaatggctcgtctgaaacacgttttcggcatccaatcgttcagtcttgccgtgaagtgccggacagatctggaaagcattaaagagacggcgctcgcttctgttcaagaacaatacaagcccggggatacctttaaagtatcgacgaaaagggcttataagcagtttgaattaaatacaaatgagatgaatgccgagatcggaggacacattttgcgcaacaccgacgatcttaccgttgacgtccactccccggacatccatttgcgtatcgaaattcgggaagatgccacgtatttgacattccgggatgaaaaaggtgcgggcggactgccggtcggaagcggaggaaaagcgatgcttatgatatccggcggaatcgacagccctgttgccgggttctatgccatgaagcgcggacttgagatcgaagccgttcactttttcagcccgccatatacaagcgagcgggccaagcaaaaagtgatcgatcttactaagcggcttacggcttttggcggagacatcaagcttcatatcgttccgtttacaaaaactcaagagctcattcaaaagcagattcccgagaactattccatgacggcgaccagaaggctgatgctccagatcgccgacaaactgcgcgaacgccataacgcgcttgcgatctttacaggggaaagcctcggccaggtggcaagccagacgcttgaaagcatgtatgccatcaacgcggtcacgagcacgccggttttgcgccctttaatcggcatggataagacggaaatcatcgaaaaagcgaaggaaatcgatacgtacgatatcagcatacgtccgtacgaagactgctgcacgatctttacgccttctgcgccgaaaacgcgtccgaaaaaagagaaaatcgaacactttgaaagctacacagatttcgaaccgcttatcaacgaagctgtggaaaacacggaaacgattgttttgagcagcaaagcggaaacgaaagatcaatttgcggattttttctaa

SEQ ID NO: 2985 - DNA, 1146 bp, Bacillus licheniformis
atgatttatcttgataatagttcaacaacaaaaccatatcctgaattattacaaatttatgaacaagtaaatcagcgcttcttcggcaacccgtcgtctctgcaccgccacggcgttgaagcggatcaattgctttctgaagcgcggaaacagattaaatcggcgctttcgctaaaaaatcatgatatcgtgtttacgtccggcgcttcagaagccaataacatggcgcttaaaggcattgctttggcacatgcgcaaaaaggaaagcatatcattgcttcctccattgaacacccgtctgtgacggaatccttggagcagctgaagacggccttcggctttgaggttacatatcttcctgtcgacggccatggctttgtttctcttgaagacttgaaacaagcgctccgcaaagacacgattcttgtaagcatcatgcacgtcaacaatgaaacaggcgtcatccagcctctggaagaaatcgggaaaatcgtaaaagaaaacacaagggcatactttcacgttgatcatgttcagggcatcaacaaggttccgctggacatctccggggcagccattgacctttgtacaatctcgggtcacaaatttcacggcttaaagggaacaggagccctcattctaaacgaacggatctcgctttttcctttgatttccggaggagaacagcagaacaacaggcgtgctggaactgaaaataccgccggcgccgttacacttgcaaaagcgatcaatttgtcaaaacaggattataaccattatatagaagaaataaaggcggcaaaatcagcttttatcaaggagctaaaagagctgaaaggtgttatattaaatacgccggaagaaaacagcgcgccgcatatcatcaatttttccgttccgggattgaaggctgaggtccttttgcatatgctagaggagcgggatattttcgtatcgacgacatcagcatgctcttcaaaacagcataagccgagcaaggtgcttttagaaatgggaaaaggtgaaggtgcggcctcaagcagcatcagaatcagcatgacgtaccgggataatcatgagattgtcggcccgtttatgacggccttaaaagaaagtttacacaaactaaaaggaattatgaggtag

SEQ ID NO: 2986 - DNA, 1338 bp, Bacillus licheniformis
atgaaaacttcactatccgctaaggaaacgacggcgattgggcttatgctgttcgccctctttttcggagcgggaaatatgatttttcctccccagcttggtcaagctgccggagagaatatttggccggctatcatcggattcttgctgacgggcgttggtcttcctctgctcggcgtcatcgcggttgctttaaaagggagtgcaaaaggcctagctgacaaagcccacccggtcttcggcacgatattaatcgtcagcatttatttaacgatcggacctttatttgccattccgaggacgggaaacgtttcatacgtcatagcggttgagccgtttttaggaaaacattcgtcaagtctttatctgttcatctttaccctgatctttttcgggatcacttatttcttggcgttaaacccaagcaagcttgttgaccgcatcggtaaaattttaacaccgatattattgactgtaatcgcaatcttagtcatcaaagcgtttatcaccccgatgggcagcatcgggtctgtgacagaggcttaccaatccgcaccgctgtttgtcggatttttagaagggtataaaacgatggatgcgatcgcttcaattgtttttggaattgtcgtcattacggcaattaaagaccgcggagtcacaaatccaaagtcaatcgccgcttcatgcatcaaagcggggatagtcgctgcagtcggtctcggactcgtttacgtttcactcgcttatttaggggcgacaagcgttgaaaccgtcggttcgctcgacaacggcggcgaaatattgtccaaagcttccgcatatttgttcggctcgcttggaaatgccgtgctcggcatcgcgatcttgttcgcctgcctgacgacaagcgtaggacttgtttcttcttgcggagagtatttttcaaatctgattccgaagctctcttacaaagcagttgtcatcattgtgacgcttttcagccttgtgattgccaatttcggactgacagaaatcatctcgttttcagtaccgattctgtctgcgatttatccgcttgcgatcgtcgtcgttttgctctcattcattgataagctgtttaatgaacggcgcgaggtctatatcggcacccttatcccgacaggaattctgagcatcatcgacggattaaacgcggcgaaaatcccgctggggccggttaacgatatcttaaaagcgaacatcccgctgttcagcatgggtgtcggctgggtcgttccggctgttatcggcgcagtgatcggttacattgtgacattttttatcgctttgccggaggacaaattaaagaacgtcagctga

SEQ ID NO: 2987 - DNA, 333 bp, Bacillus licheniformis; identical to SEQ ID NO: 485

SEQ ID NO: 2988 - DNA, 861 bp, Bacillus licheniformis; identical to SEQ ID NO: 484

SEQ ID NO: 2989 - DNA, 1695 bp, Bacillus licheniformis
atggagtttgtcattggcttactggcgttatttttaatcttattcgctacgggctacttattcagaaaaaatatatataaagagatcgaccgtttagaagcttggaaaatcgaaatcatgaaccgttcgattgtggaagagatgtcaaaaatcaagcatctgaaaatgacggggcagactgaggaattctttgaaagatggcgccgggaatgggatgaaatcgtcacctcgcatatgcccaaagtcgaagagcttctgtttgaagccgaggattgcgccgacaaataccgttttcaaaaatcgaaacaggtgctcgcgcatattgagaatcttttatcagcggctgagtccaacattgaagacatcttaaaggaaatcgccgatcttgtctcaagcgaagagcagaaccgcaaagaaatcgaagaggtaaaagaacgttatacaaaagtgcggaaaaaccttttggcatacagccacctgtacggagacctctatgcgaaaattgaagccgacctcgataccgtgtgggaaggcattaaacagtttgaagaggaaacagaaggcggaaattacatagaagccagaaaggtgctgcttgcccaagaccgtttgcttgaagagcttcaatcatacatagacgatgtgccgaaactgcttgccagctgcaagcagacagttccgcaggaaatcgcaaaattgaaagccggctatcaggaaatgatcgataaagggtataagctcgatcatattcaagtggagaaggagctcgaaaaccttttgaaagaattgaagcgcgctgaagatgcgcttttggacgagcttgatttagaggaagccgccgcaatcgtgcagatcattgatgaaacgatccagacgctgtataaccagctcgagcatgaagtcgaagcagggcaggaaattttgggcaaagtgcctgagcttgccgctgcattggaaaagcttgaagcctccaaaaaggataccgaagctgaaaccgagctcgtcaagaaaggctacagactgactaccggcgaactggagaagcagcagtcatatgaaaagcgccttgaaatgatcgaaaagcagttcgaacaagtgagagaaaggcttgatcagaaacatgtcgcctactcgctgttaaaagaagagcttgccgatatcgaaaagcagatggaagccgcgcaacgggagcatgacgaatacagggacatgctgcaaatgctgagaaaagaagagcttcaggcaagagagcttctcaagcaattgaagcagacaatcaaggatacggcgcgcagcctggagaaaagcaatgttccaggcatcccggaggccataaccgaaaagatccgacagtcgcagacgactgtgcagaaagtgacagaacagttgaatgagctgccgctgaacatggatgcggtgaacgaacgtcttcaagaggcggaacagcttgtcacggaagtgaaaacaaagacggacgaactggttgaactggttttgctgatcgaacgcatcattcaatatggcaaccgcttcagaagccaggaccgtatcctttccgaacagctgaaagaagcagaaaactgtttttacgcatatcagtatgaagaggcttacgacatagccgccagagcggtggaaaaagcgtcgcctggagcagtggcccggcttgaagcggacgcgaagcagcctgaataa

SEQ ID NO: 2990 - DNA, 813 bp, Bacillus licheniformis
atgctgaaacgagacggtcatgttcattctcccttttgtccgcacggatcaaaagacgaattcagatattatatagaagaattgtgcaaaaaaggcttccaatccgtatcctttactgagcacgcgccgcttccgccttcatttattgatccgactccggagaaagacagcgccatgccgatctcccagctgggccgctatattgaacggctgaccgaactgaaggaagaatacagaggacagcttgacattttgatcggtcttgaagtcgattatatccgcgcctttgaacatgaaacgaaagcttttctcgatcagtacggcacacatcttgacgacagcatcctgtccgttcattttttgccggctggatcttcatacatctgtcttgactacgatgaaaaagcgtttcagcagctgatcgactgctacggcagcacagagcaggtttatctcgcctattatgacgaaatctattcttccattgtatcaccgttgggagcatttaagccaaaacgaatcggccacatcacgcttgcgaaaaaatttgtgaagctgtttccgtatacgatgtcggaaagcgttagaaaatcggtctcctcctgtctggatgaagccgcaaaacgcggacttgaacttgactttaatacggccggcctccgcaagccttatgcaggcaacgtctatatggaagaatggatgataaaagaagcggaacaaaaaaacatcccgcttgtctttgggtctgacgcccaccaagcagaggatgccggatttggttacgaacattttgagagccgctttgttaaataa

SEQ ID NO: 2991 - DNA, 639 bp, Bacillus licheniformis
atgggatcaaacgctactccaaccacgaaggacaggatcatcgaatctgccgtggaactgttcaaccaaaaaggtttttcaggaacatcagtccgcgaaattgcccgagcagccaatgtcaatgtcgcccacatctcctattattttaatggaaaaggcgggttaatggagcatttagtatcccgtttttatgaaggctatttaagaatccttgaaaagggccatgaacgccttcaggatgcaggtgcaacggattgccttcttcaattggtttttgatattctatcgtatcagcatgaacatcgtcaattaactcggtttgtctatcgcgaagtcacgattgattccacactgaatcgtgaagtgatgtcgacatatttaacgaaagaaaagtacattctccatctgatcattgaaaagggaaatgaggacaacgaattttcccgttttcccctttcccattttatgattcagctgaagtcgcttttaatgatgccttatctgcagcctcaatatatttcagaagtgctttatgtacagccgcacgagccgtacttttatcaggcgtattacaaggaagtcaaaacatggcttctcagtctgttgtacagagagcgtcggcaagccgccgttatttaa

SEQ ID NO: 2992 - DNA, 495 bp, Bacillus licheniformis
atgtttcatgtcgaaaaaacagaaggcagtaaagaaaaaaaatacgagcttctcctcaaacagatcgatgcgctgacagaaggcgaacctgatatgatcgccaatacagcaaacgcttccgctcttttgtatcaatcattggaagacgtcaactgggcgggcttttattttgccaaagacggtgagcttgtgctcgggccgttccagggacttcctgcatgcgtaagaatcccgttcgggaaaggcgtctgcggcaccgcttatacaaacggccgggtcgagcgcgttgaagatgtgaacgcattccccggacacattgcgtgtgatgcagcgtcccaatccgaaatcgtagttccgcttgaagttgacgggagcatcatcggagtgctcgatatcgacagcccgattaaaaaccgcttcgatgaaactgatgagtattatttgaaaaagttcacggagaagcttggagagcgtttaagcgaaaagagccggtaa

SEQ ID NO: 2993 - DNA, 1701 bp, Bacillus licheniformis
atgaataaacaaactgaagacctatatctgacttttcatcaaaagctgtttcaattttttttaaaaaagccggccgtctcgtacgacgactctgttgcctggctaaaagcggcagcagagtcatttttttcgtttatatctctaacagtgcagccttcttcaagactgcagggatcgagaggcgacggtgatccgatcagacgagtgagcgattatcataccattataacaatagaagaaaacagcaaatatatagaactttcatgtcaaaagaaacataaattaccagaacgtctcgcggaatccattcatctgtttttggtgcattgtctggagcttgacgcattatttcgtgatgagcttaagaaaacaaagatttatgaaaagacggagctgctgcatgagctgatggatcaggagcaggtgctgaagacaatgctcgaaagcttaaggagtgtgtttccttttttaacgtattgtcttttcttgtcatacgatgaggatcaatacatcaacctccctgcgatagagttggatgtgcaaagcgaatcgaccgattcttttgccttggaggcatacttatcaggacaggagaagagcaaaaatgaagcggaagtatacattccgattaaaggccggcagggaacgtacggcgttttgaaagcctttggaccaggcgctgccgatacggcagcggatatatgcattatttcgaatgcggcagggaaagcatttgaaaattcacggctttacgaacagtcgcagaatatgatttcaaatttggagctgattaatgaaacatcgcatcagctgaaccggacgaaacgccttccggatatgatgaagagcttgtccgaaaggctgatcagttcattcggcgccgaagaggtgggctttttttataaaaatcacttaggaaaggaaaccctgctgccggaaagcactagtttttttcagacggatgaggcccttccatacatccgctatgtcaaagagaagatatcagaggaaaacggggtgtttgtcggaaacggttcttcgctttttgggaatgaaggatatgcttcattaatgggcgttccgatgctggaaaataatgaaaacaaagggtttgtcatcgtgttgaaaaaaaacgtctgctccttttcgtttgagatgtttaagctgtttcagacgctgatcaggcattccacgctcgccgtatcgaatttgatgctgcgcgaccggctgaagtatcttgttcagacagaccgtttgacagagctctactcgagaagccatctcgatgagaaaatcgggtacagtatgaaattggacgagagcggcgtcctcgtattgatcgatatcgatgattttaaacagattaacgatacgtacggccatcagaaaggcgatgatattcttatacaagtcgcccgggtgatccagcgaaacatccgcgatcaggatgtcgcagcaaggtggggaggagaagagcttgcggtatacttgccgaaagcaaggctgaacgccggtgaaatgcttgccgaaaggctcataatgcttgtcagggaatgtacggatccgacggtgacgatttcgtgcggggtatcccattggtctcaggatcgtccgaaatctttatccgacctttttaaagaagcggatgtcgcgctgtacaatgcaaagcggaacgggaaaaacaagtttatgacacattaa

SEQ ID NO: 2994 - DNA, 603 bp, Bacillus licheniformis
atggctcgctatacaggtccaagctggaaattatcccgccgtttaggcatctctttaagcggtacgggtaaagaattagaaaaacgtccttacgcaccaggtcctcacggtccgggacagcgtaaaaaactatcagaatatggtttgcaattgcaagaaaagcaaaagcttcgccatatgtacggtgtgaacgaacgccaattccgcaacctttttgacaaagctgcgaaaatggccggtaaacacggtgaaaacttcatgattcttcttgagtcacgtcttgacaacatcgtttaccgtcttggcctggcgcgcactcgccgccaagcacgccaattggtaaaccacggtcacgttcttgttgacggaagccgcgttgacattccgtcttaccaagttaaacctggccaaacgatttcacttcgtgaaaaatctcaaaacctttctgtcgttaaagaagcggttgaagtgaacaactttgttcctgaatacctgacttttgacgctgaaaagcttgaaggttcactaactcgccttccagagcgttctgagcttcctgctgagattaacgaagcgctgatcgttgagttctactctcgttaa

SEQ ID NO: 2995 - DNA, 231 bp, Bacillus licheniformis
atgcttttgttttttgctaagtttgtcttgttctacgtattctgttcagttgcattcgcccttttcaaagtcatgtactacaatatcagcaaaaaatgggttacaaagacggcggagggcactaaactgaattgggctttgaatgtcttcttaaacacggcaagaaaatggacagcaacgactgctttgttatggggggttttagcgggatggtgtgcgatttatttataa

SEQ ID NO: 2996 - DNA, 438 bp, Bacillus licheniformis
atgaagtggtattggagaggcttgaagaattatgcgaattttgaagggagagcaagacgaaaggaatactggttgtttcatgtatttaacggcatcatatgctttatattatttatcttatcattaatggtagtaagtttatttatttcaggaatcatgacagcagaaggatatgacagatatcaagtaggatatattattgggtatggcggggggttcctcggatacattctcatctttatttatcagttggctgttttggtgccttctttggctgtcaatgtccgcaggctgcatgataccgggagaagcggctggtggattttaattggctttttgccgattatcggtgctgtcattctgcttattttttactgtcaggctggcgaagcaaaagaaaatcaatatggaccaaatccaaaagtaaatgtatcgtaa

SEQ ID NO: 2997 - DNA, 762 bp, Bacillus licheniformis
atgaatattcaacaaattcgaaatgcaacattggccgtcaaatatgcgggcaaaacatttttaatagatccgatgctggctgaaaaaggcgcttaccctcctttcccgaactcagcaagacaagagcaaaacaaccctttggtcagcctgcctgtgccaaccgacgagctcgtcaagaatacagacgcagtcatcgtcactcatctgcatttagatcattttgacgatgctgccaaagatctgcttccgaaagaaatcaaactgtttgtccaaaatgaagcagatgctgaggaagtgagaaaagccggttttcaaaatatagaggtcttaacaaaagatacggggtttgaggggattcaattaatcaaaacaaaaggcgagcatgggaggggagagatattaaagcttgccggagaagtgtgcggcgttgtcttcaaacactcaaaggagaaaacgctgtatgtggcaggggatacagtttggtatgaaggtgtccgggaagaaatcgctgcgcatcagccggacgtcatagtcgttaacggaggagacaatcagttctttgaaggagggtctcttgtgatgggaaaagaggatattgctgaagtctatcaagctgcacctaaggccacaatcatttccagtcatatggaggctgtcaaccattggactttatcacgaaaagaattgaagagcttcattcaggaaaaaggaatgtcctcgcgcgtacttgtgccggatgacggcgaatcttacacattttaa

SEQ ID NO: 2998 - DNA, 420 bp, Bacillus licheniformis
atgctggatcatacagacaagcaaatcatagaggaattatcaaaaaacagccggatgaccatgaaggaattaggagagaaagttcatttgacaggccaggcggcttcagcaagggttgctaaattagaggatcaaggagtgattgaaggttataccatacaagtgaatcaagtgaaactcgggtgttttattcacgcttttatcaatatctatacaaaaagcacttatcataagccttatctttcatttattaaagcacagcagaaatacatcattcataactataaaatcagcggagacggctgttatcttcttgaatgcaagtttccgtcaaatcaacagttggaccaatttttaatagacttaaaccatcatgcaaattataaactgtcgatcgttatcaataaaacgggtgggtaa

SEQ ID NO: 2999 - DNA, 228 bp, Bacillus licheniformis
atgtatgttcattcaggaaatgtcaaaaatatagatgtaataggtagagcgtttccatcgttgaagagggaggaatgtagcatgaacctgttcattgcagccaaagagaaatttatggaagattaccacaagcagctggaaacggaacgaaaacaagaggtgcagcagtcggctgacggatacaatcaattgaatcagacggaaaatgcagcaaagcggctgaagtag

SEQ ID NO: 3000 - DNA, 1266 bp, Bacillus licheniformis
atgacacacatacttgatgatttgtccttcaggggactgattcagcagcaaaccgatgaagcaggcttgagagaactgctcgataaagagaaaatcagcttatactccggatttgatccgacagctgacagtctgcatatcggccacctgctgccgattttaatgcttcgccgcttccagctggccggacatcgtccgattgcgctcgtaggcggggcgacgggccttatcggcgatccgagcggaaagaaagcggagcgcacgctgaacaatgaagaaatcgtccgcgaatggtcgcagaaaatcaaaaaccagctttcgcgtttccttgattttgaagctgaagagaacccggcgatcatggcgaacaactatgactggatcggcaaaatgaacgtcattgatttcctgcgcgatgtcggcaaaaacttcggaatcaattacatgcttgccaaggatacggtaagctccagaatcgagacaggcatatcttatactgaattcagctacatgatcctgcagtctctcgatttcttgaatttgtacagaaaccaggaatgcaagcttcagatcggcggaagcgaccagtggggcaacatcacatcaggtctcgaactcatccgcaaatccgaagagaatgcaaaagctttcggattgacgattccgcttgtgacaaaagcagacggcacgaagttcggaaaaacggaaggcggcgcgatctggcttgataaagagaaaacgtcggcgtatgagttttatcagttctggatcaataccgacgacagggatgtcgtgaaatacttaaaatacttcactttcttatcaaaagaagaaattgaagatctcgctgaaaaaacagagacggcgcctgaaaaacgcgaagcgcaaaagcgcctcgccgaagaagtgaccgttcttgtacacggccgtgaagcgtttgagcaggccgtcaacatctcaaaagcactgttcagcggagatatcaaacaattgacagctgaagaagtaaaagtcggctttaaaggggttccttccctggaggtcgagaaagcggatgaacttcctcttgttgaaatactcgtccaatcaaagctgtctccgtctaaacggcaggcgcgcgaagatatcacgaatggcgcggtatacgttaacggcgagcgccgcaccgatgttgcggacgtcctcaccgccgacgaccgcatcgaaggacagtttaccgtcattcgccgcggtaaaaagaaatacttcctgctgacttataagtaa

SEQ ID NO: 3001 - DNA, 1719 bp, Bacillus licheniformis
atgaaattgaaagcgctgccagcagaaaagggaaattacaacttgaaagactatgatgaaacataccggacatttgactggaaggatgccgaaaagcatttttcatggcacaaaacgggaaaaatcaatgcagcttatgaagctatcgaccgccacgctgagtcaaatttgaaaaacaaagtggcattttactacaaagatccggtccgcgaagaaaagtacactttcagagagatgaaaaatgaaaccaacaaagccgggaatgtcttaaagcagcatgccgatgtgggaaagggagaccgtgtgtttgtttttatgccgagatcgcccgagctttattttattcttctcggcgccatcaaattgggagcgatcgtcgggccgttatttgaagcgtttatggaaggtgccgtcaaagacaggcttgcaaacagcggagcgaaggtcatcgtgacgacgccggaattgcttgaacgggtgccggccgatgaacttccggatcttgaatcaatcattgtcgttggagaaggcgtaaaggaagaaggacctgtcattgattattacgcgaaagcggcggaagcaggcactgatcttgagattgaatgggtggatcaggaagacgggatgctgcttcactatacgtcgggttcgaccggcgcgccaaaaggggttctccacgtccataaagcaatgatccagcattatcaaacagccaaatgggttcttgatctgcatgacgatgacatctattggtgcaccgctgatcccggctgggtcaccggaacggtttacgggattttcggtccgtggctgaatggagctacgaatgttgtcgtaggcggcagattcagtcctgaggcatggtacgaaacgattgaaaaaatggaagtgacggtatggtacagcgcgccaacggctttccggatgctgatgggtgcaggcgacgatcttgtgaataaatataatctaagctccttgcggcatattttaagcgtaggggagccgttaaatcccgaagtcatcaggtgggggcataaagtcttcggcaaccggattcatgatacttggtggatgactgaaacaggatcgcagctcatctgcaattacccgtgcatggaaattaaaccgggatcaatgggcaagccgattcccggtgtagaggctgcaatcgtcgacaaccagggaaatgaactgcctccttacagaatgggaaatctcgccattaaaaaaggctggccgtcgatgatgcattcgatctggaacaatcctgaaaaatatagctcctattttatgccgggcgattggtatgtgtcaggagattccgcctacatggatgaagacgggtacttctggttccagggacggatcgacgatgtcatcatgacatcgggcgaacgcgtcggcccgtttgaagtcgagagcaagcttgttgagcatcaggccgtcgctgaagcaggcgtcatcggcaaaccggatcccgtccggggtgaaattattaaagcgttcatcgccttgagggacggttatgaaccgtcagatgcgttaaaagaagaaatcaggcagttcgtgaaacaaggcttggccgcacatgccgcgccaagggaaatcgaatttaaagataaactgccgaagacaagaagcggaaagatcatgagacgcgtcctgaaagcatgggagctgaaccttccggcaggcgatctctcatcgatggaagactga

SEQ ID NO: 3002 - DNA, 633 bp, Bacillus licheniformis
gtggagcatcacaaaacttatcatgccaaagaattgcagaccgagaaaggctctgtgctgatagagggccctatcagtcccgaaaaactcgcagaatatgaatttcacgacgagcttacagcctttcgcccatcacaaaaacaacatgaagcattaatcgaaatcgcagggcttcccgaaggacgaatcatcatcgcccgtttccggcaaaccattgtcggctatgtgacatatgtttatccagacccgcttgaaagatggtctgaaggaaacatggaaaatttaatcgagcttggagccatcgaagtcattccggcgttcagaggtcactctgtcgggaagacgctgcttgcggtcagcatgatggatccgcagatggaaaaatatattatcatcacgactgaatattactggcattgggatctaaaggggactaacaaagatgtttgggaatacagaaagatgatggagaagatgatgaatgccggaggacttgtctggtttgcgacagacgatccggaaatcagctcccatcccgccaactgtttaatggcacgcatcggaaaagaggtcagtcaggaatcgatcgagcgttttgacagactcagattccacaatcgttttatgtattaa

SEQ ID NO: 3003 - DNA, 645 bp, Bacillus licheniformis
atgattgttgaaaaaatcatgaaacgggatgttgtgacactatccagaaccgatacgattgaagaagcgatcaaacgcatgcgaacattccacataaagcaccttcccgtcatcaatgaacggggaacggtcataggcattgtcacggacagggacgtcaaaacagcaagtccgagtatctttgcccaaaacagatctaacgaagatttaaaaaagccggtggaactgatcatgtccaaagaagtgatcaccggtcacccgcttgattttgccgaagaaatatcagccgtcttttttgaacacgaaatcggctgcctcccgatcgtaaaaaacggaaagcttgtcggcatcgtgacaaaatccgatttgctgcatacgttcgttcagctgacaggagcccattttccaggctcccaaatcgaaattaaaaccgatcatatcgcccgaagcctcgctgatatcagcgccatcttcagcaggcgccaaatcgccatattgagcgtgctcgtatatcccggtgatgaagatgattcgaaaatactcgtgtttcgcgttcaaacgatgaatcccgcctctatcatcaaagacgtaaaatccaaagggtatcaggttctttggccggctgttcaaagggatttgccatga

SEQ ID NO: 3004 - DNA, 1188 bp, Bacillus licheniformis
ttggccggctgttcaaagggatttgccatgaaggacagcgtatttattttttctccctcatatcaaacctatcaatttcatcaagaccacccgtttaatcagctgcgagtctatgtaacatacgatcttttgaacacggtcggcgcatttgaaccgggagaaacgattgccccgcgcgcagcgacagaaaccgagctcgagcttgttcacacgggcgattatatcagggccgtccagcttgcaggggcgggaaagctcccggcagccgaaagcgaaaactacgggcttggaacggaggatacccctgtttttgccgggatgcatgaagccgcctcccttttggtaggcggaacgctgacggctgcagactatgtcatgacgggcaaagctagacacgccctcaatcttggaggcgggcttcaccacgggttcagaggaagggcttcaggcttttgcgtctataatgacagttcagttgtgatacgttacttgcagaaaaaatatcatgcgaaagttttatatattgatacagacgcccatcacggcgacggggtgcagtttacgttctatgatgatccttccgtctgcaccgtctcgatacatgaaacaggccgctacctattcccgggaacggggcaggttcaggaaagaggtcatggcgaaggctacggctatgcttttaatatcccgctcgatgccttcacagaagatgagtcttttcttgattcctaccggacggctgtttctgaaatagccgagtttttcaaaccggatgtcattttgtcgcaaaacggagctgacgcacattactacgatccgctgacacacttgtgcacgacgatgaagatttacgaagagattccaaagctcgctcacgaacttgcacacacctattgcagcggaagatggatcgctgtcggcggaggcggctacgacatttggcgcgtcgtaccgagggcatgggcaagaatctggcttgaaatgaaagggatggaaccagaggagaaaatgcctgaaaaatggctgaaaaaatgggggaaacaggcatctgtccggcttcctgccaactggtccgacccggaagatttgtatcctccaattccaagaaaaaccgaaataacggaaaaaaacgcacaaaccgttgccaaagccctttatccgattcgctctgcccagcgtaccacttaa

SEQ ID NO: 3005 - DNA, 690 bp, Bacillus licheniformis
atgaagcttagacatgaacgaaggaagcgcgagcagggccgcaaatcgccaaactggatcatcacgttttcggatttgattacgctcatcctcgtgttctttattttactgttttcgatgtcgcaaatcgatttaaacaaattcaaagcagcagtcggttcatttcaagacagggccgacggcaaatccgccgcagagttgaaaaaagacgcgggcgatcagaaggctgaaaaaacggctaaaagccaagatgatttattaaagaaaatcaatgactatattgaaaaaaacgaactgtcaagtttgattgcggccaagcgtgacgaacggggcgtcattctcgtccttcaggaagcggttttgtttgattcagggaaagcggatctgaaagaccaagctcacccgcttttgcataaaatcgccgtccttctcaaatcggtgtccaacccgattcgtgtggaggggcatacggacagccgcccgatttcgacttaccgttttccatccaattgggagctttctgcagcaagggcgagcactgtgatcggctactttacgtcgaaggaaaagctcgactcgtcgcgttttcttgccatcggttatgcggatacaaaaccggtcagggacaaccgcactgagagccatatgaaggaaaacaggcgcgtcgagattgtcatcgcaaaacaataa

SEQ ID NO: 3006 - DNA, 819 bp, Bacillus licheniformis
atgaaacgatttgattatctgacaccggtcggttttattctgggtattttcattttagtgctcggcgttgtctctggagcggggctttccggtttttattcgtttatcgatttgacgtctttttttattgtgacgggtggattgtgtgcagctgtattcatcagcttttccccgaaagatttaaaaagagcgccggctgtgctgaagcaggtctttatttcggaggaagatgatgtgcgcgaattggtcaaaacctttgtcagcctgtctgaacaggcgcgcaaacaaggaattttatcattggacgccaatgtcaatgaaatgaaagacccgtttttgaaaaaaggcctgctccttgccatcgacggatgggatgaggagacgatccgcaatgtgatgaactcggaaattgccgcgatggaagaacgacacagaaaggggagaaggatctttgaaaaagcaggagaatttgcgcctgcatggggaatgatcggaacgcttgtcggtctcgtcatgatgctcaaaaacctgaacaagccggaaacgctcggtccgaatatggcaatcgcccttttgacgacgctttacggatcacttttagccaacatgctgtttataccgatcgccgcgaagcttgaagaaaagacggagaatgaaatctttaagaagcaagtcatgatcgaaggcatcatcggcatccaatcgggaagaaatccgcgaaatcttgaaagtcagcttgtcgttttcagttcaaaagaagaatggacaaaaaagcgggcggaccgcatgaaacaaaaggacaggcctcatgaagcttag

SEQ ID NO: 3007 - DNA, 1002 bp, Bacillus licheniformis
atgagtaatgtgacaatatatgatgtagcacgcgaagcaaatgtaagtatggcaaccgtttcccgggtcgtcaacgggaatccgaatgtcaagccgacgacgagaaagaaggtgcttgaagcgatcgagcgtcttggctatcgtccaaacgccgtggcaagagggctggcaagcaaaaagacgacgactgtcggcgtgatcattcccgatatttccagtatcttttattcagagctggcgaggggaatcgaagatatcgcaacgatgtacaagtacaatattattttgagcaattccgaccagaatatggacaaagaacttcatcttttgaatacgatgctaggaaagcaagttgacggtatcgtctttatgagcggaaatgtgactgaagagcatgtggaggaatttaagcgatcgccagttccgatcgtgcttgcggcatctgttgaagaaaaaggggaaacgccgtcggttgcgatcgattatgaacaggcgatttatgatgcggcaaccatgctgattgagaaaggccataagcgccttgcgttcgtctcaggacctatggctgaaccggttaatcaagcgaaaaaactgcaaggctttaaaagagcgcttggggataaggggctgcaatttaaggaagagtatgttgtagaaggcgattatacgtacgattcaggaatggaagcgctggaggctttaatgaagctggatgaaaaaccgacagccgtcctgtcagcgacagacgaaatggcgctcggcgttattcacgcagcacaggataaaggactggctgttccggatgaccttgaagtgatcggttttgacaatacaaggctttcattaatggttcggccgcagctgtcgactgtcgtccagcctacgtatgatatcggtgccgtggcgatgaggcttctgacaaagctgatgaacaaagaggaagtcgaagagcatattgtccagctgccgcatcgcattgaactcagacaatcaacaaaatga

SEQ ID NO: 3008 - DNA, 1077 bp, Bacillus licheniformis
atgagcaacactgaacttgatttgctgaggcagcaggcgaatgaattaaacttgcaaatattaaagctgattaacgagcgaggaagaatcgttcaggagattggaaaagcgaaggaagcacaaggcatcaaccgctacgatcctgtcagagaaagagcgatgctgaacgaaattattgaaaataacgacggaccgtttgaaaactcgacgatccagcatatcttcaaagagattttcaaagccgggcttgaactgcaggaagacgatcacagcaaagcgctgctcgtttcccgcaagaaaaagcctgaaaatacaatcgttgatctgaaaggcgaaaaaatcggcgacggagaacaaagatttatcgtcggtccgtgtgcggttgaaagctacgaacaagtagcggaagtcgcagcggcagctaaaaagcaaggcttgaaactgcttcgcggcggagctttcaaaccgcgtacaagcccgtacgacttccaaggcctcggcgtggaaggcctgcaaatcttaaagcgtgttgctgatgagtatgatctggccgtcatcagtgagatcgtgaatccgcagcatattgaagaagccattgattacatcgatgtcatccaaatcggcgcccgcaacatgcagaacttcgagctcttaaaagcggccggttcagtgaagaagccggttctgctgaagcgcggacttgccgcaacgctgaaggaattcatcaatgcagcggagtacatcatgtcgcagggcaatgatcaaatcatcctttgtgaacgcggaatcagaacgtatgaaacagcgactagaaatacgcttgatatctcagctgtgccgatcctgaagcaggaaactcaccttcctgtattcgtggatgtcactcattcaaccggacgccgcgacctgcttcttccgacagcaaaagcagcgcttgcgatcggagctgacggtgtcatggccgaggtccatcctgatccttctgtcgcgctttccgactcagctcagcaaatggatatcccgacatttgaaaaatggttaaatgaactgaagccgctcgttcaagtaaaagcataa

SEQ ID NO: 3009 - DNA, 450 bp, Bacillus licheniformis
ttgaacactgaattaaagtacatgcttcaatccgttctaaaagaagaattgagtccgatcaatcagcgccttgatggaatcgacaagcgcttagacaaaatcgacgcacgcttcgttgagatagacaagcgcttcgatgaagtggacgcacgcttcgttgaagtagataagcgctttaacgcaatcgacaagcgcttcaaagaaatagacgggcgcttaaacaaagtagaaaaccgcttaaacgcaatggacaagcggctgaatcggcttgaaacagatatagatgaactgaaaagagggcaggagaggctcccgaaaacgatcatcgagaacatcggacaatttacggagaacattgtcgaacatgccgatgataaggcggctgccttgaatgacagggtttttagcgtcgaaaccgcaatacagagaatatacaggttatcaagttaa

SEQ ID NO: 3010 - DNA, 327 bp, Bacillus licheniformis
gtgtcgaaacagctcattcaaacagaggatgaatttaaaaggcttgcagaaaacaatgatacatttatctttttgaaacacagcgtgacatgcccgatcagcaggcgcgcgtttgaagaattcgaatcattcgccaatcagcatgaagacataccggcttattatttaaaagtgcaggaaagccgcccgctgtcaaactatatcgctgagcaatacgggattaagcacgaaagtcctcaagccttcatttttacaaacgggaatgtgaaatggcatgcctcccattcgcaaattaccgcacaagcacttgcggaaaacagcagataa

SEQ ID NO: 3011 - DNA, 417 bp, Bacillus licheniformis
atgagtaaagacggaatgaatactaaggattttttaatcggcacgtttgtaggcggaatcatcggggcggctgcagctttatttttagcgccgaagtcggggaaagagcttcgcgatgaccttggaaatcaggccgtcgttttaaaggataagaccggaaagctcacaagcgaagcgagggagagaggctctgagtacgtcagcatcgccaaagagaagacatcttcgatttcacagcttgttgccgaccagtcttcacagattatggataaagtcaaagacttgcgaagcaagggtgccgaaaaagctggtgaactaaaggaagaagcatcgtctgcaatcgaagaacaggctgaagaagccaaaaatgaaatagaagatgaagcaaggaaaacagcagataccgctcagaaataa

SEQ ID NO: 3012 - DNA, 423 bp, Bacillus licheniformis
atgattattattctgtatttaagcgctgcactcatcgctgttagctttcttattttggttatctatttatcaaaaacattaaaatcgcttcaagtcacacttaatcatgttgcatcaacgctggaaggtgtggaaggacaaatgaaaggcatcaccgctgaaacaacggagctcctgaataagacgaatcggctcgctgatgatattcaggaaaaatctttgaagctgaatacggtcgtggatgccgttcaggaagtcggcacatcggtcaggcagtttaacaactccattcagcaggtttcacagtccgtcacatcagccgcagagcaaaaccgtgaaaaaatttctcaagttgtcagctggagcaatgcagctttggaaatttggaatagatggaaacaaaagaagatgagggaggaataa

SEQ ID NO: 3013 - DNA, 1299 bp, Bacillus licheniformis
atgactgtttatcattttgtcggaataaaagggacaggtatgagtccgcttgcccaaattctccatgataatggatataatgtccaaggatcggatatcgaaaagtacatttttacacaaaccgctttagaggagagaaatatcccgatttatccgtttgatccggaaaatatcaagccgggaatgactgttattgccggaaatgcttttcccgacactcatcccgaaattgaaaaagcgcaagctgaaggcctgccagtcgtgcggtatcataaatttctcggcgattatctgaagaagtttacgagcattgccgtaacaggggcacacggcaaaacgtcaacgacgggccttttgtcacatgtcatcaaaaaagcaaaaccgacttcttatctgattggagacggaactggaaaaggctgcgaaaacagcgagtactttgtgcttgaagcctgtgaatacagaaggcattttctgagctatcagcccgattatgcaatcatgacaaatattgattttgatcatcccgattatttcgcgaatatcgatgatgtatttgatgcatttcagacgatggcattacaggtgaacaagggaattatcgcatgcggtgacgacgagtatttgatgaaaatccatgcgaacgttccagtcgtatactacggctttgccgagaaaaacgattttcaggcgagaaatgtcatcaaaaatactgagggcacaacgttcgatgttttcgtcaggaacacattctacgacactttctatataccggcatacggcagccataacgttctgaacgctttggccgtcatcgccctctgccattatgaacaggtcgatgtcgacatcattaaagaaggattgcaaacctttggcggcgttaaacgcagatttaacgaaaaacatgccggcagccaagtgctgattgacgattatgcccaccatccgactgaaatcacggtgacgattgaagcagccagacagaagtatccggaacgggacattgttgcagtatttcaaccgcatacatttacgcgcacgcagtcattcctgaatgagtttgccgaaagcctcaagaaagccgattatgtatatctttgcgatatattcggatctgcccgggaaaacgcaggaaagctgacgatcggtgatttgcaggagaaaattccgcaggcgaagctgatcgatgaaaatgacacatcaattttaaaggagcatgaaaatgcggtgttaattttcatgggcgcaggtgacattcaaaagtatttaagagcatatgaaaatgtattagcataa

SEQ ID NO: 3014 - DNA, 2793 bp, Bacillus licheniformis
atgagctggtttaataaaatgttcagcctgtttttaggcgatgatgaagataatgaaaaacaaaaaaagcacatagacgaatttgaggcggattcatcttcagaggacgaagagatgccgcaaataaccgacgcaaaagtcgtatatgaatatccaaaagggaaattccgctttccggttatacctgatcaaaacacgcggccgcgggaaaaggacgacagccgcgaacaaaggacccgccgcccggcgagccgatattcagcttctcagccgaaacccggcaattcatatcattatgaagagaaagcggcggcgaaaaaaccttttaggccgtccgtcatcccatcaccggtttacggctttcatgagcagaaaagagccaagccggaaaatcatacatatcgtgcaaaaaaacaaactgaagcgcgtgtcacgctgtttaacgaagaaattgaaaaagagcagaagtctgcagaacataagcagccggtacgagaagaagcttccgtgcaaactgaaaagaacggccgtccgctgatcaaaagcgagagccgcaatcctgcattgcgcgccgaattcgaagatgtcccgcaggcatccacggagattccaaaagaaacggaaatccgtccagagcgaatgacagaaggcgcgggactcgcagaggaaaaagcgctgcggcatgaatccgaacgaacagaagcacctgtgtcagtgcatattccggaagaaacggaagtccgtccagagcgaatgacagaaggcgcgggactcgcagaggaaaaagcgctgcgaaatgaagctgtagaagagaccgcctccgcatcacaaaacataacggaggaagacgcaatccccgctgagcaaacaccggaacaaatcgaaaagcttttggataagattgaggaaaccggagaagagatggtactggcagaggacgcagaagccgccacggaagaacaagggaagacttacggttcgggcaaaacgcatcccgacccggaagcttcagttccggaagagccgcacactcatggccgcgcctctgaaataaccgtccagagcgatgaatcttcccataggacagattcaaacaccccggctgacgctcttgaagaaacaagcggaagccgccagactggctggagacaagagcaggcgtcatgttcaccggaaacggcagcgccaagcgcgggtgaacccgaaagcaggcaagagaaccgggagactacaaggataaacgaggatcggccggaagctccgcggaagcgggaagcaggagccgctccgggatcgaagaaaggctctgttccgtttaatgtcatgatgtttgcctcagataaacaaaaagaaaaagcgcctcaagggtatcagttcccgaatatgtctttgcttgatgtgccgccggcgcaaaagcaggatgatcaggactggatacacgagcagcgggagctgttggacgtcacgcttgagaacttcaatgttaaagcaaatgtcgttcatgtcacccaagggccttctgtgacaagatttgaagttcatcctgaacccggagtgaaagtcaacaaaattacaaatctgtcagatgatattaaactcagcctgtcagcgaaagatattcggatcgaggcaccgatcccgggaaaaaatacgatcggaattgaagtgccgaatctgcacagcaaaatggtttatttacgcgaaatgatcagaagttcggaatttagaacgaatccgtctcctctgacagcagctctcggactcgacatatccggaaagcccgtcgtggctgatctgaaaaaaatgccccacggtttgattgccggggctacgggatcaggaaaaagcgtatgcatcaacacgatcttagtaagcctgctgtttaaagcgtcgcctagggatgtaaagcttctgcttatcgatcctaagatggtggagcttgctccgtataataatattcctcatctcgtcagtcctgtcatcacagatgcaaaagcggcaaccgccgcattaaaatgggttgtcgaggaaatggaacggcgctatgaattatttgctcattccggtgttcgggaaattgagcgttttaatgaaaaagtccgggaacagaacatgggtgaaaaacttccttatcttgttgtcgtgattgatgaacttgccgatttaatgatggtcgctccgaatgaagtggaagagagcatctgccgaatcgcacaaaaagcaagagcgtgcggcatccatcttctgattgcgacgcagcggccttcagttgatgtcattaccggcttgattaaagccaatatcccaacaagaatagcgttttctgtttcaagcgctgtcgattcaagaacaattatcgatatggcgggagctgaaaagcttcttggaaaaggggatatgctgttcttggagaatggttcaggcaaaccggtccgcctgcaaggcaactttgtgtccgaccgggagattgatcgtgtcgtttcacatgtcagacggcagcaggagccgaactatttatttgaacaggaacaattggtcagacaaaatccggccggatttgaccacgatgaactgtttcttgaagcgtgcgaatttgccgtggaacaaaacagcgccagcacttcaagcctgcagcggcgcttccgcatcggctataacagagctgccagattaatcgatatgatggaaagggaaggcatgatttctgaagcgaaagggagcaagccgagagaagtcctgattacaaaggctgatctggaacagttaatagaaagtagttcacttttcggctaa

SEQ ID NO: 3015 - DNA, 606 bp, Bacillus licheniformis
atgaacgcattttataatccagaaggcgtaggcgatacgctgctcatctcattgaacgatattccacgtgaagagatcgcttttgagcggtacggagacgtcgtgaaaatttttcataaagacacaaaggaaacagcaggctataacatttttaatgcctcctcatatttgagcattgaggaaagcggagctattgcgctttccgaatcctttgtccaggatgtgaatgaaattctggtccgcaacggtttgaaagacgagctgaccgtcgacctttctccgaagtttgtggtcggatatgttgaagaaaaagaaaagcatccgaatgccgataaattaagtgtttgcaaagtgaatgtagggagcgagacgctgcaaatcgtctgcggagctcccaatgttgaagccggccaaaaagtcgtcgttgccaaagtcggcgccgtgatgcctagcggtatgatcattaaagatgcggaacttcgcggagtggcgtcaagcggcatgatttgttctgccaaggagctgaatctcccagacgcgccgaaggaaaaaggcattcttgttcttgacgacggccgtaaagcaggagaagcctttacattttaa

SEQ ID NO: 3016 - DNA, 810 bp, Bacillus licheniformis
atgaaaatgacctcaaggaaactttccgatatattaaaaaaacgtttgcaaaatgacagctggtcctttcatttcgacagggaaaaggacagcttgagaatcgaagataaaaacactggaaaaggcattacactcgagctcccggggatcatcgcgaaatgggagcagaaaaaagatgatgcgattgacgaagtcgtctattatactgaggaagcgctcaacgccatgaaaggccagtcgcaggaaatggaaggacgggaaagcctgatctatcccgtcatccgctcaacttcctttcccgagaagtccagcgcaggcgttcccttggtttttgacggccacacggctgaaacacgaatttactatgcgctcgaccttggcaacacataccgtctgatcgacgaaaaaatgcttgaaaaagagggctggacaaaagaaaggattcgggaaacagcttcctttaaccttcgctcgctccagaccgttgtaaaagaagacgaagtcgcaggcaatcacttctactttttcagagcgaatgacggctatgacgccagcagggtgttgaacgaatcgattctcgcagagtatgagaaaaacgcggaagggaccctcgccgtgtcaattccgcaccaggatgtgctgattattgccgacatccgcaataatgccggatacgatatactcgggcaaatgtcgatgagcttttttgcaaacggcacagtgccgatcactgcgctttctttcctgtatgaggatggaaagcttgaaccgatctttattctggctaaaaaccgccctaaaaagaaatga

SEQ ID NO: 3017 - DNA, 321 bp, Bacillus licheniformis
atgaaaacgatcgagacgaatgaagaattgcaaaaagttgtgaaagacgatttatccttgttgatgttttcggctgactggtgtccggactgccgttttgtagaaccttttttgcccgagcttgaagcgaactatccggaatttacattctattatgttgaccgcgacaaatttatagacacgtgcgcggagtgggatattttcggaatcccaagcttcctcgtatttaaagaaggaaacgaaatcagccgctttgtcagcaaagaccggaaaacgaaagaggaaatcgagcaatttttgaccgattcactgaataagtag

SEQ ID NO: 3018 - DNA, 447 bp, Bacillus licheniformis
atggaatttatcgtttatcttgccggagaaatacatagcaattggcgcgaagaggtgaaggaaaaagcaaaatcgctcaagctgccgatcacatttgtcggaccgatggaaaatcacgagcgctccgacaacatcggtgaagaaattatgggcaagcaggctgattcaatcgcaaaggatgatgcagcctcggatttgaacaattttagaacttccgttttaatgaacaaggcggatgttgtcatcgctcttttcggggaaaaatacaagcaatggaacacggcaatggatgcatcatacgcgatcgccaaaggcaaaccgctgatcatcatccgacccgaatcactccatcatccgttaaaagaactgtcaaacaaagcgaacattactgtggaaactgtaaatcaggcaattaaatcgttgtcatacgtatttgaaagccggtag

SEQ ID NO: 3019 - DNA, 1074 bp, Bacillus licheniformis
atgaatcaggaaacgagaacgctttttcaaacgcttacggagctccccggcgccccgggaaacgaacatcttgtccgtcgcttcatgaaaaaagagcttgaaaaatatgctgatgagatcatccaggacagacttggaagcgtgttcggcgttaaacatggacctgaaggcagtccaaaaattatggtggccggccatatggatgaagtggggtttatggtcacatcaattacagataacggcctgcttcggtttcaaacgctgggcggctggtggagtcaggttttattggcccagcgggtggaaatccacacggacaacggaccgatccccggcgtcatcgcgagcacgcctcctcatcttttgacagatgagcagaggagacgtccgatggatatcaaaaacatgatgattgatatcggggcggatgacagggaagatgccgaacgcatcggtgtcaaaccaggccagcaaatcgtaccgatctgtccgtttaccccgatggcaaatgaaaagaagatccttgcgaaagcatgggataaccgctacggctgcggactcagcattgaattgctgaaagaactgcaaggaacagaacttccgaacaatctttactcaggtgcgaccgtccaggaagagctcggaacaagaggcgcgcaaactgcggccaatatgatacagcctgacttgtttttcgcgcttgatgcaagtccggcaaacgattcgagcggcgacaaaaatcaatttggccagcttggcaaaggagtgctgttgaggattttcgaccggaccatggtgatggacagcgaaatgagaaattttgtgctggatacggcagagacaaatgacatcccgtatcaatattttgtttctccgggaggaaccgacgccggccgtgttcacatctcaaatgaaggcgttccttcggccgtgattggcatttgttcaagatacatccatacatctgcttccattatccacgttgatgactaccttgctgcaaaagaattgctgatcaagcttgtcaaagcttgcgacagttctgccgtccagtcgattttgcgaaatgagtga

SEQ ID NO: 3020 - DNA, 315 bp, Bacillus licheniformis
atgaaactgcgccactttcttattggagccggcatcggcattgccgcggccgtcgttgtcaaacaatatgtcatgcagccttacatttcttctgaaaaagcgctgcgcatcgtcaagtccgcttttaaacagagaggcccgatcgacggttcatggatatataccgttccggaagcctataccgtaaacggcgaaaccgtcatggtgtacaaaacaggcattacgcgttccgctttccgagagctcgaacagtacgaagtcatggttgatgcaaaaacaggcatgatcgtagatgtaattgatacagcagcatag

SEQ ID NO: 3021 - DNA, 1716 bp, Bacillus licheniformis
ttgaaaggaagacgacgggtgagccacaataaattaaatgaacaagtgatcgagacgcggttaagaggatttgaagtccttgcgactcccctgttgaacaaaggggttgccttccctccggaggaaagggatgctctcggcttgacaggattgcttcctcccaaggtgctgacgcttgaagaacaggcaaaacgggcgtataaacagttccaatcacagcctgatgatttgagcaaaaacgtctatttaacggcgcttcatgatcgaaatgaagtgctgttctacaggcttctgaacgaccatatgacagaaatgctgccgattgtctataccccgactgtcggaacggcaatacagcaatacagccatgaatacagaaagccgcgggggctgtttttgtcggttaatgaccctgaaggcatgaaaacggcatttgaaaatctggccgctaaaagaagccggatcgatttgatcgtggccactgatgctgaaggaattctcggaatcggggattggggagtcggcggcatcgccatttcgatcggaaagcttgctgtttatactgcagctgcgggcatcgatcctaacagggtcctgccagtagtcattgatgcggggacgaaccaggaaaggcttctgaacgatccgctttatgtcgggaatcagcattcgaggatcaggggcgagcgttatgaatcgtttattgatcaatacgttcaaatcgcaaccgagacgtttccgggcgttttgctgcactgggaagatttcggaacgcagaacgcgcgtcagattttgaaaaaatacaaagacaaaatttgcacctttaatgatgacattcaaggcacaggagctgttaccctcgcagcggtgcttgcggccgttaaaatatcaaaaatgccgctgaaggatcataaagtggtcatatttggagcggggacggccggaatcggcaatgctgagcaaattcgcgccgcactcgttcaagagggagtgtcggaagaggaatcataccgccgtttttggtgtgttgatcggaacggtttgctgacagatgatatgaacgacttgcaggacattcaacaaccgtatgcaaggcctgctgacgaggtaaaagacttcagccggaacggcccgggggatgcaattgatctgctcgaggtggttaaaagagtgcagcctaccattttgattggaacctcgacggtatcgggcgcatttacagaggaaattgtaaaagaaatggcaaagcatgtgaaacggccggctatattcccgatgtccaatccgacgccgttatctgaagcaaggcctgaagatttgatcaattggacggaagggcgggcgctcgtcgccacaggaagcccgtttgcgcctgtggaatacagcggcacccgttatgcgatcggccaggcgaataatgcctttgtattccccggccttgggctcggaacgctcgtatcaaaagcaagactgattacggacaacatgttttacgccagcgcggctgcgatcgcgggtatggttgatacgggccggcccggcgccgcgcttcttccggaagttgaggatttgcgcacggtttccgcaaccgtggcaacggctgtcatcaaagcagccatagaagacggagttgcagaaaacgagccggacgatgtgattcaggcggtgcaggatgcgatgtggcatccggtctaccggccgattcgcgccatataa

SEQ ID NO: 3022 - DNA, 846 bp, Bacillus licheniformis
atggaaactttaacaatcggacgaatcaagctgacatggctgaacggaggcgtcacgcacatggacggaggcgccatgttcggcgttgttcccaagccgctttggtcaaaaaagtattacgccaatgagaaaaatcaaatcgaacttagaacagatcctatactagttcagaaagacggcacgaacctgctgatcgattccggtatcgggctcggcaaactgacggataagcaaaaacgaaattacggagtcaccgaagaatcgtcaattgatgactcgttaaaagcactcgggctctcaacggaagatatcaaagccgttttgatgactcatctccattttgaccatgcatgcggattgacgcgctatgagggagaaagccttgtttccgtgtttccaaatgcggcgatttacacgtctgcaatcgaatgggaagagatgagaaacccgaatatccgctccaaaaatacatattggaaagagaactgggaagcggttcagcatcaagtgagaaccttcgacgagaagcttgaagttttgcccggaatcacgatgcatcatacaggcggccacagcgacggccattccgtgatcgttctcgaagatgccggtgaaacggcccttcatatggctgacattatgccgacgcacgcccatcaaaatcctctctgggtgctggcgtacgacgattatccgatgacatcgattgccgcgaagcaagcatggcaggcgaaggccgccgagaaaaacgcctggtacattttttaccacgatgccctttacagagcattaaaatgggatgaaaacggcgatattgcagagtcagtaaaaagagaaagccgctag

SEQ ID NO: 3023 - DNA, 642 bp, Bacillus licheniformis
atgcgaatgcgtcacaagccatgggcggatgactacctggctgaaaactctcatattgtgatcagcgagccgtctcaatacaaagggaaatggcattccgtttttggaaatgacaacccgatccacatcgaagtaggaaccggaaaagggcaatttatttcaggaatggccctgcaaaacccggatgtaaactatatcggaatcgaactatttaaaagcgtcatcgtaaccgctgttgataaagtaaagcagacagaggcgccgaatgtaaagctcttgaacatcaatgccaatatgctttcagacgtttttgcagacggggaagtcgaccgggtctatttgaatttttccgacccgtggccgaaaaagcgccatgaaaagcgccgtcttaccaatcatgcgttcttgaaaaagtatgagcaggtgctcggaggcaagggagcgattcattttaaaaccgataaccgcgggttgtttgagtactccctcaccagtttttccgaatacggactcgttttgacattcgtcagccttgacctgcatcaaagcgattttgaaggaaatgtgatgaccgaatacgaagaaaagttcgccgctaaaggccagccgatctacagagtcgaagctgaatggcgaacataa

SEQ ID NO: 3024 - DNA, 279 bp, Bacillus licheniformis
atgggcttaaatcagcaaaatcagattcatctattaaaagacattctctcagaccatcaagcagactgcaccggaaccgtcgctgaatgcgaacagatggagcggattatcaagtctttaatggcaaacacgaatcttgacgccggcttgaaaggcgttttggaagacatttatttgtacagccagaagggaagatcttccgcttcgatcaacaaccacattcaggagcaccaggattatctcacgcaatgggtggaagatatcgactcattttcatga

SEQ ID NO: 3025 - DNA, 816 bp, Bacillus licheniformis
ttgaaaatcgatatgaactggttgggacaattactaggtagcgaatgggagatttcccccgcaggaggagctacaggagacgcatattatgcagaacataatggacagcagctttttttaaagcgcaacagctctccttttttggctgtcctgtccgcggaaggaattgttcctaagctcgtttggacaaaacgaatggaaaacggggatgtgattacggcacagcactggctcaagggaagagagctgaagccgaaggatatgaacagccaggcggtggctgagatgcttcggaaaattcacagctccaaagagcttttggatatgctgaagagactcggcaaacagccttttcagccaagctctgtaatcactcaattgaagcagtttatccaggcccggcaatatccgataccgcagctggaccaggcccttttgtatctggagcaccatcttgaagatgtacagtccggagaaaaggtcgtctgtcactgcgatgtcaatcataataattggcttcttacagatcagaaccagctttatttaatcgattgggatggagcgatgattgcagaccccgcgatcgatctggggccgcttctttatcattacgttgaagagcgggaatggggaagctggctcgaacgctacggctcttctcttacagacaatctcaggctgagaatggcctggtacgtattggcggaaaaagcaatgacgacactctggcaaaaagcgaaaggcaatcaggaaggctttcaccaggggctggaacagctgcatgaattaatggagcgtctcgccaggtcctcatga

SEQ ID NO: 3026 - DNA, 2133 bp, Bacillus licheniformis
atgccgggtatcagccgcccttttgaagcttatctcgatgaaatgagaacgatcactgttttagttccgaagagccgtgcgtcaagctgcagtcctccttttctgcttgaagatgatcaaggagagaggatagagctttcggtaaaagcgcaggtggagcttgaggaacaattcaagtatgttcttgaaagcagctgcaccgttccattcggaagagttcacaaagtatgctgtgaagaaagcgtctggacagacctgcaaatcggctctgttacgagaagcgcggcgtttgacaaggcttttttttatgacggccgcctcggcgctttttattcaaaaggaagtactttatttaaggtatgggcgccgaccgcgagtgcggcagcgatcaagctggaggaccctgattcgcttcaaacaaatacttttcaaatgatgcgcagaaaaaagggcgtttttgaggtaacggtcgaaggcgatctaaacggctggtcctatttatatgagctttatgtaaatgggaagccgttattgacagtcgatccttatgcaaaagccgttacggcaaacggtgaaaaaggcgttgtattagatccagaggaagtcaaggtggaaaaacaccgcgctccaagacttcacagtccgtgcgatgcggttatatatgaggttcacatccgcgatttctcgattcatgaagacagcggtatgcgccataaaggcaaatatgttgcttttactgaggacggaactgaaacatccggcggcttctcaacgggaatcgcctatttgaaagagctcggcgtcacccacatcgaggttctgccctttcacgattttgccggagtggatgagctgtctcctgatcaatcttataattggggctataaccccctccattttaatgccccggaaggaagttattcgctcgatccgcagaaccccaaatgcagaatcaccgagctgaaaacgatgattcagtcgctgcacaaacacggcttctccgtgattatggatgccgtatataatcatgtgtacaagagggaaacgtccccttttgaaaaaacggttcccgggtattttttcagacataatgaatacggttttccatccgacggaacaggcgtcggaaatgatattgcttctgagcggctgatggtgcgaaaatatattctcgattctgtccgctattggctggaagaatatgatgtcgacggcattcgttttgatttaatgggcattcttgatattgaaaccgtccgccaaatcagtacgcttgccgagaatgtaaagccgggcgtgcctctgttcggagagggctgggatttaaataccccgcttgacagcgggcaaaaagcaacattgcaaaatgccggaaaagttccggcggtcggcttttttaatgatcggttcaggaacgcagtcaaagggagtacattcgagcttagcgaccgcggatatgctttaggggacaccggaaaaaaagcggcgcttcagcacggtattgccggttcacccggattcttgcagccggcacagtcaatcaattatgtggaatgccatgacaatcatacattttgggataaaatggccttatgttttgaagaagatgcggacactaaacggcttaggcaaaggctcgcggtgtcgatcgtcctgctttcgcaaggcgttccatttcttcacgccgggcaggaattttgccgaacaaagaatggggacagcaacagctacaggtccggagatgacatcaataagcttgattgggaaaagcgtgcggagctttgcgaggatgtcgaatatgtgcgccagctgatccggctgcgaagaagccatcccgcttttcgtctgcaaaaagaggaagaagtcaaggagcatctttcttttatggacggtacaggagaggtaacggcctacaagctgaagaacattgcagcaattgatccctggaacgaaatcatagtggtgcattgtccgtttgcaaaaaaggagacgcttaagctgcccgatcagaaacagtacttgctgcactgcgatccttttacgttcttcaatgggaaggttcaagcggaaaaaaggcttcggctgaacggcatcgggacctatgttttatacgaaccaaaagggattttttag

SEQ ID NO: 3027 - DNA, 921 bp, Bacillus licheniformis
atgagcgattggtatatcatcataaatccaaaggcgggaaactcgacggccttcagagcatggaaatcattgcagaaagacctccaaaaggcaaatatatcgtaccgctcgtttatgactcagcatcccgggcatgctgaggtgttggcaaggcaaatatcaacgatgcaggatgacaggctgaagcgtcttctggtgatcggcggggatggaaccgtccatgaagtgctcaatggtttagtcagcttgcgggacattcagctgagcgtcatcccgtcaggcataagcaatgattttaaacgcggctttggcgtgaaaaaatcgaatgtcatcaaagaaatgaagcgaaaagggcaatcgctgacccggacctatgccctcggaagctttcatacgaaagacagtgaaaacgaactttattttgcgaatcatctcagcctcggatttgatgcatgcaccgccaagaagatgtcagctttgccgaaatggacggctgctctcaggctgaatcatttgattcatccgctgattttctttgtcacggcgtttacgtttaaaccgtttgttctttcgtatgaaaacggggatgacaagcgtacgtttaaaaaaatctggtttgcgtcggtttcaaatcatccttactatggcggaggaatgaagattgcaccgaatgcgaatccgcgggatgagcttttagacgtgatcattattgaagacctgcccgtcttgaaaaaagccggcctcttgtttgcgatgatattcggcaaacacgtcggcaaaaacggtgttacggcatttaagacgaaagacatctattttcatacgaatgagcgggtgctctttcaagcggatggagaggtgatcggctgggcgcccgttttcattaaaacagggactgaatcccttcgattaagagcataa

SEQ ID NO: 3028 - DNA, 942 bp, Bacillus licheniformis
atggcacagattattaaaatacaggactgtatttcaaggtatgaacaagatccttatcattatatcaaccagtttatccgcttgaaaaagcagcgctggcagtcaattaaagagatggctgaaaaaaagaaagaaagctttcatcacgataaaggagccgccggtgatgaaacgtttggaaaaagaaagaatacatttacattaaagagaaaaaaagaagcatccgatattaataaaggaaaagaagccgatgaatggtttaacggactggacggagaaacggatgaaagcttgatcgcaagaattcctgcggcaggggaagaactcgtaccgttttttaaggaatacgtgtacgagtttcagctgaaatgggcaagctcgacaatctctgacatatccaggctttcccgggaaataaaaagcgataaaatcctgcacattttggcacagcagctcccggattcatatttcatcatgtatcggccggtgctgcaggtgaatcaggctgcggtagagctcagcgtcttgattctcactccccttgaaatctactgtatgtcatttcttgaaggtgagagggacagcgcatttatcggttccaaagatcgtttttggaaagaaaaaacggtaaggggcaaggaacggtcattgttaaatccggctgtcgagctcctcaggacaggcaaggttctttccggtttgttaaagggatcggggattgaactgcctgtgcgcaaagtcatcgtcagccgtacatcgtacatcgattatccggaacctccctacggaatcggcatttgcgacaagagacactggaaagagtggctggagaaacagcaaaaaaacttcgccccgattaaaagccagcagctgaaaacggcgaaaattcttttgtcgcacggcgtctccgactcggtgcggagacaggaatggctgagctga

SEQ ID NO: 3029 - DNA, 606 bp, Bacillus licheniformis
atgtcagtcaaaccgcattactttattggaattccaattccggcggagcttagtgatccgctttatcaaacggtcagcagccgtccggaattttcttttcatagatgggtgcatcctttggactaccacatcaccctcgtgttcctcggctctgctgaaaaggagcagctggcgatgcttgctggcagcctcaagctgatctccgatgagacggctccgtttcagcttgcgataaaacgtttcggaaccttcggaaagccgtcggagccgagaattcttcatgtggaaccggaatactcagccgctctctttcatgtgagggaacaggtgaagcatgcagcggatgcggcgggctttgaaattgaaaaacggccttttcatccacatgtgacggtcgccagaaagtggaatggatcggcctcttttaacggacgcctggagccgcttgaagacgcggtgtcttttacggcccggcatttcaccatctttcaaacccatttagacaggcttcccaaatacgagcatcaagccgttttccatttcggcgaacggccggctgcagaaaagcaagattcggagatgaacgcagatggcacagattattaa

SEQ ID NO: 3030 - DNA, 932 bp, Bacillus licheniformis
gtgagagccgttcaaaatattgcagaattaatcggggaaacgccccttgtcaagttgaaccgcgttcagcccgaaaacgcggcccaagtttatatcaagcttgaatcttttaatccgagcggaagcgtaaaagaccgcgcggcctaccaaatgatcctggatgccgaagaaaaaggcctgctgaaaccgggttcaaccatcattgaaccgacgagcgggaacaccggcatcggccttgcgatgaacgcggcggcaagaggctacaaagccattcttgtcatgcctgatacgatgacgaaggagcggatcaatcttctgaaagcgtacggagccgaagtcgtcctgacgccgggggatgaaagaatgccgggcagcatcaaaaaagcgcaggagctcgctcggcaaatcccaggcagctttattccgatgcagtttgataatgaagccaatccggaggctcaccggagatcaaccgctctggaaattgcccgggcaatagaagaaatcggcaaacctctcgctgcatttgttgcaacagcagggacagggggaacgattaccggaacaggcgaaaagctgaaagctttatttccgggaataaccgttcacgtggcagaacctgcagggtcgcctgttttatccggcggcaaacccggaaaacacaagcttgtcgggacaagcccgggatttatcccaaacattttaaacgaaaacgtctatgacgaaatcttaaagatcaaggatgaagaagcctatgagatgacgcgcagattggcgcgggaagaaggaatccttgtcggcccttcttcaggagccgcttgcttcgctgctgttgaaacggccaagaagctccctcccgacaaagtggtcgtctgcatgacggccgatacaggggaacgctatttatcaagcgatttatttcaatttgatta

SEQ ID NO: 3031 - DNA, 474 bp, Bacillus licheniformis
atgagtcataagcgaggcgttttatttgaaatcccgaacgggtacgggcgctttcttctcgatatactgaagccggttgaaccggccgatttcaattggctgcttgccgatggcgaatgctatctcgtggaaaacggtgaattgtcagatgaaaatctttttcctcaagatccgcaggtgatgacaggagaagcatttaaaaaaaggctggaagacgcaaggtactatctcatcttcgccgatctgaaggcttttccgaaggatggccatcccgaagatgtcagcacatatgaatcatatatgaaaagcagctgcgagctgattgtgcttacagccgattcgagttttgtcacgatatactgcaaagatcaaaaaaacctggagcttctatatcaaaatgcaaaggactgcggtttcaagcggattgaatatataacggatcacaacgatgccagaacaggaatgcatgtgtag

SEQ ID NO: 3032 - DNA, 1392 bp, Bacillus licheniformis
atgaactgggaacaggaagttttaaaaagacggaatgagatcgttgaggatattcagggttttttaaaaatcaacagcgtccttgacgaagagacggcgggtccgggacggccgtttggaaaagggattcaagaatgcctgacagcgcttctgaataaaggggaggaaagcgggtttacggtaaaaaaccttgacggttatgcaggccatatcgaatgggggaaaggcgaggagattatcggcgtgctttgccacattgatgtcgttcctcccggcgatggatggacgagcgacccgtttgcagctgaaataaggggcggccgaatctatgcaagaggagcgcttgatgataaagggccgacaatggccgcgtttcatgcattaaaaattgtcaaagactcgggcctccctttatcaaaacggatcagaatgattattggaaccgatgaagaaagcgactggcgctgtgtggagcattactttaaacacgaagaaatgccttcggccggttttgcgcctgatgctgattttccgattatctatgcagaaaaaggcctgattgacgcagctttaaaaattgaaactgatcaggcggaaacaggtgcggacttagtattggaggcattccggtccggccggcgcctgaacatggtgcctgatgatgcggaagccgtcctggcaggggccgtcccgtcagaatttgaagagtcatttgcccggtttgtaaaagaaaaacgcgcagaagggcgtattcttcaagaaggcggcagactgacattaaccgtgcacggcaaatcggctcatgccatggaacctaataacggagtcaatgccggtctcattttggccgagtttttacatacacaatcccttgacagagccgggctccattttgttcaaacggttagcggggcttttgccggagatacgagagggaaaaagatcggcatcggctgccgcgatgacatcagcggagagctgacgctgaatgtcggccggctgcagtatgaacaaggaaaaggcggggaggcccatattaacatccgctatcctgttactgaagagagcggccgggtgaaatccgggctttcacaaataaaaggcgcccggctcatcagctttaaagacagcaagccacatcatgtagcaaaagaccatgaactgatcaaaacgctgcagcgggtctatgaagagcagacaggggaaacggcacaattaatttccatcggcggggcgacatatgcacgatcactgaaagccggcgtggcattcggcccgctgtttccaggccgtcctgacgttgcccatcagaaagacgagtatatggaaatcgacgatttgctgaaggctgtatcgatttatgcacaggccatttatgaattggcgaagtag

SEQ ID NO: 3033 - DNA, 1320 bp, Bacillus licheniformis
ttggaggaaatgatgtttaacataaaagaaaaccaaaccacagtcaaaaaagaaatcctcgccggtattacaaccttctttacaatggtttatatcgtcgtggtcaacccgagtatcctttccggcacaggcgtcccgtttgatcaagtgttcactgccacaatcatcgctgcagtcgtcggaacgctttggatggcgcttgccgccaactttccgatcgcgattgcacccgggatgggactgaacgtgtattttgcagtgtcagtcgtcggctcatccaacggcgaaatttcttatcagacggcgttcagcacagtcttcgcggccggcattctctttattatcttatcgctaacacctcttagaaaacaactgatcgaagcgattccggctaatttaaaatacggaattaccgccggaatcggattgtttatcgcttttgtcggtctgagaggagccggcatcattaccgcgaacgaagccaatttggtcggactcggcaatctgcactcgcccggagtgatactggcattaatcggcttggctttctctgtcgttttgatggtgatgaatgtgagcggcgctctatttttcggtatgatcttaaccgggctgatcgccttttttaccggccagcttgagtttaccaaagggattatgtcgatgcctcatctgccggaaaaactgatcgtcacaaaccctttcgccgcttttggcgatgtcatccactacggcctttattcggttgtcttttcgtttctgctcgtgacgatttttgatacgacaggaacgatgatcggtgtcgctgagcaagccggactcatgaaaaacaacaaactgccgaatgcaagaaaagccctccttgccgattctacagcgacgacagtcggtgcaatgttcgggacaagtccgacgaccgcctatatcgaatcatccgccggggtggccgcaggcggaagaacggggcttacgtctttaacagtcgctgtgcttttcggcgcggccctgtttttcagcccgcttgtcagtgcggtctccggaatcgcagcgattacgtcgccggcattgatcattgtaggaagcatgatgatcggcgccgtgacgaacatccgctggaaagaacttgacgaagcatttccggcctttctcgtcatcttgacaatgccgctgacatcatctattgcgacaggcatttccctcgggtttatcgcttatccgattgtgaaagccgcgaaaggcaaatggcgcgagattcatccgcttgtcttcgtgtttgctgttctctttttcatacaccttttctttttggaagggcattaa

SEQ ID NO: 3034 - DNA, 222 bp, Bacillus licheniformis
ttgaaaccttcaacaaaccgaatgctaaccaggatcaaatcagtctacatgttcattcaagaaaagggactcgttacaacccaggaactggttgatgaatttggcactacaccgagaacaatccagcgtgatctgaatgtgttggcatacaacgatctagtacacagccccagcagaggcaaatgggagactacaagaaaaaaagtgaaaatctcctcatag

SEQ ID NO: 3035 - DNA, 723 bp, Bacillus licheniformis
atgagattggataaactgttgtcaaacagcggctatggttcgagaaaagaagtcaaaaaaatgctgaaaaacggcgcggtgcgcgtcaatgatcaattagtcaaagacgccaaaaagcacgttgacccggaatcagacgacatcacggtatacggggcacccgtcatgtaccgggaatttatttacttaatgatgaacaagccgcaaggagtgctgtcagcaacagaagacagccggcaggaaacggttgtcgatttgctcgacccggagctgctgaggtttgagccgtttcctgtcggaaggcttgacaaggatactgagggactgctgcttctgacgaatgacggacagttggcacaccagcttttatctccgaaaaaacacgtacctaaaacgtatgaagtccatgtcaataagccgattgatcaagcggcacttgatcagcttgaaaaaggggtcgatatcggtgaaggatatgtcacgaaacctgctgaagcatcgcttctggcaagcgaaaacggcgtagaacgcctgcttttgacaataacggaaggaaaatttcatcaggtgaaaagaatgctgaaggcggtcggccatgacgtcatctatttaaagcggctgaaaatgggggatgtcgatctcgatgaagagctattgccaggggaatacagggagctctctgaacacgagcttgccgcattgcaaaacaaaaagacactctga

SEQ ID NO: 3036 - DNA, 1629 bp, Bacillus licheniformis
atgtcaagcaaactgttaagaggcacatttgtattaacgcttggtacctatatttcaaggatcctcgggatgatttatctgattccgttcggagccatggtcggtgccaccggcggtgccctgttccagtacggttataatcaatatacgatttttttaagcattgcgaccatggggtttccggcggccgtgtccaagtttgtttcgaaatataactcgatgggtgattatgaaacaacgagaaggatgctgcgcgccggaatgtcgatgatgctcgtcacaggcatcattgctttctccattctatatttgtccgccccgttttttgcagagatggcccttggcggaacagaaaacaacgggctgacgcttgaacatgtcgtgtatgtcattcgcatggtcagtctcgcgctactggttgtgccgatcttggcgctgatcagaggctttttccaaggtcaccagatgatggggccgacagccgtttcacaggtagttgaacaaattgccagaatcgtctttctattaacggccacttacttggtgatcaaagtattaaacggcgggcttgtcgtcgctgtcggctatgcgacttttgcggctttgatcggagcgttcgccggactgttcactctttacttttcctggcagaaaagaaaaggggcgctcctggcgctgaagccgaaccttgttccttcagccgatattacgtaccggcaaatgtttaaagagctgttcagctatgccgccccttatgtctttgtcgggctggcgataccgctttaccagtacattgatacgaatacgtttaataaagcgatgattgcagccggctatcaaaacatcagccaggatttgatggcgatcgtgacgctgtacgtgccaaagcttgtgatgattccggtatctctcgcgacggcattcgggctgacattgattccggcggtgactgaaaactttaccaacaaagatttccctgctttaaacaaacagattgatcaggcgatgcagatcattctcttcatcgttcttccggcatcagtcggtatggctcttttgtcggggccggtttacacgttcttttacggctcggaaagcctgctccctgaaatgggacgagatattttgttctggtacgcgcctgtggcgctgttattctcgctcttcaccgtcaacgctgcaattttgcagggggtgaacaagcagaaatttgcggttgtcagcttgatgatcgggattgtgatcaaaatcgcgcttaacgttccgctcatcaagctgcttcaaggcagcgggtcgattttggcaacggcgctcggctattcagcttcactcctatacggatttatcatgattaaacgccatgccggctattcgtatcgcaaactgtttaaacggtttttgctgatgctgatcctgacggcggtcatgggcatcattttgctgcttgtccaggcgcttctaagtatttttatttcatacgaaggcgggcagatcaggtctgctgtcgtcattttcatcacaaccgcagtgggcgggtcagtttatctgtacttggcttaccgtgtgaaactgctcgaaaaaatcttcggtcagcgattgaatcgctttttcaaaagaaaggcctcctaa

SEQ ID NO: 3037 - DNA, 1275 bp, Bacillus licheniformis
atgaagtattttgatgtcatcgtcatcggcggaggcccctcaggattgatggccgcaatcgcggccggtgaacagggggcggacgttctcttaatcgacaaaggaaacaaactcggacgcaagctggccatttctggaggcggacggtgcaatgtgacgaaccgcttgccggttgatgagatcatccggcatattcccggaaacggacgctttttgtacagcgctttttctgaatttaacaatgaggacatcatcaagttttttgagcgtctgggcgtcaagctgaaagaggaagatcacggaagaatgtttcctgtctccgacaaggcgcaaagcgtagtggatgcacttttaacaaggctcgaacagcttcatgtaagcgtacgtacaaacgaaaaagtgaaaactgtcctatacaatgaagaaaaagcgtgcgggatcgtgacgggcagcggtgaagaaattgcagcgggatctgtcgttattgctgtcggcgggaaaagcgtcccccatacgggatcgaccggagacggctatgaatgggcggaaaaagccggccatacgattacggaactgtttcctacagaggttccggttacgtctgacgagccatttatcaatcagaaaacattgcagggcctatcactgagaaacgtcgccctcagcgtattgaacaaaaaaggaaagccggtcatcacccaccaaatggatatgatttttacccattttggactgtccggacccgcagtcctcagatgcagccaatttgtcgtcaaagagttgaaaaagcaggaaaaagtcaggctgaaaatcgacttgttccctgatattcatgaggaacagctttttcaacgcatgcataaagaattgaaggacgctccgaagaaatcactcaaaaacgtgctgaagccttggatgcaggaaaggtatctgctgtttcttttcgagcgcaacaagattgatccttctgaaaccttctcttccctttccaaagaccgtttcagagctttcgtcaaagactgtaaagagtttactgtcaacgtgaacggcaccctttcgcttgacaaagcctttgtgaccggcggaggggtttccgtaaaagaaatcgatcctaaaaaaatggcgtccaaaaaaaaggaagggctttatttctgcggggaaatcctcgatattcacggctatacgggtgggtataatatcacatccgcgcttgtcacaggcagacttgcaggcttgaatgcaggcgaattttcgctttgccggagaaaaaaataa

SEQ ID NO: 3038 - DNA, 1533 bp, Bacillus licheniformis
ttgaaaaatatttcaagcgttttttggattgtgattgttatcacagcagcagctgtattatggggaatcgttgctccggataaccttcaggcgttaacgacttcgattcaaggttatgttacaaacacactcggatggtattacttattggtggtttctctgtttgtcgcattcagcatctttttgatcttcagtccgattggaaagatcagattagggaaacctgaagaaaaacctgaattctctcgattatcttggtttgccatgctttttagcgcaggtatgggcattggtctcgtattttatggcgcggctgaaccgatcagccattatgccattagctctccatcaggtgaaacagaaacagcccaggccttcagagattctctgaggtatacatttttccactggggattgcatgcttgggcgatctatgcgatcgttgccctttgcatcgcatactttcaattcagaaaagacgcgcctggcttgatcagcgcgacgctgtttccggtcttcggcgacagagtcaacggaccgcttggaaaagggattgactgcatcgctgtatttgcaaccgtcgtcggtgtagcgactagtctcggaatcggcgccacgcagatcaacggcggactccattatctattcggagtgccgaacagcttccaggtgcagctggcgatcattgcagtcatcaccgttctgtttttaatttccgcttggagcggaatcggaaaaggcatcaagtatttgagcaatacgaacatggtgctggccggcgtcctgatgatctttatgctgtttgtcggaccgacggtgttaattatgaactcgtttacggacacgatcggaacgtatatctccaatgtggtgcaaatgagcttccgccttgcgcctaatgatccggacagccgtgaatggatcaattcatggacgattttctactgggcttggtggatctcctggtcgccgtttgtcggtattttcatcgcccgcgtatcaagggggcgcacaatcagggaatttttgattgccgtcttgtttgcgcctactgtgctggcgtttctatggttttcaattttcggggtttcagcgatggatcttcagcaaaaagggattttcaacgttgcaaaactgtctacagacacgatgctgtttggaatgtttgaccactacccgctggctatgattacatctatcgttgccttgttgctcattgccgtattctttatcacttctgcagactcggcaacatttgttctcggaatgcaaacgacttacggttcactgaatcctgagaattcggtcaagatatcatggggcatcatccagtcagcaatggctggggcgctcctgtattcaggcggactatcggcgctgcaaaacaccgccatcctggccgcactgccgttctcagtcgtcgtgattctcatgattgtatcgttatataaatctctgtcacaagaacgaaaagagattaaacaagccgagaaattccagaagccaagaagcccgagggtgaaaaaagcgtaa

SEQ ID NO: 3039 - DNA, 183 bp, Bacillus licheniformis
atgctgaaggtggccgtatttgatgaagaacacgaaaaagatttgcagcatgaaatcaatgaattcttaaaaaagctgtcggaagaccagctggtcgatataaaatatgacgtatcagccgcatgcgatcctcaaggcgaacagctttactgtttttcagcgttaatcttatacaggacataa

SEQ ID NO: 3040 - DNA, 315 bp, Bacillus licheniformis
atgacgataaaagagatttcgcctgatgaactgaaagacaggcttgcaaaaggagaaacgctgaacattatcgacgtcagagaagatgaagaggtggctgaaggaatgatccctgaagccgtccacattaaaatgggggatatccctgaaaaactcgacgtctttcaaaaagatcagccttatatttttgtgtgccgatcaggcaaacgaagcgaaaatgtctgcctctatttgcaggataaaggctttgatgtcaccaacatggtcggcggcatgctcgaatggaccggaaacacgaagccgaaaacaaaataa

SEQ ID NO: 3041 - DNA, 954 bp, Bacillus licheniformis
ttgttttcagctgttggactatcgctgcaaattgatgatggagcagtttcagaatcagccgagcttttccggaaaattaaaaggcagaaggaaacggttaagagcgcggatgacatcattcagtactattttttctttttttcaggcatgtatgagttttatgagaaaaactattttgaggcgatcagctgttacaagaaagcggaagcgaagctgcataaactgaccgatgaaattgaaaaagcggaattttattataaaatcgcgaccgcctactaccaaatagacgatcatttcagatcgttgaactactccgaaaaagcgctctcacttttcagcaagcataaagaatacatagacaaaacgatcggatgcgaaatgatactcggatcggtgcagtttgaattgttccgcatcaaacaagctgaggagcactacgggcgggcgcttgatcaggccgttgcccttcaaaaccggcgaatcatcgggctgatctatcataatatgggactgaactatgccaaatgcggcatgccgcttttggcggaggagcactttagaaaagccctttcaatcggtgtccatgagcaatcggtttttggcattaacacccttttcgagctgtctcacctcatgtacaaaaacggttctcccgaagaagcgagacgtctctgcaaagagggatttaccagatcggccgaattaggagaggatgaatacgcagcgaagttcaggctgattttcgccctgtatgacgctggccatccgctcgatattgaattttcgcttgaatatatgagtgataaacggctatggccgcatgttgctgaactgacaaaagatattgccgactattacatgaagtcaggcgaccatgaaaaaagcgcgctttacctggaaaaatcgcagcatgcgaaaaatcaaatatataaaatgaaggaggggattatatga

SEQ ID NO: 3042 - DNA, 360 bp, Bacillus licheniformis
atgggtgaagaatttgaaaaacgatatctttactggattgatgaagccgtgaaggagagcgaaaagaaagacgatttcaagtccctccccggttatggaaaaccgctcagcaaagagatgctcgagggggatgcgctttcgtcaacccttaaaaacgcccgatatctgccggaatggctgaagctgcaaaaggaaattaaacaagagattgaaaaagcgatcaaatcgaatcagcgcgaaacgctgattgatgccatcaaccaaaaaattaaaaaatacaacctcacctgtccgaaccaattccaaaaaggccttgtttcagccaaaaacctcgaaagtcagctcaaatattggagctga

SEQ ID NO: 3043 - DNA, 648 bp, Bacillus licheniformis
atggaacaaaacgtctccatgggaagggtgctgagcttttgtgaatgggtgctgaagtttttttacgccaatctgctgtggtttgtttttactatgctcggccttggcgtcttcgggtttatgccggcgacgactgcattgttttcagtgacgagaaaatggatcatgggcaaaaccgatattccgatattcaaaacgttctggcaggcgtaccgcggcgagttttttcgttccaacgccatcggtctcattctggcggcggccggcatcatcatttatgtagatcttgcttttatttatccggatcatctcctattgcacgttctccggttcgtcattatggtttttggatttttgtttttgatcatgctgttttatatgttcccgctgctcgcccatttcgattggaagaagcgaatgtatttcaagttttcgctgattctgggcatatcgtatttgcagtatacattaacgatgatggcggtcactgcaatgctttatatcgcttttgcgtttctgcccgggatcgttccttttttcagtgccagtctgcttagttatgcggttatgtggctggcatatcaagtgttgaaaaaagcggaagccgcagaacagaaggaaaccgtcataacgacaagacacacttaa

SEQ ID NO: 3044 - DNA, 1278 bp, Bacillus licheniformis
atgaaaaaatatgcgatatgcggtctgagcggccgcgcttttaacatgtttatcgagcctctggtgggaaaatacgggaaagaaaaccgcatcgctgcgctcttggacatcgatccgctgagggaggaagtctgcaaagaaaggtttccggcgcttcgccccgtcccgtttttcgaagagaaagcgtttaccgaaatgcttgacaaaatcaagccggacgccattattgtagcaggccgtgatgatacgcatgtccgctatatattgggcgctttacgggcagatattgacgtgatcactgaaaagccgatggtgacaacggcacgggatgcggcagccgtgttaaaagccgaagccgagagcaaaggaaaagtgaccgttacgtttaactatcgctacaatccgtaccaccgcaagatcaaagagctgatacttgacggaaagcttggcacgattacgtcggttgatttgaactggtacatcgatacgtatcacggcgcaagctattttaaacgctggaacaggatgagagcattctcaggcggtctttccgtccataagtcaacccatcatttcgatcttgtcaattggtggcttgatcaaacgccccagcgaggttttgcctacggcggtctgtactactacggaccccgcggcgaaatgaatcctgaaaaaggggaaaaccgctattgcggaacatgccatgtcaagaagaaatgccgctattatatgaggtggcaggcaggcgacccgcaggacgaccatgtcaagaccaatgaaagccagcatctgctctataccgattacaggcctgacgcgtgtattttcgatgaagaaatcgacatcgaggatacgtatgcagccgttttgaaatacggcaaaggggcgctgctgaattactccgttcatttttcagccccgtatgaaggctaccggcttgcaatcaacgggacaaagggaaggcttgaaacacaggaatatcatgctccggcaagagtcccatttgaagttcccgaacagaccatcgattattatccgctgtttgaatcgaaagaaacgattcgcgtcgtcaggcagcccggcgggcatggcggaggagacccgctgcttttggaggagctgtttggcggaggagaccctttgaggaattacgacattctggccggtgccgaagcaggcgcctattcaattgcagccggcgaggcattgtggcgctccatcaaagaaaaaaagccgataggaatcagtgaacttctgcatacccggcaatatacataa

SEQ ID NO: 3045 - DNA, 405 bp, Bacillus licheniformis
ttgattttttcggatgcaccggctgaagtaaaggaaaacgtgcagcgcgctgtcgggaaagaacagctcaacatcaccgttttcccggcaaccccggaaaaactccttgttgaaattgcggcgaaagaaggagatctgtttatcgttccagaagacatgtttaaacctttttacgatcctgaaggacttcagccattgaatgctgcttcggaagaaaaagagccgtacagcgctccgggcaaaaacggggaagtacagctgtatgcggctgtcatcgaaaaaggagaaaaacgtttgaacggctatacggttcagttgaatacagatatggcagctttcataccggtttatgcgaagaaaacccctgaagcgacggaactcatcgaagcgcttcaagcaaaatga

SEQ ID NO: 3046 - DNA, 1122 bp, Bacillus licheniformis
atgaatcaatctctcatcacaaaatcgcctctttacattgctgaagaagcggccaaaacaataatgaaagcgtatacaccgaaagagctgccaccggccgggcgctggcactaccatcagggcgtatttctgtgcggcctgattcgcctttgggaagaaacggggaaagaagcatacttcaaatatgtaaaagaatatgccgatgatctcatcgatgactgcggcaatttttatttcaggagggatgagctggacgctatacaagccggacttctcctttatcctttgtacgaggagacgggcgatgaacgctaccgcaaagctgcaaaaaagctgaggggcctttttgaaacgctgaatcaaacagaagaaggcggtttttggcataaagataaatacccttaccaaatgtggcttgacgggttgtacatgggagggcctttcgcactcaagtatgcaagggcgttcaatgagcctgaactttacgataaggtcatcctcgaggaaaaactaatgagaaagcatacgaaagactgcaggacgggattatattatcacgcgtgggatgaaaagaggcagatgccttgggccgaccccgtctcaggctgttctccagaattttggggaaggtcaatcggctggtacgcgcttgcactgagcgacatgatcgaactgctcccgcaggggcatagcacaagacaggagtggacccggacgcttcaagagatggtcaaaagcattgctgattttcaagatgaaagcacagggctatggcaccaggttgtcgataaaggcggacttccggacaattggctcgaaagctcctgctcgtgtttgtatatgtacgcgatggccaaaggggctcgcatgggctatattgattcatcatatattgatagagcgacaaaggctttcaaaggactcgtcgaagaaaaaatcgagatgagcgcaaaagaaggcttgcttttaaaagatatctgcgtcggaacttctgcagggacatacgattattatgtcggacgggaaaaaagcaccaacgatcttcacggtgtcggcgccttggttatggcttttgtagaacttgaaaagaccggccgtttttcctgcggggaagcgaagtga

SEQ ID NO: 3047 - DNA, 967 bp, Bacillus licheniformis
atgaaagcagccgatgtccagaccggaaaaaatccggcccttgttgttggaaaaaaacgaaagacgcgtttttgggaaaagcttctccagcaaaaatatttatatttgatgattttgccgggactgatttattttttgctttttaagtatgtgccgatgtgggggattgtcatagcgtttcaggattaccagccgtttctcggcataacggggagcgaatgggtgggctttaagcattttgaaaggctgtttaccgaaccgacgttttttatgctgttgaagaatacattgattttgttttttctcaaccttgttgtattctttccgataccgattattttggcgcttttattgaatgaagtcagagtcgcattgttcaaaaagtttgtccagacgctgatctatattccgcattttatgtcatgggtcattgtggtatcgctttctttcgtcctgttgactgttgacggaggattgatcaatgagattatcgcctacttcggcggagaaaagatcaattttttgctgaatgaaagctggttcaggccgatgtacattcttcaggtcatctggagggaagccggctggtcgacgatcatctatttggcggcgattacagctgtcgatccgcagctttacgaagcggcgaaaatggacggggccaatcgcctgaggaggatgtggcatgtcacacttcccgcgatcagaagcgtcatcgtcgttttgctgatcttgaaaatcggcgatacgctcgaactcggctttgagcatgtgtatctgcttttgaatgcaacgaaccgcgaagtggccgaaatctttgatacgtatgtatacacggccgggttaaagcagggacagttcagctacagtacagccgtcggtttatttaaagcagctgtcggtctcattcttgtcgtatttgcaaacaggatggcgaagaaatttggagaagaagggatatattaat

SEQ ID NO: 3048 - DNA, 2310 bp, Bacillus licheniformis
atgaagagaaaacaatataagttttactataaactggtgaccttctttctcattctgagcaccattccggtcatcatcgtcggctttttttcctatcagagatcagcggaaacgattgaacaaaacgttacaaacgaaaagctccaaaccgttagccagacacagctaaatattgaacatattttaaaaacggttgaccattccttcaccaattacgtccgttcctatcctttaattcagacgctcagccgcaccattacaccagaacgctttcagctgtataaccaaatcaacaaggaattaaacgaactccagacattcgataccgatctgtcggatatcacgctgatcagccaagaaaaaaagtggtatatcaacaactccggtttataccctttagatcagggaaaacaagccatcacgctctcgctttacaacgctttaaaaagccgttccagctgggtgcttgaaaaaaacaacgaccttgtcgccacaaaagaaggggcttcgggaaactgcctgtacaacgtcaatctggtcaaacagcttcccctgaacagcatggaaaacagaggccttgcgatcgcgagcattccttcttgttcgcttgtcaagcgcatgccggatcattcaaaaacaaacagcatgatggtgcttgatgacaacggacggatcatccttcactcagacccgtcaatgatcgggcaatcgatcaaacaagaaaattacttcaaaacgatccgccggcaccaagaaaaaaacggccagtttgatacaacagtcagcgacaccgcctataacattacataccagaaatcagattataataattggatatacgtttcgttaacgaccattccggaactctatcagcagacggcatcaatcggctggttcacgtttacgatctgcctcattttgttagcgctttcatatttattctcctggtttggttcacgccatttttacaggccgatcaaggttttatacgaatccgtctccggcttttctccaggagccgattccgtccaagagaaaccgaaaaacgaatttgaactgattgaacggaacattaaagaaatgaaaaataaaaaccatgatctgaaggtgcgcgtcgaacagcaggtcacccagctgaagcagtattttttaacaaggctattgctcggcaagctgagcgaagaagaaatcaaagaccgctttactgggctcggcttccctgaagattggagccatctgtcggtattcacactgcaaattgatacattgaaagacacatcatacgaaaaaaaggatcttgatgtcctgctgtttgcgatcaacagccttgtcgaacgatctgtgcccaagaataagcgccttccgccggttgtcattgataaaacgcagaccatcatcatgctgaatcgcggacagccgctggaaaggtttcaggaagacttagagcataccgcatcagccattaaggataaaattcatgaagagcttgggttgttcgtcagcatcggcatcagccagccatttacaagtcttgcaatgtcaaagcgcggttatttggaagggcttgaagcactgacataccgtctgaaatccggaaaacacgcggtgattttctatgaacaccttgaccgcaacaaagcgtttttaacccagtttccgaagcagattcaaaatgaactgtttgaagccattaaaacgtgcaaccgtaaacaagcggccgaacagcttcaccttcttcttgagtcgatttgttctgaaaacatgaatccgcatcactgccagattgcgattgcaaggctgttgaacaacttgattgaatttatgcatttgctcggaatcgagatttttgaaccgaacgaaaatacgatgctgtacgacgacgtctttgagctgacgaccatcgaggaaattgaaagctggctgaacgcgcagattatcgttaaaatgatcgatacactcagcatcagagaagaatcgcaatacaaaaacatctcagaaaaaatcgtccatattatccagcaggaattcgacacggacttgacgctcgaatcgatcgcaggaaggcttcattacaaccccaattatttaagcagcatcttcaggaaggaaatgaaaatatcgttcagcgaatacttgtcatcatacaggcatcatatcgcgaaaaactggctgacggaaacgactatgtccgtaaaagaaatttccgaaaaactgaaatacaaaaatccgcagaatttcatccgttcatttaaaaagctggaaggaatcacacccggcaaataccgcgagctgaaaaaccattcggcataa

SEQ ID NO: 3049 - DNA, 1506 bp, Bacillus licheniformis
atggggaaaaaatggctgatcccgatttttgcgttcgtgcttttggccggcggactgcttggctgttcgaacagcggagcagaccaggcttcttcgaaggaggagaaagtcgatttgaactcgcctttggacttgagctggatggtgatcctttaccatcagcagccgccgaaggacacggcgattaaaaaaatcgaggaactcaccaatactaagctcgatttaatgtgggtgcctgatgcggtaaaagaggaccgtttaaactcagcgctcgccgccggaaacctgccgaaagtcgtcaccattcaggacattaaaaattcatctgtcatgaatgcattcagatcggggatgttttgggaagtcggaccttatttaaaggattatccgaatttaagcaagatgaacaagctgatcaataaaaacgcttcaatcgacggaaagctttatggcatctacagggagcgcccgttatcaagacaggggatcgtcatccgtaaagactggcttgacaaccttggactcgatatgccgaagacagttgatgaactttacgaaacagcgaaggcatttacagaaaaagatcctgatcaaaacgggaaaaacgatacgatcggctttgccgacagaaacgatttgatctacggcgcctttaaaacattggggtcctatatgggcatgccgactgattgggaggaaaaagacggcaagttcacgcctgacttcatgacaaaagagtacatggatacgatgaaatatatgaaaaagctgtatgatgaagggctgatcaacaaagactttccggtgacgagcaaaacgcagcagcaagaaatgttttcacaagggaaggccggcatttatgtcggaaatatggttgatgccgtcaatctaagagaccagtctgtcgatgataaaatggaacttgagatcatcaatcggatcaaagggccggacggaaaggaacgcgtctgggcatcaggcgggcataacggaatctttgccttcccgaaaactagcgtcaaaacagaaaaagagctgaagaggattctggcctttttcgaccggatcgccgaagaggatgtttacagtctgatgacatacgggatcgaaggcgttcactataaaaaagaagggaataaacaattcaaacggatcgacgagaaactgaaagactggcaggcggaaattcagccgctcgtttctctcgtcggcattgataagcaatatttgaaaaatacgggcgatccgctccgcacaaaatatgaagagctgacagaggacaataacgaaatcatcgtctcaaacccggccgaaagcctgtactcaccggccgcatctgaaagaggcgatgaactgcaaaagatcattgatgatgccacataccaattcattctcggcaaaatcaatgaaagccagttcgagaaagcggttgaaaaatggcgcacgaacggcggaaatcaagtcatagaagaatatgaggagtcatttaaaaaagcagaaaaatag

SEQ ID NO: 3050 - DNA, 837 bp, Bacillus licheniformis
ttgaattattcatttttaacagggttcggattggtttgtgtgctgccgttcatccacgttattgcagcctcttttgcgacagtcgaggaggttatttcgaaaaagtttattttaataccgacgactttttcgctggatgcgtacaggtatattttttcaactgacattgtgtacaggagcttaatcgtttctattcttgtcacagccgtagggacggcggtcagcatgtttctttcctctttaatggcatacgggctgtcgagaaaggagctgatgggaaggcgcgtcctgatgttcttggtcgtgttcacgatgctgttcagcggagggatgatcccgacctttctcgtcgtaaaatcgctcggattgctcgatacctattggtctctgattcttccgaccgccatcaatgcgtttaacttgattattttaaagaacttttttcaaaacataccgtcaagcctcgaggaatccgccaaaatcgacggctgcaatgacatcggcatcttcttccgcatcattcttccgttgtctttgccggcgatcgcgacgatttcgctgttttacgccgtcacctattggaatacgtacatgcaggcgattctgtacttgagcgatgcgacaaaatggccgatacaagttttgcttcgccagattgtcatcgtatcaagcggtatgcaaggggatatgacggaaatgggagcagccgcggcgccgccggaacaaacgatcaaaatggcggtcattgtcgttgcaaccatacctgtgctgctcgtgtatccgtttattcaaaaacactttgcaaaaggcgctcttttagggtcaattaaaggataa

SEQ ID NO: 3051 - DNA, 765 bp, Bacillus licheniformis
gtgaaaaaggtgacgatcgtcggagggaacggcacggtcggccgcgtattagcgggcggattggcaggcgaagggtatgaggtgacagtgctggatttaaaagaaccggatgacaaacaggctgtccgttttatccgggtggatgcgacagattacaacgaagtcgtcaaaagcattcctgcacagacgaatgcgctgatcaatcttttggctgtaaagccgtcgggcgatttgcttgaccggcaggagtttgcgaaaatgacggatatcttttttaaagcgacatatacgattttgcgggcggcggcggagctcggcgtgccgaaagtggtatttgccagcagcaaccatgtgacagatgtatatgaaaagggcggcgattctctgttggggaggcagatcaacacaaatgactacccgcagtccaaaagcttgtacggcttgctaaaattggcgtccgaaaatctcggctaccttttctcgcaccaattagacgccaaggtttccgtcatcaatctgcggatcgggacagctgctgaaaatgagctagaaacgctgcacgcaaaaccgagaagcaaaaaaacgcttttatcccaccccgacctcatcggaatctttaaagccgctatcaaatccggcaaaacatatggtacatattatgctgtcagcgacaataaggggcggccgtggtcgatcgattccgccattcgggaactggggtacaggccgcaagtcagcgcctctgacatccttgatgaagactga

SEQ ID NO: 3052 - DNA, 888 bp, Bacillus licheniformis
atgcgcagtcaacttttcaaactgctcggcgatttgccggggaaaaaaagcattgatgcgagcactcttaaaatcgaagaaaagtcatcttttattctcgaaacgcttttgcttgatttaaacggaattgaagcggtgccggcctattttgcaaaaccgaaacagatgaacggcaagcggccggccgtgctttactgtcattcacacggagggcgctacgaaaggggaaaggaggagctggttgaaggagcggagtacttgcaagcgccgccgttcgccgaggaattgacggctttgggattctccgtgcttgcgattgatcattgggctttcggagacaggcggggcaaaacggagagtgagatatttaaagaaatgctttggacagggcgggtgatgtggggaatgatggttttcgacagcatcagagccatcgattatctgaaaatgagggaggacatagacgaaagccgcatcgcttcactcggcatgtcgatgggaggtctgatggcctggtggaccgctgcattggatgagcgggtcagcgtatgcgttgatatatgcgctcaggtggacagcgaaacattaatcaagacgcagaatttggaccgccacaatctctattcttatgttccagggctggtcaaacacttttcaaccgctcaaatcgaaagcttgatcgctccaaggcctcatttaagcctggtcggaaccgcagataaactgacgccggttcaagggattgacattattgaagaaaagctgtccgatgtgtatatagaaaaaggcgcaggtgaacgctatgaagtgtttcgttctcattcagggcacctcgagacagccggaatgaggcataaagcggtcggtttcttaaaaacatggctgtaa

SEQ ID NO: 3053 - DNA, 1251 bp, Bacillus licheniformis
atgagagaaaaaaagcttggtcctttattgttaagcgggctgatgacggggcccattttaggatccggaatcattctgctgcctccgatgattcatcagacagctggagactacgcgatttttgcgtggctgttgatgctgggaatcggttttttatttgcctgggtttttgccagattaagcgtcgagtatccgaatgatgccgggattgcttatgcggctgaaaaagcgttcgggtcgcgtgttaaaaagttggcagtcttttattttatcatggctgcgagcttcggccccgccgccgtattaatgacggccggcgaatatattcattctcttgcggcaggcacggcattccctgctgaactgtacggctttgtttttttcatcttttgtatggttatcctttgctttaatctttcatttgtcggcatggttgcactcattttttccactgccgcggcgcttatcctgtttggaagcagcgcggcttccgtgccttacttccgtgaggggcctctcgtagacggaacatttcagtttaccgattttggccgcggattgctgctcctgttctgggcattggtcggatgggaaatcgtcggcaactacagcatggaagtgaaaaaccgcgggaaaacgattccacgggctgtcgtgatcagcagcctgacggtaacggtcatatatttggcgaccgcggcagctgttcagtggattgatcctggattctccgcaaacggacaattgaagctggcgatgatgctgacgccgttgttcggatcttttgcattgccggtgatcgcagtgctcaccgctgtcctctgtatgtgtgcttattttcaggtgacaggcggagcagccaggctggtggcctcgcaggccggcgggctgtttgcctacagatcaaggggaaatcagccgactgcagcgctggggcttatatttctcatccatacgatcgttttcgtctgcctgatgtttcactttcttaatgttgagacgctggttctgatcgcaaacgcctttttcatctgcaactcgctgtgcggtcttgccgcagcttacaagctgttatcaggccgcatttacaaaaaagtatgcctctttctcatggggggcttcacgctgcttcttttgttttcatcatcgtgggtattactgtttatcatgcttgccagcgcattgtttgttgtgaacttccgccaacttaacatctggaaaaaggtaaaacgccctttcaaatcgtattaa

SEQ ID NO: 3054 - DNA, 894 bp, Bacillus licheniformis
atggagatccgacacttgaaaacatttaaaacaatcgtggatatcggcggttttacccgtgctgccgattatttaggatatgcacagtccactgtgacttcgcacgttcaagcaatcgaacaagaattaagaaagccgctgttctaccggctcgggaaaaaaatgatgctgacagaagcgggaaagcaccttctcccttatgccgcagaaatggtcgagctgtatgaaaaagcgaggcacattccggaaaacgaccaggagccgtcgggaaacttgatcatcggcgcctcggaatctttaacggtatacaggctgcccgccattcttcacgaatttacaagcaaatatccgcaggtcacggtcactttaaagtcttccacgtgctggcagctgagagacgaattgaaacagggaaaaatcgatgtcgcttttcttttggacaacgaccggaaagaaaacgaccttcatgttgaaaagctggtcaatgagccgatggtgttcatctttcccaaagaacacccggcaggacaaaaagctcttgatgatttgacttttaacgcaaatgaaacgtttttatataccgagcacggctgcagctaccgtgatttttttgaggaatatttacgtcaaaggggagtcattgccgaccatacgatggagttttggagtgtcgaagcgattaaacaatgcgtaatgtgcggtttgggcgtctcccttcttcctttgatcacaacgcgcactgatatcgaagaaggaaagcttcagggcacgctggtccgcgacgccctgttttccactcaaatggtttatcataaaaacaaatggctttctcctgctatggcggcttttacggatatcgtccgcaggaaggcaagagaatgggaacagacataa

SEQ ID NO: 3055 - DNA, 429 bp, Bacillus licheniformis
atgggaaaaaaggagatgatcatgatgcatttttccgatttttccgccgtacaggtcagaatcgcccggcctacagaccgttttgacgaaatcgttgcattttacgaaaaggggctggggctgaaaaagcttggcggtttttccggccaccacgggtataatggcgtcatgttcggcctgccgaatgtccaataccaccttgaattcacctcacatatcgaaggaagcccttgtccggcaccgactaaagacaatctgctcgttttttatattcctgatccggaggaaatcaggagcatattaaataggctcgctgacatgggctatgacgaagtgccgcctgaaaatccgtattggaaggaaaaaggggcaacggtggaagatccggacggctggcggatcgtgctgatgaataccgaaggcatatag

SEQ ID NO: 3056 - DNA, 2415 bp, Bacillus licheniformis
ttgagctttgaccatcaaacaatcgagaaaaagtggcaggactattggctgaaaaataaaacgtttgccactcgtgaagataaatccaaacctaaattttatgcattggacatgtttccgtatccgtcgggcgcaggccttcacgtcggacaccctgaaggctatacagcaactgacattttgtcccgcatgaaacggatgcaagggtacaatgtcctccatccgatgggctgggatgcattcgggcttcctgccgagcaatatgcgctagatacgggaaacgatcctgccgtcttcaccgagcagaacattgacaacttccgccgccagatcagagcgctcggcttttcgtatgattgggacagagaagtcaacacaacagatccggactactataaatggacgcagtggattttcttaaagctttacgaaaaaggtctcgcttatgtagatgaggtccctgtaaactggtgtcctgcgcttggaaccgttcttgccaatgaagaagtcatcgacggcaaaagcgaacgcggcggacatcctgtagaacgccgtccaatgaagcagtggatgctgaaaattaccgcttatgccgaccgcctgcttgaagacctggaagaactcgactggccggaaagcattaaagaaatgcagcgcaactggatcggccgttctgaaggggcgcatgttcattttgcggtcgacggcaccaatgaaacgtttacggttttcaccacgcggcctgacacattattcggtgcgacatatgccgtgctggctccggagcatgatttggttcaaaaaatcacaacgcctgaacagaaagacgcagtcaacgcctatattgaagaagttcaatcaaagagcgacttggagcggacagaccttgccaaaacaaagacaggcgtcttcacaggtgcatatgcggttaatccggcaaacggagaaaaaattccggtctggattgcggactatgtcttggctacatacgggaccggggcggtcatggccgttcctgcccatgatgagcgggaccatgaatttgcatcagcattcgggctgccgatcaaagaagtcgtcaaaggcggggatgttgagaaagaagcatatacaggcgacggcgaacatatccattcagattttctgaacggtcttgataaagcggctgcgatcgaaaaaatgatccagtggcttgaggaaaacgggaagggcgagaaaaaagtaacataccgcctccgcgactggctgttcagccgtcagcgctactggggcgagccgatcccgatcatccattgggaagacggcacatcgactccggttcctgaagaagagctgccgctgatcttgccgaaaacgtcggaaatcaaaccgagcggaacgggtgagtcccctcttgcgaatattaaagaatgggtggaagtgacagatcctgaaacaggcaaaaagggaagacgcgaaacgaatacgatgccgcaatgggcgggaagctgctggtacttcctgcgctacattgatccgaagaacccgaacgagctggcttcccctgaaaaattaaaggaatggcttcctgtcgatatgtatatcggaggggcggagcacgccgttcttcacttattgtatgcgcgcttctggcataaattcctttatgacatcggggtcgttccgacgaaagagccgttcaaacagctttataaccaagggatgattcttggcgaaaacaatgaaaaaatgagcaaatccaaaggcaatgtcgtcaatccggacgaaattgtggagacgcatggcgcggacacgctccggctgtacgaaatgttcatgggacctttggatgcatcgatcgcctggtcaacgacagggcttgacggagcccgccgcttccttgaccgcgtatggcgtttgtttatcgatgacaatggcgggttaaacgagaagatcgttgaaggagccggcgaaacgcttgagcgcgtctaccatgaaacggtcatgaaagtaacggaccatttcgaaggtctgcgctttaatacaggcatttcacagctgatggtcttcatcaatgaagcatataaagctgatcagcttccgaaagaatacatggaaggcttcgtgaaattgctttctcctgtcgcgcctcatttggctgaagagctctggaaccgcctcggtcatgaggaaacgatcgcgtatgaagcatggcctgtctatgatgaagcgaagctcgtggatgatgaaattgaaatcgtcgttcagctgaacggaaaggtgaaagcgaagctgaacgttccagccgacgcggacaaagaacagcttgaagagctggcgaaaaacaatgaaaaagtaaaagaacagctagaaggaaaaacgatcagaaaagtgatcgctgtgcctggaaagcttgtaaatattgttgcaaattaa

SEQ ID NO: 3057 - DNA, 324 bp, Bacillus licheniformis
atgctgcatcaagttttggttgcttgtttgattggagggattatgggggttctcgggcacgttaaaaaaagaggacgactcgagaaaccgagaacaacgaaacgattcatttaccttggattttttgaagatattcttgtcggaatggttgcttctattttgcttgttttatctgcggaacctgattcgggaattcagcttgtcgtgttatcgatcattgccggctacggcggtgaagctgtattgagaagctttgactttgtcagagaacagcaggcaaatgtacagaactccgaacggcaaaacaaatctccacacgattaa

SEQ ID NO: 3058 - DNA, 1182 bp, Bacillus licheniformis
atgccgcgcacattatggcttttggtcatcggaatgtttatcaatgtcacgggggcatcttttttatggccgctgaataccatctatatccatcagcatttgggaaagtcgctgacagcggccggatttgtgctgatgctgaactcaggggcaaatgtgctgggcaacctgttcgggggatatctattcgataaaatcggcggatttaaaacggttgttcttggaattgtgatcacgtttgcgagcctttctggcctcgtcttttttcacgattggttccagtacattcttttcttaacgttggccggttttggatcagggatcgtttttccggcatgctatgcaatggccggatcagtttggccggaaggcggcagaaagccgttcaactctgtatacgtggcccaaaatgcaggtgtggcagttggctcagcgctcggcggaattgtcgcttctttttcatttacgtatgtttttctcgcgaatgcgatgctgtacgccgtcttcttcatgattgcgtttttcggatttaaacgcatccggtctgaaaaagccatgcagtcatctgttttggatcatgccgattcagtcagcgggaaatcgaaattttctgcgcttttggtcatatgtacgggctacctgctcggctggatcgcttattcgcaatggtcctcgaccatcgcttcacatacccaggagctggggatatctcttgggcagtacagcgtgctttggacagtgaacggggcgctcatcgttttcggtcagccgctgatcggtttttttgtgaaacggtttgccgaatcgctgaaaaaccaaatcgtgatcggatttgtcatttttatgatggcatacggaattttgtttggcgctgaacggtttccggcttttcttgctgcgatggttgtgctgaccattggcgaaatgcttgtatggccggctgtgccgacgattgcaaaccgtctcgcaccgagagggaaagaagggttttatcaagggtttgtcaacagtatggcgaccggcggaagaatgatcggaccgctttttggcggaatgctggttgattattttagtatgcagcttttgctcgcggttctgctcgcattgctgctgattgcaataggaacggcgtttttatacaacaggaaggaaaagcagctctccgctcagtcagatgcatga

SEQ ID NO: 3059 - DNA, 825 bp, Bacillus licheniformis
atgaaaaagttattaaaatggacttctgcgctgggactggccttgagcctggcgcttctggccgcgtgcggaaacaatgccgcaagcgacggcaaaacgatcaaaataggcgccactgcaggaccgtattacgatatggtcaaaaaagcgattcaacctgagcttgagaaaaaaggctacaaagtggaggtgatcgaattcaccgattatgtacagccgaatactgcgttaagtgaaggcgagctcgacgcgaatttgtttcagcatgaggtttttatgaaatcatacaatcaagaaaacaataaaaatcttgcggctctcatttctgtgccgactgctccgatggggctctattctgccaaatataacgacttgaacgatgtcaaaagcggagcggaagtggctgttccaaacgatccggccaatgctgccagggcatttttaacccttcaggatcaggggctgattcggctgaaaagcgatgtcgacacattgaaagcctctgtgcaggacattgcggaaaatccgaaaaagctgacatttaaacagcttgaatccgccaatcttccaagagctgtcgatgacctggatatcgcggccgtcccgggaaatttcgctctctccgccaatatgaagctgcaggacgccctagcgcttgagaacatgcccgaccgctaccgcaaccaagtggtagtggatgaaaaaaacaaagacaagccattcgccaaagatctcaaagaagcggtaaaatccaaagctttcgaggagacgatcgatcgggaattcgccggtttcggaaagccgaaatggatgacgcaatcataa

SEQ ID NO: 3060 - DNA, 681 bp, Bacillus licheniformis
atggaatctatcatgctgatcgggtttttatccttccttttttccatctgctatcttgtatttcatttgatcagaaggattttttctccaggcaaaaggttttccaggaaactcttttatccttgttttgccggcggacttctcctcctgatcatctctgcaccttattacgatgaggaaacatatgccgccgatgagaaaaaaacggagaatctgacaaccgagcttcaggaactgaaaactgaacacagcgctttgcaaaaggagcaaaccgcattaaagcagcaggtcaaacaggcaaacaaaaaactgaaggcagtcaaagcggagaatgacacattaaaaaaagaaaacgaaaaactgacaaaagaaaaagattcgcttacgaaaaaaacaaaatcgctgacagaaaaactggccaaggctgaagaaaaaagcggcagtgccgaaacctctgtaaaagaaaagagcgccgccgctcaggccgaagcgtcacacagcacgcccgccgccaagaaaagcagcgctgaaagcaaacaggagtgcaaaatcaaaggaagcgtcaaccatatttatcatacaccgggcagtacatattatgaccgcacgaaaaacgtcgctcgctggttctgcacagaacaggaggcgcgtgatgcggggtacagaccgccaaaacgttaa

SEQ ID NO: 3061 - DNA, 1332 bp, Bacillus licheniformis
ttgaagtttaaggaccagttgaagttcattagaagaaatatgaggaaaaaccgcctgcgtgtattcatgaccattctcgcaacaacggtggcctgcgcgtttttaatcgtgctcgcatcggtcggattcggactgcaaaaatcaatgactgaacagctgatgaaagagcagatcgtgaccgagataaatgttgtcggaaaagaagggcaaagcgatcaaaaggttcaaaagaaagacctgaaagaatttgaaaaccgcaaagatgtgtccgcgattatcgagcgcacaaacgtgttcgcacctgctgaagcaaaattgggcaacaggaccaataatcaaatgtcgaatattacaattaccgacatggccgctgagcaaaaagccaatatcaaactcgatcgcggccgcgtagcgaaaacaccgaatgaaattgtcgtcggctaccatttcgggaagaacctctggacgaaaaaggaagccgcagattatgaaaagcagatggaaaataatgctgaggaagcaaaagagccgaaaggatacgaagaagatattctcggcaaaacgattgaattaaagatctcaaaaatggatgaaaaaacaggagaagaaggggaagcgaaaacatatgatctgaaagttgtcggagtgacaaaaaaaccttcgtatgaatgggcgagcgattcaacagtctatgtcagcaacggcatgcaaaaagacatcaccggctttctgaagtcggaaaaagacagcggcatgatcgaaaaaacgctttcggtttacgcggataactttgaacatgtcggacagctgacaacagatttggaggatgaaggctactacgtcgattcaataacgaaaaagctcgatagcatcaatctttttttcatggcttttaaaatcggtctgatctttgtcggagtcattgccgtctttatttcagcgatcgggattttcaacacgatgacaatggcggttacagagcggacgcaggaaatcggcattatgaaagcgatcggtgcaagcccgaatgtgatccgaaaaatgttcctgctggaaagcgcctatatcggcatcttaggatctgttttaggtattatcatttcatacggtgtcagctttttagtgaacaagattatacctgtcattttatcatcggtttcagaaggagaagcgagtgcggcagagctcagtatcaccttctcgcatattccggtcagtcttgtcctcatcgcgacattgatcagtgcgggtgtcgccattctttccggcctgaatccggccattaaagcgacaagaacgaacgtgctgacagcattaagaagagagctttag

SEQ ID NO: 3062 - DNA, 699 bp, Bacillus licheniformis
atgatcagtgtaaagcatattcaccactcgtttaaagtcggcaaaaagggaagggaaaatgaaattaaggtgttaaaggacgtctcgcttaccgttgaaaaaggagaaatcgcctgtattgtcggacggagcggctccggaaagtcgacactgctgaacttgatttccggctacatcgccccgacaaaagggaagatcatgattgacggcacggatgtcacgaagtacagcgagaaagaatgggccgcattcaggcttgaacatttcggcttcatctttcaaagttttcagctgattccgagcttgacgactttcgaaaatatcgaacttcccctgactttaaaaggtgttcatccgtcggagcggaagcagcgcgtcaacgagatgttccaccgcgtcggccttgaaaaccacgccggccactatccgaatgagctttcaggcggacagcagcagcgcgtcagcatcgcccgcgctttgattttgaatccttcaatcattttagccgacgagccgaccggaagcctggattccgaaacagagcaggaaatccttgaattcattcggcagctgaacagggaacgcggcattacatttgtcatcatcacgcacgatgacgaggtggcatcgatcgccaatacgaaatttcatttatctgacggcgtgttagagaaaggggaagagactgttgaagtttaa

SEQ ID NO: 3063 - DNA, 978 bp, Bacillus licheniformis
atggtagaccgcggacttttatataaagaatggaaacagcatttctggatttttttagttgtttttgcagcggtgttgctgagtgaaccgcttgcgattttgaatgattatttccagtaccagggatgccttgcagaacagaaaaaatttcccgatatagagtgcgttttatataaagattatggggtaagcggggccatgagaatgttctgggttggcggagtcgcgcttgcgatcagccagatcgggtttgaacggagcagaggaacgcttgactttacactcggcctcccttacaagcgcggcgtcattttcaatactaaatatttcttcggcatttcaattcttttaacagcccagctattatcttacttgttatcttacgctttgattattttgtataacgttgacgttgtctttttccatgagtattttatcggggcggttatcttctgctttatggtctactcgcttgtcatggcggcgggcgcgatgaccggcaatccgctggcccagatgatcgttgctttttcagcgtcgattctgccgtatttgctgatcggccttccgctggccaacttacgaatcatcctgggtttctttgggcatgaccctgctttcttttatggtgaaacagaactactagattatataacgccgatcatatacctcaacagtttcggcattcaagacggcagcctggcctttacgcttattccgctcgccatggggatcttgttttatataatcggctatttctgctttatcaaacagcagcttgaacggaacggacattttttcctttggagaaaaatggatcgtccgatccagattctcgtgattttattcggcatctggggattcggcacagccgctgcttcgagtctgttcagctatatattcggtatgttgatcggttcggcagtcggatttttaatcagttacttcttgattttcaaaaaaataaaacagctgtaa

SEQ ID NO: 3064 - DNA, 879 bp, Bacillus licheniformis
atgattgagctcaaatctgtttcaaaaacgattgacggaaaacaaatacttaaagacatctcctttaagctggaggaaggagagattttcggacttctcggaagaaacggctcaggaaaaacgacgcttcttcgcctgattcagcaaatcctgctgcctgatgagggagatatctttttcggcagcgtcaaggtgaaggatcatccgctcgtcaagcgcaacatcgtctatatgcccgttcaaaacacctatttcgaaaaatacaattacaaacagctcgtcaatattttgcgtaacatttatccggactttgatgttacatatgcaaatgaattaatgaaccgatacgatattcccgaaacaaaaaagtacagggaattgtctacaggattgaaaaagcaaatgtcgctgatcctgtcatttgcgatccggccggcggtcatcctgcttgatgagccgacagacggcattgatgccgtcacaagacaagacgttcttcagctgatggtcgatgaagtggctgaaaacaacacgacgattctcatcacatctcaccggcttgaggacattgaaagaatgtgcaaccgaatcggttttctcgaagacaatacattgtcgaacatcatggatcttgatgaactgaaaggcgattttattaaaattcaaatggcatttgaagaagatgtcaatttaaaaatcagggaaagggaaatccctgttttggaccacaccggcgtcttttatacggtattggttccgaaagaagacaatgtgagcaaacaatttcttaaaagtttgtctccgaaagtttggaacgagcttccggtcagtcttgaggaagtattcatcgcgaagtatggaggtaagcgaagatggtag

SEQ ID NO: 3065 - DNA, 393 bp, Bacillus licheniformis
atgattcaaatcgatccgagaagctcaaccccaatctatgagcagatcatccagcagatgaaagagctgtgcttaaaagggataatcaagcctggagataaacttccttctgtcagagagcttgcaaccattatcattgcaaacccgaatacggtcagcaaagcctataaagaacttgaacgggaagggattattgaaacgttgaggggaagaggaacgtatatttcagaaaacgcgaaagttacgcttgatgaagggaagattgcgatgattaaagagcagttaaagcagctgatcatcgatgcgcattacgcggggatcgacaccaaaaagctgcaggagtggatggcggaaatcgacgaagaagtgagaggaggcgaagtgaatgattga

SEQ ID NO: 3066 - DNA, 273 bp, Bacillus licheniformis
ttggctacaagacaatccgtcggagagcacatccaaagaagcgaagatgcttatgattatgctttatctcaatttgaaactgcaagcaggcaggaacattacaatgagacagagtacagcgatgcgcagctgatgcttgaaaacgcggtcaatgaattaaacaagctttcgctgtttgccaatgagcagcaaagggaggaaattcaccgcaaaaggctccagctgcaaacccttcaaaacaatatgattctgcagagatcgtatgaaagatga

SEQ ID NO: 3067 - DNA, 969 bp, Bacillus licheniformis
ttgcatcagaacaacccttttccatatacgaacagtgaaaaacgatatcatacatggaattatcatttaagaaatcatttcggtcataaagtgtttaaagtcgcccttgacggaggctttgactgcccgaaccgcgacggtacggtcgcacacggcggatgcacattttgcagcgccgcagggagcggagactttgcgggaaaccgcgccgacgatctgattacccaatttaatgaagtgcgcgacagaatgcatgaaaaatggaaagacggcaaatacatggcgtactttcaagcatttacgaatacgcacgctcccgtcagcgttcttcgcgaaaaatacgagaccgtcctcggccttgacggcgtagtcggcctttcaatcgctacccggccggattgtctacctgacgatgttgtcgaatatcttgccgagcttaatgaacgcacatacctctgggtggagctcggccttcagaccgttcatgaacggacggctgatttgatcaaccgcgcccatgatttcgactgctacgtggaaggcgtgaacaagctgaggaaacacggcatccgggtctgctcccacatcattaacggactgcctctcgaagaccgcggcatgatgatggaaaccgcaaaagccgtcgccgatttggacgtgcaggggattaaaatccatctgctccacctgttaaaagggacaccaatggtgaagcagtatgaaaaaggaaaattaacgttcctttctcaagatgaatatgtccagcttgtttgcgatcagcttgaaattcttccgccggaaatgatcattcaccggattacgggtgacggaccgatcgaattgatggtcggaccgatgtggagcgtcaataaatgggaagtcttaaacgccatcaacggggaattggaaaggcgcggcagccatcaggggaaatggttcaacaaggcgaaagaaggcatggccacatga

SEQ ID NO: 3068 - DNA, 585 bp, Bacillus licheniformis
atgaagctcaagaaaatcctcccgtatgcgaaagaactgctgaaaacagccgcaggcgaaggagacatcgtcattgatgcgacaatgggaaacggacatgatactcactttttagctgaacttgtcggtgaaagcgggcatgtctatgcctttgacattcaagaagcagctcttatgaatactgccgaaagacttggaaacgagtataaagaccgggtgacattgattcaaaaaagccatgatgagctcaccacttcgcttcctgacgacatctcaggcaaggtggcagcagccgtgtttaacctcggatatcttccgggaggcgacaaatcggtgacgacaaaaagcgattcgaccatcgccagcatcaagcagcttctcaaaatcctgaaaaatgaggggctgatcgtgcttgtcgtctaccatggccatcccgaaggaaagcgggaaaaagacgccctgctcgaattttgtgcatcgctcgaccaggatacggcccgtgtcctctgttaccaatatttaaaccagcgaaacgatccgccgtttatcattgcgatcgaaaagaaagaagcggtccaaaagtga

SEQ ID NO: 3069 - DNA, 1251 bp, Bacillus licheniformis
ttgaaaaaatttatcgcttatcaaattttgatcgcactcgccattggagcagttatcggacatttcttccctgatttcggaatggcgctgcgccccgtcggagacggatttatccgtctgattaaaatgatcgtcgttccaatcgttttttctacaattgtcatcggagcggccggaagcggaagcatgaaaaaaatgggcagcctcggcatcaagacgattatttggtttgaagtgattacgacgttcgtgctcggactcgggctgcttttggctaatgtgttaaagcccggcgtcggccttgacctttcccatttggccaaaaaggatatcgacgaactctcgggctacacggaaaaagtggtcgatattaaacaaatgatcctcgatatcattcctaccaacatcgttgacgtcatggccagaaatgatttgctcgccgtgatcttctttgcgatattgttcggcgttgcagctgccgggatcggcaaagcctcggaacctgtcatgaagttttttgaatctgttgccaacatcatgttcaagctgacgcagatggtgatggtcacagcgcctatcggcgtgcttgctcttatggccgcatccgtcgggcaatacggcatcgagctcctgcttcctatgttaaaattagtcggcactgtttttctcggactgtttctcgttctttttgttttatttccgatcgtcggtcttgtttttaaaattaaatacttcgaagtcctgaaaatgatttgggatttgtttctgatcgcgttctccacgacgagcacagaaacagtcttgccgcagctgatggaccgcatggagaaatacggctgcccaaaacgggtcgtttccttcgtggttccttcaggcttatctctgaattgcgacggctccagcctatatttatcggtcgcctgtatctttttggcgcaggctttcaatatagacatgagcatttcccagcaattgctcatgatgctcgtgctagtgatgacaagcaaagggatcgccgccgtgccatctggctcgctcgtcgtccttctggctaccgccaacgcagtcggccttcccgctgaaggagtcgcgattatcgcgggagtggaccgcgtgatggacatggcgcgaacaggcgtgaacgtgccgggtcatgctgtcgcctgcatcgttgtttctaaatgggaaaaaagcttccggtataataagcgctttgtgcttgaaaaacaataccggacggaaagcttataa

SEQ ID NO: 3070 - DNA, 1080 bp, Bacillus licheniformis
ttggcagtaccggagcatccttttggattaatggctaaagtatacagagaggtttttccccttgttcatcaggaattggacaagtggaaacgaaaagctgaaacgattcaaaatcccgaactgaaaacgcaggcgaaagccagcatcagggataaaacctttcactgtgaaggcggcggcattatggcccttctttcaggagacaaaatcgagcagtcgatccggtttattacggcgtatcagacgataagcgactacctcgacaatctatgcgaccggagcacctcgcttgatccggatgatttcaccatgcttcaccagtcgatgaaagacgcgctgacagtcggggctgaattgaaaaactattaccggttcagggaagatcaggatgatcaaggctatttgcacgacttagtgaaaacatgtcaaggcgtgcttgcggaaattgagaactatgatctgatcaaggagcatctgattgagctttgcagctactattgcgacctgcaagttcataaacacgtagtggagcatgagcgtgttccccggctcgaagcgtggtttgagaattataaatcggctctgccgaaaatggaatggtatgagttctcggcctgtgcgggttcaacgctcggcatcttctgcctcgtatcgtattccgtccgtcccgattttactgaatcgatggccggaaagatccgcgacagctattttccgtacatacagggactgcacatcctgctcgattatttaattgaccaggaggaagatttaatcggcggggatttgaatttctgcacttattacccatcacattcagatatgatggaaaggctcgaatatttcatcgaaatggcggatgaacatttgcgcgggattccgcacgaaaactttcaccgtttgatcaacagaggactgttaggcgtttatttgtcggatgacaaagtagcgggccagaaggaaatcggccggcttgcgaaaaagctgattaaagcgagcggcaaaacatctttctttttctatattaacggcagggcataccgcaaaattcaaaaaatgccgtggatgaaaagctcgtaa

SEQ ID NO: 3071 - DNA, 780 bp, Bacillus licheniformis
atgtggtgcatggaagcggaaagacctgttgctacaatcgtcgtcattcacggtgcatgtgagcatcacgggcggtataaatggctgtccgaaatgtggcgttcatccggctttaatgtcgtgatgggggatttgcccggccagggcacttcgacaagagaaagaggacatatacgctcttttcaagaatatattgatgaagtggacaaatgggtcgccagggcgaaagcatttgaactgcctgtgtttatgctcgggcacagcatgggcggcctgattgcgatcgaatggtttaagcagcagcaaagcggcattgccggtctcattttatcatccccttgtctcgggctgcaattaaagccgaacaaatttctggacttgatttccaaggggctcaacgttttggcgccgtctatgcggtttgaatccgggatcacgcctgataaagcgacgagaaacaaagaagtcatcgaaatggacatcaacgattcattatatatcacaaaagtttctgtcagatggtatcaagaaatgttaaaagcgttgaaaagcgcgatggagccgacggacgcctttctcaacatcccgctctttgtcatgcaggcgggcaccgactggcttgtcgacaaaaaaatggtcgtcaagtggtttaaccagcttgcttcccacaataagacgtacagggaatgggatggcttgtaccacgaaattttcaatgagcctgaacgggaagacgtttttaaagcggccagagcgtttgcggagcagtatataacataa

SEQ ID NO: 3072 - DNA, 519 bp, Bacillus licheniformis
atgatctacccttataaaaaaacggaacccgttattcatgaaacggcgtttatcgccgacaacgcggtcatcaccggagatgtaacaatcggagagcgatcaagcatctggttctcttctgttatccgcggcgatgtcgccccggtcagaattggaaaaggtgtgaacattcaagacctttcctgtctgcaccaaagccctgaacgccctctcgtgattgaagacggtgtgacggtaggccatcaggttacattgcacagctccgtgattcgaaagcatgcccttatcggaatggggtcgattattcttgacgaagcggagatcggggaaggcgcttttatcggggcgggcagccttgtcccgcctggcaaaaagatcccgtccgggcacctcgcattcggcaggcccgccaaagtcatccgtccgttaaccgacaaagataaacaggaaatggaaagaatacgcaaagaatatattgaaaaaggacaatactacaaatccttgcaaaaaaaagattag

SEQ ID NO: 3073 - DNA, 525 bp, Bacillus licheniformis
ttgaataaactgatggttggcatttacaactttgaatgccggattttcctcggtatgaacagattatttcatcaaaaaacactcaaccgttattttcgttcctcaactcatttgggaggggctatgtgcacgatttctgcctgcctgtctctcttgctgttcggctcgggaagtgttcgtacagcggggatggccagcgcccttgcacttttggtcagccaccttcaagtcatgctgatcaaaaagctgtatccgagaaagcggccgtatttaacgctaaaggaaactcaggttttgcaaaatccgctcaaggatcattcttttccatccggacatacgacagctgtattttctgttattacaccgttaatgatattctttccgatactcgcgcttttattaataccggttggcgtcagtgtggggctctccaggatttatctcggtcttcattatccatcggatgttctggcaggcacagccctcgggatttcagtcggaaccttgtcggcgatgatcttctaa

SEQ ID NO: 3074 - DNA, 1137 bp, Bacillus licheniformis
atgaaaattgcgatatttacggacacgttcacaccagatgtgaacggctgcgccagaacgctgaaaaggtatacggattatcttgaaaaaaacgggatgccctataaagtatttgcgccggaaagcacgcatgaaacacaattttcgagccgcatccgccgttttacgagcatgccgttcttcttataccccgagtgcagaatcgctcttcctaatctcatcaaaatgaaatcagaactccgcgaattccatcccgatctcattcacatcgcgactccttttaatatcggcctggcggggctcaagcttgcgaagaaatggaacatccccgtcgtaggctcttaccataccgattttgaccagtacctttcatattatgatcttcaaatgttttccaaactcttatggaaatatatgctctggtttcataaagattttcgaaaagtttttgtgccttcgcgcgaaacatttatgcagcttaaagccaaacaattcaggaacctctccatctggaagcgcggcgtggactgctcgcagttcagtccggcgcatcaaaccgaacacatccgcaggcgatacggcataaaggaaacctatatcctcagctatgtcggaaggcttgcacctgaaaaagacttggagacgctgctcaagatcgcaagtcaccccgctttgaaagatgacgtccactggctgatcgccggagacggcccgttaaaaaaagagcttgagaagcgagctcccctcaacatgacttttgccggctatgtcaaaggagaagagctggcaagcatctatgcgagctcagatttgttcgtctttccttctccgacggaaaccttcggaaattccgcccttgaagcgctcgcctgcgggacgcctgttatcggggcagactccggcggcctgaaagattttatacagaacggaagaaacggttttctttccgaacctagaaatccggaagcattcaccgcaaatatattgcgcgtcctctccaacccatcgttaaaaaaacggatggcatacgaagcgagaagctatgcccttacccagtcgtgggacgtgatctttgacaatctcctctccgaatgtgaaagcgtgcttgcagatttatcagcagaaaaaccggcataa

SEQ ID NO: 3075 - DNA, 1899 bp, Bacillus licheniformis
atgtgtggatttgtaggggtattcaatcatcgcccatcatccgagacagcagcacaggaagaactgattaaacaaatgaatgaaatgattgtacaccgcggtccggacgatgatgggtactatcatgatgagcatgtaggcttcggatttagaaggctcagcatcatcgatgtggaaaatggaggacagcctctgtcttatgaagacgactcctattggattatttttaatggagaaatctataactatatagaactgaaagacgaacttctttctaaaggatacgagttcaaaaccgattcagatacggaagttttgcttgcgacttaccgccactacaaacaggaagccgcttcaaagctgcgcggtatgtttgcttttttaatctgggataaaaaagagcagcttctatacggagcgcgcgatccgttcggcattaagccgctctattttacgaaaacggacggccacgtttattttgcgtcagaaagaaagagcctgatggctgtcgatgctgacttggaattgaatgaaaaagcgcttcagcagtatacatcgttccaattcgttccggagcctgagacgctggacaaaaaggtgcaaaaagtagagtcgggccatcagtttaccgtccgcccgggtgaggatattcaatttaaaacatactggaaagttcaattcaagccggttcagacagaagaagacaagcttgttcaggaagtaagagacgcgatctttgattctgtaaaagttcatatgcgaagcgatgtgcctgtaggttccttcctttccgggggcattgactcgtcctttatcgtgtcagtggcgaagcaattccatcccaacttaaagacgttctctgtcggctttgaacatgaaggcttcagcgaagttgacgttgcgaaagaaaccgctgataaggtcggcgtggaaaacttcagcgcgatcatttcccctgaggaatatatgaacgagcttccaaagatcgtctggcatctggatgatcctctggcagaccctgctgcgattcctttgtattttgtcgcgaaggaagcgaagaagcaagttacggttgttttgtcaggagaaggggcagatgagctgttcggcggttacaatatttaccgagagccgctttcattaaagccgtttgagcggatcccgtccccgctgaaaaagatgcttctgcgcgtagcttcagcgatgccggaaggaatgaaagggaaaagctttttaatgaggggctgtactcctcttgaagatagatatatcggcaatgcaaagatttttgaagaaggcatgaaatcaaaacttcttcgccaatatgacagcaacctgtcttactgtgacgtgacaaagccatattttgaagaaagcaggtcctacagcgaaatcaataaaatgcagtatgtcgatatccacacatggctgcgcggcgatattttgctgaaggccgacaaaatgacgatggccaattcgctggagcttcgcgttccgtttttggacaaagtcgtatttgaagcggcttccaaaattcccgaagagctgaaaacgaaaaacggcacgacaaaatatcttcttagaaaagcggcggaaggcatcgttccagaacacgtgctaaaccgcaaaaaactagggttccctgtgccaatccgccactggctgaaaaacgaaatgcatgactgggccgtgaacatcattaaagagagcgagacagatgcatatatccataaagattacgtgcttcagcttcttgaagaccactgcgccaacaaagcggataacagccgcaaaatctggacggttctcatctttatgatctggcacagcattttcgttgaaaaacgctttgtaccggaagagctgaaccatcagccaaaagaggtcattattgtttaa

SEQ ID NO: 3076 - DNA, 1203 bp, Bacillus licheniformis
atgagcaaaaaccgtcggttatttacatcagagtcagttacggagggacatccggacaaaatttgcgaccagatttcggatagtatattagacgaaattttaaagaaagatccgaatgcccgcgttgcctgtgaaacatctgtgacaaccggattggtgctggtaagcggtgaaatcacgacgtccacatacgtcgatattccgaaaacagtccgcgaaacgattaaagaaattggctacacacgtgcaaaatacggttttgatgccgaaacttgcgcggtcttaacgtctatagatgaacagtctccagacattgcaatgggagtcgaccaggcgcttgaagcgcgtgaaggagcaatgagcgacgctgaaattgaagcgatcggagccggagaccaaggtttaatgttcggttttgcctgcaacgaaacaaaggaacttatgccgctgccgatttcgcttgcccataaattgtctcgccgtttgacagaagtccgcaaagaggaaattctgccgtatctgcgtccggacggaaagacacaggtaaccgttgagtatgatgagaacaacaagccgattcgcatcgatacaatcgtcatttcgactcagcatcatcctgagatttcgcttgaacaaatccagcgcaatctgaaagagcacgtcatcaatccggtagttccaaaagagctgatcgatgaaaacacgaaatacttcattaatcctacgggccgttttgttatcggcggaccgcagggggatgccggtttaacagggcgcaaaatcatcgttgacacctatggcggctatgcccgtcacggaggcggagcgttttccggcaaggatgcgacaaaggttgacagatctgcagcttatgcagcgagatatgtagcgaaaaatatcgtcgccgcaggccttgctgattcctgtgaagtacagcttgcctacgcgatcggtgtcgctcagccggtgtccatttcaatcgatacattcggtacaggcaaagcgagtgaagaaacattgatcgaagtggttcgcaaaaactttgatctaagacctgccggcattattaaaatgctcgatcttcgccgtccgatttacaaacaaacggcagcttacggacatttcggccgcctcgatctcgatctgccttgggagcgcacagacaaagcagatcagctgaagaaagatgcattaggagaataa

SEQ ID NO: 3077 - DNA, 1584 bp, Bacillus licheniformis
atgaattctgtagatttaacaactgacttacaaacgctattaacgggcgaaaacgttcagatgaacttatccgttccccatttggttgaaaagatccttgagcgcaaagaaggagtcttgacatcttccggagccgtgcgggcaacaaccggtacatacaccggccgctcgccaaaagacaaattcattgtggaagaagcgagcacaaaggacaaaatcgattggggcgcagtaaaccagccgatttcagaagccgcctttgaccggctgtacgcaaaagtgctcggctatttaaaggaacgcgatgaattgtatgtatttgaagggtttgcaggagcagacgaaaaataccggcttccgattactgttgtcaacgagttcgcctggcacaacctgtttgcaagacagttgttcatcagacctgaagaacatgataaaaaacctgaagaacagccgtttacgattctttcagctccgcatttcaaagccgatccgctcgttgacggaaccagatctgaaacgtttatcatcgtgtcgtttgagaagcggacgatcttaatcggaggcaccgaatatgccggagagatgaaaaaatcgattttttctattatgaattttcttctgcctgaacaaaacattctaccgatgcactgttcggcaaacattggcgaggaaggcggaactgctctcttcttcggattgtcaggtacaggcaaaacgacgctttccgccgatccgaagcggaagctgatcggcgacgacgaacacggctggtccagcacaggcgttttcaacattgaaggaggctgctacgccaaatgcattaacttaagcgaagaaaaagaaccgcagatttacaatgcgatccgcttcggttccgttctcgaaaatgtcgtggttgacagcaaaaccggagagccggactattccgactcattctacacggaaaacactagagcggcttacccgattgacgcgattgacaacatcgtcaagccgagcatcgcagcgcacccgcagaccatcgtatttttgaccgcagatgctttcggcgtgcttcctccgatcagcaagttaacgaaagaacaagccatgtatcatttcctgagcggatatacaagcaagctcgccggcaccgaacgcgggatcaccactcctgaagccacattctcgacctgcttcggttcaccgttcctcccgcttccggcacatgtgtacgctgaaatgctcggaagaaaaatcgatgagcacggggtcggcgtctttctcgtcaatacaggctggaccggcggcggatacggaaccggggaaagaatgagcctcgcatatacgagagcgatggttcaggccgcaatagaaggagaactggataaagccgaaatgaggactgaccgcattttcggacttcattcacctgtccacgttccgggtgtgcctgatcaagtgcttgacccggccaaaacttggacagatgaaaacgaatacgaggaaaaagcgatccacctggcgaaagcattcaaacagaatttcaaaaagttctccaatacggaaaacatcgaaaaagccggaggaccgctcgtttaa

SEQ ID NO: 3078 - DNA, 1185 bp, Bacillus licheniformis
atgaaatttggattactgccaaggatcattacggcaattgttcttggtgttatcgtcggaagctttgctccgctttggttcgtcaaaacggcagctactttcaatgatatttttggaagcttcattaaatttgtcattccttttattattatcgcttttattattcccggcatcggacaaatcggcagcggcgccggaaaaatcctcggcattacggcaggtatcgcctacacgtcaaccatttttgcaggcctcctggcgtaccttgtcggttcaaaccttcttcccgcgatcatttccggccatcagctgcaggagtttaaaaatccggaagaagtactgcaagcaggatttttcaccattgaaatgacgccgtttatgagcgtgatgagcgcactgatttttgctttcatcatggggatcggcatcgcttatctgcccggaaaaacattaaaaaacgcgtttgatgaatttcaaacgatcgttgaaaagctgatatcatatattattattccgttactgcctgttcatattttcggtattttcaccaatatgacgttcggcggtcaggtgcagacgattctatccgtatttgcgaaagttttcgtgatgattatcgtgcttcaccttgtcatactcttgattcagtactccgttgcgggtgctgcaaacggcagaaatccgctgtcgctgttgaaaatcgtagcaccggcatacttcaccgcgctcggcacacaatcgtcagcggcaacgattcccgttacgctgagacaagtcagaaaaacgggggcaagccaaaaagtggctgacttcgccgttccgctcctggccaacattcatttgtcaggaagcacaattacactgacaagctgtgcaatgggcgtgatgattctaaacggtcaaacgccgactttttcggtcatgatgccgttcattttaatgcttggcgtcacaatggtcgcagcgcccggtgcaccaggcggtgccgtcatggccgctgccggattgttgcagtcgatgctcggctttaatgaaactagcgtatcgttgatgatcgctctttaccttgcccaggacagcttgggcacagcaacgaacgtaacaggagacggcgctctcaccatgctgattcacaggctgacttccaaaaaaggaatcggaaaagaggaaaatgtgcctgcataa

SEQ ID NO: 3079 - DNA, 243 bp, Bacillus licheniformis
gtgggaatgccagttgaatttaacacgatgattgtgacaaaaggaaaagaaacgcgggttgaggaaaatgtgtttacactcgagaaagaaggttatcgggtttaccctcttcatgtgccgcttgaagtcagaaagaccaagcggggcgacattaccggcaccgcgcaggcggagcgccttgaatggtcagacggacggactcatttaacatacaggctcgtatcattaaattccacgaattaa

SEQ ID NO: 3080 - DNA, 801 bp, Bacillus licheniformis
atgtggatagaaaaaagaaggtttccatcgccgaacaaagaggtgcgtctgttttccgtcacatacctttcacaaggactcaaggttaaggggcttttggccgaaccggccgctcccggaaattatgacgggtttttgtatttgcgcggcggaattaaaaacgtcgggatggtcagaccgggccgaatcgtccagttcgcttcacagggctttgtcgttcttgctccgttttacaggggcaatcaaggaggagaaggcgatgaggattttgcaggtaatgaccgggaagatgcttttgccgcttttcgtcttcttcagaagcacgaactggtaaaggacggacgcgttcacatttttggcttttcccgcggcggaatcatgggcatcttaacggcaatcgaaatgaaagcagcggccgcttcgtttgtgtcttggggcggtgtcagcgacatggtcatgacctatcgcgaacgaaaagatttgcggcggatgatgaagcgggtcatcggcgggacgcctgaaaaggttcccgaagcgtatgaatggaggacgccttttgacgagctggagaagattgaagcgcccgtgcttttgatccacggagcaaacgatgaaaatgtctccatcgagcatgcgcggcgtcttgagcgtgaacttctgcgaaggaacaagtctgtggatacgtggtatttcagccaatatacccactattttcctccgcgcgaaaacaggcggattgttagagaattatcccaatggatgaaaagccgtccttggacaagttatggtaaactaaagtaa

SEQ ID NO: 3081 - DNA, 993 bp, Bacillus licheniformis
ttgaaacgtttcttttttaccatattatccttcatcatgatgctgtttatcctcgcttcatgcggcggacaaaagaccgaaaagatccgtctggcggaagtgacccgttccgttttctatacgcctttatatatcgccttatctgaaggtttttttaaagaagaaggccttgatgttgaactgaaaacgacctggggcggagataaaacgatgactgcccttctgtcaaacggcgccgatattgcgcttgtcggctcggaaacgtcaatatacgtaaatgcccagggcgcaagcgatccggtgattaattttgcacagcttacccagacggacggaaccttcctcgtctccaggaacgattcggggcatttcagctgggatgatttgaaagacaaaacgttccttggccagcgcaaaggcggaatgccgcagatggcaggcgaatttgtcctcaaacagaaaggcatcgatcctaaaaaggatgtggatctgatccaaacgattgatttcgcgaatatcgcaaacagctttgcatctggtacaggtgattatgttcaattatttgaaccccaggcatccatttttgaaagagaaggcatcggccgcattgtcgcctccttcggaaaagaatcgggccgaatcccatatacaacttttatggccaaacaaagctatttaacgaaaaacaaagaagcggtcgaaaagttcacccgcgcggtttacaaagcgcagcagtgggttgagacgcactctgcaaaagaagcagccgaaagcattcaagattattttaaagataccgagctttcaatcattgcatcttcaatcgaacggtataaacaacaacagtcttttgctcttgatcctgttttggatgaaaaagaatggaaccagcttcaaaccatcatggatgaagccggcgagctgccgaagcgcacccctcatcaaaagctggtcaatacaaagatcgccgaaaaggtcacaaaaaattactag

SEQ ID NO: 3082 - DNA, 789 bp, Bacillus licheniformis
gtgtcttttctgcaagttcaggatgtcacacatacttacttttcattgaaggaaaaaacagcggcgctggaaaacgtcagcattgaagtcgaaaaaggcgaatttgtttcgtttctcggcccaagcggatgcggcaaaacaacgcttttatcgatcatcgccggcatcgtttcccccacggaaggacgcgtcttggttgaagggcgcacacctgatggaaaggatcggcacatcggttatatgctccagcaggattatttatttccctggaaaaccattgaggaaaacgtcttaatcggtttgcacatttccaaaaaactaggcccggaaacgaaggaaaccgctctcggcctgctgaaaaaattcgggctttacgaggttgaaaaaaagtatccaaaagagctctcgggcggcatgaggcaaagggcggcgcttgcccgcactctcgctgtcgaccccgatatccttctgcttgatgaacctttttcagcccttgactatcagacaaaattgaacctcgaagatttagtgttcaacacgttaaagacgtatcaaaaaacagcggtgctcgtgacccatgatatcggtgaagcgatagcgatgagcgaccggattctgctattttcaaagcagccgggcactatccataaaacatttgccgttcctgaaccgatcaggaagctgacaccgtttgaagcgaggcaggaaccggaatttcagcccctctttcagaacatatggaaggagctcaatgaccttgaacaacaaacatccgaaaccaaaagttga

SEQ ID NO: 3083 - DNA, 819 bp, Bacillus licheniformis
ttgaacaacaaacatccgaaaccaaaagttgacttccttcatgaggcttttttaaaggagcagcaggccgaaaaaaggcgggtccgcttttttcaaatcgcgattttcatcgttttcttttcgctgtgggaaaccgcaagccgtctggcatggatcgatccgctgatcttcagctctccttcagccgtctgggcgcttttcctcgaaaaaatgggagacggatcattgccgggacatatcggtgtaaccgtatttgaaaccatcctcggctttctggccggaacattgcttggaacttttctagccgccctcttatggtggttcccgaggctctccaaaatattagatccgtatcttgtcgtcttaaatgcgatgccgaaagtggcgctgggtcccattctcatcgttgcgatcggccccagcttgacgagcattattgcaatgggcgccatcatcagcgttatcattacgactatcgtcgtctatacgtcctttcaagaaattgatgaaaactatttaaaagtgatgaaaacattcggcgctacgaaacgcgagattttcaaagaagtcattttgcccgcttccattccgacgatcatatctacactgaaggtcaatgtcggcttgagctgggtcggtgtcatcgtaggagaatttttagtatcggctcaaggcctcggctatatgatcatctacggctttcaagtctttaatttcaacctcgtcatgctgagcctcctgatcatcgccgtcttcgcaacattgatgtatcaaggtgtcgagctgttggaaagaaagtggatgaaaggcagagtataa

SEQ ID NO: 3084 - DNA, 477 bp, Bacillus licheniformis
atgtacgaatttaaagatttttaccgtaatacggttcagctttcttttgagaaggaacctttttcaaaagaaccaaagcatgtatgggtgatctgccgttacgaggatcaatggctgctgacaaatcataaggacaggggccgtgaattccccggcggcaaagtcgaaccgagcgaaaacgctgaggaagcggctttgcgggaagtgaaggaagaaacgggcgctgtcgtaagaaagctgacctatctcggacaatataaagttcttggcagggagaaagtgatcgtcaaaaatatttattttgccgatatcgaaaagatagaaaaacagcagacgtactatgagacgaatggtcctgttttgctgaagagcctcccgaaggatatcgcaaaaaacaaaaattacagttttattatgaaagattccgtcctgacgatcagtcttgaaaagctgaaaaaggccggcatcatcaaataa

SEQ ID NO: 3085 - DNA, 324 bp, Bacillus licheniformis
ttggaaaaaaagacatactatgtttcggtgcaagatggaatgatttcgcagagctctgacgcttccccgtgggaatttcaaatttcggcgacagatgatgacatcatcattttaagggaatattttgatcagctgtattcagaagactgggtcaactttttcagagctcacgtgcctgcggtcgaatatcacaatgacagtgcaaatgataaaatggacgaactgcgcaaagacatttactcgatgctttaccgtctgggcaatgaagaaaccaagtcatttatcagtgaaaacggccttgccgaactcaattcagcagattaa

SEQ ID NO: 3086 - DNA, 405 bp, Bacillus licheniformis
atgtttaaggacttaagcatcttttcgctctttacaattggtttatcggccatcggatttttgtttggccgaatcgaatatttatttatgatcttaattacgctgatgggcattgaatttgtcagcaaaagcttgaacgaatgtgtggaagatcgatttacaattaagaggctgtttacaaggctggcgaaaaaattggttacgctctttctgatatccgttgcccacctttttgatcaaatgctgcaaacaggcagttcgatccgcgatttttctattatgttttatattttatatgaagcgtttcaaatcgtgagcacggctcattcgttaggaatccccgtgccgcagatgttattggacattttaaataccataaaggaaaaactccggggaaagccgtaa

SEQ ID NO: 3087 - DNA, 438 bp, Bacillus licheniformis
atgtctgaaaaattgaaagcaaccgtcaacaaacaagtcgcgaactggaccgttctatatgtgaagctacataattatcattggtatgtgaaagggaaagatttctttacgctgcatgaaaaattcgaagagctttacacagaagcggcagagcatatcgatgatttggctgaacgcctattggccatacagggctctccggtcggaacgatgaaggaatgcctggaaatgtccgcgattaaagaagcggacggaagcgagtctgctgaacaaatggtgcaaaatatttataatgactttttaacggtggctgaggagctgaaaagcggaatggagcttgccgatgaagtcaacgatgaaacgacgggagacatgctgctcgcgattcatcaatcgatcgaaaaacacaactggatgctgaaagcctacttagggtaa

SEQ ID NO: 3088 - DNA, 444 bp, Bacillus licheniformis
atgcgttttggaaaatggttcattctcttatgtttagcggtcggtctttccgcctgcagccagggggacaagcaggcggcatcggatgaggagcccaaagtgctgacggcaaaactggcgacgcctgaatcggcggccaaaaatgaaaaggctgtcataaaagcgaccgtcctctacggggaagagccggttgcagatgccgatgaggtggagtttgaatgctggaaggccgggagcaaggaagatagcgagctaatcaaagcgaagaatgagggaaaaggcgtatacagcatggaaaaagcgtttcctgaagacggccattacaaagtccaagtccatgtcacggcgaaaaaacagcatacaatgcctgttgcagacattaaagtagggaaagcgacggatgagaccgatgaagatgaaaaagaagaagcccaccatcattga

SEQ ID NO: 3089 - DNA, 474 bp, Bacillus licheniformis
atgccttcagttgaaagttttgagcttgaccataatgcggtaaaagcgccttatgtcagacactgcggcgtccacaaagtgggaacggacggcgtcgtcaacaagtttgacatccgtttttgccagccgaataaacaggcaatgaaacctgatacgattcatactttggagcaccttcttgcatttacaatccgcacatatgcggaaaaatatgaccactttgatattatcgacatttcgccgatgggctgccaaacgggctattacctggtggtaagcggtgagccgaaagtggaagaaatcgttgatttgcttgaggatacgttcaaagaagccgttgaagtgactgaaattccggcggctaacgaaaaacagtgcggccaggcaaagcttcacgatcttgaaggcgcaaagcgcatgatgcgtttttggctttcgcaaaataaagaagacctgctcaaggtgtttgggtaa

SEQ ID NO: 3090 - DNA, 228 bp, Bacillus licheniformis
atgaaaaccgtattcctgctgctcatccgcttttatcaaaaatggatatcaccggctcttccgccgacctgccgtttttatccgacatgctccaattacggtcttgaagcgatcgaaaagcacggcgcatttaaaggcggatggctcaccatcaagcggattctaaaatgccatccgtttcatcccggcggaatagatcccgttccggaaaaaaagcaaaaggattag

SEQ ID NO: 3091 - DNA, 570 bp, Bacillus licheniformis
atgaaacttttggataatattctacagttcaatcaacagtttgttgaacggcaggactatcaaaaatatcaaacaagcaagtttcccgataaaagaatggtgattctgtcttgcatggacacaaggcttgtcgagctgcttcctcatgccatgaatatgcggaacggagacgtgaagatcgttaagagcgcgggcgcactcgtggctcatcctttcggaagtattatgcggagcattctcgttgcggtatacgaactgaacgctgatgaagtatgcgtgatcggccattatgactgcggcatgagcaagctgagctgcgacagctttttggacaaagtcgtcaagcgcggcattccaaaagaacggattgaaacgcttgagtactccggcgtcgattttgaacaatggctgaaaagctttgattctgtagaggacagcgtcagggacagtgtaagcgttattcggaaccatccgctgatgccggaggaagtacctgttcacggacttgtcattgatccggaaacaggcagactggatctcattgtcaacggatatccggaagagcgctaa

SEQ ID NO: 3092 - DNA, 1182 bp, Bacillus licheniformis
atgaaggaaaacctgattccggtcactgttttaagcggttatctagggtccgggaaaacgacgctgctgcagcatgtcctgcatgaagcgcacggcttgaaaatcgccgtgatcgtcaatgatatgagcgagattaatatcgacggctccctcgtgaaaaaaggtgacctcatccgcacggatgaaaagcttgtcgaaatgcagaacggctgcatttgctgtacgctgagagacgatctgctcatcgaagtcaaaaagctggcggagaacggcggaatcgattatattctcattgaatcttccggtatcagcgagccgattcccgtcgcccaaacctttacgtacaaagatgaggagctgaatattgatttaggcaaatattgcaggcttgatacaatggtcaccgtcgtcgacggcagccgtttttttgaggacttcgcttcgggcgagagcctattggaacggaagcaggcggcagatgaaacggacagccgggaagtggccgaccttttaattgagcaaattgaatttgccgatgtcctcattttgaataaaactgatttactcaatgaagaagagcaggaaaagctgttctggtccctgagaaaactgaatccggactgcagaatcatttctgcggcattcgcaaaagtgccgctttcggccatcatgaatacgaaatcgttcgattttgaaaaagcaagtcaatcagcgggatggatcaaagagctgaatgaagagcacacacctgaaacagaggaattcggaatctcttctttcgtctatcaaaagcaaaggcctttccatcctgaaagactgaagcgctggcttgaaaactggccgccgcaaattatcagagcaaaaggcttcttctggcttgcttctcgaaatgacacagcaggccttctgtcccaggcaggctcttccctgatgatccaaagcgcgggcccctggattgcagcgtctaccgaggaagaacaaaagctcgcgtttgaagaggaccctaatttgaaagcggactgggatgaaacatacggagaccggaaaacggaaatcgtttttatcggcattgacatgaatcaggaagacattatccgctccctggatcagacccttcttacagataaagaaatgaattcagactggtcggccttacttgattcactgcctgagtatatttaa

SEQ ID NO: 3093 - DNA, 1032 bp, Bacillus licheniformis
atgaaaaaaacattcggaatagcatctgcattcattcttgctgccggattaacagcgggttgctcaagcaatggagcttccagtgaacaaaaagaaaataaagacacgctggacatctatacaaccatttatccgcttgaagacttcaccaaaaagatcggcggagaatatgtgaacgttaaaagtgtttacccgccaaacgttgaagcgcacacttacgagccaagctcaaaaacgatggcggaaatttccgactcggatgcctttatatactctggagtcggtgttgaaggattcgcagacaaagctgtaagcacacttaaaaacagcgacgtcaaaatcgtcaaagccggggagggcattgaccttctgtcacgtgaagaagaaggcgaacatgatgagcatgcacatggagaagaacacggtgagcacgatgagcatgcacatgaagaagaacatgaacacggagaagccgaaggtcacgatcatcatcacgaccatggagatcatgacccgcacgcatggcttgatcctgtccttgctgaaaaaatggccgaaaacattaaagaccaactcgtaaaattagaacctgaacacgaaaaaacgtttacgaaaaactatgagtcattaaaaaaagacttggagcagcttgacaaagacttcaaacaaacagtcgacaaagctgataaaaaagaaattctcgtctcacatgccgcctacggctactgggaaaaacgctacggcattaagcagataagcgttctcggcctttcgcctactgaggaaccttcacaaaagcagcttgaaaacattgttaaaacagcgaaagaacataatattaaatatatcatttttgaaagcaatgtcagcagcaaaatctccgagatcatcaaaaaagaaatcggagcggaaagtctgacgatgaaaaaccttgaatctgtaacaaaagaagacattgaaagcggcaaagattataccgccatcatgaaagaaaacctggacgtcttgaaaaaagctttatcaagcaaataa

SEQ ID NO: 3094 - DNA, 246 bp, Bacillus licheniformis
atgaaaccaaatattcatccgaaaacttatcaagtgatctttcaggatgtaaacagcgggtaccgttttttaagccgctcaactaaaacttccgatgagacggccgagtgggaagacggcaagacgtatcccgttataaaagttgaggtgagctctgatacccatccgttttataccggaagacagaaattcaatgaaagaggcggaagggtcgaacagttcaagaaaagatttaatatggattaa

SEQ ID NO: 3095 - DNA, 1326 bp, Bacillus licheniformis
atgaatgacttgatttttgcaagaagccttttcggaacaacgatgggattccatattatttttgcctcgctcggtgtcggaattcctttgatgattttgctggccgagctgatctatcaaagaacgaaagatccccactacgccattatggccaaaagatggacgaaggcgcaggccgtgttgctcggggtcgccataccgaccggaaccattgccggcacgcagctagccctgctctggccgggattcatggaagtgatcggaaaagtcatgtcccttccatttcaaattgaaatctacgccttttttattgaggctttatttatgtccatttatgtttacgcagccgatcggctgactccacttatgagaattacagccgtcatttttatcgttatcggagcagccgcatcggccatcttgattacaaatgtgcacgcttttcagggaacgccagaaggcttcaaaattgtaaacggtgaaattacggatgttcagccgtggacggcgttcttcaacaaaagctttgtggccacagcaggacatgttgtcgtctccgcttttatgacaggtgcgtttattattgcgacgatagccgcctacaaaatgctccgaaaccgcggcgatgatagagtctacgcccttcataggaaagcgctgctgctcgggctgattgtcggaggagcgttttctctggtcacggctctgagcgggcacgaatccgcacagctacttcaccgctaccagcctgaaaaactggcgggcgcagaagggctgtttgaaacccagtcccatgctcctcttgcgatcggcggatttactgatgaaaagacgcaatcggtgaaatgggcgattgagattccgtgggctttaagctttttggccgacaaccgctttgacaccgtcgtaaaagggctgaatgactttccaagggatgagtggcctcccctgttcattcataccttatttaacggcatggtttttatcggcagccttttgattgtttatgccgctgtgggttttatttggagaaaagtcatgaaaaaagaccgctttccccgctggatgctggccgtgttcataaccggcggcccgctcgcattgctcgcaatcgaacttggctgggtattcgcttgcaccggaaggcagccttgggtcatttaccatatgcagaaaacgtcggaagtagtgaccacctccggctcgatcggcatattgtttcttttgttctttatcgtctatatcattttaggagcagcggtggtgttcgtattgcaatattactttaaacgccatcctgttgaagaggacttaaaaagcagctga

SEQ ID NO: 3096 - DNA, 1050 bp, Bacillus licheniformis
atgcaactggatggaacaacagatgccctgctggctatttcgatcgtctggggatttatatttatatacgccgttatggcgtcgatggattttggagcgggattttggtcgatgatttatatgaacaaaaaacagctgaaagcaaccaatattgcaaaccgctatctttctccgacctgggaagtaaccaatgttttcatcgtcggaatcgtcgtagcccttttcagctttttcccgggcggcacttttgtgctggggactgtgcttttgattcccggcagcatcattttattgcttttggcgattcgaagcggatttttggtcttctcccacgctgcaaaagattatgaaagggcgctgacttacgtttcagggatcagcggctttatcattccggctgttttaatccttgtcttgcctgtgacacacggcaatttcgtataccaggtagacggaagccaccaattggactttgtcaatttgtttttaagccctcatgcctattcttttatgggcttcgccattttcagtacgctgtttctgtcttcactgctgctggctgatttttcaaatgtagccggagaaaaagacgcgtatcaggtctaccgccgaaacgctttaattaccgggccgctcgcactgctcatgtcgttcagcatcatgatgaccatgaggacggaagccagctggctttatacaaaaatgatggacgggcttccatggctgattttatcgtttttgctgtttctcgtcgcatttgcggctctgtttctgccaaacagacataacagcgaccggctgggaaagccgcgcctggctgtcatcgccattacgctgcagtattttacggcgagctatgtgtacgggagggcgcaccttccttacatggtctatcctgatgtcacgattcaatcgggcttcaccgcaccggagacattcagggcgctgttcatctcctacatcgtcggttttattattttattccccggcttttattatttctggaaattgttcatgaaggacaagcggtacatcaaacagcatgaataa

SEQ ID NO: 3097 - DNA, 162 bp, Bacillus licheniformis
atggagcaaaaaatactgtgtgaagtcagcaactgcacctattgggaagagggtaacaaatgcacagccgacgccatctatgtcgtcagccatgctgaaggtgaaaaagcttctaatagtgaagaaacggattgcaaaacctttaaacctgaacatcattaa

SEQ ID NO: 3098 - DNA, 192 bp, Bacillus licheniformis
gtgaataaagagtcgctgttacaggctttttatcaggaaatccacggggcggatgaaaccgcatttcaaaaagccgcccgctccttcatgaacttatgggattatgaatacggctgtctcgacgggctgccggatcaagcggaccgggtgatcggacagatcgtgcacgaagatttgcttttgggcgattaa

SEQ ID NO: 3099 - DNA, 1110 bp, Bacillus licheniformis
atgattcaaatcaaacagctgacattgtaccatctcagcatgcggctgaaaaagccttttaaatcaagcttggaaacctttcaggatcgcaagtttatcatcgttgaagctgctgatcaagaaggtgtgacaggctggggggaagtatccgctttttcatctccgtggtacaccgaagaaacaacggagacatgctaccacatgctcaaagattttttgattccggctgtgctgcgcgaatcattcacacacccttccgaagtgcccgaggcgcttcgcggattcaaaggcaaccgaatggcaaaggccggccttgaagccgccttttgggacatttacgccaggaaaaaagggatctctttaagagaggcgctgggcggagtaaaaacagaagttcctgccggagtcgtcgtcggtcttgccccattggatgatatgcttcaggaaattgaacaatatgtaaaagaaggatatcaaagaataaaaatcaaaattcagcccgggcaggatatagagcttttaaaagaaatacgccggcattttccgaaggtgccgctgatggcagatgccaactcttcttatgaattaaaagacatcagccggattaaagagcttgacgcatttaaattaatgatgatcgaacagccgctggctgatgatgatatcgttgaccaccgccatctgcaaaaacatatcaaaacatcaatttgtcttgacgaaagcatccgttcggctgctgatgcgcgaaaggcaattgagctcggcagctgcaaaattatcaatataaagccgtcccgagtcggcggtttgacagaagctctgaaaatccacgacatctgcaaagaacatcaaatgcctgtctggtgcggcggcatgtttgaaaccggcatttcaagagcccataatcttgcactgagttctcttccgcagtttttgattcccggggatctttcttcatcctcaaggtattgggaagaggatatcgtaaaaccggaaatccggatcgagggcggctatattcaggttccaaccttaccgggaatgggatttgaagtcgatactcatattttaagaaagaattcatctaaaatagacgtttttaagcagtaa

SEQ ID NO: 3100 - DNA, 1437 bp, Bacillus licheniformis
atgctgatggaccatccgaattggcttaaacagcgagcagaactgacacctgacaggatggctgtgattcagggagatcacaagctgacttttattcaattatttcatgaagcaaaaaaaacggccggccggctgaagagctttggtctgaagaatggggatacagcggctttacttctcacaaaccggatggagatggtcatcgccgtccatgcctgctttcttctcggcgttcgcatcgttttgctgaatacgaagctgtcaatggccgaacgatcatatcaaattgaacattctgaagcaaagctattgcttacagagaagcctttcatagaagagcatagagggggacagccggctcgcgctgttgacattgaagacgttcaaaacgccgcttgcccgccggttacagaaatcgaaagcattcatttggacgatgcggcaacaatcatgtatacgtctggaacgaccggacggccgaaaggggttatgcagacatttgcaaaccattatttcagcgcggtttcatccgccttgaatttggggctccaagaacacgaccgctggctgatcgccttgccgcttttccatatcagcggcttatcggcgctttttaaatcggtcatttacggaatgactgtcgttttgcatcaaaggtttgacgcggaagaagttcttcgttcgatcaaagaccagcaagtaacgattgcatcggtcgttcagacgatgctgtcgaggcttgcggcaaaagtcgacagatgccccggatcattaaggtgcctgttattgggcggagggccagcaccgctttctctccttgaggaatgcaaaagaaagcggctgcccgtcgtacagtcgtacggaatgactgaaacgtgctcacagattgcgaccctcgccccggaatactcgattgaaaagctcggttcagccggcaaaccgctgtttgcatcaagcatcaaaatcgaaaagaacggaacggaatgccaacccggagaacatggtgaaataaccgtaaaagggccgaccgttatgaagggctacttgaaaaatgaggcggcaaataaagactcattcaatgacggctggtttaaaaccggtgatatcgggtattttgacgatgacggatttttatatgtgctggacaggcgttcagacttaatcatatcaggaggagaaaacatctatccggctgaagtcgaggccgttcttctgtcacaccccaatgtcgcggaagcgggggtgaaaggagtcgatgacaaaacttggggaaaggttccccacgcctatctcgtcgccgacagccccgttgatgaagaggagctgagcgaattttgcaaagaacggcttgcttcatataaagtgcctaaagcatttcattttgtcgataggctgccgagaaatgcttcaaataaactgatgagacataaattgtag

SEQ ID NO: 3101 - DNA, 819 bp, Bacillus licheniformis
atgactgtagaatggaaaagcgaacgtcaatacgaagatgtattatatgaaacatataacggcatcgccaaaatcacgatcaatcgccctgaggtacataacgcatttcgtccaaaaacggtttcagaactgatcgatgcgtttgcatatgcgcgggatgatgccaatatcggtgtcattatccttgcaggtgccggggataaagcgttctgttcaggaggagaccagaaagtaaggggacacggaggctatgtcggtgaagacgagattccgcgtttgaatgtgcttgatcttcagcggctgatccgcgtcattccgaagcctgttgtagcgatggtgtcaggctatgcgatcggcggcggccatgtgctccacgtcgtatgcgatttgacgattgctgcggacaacgcgattttcggacaaacagggccgaaagtcggcagctttgatgcgggctacggatcaggctatctggcgcgtatcgtcggacataaaaaagcgcgcgaaatctggtatctgtgccgtcagtacaacgctcaggaagcaaaagaaatgggccttgtcaatacggttgtaccgcttgaaaagcttgaagaagaaacgattaaatggtgtgaagaaatgcttgagaaaagcccgacagcactcagattccttaaagcggcctttaacgccgatacggacgggcttgccggcatccagcagtttgccggagatgcgacactgctttattacacaacagatgaagcgaaagaaggccgcgatgcgtttaaagaaaaacgccgtccagacttcggacagttcccgcgttttccttaa

SEQ ID NO: 3102 - DNA, 813 bp, Bacillus licheniformis
ttgaaattgacactgaaagacggcgtttcctataaaattgaagacaatggcctgtctgcagaaaaaacggcggtgtttttgcatggctttacaggaagcgcggccacatgggacgggatagacggctattttcaggggatgcgtctgatcaagctgaatctgctcggacacggcggaaccgactcgccatcggacagccggcgctacacaacagagaagcaggcagcggatctcatcgaaatttttgatcgtttaaatgtaaaacaggcttacctcatcggttattcaatgggcggccggcttgccttatccttggcgatgattcaccccgagcgtgtgtccggtcttgtgctggagagcagttctccggggcttgattcgcctgaagaaagaaaagcgcgcagggagcaggacagccggctcagcaggcggatacttgaagaaggaatcaagtctttcgtagattattgggaaggcattccgctgtttgcatcccagctttcaatggacccttcaaaaagaaaaaaagtgcgcgaagaacgtctgaacaacaatccgatcggccttcgaggcagcttaatcggaatggggaccggatcacagccgtcttggtggaacaaactgagcgggatcaattatccggtgcttctcatcgcgggaagcctggatcagaaatttgtcgccatcaatgaaagcatggcaaagcggattccagccgcccgcctcgagattgttgaacataccggtcatgcggttcatgtggaagagcccgatttttttggtagaatagtaagtgagtttattttaaagtag

SEQ ID NO: 3103 - DNA, 1743 bp, Bacillus licheniformis
ttgactgaaaatccgattacaaaatatatagggaattttattgatgagctttcccttgcaggcgtgacagaagcggtcatctgcccgggatcaagatcgacgccccttgcgattttggccgcgagtcatccggacatcaatgttcatatccatgtggatgaaagatccgctgctttttttgcaatgggcatggcaaaggcaatgcggaagccagtcgcattgatctgtacatccgggacggctgcagcgaatttctacccggctgtgatcgaggctcattattctagaataccgcttatgatcttaacggctgatcggccgcatgaactgagagaagtaggagcacctcaggcgattgatcagcaattcttattcggaaactttgttaagtttttcacagactcggctttgcctgacagtcatcctgacatgctggcgtacatccggtctttggcagcacgtgcagccggagaagccaaaaaagcgccgcgcgggcccgtgcatatcaactttccgctgagagagccgctcatgccgaaccttgaggatgaaccttttcaaaggctgagaagcggcagtcatgtgacggttgaaagcggccgcttccgtgctgatcggcatgagcttgtagcgctgagtgctctgattaaagagaccgaaaaaggcgtaatcgtctgcggagagctgcaagatgatgatgcaaaagaacatattgtagctctttcacaggcagcagaatacccaattttggctgacccgctctcaaacttgagaaacggcacccattcaaaagaaaccattatcgatgcatacgactcattattgaaagaagaacagctgaaacgcgagctcatgcctgagcttgtcatccgcttcggtgcgatgccggtttccaagccgctttttcagctgctgaagcaaaatccgagcattaggcaaatcgtcgttgatccagatggaggatggcgcgatccgactcagctcagcgcacatatgctgcattgcacggaagaggagattgctgttcttgcggattccgctgtcaattcagaaaataggacaggcaactggcttgagaagtggcggtttgccaacagccgcttccgcgctcttttaagaaatcttgaagctgaggatcttacctttgaaggaaatatctaccggaaccttcagcatttgattccggacaacagctccgtgtttgtcggaaacagcatgccgatccgcgatgcggacacattttttgaaaatcaggaacggaccttccggatttttgccaatagaggggcgaacgggatagacggtgttgtctcaacggcgctgggcatatatgccgcaacgaaagaaccggtaacccttgtcatcggcgatctgtcattttatcacgacttaaacggcctcctcgtcagcaaaacgctcgatattccgctgactgtcgttctcgtcaacaatgatggcggcggcattttctcatttcttccccaatctgctgaagaaaggtacttcgagctcttgttcggaacgccgacgggtctcgaattcgagcatgctgccaagctgtatgggggacgctatatatgccctgaatcatccgcacattttgccgatgcgtatttatcctccgtcaaccgccgcggcttggatatcattgaggtgaaaacgaagcgcgatgatcgtgtggagcagcatcgccggatgcttgattccgcgctgcatgaaataagaaaagagtggccgttttga

SEQ ID NO: 3104 - DNA, 1425 bp, Bacillus licheniformis
atggtgacaacagtgcagcgcactttcctcaaggaagcgcctgaagcattaaacatcgtcaaaaaagtcaaccatgctgttttaataagctattccagaaaaattgagagcatagatgctctttcctttttcataaacgggaaagaacaatttgccggggaacggttcttctggtctgatccggacggcgggctgacgcttgtcgggctgggaaaggaaatatcggtttccacagatctgaaggatgccggacgttatcaggctgtacatgaaaaatgggagcgcttaaaagagaaaacctatcactttcatgaagatcaaagcagaggtcaggcagcggtggggccattgctgtttggcggtttttcatttgatccgctggaagatcgcaagcagcattggaacggctaccaggaaggcgctttttttattcccgccgctatgctgacacaggacggagaggaaacattcataacggtcaatagatggaagactcctgaagaagacgtgcgcaaagtacttgaagaaataaagggcgctgcttcacagctgaccaaggcggacgattcccgttatccggaaaaaggtcatacgcaatataccgccaaggaagagcttgatgttcctgaatggcttgaagcggtccggcgggcgacagacgacattaaaaacgggaagtacgataaagtcgtgctcgccagagagatccttttaacgttcgatcagcctgtcgaacttcacagagtattattcaatctgatgtctgaacaaaaaacgagctatatattcgccattgaagaaaacggcaaaagttttgtgggcgcgtctccggaacgtcttgtcaaaaaagacggagagaacgttctgtcgacctgcctcgccggttcaatcaagagaggcgaaagtgagcaggaagaccggatgctcggtcttgagctgttaaacgatgaaaaaaatctaatcgaacatgacattgtcgtcaatatgattcatcaggcgcttttgtcaaattgcagcaatatcaaaaagccggccaagccgggactttacaaaacaaaaaatgtgcagcatttgtatacgccgattgtcggcaaaatgaatgcggagtcctcgatttttgatttaatcgagaagcttcacccaactcctgcgctcggaggagcaccacagcaaaaagcgattgaggttatcagggagttggaaccgatgtcaaggggctggtatgcggcaccggcgggctggatcgacatgtccggcaatggggaattcgcggtggcgatcaggtcgggacttatcgattcaaatgcggccagaattttcgccggctgcggggttgtggctgattccgatcctcttatggaatacgaagaaacacaaattaagatgaagccgatgctgtctgctcttggaggcgatatccgttga

SEQ ID NO: 3105 - DNA, 933 bp, Bacillus licheniformis
atgcagcatcaatcactttcagggagtgtttctgaaataaagccggaaaaatggcgcgtatggtggatgttaacaagaccccatacactgacagccgcctttgtccctgtaacgctcgggaccgtgatgtcccttgaatcggggaaaattgacatctggctgtttttagctatgctggccgcatcaatattgattcaaatcggaacgaacttattcaatgagtattttgattttgtaagaggacttgataatgaaaactcggtcggcatcggaggcgctatcgtccgctatggaatgaaaccgaagacggttttatacctggcatacggactgtttggagcagccgttttactcggcgtgtacatctgcgcttcttcaagctggtggcttgcgctgatcggattggtttgcatggccgtcggctatctttatacgggcgggccgtttccgatctcctatacgccgtttggtgaaattatgtcaggcgtttttatgggaatggtcatcatcctgatttcatactatattcaaaccggcgggctgacttggaacgtctttctgatctcccttccgattacgattttagtcggaggcatcaatctttccaacaatatccgcgatttggtcggagataaagaaaacggaaggaagacgcttccgattttggccggaagaaaaaacgccgtgcagattttaagctgggtttttgctgtttcctatatattgatcggtatatacatcggctttgagatcgtttctctgtggagctgcctcgttcttttaagcctgcctaaaccgattaaagccatccaggagttcaaggcaaaagaaaagccggcagaactgatggtcgccatgaaatcgactgcgcagacgaacacctttttcggccttctgctcgccatcgccctgcttattcagtacgttttttaa

SEQ ID NO: 3106 - DNA, 756 bp, Bacillus licheniformis
gtgctaacaaaagaacagttgacaaaactcgaaaatgaactgaaagccggaaaagaacagatcatcagccgctttaaagaaaacggacattttggcatcgatgcgacgcacccgttcaactcgacgggcgatctttcggcttatgacaatcatccaggagatgaaggtacagaactgtacgaacgcgaaaaagaccttgccctttttgaacatgaaagagagcatttacacgatatcgaacatgctttagccatgatcgaaaaaggaacatacggccgctgtgaagtatgcggaaaggacatcccgtatgaaaggctgtccgtacttccaaccgcaacgacgtgcagtgaacattcgtcaaccgtctccgtttcaaaagatcggccgattgaggaagaagtgctgaacccgccgtttggacattttgaacaagacgaggacgatgaaaatgtcgcatacgattcagaggacgcttaccaggatgtcgaacgctacggcaattcggaaacgcctcaagatctggccgttccgcctctgtcatacagccagatgtacatggagtatgaagagccgctcggatatgtggaagattacgaaaactatgccgcaacagacattaccggaaaagatgttaccgtctatccgacgaaagaacacgaaaaatatgaagacctgcttgatgaagaaggcatcatgacctctttcggcgatctcccggcttatgaaaaggatccttatactgaagacgacgactaa

SEQ ID NO: 3107 - DNA, 2400 bp, Bacillus licheniformis
atgttctcaagtaaagaaagctttaaacaatgctttttgaaacgtgttgaacggttgtgcggaaaaagctttcgggactcttcaacgcttgaccagtatcagacgctcggcatcatggtcagggaacatatcagcgcaaactggatcgagaccaatgaaaggagccgctccaaccaaaataaacagacctattacttatcgattgagtttctcctgggcagactgctcggccaaaacctcctcaatctcggggttcgtgagattgtcaaagaaggtcttaccgagcttggcatttgtcttgaagacatcgaagaggccgaaatggatgcaggccttggcaacgggggattgggcaggctcgcggcgtgctttttggattcactggcttcgctcgaccttcccgggcatggaatggggattcgctacaagcatgggtttttcgaacaaaaaatcgtcgacggtcatcaagtcgaattgcctgaacaatggctcaaacatggttacgtatgggagatccgcaacgccgatcaggctgtttgtgttcgtttcggcgggcgggtcaagatggcgcaggaaggagggcgcctccgcttttggcaggaagatgcggaagtgatgacagccgtgcctcacgacatcccaatcatcggctatgagaccaagacggtcaacacccttcggctgtggaatgcggagccttgctcgctccatcatgaaccgaatattttgaagtataagcgcgagacagaagctgtatctgaatgcctgtatccggatgacacgcatgacgaaggcaagattctccgtttgaagcagcagtattttttagtatcggcaagcctgcaaagcattgtgaaacgctataagaacactcacccgtcactgcatgattttcaccaaaaagtcgcgatccatatcaatgacacccatcccgctttggcggtgccggaattgatgagaattttgcttgacgaagaaaaaatgacgtgggatgaagcgtggcatgttaccgtacatacgatctcatatacgaatcatacgacgcttgccgaagcgctggaaaaatggaggatcgatttaattaaaccgcttctgccgagaatttatatgatcattgaggagatcaatgagcggttttgcggctggctgtgggaaaaatacccgggtgaatgggaaaggatcgaaaagcttgccgtcatcgcccacggcgaagtgaaaatggcccacttggcgattgtcggcagctacagtgttaacggtgtcgccaacattcattcgaccatattaaaagagcgggaaatgaacgacttttattccgttttcccttttaaattcaataataaaacgaacggcatctcacatagaaggtggctgttaaaggcaaatccgccgcttgcgaacttgataactgaagcgataggagacaggtggctgaaagatccggaaagccttctggatcttcgtccatttgcgaacgattccgcgtttctcgagtcgtttcagcgcattaaaagggaacgaaagcagcttttggcagacatgatgaaaggcagcgtcggcttcgccgtcaaccctgacagcatcttcgatgttcaagtcaagcgtctccacgcttataagcgccagcttttaaatgtgctccatatcatgtatttgtacaacaggctgaaggaagacaaaggctttgccatttatccgcaaacctttattttcggagcgaaggcatcgccgacttatcattatgccaaaaaggtcatcaagctgatccattcagtcgcagataaaatcaatcatgatccggatgtcagacattcgatcaatgtgatctttctggaaaattaccgggtatcaaccgccgagcgtatttttccggcgtcagatgtcagcgagcaaatatctgcggccagcaaagaagcctccggaacagggaacatgaagttcatgattaatggggctttgacgatcggcacgcatgacggcgccaatattgaaatgcttgagagggtggggacagagtgtatctacacgttcggtttaaaggcggatgaagtgctggactacgcggaaaaaggcggctatctgtcaagggaatactatcagcatgatgcaaggatcagacaaacggccgatcagctgatcaatggttttttcgaaggagaagccggcgaatttgagccgatttatgactcgctgatcgcttataatgatgaatactttgttttaaaagattttgcttcttatattgtagcgcaggagcggattcaaaaagactacttgaataagcgtctttgggctgaaaaagccgtcacaaacatcgcgcatgccggatatttttcaagcgaccgcaccatccgggagtatgcggacgacatttgggaaattaagccgtaccagcattga

SEQ ID NO: 3108 - DNA, 1455 bp, Bacillus licheniformis
ttgaaagtcttatttgctgtttctgaatgtgtgccgtttgttaaatcaggcgggctcgccgatgtcgccggggcgctcccgaaagagctcgcccttttaggcatagaaacggtcgtcatgatgccgaaatacagtttgattgcggaagacgtcagaagacggatggttaaaacggctgaatgcgaggttcgcgtcgggtggcgcaggcagttttgcggcattgaacaccttgaacatgacggagtttcctattattttcttgatcatgggtattattttaatcgggattccctttacggccattatgatgatggagagcggtttgcttttttctcgcgggctgttttggaagcactatacgcgctgaattttgaagctgatgtcatccatacccacgattggcacacagggatggtcaattatttattaaaagaagaatatcgaaaaaagccgttctatcagcacatgaaaagcgtatttacaattcataaccttcaatttcagggcattttcccgaaggaagcggttcatgacctgctcggacttgatatttcccatttcacgaccgaaaagctcgagttttatgggaacattaattatatgaaaggcggcattatcgccgctgatcaggtgacaacggtcagtccgacgtaccgcgatgaaatcttgactccatactacggcgagcggcttgaaggggtgctgtcagacaagaaggatgcactgacaggcattttaaacgggattgacgatgtgctgtacgaccctttaaacgatccgcacatcgattatcattacgatgccgtcaaccgggacggaaaacggaaaaataaagccgtgatccagaagacattcggtctgccggtgaatgaagacattccgctcatcagcatggtggcaaggctgacgaagcaaaaaggcttcgatttgatcaagcgggtattgcatgaactgtttgaagaagaagacatgcagctgatcgttttaggaaccggagaagcggaatttgaaaattacttccgctatatggagcatgcttttccggacaggtgcaaggcgtatatcggttttcatgaaccgctcagccgcaagatttatgccgcgagcgatcttttcctgatgccttcaaaattcgagccgtgcggtcttggacagctgattgccctcaggtacggcgcggtgccggttgtcagggaaacaggcgggcttcatgatacggtgaccgcttaccgggaaacaaccggtgaaggcaacggttttacgttcgcccattttaacgcccatgatatgaagcatacgatcaaaagagcactgtcattttatcacaggaaagaagagtggggcaggatcgttcaaaaagcgatgacacatgatgtcagctgggctttgtcagcccgtcagtatcagcggttatacagccgggagataaagggggaagcgcatgttctcaagtaa

SEQ ID NO: 3109 - DNA, 1029 bp, Bacillus licheniformis
atgaataatcaaatgttgggaattattgatgcagctgtaaaccagcactctcttcaggacttaacggccggccgctcgatcggagccgttccgtttgcaggaaggtaccggctgatcgattttgcgttgtcaggcatggttcatgcaggcattcggagtgtcgctgtattctccaagtccccgtaccgctccttgatggaccatttaggatcgggaaaagagtgggatttaaacaggaaaagggagggccttttctttcttccatcttcacttccccatgatgagcatgttgggcttggatcgtttcggcaatttgcggagcatctcgattattttcaaagaagcactcaacaatatgctgttgtggcaaatagctatacggtcggtcacattccttttcaagaagtgctcaaacaacaccttgaatccgggtgtgatctgactgaaatttgtcacgaaggaaagcctttaggaatgtatgtcactaagaagagtctgttgtgggagatggttgaagggcattgccctgaaggagcccaatcttttgaagaagtctgccggaaagagcgcggctctctatccgtcaacagctatgagcactcgggatataccgccgtgatcgattcccccgaaagctacctttttcatagtttgaaccttattcagcctgtgttttgggagcaagtctttcatatgggccagcctgtctacacaaaaataaaaaacgatcctcctgtaaaatacgctaaaaacagcagggtaaagcaatcgattatcgctaatgggtgcgtaatcgaaggtgaggttgagaattcggtcttgttcagaggggttcacgtaggaaaaggaacaaccatcaaaaacagcgttgtcatgcaaaaaacaaggatcggagaaaactgccggcttgagcacgtcatctgcgacaaggacgtcaaaatcggccatcatatcgaaatgtccggcaccatgagcctccctttcatattaaaaaaaggagccatacaaggagcgctgatgaactcttga

SEQ ID NO: 3110 - DNA, 1140 bp, Bacillus licheniformis
atgaaagaacaatgtgtggctatgcttttggcaggcggcaagggaagcaggctgaatgccttaaccaaaaacctcgcaaaacccgccgttccatttggcggcaagtacagaatcatcgattttgccctcagcaactgcgccaactcgggaattcatcatgtcggtgtgctgactcaataccagcctcttttattaaactcatatatcggaatcggcgagccatgggatcttgaccgcaatgacggaggggtctccattttatccccttatgctgaagcgtcggaagtgaagtggtacaaagggacggctagcgcgatttatgaaaaccgccattttttaaaggagcttcagcctgaacatgtactcatcctatcaggagatcatatctacaaaatggactacggaaaaatgctcgaataccacgcggagaaacaagctgacgccaccatcgcagtcattgaagtcagctgggcagaagccggccgtttcggcatccttcatacgaatgacaagatggagattacaagcttcgaggaaaagccgaaatatccaaagagcaatttggcatcaatgggtgtctacgtttttaaatggagcgtgcttgaagatgcgttggaacgcgatgaaaaaaattccgcgtcaagccacgatttcggaaaagatgtcattccggctcttctcgaagaaaataagaggctgaacgcttatccgtttaaaggatactggaaggatgtcggtacggtcagaagtttatgggaagccaatatggatctgcttggagatcatcctccgcttgacctgttcgaacggaactggcggatttattcagtctccccgaatctcccgccgcagtttgttgccgatctggcggaaatcaaagaatcgctcgtcagcgaaggatgcaccgtgtatgggtcggtcacccgttcggttatatttcagcgcgttgccatcggcagacattccgccatcaaacgttcagtcgtgatgcatgacgtttcaattggagagtatgttgagatcgaaaatgccattgtatcggcaggaattcgaattccggacggtttttgcgcgaagccggaagatggcgaagtcctgctgatcacagaggagtatgtcaaaaaacataaggttgtttaa

SEQ ID NO: 3111 - DNA, 1884 bp, Bacillus licheniformis
atggctggtgtgagtgcctcggatattaaagcgcatctctttcatgaaggtcggctttatgaaagctacaggttcttcggcgctcatcagacggaacaggacggccgccaaggcttccgtttctgtgtttgggccccgcatgcgaaggaggttcgaatcgccggaacgtttaacggctggtccggtgtcctgcaccgaatggaaaagcgtcatcaggaaggcatatgggaactgtttatccccggtattggagaaggggagctgtataaatatgaaatgattacagccgcaaatgaaacgaaattgaaggctgatccttatgcttttttttctgaagtgaggccgaaaacggcatcggtcacttatcaattggccggataccaatggggcgaccggaagtggcaaaagaaaaagcagcaaaaagccgtgtatgaaaaaccgatttccatctacgagcttcatatcggttcgtggaaaaagaaagcggatggacgttttttcacataccgggaactgagcgaaacggtcattccttacgtcaaagaacacggattcacacatatcgagctgatgccgctgacagagcacccgtttgaccgttcatggggctaccagacaacagggtactacagtccgacgagcagatatggcgaaccgcatgacttgatgtatttcatcgaccagtgccatcagcatgagatcggcgtcattatggattgggtttccggccatttttgcaaagatgaccacggcttgtatttgtttgacggtatgcctctgtatgaatataaacacgagcatgacagggaaaattgggaatgggggaccgccaattttgacctcggaaaacgagaagttcacagttttttaatctcgaatgcgttgtattggatcgagatgtatcatatagatggatttcgagtcgatgcggttgcgaacctcctgtattggccaaaccgtcctcagcctgaagcgaacggctttgcgatcgaatttattcaaacgttaaatgaacaggtttttgcaaaagatccccactttttgatgattgcagaggactccacagactggccgcttgtgacgcatccgacctatgaaggcggtctcgggtttaattataagtggaatatgggttggatgaacgatgtattaacctatatggaagcttccccagaacaaagaaaacacctgcatcatcttgtttcattctccttaatgtatgcctactcagaaaattacatcctgccgttctcccacgatgaagtggtgtaccgcaaaaagtctctgcttcataagatgcccggcgattattggcagaaattcgcccagtaccgcctgctgatcagttattttatgatgcacccgggaaaaaagcttctttttatgggcggtgagtttgctcaatttgatgaatggaaagacgaagaagagctcgattggtttttggacgattttgacatgcaccgcaaagcccgaatgtttacaaaggaggctctacacctctacaaaaaaagccgtatcctgtatgaaaatgatcatcggcagcaaggattcgagtggattgacgttaacaatgcggaacagtcgattgtatcgtttatccgctatggaaaacagcccggtgaagcgctgattatcgtctgcaatttcacgccttccgtctatcacgaatatcgggtcggcgtcccttttcaaaccgaatatatcgaagtgcttaacagcgatgatgcaaaatacggaggttcacaccaaatcaacccaaaacgccttcaggcaagaaaaggcgttctgcacggcaaaccatacagcatcagcatgacagtccctccgctgggagctgcggttttcagagcagtcaaaaagagaggagcgaaaaagggatga

SEQ ID NO: 3112 - DNA, 1173 bp, Bacillus licheniformis
atgagtgaactcacaaaatacagcatggtgaaaaatgaaattaaatcgtggatatatgaaggcaaagtgaagccgggcgaaaaaatccattcggaaaacgaattgatgaaaatatttgatgtgagcaggcatacgatccggcaagcaattggcgaccttgttcatgaagggcttttatacagagagcaaggctcagggacgtattgctctcaccgcctgcagctttctgaaaaaggaagggaaagaaataagatgattggggtcattacgacttacctttcggattacatttttccttctattataagaggaatcgaatcttcattgtcgagtgcaggttacaccttggtcgtcgcgagcacgaataatgacattgaaaaagaaaaacaatgtcttgtaaatatgcttgacaaaaaaattgatgggttgattgtggagccgacgaaaaccggcagctttaatccgaatttaaattactatctgacccttgaacagcaccatataccatatttgatgatcaaccaattatatcaggagttaaacccgcctcatttcattttggatgatgagcacggcggttttatcgccacggagcatttgattaagctaggccatgaaaaagtgttcggtttttttaaacaggacgatatgcagggcgtcaaccggatgaaaggatttatccgggctttcagggaaaacggcttgtcgttttatccggagatggtcgtgacttacacaacagagaacaaaaaagaaaaaacgattgctgaggcaaggaagcggctttcctcagcagaccgcccgactgccatattctgctataatgatgagatagcacttatagtgttggatgtcgtaagggaattcggtttgaaagtaccggacgacatatcaattgtcggatatgacgactcacacttgagcgaggcgtctgaagtgaagctgacatcagtcacccatccgaaaatgcagatggggattgaggcggcaaaatggatgattgccaaagttgagggacggaacacggataagcttgagcattctaccgtctataaacctgaacttgttgtcagacattcgaccgccaagccgaaaagtaggctgatcagctttacccatacaagcgattcgagtattcggctgctttcgttgccaacagcacgacagaagtga

SEQ ID NO: 3113 - DNA, 585 bp, Bacillus licheniformis
atgaatcaatctaaacaacttgtacagctgattgaaattgcgattatgacaggaatagcacttatacttgatatggtgtccggaatgtttttaaaaatgcctcaaggcggttcaatcgccgtcatgatgattccgatcttcctgatctcctttagatgggggctcaaggcagggctggcgaccgggtttttagccggattgcttcaatttgtcactggaggattttacgttgttcatcctctgcagcttcttcttgattactttatcgcgcctacggccgcgggaatcggcggcttttttgccggatcgatccgaaatgcttcatttgagaaacaaaaaggaaagatcatttcctatgttatgctggccgtccttcttggaagcggactgaaatttctcgcacatgtcatcagcggcgctgtcttttttggaaactatgcgcctaaaggcactccggtatggatttattcattggtatataatggaacgtatatgcttccgtctttcattgtctgcacaatcgtcctttgtatactgctgctaaccgcaccaagacttctagaaaacagaacaaacatgagataa

SEQ ID NO: 3114 - DNA, 558 bp, Bacillus licheniformis
atggttgcgtgcggcgcttattttacaacaacgaatgtgttcaagctgatgcacggctacgctctattttcatttcagcagatgaaagaagaggaaaagcctgaaaaacctccgattcagacgacgaaaaaagaaaagacggcaattgatcaaacatttgaaaccggggagaaaatcggtgatcttgttattccgaaaatcaatgcaaggcttccgatatatcacggaacagatgaagacgagctgcaaaaaggcgtgggccatttcgcaggatccgttctgcctggagaagatgacaactcggttttatcaggccaccgggatacggttttccgaaaactcggccgagtggggaaaggcgatcagttaattgttgaagcttcctacggaacttttacatacaaagtgaaaaaggtccgaatcgtggatgcggatgaccggacggtgatagttccaaagccgagagcgacattgacggtttccacctgctatccttttgactttatcggttcagcaccggagcggtatatattggtcgcagatttgattaaaacataa

SEQ ID NO: 3115 - DNA, 996 bp, Bacillus licheniformis
atgaaaaaaaggctgatgtcactattggtctgcatcctggttttagtgccggcagcaggagcttttgccgcgccgaaacaggccgagcttaaagattatcttgaagaaataggaatgacagaaaaagaattggaagcctatttgcaggatacatatgatgagagtttaaaaggttttgactcggtggaagagttgaaagactttttagggcaaagactgactaaaaagcttttggcatcctatttgaaagaatacggattgagcgaaaaagaagcggctgacctatttgttgaaaatggctatatggaaagcggccaaaacattctcgacgtgtttatgtttgaatacgaattggacgatgcgctctacaccgtgacatatgaagaagacgattttcagatcggaaacatgtttcaagaattgggtgtggatgatcaggagtgggaaagactcgtgaatcacctccgaaaagtgcgcgataacaatccgaaccttgaaaatgacttgatggctcttggagaacgtcttgaagcggtagccgatttcgagtctgtatcagagctgtcagctcaggatatcgctgaaatgctgtccattttaaacgatcttcagaagacgctcgaagtgaaaacgaaatattatcttgttaaagacggaaagaaaaaagaagtgtctttgacgacgcttgtcagtgctgaagatctgaagggagcaagcctcctagtggaagtatacgatctgcagggcaatttcattttggatgtattgctgacgcctgaaatgatcggatctgatttaattcatgacacagggtcgaaagtgaagcaaacccaaacggctgttaaacacgacgcaaagaaatctcatgtgaaaaagacggttaaaggtgcaaagcttccgaaaacggccgggcattacgcagaatggtcgatctttggcgccgttctgatgtttggcggattgtttatggtcagaaggcttcgaaaagcggcttaa

SEQ ID NO: 3116 - DNA, 189 bp, Bacillus licheniformis
atgaatccttactatatgatgctcttatgttatgtcctatcgatcatccactttttaataggctaccgggaagccctgaaaataagcggggctgacgggctggtcaacggaaccgcaatgatctcctgtattccgcttggcgcggttttcgcttttttcgcgcactttttttggaaaatgacgatttaa

SEQ ID NO: 3117 - DNA, 1113 bp, Bacillus licheniformis
atggccaaagccgtggcttctcaagaagtcgccaatatgctgaacgactggtacatactgatgaaaaaacgagacatttcaggttcaatcgaaatgaaagatgacatagataaagcaattgaaaagatggaagaagatcatgacgttcttctctattatcaaatgctggattttcgcttaaggcttcttcttgaagatatctcccaatcttccacagaaaaattggaagccatcagttttaaggacaaagatccaaaaagtacggacgataagctgaattattatttttatctgttcaaagggatttatgaagactacaagcaaaaccatacagaagcgcttaattttttcagaatagcggaaaaaaggctgagcgtcattcaaaatgaaattgaaaaagccgaatttcattataaaatcggtgttttgtattacaacttaaaagcgacatggctgtcgattcaccacatcaacattgcctcaggcatcttccaagggtatgacgggtatgccaagcgggtcatcaactgcaaaatgctgatcgggctcaattatattgaccaatttaagtttgccgaaagtgaagtattgttaaaggaagcaattgaaaaaaccgaaaaaatcggcgaccaatatcttttgccttatacctactataatatgggctttttgaagagtaaggaagataaacacgaagaagcgctgaagtattataataaagcttttgcaatcaaagactttgaaacgaaagccaagtatgcttaccttctatgtgtatatgaaaacacaaggtctcttttcaaaaccaacgatcccgaccaagcttttaaatggatcgacacaggctttaaaaaagctcaagaagtgaatagcgaaattttcgaattaaaattcaaaactttatatacattacattccgattgtcagaataaactggaagtaatcaaggactttattcaccaattagaagataaaaaagcatgggttgatctggaggaattgctgatggacgtagcgaattactatagggaaaataagttatacgaagaagccatatatttctacattaaaacagacaaggcaagtaaacttgccggaagaggaggagaatag

SEQ ID NO: 3118 - DNA, 648 bp, Bacillus licheniformis
atgggaaagaaagtactgctgacaggatttgacccctttgggggagaaacagtcaatccgtcctgggaagctgtaaaacggctgaacggagaggaagcagaaggcgtctctatcgcagcggagcagattccgaccgtttttcatcattcagcggccgttttgaaaaaagcgatcgaaaagcacaaacccgatgtcgtcatttgcgcagggcaagcaggcggcagggctcatattacgccggaacgcatcgcaatcaacatcgatgatgctcgcattccggataatgaagaccgggaaccgatcgatgaacccatcgcggcagacgggcctgctgcttactggtccgcgcttccgatcaagctcattgtgaaagagttgagaaaaaacggaataccggcctccgtctccaattcagcgggaactttcgtatgcaaccatctcttttaccagttaatgcaccgtatagaccgcacctcggcaaacatccgcggagggttcatccacattccgtttctccccgaacaaacaatcgataaacccgagccgagtctcagccttgaaacgatcgtcgaaggacttagaatagctgcggtcatctccgccctgcacgaaaaagatattcgcgaaacgggcggatcgatcagctga

SEQ ID NO: 3119 - DNA, 657 bp, Bacillus licheniformis
atgcagaaatcttacgccgttttcgggctcggccagttcggcggcagccttgtgaaagccttccacgcaaaaggggcggaagtcttaggcatcgacaaatcagaagaaaaagtaaacgaatattctacttatgcaacctacaccatttgcgccaacgccgttgatgaaaagaccttgaaacaaatcgggatacgcaacattgaccacgcatttgtatcatttggcgatgacattgaagcaagcattctgacctcgcttttgctgattgaaatgggcgtccccaaagtatggacgaaagcacaaaatgactatcaccaaaaagttctccataaaatcggcgtccatcgtatcattcatcctgaaaaagatatggccaagcggatagccagccatatcacgtcggaaaagatgatcgattttgtcgagctgtcgccaaactacagcatcgtcgaaattgtggccactaaaaagctggacaaaagaagcctgggggatatcgacgtacgcgccaacttcggctgcaatatcgtcggcataaaaagggacgggcatttcatcatcgcaccgagcgctgatgacatgatatatgaaaacgatattttgattgtgatcgggcaaaataaagatattgagacctttgaaaaaaagggcgattaa

SEQ ID NO: 3120 - DNA, 1320 bp, Bacillus licheniformis
gtgaagtttaaacagatacaattaagcccgtcccaactgctcgtgctagtgtttttatttttcatcatattaggaacccttttattgaagctgccggcagcaacgcccaagcctataggctggattgatacgctttttacatcgacctcggcgatgactgttaccggtctggccgtcgttgatacaggcacggattatacgatgtttggtcagcttattattctcgttctcatccagctcgggggactcggcatcatgtcttttgcggtgctcatttttatcatgctcgggaaaaaaatcggcctgaaagaacggctgttgattcagcagtcgcttaatcagacttctttaggcgggattattaaactgatcaagagtttgtttatttactccttcgcgattgaaatgctggccatgctgatacttgctgtcaaatggattcctgaatacggtctcgcccgcggcatctactacagcctgttccatgcggtttcctcctttaacaatgcgggattttccatatggccggacagtttaatgcggtatgaaggcgatccgctcgtcaacctggtgatcagttttttgttcatcgtcggcgggataggatttactgtattgtccgatttatggcataagcggagctttaaaaagttgagccttcattcgaaattgatgatatacggtacgtttatcgtcaatttggcagccatgatccttatttttctgcttgagtatcaaaatcaaaaaacgctgggaatgcttccgctagctgaaaaactttggggcgcctattttcaggctgtgaccccgagaacagcaggatttaacacgacagacatcggaagcctgcgcgaaagcacgatcacgcttttgctccttcttatgtttgtcggagcggggagcgcatcgaccggcggaggaatcaagctgacgacgtttcttgtcattcttctgtcggttatcacttttttaaagggcaaaaaacatatttcaatagccaaaaaaacgctgaaagaccaattgatcctccggtcgctcgctatttcaacaatcagcgtgctgttgattttaacggccatctttattttaaatatgacagaacctataccgtttttggcgattttgtttgaagtcgtttcagctttcggcacggtcggcctgtcaatggggattacggccgacctgtcccctatcgggaagatgctgattgttttcattatgtttctcggaaaactcgggccgctcacattggcgttttccctggccagacctgaaaaggaaaacatccgctattcaagcgaagatattttgactggataa

SEQ ID NO: 3121 - DNA, 915 bp, Bacillus licheniformis
ttgagaaccacattgtacccgtatatagcattagtggtcggggtgttggctgtgtcttcctccgccatcttcgtcaggctgtcaacagctgatgctggaatcatcgctttttatcgtctctttttttccgctttgctgatctttccttttttctggggaaaaagaaaagaagtcttgggtttttcgaaaaaagactggctgttttccgcggcagcgggattctttttagcatttcattttattttatggtttcgctcgcttgaatacacgtctgtggcgagctcggttgttcttgttacgctgcagccgatcttttcctttatcggtacatattttttatttaaagaaagagtctcgttcgctgggatcatcagtgcgcttctcgcgatcggcggaagcgtgtacatcagctggggggatttcaaagtaagcggccaggcgctctacggcgatatcctggcgcttttggcatgtgcgcttgtgacggcatatctgctgtttggccagcatgtcagaaaacgccacagcttgaccgtttacacttttattgtatatggaatcagcgccctcactttatgtctatactgcctgttttcgggcgccgcctttttttcttatcctgcgtcagattggggttacttctttctgcttgccgtcattccgactttgctcggccactcgctctttaactgggtgctgaaatggctgagcacaaatatgatttctgtggcgattttatttgaacccgtcggagcggttgcgctggcgtattggattttagacgaatccgtcatgatgacgcaggtgatcggcggagcggtcattttttcaggcatcatcctgttcatggcctcgcaaagcatacggaaaaacaacgtcccggcggtgaaagggaaaacgcccaaggcgctttaa

SEQ ID NO: 3122 - DNA, 483 bp, Bacillus licheniformis
atgagcatttttaatgaagcgagaaaagaactttggagcgagattcaaggcctatcagacgaaatgctgaataaaaggccggcggaagacgaatggagcattcaagaagtgatcgaccacctgaaaaaaatcgatctgatggcacttcaaatcttgaaggaacaaatcaaacatgcaccggttaaatcaatcgaagataaaccggttcatcagttggaagacagaagctccaaacgaaaggcgcctccatatgcggagccggaaagaaaaacagcggatgctttaaccctcaaagctgagctcgacaatgtcagaacacaattaacttcagtcatcgccgcctttcacaatgaagattttcaaagggtgctgccgcatccgattttcgaagagcttacggtcaggcagtggctcgacttcatcggccatcatgaaagaagacatattaaacagatcaaagaagtcaagcagaaactgctgtaa

SEQ ID NO: 3123 - DNA, 582 bp, Bacillus licheniformis
atgtggaagaagcgcacggctgtggcggagcacgtatacatagcggacacagcgtcatttgtgacagagaaacaggcaaagatcgtaatcgattacgggggcataccgggggatctgcattttggactgacgaaaaaagccggggcaagggagccgatgtataaaagaggaacggagattttcaacaggaggcagatttctatcgtctcggtagaagagtgccttgaaattgccggacggctgaacattccggcggtccttccggaatggctcggggccaatatcgcattaagcggcctgcctgatttaacctcattaagagaaggaagcagaatcgtttttccaagcggcgcctctttgttgagcgagggcgagaatgagccgtgcattcagcccggagaagtcattcaggagcagtttcccgacaaaccgaagcttgcttcgcgctttgtgcgccatgcgatgggaagaaggggaatcgtctgcatcgttgaacgcccgggcctgatccatcaaggcgaccaagcagaagtgtgggcgtattcgcctgctgccatgaaagacgccaggtcgtttgcctag

SEQ ID NO: 3124 - DNA, 1209 bp, Bacillus licheniformis
atgactttaaatatgaaagtagaagcgatgaacaaattccacacgtttgaaatccctaccgtcattaagcacggaatcggagccgttaaacatgtgggggaagaagtgaaaaagcttggcgtttcaaaagcgctgcttgtcacagaccctggcatctacaaagccggtgtaacaaacccggtcgttgtatcccttcaggaagcaggcgtagaagttgccgtctttaataaagtcgagccgaatccgcctgtccgtcttgtcgctgaaggttccaaactgtatgctgaagaaaactgcgacggccttgtcgcggtcggcggcggaagctcaatggatacggcgaaagcgatcggagttgaagccactcatgaaggctcagtccttgactatgaagcggcagaaggaaaaaagccgcttgaaaaccggattcctccgcttacaacgatcccgacgactgccggaaccggctcagaagttacacaatgggcggttatcacagatgaagagcgcgaatttaaattcaatacgggcggcccgctgattgctgctcatttgacaattatcgatcctgaattgcatgtatcaatgcctccgcacgtaacagcgatgaccggcgttgacgctttggctcatgccatcgagtgctatacgatgaaatttgcccagccgattactgacgcggtggcccttcttgcgatcgaatacggcgcacattacatccgcagagcgtttgccgatggagaagatcttgaagcgagatacggcatggcgcaggcggccatgcttgcaggcctttcttacggaagcgaatccgcaggcgctgctcacgcgatgagccagacgctcggagggatcatccctgtcgcgcacggccaatgtgtggcggcgatgatgggccctgtaatggaatacaactggaaaggctaccctgaaaaatttgcccgcattgcaaaagcgttcggaattgacacaagcggcatgtctgcagttgaagcggctaaagctgcggtgaactggatgtatcagcttgtggaagacttagagattcctagtcttgaagagcaaggcgtatcacctgacatgatcgaccgcctttcaaaagaagcgatgaaagatccgcaaacggtcggtaaccctagagacctgaacgaaaaagcgtacaattggatttacaaacgctgcttcaatttaaccccgaaaactgtctga

SEQ ID NO: 3125 - DNA, 1497 bp, Bacillus licheniformis
ttgcgtaatgaggaggctgcttttatgagtcaaacacttttcattgacggaaagtgggtgggcgccaaaaaaggcgagactcgccaaattatcaatccttacaatcaagagcatattgaaaccgtcagtgaaggagacagagaagacgctgttagggcgattgctgcagcgcgccgcgcatttgacgacggcgagtgggcgaatacgccgggtcttgaacgaggcaacatcgtattaaagatcgccgaactgatcagacgcgaccacgaagagctggcagaacttgaatcgcttgataccggcaagacgattgaagaaagcagagccgatatggatgatattgcaaacgtatttcaatattatgcagggcttgcggataaagacggcggagaagtcatttcttcaccgatccccgattctaaaagcaaaattgtcagggagccggtcggtgtctgcgggcagatcacaccgtggaactatccgctcctgcaggcaagctggaaaatcgctccggctttggcggcgggcaacacgatcgttgtcaaaccaagtgaaatcacaccgctgacaaccattaagatcttcaagctgatggaagaagccggtgtgcctgaaggggtggccaaccttgttctcggccccggggcgactgtcggcgatgaacttgccagaaataaagacgtcgacttaatttccttcaccggcggaattgaaaccggaaagaaaatcatgcaggctgcaagtacgaatgtgaaaaaaattgcgcttgagcttggcgggaaaaatccgaatattgtgtttaaagacgcagattttgacgtagcggttgaccaggcgctgaatgcggtatttttccacgcaggacaggtttgctctgcgggcgctcgtcttctcgttgaagagtccattcaagatgagtttgtcgcagagcttgtcaagcgtgcgaaaaaaatcaagcttggcaacggatttcacgaggagacacagagcggtccgcttatttcagctgaacaccgcagcaaagttgaaaaatatgtggaaatcggcttgcaagaaggcgccaagctggaaacaggcggaaaacgtccggaggaccctgaacttgcaaatggcttcttctatctgccgacaatcttctcgagctgtacatcagatatgagaatcgttaaggaagaagtattcggtccggtattaacagttgaaacatttaaaacagaagaagaggttgtctcacttgcgaacgatacgatttacggccttgccggcgccgtttggtcaaaagacatcgaaaaagcggagcgcgtcgcttccaaactgcgcatgggaaccgtctggatcaatgacttccacccttatttcgcacaagcgccttggggaggttacaagcagtcaggcatcggccgcgagcttggccgcatgggccttgaagaatacacagaagtgaagcatgtctaccgcaatacgaaaccggcggctgtcaattggtttaaagcataa

SEQ ID NO: 3126 - DNA, 555 bp, Bacillus licheniformis
atggacaatccccgtgatgtttcagcaaaagaaacgatcgcacaggcaaaagatcttgtcattgattcaatcgcagaaacaatggatctgtacggcattacccggagtgcgggcattttgtacggaacgatgtacctttcggatgaaatgacgctggacgaaatgcgggaagaactgcaaatgagcaagcccagcatgagcacaagcgtaaaaaagctccaagacttaaacgtcgtcaaaaagacattccacagaggaagaagaaaacacagctttgttgctgaaaaggatttcttcaaatttttcacaagctttttccctaaaaaatgggaaagggaagtcaaagtgaatctcatggctattcaagacgctcaaaaagcattggaggacatcatcgaaagcgaagggcttgacgaaagcataaaagaggaagcgagaactctttatgaccagcttgaacattcaaaaccgtattatgactggctgctgagactcgctaaatctgtccaatcgggagagatttttgagtttataccgattgataacaagaaataa

SEQ ID NO: 3127 - DNA, 1629 bp, Bacillus licheniformis
atgaattatgctgagaagaaaaaaaactggatcaaattaggtatttttgcgctgtttgcgggaggcatactcgcgtatatcggcatttcgaatgcggacattcattggggcggctttatctccatgatgatattctttgctttcacctattatttaggcgctttttacgcagcaaagaaatcaaattctttttccgatatgatcgtggcaaaaaggagcatgccgtttttcgtcggaatggtgacgatggccgcaacatgggtcggcggcggatatattaacggaacggccgaatcgacttacagcgacggcctcatctgggcccaagcgccttggggctacgcattgagcctgattatcggcggtattttcttcgccagaaaaatgcgccgtcatcaatttatgaccattatcgatcctctcgaacagcgcttcggtaagcggatggccggcgttttatatataccggcgctgttaggagaattgttttggagcgccgcgatcttaacggcattgggcacgactttcggaatgattctgaatatcgatttccaaacgtcgattattctttcggcgatgatcgccatcgcttatacggtggccggaggcatgtgggcagttgctttcacagatgtctttcaaatgattgtcattttgctcgggctgtttttagtcgtcccatttgtattgtcgaatgtcggtgctctcgatagcgtatgggcaaattacaggcacgatttcggcagcagcgccaatctgcttccgccgttggacggctggaaaaacccggattggggaaacctgttttggaactggtgggataatgcgctcctcttaattttcggaggtatcgcatggcaggtgtactttcagcgcgttctttcggcaaaatcggaaagcgccgccatgtggcagtcgataattgccggagtgatctgcatcattgccgccattccgtgcgtaatcatcggagctgccggaaacagtaccgattggagcctgttcggagcgagcgctccggataacccggcgatgattttgccgcaaacgcttgcgtatttgacgccaggaatcatcgcaggcctcggcttgggtgcaatcgcagcagccgtcatgtcaagcatggactcatcgattctatcggcatcatcaatggccgcatggaatatttaccgtccgctcatcaagccgaaggccacccaaaaacagctgcaaaaagtcgtcaaacgctcaatcattttgttcggcgcgggagcagcggtcatcgcgctgaatgtcaaaagcgtttatactttatggtatttggcttcggatttagtttattgcattctttttccccagttaacaatggccctcttttataaaagagcaaatctttacgggtcgattgctggatttgcagttgcagtcattctgaggctcggcggtggtgaacccgcattcggcattccgccgcttctgccgtatccgatgattgaagacggcacggtcctctttcctttccggacgctggctgcagtcacagcatttatgacgatcttcgctgtgtccgaattgacgcagcgcaaatgccctcctaaacagcttgtactcccccaagaaaaacagaaagacgaccgcgcggcttaa

SEQ ID NO: 3128 - DNA, 918 bp, Bacillus licheniformis
atgaaaaaagatgaatcgagtataacgtcccttatttcggcttttggcagagcttatcacagccagtatgatgaaccaaaaatctttgatgataatctggccaaatcgctcatttcccaacaagaatttgctgatatcaaaaacagcttcattcaaggcatacagttcttcaacaaagctatagcggaaaaatacgagggagacgatgaagaaatattaagatggatcacacaagttcagctctctccgacgccgctcgcccgtgccgcttattgcgaaagagtgctgcatcatgagattcggcttgggacagaacaatacgtgattcttggggcagggctggatactttctgttttcggaacctagagttaaaggacaaaattgatatctttgaaattgaccacccagcgacacagaaattgaaaaaggaaaagctggacaaagccggttttcacatcccggaccaccttcattttattcctttggactttgccaagtcgttttcttatcaagaattggctgataagggttttcattttaacaaaaaaacgttcttcagctttttaggcgtttcttactacttaacaaaggaagaaaccgaaaaactgctcggggaattaatggctgacctcccttcaggcagttcgatcgttttcgattatgctgatgaaaacttgtttaaagagaaaggcttcttcaacagggtggaaaatatggtaaaaatggcagcggcaggaggagaaccgatgaaatcatgctattcgtatcagaaaatacagcacatgctgcagcaatccggactgctcgtttacgagcatttatcaccttcagatattcaagggcgttattttaaaaatcgaaaagatgatctgtcagcctttgaaacgattcattacattcttgccgtaaaaaaataa

SEQ ID NO: 3129 - DNA, 1182 bp, Bacillus licheniformis
atgaaaaagctttgccgtgaagtttgggtagaggtaaatcttgatgcgatcaaaaaaaatttgcgcgcgtttcggcggcatattccgaaaaagagcaaaattatggctgtcgtaaaagcgaatgcttatggtcacggatcggtggaagttgcacgccatgcacttgaacatggtgcgagtgagctcgccgttgcctcggtggaggaagcggtcgttttacgaaaagcggggattaaagcgccgatccttgtgcttggtttcaccccgctgagctgtgtgaaagaagcggcagcttggaatatatcgttatcagcttttcaagttgactggattaaagaagcgaacgagatattggaaaatgaagcagatcctaaccggctggctgttcatatcaatgtggataccggcatggggcgtttaggtgtacgaacaaaggaaaagcttttagcaatcgtggaagcgctgacggcaagtgaaaacctcgaatgggaaggaatttttacgcatttttccacagctgacgaaccggatactgagctaaccatgattcaacacgaaaagtttatcagctttcttcgctttctgaaagaacaaggctttaagctgcctacggtgcatatgaacaatacggccgcggcgatcgcttttccggaattcagcgctgatatgattcgcttaggcatcggaatgtatggattatatccttccgattatatcaggcagcttaatctcgttaagcttgtgcctgcactaagcttgaaggcgcgaatcgcttatgtgaaaaccatgttgactgaaccgcggacggttagttatggtgctacatatgttgcagagcgcggggaagtcattgccacaattccggtcggctatgctgacggctattcccgtgaactttccaaccgcggttttattcttcatcgaggaagacgagtgccggtggcgggaagagtaacaatggatatgataatggtcagtctgggagagggtgaaggtaaacaaggagaggaagtcgtgatttacggccggcaaaagggagcagagatatctgttgatgaaattgcggaaatgcttgatacgatcaactatgaagtggtatctaccataagctggcgcgtccctcgtttttatataagagacggcgagatttttaaaaagtcgaccccgctgttatacgtgtag

SEQ ID NO: 3130 - DNA, 1077 bp, Bacillus licheniformis
atgaaaagaacagccgggactccagcttggtacaatcacgtgccgcatccaataagaaacgatggtgcgggcgcgaccgattttggcccccgcgacgtgatgcgggatttagagaatcccgacatgttcgttcctccaaaaacagatgccggagcaatccctaatttaaagttttctttttcagacacacatatgcagttaaatcatggcggctggtcccgtgaaataacagcccgggaactgccggtatcaacgacgattgccggcgtcaatatgcggctgacgccaggcggggttcgcgagttgcattggcataagcaatcggaatgggcttacatgattttgggccatgcgcgcattaccgccgtcgatcaggaaggccgaaactttatcgccgatgtcggccccggagatttgtggttctttcccgccggaataccgcactcgattcaagggcttgaggatggctgcgaatttctcctcgtttttgatgacgggaacttctctgagttcgataccttcacgattaccgattggttcgcacacacaccgaaagatgttctggccgcgaatttcggtgtacacgaaagcgccttcgcccgcatccctgacaaacagcggtacatcttccaagcaaaagtgccgggaccgcttgaaaaccaaaaagtgccggacccgtatggaaccgtcccaaaaagcttcgcatacaggctgtttgcacaaaagcctatcgtaacgccgggcggaacggtacgaattgttgattcttcaaactttccaatttcgacagcgatcgccgccgcactcgtcgaagtcaagcccggcggaatgagggaaatgcattggcacccgaacaacgatgaatggcagtactatatctcagggaccgggcgaatgacagtattcgccgcaaacgagactgcccggacctttaattaccgggcgggggatgtcggatatgtcccgtttgccatggggcattacattcaaaatacaggcagcgaaagcctgtggtttttagaaatattcaaaagcagccgctttgcagacatttcattaaatcagtggatggcctga

SEQ ID NO: 3131 - DNA, 399 bp, Bacillus licheniformis
atgagaaatggcgtttgggcactatacaatgataaagagtacgagattattcagcatgatcaagaaaactacgaattatttaccaaagatcctgaggcaattcaatttggttttattttagatgaaactggacattattgtaaacaagttcgaagagaacatatttcttcagtttatgatgtaagataccaagcaattattaatgatcttgagtttcctgtttttcgtgaggaagacaataggctcttaattggaagtgggctacatggcccggacattatcaaaaaatatggatttgttcaagttgatcgatttgaatatgaaaaatgggtaggaaaaagtgaagttgaaaaaattgaagaagttaaagtacctatgtggggttttcccgccccgtga

SEQ ID NO: 3132 - DNA, 1923 bp, Bacillus licheniformis
atggatgtgaaatacgtaccggaagaatggcagggcatgaaagacggtcttgatgcgctgacgggcggccaatacggcggcggtatgaaatccggccttataaaactcaatgatctcttggaagatatcgaatccaaaatcaaagacaaggacagcgacaggtcgatcagctttacccacaccagcaaaaaaagcaagatcgaggaactgtttaaggattatcaaaagctggccgacttttgcctgaaagccggcagtttggtggcagaccacattgacagccctttttataaaaaaatagacgcgttcgccgaaaaaatgcgcggactgaccatacataattacaccaccgtaaaccggatcggctccaaggaaaccacttacgtcggatacggcatgtccaagcaagcggttgaaaccgacaaagcgaaagtgagcgtaaatgatatcttcaaagactcggaatcgtttgatcacgtactgagcaaagaatttgaagaattccagatcaaccaccccgacattgagttatcgtatgaagaatacacgaaagcgattgcctcttcccgcggatttgaatacgaatcaatcggcgatgtccaaaagaatcaggaattatggcgggatcttctggccggagcaggcattatcgtgctcaccatcttttgcgcaccggcaggtctcacggtggccgtcgcctacggaggagccaatatcgcgagcgcggcaacaggaaaagactggatgacgcagcgggagttaaacacaggcgaaaggtttgaaagaggcgtgttcggcgcccttgacatcatcccaggcgctgccgcggcgaaaggctcatttaaaagcgcagccacaatcggccaaatttcaagcaaaacagaacatatggtacaatctcttaaagacagcaaaaacatctgggcgaaccgcatgaaggtgaatgggctgaaagctcaagaccggctcaacgacgcaggcttcgccattaaaaaacaattcgccaaaagcgccgacgccttgagcgatattgcccgcggtgcagaagcaggagcgggcggcaccctcgtccgaaaaggatccaattactccgcccacgtcaacgacgcccataaggcttcgaaagcgaagatgcaggattcgattcagcgggttgagaaggagattgaagctgggaagagtgttaaaagtgttgttaaagaggtagatgttaataggaattcaccagttaatccgaaattttcgtgggaacaattggataaatcttttgaagataatttaggaactgtattaaaaaagcataaattaacagtcaataattttaatgacttgaggcttaaatctataaataaactttcatctaaagaggtggaagttattaaagatattaggcgaaacgttcctagtctttcagaagatacaattatgcagaaggttctttctcctgattccaaaagttggctattttcttcaccaagtgatggtgggcaaataaagctaggtggatatgtggcaagagctactgatactaaggaattgaacacttttgataagatttatgaaggacttagattagattacgaaaacaaccctttcagtggcggaacatcagcattagcggtacgctataaggcaggtaatccaaacgattataaaattccgtttggagggaagaattcagaggccgtaaataaaatgacccacgatgatttggcaatggattatattgcaactgagcaacaatctccgtttactggaaatggatttacagagagtaaagattacactattcctgaatatcgcaatgatacaagaacacctatgcatgaaggtgcagaactttatgagatcactaatcaaggcgagaaacttattgggatctatagtgttaaacaaaaaaggttcatttcagttaatgaatag

SEQ ID NO: 3133 - DNA, 324 bp, Bacillus licheniformis
atgaatgcagaaggcggagcaggaggcggcggtacaaacatccatctcgagtttgaagaaatgatcaccatttccaataagctgaaaagcatctgcgatatttatacagaaggggttcagaaggaaatcaaaaacctctcagaatccgatttttataaagccggacaagcatcaaaagcgattgaaagctacgcggatattctcggaaagacgatggagctgtttgataattactgtatagcttcccacattgtcagttatgcgatggagaaaatgtatgaaacagataaagagctccaaaaactctacaagattcagaaatag

SEQ ID NO: 3134 - DNA, 666 bp, Bacillus licheniformis
atgcaggtgaaagcagatacgctgtcggcggcagaactgtatgttttagcaggagcagccggagtttcctacatattcggtcttccggaacgcgaacagctggccttggtcgagccggattgtgcaataaaagcaaaggacagcctgattgaaaaaggcattcttttaaaggaaggcaagctgaccaagaccgctttttttctgattaagctgctgcaacattaccaagaaagcggagaatacgtgcgctttaataacgtgatgtgcgcatttctgccggacgacgaggagcgcgttatcgccctgactgaaataagcccgggcaaagggtacacattagattatgtggaaaagcgcgaagtttatttatcgctcatttcaaaggtgtcatttttagtaagggagccgcgcgatcaagaccgcgcctttttgacaaaaccgatgagcgccgctgaaaaagcggaagtcagggcaatgaatcttgatgaaaaagaagttcttgctgtggaaacgttcaagctagcctcacagcaaaaaccggcagaccccggcttccagacgacaacactttactttacaaaaggcgaagacttcatctcggttgatcctttaaatgatcgatatgaatggatcagccttttatatcatgaacaaccggatctatga

SEQ ID NO: 3135 - DNA, 351 bp, Bacillus licheniformis
atggacggatatggatactacaactatcaagcggcgaatccgaaagtaagcggagagactgtgaaaatttcacacaatggaacaataaaagcgcattcccatgcgaaagcgatcgaaaaacatgtcggcgattcgctcaaaaaagcaaaggaattgaaagcgtacgtcgaaagcggcaaatggagcgggaaaacccgcgacgcatttttaagctaccttgagctgattattgaattgaatgccgatatgaaagacgccttgaaagagcataccgctgcattagatgcgctggaaaaacacatcgacggtttttcgcagctcagtgaagtgcaggaaatcaaaaacttataa

SEQ ID NO: 3136 - DNA, 360 bp, Bacillus licheniformis
ttgagcgaaggtttttgggattcagtaggcaactttttacacatatcctacacggaaaatgaacgaaaacgcgatgagtataaaaatttatacgactatttatctgataaagaaagcgatgtcaagacgaaattagcagaaattgatgcaagtttgaaggcttaccacagcaatctcccggacttgaaaatcccttcacacgaatttgaggatacccgccatgaaaaggatgccaagctgaaggaattggtcaagcattttaaagatatggtcgatgacatccaaagcgccaagacgaaggcgaaaagcaagtgggagtattataaagcaaaagctgaagctgaagagaaaaaggcgtag

SEQ ID NO: 3137 - DNA, 210 bp, Bacillus licheniformis
atgcgtgaacataaaggatgtatcaagtgcggaagcacagatgcggggcaaaaagaaatcgcgacgaccggcaccggcctgtcaaaattgttcgatgtgcagcataaccgttttctcgtcgtttattgcaaaaactgcgggtattcagagctgtacaataaacaatcttcaaccgccggaaacattctcgacctgttctttggaggatga

SEQ ID NO: 3138 - DNA, 174 bp, Bacillus licheniformis
atgggggaaaaatacggttcattgattgccatatttattttggcattatgtgtgcactccaacattgtcgtagaacatgcgctcttacagacaatcataaaggcagtttcactttttgtgatgatcgcttcggcgcttgcagcatttgtcaaaggcatcagacaaccgtcataa

SEQ ID NO: 3139 - DNA, 1482 bp, Bacillus licheniformis
atgtctgagagcagcaagaaatcagtcgtcatgttgctgatcgattcattaatggatgaaccgctcaaagaagccgtgaaaaacggacaggctcctggactgcaatatttactggaaaacgggcgttatgtgcctgatatgatcagcccttttccgacgatgtctgtcaatgtcgacagcacattgcttacaggggtgtacagcgaccagcacaaagtgcctggccttgtgtggtacaacgcgaaggaaaaacggattatcaattatggcagccacattcgagagcttctgaaattaggcatcaaacaatcctccagagacgtcttttacaatctgaatcaggttcatttaagccaacaggtgaagacgcttcacgaagagcttgacgaaaaaggaatcgaaacgtgctcgatcaatgcgctcttgcacagggggagccgggacggctatttgcagattccctttcttttttcaatgatttccggattaaaccggtcagtcaaaatcaacgcatcccagctgttttcgtacggcggtttttccaaagtgaatccggccaaccgctcgcttttcaaaaaattcggttttaacgaccgattttcaaccaatgaattggtctatctgattcaaacaaacaaagtaccgcctcttgcgctcgtctattttcccgatctcgaccagcacgtgcataaacacgggaggaacgacgcagcgggggtggcgaaagccgaccggcatgttcaaaggattttagacagtttttcgtcatgggaagccgctttaaaggatcacatttggatcgtgatgggggacaacggacaggcctggatcagcggcaataaaaaagaagcattgattgatttgagaagccttttggacgcctttcgcattgtgaaattaaagaaaggtgtgacggccgatgacgacatcgttcttgcagttaacgaaagaatggcgttcatctattcgctcgataaagcgaagcttccgctcaagaggatagcggacattctgcaaaaggacgaacggatcgacatcatctgctggaaaaatgaagcggattcaattgaggccgtttcgggggagcagcacgggaagctcacatttcggccgggaggcaaatgcacggacgaatttggacaaacgtggacgctggaaggggatttacatattctcgatttgacggttgagcagaacagcctgacatacggaaaatttcctgatgcgctggccagactgtacgcttcatttttttctcatgaaggcgattatttgatcgccaatgcaaagcccggatacgaatttatcggcgaagggtcgccgacgcacgtcggaggagccagccacggtgcactgcataagcaggacaccctcgtctccatgatcatcaccggaaccgatacaatgccggcatacaatcgtcttgtcgatataaaagaatggatcctcgatttagtcaaatcacggggagcgggggaatga

SEQ ID NO: 3140 - DNA, 1134 bp, Bacillus licheniformis
atgacaaagattctgattttcccttttttaagcatttccaccggtcatcatcacgttgccgattcgctgcagacagaactgctcctcaaatcccatcactgtgaaaaaatcgacattttttcacatgcttatcggcggctggaaaaggcctcctctgcggcatatttgtcatggattcagtattttccgaaagtctacagctcggtctatcatctcctggcgtgcgggcgccatgaaacggcaaagcgccacctcttgtatgagctgatctttttgaaaggcatgcagcagattattgcagaaaaaaagcctgatatcgtgttctgtacgcatgcattgccctcctatttgctgaaccgcttaaaaggccaatttcccgacatgaaagtggccaatgtatataccgattttttcgtcaaccgaatctggggaagagagaagattgattatcatttcgcgccgatcaaagacatcaaagaccagctgatcgcagaaggcgttgatgaagagaaaatttttctgaccggaatacctgtgcaccgttcctataaaacggagagaaagcctgagcaggacggggacaaaaaagcgttttgcaacatcctcataaccggcggaagcatgggggtgggcggcatttttaaactcgtgcgggaactgtcgccgaacgggaatgtcgcataccaaatactatgcggaaaaaaccgaaagctctaccggtatgttcgtgatttaaacaatccatatattaaagcgctgccttatatcgaaagcaagactgaaatgaaccgcttatacgcggaggcgtcgggcattattacgaagcccggcggcgtcacgatcagcgagtgcattgaaaaacagctccctgttttcatctatcatgcgctgcccggacaggaagagatgaatctcgatattctgaaaaagaaaaaccttgtcatcgaactgaatcagcaaaaacagcagccgattgaacagcagctgctttcctttttccgttcggatgaagacatcaggcgctatcaaatgagcgtcgatcaatatttgcgcgaaaaatcggaccgtgatttcagcgatattttagacgggatcattcataaccggagcggtttagggaatgctcacgtataa

SEQ ID NO: 3141 - DNA, 549 bp, Bacillus licheniformis
ttgagaaactgttttttgtcaatttggagtgtaattgacccgttttattattttttttcaagactgacactcattgaccaaacgaaaacgagcatttttcgcgtccgtctaacaaagtacaaagggatcgatgtggtgttaagcgatgggacggttattaagaaaaacgatgttctgatcaaaattcatctgcacaatattaagctgatcaaggagcttcaaaatattgagagcgctgtcggaagaggcattctcatttatcaaaaagcgtatttttcaatgccgatcttggccgaatatatcaaaaatcatcaccggtcagaccaaattaaaggcatcatcggcatcactacgctgcataaaggagttgagaggctcggttttgaagcggttgagcctgcgaaccagttttacagagtgttcaagaagctgacgcagattccgatcttatatttaacaacaaagcaattttctcttcgcaaaatccccccttcccaatatttgtttatttcgaaagaaaaattgttcaagtcctatctgcagaaataa

SEQ ID NO: 3142 - DNA, 816 bp, Bacillus licheniformis
atgtttattatcgcatgtttattgattatcttaggcctcatgccttttttatataaagcgaaccacaatacaaaagatgtgaaagtcaacacgatttcggtcgagcgcgtgcaggctcccgctttaaagaaaaagctgaacattcttcatctgtccgatcttcatttagaaaacatttcgatttcacctgaacggattcttgaacttgccaataaaaaacgagtggatctcattgctttaacaggagattttcttgataggaagagaaatattccaaagcttgcaaactacttaaaagctttgaaaaaactgaagccggcatacgggatgtacgctgtattcggcaaccatgactacctattgaaagacgaacactttcggaagctgaaacgtgtactggaagataacggatgcatcaccctacagaaccagcatgtctccattgaagtggaaggcgagacactcaacattatcgggattgatgattacagcacgaagcgaagcgatattgccggttcatataaagggcttaaagagggctacaaccttgtattgacgcatgatccgaacgttgtgcttgatatgcaggaatttcactttgactatcttctttcaggacattttcacggcggtcagattcattggccgaagccttatcatctcgtgaagatgggaaagcttgtgcgaatgaatatgataaaaggtcttcactaccatcatgacaaaccgttttatatcagcgagggattgggtcagactggggcgaacatccgaatcggaagccgtccggaaatgacgttccatcacatttcataa

SEQ ID NO: 3143 - DNA, 831 bp, Bacillus licheniformis
atgaacatttgggatattattgtcgctatcatacttggaattgttgaaggattaaccgaatatgcccctgtatcgtcaacagggcatatgattattgttgacgatgtctggctgaaatcgaaagaactgcttacgccggaggcggcgaatacctttaaagtcgtgattcagctcggctccatccttgccgtcgccttcgtatttaaagaccggattctcaatcttttaggcatgaagaaaaacattacggaagagcagaaatcgggaaaccgcctttccatcgcccaaatcgctgtaggccttgttcccgccgctgtgcttggatttttatttgaagactatattgatcaatacttgttttccgtccgcaccgttgcggtcggtctcatcgccggtgcggtgctgatgctcgcagccgactggatcaatcggcgcaaggatacgacagattcggttgataggatgacgtataagcaggcgcttggcatggggctgtttcaatgtctggcgctttggccgggcttctcgcgctcgggttcgacgatttcaggcggggttattctcggcttgagccacagagcggccgctgatttcaccttcatcatggcgattccgatcatgatgggtgcaagcctgctctctttaatcaaaaactgggcatatttgagtgcagacctgttgcctttctttatcgcagggtttatcagcgcttttattgtcgctctttttgtcgtccgttttttcctccggctgatcaacaagatcaagctggttccgtttgccatctatcgaatcgttttagggctgcttctgttcattttgtttctgtaa

SEQ ID NO: 3144 - DNA, 1146 bp, Bacillus licheniformis
atggactctttgcatatgtggggcggcaggtttaaaaagttttttttagacaataaattcgtcctgtttctgcttattctgcttttgatcggactgaacatccttgtatttacaaaagcatcgtttattttcacgcctttcatcgttcttgtggaaaccatcgctctgcctgtcgtgctgacaggtgtcgtttattatttgttaaatccgatcgttgattttctagagtggaaaaacgtgaaaagaatttattcgattcttcttctctacattgtgatcatcggtctgatcacgatttcgatcgtctctgttatcccgctgttaagggaacagatcacaagccttgtcgataacttcccaaggtatgtccacattgtggaagaccaaattaaacagctgatcggaagccagttctttaatcaggtccagcagacgatgaacatcaatctgaccgatttggcaagcaaattatccgatcaggctaccaccattttaaacagtacgtttaccggtgtgggaacgttcataggcgccgtgacagaggtcgtgatttcgattgtgaccgtgccgtttatcctgttttacttgttgaaagacggcaaaaaactgccgctgtttattctaaaactcataccggtccgcctgcgggagcagacgtatgtgatgatgtccgagatgaatcaccggctgagttcgtatatcagggggcagatcatcgtcagcttctgtatcggctgcctgttgtttatcggatatatgatcatcggtcttgattatgcttctcttttggcccttgtggcggcgtgtacgagcatcgttccgtatctcggaccgacgattgcgattacgccggcaatcatcatcgctttggtcacttctccgtttatgcttgtgaagctgatcatcgtttggactgtggtgcagctgtttgaaggaaaatttatttcgccgcagattatgggaaaaaacctgcacatccatccggtaacaatcatctttgtgctgctgacggcagccaagctgttcggcgtgatcggcgtcattctcgccatccccggatacgcggtcatcaaagtggttgtcacgcatttatttgaatggtttaaacagcgttcacacctttacgaaaaaaacgaagaagtctga

SEQ ID NO: 3145 - DNA, 987 bp, Bacillus licheniformis
atgatgcggttcggggtagtcggaacaaattggattaccgaccggtttcttggggcggcccgtttgatcgaagattttcaattaaccgcggtatattcaaggaccggagagcgcggacgtgaattcgcgcagaaatacggagccgaggcggtttttaccgatatcggagaaatggctgagagcgatgttattgatgcggtatatatcgcaagtcccaactctttacataaagatcaggcagttacattcatgaaaagcggaaaacacgtcctgtgcgaaaaaccgcttgcgtcccatgtcaaagaagcggaagaaatggtaaaaacagcgcaggaacaccgcgtaacatttatggaagcgatgaaaacgacgtttcttccgaattttaaaaacatcagtcgcaacctgcacaaaatcggcaaagtccgccgttttacagccagctactgccaatactcttcccgctatgacgcctatcgaaacggaaccgtcttaaacgcatttaatccggctttatcgaacggttccttgatggatatcggcgtctattgcgttcatcccgcgatcgtcctgttcggcaaacccctcgaagtcaaagcgaacgggctgatccttgagtcaggggcggacggtgaaggaacagtgctgttaaaatacaaggagcacgaagccgtactgatgcactcgaaaatctcaaattccttcatcccggctgaaattcaaggagaagaaggctctatcgtcatcgataaaatccaccgccccgaacaagtcgacatccgctatcgggacggtcgggttgaacatcttacgctgcctgatgacaaaccggccatgttttatgaaacagaggaattcatcaatttaattaaacaagggcggatcgagtcttcgcttaacacgtttgaacgttctatagacacattggcggtcatagatgaagcgcgcaaacagatcggtctcgttttccccgctgatcacatgtag

SEQ ID NO: 3146 - DNA, 525 bp, Bacillus licheniformis
atgcgactggaaggcaagaaagtgatcgcgcttgtcagcgatgaattcgaagatttagaactgtggtatccagttttgaggttgaaggaagaaggagcgatcgtacatttcattggtgaaaaagcggatcatgaatacaagggcaaatacggagtgcccgctgtctcagattatgagctgaaaagcgtgaacattgaggaatacgacgccgttctggttccgggaggctgggcgcctgacaagctcagaagatatcccgaggtcctggagatgattcggtggttcaacgaaaggaagaagcccatcggacaaatctgccatgccggctgggtgctgatttctgcaggaatattggaaggcaggaaggttacaagcacaccggggattaaagacgatatggaaaatgccggagccatatgggtgaatgaagcagcggtcgtcgacggccatatcgtgtcaagccgccgcccgccggacctgccgatctatgtcaaagcctttgccgatcttttggcgcagtcctaa

SEQ ID NO: 3147 - DNA, 1983 bp, Bacillus licheniformis
atgtcaaagattgtcaattgggtgaagcgtccctccattgcaaagaaattaattctttcattcttgcttattttaaccgttccaatcatcgtcctttcctatagtgcgtatcaaacggcaagcagtacgcttgacggagaaatcatggacaatgcgcgcgaaaacgttaaccagttgaatgaaatcatcaatcagaatatcagccagaaaacaaacgccatgtcttatttcagcgggttcattaaagaaaactcttttacagggaaagaaagcgacgctttaaaagtgaaattcgaacagttcgccaagcttcatcccgatgttgaagggatctttaccggttcaaaggacgggaagttcatccgctacccggatcaaaagatgccgagcggatataatccggtagagcgggactggtataaaaaagccgctgaacacaagggcgaagtcgttatcacagacccctacaaaacggcgtcaaccggaacggtggttatcaccatcgccaagatgcatgaggacggctccggcgttgtcgccgtcaatatgaaaatcgaagagctcattaaagcgacagaacgcgtaaccatcgggaaaaaaggctttgcctttatcacgagcgctgataaaaagtttgtcgcccacccgaaacatgatgcgggcacagatgtcgaaggcagctgggcggaaaaggtatatgcgaatgacaaaggaacattcaaatacacgcttgacggcgaaaagcagatggctttcgcgaccaacaagctgaccggctggaaaatcggcggaaccatgtatatcactgaattaaaagaagcctcacagcctgtgctgaatgccgctctgattacgttgggcgccagcatcatcattggcgtgcttctcatgattctcatcatcagatcgatcacagggccgctccgcgaactcgtttcctctgcgaaaagcatcagcggcggcgatctgacgcaaaaaatcactgtccgctcaaaagatgaaatcggacagctcggaacaagcttcaacgatatggctgaatcgctgagctctttaatcagcgtcattcagacatcggttgaaaacgttgcttcttcgtcagagcagctgaccgcgagcgcggatcagacaagcaaggcgacagaacatattacatctgcgatcgaacaattttcaaacggaaatgaaagccaaaatgagaaagtggaaatcagtgcgcagcagctgactgacatgaacagccgattgcatgaaatgtccaaagtctcagcatcgattacagaatcatccattcaatcgacggacattgccggtacaggcggagagcttgttcaaaaaacggtcggacagatgaattccatcgatcattccgttaaacaggcggaatccgtcgtgaaaggacttgagagcaaatcaaaagacattacggcgatcctgcgggtgatcaacggcatcgcagaccagacgaatttgctcgcgttgaacgcggcaattgaagcagcaagagccggtgaagccggaagagggttttctgtagttgccgaagaagtgcgcaaactggctgagcaatccgcgtcatcggcaaaagaaattgaagcgctcattcaggaaatcgtcaatgaaatcggaaagtcgctggacatgttccgggacgtcaaccgtgaagtacagtcgggactcaccatcacagatgaaacagatacaagctttaagcagatttatgacatgacaaacgaaatcgcgggcaagctgcagacgatgaatgcggcagttgaagagctgtcagaagggtcacagcaagtcgcgggagcggttgaagaaattgcagacgtatcgcgtgaaagctcaggaagcattcaagacattgccgcttcggctgaagaacagctcgcttcaatggaggaaatcagttcttctgcggctacgcttgaacaaatggctgaagaactgcgcgatttaacgaaaaaatttaagattgactaa

SEQ ID NO: 3148 - DNA, 1986 bp, Bacillus licheniformis
atgaaaaagatattggactggcttaaacgtccgtctatctcaaaaaggctgtttttcagctttatattggttttaactttgccgattttggccttatcctatagtgcgtaccaaacggcgggaagctctcttgaaacggaaatcatgagaagcgcacgcgataatgtcgaacagctgaatgagatcatagaccagaatatcggagagaaagaggaggccgtctcctttttcagcggcttggtaaatgaaaagctttatcaagaaaaagagaacgcatcactcgtagaaagactcgagcagtacgccaagctgaatcaggatgtggaagcgatctacacaggttcaaaagacggcaagttcatccgatatcccgccgagaaaatggcgaaaggctataacccggcggacagggactggtataagcaagccgttgaaaataaaggaaaggtgatcatcacaaacccttataaaacagcgtcaaccggaacgatggtcattacgattgcgaagcagacggaggacggctcaggagttgttgccgtcaacatgaaaatcgatgagcttatcaaagcgacagagcgcgtcaacatcggaaaaagcggctttgcgtttatttcaagcaatgacaaaaaatatgttgcccatccgacaatcgaagccggaaccgaaggcaaaggcgactgggttggacaaatgtacggcagtgagaaaggcgattttcaatatacatttgaaggaaaagaaaagaaaatggcttttacgacgaacaagctgaccggctggaaaatcggcggaacgatgttcacagatgagatatcagaggccgcccagcccgtcttccacatggcgataatcattttggcagcggcgatcgtgctcggcggcattctcatctactttattatccgcggaatcagcaagccgttaagcgagctcgtgtcatccgcaaagagcatcagcggaggcgatttgacgcaaaaaatcgaagtccgttcaaaagacgaattcggtcagctcggtacaagctttaatgaaatggccgaatcgctgagatctttaatcagcgtcatccaatcatcagttgacaatgtagcttcttcatctgaagagcttcatgccagcgcggcgcagacaagcaaagcgactgagcatattacaatggccattgaacaattttccgacggaaatgaaagccagaaagaaaaagtggaagcgagctcgcatcagctgaatgaaatgaacaacgggttatatgacatgtcaaaaacatcagctgcgattaccgatgcgtcgctgaaatcgactgagattgccggcaaaggagaagagcttgttcaaaagacggtcggccaaatgaactcgatcgatcggtctgtcaagcaagcggaagcggtcgtcaaaggacttgaagccaaatccaaagatatcacaagcattttgcgcgtgattaacggaatcgccgatcaaacgaatctgctggcgctcaatgccgcgatcgaagcggcaagggccggggaatcgggccgcggcttctcggtagtggctgaagaagtcaggaagctcgccgcacaatccgccgactcggcgaaggaaattgaacatttaattcaggaaatcgtcaaggagatcgacaactctttgaacatgttcaaatcggtcaatcatgaagtacagtcaggacttcgaatcaccgatgaaacagagacaagcttcaaaacgatttacgatatgaccaatgatatcgcaggaaagctgcagaccatgaatgccgctgtcgagcaattgacgcaaggttcccgccaagtcgcgggcgcggtcgaagaaatcgctgatgtatcgagagaaagttcggcaagcattcaggacatcgctgcttcagccgaggagcagcttgcctccatggaagagatcagcgcctcctccacgacattggcggagctggctgaagaactgcgtgatttgacacagaaatttaagattgaatag

SEQ ID NO: 3149 - DNA, 1983 bp, Bacillus licheniformis
atgaaaaagcttttaaattggacgaaacgtccttctatttctaaaaaattaattttctcatttatattcattttaacaattccgatcttggttctttcggttacttcatattttacggccagcagcacgctcgaggatgagattttgagaagtgcgaaagacaatatcgatgaactgaacgacattattcagcaagatatcggcagcaaggagacttccattgcgtatttcagcgaatggattgatcaaaaagcgtacaaagagaaaggccagactgcaattaaacaacggtttgagcagtttgcaaaacagaatcccgacgtcgaactcgtcttcaccggatcggaagatagtgtttacgcacaatatccgaatgctccactgcccgacgggtatgacccggtagaacgcgactggtacaaacaggctgtccaggaaaaagggaaaacgattgtaactgaaccttatgagtctgcatcaacggggcatatggtcgtcacgatcgccaagcagaataaagacggttctggcgtagtcgcccttgacttgaacattgacaagctgatcaaatcggcaaacagcatcagcatcggaaaaaccggatatgcattcatcatcggcgaggggaaaacgtatgtcgcccatccgaaaattaaagccggcacagaagcagaagctgatctgacagagcaaatgttcagcaaagagagcggcttgttcacctttaatgaaaaaggcaaagaaaagaaaacggtcttcacgacaaacaaactaaccggttggaaaatcggcggaaagatgaatacagcagagattaaagacgctgcccagcccgtgcttcacatggcagtcatgacattggcaggcgcgattattctgggcggaatccttgtttactttatcgtccgcgcgatcagcaagcctttaaatcaactcgtctcttctgcaaaaagcatcagcgaaggagatctgacacaaaaaatcgatgtccgctccaaagacgaattcggccagctgggcacaagcttcaacgaaatggctgactcgttgcgctcgctgatcagcacgattcaagaatcggtcgacaatgtggcatcttcttcagagcagctgacggcaagcgcggaccagacaagcaaagcgaccgagcacattacattagccatcgagcggttctcaagcggcgctgaaagtcaaagcgaaaaagtcgaagaaagctcacagcggctcagccaaatgaatgagaagctgaatgaaattgcaggcgtgtcagaatcgattacagaatcctcgggtaaatcgacggaaattgccgaaacaggcggagagctcgtccaacaaaccgtcgggcagatgaactcgatcaacaggtctgtcaaacaggctgaacaggttgtcaaagggcttgaagcgaaatcgaaagatatcaccgcgatcctgcgcgtcataaacggaatcgccgatcaaacgaatttattagctctgaacgccgccatcgaggcagcgcgggccggcgaatcaggcagaggcttctcggttgtcgctgaagaagtcagaaagcttgcggctcaatcagcgggatcggcaaaagaaatcgaagcgctgattcaggatatcgttaaggaaatcgaacattcgctcaacatgttcaaatcggtcaaccaggaagtacagtcaggactcgaaattaccgaagaaacggaatctagttttaaacacatttacgacatgacaaacgaaatcgcaggcaagctgcaaacgatgaatgccgccgtagagcatttatcaacaggttctcacgaaatatccgatgcggtcgaagagatcgccgacgtatcgcgtgaaagctctgccggcattcaggacatcgccgcttcagcggaagaacagctggcttccatggaagaaatcagctcatccgctgcaacgctcgaacagatggctgaagagctgcgcgatttaacgaaaaagtttaagatttga

SEQ ID NO: 3150 - DNA, 738 bp, Bacillus licheniformis
atgataagtgtttcgggctaccggctccgtcctgaggatatcgaaaaactgaatgtcagtcagacgcagagagacatcgcaaaccggatgctggccatgccgtccggatatagatacggttcaatctcagaactgttatttgagctgagattcagagagcataccgtcaaatcggccagagagctgatcaacagcggagcgaagtttgccaccttttcaaagacatacgggaatgaagagttttggagggtgacgcctgagggggctttggagttgaagtacagggcaccggcttcaaaggcgattcgaaatatttttgaaagcggcccttcttatgcttttgagtgcgcgactgcgattgtcatcattttttatatggcgcttctcaaaacgatcggcgaccagacatttgaccggaattatcaaaggatcattttatacgattggcactatgagcggctgccgatctatacggataaaggaaacgactaccttccgggagactgcctgtatttcaagaaccctgaattcgatccctcaagaccgcagtggcgcggagaaaatgctattttacttgaaaataatctctatgcggcacacggcctggggatcttaagcggcgaaacaatcattgaaaaactgaacgggctgagaaagcctcatgcacagacgtccgcctatctgctttcccaagtgacgcgggttgatattccggcattaattcaaatgatcagatag

SEQ ID NO: 3151 - DNA, 1056 bp, Bacillus licheniformis
atgaatcagttcatggaacgcctctctttgtcaaagcctgtggtccaggcgccgatggcgggcgggccgacaacaccaaggctcgccgccgccgtatcagactgcggcggcttaggcagccttgcatccggctatttgacgccggaagtgcttcaacaacagattctggaaacgaaaaagctgacatcagccggatttcaagtcaacctcttcattccggaaaaacgggaaaccgtcacccgggaagaatatgaaaggtggcaagagaagatacctttggcgcggtcggcttcacccgtgacagatgagaaacaagattgggacgatttttacgagaaaatagaaatcattctcaaagaaggaatcagcgccgtttcatttacgtttggccctccgccggctgatgccgtcaaggaactgaaaaaccgaaattgctgtttaatgggcaccgccgtttcagttgaagaagccgtgctgcttgaagaactggggatggatgtcatcattgttcaaggaagtgaagcgggcggccacaggggagccttcttgaaaacgaagggagagcctgctgtcggctcgatggctttaattccccaagcggcagatcatgtgtcggttccagttatcgcagcgggcggcatttttgacaaaagaggtgttgctgcagcttttgccctcggcgcacagggcgttcaaatcggtaccgcttttttgacgtgcgaagaaagcggaacacaccctgcctacaaacaaaaattgttcgaagcggttgaaaccgacacaagcctgacccgtttgttctcggggaagccggcaagaggcatcgtcaatcagtggatggaagacagacgccaggaagaagctgaagcgctgccttatcctctgcaaaacacgctgacgcaaccgatgagaaaacaggcgaagcttgacgggaatacggataacatgtcattgtgggccggacagagcgtgcgggccaccgtcgagcaaacgacggtgaaggagctgatggatcagcttgtgccggccgatgtgctatctgatcatttgaattaa

SEQ ID NO: 3152 - DNA, 402 bp, Bacillus licheniformis
atgttgaaaaaaatacagattcaaacaaaccggcgcgatgaaatgcttgatatcacaaatgacgtccaaagattcatctcagaaaacgatgtttccagcggcgctgttatcgtctactgtccgcatacgacggcgggtataacgatcaatgaaaatgccgaccccgatgtcaaacgcgatatgctgagaagattcgatgaagtgtatccgtgggaacatgagcttgaccgccatatggaagggaatacagcggcgcatttgaaagcgagcacggtcggggcatcgcagcatatgattattgaagggggcaggcttgtcctcgggacttggcagggcatatatttctgcgagttcgacggcccgaggcaccggacgtgctattttaaaattttagccgattaa

SEQ ID NO: 3153 - DNA, 1683 bp, Bacillus licheniformis
atggcaagggcatggtggaaagaggcagtcgtttatcaagtgtatccgcgcagttttatggattcgaacggggatggcgtcggagatatcaacgggatcagagagaagcttccgtatatcagggagctcggggcagatgccatttggatttgtccggtctttgattctcccaatgcagataacggctacgacatcagggattatcaaagcatcatgccggaatttggcacgatggacgactttgacgaactattaactgaagcgcatcagctcggaatgaaactgatcatcgatcttgtcatcaatcatacgagcgatgaacatccttggtttatcgaatcaagagcagagcggaattccgggaaacgggactggtatatttggcatgacggaaaggacggaagcgaaccgaacaactgggaaagcatattcggcggctcagcctggacttatgacgaaaaaacagagcaatattatctgcacctttttcacgaaaagcagcctgatctgaattgggaaaacagtgatatgcgaagcgctctttatgacatgatcaactggtggcttcaaaaaggaatcgacggattcagggttgacgcgatttcgcacattaagaaaaaagaagggctgccggatctgccgaatccggaagggcgccctttcgtgccttcatttgcttatcatatgaatgtcgaagggattatggcgttattgcaggatgtaaaagagaatacgttcgccgggtatccacatatcatgacagtcggcgaagcaaacggtgtcagcgctgaagaagcggaggactgggttggagaaccaaacggtatattcagcatgatttttcaatttgaacacctcgggctttgggatattgaaggcggagaacccgatatccccgaactcaagcggattttgtcaaactggcaatctgctcttgaaggaaaaggctggaacgcgctttttatcgaaaatcatgatcagccccgggccgtttcagtttggggagatgacgggaaatacagaacagtcagcgcgaaggccttagctgcaatgtattttttgatgaaaggcaccccgtttatttatcaagggcaggaaatcggaatgacaaacgcgattttcttagatatagacgattatgatgacgtctcgattaaaaattattaccggattcaaaaagaaaagggccgctcacacgaagacatcatgaaggcggtatggaaaaagagcagggatcacgcgcgcacgcctatgcaatggactgatcggccaaatgccggctttaccaaaggggaaccgtggctgcgcatgaacgaaaattacaagctgatcaatgtcgttcatcagcagcatgacccccggtcggtctatcatttttataaacggttaatcgcaatcagaaaacggtatgacgtcttcatcgacggatcatataaactgcttctggctgaggatcggcagatttttgcatacttgcgaaagcttgaagaagaaaccgccatcgtgatcgtgaacctcagcgcacgccaggcgttttaccatcatcccgcatatccgttatgttcgaacggactgctgctgtcaaacttggatatcaacgcgcacaagcacctcacatctttcatgatgagaccctatgaggcgcgcgtttatttgatcagacaggaaatcggcgatttgtaa

SEQ ID NO: 3154 - DNA, 591 bp, Bacillus licheniformis
atgaaaaagaaaatgaacacccaagatgcgattgttgaagcagcatttactcttattgcccgacacggcctaaaaggcacgagcctttcaatgattgcatcggaagtcggcatttctaaaccggctatttactattatttcccttctaaagaagagcttatcgattatctatttcacatcgtatttgatgatcacaatttctctgaatatttttcaatcaataagtacacgaaggagaactttaaaaaacgattaataacagacggcgtacgctattttgaagagtataaacataactctcctgctttaaaagtggtacacgagtttgttttaagtgcagcacaaaaaccaagatatgagaaaaagcttaaatctatcatggaacaattcttagaaggttttgaagcattgctttcctacggtgtcgaactcggtgtcatctcttctaaaaacaccaaagtgaatgcacactcccttgccctgatcattgataatttgggtaactttatgattttaggaattgagatggattataaaaaagtatgggaaacagcagtcagtaatgtaatgaaaggcagtgaaagattttga

SEQ ID NO: 3155 - DNA, 675 bp, Bacillus licheniformis
ttgaatcaggaaacgattattggattgtctaaaatagagaaaaccttatattggatcattccaccggttttaggagctgttcttggatggtttttgcctgttatagccgattgggtattgaccattccaatcgttccttttaaagggcctttggaatttatcacatcactaaacagtttctgggtttcaattatcgctgcatttatcggaatcgttgccggcctatttttttcacaatatattttcactgaaattcttcaagtgttcatttctgatcaaaacgtgaagctgttgtttaaagagaaagaagaagtgattgagaaaaaagacatttctgcaatttatcttgagaagaaggatcttgttgttcttggtcataagggcactgaattgtaccgtgaacaacttgaatcaaagagagcgctagcagaaagtgcttttaaacatcacggctataaatgggcagacgaagatccctttaagaatgagtatcaacgctgggttgcggatcaccccgattttccctcgcatatcaatacgctacttttagccagagaacgagctttactggataataaacatgaagaggcaaaaattctgcgcaaagacctggcaaagcttggagtggttattcaggatgaagataaacggcaatacgtaaggatggtatcgtaa

SEQ ID NO: 3156 - DNA, 786 bp, Bacillus licheniformis
gtgaaaaacaaccatttgctaaaatccattctgctatggggtgccgtatgcatcatagtgctggcagggccgctctcagcatttgccgcttcgtcatcaaacccgtcggataaattgtattttaaaaacaaaaaatactacatattcaacaatgtatggggagccgaccaggtcagcggctggtggcagaccatttatcataatagtgattcagatatgggctgggtgtggaattggccgagcaatacaagcacggtaaaagcttatccgtcgatcgtcagcggctggcattggactgaaggctatactgccggaagcggcttcccgacgcgattgtcagatcaaaaaaacatcaacacgaaagtcagctattcgatcagcgcaaacggcacatacaatgccgcatatgacatttggctccacaatacaaacaaggcgagctgggattcggctccaaccgatgagattatgatctggctcaataacacaaacgccggacctgccggttcctatgtcgaaactgtatcgattggcgggcacagttggaaagtatataaaggctatattgatgctggaggcggcaaagggtggaacgtgttttcatttatcagaacagcaaacacccaaagtgcgaacctgaatattcgggatttcacgaattatcttgccgactccaaacagtggctttccaaaacaaagtatgtcagcagtgtggaattcggtactgaagttttcggaggcacaggacaaattaatatttccaattgggacgtaacggtccgctga

SEQ ID NO: 3157 - DNA, 1290 bp, Bacillus licheniformis
ttgaatatcctgaatctcatactcgtcatacttttaattgcagctacggcttttttcgttgtcgccgaatttgcgatcgtcaaaatccgcggcacaaaaatcgatcagctcgttgaaagcggggataagcgggcgattgcggccaaaagagtggtgacaaatcttgatgaatatttgtctgcctgccagctcggcattaccatcaccgcattagggctcggctggctcggagaatcgacattcgaacagatcattcacccgctttttgagttatttggcctgcctgagtccgttttaagagtggcttcggttgttgccgcatttatcatcattacatttttgcacgttgtggtcggcgagcttgcgccaaaaacaattgcgattcaaaaagcggaagccgtcagcttatggacggcgaagccgctcattttgttttataaaatcatgtttccgtttatcaaactgttgaatggctcggcccggctgttaacgaagctgttcgggttccattctgttaaagagcatgaagtggcgatcagtgaggaagagctgcggcttatgctgtctgaaagctataaaaaaggggaaatcaatcagtctgagtataaatacgtcaacaaaatttttgaatttgacaacaggctggcccgggaaatcatggtgccgagaacggagatggcgacgcttatggccgatcaatccataaaagaagcgattgaaaccgtcattaatgaacgctacacgagatatccggttattaaggacgataaagaccatattatcggaattgtcaacagcaaggacttgtttaaatcgtattttctcgacgagacgattcctttaactgacttaatgaggcctgtcatcagggtgattgagaacataccgatccaggagctcttgattcgcatgcagaaggaacggatccatatggccattcttgttgatgagtacggcggaacggcagggctggttacggtagaagacatattagaggaaatcgtcggagaaatcagggatgagtttgatcaggacgaaatgccgcacattataaaaaaaggcgaacatcattatattatggacggaaaagctttaatcgacgaagtgaatgacctccttcatatcgcgatagaaaacgaagaagtcgatacgatcgccggctggcttttgacgcaaaagatggagctgaaaaacggggacatccttaaaactgaggggtgcgaatttaaaattcttgatgctgaagatcatcatatccgtttcatcgaagtgaaaaaaacggatttttaa

SEQ ID NO: 3158 - DNA, 681 bp, Bacillus licheniformis
atgagcatgattttttacttgttaacatttgctgcattaggtttatcgatttgggcacaatttaaagtaaagagcaactttgaaaaatattcaaaagtagaggcgtcaagcgggagaactggagccgaagtggccagacagattctcgaccgaaacggcctttacgatgtcccggttgaaccggtaagaggaaccttgacagaccattatgacccgacagcacgcgttgtgcgcctgtccgaacccgtatactacggccgttcaatcgcagcggtttccgttgcttcccatgaatgcggacatgccctgcagcaccaggagtcatacggcgcacttgttttgaggcataagatgtttccggtcgtgaacttttcttcgggagtggcgccgtttttgtttatcggcggaatgctgctcggaagcctgaatctgatcggactcggcatcatattgttttctgcggccgtattcttccagcttgtgacattgcctgttgaatttaacgcaagctcccgggcaaaaaggatcatcgtttcagaaggaatgatccgcaacacggaggaaagaggcgtcagcaaggtgctggatgccgcggctctgacatacgtcgcagcagcgcttgtttcgctgtttgagctgctgcgcttcgtcgcaattttcctgtccggtcgtaatgactaa

SEQ ID NO: 3159 - DNA, 1235 bp, Bacillus licheniformis
gtgaaagtaacggatcaggaaaaagaacagttaagcacggcgatcgataaaatgaatgaagggcttgatgcgttcattcttctctataacgaatcggaaaaggacgagcagctgatcgaatttgaagaagaaacggcagagatgatcagacaagcgattgaacagcacgggaaagttagcaccaatcaaaagttaaatgcgatcatcaaagaaattttatcattttccctgcggaaagacggtgaagaagcatgaaatcaaaccgtgtattcatcgcatggctgaggtggcctatatatgtccgcatcgcaatcattatccttttattgatcctccttttcggtcagctgatcaccttcgtcgagccgcagcagttttcaaatgtttttgaaggcatatggtgggccctgatcaccgtgtcctcagtcggatacggcgattttgtccctaaaacagcgctcggcaaaatcgtcggcatgctcctgattttaataggggcagcgtttgtcacggcctattttgcaacgatggcgacggccgctttcagcaagcagcagcgctacgccgaaggcaaggtgaactacagaggcaaggggcatatgatcctgatcggctggaacgagaaatccaacaagctgatgaggacgctccaggccgccgattcaaacaaaacgatcgtcctcattgatgaaacgctaaaggaaggtcccctgatggaaaacattcatttcatcagaggacacgcagcggatgatgccacactgcaaaaagcgaatatcgaagaggctgaaatcgtctttataaccgccgatcagcataaaagcgaaatatctgcagacatgcagtcggtcttaacattgctggccgttaaaggcttgaacccgtcggtgtattgcgttgtagaaatcttgacggaaaagcagaaaaaaaatgccgagcgcgccggagccaaccaaatcatcagtacggcggaccttttaaaaacggcgatgctgcagcattttctcattaaagaccagcttcctgatccgctttttacggaagcggatattcatttcaaagtccatcgggttccgcttccgaagacgatggagggcgcgtcttttcaagaagtgatccgccattttatgaaggaagacattttcatcatcggtgtccaccaaaaagacgggcctgtgctgtctccttctttttcgtacaagctacagccgacggaccagctgctgtccctttaa

SEQ ID NO: 3160 - DNA, 405 bp, Bacillus licheniformis
atgataagcttaccttctgaactggaaaaccggtcgttttctctttatcacctcgaacagacgctgaagcctctcggctatgtgatcagcggcggctgggaatatgaccgcggcttttttgactataagattgatgatgaggacggatacctgtttttgcggattccgtttgaggcggaggacggacagcttgattcgcaaaatgcgacggtcaagctcggcacgccgtttttgcttcgccatgtctatcaggaagcgctggatgactacgtcgttcaggggaatttccgcgcatcttttgaccagtttgccgaaccgaaagaaaaagacgccgatattcccggcgtctatgaaaagcttggccaatcgtatgtaaaagaactcgaagaggcgcttctttcttaa

SEQ ID NO: 3161 - DNA, 567 bp, Bacillus licheniformis
atggcatttgtattggaaacattgtttctcatcttaacgggcattgttctgctgagaatttcgggaagaaaatcaatttcgcagatgacaattgccaccaccgtcgtcatgatatccatcggaacgatcatcgttcagccgattatagaagacagcatttttaaaacggtggcagctgcatcgatctttatcatcgtccttctgttgatcgagtacttgaaaatgaaatttgatttttttgaaagcctgattgcggggaaagccgttgtattgatcgaaaacggggagctccaggagcagaatttaaaaaagcaccgcctgaccgtcgaccagctggaaatgaggctccggacacaggggatttcaaagttagcggatgtgaaaaacgtaacgctcgaatcaaacggccagatcggctacgagttatcggatgatgccaagcctttcactatgggagagtataaaaaattcctgcgcatgcaaaacaacctgcagcagccggaggacaacctgtttaaagaaatcaccgaaggccatctgaacgaacctgataagcaattgcgctaa

SEQ ID NO: 3162 - DNA, 477 bp, Bacillus licheniformis
ttgaagaaaggaaaaatagtaacggctgtgatagtgtttctcgttatatatgcactgttttcactcgcaggaattttatttcccgtagaccgggaatggtatgagtcattaaacaagccggattggacgccgtcaggccgtttgatcggaaccgtctggagcgtgctgttcgccttcatttcattagcagcggcgctcgtgtatgctgcatatgacatgagaaaagcagctgcgccattttggatcatgctgatcatcaactatgtgtttaaccaggcattcagctattttcaatttacgcaaaaaaacttacttgctgccgcagtcgactcctttttcgtagccattaccgctctttcgctcacctttatcacacggcgaattcacaaaacggcggccattctctttatcccttatgtgctgtggagttttttcgcggcttatctcgcgtttacgatttacgggatgaatcattag

SEQ ID NO: 3163 - DNA, 510 bp, Bacillus licheniformis
atgaaccactttctgcaaactaaacgcatcggcttttctttatggaagaaagagaatttgaatttggcaaagacattgtggggaaatcgagatgtgaccaattatctaacagcagacggaatcatgaccgaaggcgaaataagaaaccgtttgctgctggaaatcgaacaatataaaacacacggggttcttaaaacaagcaacaatgaattcgtcggatgctgcggccttcgcccctatgacccggaaaatgatgtgtacgagcttggttttcatctcgtccgttcagcttggggtaaaggttatgcatctgaagcggctgaagccatgattgagtacgcatttaacaaaatccgggcaaaaaagctgtttgcgggacatcatcctgaaaatacagcttcacgaaaacgattggagaaattaggattcgtctacatacatgacgaattttatccgtccaccggacttcagcatccgtcatacgaattaaaacagcctccgggacaataa

SEQ ID NO: 3164 - DNA, 1353 bp, Bacillus licheniformis
atgacgcatgtccgttttgactactcaagagcattgccattctttaaagaacaggagcttacatatctgcgtgacttcgttaaagtcgcccaccataccattcacgaaaaaacaggtgcgggcagcgactttttaggctgggtggatcttccgactgactatgataaagaagaattcgcccgcattaaaaaatgcgctgaaaaaattcaaaacgattccgatgttttgctggttgtcggaatcggcggttcatacctcggcgcaagagcagcgatcgaaatgctgaatcattcattttacaatgtgctgccgaaagaaaagcggaaaacgccgcaagtgattttcatcggcaacaacatcagctcttcttacatgagagacgtgatggatcttcttgaagacgctgatttttcaatcaacgtgatttctaaatcaggcacaacgacagaaccggcgattgctttccggatcttccgcaagcttcttgaagaaaagtatggaaaagaagaagcgaaacgccgcatttatgcaacgacagataaagagcggggcgcattaaaaacgcttgctaatgaggaaggttttgaatcattcatcattcctgacgatgtcgggggccgcttctctgtgctcacagcggtcggcttgcttccgatcgcagtcagcggagccgatatcgatgaaatgatgaagggcgcccgcgatgcgagcaaagacttctccacatcagagcttgaagacaatccggcttatcaatatgcggtcgtcagaaacgtcctttataacaaaggcaaaacaattgaaatgctgatcaactacgagccgggccttcagtacttcgcagaatggtggaagcagctctttggtgaaagtgaaggaaaagacgaaaaaggcatttacccttcttcagccaacttctctactgatcttcactctcttggacaatacgtacaagaaggaagaagagatatgttcgaaacggtgctgaacgttgaaaagccaagacacgagctgacaatcgaagaagcggacaatgatcttgacggcttgaactaccttgccggcaaaacagtcgacttcgttaataaaaaagcgttccaaggcacaatgctcgcgcacacggacggtaacgtgccgaacctgatcgtgaacgtacctgaaatgaacgcttacacgttcggctatctcgtgtacttctttgaaaaagcctgcgcaatgagcggatacttgctcggcgtcaacccgtttgaccagcctggagtggaagcatacaaagtcaacatgttcgcccttctcggcaagcctggcttcgaagagaaaaaagcagagcttgagaagcgtttgaatcaataa

SEQ ID NO: 3165 - DNA, 1164 bp, Bacillus licheniformis
atggataactttacatattggaatcccacaaagctgatattcggccggggagaagttgaaaagctggcagaagaggtgaaacaatacggccgcaatgtcctgctcgtatacggcggaggcagcattaagcgaaacggtttatacgatcaagtcatttcaatccttgaaaaggcgggcgcgaccgtccatgaactgcccggcgtcgaaccgaatccgcgtgttgccactgtgaataaaggagttgcgatctgcaaagagaacgatattgactttcttttggcagtcggcggcggaagcgtcattgattgtacgaaagcaattgctgccggagcgaaatacgacggcgatgcgtgggatattgtgacgaaaaaacatattccggctgatgcgctgccgtttggaacagttttaacgttagcagcaacaggctctgaaatgaactcgggatctgtgatcacaaattgggaaaccaatgaaaaatacggctggggaagcccgctcgtattccctaaattttcaattcttgatccggtcaacacgtttaccgtcccgaaagaccacacgatttacggcattgtcgacatgatgtcccacgtgtttgagcaatattttcaccataccgaaaataccccttatcaggaccggatgtgcgaatccctgcttaaaacggtaattgaaacagctcctaagctcattgaagacctagaaaactatgagctgcgtgaaacgattctgtatacaggcaccattgcgctgaacggcatgctatcaatgggcgcacgcggagactgggcaacgcacaatatcgagcacgctgtttcagccgtatacgatattccgcatgcgggagggcttgcgattctgttcccgaattggatgaagcacacgctttccgagaacgtcggccgctttaaacagcttgccgtccgtgtttttgacgtagatgaaacaggaaaaaccgatcgcgaagtggcgcttgttggaatcgagaaactgtctgaattctggaccagccttggcgcgccaaatcgtcttgccgattatgacattacagatgagaagcttgatctcattgccgacaaagcgatggcaaacggcgaattcggccgctttaaaacgctgaataaagacgatgttctgtctattttgaaggcttctttataa

SEQ ID NO: 3166 - DNA, 237 bp, Bacillus licheniformis
atgaatgcacttcaacgtattgcattggttttaacgatcatcggagcaatcaattggggactgataggattttttcaatttgacttggttgcagccatttttggcggccaagggtctgctttagcacggaccgtttacgcgcttgtcggaatcgcaggtctgatcaacctcggacttttatttaaacctgctgaagagaccgccggcgaagacgccaaacagccggaaatgcgttaa

SEQ ID NO: 3167 - DNA, 390 bp, Bacillus licheniformis
atgacagcaaagtttgaagtaggcagtgtttacactggtaaagtgactggattacaggcgtacggagcgtttgttgcattagatgaagaaacacagggactcgtgcatatttctgaagtaacacacggtttcgttaaagatatcaatgaacatttggcggtcggtgatgaggtgcaagtgaaggttctttccgtagatgaggaaaaaggcaaaatcagcctttctatccgcgctacacaggcagctcctgaacgaaaagaaagcaagcctagaagacaaaaggctgttcaagccgaagatacagctgctccacaaggattcaacactttgaaagacaaacttgaagagtggatcgagcagtccaacagaaaagatcttattaagaagtaa

SEQ ID NO: 3168 - DNA, 1173 bp, Bacillus licheniformis
atgaggacaacttatatttcaaaagcagcccagcagatcaaaccgtcaggcatccgcaaattttttgatcttgcgtccacaatggagggcgtgatttcattgggagtcggagagccagattttgtgacggcgtggaatgtaagggaagcgagcatcctttcccttgagcagggctacacgtcttatacggcaaacgcgggtcttctttctctgcggaaagagatcagcgcttatctgaataaacgttttcatctggattatgctcctgatgacgagctgattgttacagtcggagcaagccaggcgcttgatattgcggtcagggcgatccttgatcccggagaagaagtgctgattcctgagccttgttttgtcgcttatgaagcgcttgtctctttggcggggggaaaagcggtccacattcatacgaacgcagagcgcggatttaaagcgagcgctgcagattttgaagccgttctgactgagcgtacgaaggccatcattctttgcaccccgtctaatccgacaggctctgtttattcaaaaaaagaactggaagagatcgcggcttttgccgaaaaacacgacctgattgtaatagcggatgaaatttacgccgagctgacatacgatgaagcgtatacaagctttgcggaaatcgccggaatgaaaaagcggacgatattgatatcgggtttttctaaagggtttgccatgacaggctggcgcctcggatatgtcgcagctcctgcatatttaagggaccctatgctgaaaattcaccagtactcgatgatgtgcgcgccaagcatggctcaatttgcggcggaggaagcccttaaaaacggcctcgaagacgttgaaaagatgaaaaaaagctaccgccgccgaagaaacgtgtttgtggattcactgaacgaaatcgggcttgactgccatcagccggggggcgctttttacgcgtttccatccgttaaaaaaacgggcatgagctcagagcagtttgcagaggagctgctcatcagcgaaaaagtcgccgtcgtcccgggcaatgttttcggtccgagcggcgagggctatatcagatgttcctatgcttcctcgcttgaacagcttcaggaagcactcgtcagaatgaagcgctttgtggagaaggtcggtgcagtaaaataa

SEQ ID NO: 3169 - DNA, 501 bp, Bacillus licheniformis
atgaagctaacagaaaaagaaacagaaatattggaaatattagaggaaaacagccgcctcgaacctgaaacgattgctaaaatggcgaacatttcacaggaagaaacaaaagcgattattgaaaagcttgaaaaagaaaaggtcatcatcgattattctgcaatgatcgactggcgaaaagtcgacggccatgaaggcgtgacagcgatgatcgatgtgaaagtaacgccgaagcgcggcgtcggatttgacgaagtggccgagcggatttatcgttttcaggaagttgaatccgtttacttgatgtcaggcgtatatgacctgtctgttgtcatccgcggcagaacgatgtcggatatttcgcatttcgtgtccgaaaaattatcgacgcttgaatcggtcgtgtcgacaaccacccactttattttaaagaaatacaagcatgacggtaaagtttttgactccggtgatgatgacaaaagaatcgtggtgtctccttaa

SEQ ID NO: 3170 - DNA, 822 bp, Bacillus licheniformis
atgctgttaacaaaaccttctatcgagaccattcaaggggtcaatatatattatgaacattacgagaatccaggcaagacatcgctcgttttaatacacggttttctttcttcctcgttttgctacagaaaaatcattcctcttctgaaggatgagtttaatttagtcgccgttgacctgcctcccttcggccaatcagaaaaatccagcacctttgtgtatacctatcaaaacatggccagggtggtcatcgaactgatcgaaaggctgaagattaaagacgccgtgcttgtcggtcattcgatgggcggccagatttcactttatgcgataaaggaaaggcctgaactgttcaaaaaagtcgtcctgctgtgcagctcaggctatttaaagcgttcgccccgctcgcttattttcgggagccatattccttatttttatttgtacatcaagcgctggctgtcaaaacagggcgtcctgaaaaacctcatgaatgttgtctacgacagctccctgatcgatcaggaaatgatcaacggctacctgaaaccgtttctcgatgatcaaattttcagggcgctcgcacgtcttatcagacaccgggaaggcgatttatcaccggatgatttgaagaaaatcgagacgccttccctcttgatctggggcgaagaggaccgcgtcgtcccggtacagatcggaaaaaggcttcatcaggatctgcccaattccattttctactccctgcaagaaaccggacacctcgtccctgaagaaaatccggattatgtatcagacaagattgccaatttcattttgacatga

SEQ ID NO: 3171 - DNA, 264 bp, Bacillus licheniformis
gtgatcatgatgaaagaaagtcaggcagcagcacaaatcatacacatcataaaggaatgggatccgtttcaagccggacccgatttttatgaaacggaagcggccgaaatcgttcaggccgtctatacggaagacgatgcagagcggctgggcgaagcgatccagaccgtttttgaagtatcgtttgatcagacgctgcctctgtcggaatgcaaacggctggctgaacggctccttgtgatcaaagacagcagttcgtgctga

SEQ ID NO: 3172 - DNA, 498 bp, Bacillus licheniformis
gtggaatggagcagcatccttgagtgggcttttcagcgtcatctcaacccaatgagctggtatatacgcccgctctttctggtggcgctcgcgtacttttgttataggcggtcttggaaaggtgtcatcattacttttttgctgatgacgagcagcatggtttggtttcccgtccccgagcggatcaatccggagatgcaggccgttttggattacgagctaatgcttttgtccaacccgctttcagccgtggtcacgctcgctttcatgatgggttttctcgtgttgattggcacggcattttggaagcgctccttagggtgggggcttgcggtattgaatgtgacgctgatcggaaaggtcgtgctgtcagtgatgctgacgggggaaaacggctgggcgcccctcggaaataccgtctttggattgattctcgtcaacggcatcgggctgctgctgatcgcctggagggagaagcggggaaaagccggccgttag

SEQ ID NO: 3173 - DNA, 1164 bp, Bacillus licheniformis
atggattttaatacagagcataacagacgcgggacccagtctgtaaagtgggacttaacacaggaattattcggcgtaaatgacgcgcttccaatgtgggtggctgatatggattttcgtgcccctcagcctgttattgacgcccttcagcagcgcctggagcacggggttttcggctatacatctgcaaacgcgggcacgaaggaagctgtcaccgattggctcagccgccggcacggatggaatactgaaccggcgtttatcaccttcagcccgggcattgtaacagcgctcgcccaagcggttcaggcgtacacagagcctggcgagcgggtggtcgtacagccgcctgtatatacgccgttctttgatatagttgaaaaaaacgggcgggttgttttacataatccattaatcgaaaaagacggccgctatgaaatggatttttccgaccttgaaaaaaagcttgtggaaccggatgtcaagctgttcattctttgcaatccgcataacccttccggccgttcatggtcgaaagaggaactgacaacgcttggcgaactctgccttaaacacggtgtcacagttgtttccgacgaaatccactcggacctgatgctgaacggactgaaccatacgccgttcgcctctttatctccggaattcgcggatatatccatcacatgcattgcaccgagcaaaacgtttaacttggccgggttgcaggcctcagccatcatcatacccgacaaagcgaagagaaccgcctttgcaaaggtcatgcagcgtcagggactgcattctttaaatacatttgcgattgcagccatcgaggcggcctattcaaaaggcgaaccatggctcgatcagcttatcccatacattgaacgaaatatggaagaagtccgccgctttttggcagaggagctgcccgaggtccgcatgatggagcctgacgcctcttacttggcatggcttgactgccgaaagctcggattgtcggatcaggacatcaaacggcttctccttcataaaggaaagctgattcttgagccgggaccgaagtacggaccgggcggagaaggattcgtcagaatgaatgtcggatgttcgctctctgttgtaaaagacggactccgacgtctgaagaccgctttttcgtaa

SEQ ID NO: 3174 - DNA, 201 bp, Bacillus licheniformis
atggcgccgtttctgattcagtttatgctctattttcctgaagacaaaagagaatatatcccttcttttattacgctggccgttttctttatcatcgcgatcgctgtattccggctgattatcaagcattccaaaaaagaagctgaaaaagcggaaaagctggaaagagaattgaatgaaaccatccataaacgctcttag

SEQ ID NO: 3175 - DNA, 390 bp, Bacillus licheniformis
gtgaacaaccaatttcaagtcggagatcgcgtaaagggcttttataaaacaggcgtctacatcggcgaaattacggatgttaaaccgatgcactacctggtcaaaatcctcgccgtgctgacccatccgaagcagggcgaccttcatcatcccaatcgggcagacgtccctttttttcatgaacgaaaagcgctcgcttacggtgaacagacgaatatcccgcaccgcatggtgaagccgttcgatgaagctgtaccggattatgcggattcgctccgctcagctttgagccgcttaaaaacggatctgcaaaacgattcgtccgaatacgcggcaaaatcgcttgagcttattcatgggcttgaaaaagaatatttcctgcacaaataa

SEQ ID NO: 3176 - DNA, 618 bp, Bacillus licheniformis
ttggaagcgagcaccttactgattattgattttgaatttacaatgcctgagggaaagtatcacccgcaaaattttttcccggaaatcatagaagcagggattgtaaagacggttcatgatgaggtggttgagacgttttcaagctatattaagccgaagaagttccctaaattaacgaggcgctgcaaaaattttctcagcatcacgcaggaacaggttgaccaaggcatcacgtttaacgcgctgattgaaaagctgcgggagcttgatcctgaccgaaacagcgtcatcattacatggggaaacatggatatgaaagtgctgaagcaaaattgcatgttcaaccatgttccgtttccgtttaaaggagagatgagggacctttccatggagtacaaggaatttttcggcgacaaaacattgacgaatttgtggaaggcagcggaagagtacggcgattcaggaacgggaaaacagcataaagcgcttgacgacgcgatgacaacgtataagttgtttcggctcgtagaacgggataagaagtatttggaaaatccgaagccgacgacgatcggcgaacgggttgacctctcaaaagtctttccgcacgccacataa

SEQ ID NO: 3177 - DNA, 1278 bp, Bacillus licheniformis
atgcagctttcgcatttcatttataatgaaagggaattcaaattttttaagaaggtgattcgcatctctgtttataagaaaaaccttgtgatcatgtggtttgcgaattttttcgtggccgcaagctccacaatggttctgccgtttctttccctctatattgagacgcttggcagctattcggacggatttacggcaaaatggagcggatacgttttcggcgtcacatttttgatggcctttttagtttctcctttttggggaaggttcggcgataaacacggctataaaaaaatcctcttgatcacgggtaccggaatcggcacttccattcttctcatgtcccttgtctcgtccgtatacgagctgttttttttgagaatggcgatggggctcgtcaccgggttcattcccacttcccttgccatgatttcggctcagacgccgaaaaaaacggctggcaaagtgctcggcacgctgcagatgggcacggtctcgggaggattattcggccccttgctcggcggtctgctcgccgatcgcgtcggttttacatatacgtttttcattacgtcatttgcgatttacagcgcggttttcctcgtgtttgccggagtgcgcgaacggcccctgaagcagaagcgcgatgcttccgccgggtacacgagaaagcaggttctgcagacgattctgcatcagcgtccgctgatcacggcgatgatcctcaccgctgtgattcaagtgggaaacttcagtgttcacccgctgctcgctttatacgtcagcgaactgcacggaactcataatctcgcatttttttcagggctggctttttctgcacccggccttggaagcctgctcgctgcgagaaaatggggcgctttgggccaccggttcgggcccggaaaaaatattgatgattcctcgcggctggcttgccgcggttttgcgttatcccgcaaggaacttacatctcagtatgaaacgcttgtgttcttccgctttctgttcggaatcgcacttggcgggatgattccctgcatcaccgctttaatccgggttgaatcaccggggcctatacaaggagaagtgcttggctataatgtaagtttcagatttttaggcaatgtcatcggcccggtgctcggcggcatcctttccagctttttcggtatttcttccgccttttacgcaactgcagtcctctttttcggcggagcatgccttctgatgttccaaaggtcccagcaaaaaaaatcagaggcgaaagcaagctga

SEQ ID NO: 3178 - DNA, 1779 bp, Bacillus licheniformis
atgaagcctctcgatcaggtgctcgatgagaagatcaatataaaggatatcggccttgtacaaaacagctacatgtatgacagggacggcgctctgatttccgaaatcgtttcagatcaccaaaaccgggtattcgtcccctataaagatatccctgaacatgtgaagcagctgtttctgacttcggaggaccgtcatttctttcagcataaaggctttgattttatcgggatggcccgggccgccgcagccaatgtcaaaaaaggcggcattgatcagggggccagcacgattacacagcagctttcgagaaacttgtatttgaaccatgaacgaaccttcgaccgcaagttcactgagctcctgtattcctaccagctggaaaaaaagctttcaaaagaagaaatttttgagaaatacttaaacaccatctattttaatcacggggtctacggaattggatccgcgtcttctttctatttcagcaagcctttgaaatctctcagccttgccgaaacggcgtttatttgcgcgatccctaataaccctacattatatgatcctttgaaacattttgactacacaaaaacccgccaaaagcggctgcttgaagggctgaaaaaagcgggcgtgatcaccgaaaaagaatacagcaaagccgttaagcaaaaaattacgcttaacgtgaaagaaaagaaagacgactatcccgactatacgacctatgtcaacgaggaattcaccaaattggtgtccgctacggaagggtttgacgaacggctgaaaaaggcaaaaacaaaagaagaaaagaaaaaaatcgaaaaagagctgtcaaaccgaatcagctccctcacgacaagcggaatcaaaatttatacggcgctcgataccagcatgcaaaaccgtgtcgtccagcaagtgaagaaccgcctcccttatgaaggcgtacaaggcggagcagtggtgatcaaccaccaaacccatcaaatcgtcgccatgtccggcgggaaaaactataaaaagtacgattataacctggcattccaagcatacaggcagccggggtcatcaattaagccgctccttgactacgggccgtacattgaagaaacgggtgcgacggcaggcagcatgattgacgcaagcaaattttgcagcaaggaatactgtccgaacaacttcaacgaaagaacatacggaaccgtgtcgatcaagacagcctttaaatattcgtataatacaccagccgtacgtatgctgaaccgggtcggcgtgcaaaaaggattcagctatttaaaaccgttcggattcgataaaatcgttcaaaacgactaccgtcttcctgctgcgctgggcggatttacatggggcttctcaccgctggagatggctgatgcctatacgaccttcggcaataacggaagctacacatccagccatgcaatcacaaaggtgacggatttaaaaggaaaaacgctatacaaatggaaagacaagccgcagcaagtattcagcatgcggacaaacagccaaatgcgcgaactcttagcagcggttgttaaagaaggaaccggaaaaaaagcgaatttcagcggcggatatgtaggaggaaaaaccggaacatccaacgggtacagagacctttggtttgtcggattgacggatacatacacaatgagtgtatgggtcggaaaagaggcaaaaggcactgtcgagtacctgcatcacgcgggacctcaacttttaatctggagaggaacgctgcaatacgcatcttaa

SEQ ID NO: 3179 - DNA, 408 bp, Bacillus licheniformis
gtggcggatatgcccgatcgaatcgttctgtttgacggcgtgtgcaacttttgcgacggagccgtgcaattcattatcaaacatgatcctgaaggcttattttcattcgcttccctgcaatctgacgccggagggaatctgctcaagcaatatcacctcccttccgatcattttaacagctttattttgatcgaaaacggccgggtatatcaaaagtcaacggccgccttgcacgtggtgaaaagcctcccgggcctttggcgggccgcttccgccctcttgatcattccccggccgcttcgggacgccgtctacagtgtcattgcgaaaaaccgctacaaatggttcgggcaaaaaagcgagtgcaccgttcccggtcctgagatcagaaaacgatttttatcataa

SEQ ID NO: 3180 - DNA, 558 bp, Bacillus licheniformis
atgaaaaatacgtatgtaacaggcttttttccttttatcgcaattcttcttttcagttcatctcttgcgatttcttccgttatctatgccatgcagatgctgtcttctctcggcatctacaaagggatgctcgaatttttctctgagagcggcatccggatggctttgtttgctgtgtttacgctgatttttttcatggtattttccgctttgaagctgattgccaatacagtgacagagcttgcccttttattttttgccaaagatcctgaaggagcgaatctgagaaaaatcaggatcggttctgccgtgtatctaggagcaagccttttatcttttatttttgtccaatatgccgcgggaattgcagcgctttttttactcgcaactctcgtatattttatttttatcgtttatacgatccacagcacgctttcattcatgtcattaatcggttttattatgtttgagctgctgttttggtttacgtttatgatcgggacggtgtatatcatcatcaagctttataacagcgtcatggcgagcctgcccgtttga

SEQ ID NO: 3181 - DNA, 1602 bp, Bacillus licheniformis
ttgaaaaaaacattaaaactgcagacacggttaacgatatttgtctgcgtcgtcgttttaatttctttattgatcgcgttttttatggtcggctctgagaccgcaaggaacattcgggagcaggagcagcagattgccctgcagacggcggagatggtcgccgaggctccgattacggcacaatcgctggaaagcggcgaatacgaagagctccggaaatacaccgcccgcgttcaaaaaatcacccagactgaattcgtcgttgtcatggatatgaacagcatccgcaaaacccaccccgatccgaataaaatcggaaagaaatttgccggcggggacgaaaaagaagtgctgaagggccgacgccacattagtacggcaaaaggcacgctcggtgaatcactgagggctttcgttcccatctataataaaacgggcacccaggtcggagcggtagcggtcgggatcacccttaacgagattgagcagatcacccagcaaaatctccgccctctatatacggtcatcgtcctcagcatcgtcgccggaatcatcggagctgtcatcgtggcgaggaaagtgaaaacgattatgttcggcatggaaccatatgaaattgcaacgcttttgaacgaacgaagcgcaatgcttgagtcgacaaaagaagggattctcgccgttgatcgaacaggaaaaatcaagctcgccaatgcggaagcgaagcgcctgtttcaaaaaatggggatcgaagagaatccgatcgaccgggatgtactcgacatcttgccaaacagccgactgaaacaagtgatcgaaacacagaagcccgttcaggaccgcgatgtcagaatcaatggccttgaacttgtctttaatgaagttccgattcacttaaaaaagggaaacatcgtcggagcgattgcgacattccgcgacaaaaccgaagtgaagcacttagctgagcagctgtccggtgttaaaatgtacgcaaacgcgctcagggcgcagtcgcacgagtttatgaacaagctccacgtcattctcggtcttgttcaattaaagaactacgacgagcttggaaactatataaaagacattgcgatctatcagcagtctgaagcgagcggaattatcaaccatatcaaaaactcggtactcgccggctttttgctcggcaaacagagctatattcgggaacagggggcctcgttggaggttcattgcagcacgaggattccggatacagccaacacagcggtgattcacgatttgatcaccgttatcgggaaccttctcaacaatgcccttgatgccgtttccgccactgagaagaaaaatatttcgatttcattccgccatcatgacggacagcttgatattgaagtcacggatacgggagtcggcatatccaaggaggaacagcagaaaatgtttgaccaaggcttttcaacaaagggccccaatcgggggttcggtctttatttcgtcgaacaaagccttgaaaatttaaatggacatatcgtcgtgacgagcgaaaagaatgaaggaacgacattcagtctccgcattccgtatgaaccaaaggaggatgaccatgattga

SEQ ID NO: 3182 - DNA, 708 bp, Bacillus licheniformis
atgattgatgtattaattgttgaagacgacccgatggtaagagagctgaataaacgttacctcagccaagtagagggatttcagctgaagggcattgccgcttcttttcaagaggctctcaccttcctccgggaagagcatatcgatctgatcctgctcgacatttatatgcctggcaggaacggcgtcgaactgctcactgagatcagacgccaaaatcaagctgtcgacgtgatcgtcatctcagcggccagtgaaatggatgttgttcaaaaaacgctgcggttcggggccgtcgattacttaatcaagccgttcgaatttgagcggtttcaaagcgcgctcactgattacaaacggaagcagcagctctatgctagcaaccggaatatcagccaaaaagagctggattttgaactttttcaaaaaaaacgcgcgcccgaaaaggtacatttgccaaaagggctgaccaaaagcacgctgaagctcatttggtcaagcatcagatcgtttgacagcttgacgttcacaacggaagatttggccaatcacacggaaatctctcaagtttcaatccgcaaatacttaaagtttctggaggaaatcgaagttctcaacgtagaaatggcctacgggacgatcggcaggccggttttccaatataaattaaatacaaatgacttgaatgtgattaaccaatatctataa

SEQ ID NO: 3183 - DNA, 262 bp, Bacillus licheniformis
ctcgccatcattgccggacaaggatttatcgcgctcgccgcgcttgtgttcggtaaatggcagccgatcggagccctgttcttcagcttcgctcaaagcttaagcatcatcgggttcacgcttcccttcttcaaaagaaataccaaacgtctatatgctgattgcgccttacgtattgacgattctagcgctggccggatttagcggcagagccgaagcgccaaaggcaaacggtatcccttatattaaaggaaaacgataa

SEQ ID NO: 3184 - DNA, 537 bp, Bacillus licheniformis
ttgaataaatcagtcataccttctttaattacggttggaaactttgtttcgggcatctcttcaatactgcttgcattcagagggtatttattcttagccattatatttgttctgatcggcgctatcttggacagccttgacggcatggccgcgcgcagattaaatgccgtcagcccgtttggaaaagaattagattctttgtctgatattatcactttcggagtcgccccggccatcatcacctattcaatcgttttttatgatgctccgatcttaggccttccttcgacattgttattccctgtttgcggagcgcttcggctggcgcgatttaatattcaatcagagaaccaggattattttacaggccttccgatcaccgcagccggaacgattctggtatgcttaaaccttttctcagaaatcctgggcaaaaagccgttcattttgatcatgctgttcctgtcctttcttatggtcagcaaaatcaaagtcatcagcctgaaggggaaaaaactattgaagaaagtgagctag

SEQ ID NO: 3185 - DNA, 483 bp, Bacillus licheniformis
atggagttggcaaaagaattgatttcccaatacgggtatttcgcgatattcgggatgcttgtcctcggaattgtaggcctgccgatacccgatgaagtcatgatgacatttgtcgggtatctgtcttctattcatatattaaactatgagatgtgccttttgatcagtttttcaggtgcgatatcagggatgctcatcagttattttctagggaagaaaatcggtaaaccgctgctcgataagttcgggaaatggatcggtctgacgccgaaaagactggacaccgtgcaccgctggtttgaaaaatacggcccgtggacgattcttttcggctattttgtccccggaatccgccatgtgacatgctatctgtccggcatgaacgagatggacatgaaaaggttcctgatttatgccggatcaggagcttttatttggtgtcttgtttttattacgatcggatacacaatcggcgtgatttaa

SEQ ID NO: 3186 - DNA, 792 bp, Bacillus licheniformis
ttgaaaaagcggctttaccggtttttgattgagttgacgaataaaaagggcgtgtcccggatgctggaaaagtttgctcagtcaaagctaagcaaacctctcatcccctcctatatcaaaacctttcatattaatacagaagagatgctggaagatgtccgctcttttaacagcctgcacgagctgttcatcagaaaattaaagagcggtgcacgcccccttcccgctgatccaaacagcctggtcagccctgtggacggcgtcatcgaagaaatgggcaccatcacgcgcgacaagcaatttaccgtcaaacaaaaactctattctgtagaagaaatgatcggacgatccgagatcgtgaaccgctatgtcggcggaacctatatcattatctatttaagtccgagagactaccacagaattcacagcccggcttacggcacacttgaaacgcagtattcgctgggaagcacgtcttaccctgtgaataaaatcggtttgacatacgggaaatcgccgctgacaaaaaactaccggatgatttccgaatttaagcatcaatatgggtccgccctgcttgtgaaggtcggagcgatgtatattaactcgatcgtgatgctccaggagtcaaaagaatggcgccgaggcgacgaaatcgcatatttctctttcggctcaaccgttattctgctgtttgaaaaggatacctttattcctgatgaacgccttcacccctctcttcaagtcaaaatgggagaggtgttaggatctcttgccaaaagaacatcataa

SEQ ID NO: 3187 - DNA, 861 bp, Bacillus licheniformis; identical to SEQ ID NO: 484

SEQ ID NO: 3188 - DNA, 333 bp, Bacillus licheniformis; identical to SEQ ID NO: 485

SEQ ID NO: 3189 - DNA, 1344 bp, Bacillus licheniformis
atggaagcagcaaaagatttgaaaccgattacaaatcacggtcataaagaaaataaaaatattttccataagctgatcaactggaaaatcggcgtgattccgtttccgctatatattgcgcttgcgctgattgtttttctggcagcttactttaatgaattgccgaatgacatgctcggcggtttcgcggtcattatgattctcggcatttttctcggggatgtcggacagcgcattccgattttaaaagatatcggcggacctgccattctatcgctgtttgttccttcgttcttagtctttttcaaagtgcttaaccctgcatctatggaagcggttacaactttgatgaaaacgtcaaatttcttgtatttctacatcgcatgtttagtcgcgggaagtattttaggaatgcatcgcacggttctgattcaaggttttatgagaatgttcgttccgttgttggccgggacgatcgcagcggttgccgccggtattctcgtcggtctgttatttggctacagcccttatgaagctttcttctttattattgtaccgattattgccggaggcatcggcgaaggcatcctgccgctgtcactcgcctactcgcaaattttgggacagtccaccgatgtatttgtttcacagctcattccggccgctattatcggaaacgtcgttgccatcatctcagccggactgatgaaaaagcttggggaaaagcgtcctgaactgaacggtaacggcagactcgttaaatcgaaaaaagacgatgaaattttcaaccaaaaagaagaggagccgaaaatcgacttgaaattaatgggtgccggcgttttaatcgcatgttccttcttcattttcggcggtttggtctccaagttcatcgcgattccgggagcgatcctgatgatcatcgcagcggctgccgtaaaatatgcaaagcttctgcctgcaagcatggaaaaaggcgctcaccagctttacaagttcatgtcatcaagcttcacttggccgctgatggtcgggctcggcattctttatatccctcttgatgatgtggcgtctgttatttccctgcgcttcatcgccgtctgcgcttcagtcgtcattgccatggtgacatcaggctactttgtcggaaaattaatgaacatgtaccctgttgaatcagcgatcgtcacaggctgtcacagcggtctcggcggcacgggggacgtggccattctttcggcttcaggccggatgggtctgatgccgtttgcgcaaatctcaacgcgtctcggcggggcatccaccgtcattatggcgaccgttttactgaggttcttcacctcgtaa

SEQ ID NO: 3190 - DNA, 222 bp, Bacillus licheniformis
atgaaaaggaaagcttttgtcagcctaagtttattttgttcgctttttgcgggagcgtttatgatcaacagggaaatgacgcgtgaacagactccggggatcggaacacccgaaggccctcaataccgcggtgattacacgccgctacagacgggagcggaagatcagtccttaacgggaacagaaagagctccctttaaaccgagagaatatatcagagtt

SEQ ID NO: 3191 - DNA, 2403 bp, Bacillus licheniformis
atgacgtctttacatattgctattttatcgccttttgcactcgccttcttgattccgctattggcgaaaaacgtcagaaagattcatacaggctggtttgtcctgtttcttcctgttctattatttatttattttttccgcatgatcaaaatgacggcggatggcggaacattaaaggctgtactggaatggattccgtcctttgggattaactttaccgcgtacgttgacggactcggattgctattcgcccttctgattacagggatcgggtctttggttgtcctttacagcatctattatctgtctaaagaaagagagcagctcggaccattttacgtttatctgctcatgttcatgggggcaatgctcggcgttgttctcgttgataacgtcattgtactttatttgttttgggaattgaccagcatatcgtcttttctgctcatcggctattggtacaagcgggaaaaatcaagatacggcgcgacaaaatcgatgcttatcaccatattcggcggtctttccatgcttggaggcttcattcttctttacacgatcacaggttcattctcgattagagaaatgatcaaccaggttgatttaatttcggggcacggctttttcatcccggctctcgtgctggtgttaatcggagccttcactaaatctgcgcagttccctttttacatctggcttccggacgcaatggaagcaccaacgcctgtaagtgcttacctgcactccgccacgatggtaaaagcgggaatttatatcgttgcaagattcacccctgtgttcgctttttcaggggaatggttttggatcgtgtctctcacggggattgtcacgcttttctggggttcgttcaacgccgtcaagcagactgatctgaaatcgatacttgcattttctacggtcagccagctcggaatgatcatgtcgatgcttggcgtcggagcggccgcactgcattttcagcattttgaatactacatggttgcagtaatcgccgctatctttcacttgattaaccatgcgactttcaaaggcagcttattcatggcagtcggaatcatcgaccatgaaacaggtacgagagatatccgcaagctcggcggccttatgacgatcatgccgattacgtttacgattacgctcatcggcgcgttttcaatggccggactgcctccgttcaacggctttttgagcaaggaaatgttcttcaccagcatgctcaggattacgaactttaacttgtataacgctgacacatggggttttctctttcctgtgctggcttggatcggaagcgtgtttacattcatttactgcatggttctcttatttaaaaccttcgggggaaaatatcagcctgaaaagcttgaaaaacaagcgcatgaggctccaatcggcatgctgatttcgccgattgtcctcgtatctctcgtggtgatttttttctttttcccgaacattctgtcatacagcatcattgaacctgctgcagcgtcgattatgccgacccttttggacggtgacgaaaaattcaaggttcatatttacatgtggcacggcttttcgactgagctctatatgacgatcggcgtcgttgctctcggagttctcgcctatttgaccttgtcaaaatggcggaaggtctacggcctcttcccggaaacactgacgctgaacaagttgtacgacagctcgctgtcagggcttgaaaaaggctccaacaagattacaagaacgtatatgacagggtttctccgcgactatcttgtttatgtttttgtcttctttatcgtgatcatcggcggatcgctcgctgttaccgggggcttttcatacgatgtgaaaggcaatgcttcaatcggcgtctatgagctcgttctgtcagccgtaatgattgccgcaacctttaccaccgtttttgcaaggtcaagactgacggcgattatcggactcggcgtcatcggctacacgctcgcgctgttctttgtcattttcagggcgccggatctcgcgctgacgcagctgatcatcgaaaccatttcagtcgcattgttcctgctgtgcttctatcatttgccgaagctcagatttaagccgaaatcggctaggttcagggtcacaaatgcgcttgtatcggtcggcgtcggaactgttgtgacgctgctcgcactttcagcaaacagccagcgctcgcttgaaagcattgcatcgtattttattgaaaacagctataaactcgcaggcggccacaatatcgtcaacgtaatattggtcgacttcaggggatttgatacattgtttgaaattaccgtacttgtcattgccgctttaggaatatacggcatgatcaggctcagattggagaaaggaggggaagagcattga

SEQ ID NO: 3192 - DNA, 432 bp, Bacillus licheniformis
ttgaaaaaggttcagacgaatgatgtgatcctgcaaaccgttacaaagattgcatcctttatcattctgctcttttctttccatctgttttttgccggccataataacccgggcggcggttttatcggcggattgatgacggcgtcttcgcttgtccttctgctgctcgcctatgatttaaaaacggtgcagaacatcttgcccgtcaactttatctatgtggcggccgtcggcttattcatttccgtttccaccggaatcggctcatttttgttcggcgctcagtttctttcccacgcgtttgattactttaaccttccgctcttggggaaaacggagcttgccaccgcggtattgtttgatatcggggtttatctcgtagtggtcggcgtgaccatgaccattattcagacgattggggagagagaataa

SEQ ID NO: 3193 - DNA, 342 bp, Bacillus licheniformis
atggagattttaatgtcttttattgtaggaattctgttcatggcggcgacttatctgctgctttccaaaagccttttgagggtgattatcggaactgccgttctcagccatggcgtccatctgcttttgctgacgatgggagggttaaaaaaaggagcgccccccattttgaatgaagagtcgacaacctatgtcgatcctctccctcaggcgttgattttaacggcgatcgtcattgctttcggggttacctcgtttctcctggtcatggctttccgcgcctatcaagagctgaaaatggatgatatggatcaaatgaggggaaatgatcaacatgaataa

SEQ ID NO: 3194 - DNA, 1479 bp, Bacillus licheniformis
atgaataatcttgtaattctgccaatactgattcctttaatggccgcaattctgcttatctttatgaacaggtcgatcgtgctgatgcgtgcattcagcgccatatcttccattgcggcgatcgctgcggccgccgttcttgtgcagacagtctatacggacggaatccagaccttgtatctcggcgggtggaagcctccgttcggaatcagccttgtcgctgatcaatttgccagccttctggcgttaacgacagccattatcggatttctgacggttctttattcgtttcgctccatcggcgaaaaacgcgagcgtttcttttattatcccgccgtccagttcctgcttgccggagttagcggcgctttcttgaccggggacttgtttaacctgttcgtattttttgaggtgcttctgatggcttcgtatgtgctgatcgtcatcggcggcacgaagattcagctgcgggagtctctgaagtacatcgtctttaacattatttcttccgccctctttgtcatcggagtcgcttatttatatgcggttacgggcacattaaacatggcggatctgagcgtccggatcagcgaatcagggcaaaccgggctgatcacggtcatcgctgttttatttttgatcgtcttcggtttaaaaggcggcatcttcccgctgtatttctggatgcctggttcctattatgcgccgccagccgctgtttccgcactgtttggcgcacttctgaccaaagtcggcctgtacgcgatcacaagggtgtttacattaattttcacccaagacgccgcttttactcatcaattaatggtctggcttgcggcgcttacgatcatcttcggggtcatcggctcgatcgcctactgggatgttcaaaaaatcatcatctacaatattgtcactgcggtcggcgtcatcttgttcggcatcgccgccaatacgccggcttcaatcgaaggatctgtctactatttgattcatgacatgatcattaaaggagcgctgtttatgcttggcggagcgctttttgccctgacagggacaaacaacctgaaaaaaatgagcggcctgatcaaaaaccatcccgtgctcggctggatgtttatgatttcagccgtttcattggcaggtgttcctcctttcagcggattcatcggcaagctgaaaattgcagaaggcggctttttaagcggcgaattcgtgattacgctgctgatgcttttatccagcctgctcgtcttgtattccgtcatgaaaatatttatcaacggcttctggggggatgaacaggaagatgctccggccaaaaggcagctaaaaggctacatgtatccggcagcggtactgctctttctgtcgcttgccatcggactcggaaccgagcttatcgctccgtattttcaccaggcggctgatacgctcgtcaaccccgaaaaatatattgaagccgttttgaaggagtag

SEQ ID NO: 3195 - DNA, 477 bp, Bacillus licheniformis
atggcattacaaatattgttgaactttattcttgcgttgtgctggatgtttctgaacaatgactacaccgctgccgggtttgtcatcggttatgtgatcggattattctcgctctttctgatgaggcgttttttccgccgccgcttttacttgattaacatttgggcgatcgtcagactgctgtttatttttattaaagagctcgtgctggcaaacgtcagcgtattaaagacgatcttgtcaccgcggttaaaaaataagcccggcattttcgccttcaagacagatcttaaagcggactgggaaatcacgacgttggcaaacctgattacgctgacaccgggcacattggtcgtcgatatctccgatgaccgttcgattctttatattcatgcggtcgatatcgatgatgccgagaaagccatcagtgatatccgaatttcgtttgaagaggccattaaggaggtaagccgctga

SEQ ID NO: 3196 - DNA, 285 bp, Bacillus licheniformis
atgtttgaatttattttgcaattgtcactcggcattttggcggtctccacttttctgtatgtcctgagggtcattaaagggccgagcatcccggacagagtggtggcgcttgatgcgatcggcatcaacttaatcggaattacggctctcgtgtccatcctgttaaatacgacagcatatttggaagtcatcctcttgatcggcattctggccttcatcggcaccgtcgcattttctaaattccttgagaaaggagagattatcgaaaatgatcgaagccgctaa

SEQ ID NO: 3197 - DNA, 375 bp, Bacillus licheniformis
atgatcgaagccgctaaattgcttatcgccgttttgatccttcttggcgcactgatatcgttagccgcttcctttggaacgcttaggctgcctgacttatactcaagaatccacgccgcttcaaaaggagcgacactggggatcatcagcgtgctgctcggcgtattcttttacttctggtttctgcacggcttcattacggcaaaagtgctgctcggtatcgtctttgtatttctgacgtctcctgtaggcgcgcacctgatcgcaagagccgcgtataatacaggcgttaaaatggaaaagaaaaccgtacaggacgattatgaaggctacagaaattttctgattaaaaagaaggaagattcctatttataa

SEQ ID NO: 3198 - DNA, 390 bp, Bacillus licheniformis
atggaaacgaaacatacacttcttgaagcgttgggaatcgagttgaaggagtgcagcaaagaacggtgtgttgccgtcatgcctgtcgatgaaagaacgcgtcagcctttcggctatctgcacggaggcgcgtccgttgcgctcgctgaaacggtggcaagcatcggggcatatcagcatatcgatccaaaagagcaggcatgcttcgggcttgagatcaacgccaaccatattaaatcggtaaaagacggaacggttaaagcggtcgctacgcctctgcatgtgggcaaatcaacaatggtgtttcaaattgacatacgcgatgagcaggacagcctgatttgcacgtccaggtgcacgatggcggtcatcagccgtccttcatcgtaa

SEQ ID NO: 3199 - DNA, 639 bp, Bacillus licheniformis
atgagaagattacttgtgatcgatgatcatccggctgtcatggaggggacgaaggcaattcttgaaacgaaccaggactttgttgtcgattgcctcagccctgaagccagcgaacaatttctcaagaaacatgatttttctgcgtatgacctgatcttaatggatttaaatttgggtgaaatcaacggcatggacctatctaagaaaatccttgagacatgttcatcatgcaaaattatcgtttacacaggctatgaagtcgaagattattttgaagaggcgattcgttccggcatgcacggcgccatcagcaaaacggaatcgaaggaaaagattatagagtacatatatcaggttctggataataaaattgtcgtcgattatgattatttcaagcagttgattacacagcaaaaatcgaagtcaaacagccagcagacccagcacgacctcttgactgaaagggaatgcctgattttaaaagaagtcgaaaaaggctacacaaatcaggaaattgctgatgcgcttcatttaagcaagcggtcgatcgaatacagcttgacttccgtattcagcaagctgaatgtaggatcaaggacagaggctgttttaatcgcgaaatctgaaggtgtactctga

SEQ ID NO: 3200 - DNA, 1035 bp, Bacillus licheniformis
ttgtctcaaacgattcttgatgttttacctgtcagccaggcttatgtactggagttaaagagtgatggaaccgtagggttacttgaaaataatgcaaacgatcaagtttggaagccttatgaaaaagaagcttttagggctatcaccgacatcggcaaaatcgtcgaagtcgaccgtgggtttttgattaagatcggtgaacggggcgggacgtcttatgtcatgctgtgtttgtcggttttaaatacgcctaggctgacgcgcgatgagatttcatggcttgagacgctggcgttttatacgagcgtttccctggaaaacgtgctgaaaatcggcgagctgatggagcatctggaaaatgtgaaaaaagaagggccgaatccggcgtggctgaataaattgatgtttgcgattgaagagaagcagagatctgatttagcccgcgatctccacgactctgtcctgcaggatatgatttccttgaagcatcaaagcgagatgtttctggctgattttgaaaaagataaagtctgtacgaatcaaatccggcaaaggctcatcaatatgaatgagcaaatgtccgccgtcatccagacgacaagggaaacgtgccaggagctgaggccgcagctgttgtacgatctcggacttgtcaaagccctttcgaaactggcggcgcagcatcaggagtcctcatcgatcgataagatccgcctcaatacggaaaggttctcaaaggtgctcgacttggacacgcagttgaatttgtacagaattgtgcaggagcttttaagcaatgcggttaaacattcgagagctaatgaggttttgattatgcttgtctgcataaaagaaaaagttgttcttcattatgaagatgacggcattggggttgacccggacaagctttatcaaaacagcgcaagcatggggctgtcgggcattcgcgagcgcgtccgcgcactgaacggcagtctggatatacagacagcagaagggaaaggctttagggtcgccattgaaatgggattgtaa

SEQ ID NO: 3201 - DNA, 333 bp, Bacillus licheniformis; identical to SEQ ID NO: 485

SEQ ID NO: 3202 - DNA, 861 bp, Bacillus licheniformis; identical to SEQ ID NO: 484

SEQ ID NO: 3203 - DNA, 1143 bp, Bacillus licheniformis
atgcgtgttaattataataaactatctttaattattattttgctaagcctctccttggttccttatattatctatgtaaatctgcattctagttaccttggaatgacaatgcaatttaatgaaaaaaacgaataccaagtattcgagattgaaaaagggtcactggctcaatccctaggatttaaaaaaggggatgttattctagagataaatggtaaaagtgtagaaaaattaagggctgatgatgggaaattagctgatgaattaagtgatgttaaatcgatgatcgttgaaagagatggagagatagggtttgtagagaccggatatgaattggtgagttatgaaagtctatttctatttattattccaatgatgttttatctcctttctcttttttgtgtttatttcataataaaatcaaacaaaagattaaattcggcttcagcttttattttaattgtttttctgcttgttacatcaacagcttattcttgttctgtgggatctgcaaagggagatagtttaagtatctatataacaatgataacttttcaattcgttcctgttttgtatctccactatatttatcaatatttcaaggaaaaaggaaaagagtttttcaataataaaatatttcttttcctataccctgtgggtttattgaatttgctattggaaatttccagtgataatttgcagatttcttatagttccattaagctctttaacctggtatctttcttggttgttaccattatagcctttgctcttatcatttatggtgtaataaaaaataaagcttctgagcaagcctattttttaaggatacttgttatcacaaattttgttgcgtttattccgttcttaattttctatgtcattccatatgtatttatcggtgattatatattcccggcaatgtttgttgtaccctttttgttgattattcctttctcattagtgtatcaatttattgctaccaaaatatatgacattgaattcttattgggacgttttaaatactatggattgttagccattttaccaagcttgacagctgtaggtgtatttactttaacacaagaattaagtaatagtctaaatacagttaaaaacactatatttatctatttgaactga

SEQ ID NO: 3204 - DNA, 165 bp, Bacillus licheniformis
atgcaagatattgtgaactttttggtcgaaaatcctgaagtattaaaaaaagttgttgatggggatgcttgtttattaggcattgatccagaaaaaacaggagtagtggttgacagtattagattattaggtaagagttggggtggaggaggattttggatttaa

SEQ ID NO: 3205 - DNA, 870 bp, Bacillus licheniformis
atgaatcattttatagaccttgagattcccaatgcggacttaaatcggacgctgcacgcttttctagatgcaaaggaccagttgcatttcagcgagcttgctttttatcattaccaaagtttcggcggcacggacaccgatgcggcagaaacccttggagcaggcattgaactcttgattcttgcgtttgatatattcgatgatttagaggatgaagacagccccgatgaaccttggatgaaaatcaaccgttcagtcgcaatgaatgcggcgactgcgctttatacaataagcattaaagtgatcggttcggtgtcgaaagaaccggtgtttttcgaaaagctaatggaatatacacttcaatcgatgcagggacagcatgacgatctcagcaaccgccctgccactgaagatgagtgccttgacatgatcaagcgtaaatccggggcgctgacagccttgccatgcgtgctgggagctatgcttgctacgggcaaatttgacccgacggttgaaaagtacgcctaccagctgggcattgcttcacaaattgaaaatgattataaagcacttttttatgattcaaaaagcgatatcgccaagaaaaagcggacgcttgcgtatttatatttgtcaagaaaatttaaccagccgtcgattgatttgttaaaaacatttgaaactgaggataaaattgccgataaagaaataaaatgctataaagagaaattgaaggcagcaggcgtcactcagtatatgtatgttatgaatcagctcgctattcagaaatttaagaagggaatcggggagcttgagttgggggatatggagaaagaacgtttgatgtctaccctgctgaataacaattaa

SEQ ID NO: 3206 - DNA, 141 bp, Bacillus licheniformis
gtggaaaagcaacaaattgaagaattaaaacaactgctttggcggctagagaatgaaatcagagaaacaaaggactccttgcgcaagattaacaaaagcattgatcaatacgataagtacacatatctaaaaacctcgtaa

SEQ ID NO: 3207 - DNA, 338 bp, Bacillus licheniformis
ttgcttcctcctcattgcttttggatgcatccatatcaacacgtcagctgccggcaggtctatcccgaagttcaagtcagcgccttattgcgctcggcaaaagaagcggagagcttgatggctgacggacagagaattttaagcaggctttcagcctcgcgtactttggcccagcaaatcatgacggctgcccaaagcaaccaaaaaaataacgtgctggccgcgctcaggcaaaccggcgtccgcagccagcttgatgcctcattcgatcccgacggcattcgcatcatgctcatcagcccccgcagcagactattcctgctattgcgttggtctta

SEQ ID NO: 3208 - DNA, 1221 bp, Bacillus licheniformis
atgagggtattcgttgccagacagccaatattcaacagaaaagaacaagttgtcgcatacgagcttttatacagggaaagcgagaaaaactttttttccggtattgacggtgatcaagcgacaacagaattaatgattaacagctttttaaacattggaatcgataaattgacagaaggcaaaaggtattacgtgaattttaccgagggtcttttggcatcagggctgccgacgtattttgacccggatcagctcgttgtggaaatccttgaagatgtgccgattacccttgagcttatcgaaaggtgcaggcatttgaaaagcctcggctacacgattgcactcgatgatttttgtttaaagcatcgcgtgaagagggacttgctccatcagcttttggcatccattgatattttgaagatcgattttttcaaaacgacgcagcaggaaagacagagcatccttcgatcatgccgtaaccaccgcctgacgttcctcgctgaaaaagtggagacgcgaaaagaatatgagcaggctgtaaaagacggatttcatctgtttcaaggctatttcttcagcgagcctgtcgtgattgacggtcaggacattacatatcatttccacgcttattatgagctgctgcatgaattaagcgaagatcagcctgatattgaaaacgtcacaaatattatagagcgcgatttgtcgctttcttaccagctgctgaagctgttgaattctccagccaaccggccgatccaaaagattaaaagcatccgccaggctatcgtgcttctcggatttaaagaaatcaaaaggtggatcttcatcctctcatttaaggatttaacgaaaaagcaaaactccagcaagaacgaagtcgtcaagatttcgctgatccgcgcgaagctttgcgaattgctggcaaaaaaaacgaaccgccctcagccggcttcttatatgctgacaggcatgttttcatttatcgatacactgctgcacaaagaactaacggaagtcgtcagcgaactgccgctgacagacgaagtgggccaggcgctgctcggaaaagaaaatgattaccgaaaaatcttgcggcttgcaaaatcgatcgaacgaaacgaatgggaagacaacacaccggagacagaaggcttaactaaagatgaagcgtaccagtgctatcttgaagctgttgattggtgtcaaaagctcttataa

SEQ ID NO: 3209 - DNA, 1470 bp, Bacillus licheniformis
ttggaacaccgttttacagacgacagtctagcactacacacagacctatatcaaattaatatggcggaaacgtattggcgcgacggcattgatcaaaagaaagccgtatttgaactgtttttcagaaagctcccttttgacagcggttttgccgtttttgccggtcttgaaaaagcgattgaatttttgcgggatttcagatttactgaaagcgatttagtttatttaaaagaagagctgggctttaaagatgactttctcggctttttaaaagatatgagattcaccggttcgctttattctatgcaggaaggcgaaatcgtgtttggcaacgaaccgatcatgaggatcgaagcgcctttggctgaagcgcagctgattgagacggctctgctcaacattgtgaattaccaaacattgattgccacaaaagcggcgagaatcaaaagtgtgatcggagaagagacggcgcttgaatttggaacaaggcgcgcgcatgaaatggacgcggcgatgtggggagcaagagccgcgattatcggcggattcgacgcgacaagcaatgtccgcgccggcaagcggtttgacattccggtatcaggcacgcacgcccatgcgcttgtacaggcctatcgcgatgagtacacggcatttaaaaaatatgcggaaacccataaaaaatgtgtctttttggtcgatacatatgatacggtgcgttccggcattccaaatgcgatcaaagtagcaaaggaattcggcgatcaaattgaattttcgggaatccgcctggacagcggagacctcgcctatttgtcgaagaaagcgagagccatgctggatgaagccggatttacagatacaaaagttgttgcatcaagcgatcttgatgagtacacgattatgaaccttaaagcccagggtgcaaaaatcgacgtctggggcgtgggcacaaagctgattaccgcttacgaccagccggctctcggcgcggtttacaaacttgtttcgatcgaagaagacggaaagatggcagacacgattaaaatttcttcgaatccggaaaaagtgacgactccaggcttgaaaaaggtgtacagaatcatcaatcagctgaaccatcattcagaaggcgattatatcgctttggactatgaaaaggtcaatgaacaggagcggctgaagatgtttcaccccgttcatacgtttatcagcaagtttgtgacgaattttgatgcgaaagatcttcaccagccgatctttgaaaaaggcgagcttgtctatgagaatccgagcattcaggatattaagcggtatgttcaagaaaatctcagtttgctttgggaagagtataagcggatcagcaagcccgaagaatatcctgtcgatttaagcgaagcttgctggaacaacaagatgcagcaaattcacgaagcgaaaatcaaggcgaaaaaaggtctggatcaaggttga

SEQ ID NO: 3210 - DNA, 552 bp, Bacillus licheniformis
atgaaaaaagctcttatatgtatagattatacgaatgactttgtcgcagctgacggtaagctgacgtgcggggaacccggccgcaaaatcgaagacgccgtggcgcgtctcgcggatacgtttattcaaaacggcgattatgtcgtatttgcagtcgattcacacgaggccggcgatacgcttcatccggaaacccgtttgtttcctccgcataatataaaaggtacatcaggacaggatttatacgggaagcttgaaaagctttatcgaaaacacgaacacgatcagaatgtctattacatggaaaaaacaaggtactctgcttttgccgggacaaacctcgagctgaagcttcgtgaaagggatattcaagaactgcaccttgttggcgtatgcacagatatatgcgtgctccataccgcagtagatgcttataataaagggtttaatcttgtcattcatcaaaacgcagtggctagctttaacccggacggacacgactgggctctttctcattttgcaaacaccctgggagcctcagtgtcagattga

SEQ ID NO: 3211 - DNA, 402 bp, Bacillus licheniformis
gtgagcgaccaatcattggatcaatatttacagcagggaatgtacggaccacgcgaaacgaagccggatgaacgcagactgtttttaggctcgctgagggaaagggtcatcatcgcattgactaaaggacaagtgctgcgtccgaaggcataccgggaagtcatcgatgcgcttggctcaaaagcggatgcaacattattgcttaacggcgaaatcggctactctcatttatctccttacatcaaggagtccaataagcaaggcgtccctttttcgatcgtgtccgatcagcaatcggacactccccttggacttgttctcgcggcgcgtgaggccgtagagaaagaatcgatttatgttcaggacgatatctttgagcagtcggttttaaacaagagatga

SEQ ID NO: 3212 - DNA, 246 bp, Bacillus licheniformis
gtgacaaagatgaaaatcaggaaggcaaacatcttaaacgaagatcagatgatcacagacgtttacctccatgaaaataaaaaggaatttcatacgcttgtggctgtgccgcaactggagtggagcacgctgatttcctatgaggaagaaaaagcagaactcgccgaaaagcttgaccggtcattgtcgaaagtggctgagtcggatgcggccgagagctgtccaaaaagatcgtacaatgggtga

SEQ ID NO: 3213 - DNA, 222 bp, Bacillus licheniformis
atgccggcaattgtcggaccgatttttatcaggcgagtcgttgatgacagcgcagccttttttggagatgtgtttgcgatttccccgaagtgcacggattcctccggaggaggagcgggcacatttcaaacaggggactacggattgattcataacgatatcaataaaacgaccttcacagatgcggatgtgatggacggttcccagtcattgaacctgtga

SEQ ID NO: 3214 - DNA, 1137 bp, Bacillus licheniformis
atgaaaaaagccgggaggaaacaaagcttgttaaaatcaaaaacccatttttggacgctgcaaattttattggttcttcttatcatttatgtgtcgacaaaagtgtcttttcttttcgaaccgatcatcgtatttgcatcgactctatttactccgattttaattgcgggaatcttgtattttatattcaatccgatcgtgcggcttcttgagaaaaagctgccgagaacgctgtccattctgctgatctatttggtgtttgtggcattcatcgggtttgtattgtcagcagtcggtcctgtatttacaaagcaggttaccgatctgttcaacaacatcccctcctatgtgaaacagatccagattttcattaagcaaatgtcgaattcgcagtggttcacttggataatgaatcaggacttcgtatcggttgccaaaatcgaaagctcaatcggcgaatatttgacgagcctgcctgaaaatattacagggagcctgacttctgtattcggcgttgtgaccaacattgcgctcacggctgttaccgtgccgttcatcctgttttatatgctgaaggacggccaccgtttcccgaatttggctgtcaagatcctgcctgacaagtataaaaatgaagggctgaagatttttaaggatttgtacgagacgctggcggcttacattcaaggacagctcattgtttgtctgttcgtcggaacggcgtgcttcatcggtttttggatcgccggtgtgaaatacgcgctgattctcgggttgatcattgccgtgacgaatattattccatatgtcggaccgtttcttggagcggcgccggccgtcattatcgcatttctcgactcgccgacgaaagcattgatcgcgctgatcatcgtcgttgccgttcagcagacagacgggaatctgctgtcgccgctgattatcggccgccgcttgaatacgcatccgctgacgatcatccttttattaatcggcgccggaagcttcggaggcattctcggcatgatcctggccgttccggcttatgccctgctcaaggcttttacattgaatatcgtccgccttgtccgtttaaggcagaggtataaaaaagaaacggcggaaaatcctgaagtctga

SEQ ID NO: 3215 - DNA, 435 bp, Bacillus licheniformis
atgaagatcagcagcagatttacgatagccgtacatatgttatccttgatgcacgtccgaagcgaccatttgacatcagagcaaatcgcagacagcgtcaataccaatccggtcatcatccgccaaatcagcagattgctgaaaaaagcgggcttgattgaagtaaagcgcggcacaggcggagcgcacttattacgggatgccggcgccatttctttgtatgatgtctataaagctgtcgaagttgtcggtgaaggcgaactgtttcacactcacgaaaaccccaatcctgattgctgggttggcgcgaatatccaccaggttcttgagcttgttttattaaaagcgcaaacagccatggagaatatactcaaagaaatgtctataaaggaattgactgatctgatcatccaaaaaaagaatgcttctcagtga

SEQ ID NO: 3216 - DNA, 897 bp, Bacillus licheniformis
atgacgaatcatataaaagaaatcaactgggagcaaaacaccaactcttacattcagctcataccgaatattgagtacacaaaagtggaagacacttctttgacattacatttgctggtgtaccgcaatccaatggatgcgttatttaacaggaaaggcaatcaggaaacatacccgctgatcatttatttgcaagggtgcggatggggctggacaaaacaggatacatccgcctttatcccccaactggttccatttgtcgagcaaggatatgtcgtggcaagcgttcaatacagaggcagcggagaggcggtgtttccggctcagcttcatgatgtgaaaacagcagtccgctttttaaaagcaaatgccgcccgctataacatcgatcctgatagagtcggagtctggggggattcttcaggcggccatttggctcttttgcttggattgaccgaaggaattgaagaatttgaaggcccggacgaataccgtcatgtatcgagcaaagtcgatgcggttgcggactggttcggtccggtcgaccttctgtccatgagcaagtatccgtccatcttcgatcatgattcacccaattcaccggaatccaagctgatcggcggagctgttcaagaaaacagagtacaggcgaaacaagcgagtccgataagctatgttcacagggaagcgcctcccattctgattatgcacggggatcaggacgatgtcgtcccttatcaacaaagcgtccaattgtttgaagccttaataaaagaaggccatgatgcccttatgtataaaataaacggggccggacataacggttttacccaggctcataccctggacatcgtcaaatcgttcttccgcaaacatttaaagcctggaaaagcctga

SEQ ID NO: 3217 - DNA, 1464 bp, Bacillus licheniformis
atgaaaaaactggtgctgctcatgcttgttttgctgctcgtgtatccgcatgtatcgaaagcgggaggatttaaaggaggaggcggcaatccgggctactggttcgcgggagaccctgtagaacatcccgatcccgcaaaaccgccgattgtattcgtccatggattaaacggctcttcaagcgcttggtttgacgaaaacgacatggcggaacaggcctggaaaaacgggtatgacgcggcttttatcgatctccaccccgataaagacatgcaggacaacggagcgatgctggccgccaaactgcgcgaaatctaccagtatttcggccgcaaggtgattctcgtttcctacagcaaaggcggaattgacagtcagtcggctcttattcatcacaacgcataccattatgtcgagcgggtgattacactcggaaccccccatcacggctcacagctggcagaccttgcctacagcaactgggcaggatggctagccgatattttaggccagaaaaatgacgccgtttattcactccagacagggtttatgaaatcgttccgcgaccagaccgacaatcatcccaatcgattgaaaaccaaatattttaccctggcaggcaataaaatcggcgggttcggcagcgctttatttttcgggggcgtctatttaaacatgtttggcgaaaatgacggagccgtcactgaaaaaaatgcgagactcccttacgccacaaacctggatacagggaagtgggatcacttctcaattattaaaggaaacctcacgtttcctgtattcatgcctttactgacgattcaggcaaatgcaaatgaaactgcggccaccaaagaaaacttatcgtaccctttcatcagagggggggaaaatcatggattgagagaagaggagtttgccgttgaaaaaggcgtcaaggagataaccgttcactggctgagcaatcattcctcgggaaatatcaaattgacagatccacgcggcaagccgttcaaagatttttcaatcgcaaagacggcggatgtttttgaaggggggttcgtccattccgctgccatcaaaaatcccgcggcaggcacttggaagatcgcatcatccgtcaaacaaaaagaggcgtttttgttcattgtgactttcgattctcctctaaaccagcaaatcaaaaacgcagtcaccagagaatcgtcaaaccttgcgaatgttaaggcgtccgtccgctcgatccgctacgaaaacggaaaacaagccgagaaaaagtcgctgaaacctgcttctatcaatgcgctgcaaaacagcctgtcattcaaaaaagccggcatgtactcggtgacgatagacctttcaggaaaaacggcagacaactcgccgtttaacaggacgatcatccgctctatttatgtaaatgacaaaggggaaaagtttgaaaacagccctttgtccgattaa

SEQ ID NO: 3218 - DNA, 531 bp, Bacillus licheniformis
atgagaaacgtaactttaatggatgtattcacccatccaatcgcacaaaaatatttaactcgttccggtgtagctcatgctgtagcctgcgcctatcactcataccgcctggcggtgcgagctggagtagatcccgatatcgcgacaaaagcggcattgctgcacgatatcggccattatgaatggtacaccgacggagaatgggattatgaaaaatacaagcaaaacgacattcacgcaataaagggagccgagcgcgcccacaagcttctcatccgcctcggcgaagatcggaaagcggccaaagagattgctttggcgattctgcttcatacggattcctatttgccagaaggggaccttgataaaaacaagctgcagcaaatcgtcaaaaaagcggatgagctggacgaagagccgggcggaaaccaccattaccgcaaaatcgatcataagctggcgcttgaaaaaatccggaagcttgaccgcatggtcgatgaatccttatctcccatgaaaagaacggtttaa

SEQ ID NO: 3219 - DNA, 732 bp, Bacillus licheniformis
atgcatttatccattgttaccggagcgtcaaaagggcttggcgccgcgatggccgaagggcttttgcaaaaaggccatattgttcatgctgtttcaaggaccaagtctgatatcagtcatgacaggctgatccagcatgaggccgatctggcgcagctcgccgaaacagaaaagtggtttcggcaattctcagattctgtccaagcccatgattttgcttcgatcaccttgatcaataatgcgggaatggtgacgccgatcaagcgcgccggcgaagctgaaccggaagaactgaggctgcattatgacttgaatttgttagcgccggtgatgctcagccagctgtttaccaaatggctcaagccatataaaggcaaaaaatcgattgtcaatatatcatcaggcgcggccaaaaacccttataaaggatggagtgcctactgcagctcaaaagcggggctcgatatgttcacgaaaacattcggctttgaacaggaagatgagtctgatccggtgaagatgatttctttctcccccgggatcatggataccggcatgcaagaggttatccgttcatcatcgaaaaaagattttcatgaaattgaacgattcaaaacctatcaaacagaaggaaagctgagaagcacctcttatgtggccggcattctgctcgacctgcttgagaccgactttgaaaacggcagagtgtatgatattaaagagtttttgtaa

SEQ ID NO: 3220 - DNA, 453 bp, Bacillus licheniformis
atggcagtcatgctctccttctttcttttcactccgatcgcgaaggcggaggaaaccgataaagtcgatgtaaagccaaacgagtacgaaaagcaggatattaaaatcgagacggactaccttcaggaagaagaggcggaatacaaagaggaaatatcaattccagaagaactgaaggaattctcatttacagattcgaaaaaagaagatgctatcgaaaagctgaaaagcctgtccggaagcttcacgaatgaaagcaattccgtggcttcaaagctaaagcagcttgacctgtcattctcggcaaatccgtccttatcgggaagggaagatgactctgcggaaaaccggcaatccatcttcctgcccattctatacggtctgctgatccttctttgcatcgccggtctgttctttttgattccgaaagtcagcgggcagcagaaaaaataa

SEQ ID NO: 3221 - DNA, 3030 bp, Bacillus licheniformis
atgacggaacaacaaaaaagcacgctgaaaattatcagcgccatcgtcacgatcatcttgctgcccgtcctgttttttcatttcatcggtgagaacccgacgaaaaaggtatcgaacgcgacaagggaaatcgccgttgtcaatgaggataccggcgttttgaaagatgacggaaccgttgatcaagatgcgctgctgggaaacgaaatctcggcttccctggttgaccgtccggattataaatggacggtcgtcaaccggagcgcagcagaaagcggacttgcggagaagcaatacgatgcgattgtctacattccgtcggacttttcgcaaaacattttaagctacaaccatgagcgtccgcaaaaagcggagctggaattcaaaattcaggaccagctcgacgccgtcaacaaggaaaaagtccagcgcgagcttcaggacgcgcaaaaaacggtgagcaagaaaatgtcttccctgtactggcgctttgtcaaacagggagtcaaaaaggtcagaaaagagtttgacagcatcgtaaacaaagagtcggagttccaaaacgcgatgtacaatttttacaagccgagctccaacaatttagctggcgaagtagaaagacaaaaagagatgatcgacagactgaaagaatcgatcaatgaaacagaaggcacatcaaaagaacgcaacgcaagcgtcgaagaatccaaaaaacaattggacagcttcgtcgacaacgtcaatcaatacaaacaatatcaagagaagcagtcggagctgctgatggctgcacaagcggacagcgaaggccagattcaagacggacttacggtgattaaggaaaagcagtccagcgcaacaagccgtttcaatgaacaaatgagcggcatggccgcttcgttcaacggcttgcaaaatcaattcagcctgactgcgaactcttttcaaaacctgcaaacgatgcgggaaaatcaggtgcctttacaggcgattgggattgaaagtattcagaaacagttgatcgatgattatcaggatcaaacgaaactagagagactcagagggcttcaacctgatttaatttcaatgcggtcagaactggctaaaggctcagaagatgattcaaatgataacccaggtaatgaagataaagaagatcaggataaaggtgatgaagaagaaccaaaagatctaaaaattgatcttcaagaacagcaagatgaattgaagagcattgcggctgatcttaaagaattatcggacgggctaaaggattcctcagggaatgaaggcgacaattcaggagataaagaaccatctgccggagacccgaatcaaggacaagaaccttcccctggaaccggggaaaacggtcagcaaggcgacgcggcaactccttcagatgagataaatgatcaagggacgggtgaagatgatcaacagctgaaacctggaaacgaacaaccggaagatgagaatgctaagttaaaagaacaattgaacgaagccgcagcaaggcttgaaaaattggaagaagatcttcgtgctaaacaggacactcataacgaagagctggaaaaacagattgaaaacttaaataagaaaattagtagtctgaaagaaaacattaaggatttaaagcatgaaatcaaagatttgaaggtggatattgagaatctcaataaaaattttgatgtaatctatgatagtattaaaaaaattgaaaatggcatattagagtatcttccgaaagatagtgatcgaagagaaacgttaagcaaggcttttgagtcaacgattcgtacgagagatgtagaccagttacttaaatactataagttactttcaaactatgaaacaacgctatacggatcagtagattatacaattaagaacaatgtcatctccgcgaaaaaagacagcgtgaataccgtccttaaaatcggtgaaaccgaagcggaaaaatggagcaatttaaaaaacaacatgctgtctacaaatgaagatattgaaaattatacaaaagacatgaccgatttcgtcaaaagctacggcgatttcattaatgagaagcagactgacgtgctgaatgagctcagcacgatttcagacagagcaaatgccgtatctgaacagctgcgcaatccggaaggcgccggaacagcagtcatgcagggagatgcgacagatggaacgatggtcatcagcatgcaggatacgcttggaaatgacattttgcagctgtccaacatgctcggttccttgtcggaaacgcaatcaggcgtcatcgagtacacgagcaatattcaggaaagtgtaaacgatgttcagaaaaaagcggataccctgaattcaaactggggtcaaaatgtcgcgacgacaaagcttatccgcggagacgtatacggcattctcggaaatgcgttcggaggaaacgacggatatgtatacgatcatctggcaagtccggtgaaaatcagcggggatgttccagagtcaaaagcgcaaaacgtaccgccggtcgtcattctcgtgattgtgatgctttccagcttgctgatcggatatttcagccaccattatcaaaatgctccgctcttagtcaggggcgcgctgttcggcattttgaatatcattgtcggactgatgatcagcctgttcggtttgaacatttactcactcgcagacgatcaggccgtcatgtggtcggtctttacgatcttgctgcttgtcgcaagttcagccattatccggacggcgtttatgctgggatcgatcgcaggcggaatcgcgacagccgccatggtgctgttctatgtagcgccgctgcttgacctggcgatgccgaacttcagctttaacaatccggtatcaaccgtatatatgtcgattcagtacggaactggaagccagtttgcactcggaatcggagcattaattttaatcacgatcatcgcaattgctgttccttttattgtcgattttgcaaaatcaagaacagaagaaagcgagactgaccatgatgcgtaa

SEQ ID NO: 3222 - DNA, 4485 bp, Bacillus licheniformis
atgagtctgttatggattttttatcataaaaactatcaaaaaataaaactggatgatcagaacagccgcacgctcaccatcgggccggatttgaaacattctgtcacgattaagcatttttcatttgaaaaaggcccggtgacactggaaaagcagaaggactcagacgctttgaacgtgcagctgggaggggagacggtctcttctttaaagcttggcggaaaggcgtccgtccaaagcggcgctgaacagctgacgctctttttagccgaagaagccgacagcgttcctgcctactatttgggagagagacaggaaatcgtcatttcttccctcgatcaagaagcggatgtttatttcaatgaaacggattcattctttggagaaaaaggtacgttctctttcatccgcctcgacgggcaatggaatgtcctgccgaatgacgcgaaaatttatttgaacggagaagaagtgtccgcccctgtctccgtgcaaaatggagacgaaatcgcatttggactgaatattcttcgcatcgttgaagacgacctcttggaaatcgagggattcgggaagtttgatacgtctttggagaacattcttaagccgagctccgagacaaaaaataaatatccgcaataccgcaggccgccgagaatgatttacgacctgccggatgaaaaagtatccttcagcttcccggcacaggaaagcgacggagacaacagaggcctatggctgatgattctgcctccgctcgtcatgctgatcgtcatggggatcgtggcgctcattcagccgcgggggatctttatcatcgtttcccttgcgatgtttatgatgacgctgattacgtcaaccgtgcagtacttccgcgacaaaaatcagcgtaaaaaaagagaagaaaaaagagagcgggtctataccctttaccttgaaaacaaaaagaaagagctgcatgaacttgcagaaagacaaaagttcgtacttgatttccattttcctacatttgagagaatgaaatatttaacaaaggagatcagcggacgaatttgggaaaaatcgattgaaagcgccgattttctgcaaatccgccttggaacgggaaatgttgcatcttcgtaccaaatcaatttgaacggcggagatttggccaaccgcgatacagaccatctccttgaacaaacgcaaaaaatggaagaggtctacagagagctgaaaaatgcgccgatcactgtgaatcttgccgaaggcccgatgggcgtcgtcggaaaattgtccgtcgtcaaaaatgaaattcatcagcttgtcggccagctcgcatttttccacagctatcatgacttgcgctttgtctttatttttgacgaagccgagtatcaagaatgggaatggatgaagtggctcccgcattttcagatgcctcatatttatgcgaaagggtttatttacaacgaacagacgagagatcagctcctttcaagcatatatgagattttgagagaacgggatttagatgaaaacaaaaagaagactttgtttaagccgcactttgtgtttatcatcacaaatcagcagctcatcgcagaacacgtcattttagaatatttggaaggcaagcagaaacacctcggagtgtcgacaatcgtggcggcagagacaaaagaaagcctgtccgaaaacattcatacccttgttcgttatattactgaacaggaaggcgacattctgatcaagcaaaagaaagccgtccagatcccgtttcagctggatcaccacaacagggaagacaacgaacagttttcccggacgctgagaacgcttgaccaccagacgggcatgacgaattcgattcctgataccgtatcgtttctcgaactgttccaagtgaaggaagtcgatgacatcggcatcgaacaaaaatggatgacaagcgaatcggccaaatctttggccgtgccgatcggctataaaggaaaagacgacattgtttatttaaaccttcacgaaaaggcgcacggcccccacgggctgcttgccggaacgaccggttcgggtaaaagtgaatttttgcagacttatattttgtctttggcagttcactttcacccgcatgaagtcgcatttttgctaatcgactacaaagggggcggaatggcgcagccgttccggaacattccgcatttgctcggaacgattactaacattgaaggcagcaagaacttcagcaaccgggcgcttgcgtccattaagagcgagctgaagaaaaggcagcggctctttgatcagtacaaagtgaaccatatcaacgactatacaaagctttacaaacagaaaaaagcgaaaacggcgatgccgcaccttttcttaatttcagacgaatttgccgagctgaaaagcgaagaaccggaatttatccgcgagcttgtcagtgcggcaaggatcgggcgaagcctcggggtgcacttaatcttggcgacgcaaaaaccgggcggcatcatcgatgaccagatttggagcaactccagattcaaggtcgccttgaaggtgcaggatgcgaatgacagtaaagagatcctcaaaaacggggatgcggctaccatcacggtaacgggccgcggctatttgcaagtcggcaacaacgaggtgtatgaactgttccagtctgcatggagcggagccccttacatggaggacggctacggcacagaggatgaagtggcgatcgtcacagataccggattaattcctttatcagatgttgatgctgatcgcgctgcgaaaaaagaggctgtgacggaaatttcggcagtcgtcgaacaaattgaacggattcaagcggagatgggaatcgagaagctcccgagcccttggctgccgccgcttgaagaacgcataccgaaaacgcgctatccgtcggaggaagccgatgcctttaactttgcctatatcgatgaacctgaaaagcaaagccaggagccgatcagctaccgcatgatggaagacggcaatatcggcatcgtcggctcgtcaggctacggaaaatccctgacagccacgacgttcatgatgagctttgccgaacagtatacgccggaagaattgcattactacattttcgactttggcaacggaacgctgcttccgcttgcaaggcttccgcacaccgcggattatttcctgatggaccaaacgagaaaaatcgagaaatttatggtccggatcaaggcggaaatcgagcacaggaaaaatctcttccgtgcaaaagaaatcagccatatcaagatgtacaatgcgctgaatgaggaaaagctgccgtttattttcataacggtcgacaactttgacatcattaaagacgaaatgcatgaactcgaaagcgaatttatccagttttcacgagacggccagtcgcttggaatttatttaatcctgaccgcgacaagggtcaatgcaatcagacagtcgctcttgaacaacctgaaaacgagggttgtccactatctgatggatcagtctgaagcatattcgattatcggaaggccggaattcagccttgaaccgatccctggacgcgttattatcaataaagaaaaccaatacttcgcacaaatgtttatgcctgtggaagcggacaacgatatcgagctgtttgaagggatcaaagccgacattcaggcgatcgcagaacgctcggaaggcatgagaaagccggcgcctgtgccgatgctgccgctcgagctttccgtcacacagtttgtgagagattatccgcttcagcctgaaagaggccttattccaatgggactcgatgaagaaactgtcgaacccgtatactttaatcttgagaaaaataagcactgcctcattatgggtcagacgcagcgcggaaaaacaaacgtcatcaagatcatgctcgagcacctgcttgaccatgacacgaaaaaaatcgccgtgtttgattcgatagacagagggctttctcaatatgcgacagaggatcaaatcagctatctagaaacaaaagacgacattctgctctggctcgctgagacggaagaaatttgccggacaagggaagcgatgtatttggaagccgttaaacaaggagaaatcgccaaccttgatttctcaccgatggtctttattgtcgacggaatttcacggttccagcagacgatcgacgcatcgattcaggacaaaatggcgatgttcatgaaatcttacgcccatttaggtttccactttatacctgccggaaatcacagcgagttcacaaaaggctatgattcgctgacaagcgaagtcaagcaggtcagacacgcgatgctattgatgaaaaaatccgagcagaacttgattcagctcccatatgaacgccaggagccggaaattctgccgggctttggctatatcgttgaaaacggcaaagagaggaaaattcaaattcctttatgtgctgtagaaaggaagaaagcgaaatga

SEQ ID NO: 3223 - DNA, 1317 bp, Bacillus licheniformis
atggcagagaaaaagaaaacgtatctcgaagaccaattagaggccgtcatgacgaaagaagacggtacatatatctttcgttttcaaagagagaagatcaatcttgtgaacggcttggaagcaaacgtcattaaagaagtcgatccttcctttaataaagaagccgtcatgaccgatgatgaagtccaaattatgattcagcctccttccgaatataaagaatttcgttatataaaagggaaaaataaaaaaagcaagtggctattcgcgtaccagctcgtgaaagccgttgaagaacattcaattaaaaggctgcacctgatcgctgcgcctgaaaacattgtttttgacaaagggttgacgcctaaatttttacattatggagtgaaagaaagcattccgccatatgaacacgacgaagaaagacttttcaatgaagtgaaagccgccgcggcgcttgctgtcgacgggcaattttcttttgaagagtatttaaaatacagcgaaaccatcaaattttcagatcaggtaaaagacatcatcacaagcgggacatacggcgatttgaaagccgtcattcaaaagaggatcgatgaactggatgccaaagaaaaaatgcttgtccatcttccgaagaagaaatggaagattcaaaggtacatagggttaggactaattttatgcttaataccggctgttttattttccttctattcattattcttcgcgcagccgaaacagcaggcgtttatcgaaagcaaccgctacttcttaaataaacagtacagcaaagtcatcagtacgcttgataaatatgatgccgatgagatgcctgattctgttcagtatcagctggcttattcgtatatcatcgttgacaatgtactgaaggaagccgatttacaggaagatgccatgaagagcctgacgcttcaagtcgatccgaataatttcctttactggattcagatcggacgcggcgccaataaagaagcgcttgagacggcccgtaagctggaaaacaatgcacagatcatgttggcacttatgaaatacacagatgacattaaagccgatgataaattgtccagtgatgagcggcagaaacagctggatccgctcgaaaaagaacttgaagaattgaagcggacagcggatgaacagaaagccaaaactgaagaaaaccagcaggcaaacaccgagcaaaaccaggcggacgtagaggccgcaaaggctgaaacggagaaggccgagaaggaacaggcgaaaaaagaaaataaagaaaaggaagacaaaaagaaaaaagatgacaaataa

SEQ ID NO: 3224 - DNA, 240 bp, Bacillus licheniformis
gtgtatgttgacattaccatcgatttaaaacattacgacggcagcgtctttgacctcagactgtcggattaccattctgttaaaaaggtagtcgacattgcgtggcaagccaaaagcataccggtgcctccccgggaaggctactgggtaagggtgacaaataaagatgccgttttttcaggcgaatatacattatcgcaatgcggaattacgacaggtgaccgtctggaaatattatga

SEQ ID NO: 3225 - DNA, 297 bp, Bacillus licheniformis
atgtcaggaatcattcgtgttacgccggctgaactgcggcaaatggctgacagatatcaaaaagaaagcggagatgtgactgagcaggtcaatcagcgtcttgatcaaatgatcaaccagcttcaagatatgtgggaaggtgaatcaagccgtgcgttctcagagcaataccaagagctaagaccttcttttattaaaatggctgaacttctaagcgacgtttctaaacagcttcatcagactgctaacactcttgaaagcactgaccaagacatcgctagccaaatccgcggctaa

SEQ ID NO: 3226 - DNA, 1410 bp, Bacillus licheniformis
ttggcgattctagagaaaatcaacggctttttatggggagtcccgggcatcgttatgcttgcgggaaccggtttatttctgacgttcatcctgcgggggcttcaatttaaaagattgatatatgcattcaaacttgcattcgggaaagaaaaagaatcagccggagcagacggtgatgtcagcaatttcaaggcgctgatgacaacgcttgccggaacgatcggaaatggaaatattgccggtgtagccacggcgattacggttggaggtccgggggctttgttttggatgtggctcgtcggtcttttagggatggctacaaaatacagcgaacgattgctcgccacgaaataccgcgtcaaaaatgagcggggcgaatattcgggcgggccgatgtactatgtcgaaaaagggctcgggaagaagtggaagccgcttgccgttttatttgcattgtcaggtgtgcttgcctcttttggaatcggggattccgtccagtccaacacgatttcggaagtcgttacacagagcttcgggattcccggctggatcatcggccttgtgctcgcggtattgacggctgcgatcatcttcggcggttttcagcgtgtcagcacggttgcgagcatttttgtgccggtcatggcgatactttatatcggcggatcactgatcattattttccttcattatgatcaaatcattccggcgttccagctgattttttatcacgccttcaacccggtgtcagccgcggggggctttactggcgtggtcgtctctgaggcgatcagaaacggaatgtcgaaaggaatcttttcaaatgaagctggtcttggtaccgctgctttaatcgcaggaaacgcgaaatccgatcaccccgtcaaggccgctttggttgcgatgacgggaactttcatcgttacattgatcgtttgtacgatgacggggcttgtcctcattatcacgggattctgggatccttcaggcggtctgctttctggtgttgcccacgatgcatcgcttgatgccggcgcgctgacaaacgccgcgtttgcttcttcgctgggagccgcgggcaaatacatcgtcacgttttcggtgattttctttggctactcaaccattgtcggttggtatgtatatggagaaaaatgtctggaatatttagttggtttaaaatgggtgccgctttatcgtgtcgtttatgtcattgctgcatattacggtgcagtcgcaagcctgaatactgtatgggcttttgccgacgcggcaaacgcattaatgatgatcccgaacttgatcgcccttgtgctcttatggaaagtcattcgggcggaaactgacgatttctttttgcaccactataataaggaaaaacaaaagtcagccggcttgaaagcgggctga

SEQ ID NO: 3227 - DNA, 1239 bp, Bacillus licheniformis
atgaacaatcgaaacaatccttttaaatatcaatatgaccgtttagaagatgtggcagatcatatcagcgaggtgctggactgtccgattacgatagaagacatcaaccaccgcctccttgcttacagcacccacagcgactacacggacccggcgagaacgtcaacaatcatcggaaggcgcgttccggaaaaagtcatcaacaagctttggaaggatggaacgattcccgccttgatgaaaaccgacgaaccgatcagggtcgaacaaatcgatgaagtcggcctgtcgagccgcgtggcgatttcaatctggaaaaacagcgaggttatcggttttatctgggcgctggaaagccaaaaaacgctgtcggaagacgagcttcaccttttgaagctggccgcggattccgtaaagaacaagctgctgccttatcaggtccgaaaaagaaaaaatgaacagcgcagccaggaatttttctggaagctattgaccgggcacatttcggaagatcaggaaatctccgacggctttcaccagcttggcatcggagttccttcaacttattcggtcatcatcatccggctgaaagacgaaatcgaagaaaaaaccgaaaagcagctccattacttgctggaaacgacgcagcagctgcaaatccttctggctacaatcgactataatgagctgattgtcctcgcttcgccaaaaacggggcaaaaagggcagccgttcaatgatttaaagcaatttgccgcgaatatacaaaagcaacttgaagagcgctataaactgaataactgcacgatcgcgatcggcggaatgtacagcttgatcacccttgtacaccagtcttatcaggaagcgctctcggcgctgaaggtcaaggagcgttttcccgatgagacaaggcacctcgtcagcttttcagagctcggcatctaccagtatctcgacgtgctcagcgaaaaacggaaacatgcaagctatccaaactattctttaatgcagcttgaagcatatgataaagagcaccactccaatcttgtcgagacgcttgaacaattcatcgaatgcgacagcaacgtcaacaccgccgcaaaaaagctgaacattcacgtcaacacgctgaattacaggctgaaacgcatcagcaaaatcgccgaaatcgatttaaaaaacatcaatgaaaaatttacgatttatcttgaaatcaagcttcgcaacatgcatttgtga

SEQ ID NO: 3228 - DNA, 1140 bp, Bacillus licheniformis
atgattatcggcgtaccgaaagaaatcaaaaacaatgaaaaccgtgttgctttgactcccggtgcggcttctcaattgatcgcggcaggacaccgcgtcatcgtggaaaaagacgcggggactggaagcgggtttgaaaatgaggattacgtctcagtgggagccgagatctcagaacaagcggaagccgtctgggaagcggctgaaatggtgatgaaagtcaaagagccgctccctgaagaatatccgtattttagagaaggtctcatcttgttcacctacctgcatctagccgcagagccttccttggctgaagcattaaagcagaaaggcgtgacagccatcgcctatgaaaccgtcagcaatggccgttcccttcctttgctgacgccgatgtctgaggtagccgggcggatggccgcccaaatcggcgcgcagttcctcgaaaagccgaaaggcggaaaaggcatattattggccggtgtacccggagtcgcgcgcgggaaagtgacgatcatcggcggaggcgttgtcggcacaaatgcggcaaaaatcgcggcgggcctcggagccgacgtgacgatgatcgatttaagcgcggatcgcctgcgccagcttgatgatcaattcggcaatcaaattaaaacattgatgtccaatccggtcaacatcgccgatgccgtagcggaagccgacctcctcatctgcgcggttctgatcccgggtgccaaagcgccgactttagtgacggaagagatggtcaaacagatgaaaccgggctctgtgattgttgacgtcgcaatcgatcaaggcggcatcgtcgagacggtggatcacatcacaacccacgacaatccgacctatgtcaaacacggagtcgtccattacgctgttgccaacatgcctggcgccgttccgcggacatctacagttgcgctgacgaatgtaacagttccgtatgcgcttgaaatcgcgaacaaaggcgcggaaaaagcgattcttgaaaaccctgcgctaaaagccggcgtcaacacagcaaacggccatattacttatgaagccgtagccagggacttaaactatggctacgttcccgcagagcttgcgatcgaaaattcgtcgtcagccgccggcgcatag

SEQ ID NO: 3229 - DNA, 246 bp, Bacillus licheniformis
atgtttttcgtacagctgttcatatttttaatgctgagcgcctgtttttggcttttcattgcatcattcaagaaaaaggcttttgctgttttattattgctgacggctgcggcagttctggcactgtttgccgcagtcggcgatgcctctgaccggacgctgtggagaatcgtcctgtttggggcggttcctgtttctgcaattgcggcaaaattgattcaggatcgccggaaaacggaatcataa

SEQ ID NO: 3230 - DNA, 594 bp, Bacillus licheniformis
gtgttttttgggaaaacaaaaccgcacaagtccgacagggtgcctccaaaccaaaatgtcacaacatcttttcctgttcttcatgcaggacatgttccggaatacgaagacctgtcaaaatggaatttgcaaatttacggacttgtcgaacagccgctcctgctgacgttggatgatcttcatgagatgccgcaaagcgaagtgtccaatgacattcattgtgtaacaggctggtccaagctcgataatgtttgggaagggatcaagacaaaggagatcgctgaaagagtaaagccgcttccggaagccagatttgtcatcttgcatgcagaggaaggctggacgacgaatgttccgctcgaagactttttgaaggattcgtctcttttggctcattcccataacggcgccccgctcacgccggagcacggctttccgctcagagcggtgatgccgcatttgtatttttggaaaagcgccaaatggctgaggggcattcagtttacaaaggaaaaccatccgggcttttgggagaaaaacggctaccatcttaggggaaatccgtggaaagaagaaagatacagctttgattag

SEQ ID NO: 3231 - DNA, 597 bp, Bacillus licheniformis
atgaataataaaaaacttcgcgccggcgatatggcgcttgtcggaatgtttgccgctctgatggggatcggcgctaatatcacttcgtttgccccgtttctgcaaatcggcggtattccgcttacgatgcagcctttcttctgtttgcttgccggacttttgctcggccgtaaattaggtgcgctgtccatgattgtctatgcgttagtcggctttattggcgctccggtattcgcttctttttcaggcggtatttccgttctttttaaaggaagcgcaggctttattctatcctatattcctgccgcatatgccgcgggctggatcacggacaaactatccgaaccgaaaacaggccactttttcgcagcctcattgatcggtacgctgatcatttatctgatcggcgtcaactatacgtatctcgctttttccacttggctcaatacaccgatgtcatattcagccgtttggaaaatgatggcctggttcttcgtgaaagacttggcattctccgttctgctcgccgcgctcgcctcaaaggttttccgggcggttcaaaaaggcgcaggcttcagaagaaatccgactttttaa

SEQ ID NO: 3232 - DNA, 1329 bp, Bacillus licheniformis
atgaatgcagttgtgattgctgttattgtgatgcttatattaagcctgctgcgggtcaatgtcgttctagccctgattgtgggcgctcttgccggcggtctgacgggcggtctcggtctcggccagacggtcagcgtatttacggaaggactcggaggcaacgcaaccgtcgcagtcagctacgcgctccttggcgcttttgcagtcgctttgacgaaaacgggtcttccggatgccatggttgaagctgctgtcaagctgatcggcaaagaaggcgatacaaggcgcaaaaccctttcaaaagcgctgatcgtcttcgtgattttaattatttcttgtatgtctcaaaatgtcgttccggttcatatcgcatttattcctgttttaattccgccgttattgaaaattttgaatgagctgcaagtggaccgccgcctgattgcgtgtgcgatgacattcggattgacagctccgtatattttgcttcccgtcggcttcggccagattttccaggggattttgaaagacaatatgaaagatgcaggcctttctgtcacattggctgatattccaatcgccatgatcattccgattgtcgggatgattgccggtttggccgttgctgcttttgtgtaccgcaaaccccgcacatatgaaatgaaggaaatcgccggtcaaaagtcggcgtcctatacgaagaaaagcctttcgattgccgttttggccatcgctgtatcattaagcgtacagctctatttgtctcagagcttagacgtcgacggaatgatcttcggcgcgctcagcggtttggcggtcttgtttttaagcggagcgatgaagcgcggcgaagcggacgaattgatcactaacggcatgaacatgatggcgtttatcggatttgtgatgctggccgcggccggttttgccaatgtgcttgaaaaaacgggcgatgtcaaagcgcttgttgaagcgtcaacaggtttcatcagcaataatcaggtgctcggcgcattgctgatgctggttgtcggcttattgatcacaatggggatcggttcctcatttgcgacgattccgattatcgcaacgatatttgttccgctttgcatgcagcttggcttcagcccgatggcgacaatcgccattatcgggacggccgcagctctcggagacgccggttcacctgcgagcgacagcacgcttggaccgacatccggcttaaatgcggacggacagcaccaccacatttgggacacctgtgttccgacattcatcttctataatattccgctgattttgttcggctggatcgcggcgattgttctttaa

SEQ ID NO: 3233 - DNA, 1491 bp, Bacillus licheniformis
atgttttatgcctttaaagatttcgaaaaaaaagaaacgcttttaatcggactgtttaaaaaaagccggctgtacggtaaggctgaagaaatcgaccgccttttgaacggccagctttctcagctgctgaaagacggggatgtatcttccaaaaaagcgaaagtgtctaaaatatttaccccttcgcttcagggagtcaaacgcatttatatcgtcggattgggccgtgaagcggaatttaccttcgaggatgcgaagcagtgctttgccgaagctgttcagctgattcacaaagatcgaaagcaggagttaaccgtcatgctcgacagcttcgtatccgaagaagtcccagctgctgacgccgcacatgcattggctgaatcgtgcatgctgtcatgctatgaagtgcaggattacaagcacagatcaaatgtgcctgatcaatgtctgcaaagcgtctatgttttgacagaccatgacctgaaggagattcaggcgagtctgcatgtcggacaggtgtacggaaatgcgacgaattcggcgagaaccctcgtgaacatgccggggaacatgctgacagcggcggatctcgcgtcatatgccgctgaattggcggcgaaatacgaatttgaatgtgaaattcttgaaaaggctgaaatggaagagctcgggatgggcggtctcctcgcggtcaaccaaggatcagaagagccgccgaaaatgatcgtcttgaaatatcaaggaaaagaaacatgggatgacgtcatcggtttagtcggcaaagggattacgtttgataccggaggctattcgattaagacaaagagcgggattgtcggcatgaagtccgatatgggcggagccgccagcgttttgggagcgatggaagcgatcggcgaattgaggccggaacaaaacgtgcttgccgtgattccgtcgactgataacatgatttcgggaagcgcaatgaagccggacgacgtcatcgtttccttgagcggcaagacgattgagatcttgaatacggacgccgaaggaaggctggcgctcgctgacggactgacatatgcgaagcaccacggagcttccgtgctgatcgatgtcgcgacactgaccggaggcgtcgtcgtagctctgggaacggaaacgacgggagcgatgacaaatcatgatccgctttatcagcaggtgagacaggcggctgaagaagcgggagaagcgatttggcagcttccgattactgaaaaagacaaaaaaagagtaaaaaacagccaaatggccgatcttaacaattcaccgggcagggaaggccatgcgattatggccggaacgttcctcggcgaattcgccgagcagacgccatgggttcaccttgacatcgccggaacggcaacgacagctcaaaactcatgctttggaccgaaaggcggaacgggcgtgatggtgagaacgcttgtcacgtttgtcgagcggttttcgggaaatttgtag

SEQ ID NO: 3234 - DNA, 477 bp, Bacillus licheniformis
atggaaatcctcacaaactttcctttgctggcgagctttgccgcgatctttttcgctcagtttatcaaggttcccatttactttgtcgtctcaaaaaaatgggattggcggcttgtcacaagcacgggcggaatgccgagttcacactcagcggccgtcacggcgctctcgaccggtgtagctcttgatcacgggatggattcttctttgttcgccgtttccgcaatatttgccgttattacgatgtttgatgcaaccggagtgagaagacatgccggagaacaagcaacagtgatcaaccggcttgtccgcgattttaaccgctttgtcaacgaagcgaaggatttccctaaaagccatcaggaagaaaaacagaaaaagctgaaggaactgctcggccatcagccgattgaagtgtttttcggcggcctgaccggcattgcactgacgctgcttctcgattatttattgatgtaa

SEQ ID NO: 3235 - DNA, 675 bp, Bacillus licheniformis
ttgagaaaagtgatgactatgttccggcgtttcttgatgacagttttgtttgtccttgcttttatgacgaccttctttgccgtttcaggcgtggaggcacaggatatatccagctgggcaaaagaacgcgatctgtccttgaaacagctgatgctcacctttaaatcacttcccgaagaaaaagcggaaaagacgtctctgtctgccgcagaacaaattaaaaacaaaccgaaatcgcttgaagacgcgtttgactggagcaagtatccgaagcaaaaagtcaccgcgaccggatatacagcaggggctgaatcaacgggaaaacagcctcatcatcccgattacgggattacatattcgggagtcaaagtaaaaagagatttatattcaaccgttgcagccgacccgtcggtctttccgatcggcaccatattgttcatcccggactacggctatggggttgttgcggataccggatcagccattaagggaaaccggctcgatttgtactatgagacggttgaggatgtttataaagaatggggcaaaaaaacacttgatgtttatgtcattaaaaaaggaaacggcaccattaccgaagaggatctcctgaagctgaatgaaaataaatcgatgcaagtattcagacaaaaatataaaatggcgaaagaataa

SEQ ID NO: 3236 - DNA, 330 bp, Bacillus licheniformis
gtggaggctttgattagtttaccagttgtcatcatttcagttgtcttatttttcgtcctgtttttcggcatcggttttctgctgaatatgctgctcagaatgtcatggatcatggctgtcatttatccaattgtatgccttttcattgtgaataaagaaaagctgattcgctatgtagaggcgccgggagaggcattttccggcctttttgacagagtggcttctttggctgctgccgatatcatcattttagccagcggaatggccggagccctgttgtcgggcgttacgatcaaagcgctgcgaaaaaggggatatcaaatgttttaa

SEQ ID NO: 3237 - DNA, 129 bp, Bacillus licheniformis
atgaagacaacgtcaacccatcgacttgaatctacctgtacattctgttcaggaaaaggctattttcagcttctgctcggcggttcggaaacgtgcagcaactgcaagggaacaggaaaagaccgttga

SEQ ID NO: 3238 - DNA, 1164 bp, Bacillus licheniformis
atgaccgttacgagacttgttaaaaaaatcggcatcaatgaagcgaatattacgcttgtcaacaagcacaattaccattatgagacgacctggatgcacgaggcgagcgcaggtacgcttcatcatgacagatgccgctatcagattaaagacgtcatcaatacatcccgtgtcaatttcgttcaggatacggtaaagaaaatcgataaagaaggaaagaaagtcgtccttgaaacaggagagcttagttacgactatcttgtcgtggcgctcggctccgtccctgaaactttcggaatttcgggattgaaagagcatgctttctctatttcaaacatcaattcgtcccgccagcttcgcgagcacattgaatatcagttcgcgacgtataacacagaagccgagaagcgcccggaacgcctgacgatcgttgtcgggggagctggttttacaggcattgaatttttaggtgaaatggccaaccgcattcctgagctgtgccgcgaatacgatatcgaccgccagcaggttcgtttaatttgcgtggaagccgcgccgtctgttctcccgggctttgaaccggagcttgtcgattatgcggtcaactacctcgaaggaaaaggcgttgaattcaaaatcggcacggccgtgaaagaatgcacgcctgacggaatcatcgtcggaaaagacgatcagaccgaagaaatcaaagcaggcactgtcgtatgggccgcaggcgtccgcggcaacccgatcattgaggaatccggctttgaaaacatgcgcggccgtgtgaaggttaaacctgacctgcgcgttgaaggccatgatgatatatttgttatcggagactgctctttaatcataaatgaagaaaccgaaaggccttatccgccgactgcgcagatttccatgcagcaaggcgaaacgtgcgcaaacaatctggccgcactgattcacggcaaagaaacggaaacgttctcatttgataacaaaggctctgtcgcttctctcggcgaacacgatgcaatcggcgtcgcattcggcagaaagatgacgggaacgacggcgtccatgatgaaaaaaatcatcgacaaccgctcgcttttcatgatcggcgggccgggacttgttctgaaaaaaggcaagtttaaatttttctga

SEQ ID NO: 3239 - DNA, 999 bp, Bacillus licheniformis
atgcgtgaagacacaaaagtatatgatatcacaattatcgggggcggccctgtcggcttgtttaccgcattttacggcggaatgcggcaagcgagcgtcaaaattattgaaagcctgccgcaactcggcggtcagctgtccgctttgtatcccgaaaaatacatatacgatgtagccgggttccctaaaatccgcgctcaggagctggtcgacaatttaaaagagcaaatggcgaaattcgatcagaccgtttgtttggaacaagccgtcgaaagcgttgaaaaacaagcagacggtattttcaaactcgtcaccaacaaagaaatccactattctaaaacggtgattattacagccggaaacggagcattccagccgagaaagctcgagcttgaatctgcggcacaattcgagaatgcaaaccttcattactttatagatgatctgaatcaatttgcgggcaagcgcgttgcggtattgggcggcggcgactccgccgtcgactgggcgctcatgctggaaccgatcgcaaaagaggtgtcaattattcatcgccgcgataaattccgcgcacacgagcacagcgtcgaaaacttgcgcaattctaaagtcaatgtattgacaccgtttgttccgaccgagctgatcggcagcgagcgaatcgaacagatcgtcattgaggaagtgaaaggcgagagaaaagaaatcatcgatgtcgacgatgtgatcgtcaacttcggttttgtttcatctctcggaccaatcaaaaactgggggcttgaaatcgagaaaaattcgatcgtcgtcaagtccacaatggaaacgaacatcgagggattctatgcagccggcgatatctgcacatatgaagggaaagtcaagctgattgcgagcggatttggtgaagcgccgaccgctgtcaacaatgcaaaagcttatatggatcctaaagcgcgtgtgcagccgctgcactctacaagcatgtttgaaaacaaataa

SEQ ID NO: 3240 - DNA, 201 bp, Bacillus licheniformis
atggaaaaaatcaactgcagaagctgcggcgggcttacgccgtacgattcaaaagtctgcgaggcatgcggatgcgaaaaaccgcttccaaaatcacagaaaattacggaccggattgtcttgactgcggcgggagtcgtcggcatcttaacaattgtgctgatattgggaacgatcttctcatatttgaatatcatataa

SEQ ID NO: 3241 - DNA, 225 bp, Bacillus licheniformis
atgtcttactacaacaatcgcaatcaagagcctctgccaaaggaagatatcagtacgtgggaatgtacggctgaggactgcaacggatggatgagaaaaaatttcacgagcagcgaccgccctttatgccctctgtgcaacaaggaaatgataagcggaagccgctatatcacctctatcaccaacaacacgagcaatctgaatcgcatctttaaccagaaataa

SEQ ID NO: 3242 - DNA, 555 bp, Bacillus licheniformis
atgaaaaaaacgcctttcatctcgatgcttcatcgtgatgaaaaggcgttttattatggtctgggggaaaaagaaatgaaactcgtatcaacgcacgccttgtcaaaagcggacgttaccgcgttttttcatacacattggggaagtccggaaatggtcaattcacacggaacattccgctgcgatgaattggaaggattcgctgtaacagatgaaaaaagcgacattaaaggcttgattacgtacttcatcgctggaaacgaatgtgaagtcgtctctttggacagtgttgtcgaaaacaaagggatcggctcactccttttacaagaagtggagcgtgtttcaaagcgaaaacagtgtaaatcgattaaactgatcacgacgaacgataatatgcgggcgcttatgttttatcaaaagaggggctatactttggccgagttgtatgtaaacgcagttgacaaagcaagaaaagtaaagccggaaattccctttgtcgctgataacggcattccgattcgggatgagattctattggtgaaagatttagcatag

SEQ ID NO: 3243 - DNA, 366 bp, Bacillus licheniformis
atgagcgaaaaaacggtcacggttacggaagcggctgctcttcatatcaaggatatgatgaaagagcatgaagaggagaacgcatttttgagaatcggagtaaaaggcggcggatgcagcggcctgtcatacggcatgggttttgaacatgaaaaaaacgaagacgacaatgaattcgtccagcatggaatcacagtgcttgtagaccaagaaagtctggatatcatgaacggtacggtcattgattttaaacaatcgatgatgggcggaggcttcaccatcgataatccaaacgccatcgcttcatgcggctgcggatcatcattcagaaccgcagcgaatgcggggaagcctgaagagtgctga

SEQ ID NO: 3244 - DNA, 858 bp, Bacillus licheniformis
atgaattcttttcgttttactaaaatgcacggcttaggaaacagctatatatacgtcaatcagtttgaagaacatctccctgaggagctgttgtcggatttggccgtcaaagtgtcttccgtttacaccggaatcggttcagacggaatgattctcatctgtccttcagatcgagcgccggttaaaatgcggattttcaacagcgacggatctgaaggcaaaaactgcggaaacggtttgcgctgcgttgcaaaatacgcgtatgaacataaactggtagaggaaacgtcctttttaattgaaaccctttcaggcttggtaaaggctcaggttgaggtggatgaaggaaaagttgtatcggctacggtcgatatgggcgaaccgcgacttctcaaatcagatatgccgatgcggggtgaacagggttcagagacgatcaatgaaaagatgatattcggcggccgtgaaatgaagggtaccgctgtatccatgggcaatccccacatcgtcttttatttagacgatattgaaaaagccccgctgacgacgatgggaccgctcattgaaaaagatgaaaggtttccggaaggggttaatgtagaatttgttgaagttgaaaacgaaaatgaactccatttccgcgtatgggaaaggggatcaggaattacccaggcttgcggaacaggcgcctgcgcagccgcagtgagttcggtgctcaacggctattccaaacgggacacggacattaccgtccatctcgccggcggcgatttgatcattaattggaaaaacgacggacgcgtcatgatgacgggacccgctgaaacggtatgtgaaggcgagttttttatatcataa

SEQ ID NO: 3245 - DNA, 1218 bp, Bacillus licheniformis
atgaacattttatggggacttcttggtattctggcgattttcgcgattgctttcctgctttccgagcataagagcaaaattaacataagaacgattttaatcggtttggcgatccagctcctgttcggattcatcgttctcaaatgggaaacggggagggaagcgtttctttggtttacaaaagccgttcagcatctcgtcaattatgcgaatgaaggcatcagctttctcttcgggcctctcttacaagtaggcgacagtgctgcctttgctttaagcgttcttcctgttatcatcttcttttcatctctgattgcagttctttaccatttaagaatcatgcaagtgatcatccgcttcatcggcggcggattggcaaaactgctcggaacaagcaaaacggaatctctttctgcagctgccaatatctttgtcgggcaaactgaggcgccgcttgtaattaagccgtttatcgcaaacttaacaaagtcagagctgtttgccgttatgacaggcggactcgcttcagtggccggttctgttttgttcggttacgcccttctcggggttcctctcgaatatttgcttgcagcgagctttatggccgcacctgcgggcttgattatggcaaaaatgctcattcccgaaacggaaaaaccgaaaattgaagaaaaagatattcaaatggctgaagacgaagacgcagcaaatgtcatcgatgccgcggcaaaaggggcatcaacgggtctctctcttgcgttgaatgtcggcgcgatgctgcttgcttttgttgctttgattgccgttttaaacggaattcttggaggagtcggcggatggttcggctttaaagacctttcactcgaatatattctcggctatgtatttgccccgctcgcctttgtcatcggcgtgccatgggatgaagcggtccaggccggaagctttatcggtcaaaagctcgttctgaacgaatttgtcgcttattccaattttgctccgatgtttgatcagctttccgtcaaaacagcttcgattatcagctttgcgctgtgcggtttcgcaaacttgtcttctgtggcgattttgcttggaggacttggaggaatggcgccgaaccgccgttccgatatcgcccgtctcggcttgaaagccgttgcggccggaacattggccaaccttttaagcgcggcgatcgccggaatgtttatcggataa

SEQ ID NO: 3246 - DNA, 237 bp, Bacillus licheniformis
gtgtttccaatcgttgagttttgcgtcagcaatcttgcccaaggttctcaggaggcaaaggaaatattggagaaagatccgaatttggatgtcgttgaatacggctgcctgagttactgcggacaatgcatgcagacgatgtatgctcttgtaaacggagaaatggtgacagcgaataatccggctgaattggtcgaaaatatatacaagttcattgatgaaaatgaactcatttaa

SEQ ID NO: 3247 - DNA, 1068 bp, Bacillus licheniformis
atgagaaatttagtcttgctcggcggcggatacgggaatatgcgcatcattcatcgtttgctgcctaatcagctgccagatgatgtgatgatcactttaatcgacagaaacccttaccattgtttaaaaacggagtactacgcactggctgcggggacgatttccgatcatcatatcagagtgtccttcccggatcacccgaagttaaagattgaatacgggacgatttcgtctgttgatttggaaggaaaaaaggttttgtttcatgacagggagccggtatcctatgatgacgccgtcatcggactcggctgtgaagataaatatcacaacgttcccggggcgcctgaacatacctacagcattcagacaatcgatcaatcacgcagcacgtaccaggcgctcaacaacttaaatgcggaagccaccgttgcgatcgtcggggcaggactgagcggcgttgagcttgcgagcgagctgagggaaagccgaaaagatttgaacatcatcctttttgaccggggagaattaattttgtcgagcttcccgaagcgtttgagcaaatatgtgcaaagctggtttgaagagcacggcgtcaagattatcaactgcgccaatattacaaaggtggaagaaggcatcgtctacaatcatgacgacccgatccaagccgacgccatcgtctggacagcggggatacagccgaatcaaatcgttcgggatctcgatgtggaaaaagatccgcaagggcgcgtcgtcctgacgccgcaccataacctgccgggagacgaacacgtttatgttgtcggcgactgtgcaagcctgcctcacgcgccgagcgcacagctggccgaagcccaggcggaacaaatcgtccaagtgcttgaactgcgctggaaaggcgaacctcttcctgaaacaatgccgaaattcaagctgaaaggcgtcctcgggtcgctcggcaaaaaagccggtttcggtttagttgctgaacggccgttgatcggcagagtgcctcgcctgctgaaatccggcttgctttggatgtataagcatcataacgggtag

SEQ ID NO: 3248 - DNA, 372 bp, Bacillus licheniformis
atggaagtctttgaagaatatttagcgggaattgatcatccggaacatcgtgcccggatggaagaagtattgggttgggtagcggagacatttccaaatttaacgccgaaaatcgcttggaatcagccgatgtttactgatcacggcacatttattatcggctttagcgtcgcgaaaaatcatttggctgtcgcccctgaaagcgctgggatcgatcgtttttctgaggaaattgtgcaggccggctatgatcatacgaagcagcttgtccgtttccgctgggatcgtccggtggatttttcattgcttgagaaaatgatcgagtttaatattgcggataaggcggactgctcgactttttggcggaaataa

SEQ ID NO: 3249 - DNA, 1107 bp, Bacillus licheniformis
ttgaagacaaaaattgcgtatgaggaagttgcgggaatgcttaatcaatggtatgtcatgatcaagcgtcacgaagtatcacaagcggtctcgattaaatgcgacattgagcaccagctgccgaatatggaagaaaatcaagatctgcttctttattttaatcttttagactatcggcacaagctgctgacagaagagtttgccgcttccaacaaactgttcgaggatattcaggagcaaaaagccgatatgcaaagcacagatgacatgattgaatattattatttctttttcgctggcatgtacgaatttcataagaaggattatacaaatgcaatcaattattataaattagccgaggaaaagctcaggacaatccccgatcaaatcgaaatcgccgaattccattacaaactggctatcgcctactatcaaatcaaacaaaatttcctttccttaaaccatgcgaaaacagctctaaaaaccttcaaagcacatgatgattacattcaaaaagcgatcagcaacgatatgctgatcggggcaaataaactcgatttatttcgttttgatgaagccgaacagcattacaagcaagcccttaaagacgcggcactgatcaaacatcatgtcctcctcggcatggctcaccacaacttagggttgagctatgtcaatcgcaacctcctcacattggctgaacatcatttcaaagaagcgctgcttatcaaagagcatgaagaatcggtttacggcatccattccatgtttgaactgacacatgtgctgtacaaatcaaatgttgtcaaagaagcacgcaaattgtatgaaaaaggatttttccgtgcggaaaaagcaggagaaagggaatatttgtcgaaatttaaacttattcatgctctgtatgatgaacaggatccacttacggttgaacatgctttagaatatcttaaaacgatcaatctctggacggatgtagcggaattaacatttgatatcgcactttactataaagaaaatggagatgcagacaaagctgccgaatattttgaagaatctcatcatgcaagagaccaaattcttaaaagaacggaggagttaaagtga

SEQ ID NO: 3250 - DNA, 501 bp, Bacillus licheniformis
atgaatcaagatgtaaaagagtttgtaggaagccatatgatctatacgtatgaaaacggatgggaatatgaaatctacattaaaaatgaccataccatcgattaccgcattcacagcggaatggttgggggacgctgggttcgcgatcaaaaagccgatatcgtcaagctgactgaaggcgtctataaagtatcctggacagaaccgacagggactgacgtttccttgaacttcatgccgaatgaaaagcggatgcacggcatcatcttcttccctaaatgggttcatgaacgccctgatattacagtctgctatcaaaatgaccatatcgacttaatggaggaatcgcgcgaaaaatatgagacgtatccaaaatatgtcgtaccggaattcgccgatatcacatttattgaaaatgccggaatcgataatgaagatctgatttcaaaagccccttatcccggaatgacggatgacatcagggcaggaaagcgggtataa

SEQ ID NO: 3251 - DNA, 267 bp, Bacillus licheniformis
atgtcaagcattgaaggacaaatcatgtcaggcgattttgatgacgaaatgaatgttttttcattaaagaaaatcaagcagtttcaaacgcagaccagtctgaaagaaaaccagctcaaggctttacagcactatttaaggcagcatgagcacgatgaggacggacagatcatcaccctctacgaccaaatgcttgtacctttgtcgcaagatgatataaaagcgctgctggatgacttaacaaaagtccagtcattatatcattaa

SEQ ID NO: 3252 - DNA, 327 bp, Bacillus licheniformis
atgaaaaaacaagccgagctttttgtttacggtgccgacgttctttgtccaagctgtgtgaaccttccgtcatcaaaagaaacgtatgagtggctagaagccgccctgaaaagaaaatatcccgaccagcctttctcaatcacgtacattgatatccatcagccgccggaaaacgaccctgaaaaacaggaaatctccgaaaaaatcctgaacgacgaatatttttatccgctcgtcatggtcggtgatcaagtggtcggcgaaggaaatccgaagctgaaagacgtgtataaagaaatggaaaagcaaggatataagcctgcatga

SEQ ID NO: 3253 - DNA, 240 bp, Bacillus licheniformis
atgacgacagaggtcgaaatgaaagaacaagtacaggaagtgctggacaaacttcgtccgtttttactccgtgacggcggtgactgtgaactcgtcgatgttgaagacggcatcgtcaagcttcgcctgctcggcgcatgcggaagctgcccaagttccaccatcacccttaaagctggaattgagcgcgcccttttagaagaagttccgggcgtcattgaagtagagcaagtattttaa

SEQ ID NO: 3254 - DNA, 1962 bp, Bacillus licheniformis
atgaagcagctgataaccgaaaaagacctcatcaagcttgtatccattaccgatccccagtattcgcccgatggtgcaaaaatcgcctacgtccaaacaaaagtaaacgaaaaacaggactcatatgattcgcatatcatgatctacgaccgcgaaaaacaagcttcggtgcaatggacgtttgggaaaggcagaaaccagcatccccgctggtcgccggacggcaaataccttgcatttacgtccaatcgcgaggaaaccgcacaaatttacgtgataagcgccgccgggggagaagcgagaaaagtgaccgatattccctatgatgtatcacagcctgaatggtcgccggacggcaagtcattgctttgttcagtgaagctgacaaaagaggaaagcgtcgacgatgagaagaaaaccgagattgaagaccacgaaccgctggaagtcgattctttgtcatataaagcagacggccaagggtttaaaaggggaaagtatacgcagcttgtcctcgttcaagtggaaaccggggaaatgaaacagctgaccgatcttgaacgcgaccatttcagccatgcattttcaccgtgcggagatcagattgcattttgcgccaatcaaacggatatgcgtgtgaacgatgtctacttgatgaacctttcgacaggtgatttgaagcgcctcacaggtcaaaacggcattttttcttcactatcgttttctcctgacggcaaacaccttgcatttatcggaaacgagaaagaatatcaaaacgccacgctcgataaagcatggctgtatgatattgaaacaggaaaactaacgtgtctgacggaaatgcttgacgtccatctcagcgatgcggtggcaggagacagccttgtcggaggcgttcttccgaaaccggcctggaccaaagacggaaacggcttttatgtcatcggatctgaccagggttctacaggcatttactacatatcaatcgaaggtcttgcttatccggtccggttggaaaaagagcatgtgaacggattcagcctgcatccggacgaaagtggctttgcggcatccatagccctgcccgtccggccgagcgaactttaccatctccaattgggtgaagaaaaagcggagcgactaacagatgccaaccaagcgtttacggaagaacatatcatatcggaaccggaggagcttcaatttcaggcagcggacggtctgacaattcacggatggctgataaagcccgcccaatatgaaaaaggaaacacgtatccgctcattctggaagtgcacggcggacctcacgccatgtatgcgaatgcttattttcatgaatttcaagtgctggccgcaaagggaagcgccgtcgtatatgttaacccgcggggaagccacggctacggacaggattttgtcaaccgggtgaggggcgactacggcggtggagattttaaggatgtaatggcggctgttgaccacgtgcttgaacattatgatttcgtcgatcaagaaaggctcggcatcaccggaggaagctacgggggctttatgacaaactgggctgtcggccacacgaagcgcttcaaggccgcagtgacacagaggtccatttccaactggatcagtttttacggggtaagcgacatcggctattttttcacagactggcagctcggtgcagacctttttgaagatccaggcaaactgtgggagcattcgccgctcaaatacgcggacaaggtggagacccctcttctcattctgcatggcgaacgggacgacaggtgcccgattgaacaggcggaacagctgttcacggcgctgaaaaaaatggggaaagaagtaaaactcgtcagatttccgaacgcgtcacacgatttatcaagaagcgggcatccgaagcagcggatcaggcggcttgagtatattgcaggctggtttgaagcttatctataa

SEQ ID NO: 3255 - DNA, 921 bp, Bacillus licheniformis
atgactgaggctgacatgctgttttccgttacggttcccggaagcacggccaatcttggcccgggctttgattcagtcggcatggcgctgtcccgctatttaagactgtctgtttttcctcatgatgagtggcgttttgaagctgaaacagaagtcgtagcgggaatacctgaaggaacggacaatttaatttaccaggtggccaaacggaccgccgcacacttcggaaaagaacttccgccaagccttgtcaaagtgtggagcgatattccgcttgcgcgcggtctcggcagcagcgcagccgcaattgccgctgcggttgagctggcgaacgaacttgccgatttgaagctttcagaccgcgagaaacttcattttgcgagccttgaagaaggccatcctgacaatgccggagcatcgcttttcggcgggcttgtcatcggacttcatgaggaagatgaaacagagatggtttctatgaaagacatcgatttggatgtcgtcgtcgtcattcctttttatgaagtgctgacaaaagatgcgcgggatgttcttcccgaaagcctctcttatccgaaagccgtggaagcaagcgcggtcagcaatatgctcgtcgccggactgatggcgaaagattggaagcttgtcggccgcatgatgcaaaaagacctctttcaccagccataccgaagggcgctcgtccctgagctttcgaaagtggagcatgaagcaggccaaaacggcgcgttcgggacggctttaagcggagccggcccgacgatcctttcctttattgaaaaaggaaaaggagaggcgctgagaaaccagcttgcgtccaagtttccgcactgtgaggtcgactgcctttatgtcccggatacaggcattatcgttgaaagaaaatcagtaaacagtgtttaa

SEQ ID NO: 3256 - DNA, 1059 bp, Bacillus licheniformis
atgtggaaaggactcatccatcaatataaagaatatttgccagtaacggacaaaacaccggaattgacgctgaacgagggaaataccccgcttatttatctgcaaaacctttcgaaaaagctcggaatcgagctttatgtcaagacggagggtgtcaaccctacaggctcctttaaagaccgcgggatggtcatggcggtcgccaaggcgaaagaagaaggcaatgacacgatcatgtgcgcttcgaccggcaatacgtcggctgctgcggcggcttatgcggcccgcgccaacatgaagtgcatcgtcattattccagacggcaaaatcgccttcggaaaattggcccaagccgtcatgtacggcgcagaaatcattgcgatcgacggaaacttcgacgatgccctgaaaatggtgcgcagcatttgcgagaaagagccgattgcgctggtcaactctgtgaatccataccggattgaaggacagaaaaccgcttcctttgaaatttgtgaacagctgggcgaagcgcctgatatcctagcgattcctgtcggaaatgccggtaatataacggcttactggaaaggctttaaagagtatcatgagaaaaacggcacaggcctgccggtcatgaagggttttcaggcggaaggcgcggccccgattgtcaaaaacaaagtaattgaaaagccggaaaccgttgcgacagcgatcagaatcggaaatccggctagctgggataaagcggtcaacgctgcaaaagaatcgaacggtaaaatcgatgcagtgtcagacgaggagattctccacgcttatcagctcctggcaagagaagaaggcgtatttgcagaaccgggatcatgcgcatccattgcgggcgtgctgaaacagctgcaaacgaaagagattcagccgggtgcgaaagtggttgccgtcttaaccggaaacggcctgaaagatccgaacacagccgttgatgtgtcgcagatcaaacctgtcacactgccgacagacgaagaagctattctcgaacacttaaaaggagccgctcgtgtatga

SEQ ID NO: 3257 - DNA, 1302 bp, Bacillus licheniformis
ttgaaggcgatacgagtggggctgctaggattaggaacagtcgggagcggtgtggtgaagattattcaggatcaccaggataagctgacacaccaagtcggatgccctgttacgattcaaaaagttcttgtaaaagataaagataagaagagggatgtcgagctttccaaagacgttctgacgactgaagcctatgatgtcattcaagatccagaagtagatgtcattatcgaggtcatcggggggatcgaggagacgagacgctatttgcttgacgcgcttcaggcgaagaaacacgtcgtgacagcgaataaagatttgatcgccctctatggatcggaactgacggctgccgcgaaagaaaacggctgcgacctttattttgaagcgagcgtcgccggcggaattccgattttgcgaagccttgaagacgggctggcttcagaccggattacgaagatgatgggcatcgtcaatggaacgaccaactttattttaacgaagatgaacaaagaaaacgcgccttatgacgaggtgctgaaagaagcgcaggagctcggcttcgcagaagcagacccgacagctgatgttgaaggtcttgatgccgcgagaaagatggcgattttggccaggctcggtttctcaatgaatgtcgaccttgacgatgtcaaagtgaaaggcatttcccaagtgtctgatgaagacatcaatttcagcaaacggctcggctatacgatgaagctgatcggcatcgctcagcgcgacggacaaaaagtcgaagtgagcgtccagccgacattgctgccggagcatcatccgctgtcttccgtccataatgaattcaatgcggtttacgtatacggcgaagccgtaggggaaacgatgttttacggacctggcgccggaagcatgccgactgcaaccgccgtcgtgtcagatttggtctccgtcatgaaaaacatgcgtcttggcgtgaacggcagcagctttgtcgatccgcagtttgaaaagaagataaaggcgccgtctgaaatctttgcccagcagtttttaagaattcatgtcaaagaccaggttggttcgttttcgaaaatcacatcgattttttcagaaagaggcgtcagctttgaaaagatccttcagcttccgattaaaggccatgacgacctggctgagattgtcattgtgacacatcatacgtcagaagaggattttacggatatcctgcaaaagctgaacgatcttgaggttgttcatcaggtgaaaagcacttatcgagtagaagggaacggttggagctaa

SEQ ID NO: 3258 - DNA, 963 bp, Bacillus licheniformis
atggacaaaccgtttgtatatgtgacgagaaaattacctgaagaacagctttctgcgttaaaagaagaagcccatattgaaatgtgggaaaaggaagaagaaccgtgtccgcgcgccattctgaaagaaaaagcaaaaaaggcgcacggactgttgacgatgctttccgacacgattgatgaggagcttttaaaaggcgcgccgcatttaaaagtcgtggccaacttggcggtaggctatgacaacatcgatgtggaggctgcgcaaaagcatcgcgtcatctgctgcaacacgcctggcgtgctgacagagtcaacggcagatttgacgtttgctctgctgatggcatccgcccgcagaatcgtcgaagcgagcgactggattagacaagggaagtggacgggctggggtcctctgcttttggccggtgcggatgtccatcataaaacgatcggcattgtcgggatggggagcatcggacaagccgtcgcccggcgtgcgaaaggcttcggcatgaaaattttatatcataaccgcacccgcaatccagatgcagaagcagaactgggcgcatcctatctgcccttcgatgaactgcttgaacaggcggattttgttgtctgcctgacacctctgactcatgaaacgaagcatctgtttaaccgcagcgcttttaaaaagatgaagcgctccgctatttttatcaatgtctcaagaggacaggttgtcaatgaagacgatttatatgaagcgctggtcgaaaaagatattgccggcgcaggactcgacgtctttgcggaagaacctgtgcaaaaggatcacccgctcgtcagcctgccgcaagtcaccgcgctgcctcacatcggcagcgccgccgtcgaaacgagagaagccatgatgaggctttgtgcggaaaatattgcgcttgtcctgagaggaaagcaggcaaagaccgagatttga

SEQ ID NO: 3259 - DNA, 1023 bp, Bacillus licheniformis
ttgcaggaagtgatgtccgtgaaggagctgatcaaagaaaaattcggaatctacattcgcgatcttacatcgtacttgtcttatcaggcttttcataccccgaattcgatgtttttgatcgtccctgtttcccacttgagtcaggatgagctggcggaattgtttagtatgagtcagtatttgcaagaacagcgcgacccatacgtttcatcttttatattgacaaaggacggggagatgacgtttgaggagaatggcgtctcatatgtgcttcttcaagctgctccccgcatgacaaacaggtccgtttcatttggtgcggagctcgccgaatttcatcacaagggaaggggatacccttacgaggtaaaagaaacctcgcggatcgggcagtggaaagaactttgggggaaacggctcgaccagctggaacaattctggattcaaaaaacgcaggcaaggcagctgcagccctttgaaaaacaatttatcgaatcgtttccttattatctcggtttaaccgaaaatgcgattcaatatttggcagataccgaattggatgatcagccgcaggccgctgactcgggaacgatttgccagcagcggctcacctgcgaggctttaaggcgcgagccgcttattaaaatcccgatggaatgggtgtttgatcatgcggccagggatcttgcggaatatgccagaagcttgtttcacgaaaggaaaaacttcaatgaaatcatgttgtttcttcagcaatacgaacaagccgcgccgctatcctcattttctaagcggctgatgtacagcaggctgctgtttccgctccactattttgagacgcttgaagggtactatatttctcctgaatcagagcaccattattttgaaagcagactcgactatttattgtctcaggcgccggcatatgagcaattcctgaacggctttcaagaaatggcgggcatgagatccgcaggattgataagcatgccgcctgtcaattggctgaaaaggacaccatag

SEQ ID NO: 3260 - DNA, 510 bp, Bacillus licheniformis
gtgaaaatgatgccggaaaacaacagcatgcatcagatcgaaacagcagcaaaagaatggcttgagaaacggggcgtcaagatttcggaaattgccgatcttgtctacgtattgcagaagaaatatcatccaaacttaacaaaagaagaatgtgaagagaatgtcaaccgggtcatgaaaaaacgtgaagttcaaaacgccgtgatcacagggattcaattggatatgctgggcgagcaaagaaagctcatggaaccgctccaaaccttaatcgagacagatgaaagcctgtacggcgtcgatgaaatcttatccttctccattgtgaacttgtatggatcgattggttatacaaattatggatatattgataaaatcaaaccgggagtgctcgcacgtttaaacgataaatcaacaggcgaatgccacacgttcttggatgatatcgtcggagcgattgcggcagccgcatccagcagactggcgcatcgagcaaaagatgcggaataa

SEQ ID NO: 3261 - DNA, 771 bp, Bacillus licheniformis
atgaaaacatacaaaggatacttaattgatcttgatggaacaatgtacaaagggacggaaaaaatcgaagaagcatgcgaattcgtgaggaagctgaaagaccggaacatcccgtatctgtttgtcacgaacaactcgtcgcgcacgccgaagcaagtggcggacaagcttgtttcatttgatattccggccgaagagagccaggtattcacaaccagcatggcaaccgccaatttcatcgccgaacaaaaacccgatgcttccgtatatgtgatcggcgaagaagggatccgtcaggccattgaggaaaaagggctggcattcggcggggaagacgccgactttgtcgtcgtcggcatcgaccgcggcattacatacgaaaagctagccgtcggttgtcttgccatccgcaacggcgctacattcatctcgactaacggcgatatcgccattcctacagaaagaggactcttgccaggcaatggttctctcacgtcagtattaactgtttctacgcagacagagcctatttttatcggcaagccggagccgatcatcatggagcaggcgatgaaggtgctcggcacagacatcagtgaaacgctgatggtcggtgacaattatgatacggatattatggcgggaatgaattccgggatggacacgcttctcgttcatacgggcgtgaccaaaaaagaacaccttgaagcctatcaggaaaagccgacatatgtcattgattcactgacagaatggctggatcgcgtctaa

SEQ ID NO: 3262 - DNA, 444 bp, Bacillus licheniformis
atgatgtattttgtcgatcgacacaaaatcgaaaacacgctcaacttcctggaagaggagctgcggctttatcaaatgcaggaagaatggacttccgacgtcgaaaaaaaagcgcttgaacgaatcggccacacgctgatcgaatgtatattggatatagggaacgatatgattgacggctttattatgagagatccgggaagctatgacgacattatggatatactgaccgatgaaaaggttgtcagccaagcggaaggcgacagtttgaaacatttgatcgcctatcggaagacattggtccaagactacctgaacgtcaaccatgaagaattggaagagctgctcagcaggcatgcggaaacgctcgagaaatttccggcgcggatccgcgattatttaaaccatgaactcggtccggtatccgcattcaaaccgcactaa

SEQ ID NO: 3263 - DNA, 276 bp, Bacillus licheniformis
atgattgtcgttcagaacgctgcatttgaagtcgtcaaagatgtgaaaaacggttttaacgaagaagcgtttaaagccagatactccgacattttaaataaatacgactacatcgtcggggattggggatacagccagctgaggctgaaaggcttttttgacgatcaaaatcaaaaggccacatttgatacgaagatcagcacgcttgatgaatatatttacgagtactgcaatttcggatgtgcctactttgttttaaaacgtctgcgaaaataa

SEQ ID NO: 3264 - DNA, 624 bp, Bacillus licheniformis
atgaataaaaaaattcttttagcagggctggtggcgctgcctttagcaggctgccagacggccttaaacgataccgaacacaatatatatgacgaagacggaaataccgttcacgttgcagacaagaaccctcaatatcaggaaaagttcagaaatgacaaccgaaaaggcagattcggatatgcgcgccatcaggcaacaccagtcgcaaacaaggaagaaatgcaggcgccccaaatcgaccgggaagaaatggcgcatattatatctagtttaacggttcagcttcccaatattcaagatgcgtcggcgcttgtgacagacgaagaggcgctagtcgtgtacaaaacggactccgggcagcgcaaacagacggctgatcaagtcaaaaagacggcggcatccgtcgttccgagatattaccatatctatatttccgatgatccggacatgatgcaatccgtcgctaatttcagccggcttggagccaattcaagaaacgtcgatcagctgatggccgatacaattaaggaaatgcaaaaatcgccgcaaggcaaaaccacgacaggtacagatgaaaacggaaacgaccttgacggaaaaggaaaggcgaccgaatcttga

SEQ ID NO: 3265 - DNA, 897 bp, Bacillus licheniformis
ttggcaaagaaagacgagcacctaagaaagcccgaatggcttaaaatcaagctgaacacgaatgaaaactatacgggcttaaaaaaattaatgcgggaaaacaacctccatacggtctgcgaagaggcaaaatgcccgaacatccacgaatgctgggccgtcagacgtaccgcgacctttatgattctcggatctgtctgtacgagagcctgccgcttctgtgcggtgaagacggggctgccgacagagcttgacttgaatgagccggaaagagtcgcagattctgtgagcatcatgaacctgaaacacgcggtcattacagccgttgcccgtgacgatttaaaagacggaggagcgggggtattcgccgaaaccgtacgcgccgtccggagaaaaagcccatttacaacaatcgaagttctgccgtccgatatgggcggagactataataatttgaaaacgctgatggatacgcgtccggacattttaaaccataatattgaaacggtccgccgcctgacgccgagagtccgtgcgagagctacatatgaaagatcattggaatttttgcgccgcgccaaagagatgcagccggacatcccgacgaaatccagcatcatgatcggtcttggcgaaacaaaagaagaaatcatcgaaacaatggacgaccttcttgcgaacaacgtcgacatcatggcaatcggccagtatctgcagccgtccaaaaaacacattaaagtacagaaatattaccatcctgacgagtttgccgaactgaaagaaatcgccatggaaaagggcttcagccactgtgaagcaggaccgctcgtccgttcttcataccatgccgacgaacaggtgaatgaagcgtctaaaaaacgccaggcgcaggcataa

SEQ ID NO: 3266 - DNA, 981 bp, Bacillus licheniformis
gtgaaagctgtattatccgttctcatcctccttttgctcatcttgcagccgtgcgctcttgcaaaggagaaaaaagagcccgatctgcaaaagagaatggccctttatcataagacagaagccgcaacccatattccttggtatgttttcgcggcagtcgaccaatacgaaatcaatatccgcaaaaaccgcaaagacttgccgaagcaaaaagggcacaccgggatatatattccgcaaagcgtgtggagcggacctgaaaaccccaatcctaaagatacatcgccgctcagcatcaaggtttttgacggaattggaatggacggaaacggagacggactcgcagaaccggatcaggatgaagacgtcctttatacgtttggacaatacttgttgacatacggaagggacattgaaaatatccgcatcggtctgtgggagttttacgaaagggatcagacggtcggcatcatatcaggctttatcaggctttttcaaaaatacggccacattgatttgggcaagcacgcctttccccttcccgtaagatcagattacagctatagaagcacatggggagatgcccgcggattcgggggcagacgcattcacgaagggacggatttgttcgcccattacggcctccccgtccggtcgacatgctacggcattgtggaaatgaaaggctggaaccgtttcggcggatggcggatcggaatcagagacatcaacaatacgtaccattatttcgctcatttgaacggtttcacaaaaggcttgaaagtgggagaaatcgtcgagcccggccaggtgatcggctcagttggagcgacgggatacgggccgccgggaacatcgggaaaattcccgccccaccttcactacggcatgtataaagacaatggaagaacagagtggtcttttgacccttatcctcatttaaaggcatgggaacggaaggaacttcgaaagaaaaaataa

SEQ ID NO: 3267 - DNA, 114 bp, Bacillus licheniformis
atgaacggcgcatctatagcaatgatggtgatcggcatcgtcattatttggggaggattggccgcaagcattatcaatgcggttgtgaaaagcaagaaaagccaggccggctaa

SEQ ID NO: 3268 - DNA, 1530 bp, Bacillus licheniformis
atggataatcgtccgcaatggggaacaagagcgggttttattttagcagccgtcggttctgcgatcggtttggggaatatttggagattcccggcagtagcttatgaaaacgggggaggcgcgttctttctgccatatttgttcgcgctcttgacagcaggaattcctcttctcatcatggaatttacaatcggtcataaatacagaggctcagccccgctgtcctatgccaggatggggaaagggaaggaatggatcggctggtggcaggtcgccatctcatttgtcatctcgacgtattatgccgttatcgtggcatgggccatttcttacactgtcttttcattcaatttaggttggggtaaaaatacagaaaatttcctaatgaataaatatttaaacagaattgatatcgggggaggagccatcggccaattcggcggcttcgtgccgggcgtcctgattccgctcgcgattgtatggattgtttcattggggattttatttgccggagtcaaaaaaggaatcgaaatcgcgaaccgcattttcattccgctgcttgtggtcttattttttatcattgtcatttattcgataacacttgatggggctgcacaaggactgaatgcctttttcacgcctgattggagccagattacaaacggaaaagtgtgggtggcggcctacggccaaattttcttcagtctgtcgattgcgtttgccatcatgattacgtattccagctatttgccgaaaaaatccgatattacaaacaatgcgtttatcaccggctttgggaactcgtcatttgaactgctggccggaatcggggtattcagtgcgctgggctttatggctgcgcagcaaggcgttccagtcaaagaagtcgtctcttcgggaatcggtttggcgttcgtcgtcttcccgcaaatcatcaatgagtttccggcgtttaatgcgtttttcggatttttattctttggctcgctcgttttggcaggtctgacatctctcatttctatctctgaaacatatgttgccgcgattcaggataaattcaacgttccgcggcggaaagccgtcctgttcggcggaggggctgctgcattgtgttcgctcgtatttgcgacgaaaggcggactgttcttcctcgatgcggccgattactttatcaacaatttcggagtggcgcttgccggattgatcgaagtcgttgcgattgcatggtttgcgaaagagctgaaagctctgcaggctcacgccaattcggtttccgacattcagctcggcgcttggtggagaatctgcctgagcgtcgtcaccccgattgttctggggtatatgatgtttgataatatcaagacgaatatcacaacagcctatggcgacctgccggttgaattcctcctgaaatggggatggtgcgtcgcttttggagcgatcgcagccggatttatcctttcgctttcaaaatggaagaatgggctggcatatacgccatttcaacatgacaaggaggtttcctcatga

SEQ ID NO: 3269 - DNA, 774 bp, Bacillus licheniformis
ttgcgaagacttcgcggccctctgtcaaaaagaggacctttgcctttgcgatatgtcatgctgctttcgtttatattttttattttttcaacggccgtcagcctgttgattatcaactcatccatcaaaccgacccttctgaacatcgctgaaatggaaacgaaccggattgcgacccacgtcatccaggaagccgtcgaggattatatgagccaagatgaaaatgtgaaaaatctagtagaaatgaagacgaatgaaaatggaaaagtaacaacaattgatttcaactctcatggtcttagtggtatgcattcgaaaattacgaaacaacttcacgaaaagctgaaggaaacagaaacagaagaatttaattcttctgcgaaaactcccgaaggtaagaatgatggtgtaatctataatattcctctgggtcaggcaacgggaaactcgcttcttggaaacctggggccgaaaatacctgtacggtttaatgttgtgggggatgtctttacagattttaagcaaagtgtcgagccatatggtattaataatgcattaataaatgtcggtgtgcttgtcgaagtcaaggtccgtgtcgtcataccgtttgcgacaaaaacggcggttgtcaaaaatacgattccggcaacgattcaagctgtgcacggagaagtacccgacttctacagcggcaacggcagccaaacggcgccatcgattcagatcccttcaaaggatgaaaaaacagagcaaaaaaaggaacaaaaagagtaa

SEQ ID NO: 3270 - DNA, 306 bp, Bacillus licheniformis
atggtaaatttaactccgatcatgatagaagatcagccgtttacggctgtaacggtcaaactgccgaaaacgaactttatggcggtaaccaatgaccatggatatattatgtgcggagcgcttgatgtcgccctgctgaatgataaattaaaagaacggaaaatcgtcgccgccagagccgtcggcgtgcggacgatcgatcagcttctcgaagccccgctcgaatctgtaaccgatgcggccggagagctcggcattcatcccggaatgagcggaaaagaagcccttttaaaaatggtgaaataa

SEQ ID NO: 3271 - DNA, 1356 bp, Bacillus licheniformis
atgacggaaaagctccatatctaccatacgaacgatttgcacagccattttgaaaactggccgaaaatcgtcgattacattcagacacaaagacagaaacatgaagagcagggggaagaagtgcttttgttcgacctcggcgatcatgtcgacagattccatccgatatctgaggctaccttcggaaaagcgaatgtggagctgttgaaccgtctgcagtatgatgctgcaacgatcgggaacaatgaaggaattacactgccgcatcaggagttggatacactttatgacaacgctcagtttcctgtcgttgtctccaatttgtttgacggagaagggaagaggcccggctgggcagcgccgtatttgctcaaaaaggtgaagagcggcgcaactcttgccattctcggtgtgacagtcccgtactatccgatctatcgccagcttggctggacggttacagacgcatttgaaagcatcggagagatgctaagtgaaatcaaagaaaaagccgacactgtcatccttctttcacaccttggcattttggacgatcagcgcgtcgcggaggcttttcccgaaatcgacctgatcctcggctcccacacccatcacctgcttgaagaagggatgatgaaagacggcgttatgctggcctgcgcggaaaagtacgggaactatgtcggtcatgttgaactgacatataacggagcgcttgagaacatcacagcaaccgtcatgaagacggcagattggaatgaagaatcagaggagacgattcgttttctgaaggaaaaagagagagaagccggacatctccttgaagaggaaattgcgacattggacaacacccttgaaaccgcctggttccgcagaagcgcccttccgcaaatgctggcagatgccttaaaggaatggtgtgaggcggaaatcgggatggtcaactcaggcattgtgctggagtctctttcacaaggtccggtgacgaaagccgatgttcaccgcatctgtccgcatccgattaatccggtcaaactgaagctgacgggacgagagctgaaagaggtcatcctccatgcatcatcagaacaaaccgagaagctgcgcattaaagggctcggttttcgcggcgaagtgatggggaagatgctgtatgccggccttgacccggaaaagctctccgtcaacggagcggacattgaagatgatgcgttctacacgctcgccacgattgatatgtttacactcggaacgctgtttcctgttatccgcgatgcggaagatattgactactttatgcctgaattcctgcgcgatctgctcgcctggaagctgaaaaaagcaaaccggtcctaa

SEQ ID NO: 3272 - DNA, 822 bp, Bacillus licheniformis
atggaatatcttatcttgatcatactcgggtttatcgcgggaaccatcggcagtcttgtcgggctcggcggagggatcgtcatcgttccctcgctcctttttctggcggggctgccgacgctgtttgaccatgtgacaccgcagatggcggtcggcacatcgctggtcgtcatcatattcacagggctttcttcaacgattgcgtatatgaagtataaaaccgttgactataaaagcggccttatttttttcatcggctcggggccgggcagcatcgtcggtgcccatgtatcgacatattttagctcagactcgttttctctatggttcgggatttttatgatcctcatttccctttccttaatgataaagaaaagggtgaaacctgccgagaaaaagcatacgggcgttatcagaacgttcacaggtgatgaaggacaggaatatacgtattcataccatcctttagccggaatcgcgatcgccttttttgtgggctttctcggcgggcttttcggcatcggaggcggctcgctgatggtgccggcgatgattcttctgtttttatttccgacaagggtcgccgttgcgacatcgatgtttatcattttcctttcatctgtcgcgggctctgccggccatgtcatctcgggacatgtcaactggctttatgcgcttgcattgatcccgggcgcctggtttggcggacagctcggcgcctacattaacaaaaagatgcagacaaagacgatcgtattgatcatgcggttcgtattgattctcatcggaatcagattaatctatcaaggcgtgtttagttaa

SEQ ID NO: 3273 - DNA, 852 bp, Bacillus licheniformis
ttgatttatattggattaacaggatggggggatcatgacagcctgtatccgcccaagacaagcagtcaaaacaagctgatccactattcatcgcattttccgatcgtcgagcttgatgcgagcttttacgcgatacagcccgagcggaacaatgaaaagtgggtaaaggagacgccggaaacctttcagtttatcgttaaggcatatcagggaatgacagggcatcagcgcggggaaatcccctttgaaacgaaagacgacatgtttgctgcttttaagctctcattaacgccatacataaaagcgggtaagctggcgatggtcctctttcagtttccgccatggtttgattgcaagaaagaaaacgtcaattacttaagatgggtaaaagagaaaatgggagatatcccgtgtgcgcttgaattcaggcataggtcatggtttatgccccagttttacgacaaaacgctcgcttttatggaggagcagcaatggattcacagcatttgcgatgaaccccaggcgggcgaaggcagcatcccgactgttcttcacgcgactgacagccggaaaacgctcgtccgttttcacggccgcaacaaggaaggctggttaaggccatcttccggtcaaaattggcgtgaggtcagatatttgtatttatataatgaacaagaattaaaagactggaaaagaaaccttgagctgcttgaacagcagtcgaaaaacgtttacgtgctgtttaataacaattcgggcggtgatgcggctcaaaacggtaagcaaatgatggagctgctcaacattgaatacaaagggcttacgccaaggcagctcgatttattcagctag

SEQ ID NO: 3274 - DNA, 522 bp, Bacillus licheniformis
ttgattttagcttgtgaaatcggcttttggatttttattctgcttggacttatttttcgctatatggcaggctggaaaaaggctggtttgatcatgtttgcatgcacaccggttttggatttactgcttttggctgcaacgtcgcttgatctgcacaatggggcgcaagcggatgttttgcacggcatcgccgccgtttatatcggcgtcagcatcgcgttcgggagccgcatgatcaaatgggcggatgaaaggtttgcctatcgctttgccggaggtccgaagcctgacaaaggcccgcagtacggcagggaacacgccaaaaaagagcgtgaaggctggtttcgccatttcatcgcatggctgatcggagcggctctgctggccgggatgcacctgttcatcggcgacccggaaagaacggaaccattaatccgcatcgcttctttatggtcgatcatccttgtcatcgattttttgtacagtttcagctttaccctttttccgaggaaagcccgttaa

SEQ ID NO: 3275 - DNA, 585 bp, Bacillus licheniformis
atgccaaaaatagttgatcacgaaaaacaaaaagaaaaaattgccgaagcggtgtggaatgtgattcacagagatggacttgaacaatgcaccgtcagaaatgtcgctaaggaagccggactttcggccgggtcgatgcgccattattttcctcatcagtctgagcttttcatttattcaatgaggcttgtggcaaaccgggtcaaaacgcgtatcgaaaacatgacatttaacggtacaccggctgaaaacgtcaaacagcttctttttcagcttatgcctcttgatgaagagcgaaaactggaaatggaggcatggtatgcatttacagccaaatcgctcagcgatccggagctcaaaccgttgagaaaggagatgaatgaaggcatttattcagcctgcaaatcggctgttgaaatactggtaaaaaccgaaaaaaagaccgggatcgatgttcttaaggaaaccgagcatctatacgcccttgtcgacgggctggcgcttcatttgatcatggcccctgaaaggctgacggctgaaaggatcgatactgtattggcgggttatttaagatcgttggaatag

SEQ ID NO: 3276 - DNA, 332 bp, Bacillus licheniformis
atgaagaaaaaacggttcggaatcttgttcttggttcttttcttgttactgtttaatacagcttcacaagcggctgatccaaatcaaaaaacaactgaagaagtacttctgaacgcctttgataagtttggtttagttagttctgtgattggaaaaacagaccagttatatcaatcggcccagatgatactcgcagcgaagaaaaactccgagaatacttagatgagaacttacctccagatgcaaaagagaaatacgaaattgaaattattaaaagaaatgtcgaagaaatgaagaaggaaatccgtgagaatttaaaacaagagcattaa

SEQ ID NO: 3277 - DNA, 1227 bp, Bacillus licheniformis
atgacaattggcgaaatgaatattccgaaacggacaattatgactcccggtcctgtcgaggttcatccgagagtgctgagggcgctttcctcacctgtactgggacagttcgatcctgcatttacagacatgatgaacgacgtcatggcgctgcttcggcagattttccgaacgacaaataaatgggcattcccgatagacgggacatcgcgggccgggcttgaagccgtccttgccagtctcatcaaaccgggggacagggtgctcattcccattttcggacggttcggctatctgcttgccgagatttgcgaacggtaccaggctgatgtttatacaatggaatgcccgtggggagacgtttttgaaccgaaagaggtcatctccgaaatcaaacggacgaaaccggagattgttgcggttgtgcacggcgagacatcgacgggatgcattcagccgctcgaagaaattggccgggcctgccgggagcttgatgtgctttgtgtagtcgatgcggtggctacaatcggcggcacggatgtcaatacggatgaatggtgtcttgacgcggtcgtcggcggtacgcaaaagtgtttatccgttccttcaggtatggcgccgatcacatttaacagccgggttgaaaagcgcatcaatgaaaggaaaaaggtagaacggggcattgccacaagagaagatatcgtgcttgaaacgggacgcttgccgatttccagcaattattttgacctcggcatgctgatggattattggagcccgaggcgccttaatcatcatacagaagcgacttcgatgctgtacggcttgcgcgaaggagcgcgggtcgttcttgaggaagggctccgcgagcgattctcaagacaccggctccatgaaacagcactaatcaagggcatcaaagcgatgggactcgaattgtttacggaaggccggaaaaagctgccgaccgtcacttgtgtgaaagttcctgatcgggttgacgcagatcttgtcaggaagatgatgcttgacgacttcggcgtcgaaatcgccagctctttcgggccgctggccggaaagatatggagaatcggaacgatgggatacagctgccggaaagaaaatgttctttttacattggctgctctcgaagctgttctcattcgcacaggtgcttcagtatcgccgggaaatgcgcttcaggcggcactggatttctatcatgagtag

SEQ ID NO: 3278 - DNA, 1254 bp, Bacillus licheniformis
atgaccattggtattcataagaccggagaaagtacagcccgcaatatcgaagacatgatcaattggctggcatcattcggtgaaagcggagaaggaggggtgacaaggcttctctattcaaagccgtggctcagcgcccagcagtcgttgaaggaaaagatggaggactggggaatagagccgtacttcgatgatgccggaaatctgtttgggagaatagaaggtacagagaaccgtacgaaagcgatcttgaccggttcacacattgatacggtcatcaacggagggaaattcgacggagcgtacgggattttagcgagccttttgtctgccaaacaccttctggacacgtacggcaggccgaaaacgtcaatcgaagtcgtgtctctgtgcgaggaagagggaagccgtttccctttgactttttggggatcggggaatttaacgggcttgtttgactgtcaaaagacgccggctgtgcacgatcgggacggagtatcgattgagcaggcgatgaaagattgcggtttcggaaaacggcggtacaggcgcccgttcaggcgtgatgtgaagtgctttatcgagcttcatattgaacaggggagcattcttgaggagagcggccgtcaaatcggcattgtcacggacatcgtcggacaaagacggtttacggttatggtcaagggagaaagcaaccatgccgggacgacgccgatgaacgccagaaaagatgcggtggccgtctcggcattgtgcatttcctatttgacgaacaaggctaaagctgcttatccgcttttaacagcaacggtcgggaggattgaagcaaagccgaatgtgccgaatgtcatatcaggagaagctgttttttctcttgatctccgccatcatcatgatgcggtgttggaccggtattgcgacgatatttttgcttatttcacagagctggccggcgaatggaacgttcagatcacagttgaacagacgacggatgcgaagcctgtgaggatggaccgggatttgattcaactctcaaaacagtcggccgaggatcttgacgtatcctatcaggagatggtcagcggggcggggcacgatgcccaggttttcggcccgcattgcccgacgtcactgctgttcgttccgagccggaagggcatcagccattcgccggaagaatggacaaaaccggctgatcttgcagccggcgttgagctcttgactcatgtattatacaggctggcatatgaatga

SEQ ID NO: 3279 - DNA, 1599 bp, Bacillus licheniformis
atgaatatctatgacatgatgaaactccctgtatttaaaggcgcaacgcttgccgctggaaaggcgggcgtaacccggaacattgaacacatcaatatgatggatgcgccagatattgccgattatctgcatcatggcgaactcctcgtcacgaccgcataccatttaaaagaccggccttttttattgaaggaattgattgaaaggatgatcaggcggggctgcgccggactcggtatcaaaacccgctttttgcaggaaatacccgacgaggtgatcaagcttgccgacgagcggacatttccgatcatcgagctaaatgaagatgtccgcctcggtgatattgtcaatcatacactgagccatattctagacaaacggacggcagaactcgaacaggccatcgccgctcaaaaaaagttcacaagccatattatgagcggaaaaagcattcaatcgctcttgcataacgtctctgctgttttaaagcttcccgttcttctattcaatcagcacctcaagccgattgcctcctcaaaagcagatgccgccgggacgctgtcggattatgaaggaatatttcaaaaaggaaacagaacggggctcacctgtttttcaacgattcccgacaaacaaacctattcggtatttccgatctatactcatgaaaaaaaatgcggcttcctcgttgtctgcgggatgatttccccttcagacaaaggcttgctgttaaccctcgaacaagccgccaatgtcatcgcctttgagctgctgaaggaaaatgcgctcaaacaatatttgcgaagagcgcggaacgagtttttcagaaattttttggacggcgccttttcctctgctgaagaaattaaaaaccgagcaaaagaatttcagctcaagtgggatcaaaaatatgtgtgcatcgccggcaaattggaccgccgcgaaaaatcgctcagcttcacggaaaatcagcttgaatcagattccgtgttcgaacgcctggaagaagagctggttgacttcccgtttcctccgcaccttttcacaaaaggaaacatatgcttcctgctggccgaggcgacggacagctgggctgaaatgaatgcagccgtgggcggatttttaaaggcgtttcagcgccatgcatctgagcattttcagcggacgatttcttttggaatcagcaacctcagccatcagctgagagacgttccgcacatttgcaaagaagccgtcgatgcgctccactccggccatttgtcaggcagcaccgagttcatccagacgtaccatatgaaagacgtgtcagagcttttgcgcatgattccggctgatgatttgaagacattttacacgcatgcgctgcatcagcttgccagcctgccgaaggatgacccagggctcctgcaaacattgtccgtctatctggaaacgcactgtcagatttctgaaacggccaagcgcctgtacatccacagaaacaccgtcatctacaggcttgaaaaatgcgaggaactgctcgggaaaagcctgaaagatgcggacacgaccttgcgcttgagactcgcgctcagaattcaaatgctgcttgggttgtga

SEQ ID NO: 3280 - DNA, 1197 bp, Bacillus licheniformis
atgaaaaagatggccagattgtatatgctcatgcttaacgtgtttatcgtgatgcttggtataggcttgattattccactcatgcctacgtttatagaagaattcggcgcgtcaggcagcacgctcggattgctgatcgcggcttcggggattacccagctgctgttttcgcccgttgccggggaaatgactgataaatacggaaggcggaaaatgatcattttaggaatcggtgcgtttgcggtttcccagctgcttttcgccttggcgagccagatgtggctgctgtttgtttcccgccttctcggcggagcgggagctgcgtttttggtgccggccatgtttgcctacatcgctgacatcacatcggaaaaggatcgaagcaaagggatggggctgatcagcgccgcgatgtctctcggctttgtcatcggtccgggagcaggcggatatttggcggcgttcgggctcaccttcccgttttacgtgtcagccggattagccggcttggcgacggttttatcgcttcttgtcctcccggaaacgctcagtcaagaaaagatgcttgaaaagcgccgctccgttcaaaagcgcgaaccgctcgctaagcaaatggcgcgcgcgctgcggtcgccgtatgcatttctgtttatcctcgtgttcatcttgaacttcgggatcatgaatttcgaggcggtattcagcctttatgtcgatcataagcacggctttacaccgggagacattgcctttgtcataacagcggcaagtctgatcggcgtgttcgtccaggcggtggctctcgggatgctgacgaaccgcttcggcgaaaaaaagctgatgaacatgacgctgatcggttctgccggagcgcttgccgtctgctcgattgccggttcgtactggctggttttcggggcaacaattgttttcttcatgctgacgtccattcttcgaccggcgattaatacgctgatttcaaaaatggccggagatgaacagggatttgccgcaggcatgaacaatgcgtttatgagccttgccaacattgtcggaccgacagtggccggtctgttattcgatgtgaacgtagaaattccatatatttttggtgtggtcgttctcgtgctcagctttttggcggcagtcagctgggggcggaagcagcaggcgcgcacaattcctgaaaaagtataa

SEQ ID NO: 3281 - DNA, 1407 bp, Bacillus licheniformis
atgggaatgccggcttacaaaacagaagaggtgaaaaagaacgaaaaacgcaaaaaggaatttccgcatatttatgtcattctggctgtcatgattggtcttatggcgcttgcgacatatatcattccggcaggcgaatatgaacgggtggaaagtccggacggcagggaaatgattgatccagcgtcctacaaacgggtcgaacagacgccggttgatattcttggcttgcttacggcggttccgaaagggatgacagaagcggctccgattattgtgtttacgtttgtgattggcggagcttttgccgttctgaggaaagcatctgtcattgagctcggcgtccgtctgttggccgatcagttcaggaacaagcctgttttcgttacgcctgtcttaatattcgttttctccggcatttcctgttttatcgggacgcctgagctttcgatcgtttatgtccctgtcattcttcctttgctgctgtccctcggatatgaccggatgacagcagcagcaatcgcattgtgcgggacgatcgccggctttacgagcgctttgacaaacccatttaccgtgggaacctcacaaatgatttccggtctcccgctttattccgggatggggtacagggcggtcatctttgttgtcgttacggcgattgccgctgtttatgtgctcaaatatgcggaaaagatcagagcgcatcctgaaaaaagcctgacgggcaaggaagcagtcgaacccgtgccggcttttaaagcaggcggacgggtgaaatgggccgggatcgcggcgcttgggttgtttgccggcttgattgggtgtgtaatttatttcaggtgggatatgctgacaatggcgggctatttcctggcgctcggcatcattcctgcttacatcgccggcatgaattcgagagacattgccgagtcctttaatgagggttttaaagaagtgctcgtcggtgcgatgatttgcggcattgcaagagctgcagcagtcgttatggccgacgggcagatcatggatacgattgtttacggcttgtctcatgctgtctcacagcttccttcgtatttaacggttacggcgatgctctttacacagatgctgtttaacttttttgttccaagcggaagcggacaggctttaataatgatgccgattatggcgcctttggctgatatcgtcggaattacgcggcagacggcgattctggccttccaattcggagacggtttttcaaacatcgtctttccgacatcgggatattttatggcgacgcttgcgatcagccggattgcctggaacaaatggctgcgattcatccttccgctgttttgcctctggatgggagcggccgtgcttttcctgatgtttgctaacgctgtcggctggtcgtaa

SEQ ID NO: 3282 - DNA, 735 bp, Bacillus licheniformis
ttgcagcagtggattaaagaagtggccagaggaaaaaggggcgcccgggatttaacttatgaagaggccagacaggctgctgaagcgattgttacgggaaatgcaagccccgctcagacagccgcgttgttaatagcggagaggatcaaaacggagtcccctgaagaattgttcgcgtttaccgaagcattgcggaacagctcggaatcattgagcctttccagagctgtaaaagaggcggtcatcgattttgcaggaccttatacaggaagacattcttttttagcaaccattcccgtctccctccttctcgcaggaaacggcgttcctgcgtttctccacggcagcgatgcattgccgcccaaatatggaacgagcgtaaaagatgtcctggacaaactcggaatcccctctgagactgccccagcgcaaacggcacgctcactcgaaaaggctttaatcggattcgccgccgccgaaacattttgcaaaccgtttgttcgcatgaggaaaatccgcgaggaaatcggcgtccgcaccgtgttgaatacagcagaaaaactggtcaacttctctgatgccgacaagcttatgatgggcgcatttcaccggacggccatacagaaaatgcatcccgtatttcagcgcttgacgtacaaagaagtgttcattgtccaggggcggagggctcggaagatgtgccggtccacagaggcagctttgtgtttacaataa

SEQ ID NO: 3283 - DNA, 348 bp, Bacillus licheniformis
gtgccggtccacagaggcagctttgtgtttacaataaaaaacggcgagatcgattcttttatattaaaacctgaagaatacggactttacgcagaggaagcaaagctcaacaaaccgctgtctgctgaagagcaggcggaaaaaataacagccgttctcgccggagatgaatcggcggatacggaatacgaaagaaaacaagtcatcatgaatgccgcattgcgctattatttgttcggatactgcgcggccattgaagaaggtgtccaagcggcggaaaaacagctgaaagaaaaagccggtctggaagctcttgaaaggtggaaagcttcatttacaagaccgtaa

SEQ ID NO: 3284 - DNA, 813 bp, Bacillus licheniformis
atgaaccgaaagtgtgtcattccgtttattttgatgttgtcggcgatgtgcgcgcccgcccaaaacgcagaggccttccagctgttttccttacccgtacaatcctcggctccggcagattactacgaacaggcgcagggcaaaacaggtgaagctttaaaacgagcgcttcacgacacaatcgacgatcatcgagagctgtcttacagcgaggtatgggaagcgctgaaagcaacggatgaagatccggccaatcgaaacaacgtgatactgttatattccagagagtcgcgctctaaacaggcgaacggggggcaaacgggcgattggaaccgcgagcacgtatgggcaaaatcgcacggtgatttcgggacaagcaaaggacccgggacagatttgcatcacctcaggcccagcgatgtgcaagttaacgccgcccgcggaaaccttgattttgacgaaggcggcagcccctatcccggagctcccggaaactactatgacggcgattcctgggaacctgacaaaagcatcaaaggcgatgtcgccagaatgattttctatatggcggtccgctatgaaggggacgacggtcatccggatcttgaaatgaacaatacaacgaacaacgggtctaaaccgtaccacggaaaaatgtcggttttattgaaatggcatcatgaagaccctgtcgatgccctcgaaagaaagcggaacgatatcatctatcagcaataccagcataaccgcaatccgttcattgatcaccctgaatgggcggaggatatttggggctcgggcgttttgaattga

SEQ ID NO: 3285 - DNA, 840 bp, Bacillus licheniformis
atgatccagtttgactttgagtattacagcccccaatctgcgcaggaagcggtaaagctctttcaaagcctggagcgggaggggaaaaagccggcgtattgttccggcggaacagaacagttgatgctcggacggatgaatgtgatccatacaaatgccgtcatcgatattaaagatatacctgagtgcaggactttgcaatttgaacggcatcaccttgctttaggctcggcgctaacactgacggagatcacggaaaacggcggctttccgctgttgagcaaagcggcgagagaggtggccgaccatacggcgcgcaataagattacgcttggcggcaatatttgcgggcagatcttttaccgcgaagcggtgctgccttttttattaaccgacagcaaagtggtgacagttggagacaaggggaaaaagcgctatctgattcacgacgtatttgatcagcagctgaagctgagcaagggagaaatcctcatttcgcttttgattgaagaacgctatcttcatcagccttttgcaagcataaaagtgaggcagcgatgggatacgggatatcctttggcaacgatttcggctctcgaaatagacggacgcgtccgctgtgcattcagcggtgtctgctcttatccgtttcgctccgctgaagtggaatctgcgttgaatgacgaggcactccctgttggtcaaagggtggaagaggcgatcaaccgcctgcccggtcctgtattggacgatgcgcaaggttccgcagagtaccgcacgtttgtcatcaaacatactctgtttgacattctcggcatgctgaaaaaggaaaccttatga

SEQ ID NO: 3286 - DNA, 1044 bp, Bacillus licheniformis
gtgacattgattgaccgcggagagcggggaagggctacagatgccgcggctggaatcgtctgcccctggctttcgcagcgcaggaaccaggcatggtacaagcttgcaaaaggcggtgcggcgtactatgccgatttaatcaagcagcttgaagctgacggagaatcggatacggggtataaacggacaggcgctatcagcttgcatacagacgagcgaaagctggagaaaatggaagaacgggcgcatctaaggcgcaaggatgcgcccgaaatcggcgagatcacccggttatcccatgaggaaacgaagcgtttatttccgcctttggcagaggggtacagctcggttcatatcagcggagccgcgcgcgtgaatggaaaattgctgcgccgctcacttgtgaatgccgcaaaaaaatacggagcttctgttgtttcaggaaacgcttcattgctctatgaaggaaaccgggtaacagggatctccacagggggcaagaaaatatacgctgatcaggtgcttgtcacagcgggagcttgggcggacgagctcttgaagccgctcggcgttcgtttttcagtcagctaccaaaaagcgcagatcgtccacctttgtcttcctgatgccgataccggcagctggcctgttgtgatgcctccgaatgaccaatacatactggcatttgaagacggccggatcgttgccggcgctactcacgaaaatgaagcggaactggacgatcttcgggtaacggccggcggccttcacgaaattttctcaaaggcgctcgccgttgcgccggggttggaattgagcgagctgcttgaggcgcgcgtaggcttcaggccgtttacaccgggctttctccccgtgatcggctcattgccgaacatttgcgggctcctcgttgccaacggtctcggcgcttcagggcttacgtcaggtccgtaccttggcgctgaattggcaaggctcgctttgggagaagagcctgagcttgatatcgctttatatgatccggccggcgcgcttgaaagttga

SEQ ID NO: 3287 - DNA, 861 bp, Bacillus licheniformis
atgactgtcgtgggtttttgcgtattattatgttctgcatttatccatgcatcgtggaactatctttctaaaaaagccgatggaggcgttccgtttatctggctgttcacagcgattgcagccgtcatctacacgccgttggccataggtgtcgtcatatatgaaaagcctgagatcggcatctggcagcttgtcatcatcatggcgagcatccttgctcacttgggcttttttcttgttcttcaaaaaggatacaaaaagggcgatctctcccttgtctatccgatcgcgagggggacaggcccgctgctcacctgcatgctggcggtcgccttttttggcgagacgttgacgctgcccgctattatagggattctattgattgtgatcagcattcttttttttacagggggagtgaagcggttaaaagaatcaggctcgttcacaccggttctttacgggctggcggtcggcggcattattgccgcatatactctccttgataaagcagcggtcagccggtttctcattccgccattgctgctggattattgcaatacgctcggccgcctggtcatattgactccttatgccgcgaaaagctggagtgaagtccggtttgagtggaagcatcaccggatggaagctgtcggggtcggggtttttaattctttggcttatattttggcgctgagtgtcatggtatttgccccggtcagctatgtggcgcctgttcgggaaatcagcattttaatcggaaccgtgatgggggcggttcttttgtccgaaggtttcggacgactgaggatcatcgcggctgccttaatggtgcttggcgtgatatcggtagccgctggttag

SEQ ID NO: 3288 - DNA, 384 bp, Bacillus licheniformis
gtgaaaatgttgaaaaaggctgtgttgatagccgctgttttcttgctggccgcatttgccgggagtacagaagcctttgctatgccttccaaaggcgcggtgaaattcaggacggatgccaatacatatacgaaatcagccacttcgatcgttgtcactggaaaaagccctgttacgggaacgatgattgccgtcaggctgatcaataaaaaagggactgtcctgatctatcgagatgttcatttaacgcgcggaaagcctcattttcgggtgagctttccgacgaaaaagctgaaaccgggcaagtatgacgtctgggtggatgccgtcaaaggaaagaagtggcacggggaattgaagcgctacattgtcatcaagcattga

SEQ ID NO: 3289 - DNA, 1122 bp, Bacillus licheniformis
gtgagcgtgataccatatgatttggttgcgacgaaaatgaatttttggtatacagccttaaaaaacaattggacaggcaaggctgaggatactaagaaagaagttgaacgagaattagaacaaatggaacaaaatcaggatgtgattgtctattacaacttactgctcttccggcataatcttcaacttgattatatgtattctaaacccggtgtaaatttaaatagtcgttttgatgagttcaaaaagattcgcgatcagaataatctggaaggaatgttggattattattatcattttttcgctggaatgtatcatttcagacaaaaagaattaatccttgcgctgaatttttatagggatgccgagaaaaaactcgattcttttgattgtgatgaactggaaaaggctgaattttatttcaaggcatctgaagtgtattaccatatgaaacaaaccatcttttcgatgaattatgcaagtcgtgcgtataacttattcaaaaagtatgatacttacggtgagcgtcgagtacaaagtcagtttattattgcaggtaactggctagatcatatgtatcccgaaaaagctctacataatttaaataaagagcttaaagagtcagagacacaaggaattcttcatcttatgggttcatcacatttaaatatcggaatatgctacaataaattggaagatgtcgataaagcaacctacaattttcaaagagctctgaacctttataaagaggagaagcatagttttttgccaaaaacattattcaacctcgcacatgtcagggcaaagcaagggaagttgtcaataactgatgacctatactatgaaggcaaagagttggctgaaaagaacaagaatttagatatgcttgcaaagtttgatttaataaaagggctttatctttcatttgatctggatatggttcgcgaatcgttcaagtttttcgaaagtaaaggcaagtatgcagacatggaggaatacggtcttatagcggctgaactattagagaaaaaagaaaaaattcgagatgcagtggaattctaccggataacagttaatgcgagaagacaaattcaaaggagtgcttttctacatgtaaactaa

SEQ ID NO: 3290 - DNA, 1398 bp, Bacillus licheniformis
atggctaagaaaatgccggatatcggcgaatataaatacggttttgccgacaaagacgtttccattttccgttcagagcggggattgacaaaagaaatcgttgaagaaatttcacgcatgaaagaagagccacagtggatgctcgactttcgcttgaaatctcttgaacacttctacaatatgccaatgccgcaatggggcggagatttaaactcattaaactttgatgaaatcacatactatgtaaagccttctgagcgttcagaaagatcatgggacgaagtgcctgaggaaatcaaacagacatttgacaagctcggaatcccagaagctgagcaaaaatatttggccggtgtatccgcgcaatatgagtcagaagtcgtttaccataacatgaaagaagaccttgagtctcaagggatcgtcttcaaagacacagacagcgccctcaaagaaaatgaagacattttccgcgagcattgggcaaaagtcatcccgccgactgacaacaagtttgcggccttgaactcagcggtatggtcaggcggatcattcatctacgtgccaaaaggcgtaaaagtggatactccgctgcaagcatacttccgcatcaactcagaaaacatgggacagttcgaacggacgctgatcatcgtagacgaaggcgctcacgtccactatgtagagggatgtacagcacctgtttatacgacgaactcccttcacagcgcggttgttgagatcatcgttaaaaaaggcggctactgccgttatacaacgattcaaaactgggcgaacaacgtcttcaaccttgtgacaaagcgtgcggtttgtgaagaaaacgcgacgatggaatggatcgacggaaacatcggctccaagctgacaatgaaatatcctgccgttatcctgaaaggcgaaggcgcgcgcggcatgacgctttctatcgccctggcaggaaaaggacagcatcaggatgccggtgcgaaaatgattcaccttgcaccgaatacgtcatccacaatcgtttcaaaatcaatctcaaaacaaggcggaaaagtcacataccgcggaatcgtacacttcggacgcaaagccgaaggcgcccgctcaaacatcgagtgcgacacgcttatcatggacaacaaatcaacttctgatacaatcccatacaatgaaattttgaacgacaacatttcattggagcacgaagcgaaagtatcaaaagtatctgaagagcagctcttctacttgatgagccgcggtatttctgaagaagaagcaacagaaatgatcgtcatgggcttcatcgagccgttcacgaaagaactgccgatggaatacgcagtcgaaatgaaccgtcttatcaagttcgagatggaagggtctattggttaa

SEQ ID NO: 3291 - DNA, 447 bp, Bacillus licheniformis
atgtcttttaatgtgaacttggatacactgtatcgccaggtgattatggatcactataaaaacccgagaaataaaggggttttgaatgacagcatcgtcgttgacatgaacaacccgacatgcggtgaccggatcaggctgacgatgaagataacggacggtaaagtagaagatgcaaaatttgaaggcgaaggatgctcaatctcaatggcttctgcgtctatgatgacacaggcgatcaaagggaaagacgtggagaccgcccttcaaatgtcacggatcttttcagatatgatgcagggcaaagactacgacgattcgattgatttaggagatattgaagctctgcaaggcgtttcaaaatttccggcccgaattaaatgcgcaacattgtcatggaaagccctcgaaaaaggcgtttccaaagaaaacagcgataacgaataa

SEQ ID NO: 3292 - DNA, 1221 bp, Bacillus licheniformis
atgaatgctaaagatattcgcgaacagtttccgattctcagccaacaggtcaacggacacgatctcgtttatttggacagcgcggccacctcgcaaaagccgcgcgtcgtcattgagacgcttgatgagtattacaactcttacaattccaatgtccatcgcggcgtccatacattaggaacaaaagcaacggatggatatgaaggagcacgtgagaaggtcaggaagtttataaacgcgaaatcgatgcaggaaattattttcacaaggggtacgacaacggccctgaacacggttgcgctcagctatgcccgcgcaaaccttaagcccggtgatgaaatcgtcattacaccgatggagcaccatgcgaatattattccgtggcagcaggctgtcaaagcaaccggcgccacgctgaagtacattccgcttcaggaagacggcaccatttccttggacgatgtcagggaaacggtgacggaaaatacaaaaatcgtctctgcagcgcatgtttcaaacgttctcggtacgatcaacccgattaaggaaatggccaaaatcgcccacgaacacggcgcggtcatggtcgtagacggtgcgcaaagcacgccgcacatgaaaattgacgtccaggatttggactgcgatttctatacgttttcagcccacaaaatgtgtggtccgaccggaatcggggtattgtatggaaaaaaagcattgcttgaaaacatggaacctgcagaattcggcggagaaatgatcgattttgtcggtctttacgaatcgacttggaaggagctgccttggaaattcgaagccggcacaccgatcattgccggcgcgatcggattgggagcggcgattgacttccttgaagacatcggacttgatgaaatattagcgcatgaacaccgtttggcggcatacgcgctggagcgctttaaagagcttgaaggcgctgttgtctatggtccggccgaacgtgcaggactcgtgacgttcaaccttgaagacgttcatccgcacgatgtggcaaccgtgctggatgcagaaggggtcgccgtcagagccggccatcactgcgcgcagcctttaatgaaatggctgaacgtctccgccactgcaagagcgagcttttatctgtataatacggaagaagacatcgacaaactgattgaagctcttcagaagacaaaggagtatttcacaaatgtcttttaa

SEQ ID NO: 3293 - DNA, 1314 bp, Bacillus licheniformis
atgacattggaaacaaaactatctgtagatcgggaatatgtcaaaagcttctctgagaagcaccaggaaccggcatggctgcaagatctacgcttagaagcgcttgaaaaagcagaagatctgccgctgccgaaacctgataaaacaaaaattacaaattggaattttacacggtttgataagcatactgtagaaaataaaccgcttgattctttggatgatctttcagatgaggtcaaatcgctgatcgatcttggaaatgaagacaaaacgctttatgtccagagagaccagacgccggcttacctttctctttcaaaagagctgcaggataaaggcgtcatctttacagatattcatactgcgttccgcgaacacggcgagcttgtcaaaaagtactttatgaaagacggcgtaaaagccgatgagcataaattaactgcattgcatgcagccctcctgaacggcggagccttcctttacgtaccgaaaaacgtcgagctggaagctccggtgcaggctgtttatgtccatgaaagcaacgatacaacgcttttcaaccatgtacttgtcgttgcagatgacaacagtgccgtcacatatgtagaaaactacatcagcacggtgaatcctaaggaagcggtctttaacatcgtgtcagaagtgatcacaggcgcgaatgcccgcgtgcaatacggagccgtcgacaacctttccgcaggggtaacggcttatgtcagccgccgcggaactgcactcggacgcgacagcaaaattgaatgggcgctcggtttgatgaatgacggagacaccatttctgaaaacacgacgaatctgcatggagacggcacattcggcgatacgaaaacggttgtcgtcggcagaggagaacagactcaaaactttacaacgcaaatcattcaccacggaaagcattcagaaggctatattttaaaacacggcgttatgaaagattccgcgtcttcgatcttcaacggtatcggaaagatcgagcacggcgcgtcaaaatcaaatgcagagcaggagtcacgcgttcttatgctgagtgaaaaagcgcgcggcgacgcaaacccgatcctattaatcgatgaagacgatgtaacggcaggacacgctgcatctgtcggccgcgtcgatccggttcagctctactatttgatgagccgcggaattcctaaagaagaagcagagcgcctcgtcatttacggcttcctcgcaccggttgtcaatgaacttccgattgaaggcgtgaagaagcagctggtctctgtgattgaaaggaaagtaaaataa

SEQ ID NO: 3294 - DNA, 786 bp, Bacillus licheniformis
atggctgcttcgacattaacaatcaaagatcttcacgttgagattgaagggaaagagattttaaaaggtgtaaaccttgaaataaaaggcggggaattccacgctgtaatgggaccgaacggaacgggtaaatcaactttatccgcggcgatcatgggacaccctaaatacgaagtgacgaaaggaagcatcacgctggacggcaaggacgttctggaaatggaagtggacgagcgcgctcaagccggtctgtttttggctatgcagtatccgagtgaaatcagcggtgttacaaatgccgattttctccgttcagcgatcaacgcgcgcagagaagaaggcgacgagatttctttaatgaaattcatccgcaaaatggacgaaaacatggaatttcttgaaatggaccctgatatggcgcagcgctacctgaacgaaggtttttcaggcggtgagaaaaagcgcaacgagatccttcagctgatgatgatcgaaccgaaaatcgcgattcttgacgaaatcgattcaggtttggatatcgacgcccttaaagtcgtttcaaaaggaatcaacaaaatgcgcggcgagaactttggctgcctgatcatcacgcactatcagcgcctcttgaactacattacgcctgaccatgtgcacgtcatgatgcagggccgcgtcgtgaaatccggcggacctgaacttgcacagcgccttgaggctgaaggatatgactggattaagcatgagcttggaatcgaagacgaaactgtcggtcaagaagcgtaa

SEQ ID NO: 3295 - DNA, 936 bp, Bacillus licheniformis
atggctcattctcacggacatacaggacacagccaccatggcagccgatcagcaaatcaaaaagcgctgttcatcagcttcggtttaatttttacttttatgatgattgaagtgataggcggaatattgacgaacagcctcgctttgctgtcagatgcgggacatatgctcagcgacgctgcggcgcttggcttcagcctcttggcgtttaaaattggggaaaaggccgcaagcgcgagcaaaacattcggctacaggcgctttgagattttggctgcgtttatcaatggcatcaccctgcttttgatttcactttatattttttgggaagcatacaatcgctttttcagcccgccggaagtcgcgggaaggggtatgcttgcgattgcgacggttggtctgttcgtcaacattgctgcggcctgggtaataatgaaaggcgacacaagcgggaatttaaatatgcggagcgcttttttgcacatcatcggcgatatgctgggctctttcggggcgatcatcgcgggcctccttatgcttttcttcaattggaacatcgccgatccaatcgccagcgccgtcgtcgctgctttggttctcgtcagcggctggcgggtgacgaaagactcggtgcatatattaatggaaggaaaaccgaaagacattgatgcggaggcgcttaaaaacggcctgctttccatcccgtcggtcagggaggttcacgacctccacatttggtcgatctcatccgatatgccgtcattaagctgccatatcgtagcggatgaaaacagtgacagggatagaattttaaaacaagtatcaaaatatctaaggaaagaatgcaacgtggagcatgtgacggttcaaatagaaggggagcgctgttcccctcatgaatcgtgcagcctgggagcaaaccatccccgctcttaa

SEQ ID NO: 3296 - DNA, 117 bp, Bacillus licheniformis
atggggtacgaggagtacagcagaagccatgtgaatcggcttgaagttgagaaaagacgagaaaagcagtatcaaaaaagcaagcagatcgtatcagacttgcccataatcggataa

SEQ ID NO: 3297 - DNA, 369 bp, Bacillus licheniformis
gtgaatcagcatgaatcagaaggcattatcgaatccgcactgcacgaatataaggcggggatcggcatcttttccgaaaaaatgcccggaattgccgccaaatacaacgaatttaccgaagagtgctttaaaaaaggcgtgctcagcgaaaaggataagcagctgatcgcactgggcatcagtgtcaatacgcaggatgaatattgcattatttatcacatcaagggctgcctggattgcggagcatcggaggaagaaattcttgaggcagtcggtgtaactgctgcatttggcggaggcgcagccatgagccaagccgtcacgctcgttttgcaggcgatggaagaattccagcagatgaagcattga

SEQ ID NO: 3298 - DNA, 831 bp, Bacillus licheniformis
atgaaaaaaggtttattaacagctttattcatcatttttgcaggcgttttggccgcttgcggatcttccagcagcgaaggagataaagacagcaaagtcattacagtcggagcgacgccgacgcctcacgccgaaatccttgaagaagcaaaaccgcttttgaaagaaaaaggctatgagcttaaaatcaaaaatttcacggactacaaactgatcaacaaagcgctcgctacaaaagatcttgatgcgaactacttccagcacgtcccttaccttgaacaggaaatgaaagaaaacaaagattacgatctagtcaacgtcggtgcggtacaccttgagccattcggcatttactctaaaaagtataaatctttaaaagaccttcctgacggtgcaaaaattattatgagcaacaatgccgctgaacagggccgcatgcttgcaatgcttgaaaatgcgggactgatcaagctgaaatcaggcattgaaaaagtagatgcgacagtaaaagatattacagaaaacaagaaaaacctgaaaatcaaaaatgatgtggcgcctgaaatgacggcaaaagcatacgaagctaatgaagcagacgcagtgttcatcaatgtgaactatgcgatccaaaacaagctgaatccgaaaactgattcaatcgaacttgagtctccaaaagacaatccttacgctaacatcatcgccgtccgcaaaggcgacgaagattctgacaaagtaaaagctctgatggaagtattgcgctctgacgacatcaaaaagttcatcgacaaaaaatataaaggctctgtcatttctgtatctgagtaa

SEQ ID NO: 3299 - DNA, 669 bp, Bacillus licheniformis
atgtttgaaaaactgtttccaaacgtagatatggagcagctgtgggaagcaacgtatgaaacgatatatatgacaggaatttccctattgtttgcttttatcatcggagtgattctcggcatgctgctctatttgacttcaaaaggcaacatttggcagaaccgagtcgttaacggtgtaatctcggcaatcgtcaatgtgttcaggtctattccttttatcatattgattattttgctgctcggtttcacaaagtttttaatgaatacgattctggggccgaatgccgctcttccggctttgattatcgcatccgctccgttctatgcccgcctggttgaaattgctttgcgcgaggtcgacaaaggcgtgattgaagcagcgaaatcgatgggggcaaaaacatcgacgatcatatttaaagtgctcctgcccgaatcgatgccggcgctgatctcaggcattacggttacagccattgcactgatcggttcgacagcgatggccggagcaatcggttcaggcggactcgggaaccttgcctatgtaaacggctttcagatgaacaatcccgatattatactgatcgccactattttcatcttagctattgtgttcatcatccaatttatcggggattttataacaaataaattagacaaacgttag

SEQ ID NO: 3300 - DNA, 1026 bp, Bacillus licheniformis
ttgataaatcttcaaaatgtttcaaagatttatcggtcaaagcatggagatgtcaatgctgtccaagatgtcacccttacgattaaaaaaggtgaaatcttcggaattattggatatagcggagccggaaaaagctccttgatccgtctcttgaacggacttgaacagccgacttcaggcacggttgaagtagccggcagaaaaatcagcgagatcaaagggaagaagctgaggaaagcaaggcaggaaatcagcatgattttccagcatttcaacctgttatggtcgagaacggtgcgcgacaatattgcgtttccgctggagatcgccggtgtcagcaaagcaaaacgtctggaaagagtcgctgaactgattaagcttgtcggtcttgaaggcaaggaaaacgcctacccttcacagctgagcggaggccaaaagcagcgcgtcggcatcgcacgggcgctcgcaaacaatccgaaagttctgttatgcgatgaagcgacatcagcgcttgatccgcagacgactgattcgattctgggtcttctgtccgatatcaatgaaaggctcggactgaccattgtcctgatcactcatgaaatgcatgtcatcaggaaaatctgccacagagtggccgtcatggaaaacggaaaggtcgtagaagaaggcgatgtactgaacgtcttcatcaagccgaaggaagaaatgacaaagcgctttgttcagcaggtaacagaaccggtggaaacaaaggaaacgctgaagcatttcctcgaagaaacgacatccgggcggacgatcaagctcactttcgtcggcgaagcggccgaatcgccgctgatcacgcagatcattcggaagttcgatgttgaagtcaacatccttcaaggcaaaatctcgcagactcaggacggtgcatacggttcattgttcatacatgtcgacggacgtgaaaacgaggtcaatgacgtggtcgatttcatcaagagccgccaggtagaagcagaggtgatcacgaatgtttga

SEQ ID NO: 3301 - DNA, 348 bp, Bacillus licheniformis
ttggagaaaatgggattgatagaaagagagggcaaggctctttttttaaaacctctattatctacaacggctttgctgattacgtttcaaggagagaaagaagcttttacgttagcaatcaacgaaaaaggggaaatggaaaaatattctcctgtagaaaaagctcatttgaccttttttggagagcaaagcgagattattgaccttcttcatggcgacatttcattgcagcatctcgtacagcgcggcactgttaaagtaaaaggctcttttagagctttattgaagcttgaagcgattttatggctgacggacggcttctttaaaaacagcgatctttattcatag

SEQ ID NO: 3302 - DNA, 309 bp, Bacillus licheniformis
atgcaagaacttcaagaaaaagagctaaaacggctagagcatgaaacttgtcttctatatgtatacacgccgttctgcggaacgtgtcagctggccggaagaatgctggaggtcgttgatgaaatgatgaaggacattcctttttataaaaacaatctcaattactccccgtcatttgccaaacagcaggaaattgaaagcgtcccgtgttttatcctttacaaaaaagggcgagtcgtcaaaaaagaatacgcttttcactccgtttcctacttatatgatacgattaaacaaaatcttgtggattaa

SEQ ID NO: 3303 - DNA, 345 bp, Bacillus licheniformis
atgccggaaaatgaaaaagtcatgatcgtcgaagggaaatcagataagcaaaaagtgaagcatgtcatcgaagagcccgtggacatcatatgcacaaacggaacgatcagccaggcaaaactcgatgaattcgctgagacgctgttcgataaagacgtttatatcctggtggatgccgatgaatcaggcgaaaagctccgccggcagctgaagagggagcttccccaagcttcgcatctatacattgatagagtatacaaagaagtcgcttccgccccgagtcagcatgttgcagaagtattatttcgttcaaacatccgggtacatacaaaatatctattataa

SEQ ID NO: 3304 - DNA, 246 bp, Bacillus licheniformis
gtgtccaaattgacgctgaaaaaagaacgtattgatattacagaacatgtggaaagccgattaaaaaacggcggaacgcagctgtatcatgaaaatgagctgatcggccgaatgaccggcaaggatcaatacgagttgaaatctggatattcattccaagatgaaaagttttacaaaatggcggataccgtaagcggaccggatgctaaatatgtagactgtgatgaccaccaaggctggtgttaa

SEQ ID NO: 3305 - DNA, 384 bp, Bacillus licheniformis
atgagcacaccgaaagagttgcgttattcagaagaacacgaatgggtgaaaaccgaaggagataaagtcagaatcggcattacagactttgcacaatctgagcttggagacatcgtatttgtcgagcttcctgaagtgggagacgaaatcaaagcggacgagccttttggcagcgttgaatccgtaaagaccgtttctgagctgtatgccccgatcaacggaaaagtggtcgaagtgaacgaagatctggaagacagccctgaattcgtcaacgagtctccgtatgaaaaggcttggatgattgtcgtcgagccgtcagacgcttctgaaatcgaaaacctgatgacagccgggcaatatgaggacatgataaaagaagactaa

SEQ ID NO: 3306 - DNA, 357 bp, Bacillus licheniformis
atggctttggatttttactggtatccgaaatgcgggacatgccgcaaagcgaaaaaatggctcgaagaccacggaaaagaaatcaatgggatacatatcgcagaacagccgccgagcaaggaaaaactgaaagagctctacgagaaaagcgggcttgaattgaagaagtttttcaacacgagcggccaaaaataccgcgaactcggcctgaaagacaagctgcaaagcatgtctgaagatgagcagctggaactgcttgcatcagacggtatgctgatcaaacgcccaattacgacagacggcagtaaagtaacggtcggttttaaagaagatcagtttaagacatactggttataa

SEQ ID NO: 3307 - DNA, 1785 bp, Bacillus licheniformis
atggaacaaacaaaagatcatatgaaaaaaggcggcgcctttctgatcgaagaggtaacggctgatcagatgttcacaccggaagatttcacagatgaacataaaatgatcgccaaaacgactgaggattatattctcggagatgtgctaccgtacatcgacgaaattgaagagcacaatttcgatcattctgtcaggcttctgaaaaaagccggcgaactcgggcttctcggagctgacgttcctgaggagtatggcggactcggacttgataaaatcagctcggcgttaatcaccgaaaaattttcaagagcggggagcttttcgttatcgtacggggcgcacgtagggatcggcacgcttccgatcgtatttttcggaaccgaggagcaaaagaaaaagtatctgccgtcccttgcaacgggggaaaagtttgcagcctatgctttaacagagccgggctccgggtctgatgcattaggggcaaaaacaacggccgttttgaatgaggcgggaacccactatatattaaacggcgaaaagcaatggattacaaactcagcctttgctgatattttcatcgtctatgcgaaaatagacggcgaacatttctcggccttcattgtggaaaaagactactcaggcgtctccacagggcctgaagagaaaaaaatgggcatcaaaggctcttcgacccgcacgctcatcttagaccaggttcaagttccaaaagaaaacctattaggtgaaccgggaaaagggcatgtcatcgccttcaatattttaaatatcggacgctataagctcgctgtcgggacaatcggcgcttcgaaacgggtcatcgagctgtccgcttcatacgccaatcagcgccagcagtttaagacaccgatttcaaagttcagcttaattggggaaaaaatcgccaacatgtcagtcaaactttatgcgatggaaagctctgtttatcgtacggtcgggctgtttgaagacaaaatgggcaccttgagcgaagaagagcaaaaagacgggcgccaggttgcgaaatcgatcgcagaatatgcaatcgaatgctcccttaacaaagtattcggatctgaaacgcttgattatatcgttgatgaaggcgttcaaatccacggcggttacggattcatgcaggaatacgaagtggagcgggcttaccgcgattcacggattaaccggatttttgaaggcacaaacgaaatcaaccggctcatcgtcccgggcacctacatgaaaaaagcgatgaaaggcgagcttcctctgtttgagaaagcaaaggctcttcaggaagaactgatgatgctcatgcctgaagaaccaggtgacggcgttctcgaacaggaaaagtatctgctgagaaacgccaaaaagaccgcgctcatgatcgcgggactcgccgcgcaaaaatacggaaaagcgctcgaccaggagcaggaaatcctcgtcaacatcgccgacattgtcagccagatctacgcaatggaagcagctattttacgtactgaaaaagccatccgggcaaccggcgaagacaaaaacgcacagaaaattctttatacgcaaatttttgcgcaggaagcctttcaggaaattgaaagccatgccaaagaatcgctcattgcgatggaatcaggcgattcgctgcgcatgatgctgtccgcgctgcgcaaattgacgcgctttacgcctgtcaacgtgattgagaaaaagcgccaggcagccaagggagtctttgaagctgagaaatatatcgtttaa

SEQ ID NO: 3308 - DNA, 1176 bp, Bacillus licheniformis
atgaaagaggcagttattgtatcgggggcgagaaccccgatcggaaaagcaaaaaaaggctcattgaggactgtccgtcccgatgatttaggcgcatatgcggtgagagagacgctgaaaagagcgggcggttatgaagggaatatcgatgatttgatcatcggctgcgctacgccggaagccgaacaaggcttgaatatggcgcgcaatatcggcgcgcttgccggtctgccgcacacagttccggccgttacgatcaacagatattgttcatcaggacttcaatcaatcgcttacggggccgaaaaaatcatgcttggagctgctgacacgatcattgcaggcggcgccgaatcgatgagcatcgtgccgatgatgggtcatatcgtcagaccgaacgcggctctggcggaaacggctcctgaatattatatgggaatgggccatacggctgaacaggttgccgtcaaatacggcgtttccagggaggaccaagatgcatttgccgtcaacagccatcaaaaagcagccaaggcgatcgcggaaggaaagttcgaagatgaaatcgtcccggtggacgtcaccgtcagagaagtggatgaacatcataacctgaaggagcggacgtttactttctctgccgatgaaggtgtacgcccggggacaaccaaagacgttctgtcaacgttgaaaccggcgttttcggcaaacggctcggttacggcagggaattcctcgcagacgagcgacggggctgccgcagtgatgatcatggacagagaaaaagcggacgcactcgggttaaagcccctcgcaaaatttcgttcgttcgcagtcggcggcgttccgccggaagtgatgggcatcggccctgtggaagcagtcccaagggcgctgaagatggcgggacttgagctgtcggatatcggtttattcgaattaaatgaggcgtttgcatcgcaagcgatccaggtcatcaggtcgcttggcattgatgaagaaaaagtcaatgtcaacggcggagcgattgcgctcggacatccgctcggctgcacgggtacaaagctgacgctgacattgatccacgaaatgcgccggagaagcgagcaattcggcattgtgacgatgtgtatcggcggaggcatgggagcagcaggggtattcgaattagtttaa

SEQ ID NO: 3309 - DNA, 2391 bp, Bacillus licheniformis
atggtcaagcatattcgaaaagccgccgttatcggttccggtgttatgggttccggcatcgcggctcacttagccaatatcgggattcctgtattactgctcgatatggtgccgcatgaattaacagatgaggaaaggaaaaaaggccgcacccttgaagacccggatgtgcgcaatcggctggcacggacagccgtacaaaagctgctaaagcaaaaaccggctccgctgacttcaaagaagaatatcagccgtatcagcacagggaacatggaagacgattttgaaaagattaaagatgccgactggattattgaagttgttgtcgaaaacctggagatcaaaaagcaagtgttttcaaaggtcgatcaatacagaaaacaaggaagcatcgtcagcagcaacacatcaggcatctccgtcaggcagatggctgagggaaggtccgctgattttaaaaagcactttttaggaacgcacttcttcaatccggcccgctatttaaagctccttgaggtgattccgattgacgaaacggagcccgaagtgctgtcctttatgaagaaattcggcgaagacgttcttggcaaaggggttgttgaagcgaaagacacgccaaactttatcgccaaccgcatcggaacctacggcttgcttgtgacggttcaggaaatgctgaaaggcggctacacgataggcgaagtcgattcgattacaggtccgctgatcggacgcccgaaaagcgcgaccttcagaacgctcgatgtcgtcggccttgatacattttcacacgttgccaaaaatgtctataaccaagtcacgggcgaagaaaaaaacgttttccggctccctgaatttattgaacaaatgctcgaaaaaggctggatcgggagcaaagcgaaacaaggtttttacaaaaaagaaggaaaagacatccttgagctcgatccgatgacgatgacctacagcgcgcgtcaaacattaaaaacatcgggactggaagcggccaagcaaatgaaaggcgcaggagcgagattgaaagcgcttgtttattccgatgacagggcgggaagcctcctttggaagattacagctccgacgcttgtatattcggcggagctgacaggggaaatcgccgacagcataacggcggttgatcaggcgatgaaatggggattcggctggtcggaagggccgtttgaaatgtgggacagcatcggtgtgaaaagctcggtgcaaaagcttgaagcagagggctggaaggtcgcggactgggtgaaggaaatgctcgcaaaaggacatgaaaccttctaccttaaggaaaacggaaagacgttctactactgttttgaaagcggcgaatacagggcgcttcaagaaaacaagaaaacgatccatttgtcgtcactcaaagaaacaaaaggcgtcatcaagaaaaacagcggggcaagtttgatcgatttaggcgatgatgtcgcactgctcgaatttcactcgaaaagcaacgcaatcggcctggacatcattcaaatgctgaaatttgctctcgaggaagtagacgccaactataaagggcttgtgatcggcaaccagggcaaaaatttctgcgtcggagccaatctcgcgatgatgctgatggaagctcaagacgacaactatatggaaattgacatgatcatccgtcagttccaagagacgatgatgaaagtgaaatacagttccaagccggtcgtcgctgctccgttcggcatgacgcttggcggggggactgagctatgcctgcctgctgcccgtgttcaagcctcaagcgaatcatacatgggcctcgttgaaacaggcgtcggtctgattccgggcggcggaggcaataaagagctttatttaaattacttgaaagggctgcctgaaggcgttaaaccggatatccaggaggccgccatcaagacgtttgagacaattgcccttgcaaaaacgtcgacttcggctcaagaagcgaaagaactgaacatcttaaccgcagaggatcaaatcagcatcaatcaggatcacttgttatacgatgccaaaaaactcgtcctgacactttccgaaagcggctaccgtccgccggtgaaagagaaagttccggtgacgggcgaaaccggctatgcggcgctcctgctcggtgctgaatcgttaaaactttccggcgccatctctgaacacgacatgaagattgcgaaaaaactggcgtttgtcatcgcgggcggccgagttccattcggcgccgaagtaacggaagaatacttgctcaatttggaaagagaagcgtttctgagccttgtgagcgaaccgaaatcgcaggcgagaatgcagcatatgcttgtgaaaggcaaacctttgcgtaattag

SEQ ID NO: 3310 - DNA, 162 bp, Bacillus licheniformis
ttggtacgtgaaagaaaaaatccatcttctgccgcagtcagcgccgcaagcataaaaggcaatgcaggtccggattataaaaagacggatgcgggcggtaaacggacaagccaaaaccagcaatataaaaagcataatatggatgttcctgaagatcactaa

SEQ ID NO: 3311 - DNA, 258 bp, Bacillus licheniformis
atgcagcagcaaggaatgacaacaccgccgccggtcatttcaacgaaggaccatctgtatttgcaggatatgctgaactggaacctgctcgcgatgaaaaaagcgcattttatggcggatcaatgccaggatcagtctcttaaacagaactcgacagggtcggccaatgcaccatcaccattacaatatgatattggagcagcttcgtcaaaatcaaacgcaaaacccgtcagcatacatgcaataggaggtcaatga

SEQ ID NO: 3312 - DNA, 342 bp, Bacillus licheniformis
atgaatcagcaaaaccaacagaaaatcggcaatcaggaaacccctgtcccaaagacgagcgcgatgaacgacagggattttgtcaacgaactgctgacaaccgaaaaatatatgacgtcagcatactcgacggcgcttaatgaactaagccatgaatcgctttaccaggccgtacagccgctgtttaacgaggcgcaaaacgctcagcgcagattgtaccaggtaatgtttcaaaacggatggtacaaggtggaggcagaagatgcccaaaaaatccagcagtcctatcagcagttccattctacactgcaagaccagtcgccttatcagcaaaatcaataa

SEQ ID NO: 3313 - DNA, 252 bp, Bacillus licheniformis
gtggaaaaactcagggagcagctggacggactggtcgagaaatatacggaactgcttttgggcgaaacggacgaagaactgaaagaacaggtgaagatgtggatcatctacagccatatcgccaaaagcatgccgcccctcgccaagcattggaacggagcttatccggatgcgaagcaggggataaaagaagtaatccgccagattaaagaacgtaatgaagcgcaccgggcggctaatcagaaaaaataa

SEQ ID NO: 3314 - DNA, 741 bp, Bacillus licheniformis
atgcttaatttaacaaaagaggagcttgagtcattgcttcgtttccgccttggaacgaagcagaccggctccttattctctgttaaaggaaacatgctccttgatgaggattttttaggccgttatgcagaagctataaaagacaggctgaacgctccgaatcaaaaagttgcggcttcaatgctcgttaagcgcggcggcatgcttgctgcgctgcatttctatctgtttacggtttgcggaaaacggctcccagccgacccggcttccgtatcgtgggagatagaagcggatgatcaaggatggacgccgtcgttttattttcacaaaggtgctgagcttatcgaaggggaccgcaccgaagaactgaaaaaattgaccgaagatatcttcaggcgccatttgggcggcatgatcgaggcctgtcgacagacattctcgatttcaaagcacattctttgggaaaatattgcggtttatctgtattggatgtacgacatgcttcaggaagatccgaagctcaaggcacgggcggcgcgagatttccgttttcttctttacgaagcagagccaggcctttttgatgaaggtgaggacgaaaaccctctcaaaaggttttatcccggacagcatgcggaggatcggacacgcacgacttgctgtctgtattatgcaacagacgaaaacggcgtcaaatgcagaacatgcccgagaaataaacataaagaaagggtgtcgtga

SEQ ID NO: 3315 - DNA, 819 bp, Bacillus licheniformis
atgagtgccatttcaacagaaacgttaagcttaggttatggagaaacaatcattattgatgagttaaacttaacgatcccaaaaggtgaaatcaccgtatttatcggcagcaacggctgcggtaagtcgactctccttcggtctctcgcacgtttgatgaagccaaagggcggttcggtgctcctcgaaggcagctccatcgccaagcttccgacgaaagaagtggcaaaggagctggccattcttcctcaaggcccttcggctccggaaggcttgaccgttctccagctcgttaagcaggggcggtatccttaccaaaactggctgaagcaatggtcagcagaagatgaagaggccgtgcaaagggctttgaaagcgacaagaatggaagaactggctgagcgtacagtcgattccttgtcaggaggccagcggcagcgcgcttggatcgcgatgacgctcgcccaggaaacggatatcattttactggatgaaccgacgacatacttggatatgacgcatcaaatcgaaattctggacctattgtttgaattaaatgaacacgaaaagcgcacgatcgtgatggtgctgcacgatttgaacctcgcctgccgctacgcccatcacctcgtcgcgattaaagataaaaagatatatgccgaaggccggcctgaatccattatcaactgcaagcttgtacaggacgtttttgaaatggactgcgaagtgacgaaagatccgcttttcggcacgccgcactgcattccgtacggaaaaggaagatgcatcgtccagcaggtggttcagtcccatgcttaa

SEQ ID NO: 3316 - DNA, 1041 bp, Bacillus licheniformis
atgaaaaattaccgcacgctgagaatcggaaaaggcggcatttcattgttgatcggcagaaaagcgctgttttcattcgtgatcctattggtgttgacggcttgtgcagtcatcctcagcgccggcatcggcgaacgttttatttctccgggcgccgtcgcgaaaacgtttttgggcatgggggatccgggcgatgacctgatcatcatgtccttcaggatgccgcggattttggttgctctgtttgccggaatctgtctggcggcagccggatcgatcctccagggtctgatccgcaatccgctcgcttcgccggatattatcggtgtgaccggcggggcttcagtcgccgttgtcttgtttttaatgctgttttccaataaaaataatgcgcttacggtcagcatcagctggctcccggtcgccgcttttatcggcgcggctctcgccggaatgctcgtttattttctttcatataaaaacggctcttcaactttcaggctcgttttgatcggaatcggattttcgatgcttgcccagtcgctgacgacattgtttatgataaaaggaccgatatacagaatgtcccaggcgaacgtctggattaccggatcagtatatggctccaactggcaggatgtgaacgttttattgccggctgcgcttgtccttttgctgatatcggcagccgccgccagaaacgtcaatatccagacgctcggcgaagaactggcgacaggagcgggcagctcggttcagcgaaaccgctttttgctcctgcttctgagcactgcttttgccggaatcgccgttgcttttgccggaactgtcggttttgtcggtttgatggccccgcatatcgcaagaaggcttgtcggatcgtcattcggcgccctcttgccggttgccgcgctgatcggaggattgctcgtgctgattgccgacatcatcggccgcacgcttttttctcccgttgaagtgcctgccggtgtgtttaccgccgcgatcggcgcccccttactttatctacttgctgtataa

SEQ ID NO: 3317 - DNA, 1002 bp, Bacillus licheniformis
atgctcttaagaacgaataaatatagaacgatcgcactactgtcttttattttggtgctggctgccgccgtttgcgccagtatcgtatacggttatacgaatacgtcatggtcgatggcctacaaggcttttaccggcttcagcggctctaatgaacatcttgtcatcaaaaacgtgcgtttgccgcgcgcgctgattgctgcaactgtcggtgcttccctcggggttgccggcgctttaatgcaggcgatgacaaaaaacccgcttgcttccccgggaattttcggcgtgaacgcgggtgccggtttctttgttgttggagcgctgtttttctttcacgtcggttcgcttcagacgattgcatggatctcttttttcggtgcagcgtttgccgcgcttgtcgtctattttgtcggctctctcggaagggaagggctgacgccggtcaagctgacgcttgcaggggcggcgatgtcagcgctgttctcatcattgacgcaagggatgctttccgttaatgaagcagcccttgagcaggcgctgttttggcttgcgggctctgtccaggggcgcgacctcagcctcttggtctccgttcttccatatatcgtgccggcattcatcatcagctttttgctaggatccaaaatcaatgtcttaacaatgggggaggaagtggcaaaaagcctcggccaaaaaacgtggctgattaaagcgctgatggcggtttcgattgtcctgctagccgggggatctgtcgccgtggccgggccgatcggctttatcggcattgtcatcccgcattttgctaaatttatcgtcgggcacgaccatcgctgggttcttccgtactgcgccgtgcttggagccatcctgctcgttaccgcagacattggcgcaaggtacctgatcatgcctgaagaagtacctgtcggcgtcatgacagccatcattgggacacccatttttgtctatatcgcgagaagggggttccaaaaatga

SEQ ID NO: 3318 - DNA, 978 bp, Bacillus licheniformis
atgaagagatggtcaattgttggatttatcgctttgttagcgatttcaattcttgcagcctgcggcggaggcaaggatgactctgcaaagggcggagaaaataaagatacgatcaccgttaaacacgcaatgggtacggaagaccaagtgcctgcagacccaaaaagagtcgtcgtcctgacaaatgaaggaaccgaagcgcttttggaactcggaatcaaacctgtgggtgcagtcaaatcctggacaggcgatccttggtataagcatattcaagccgatatgaaaggcgttaagcaaatcggactcgaaggcgaaccgaatatcgaagcgattgccgagctgaagcctgatttaatcatcgggaataaaatgagacatgaaaaaatctacgacaagcttgaaaaaattgctccgactgtcttctctgaaacgctgcgcggcgaatggaaagacaacttctccctctacgcgaaagcggtaaacaaagaggaaaagggcaaagaagttttagaagatttcgataaaaaagtcagcgaattaagcgacaagctcggcgaccagaaaaagaaacgggtgtcggtaatcagatttatggccggccaatcaaggatttactataaagattctttcccgggaattatcctggatcagctcggattcaagtatccggaaaaacaggaaaaactgtttgagaaacaagacgacaaatttgtttttatgacggaaaataaagaatcgatccctgatatggacggagatgtcctgttctatttcacatataaacctgccgaaagcaaaaaagaagctgaaacatggcaaaacgattggacaagcgatccgctgtggaaaaaattgaacgctgtaaaaaccggaaacgcccatgaagtcgacgatgcgatctggacgacggccggcggcgtaaaagcagcgtatctgttccttgatgacatcgaaaaatactttttaaaatcttaa

SEQ ID NO: 3319 - DNA, 447 bp, Bacillus licheniformis
atgaatcaatttcggatggccgttatcgctctcgtcctgatcctgatgaccggctgcggctccatagcggaagaacatgcggaaggcaaggaggccgttcccgataacgcccctgtttcagatgtgaaaagcgtgccttacgctgcatttgcattggaagtgaactatggccatggaaagcacaatacgtttgaagccgtatacgacaaacaggagcgggaagaagcatcgattaaagactatctgaacggagcggaccgcgaaggggaggaagctttaaacgaaatgaaaatggttttaagcgagctttcgatcgccaaatccgatccagagcaggacgtgatcagcaatgtgctcgaggccttcaatcttgacgaacaatatgaccggtttcagctgcgggtgaaatggcctgatggcacgtccagaatctataacggaaaataa

SEQ ID NO: 3320 - DNA, 1785 bp, Bacillus licheniformis
atgacatttcatcaacttaaggatacgtgggatctcgaggttttctttaaaggcgggagcggctccgccgaattccgccaatatttaaatgagattaaaacactgctttcaacttttaaacgttcggccgaggctcttaccgtctcaaaaagcggccttgatgaattgaaagaaacgctggcgctttttgaaacaattgatgttaaaatccgcgaagcagacgcttttgtcggatgtctccaagcccaggacaccgcggatttaaaggcgaatgcccttaattttgaggtcacccggctcgctgccgatgcgcagaaggcgctggtcgtgcttgacagcaaatttgccgttgtcccaaatgtagaatgggaagcgatccttcaagatgaaagcatttccgatatcgcttatattttgaatgagagaagagagcgggtaacggaaaagcttagttccgaacaggaaacattgattcaaggcttgtctgttgacggatatcatgcctggggcgatatgtacgacagcatcgtcgaccaaattcaaattccgtatgaagaagatggcgagacgaaaattctgtctgtcggacaggcgcagaacctgacatctaaacctgacagaaagatccgccgctccgtatcggaaaatttggaccacggctgggaacagcacgctgatttgctcagcagcacgctgaatcacctcgccggtttcagactgaacgtctatgaggcgagaggctgggacaatgtattgaaagaaccgctggacatcaaccgcatgaagcaggaaacccttgatgtcatgtggcaggtcattattgatcataaaaagccgtttgcagactatctttcccggaaggcgtctttgctcggactggataaactgagctggtatgacgtcgaagcgccgatcggttcagcagcaaaggaatattcgtatcaagaggcagccgcttttattaccgggcagtttaaaacgtttggaaaaaagctctcctcctttgctgaaaaggcgctcagagacagatgggttgaagctgaagacaggggaggaaaacgtccgggcggcttttgcgccaattttcctgacagcggggaatcaagaatatttatgacatttgcaggaagccagtcaaacgtttccaccttggcgcatgagcttggccatgcctttcatcaggaatccatgctggacgtcaggccgctgaacagggcgtatgcgatgaatgtggcggaaacggcgtccacctttgcagaaatgatcgtggccgatgcggcgttaaaacaagccggttcagacgaagaaaaaatcgtccttctggaagataaggttcagcggagcgtcgccttttttatgaacattcacgcaaggttcctatttgaaacccgcttctacgatgaacgaaaaaacggcgtcgtatccgccggaaggctgaacgaactgatggaagaagctcagaaagaagcgttttgcggtgcgcttggcgagtatcatccgtatttttgggcatcaaagcttcatttttatattacgtctgttccgttttacaattttccttatacgttcggctacttgttttcgcttggcatttacgcgcaagcgctgaaagagggtgcggcatttgaagaaaaatatattgctctcttaaaagatacagcctccatgtctgttgaagaactggccatgaagcatctcggcgccgatctgacgaagcgggatttctgggaagcggccattcagccggctgtccgagatgcagaagcatttttagcgatgacataa

SEQ ID NO: 3321 - DNA, 1155 bp, Bacillus licheniformis
atgaatgttaaacgatccctcctgttcattattgtactatgtctgacgctgttttttcatagctcggctcaagcaggagaaaaaaacaaaccggaaatcaaaagcgtttccgctatattgatcgatgggaaatcgggccaggtcctctatgaaaaaaacagccgcaaaaaaatgtatccagccagcataaccaaaattgccacggcgatttatgcaatagaaaacggaaatttggaagatcgtgtgaaagtcagcaaaaatgccgctcaaacggaaggatcaagcgtatatctggaagagggggagtcggttccattaaaacggctgctccaagggctgctgatgaattcgggaaatgacgccggtacggcgatcgccgaacatctcagcggaagcgtgaaacagtttgcggatgatttgaacgcgtttattgccgaacatgccggagtgcatgacactcattttatgaatcctcacgggctgtttgacaaaaatcattatacgacgtctgccgacatggcgagaattactgagtacgcaatgaaaaacaaaacgttccgagcgcttttttcggaaaagcaaacggattggcacggacagacatgggacacgacgcttaaaaaccatcatcgaatgctgacgggtgagattccttacaaaggtataaccggcggcaaaacaggatttgtggatgaatcaaagcatacccttgtcacgacggcaacgcggggcagccttgatttaattgcggtcgtcatgaaggcagatagcaagaaaatgatgtacagcgatacaaaagctcttctggatgagggatttcacaatttcgaaacacaagaactcaaaaagggagaagcgtttacggaccagaacgggacgagccatgaactgaaggaccctttatacgttacgaaaaagaaaggcgaagttctgagtgaaaatgtagacacggacggaatccttaacattaaaggggaggatggcaggctgcttcaagccctgcaaatcgcagaaccattcagcgcggaaatgacaaacggtacagatgctattcagggtcaaccgcaaagtaaaggcggattgtttttatttgtgttcggcctaatcggtttattgacggccagctatgcggtcaagcggatgaggcagctgtaa

SEQ ID NO: 3322 - DNA, 843 bp, Bacillus licheniformis
ttgaacaataaaatcgcaattgtaacgggcgcgacgagcggatttggtttattgaccgctttaaaactcgcaagcactcatttcgtaatcgcaacggcgcgccatccagaaaaagcggaagctctgcggaaccgtatagcggagctgtcgatcgagtcatcgattgccgtcgctgaacttgatgtcacaaacgaacaatcgatttcctcattttccgaagagctgaagcagtacggacagatagacgttctcatcaataatgcaggaacggcatacggcggattcgctgaagagctttctcttggcgactacagaaaacagtatgacaccaatgttttcggcctggtggcagtcacaaaagcggtccttccttatatgaagaaacacagcggcgccaaaatcatcaatctgagcagcatcagcgggcggatcgctttccccgctttctcggcatatgcttcatcaaagcatgcagttgaaggcttttcagaaagcctccgcctcgaactccgtccattcggcatcaatgtggccgtcgtccagccgggatcgtaccagacggcgatttgggagacatcgtttgccgcccaagtcactgcacctgatgccgaatcacagtacaaaacatatttcgagcggatctccgcctacattgcagcgagccgcaaacattacggaaacccggatgatgtggctgaattgatctgccgactcgctgcaaaaaagcggctgaacaggctgcgctatccgatcggcaggggcgtccgtctctcgatccttctccaccaaatcctgccatggcggatttgggaacgtgcggtcataaaaaaattgcttaaatga

SEQ ID NO: 3323 - DNA, 465 bp, Bacillus licheniformis
atgatctctcaacaattaaaacagcaaaatcctgtacttgaaaactcaatgaatacgaatttgtcaaactggttcatcctttacacgaagcttcaccgttttcactggtacgtaaaagggccgcagttctttaccctacatgaaaaatttgaagagctatacaaccatgcgtcagaaacagcagatgtgatcgcggaacgcttgctggccatcggcggacagccgctcgccacaatgaaagaatacattgaccacggcacaattgaggaaaacggagccgaaaaaacggccgaagaaatggtttccgcactggtaagcgattaccgtcaaatccgcgatgaaattcagcataccatcgaacttgcggaagataaatcagatcattctaccgctgacctttatatcgccctgacagaggaaattgataagcagatttggatgctttcttcatttttggacaagtaa

SEQ ID NO: 3324 - DNA, 1371 bp, Bacillus licheniformis
atggattttagacgcgatgacgaacaaaaacatgcaaatgaagagcagtttcacgaagaagcgcagacgccgcaaacggcaggttctgaggagcagcagtcagaacagccggcaaaggagcccgagctgattttaaagaaggatacagacgatcagtcagatcttacgaataaagaaaccgctgcagccctggaagatgccagggaaacgagagcggcaaaagaaaagcggcgcaaggcttcgtggctgagcccgattttgggcgggatcatcggaggcggcttggtgcttggaatctccccgtatctgccgggcgatcatccgagcgaaactgccggaaccggacagacagagccaaagcagtcgcagaatttcaccacaaaacctgtcacgaacgcagataacgtacctgatatggtggaagatttggagcctgcgatcgtcggagtttcaaatattcaaacgagcttcggcttctctgaagacgacgtggaggagagcggcacgggatcaggcgtcatctttaagaaagacggcggcaaggcctacattatcacaaacaaccatgtcgttgaaggcgcctcgaaggtgaccatctccttatacaacggaaagaccgcggatgccaagattatcggcagcgacgctttgactgatctggctgttttagagatcagcagcaaaggcgttgataaggttgcaagtttcggagactccgcaaaactgcgcgccggcgaaaaagtaattgcgatcgggaaccctctcggccttcaattttcaagaacggttacagaaggcatcatcagcggtgtcaaccggacgattgaagtctcaacatctgaagggaattgggatatgaacgtccttcagacagatgcggcgatcaaccctggaaacagcggcgggcctctgattaacagcagcgggcaggtcatcggcatcaacagcctgaagatcagccaaagcggtgttgaatcgcttggcttcgcgattccgagcaacgatgttcagccgatcgttgacgagcttttggaaaaagggaaagtggaacggcctttcctcggcgtgcaaatgatcgatatgcagcaggtgcctgaacagtaccagcaaaatacgctcggcctattcggagaccagcttaataaaggcgtgtacatcgataaagtatcgccgaaatcgcctgcggcagacgcgggtatgaaagccggcgacgtcatcaccaaaatgaacggcaaaaacgtcgaaaccacctcagacctcagaaaaattctttatacagaagcaaaagcaggagatactgtcacatttgaggtgctgagaaacggaaagcaaacaacaatgaaagcaaaacttgcgaaaagcaaatcataa

SEQ ID NO: 3325 - DNA, 675 bp, Bacillus licheniformis
ttgtcatactccatttatctagttgaagatgaagagaatttaaatgaattgctgacaaaatacttagagagtgaaggctggcacgtcacttcttttctaaacggtgaaagcgccaggcaaaaaataggccagtcacctcatttatggattctcgatatcatgttaccagatatcgacgggtatacgctaataaaagaaataaaaaatcaagatccggaagtccccgtcatttttatttctgcgcgcgatgccgacattgacagagtgctggggcttgaactgggcagcagcgactatatatctaagccgtttctccccagggagctgatcatccgcgtgcaaaagctgctcaagctgatttataaagaagaaccgcctgagaagaaaaaaggaacgccggtttcctgctatgaagtctatgaagacttgagagaagtctatgaaaatggcagcatgatcaatttgacgtcaaaggaatttgatcttctgcttctatttataaacaaccagggccgcgccttttcaagggaggatattctcaccagcgtctggggagtcgattacttcggaaccgaccgcgtcgtcgacgatcttgtcagaaggctgcgcaagaaaatgcccgaactgaaagtggaaaccatctacgggtttggctacaggatgttgaaatcatga

SEQ ID NO: 3326 - DNA, 1347 bp, Bacillus licheniformis
atgaagaacaggtcgctcgcctttcaaatttggagtgtcatttgcggcatcctgttaacggtctcgattttgctgacgtttctattctcgacgacactgcagaactttttcactgatgaaatttatacaaacattgaaaatgagcagcatgttctgacggaatacggattttccgattcaccggaaagaggcttcggcggaagcagcggctcgcgaagcacaaaccgccacgttcagcacgtcctgctgcctgagaaaggaaccgtctatcagagcccgcagattctccccgattcatttatcgagaaggtgcagaagctcgggaaaaggcaggacgagtcatcgaaaaggtattcggagaatgtcaacggagagcacgttttctttgtgctcaaaaaaatccagacccaggaccagacgtttctgttgttatcctatgcgcttgattcatacagggacgatttgtctcatacgctgtttaagcagctgctgtttattttgatcgtcgtcattttgctgagctggattccttctatttggctggcgaaatatttatcaagaccgctcgtcacgcttgaaaagcacgtcaaacaaatctctaaacaggattgggatgatcccgtgattgtcgacagggaagacgaaatcggcaagctggggcacaccattgaagacatgcggcaaaagctcatccagaaagatgagacagaacgcacgctcctgcaaaacatctcccacgacctgaaaacgccggtcatggtcatccgcgggtatacccagtcgatcaaagacggcatctaccctaaaggagatttggaaaacacgattgaagtcattgaaggcgaagctgaaaaacttgaaaagaaaatcaaggatcttctttatctgacaaagcttgattatttgctgagacaagaaagacagtacggaacttttgatatacaagaggtcattaaagaagttgttgaacgcttgagatggtccaaaaaagaattgaactggaagattgatcttgaagaggaaacaatgttgacgggcgatcaagaacaatggagcaagctgttggaaaacgttcttgaaaaccagatccgctatgcggagacattcattgacatcagcgtcaggtcgacgaaagaacatacgttgatcaccattaaaaatgacggaccgcacattgaagaagagatgctttccagcctgtatgagccttttaataaagggaagaaaggcgaattcggcattggactcagcatcgttaaacgaatcttaacgctccaccatgctgacatgaccattcggaatgatcaaaccggtgtgtgctactcaatatccgttccgagaaattag

SEQ ID NO: 3327 - DNA, 165 bp, Bacillus licheniformis
atgaaagaaatcgatgacatgatcaggcgcctgcgcagcaggggaattaaggtggacaaagttaaatatccaaagcacgtcctgtgcgaaaagaaatggatgaaaaagccaaaaaacacagtgaagccgagctaccgggatttcaacggctattcgtttatatga

SEQ ID NO: 3328 - DNA, 885 bp, Bacillus licheniformis
atgaaacaaaaagagaaagtcattattgaaacagccatcaaacttttcgctaaaaaaggatacagttctacttcagttcaagagattgcaaaagagtgccaaatgtcaaaaggcgctttctacatttattttaaatcaaaagaagcgctcctcctttcagtccttcactactactatgaaagaatctttacccgaatccagaaaatcaaaacggagcatgacaatccgcgcgatgtgtaccggatgcagctcgtcgtttttttcgaaaacattttggagcataaagagtttatcacgatgcagtttaatgagcggtcgatgccgatcaatgaagaaattgaggcgtttgcgaaaaaaatgcggagaaccacgctcaggctgcacatcgaaaacatccagaacatttacggcaaagacattgaaccgtacagcgccgaactgtgctttatgatcaacggaatgagcgatgtctaccttgagctgatgattttgctgcaccattcgttcgacctgcagtctctcgccgaccacatgctgaaccgcctcgacgatttggcgaaggggatgatcaagcgcaatgaccagccgctgatcccattcgaaaaagcagacgagtggttcggcccattttacacatttgatccgctgaaggacgccctgctcaatgaaatgcgcgtcaaagcgaacaagcagtacaacggcgctcctcctgcagaccttgccgaaagcctggatattctggagaaagagctgagaaaagaaaaacgcaaaaacgccattatcaaaggcatgatagccaacttgaaggaatatcccgcgattcgaaaagaaacggacaaactcgccgaattgctcaaaaaagacatgcaccatccgcacggatga

SEQ ID NO: 3329 - DNA, 1389 bp, Bacillus licheniformis
gtggactacagaattgaaaaagatacgatgggtgaagtcaaggttcccgcggataagttttggggagcccaaacccaaagaagcaaggagaactttaaaatcggttccgagaaaatgccgcaggaaattgtgtatgcgtttgcaatcttgaaaagaagcgctgcgattgccaatgaaaagcttggaaatcttgaggcggaaaaaaaggaagcgattgtttccgtatgcgatgatattttagaaggaaagtatgacagccattttccgctggtcgtctggcagaccggcagcggaacacagagcaacatgaatatgaatgaagttgtggcaaacaggggaacggcttatttgcaggaaaaaggatcaagcctgaaaatccacccgaatgatgatgtcaaccgcagccaaagctctaacgacacattcccgacagctatgcacgtggcagctgtcctcgcgattcacgataaactgattccggcgattgaccggttgagaagcacgctgcatgaaaaagctgaagctttcaaagacattgtcaaaatcggccgcactcatttgcaggatgcgacaccgctgacattgggacaggaaatcagcggctgggtatacatgctggaccgctctaaagagatgattcttgaagctgctgaaaaaatccgcgatcttgccatcggcggaactgccgtcggaacaggcattaatgcccaccctgaattcggcagcaccgttgccgaagagatcagcgctctgaccgggcagacattcaaaagctcgcctaataagtttcatgcgctgacaagccatgatgaactgacacacgtgcatggggcgcttaaagcgcttgcggcagatctcatgaaaatcgccaatgatgtcagatggcttgcgagcggacctcgctgcggaatcggcgagctgcttatcccggaaaatgagccgggaagctcgatcatgcctggaaaagtaaaccctacgcaaagcgaagcgctgacaatggtcgcatcccagatcatggggaatgacgcaacgatcggctttgccgcgagccaggggaactttgaactgaacgtctttaaacctgtgattatttacaacttcctccaatccgttcagcttcttgccgacggcatgaattcattccatgacaagtgtgctgtaggaatcgaacctaatcgggaaacaattgagaagaacctgaccaactctctcatgctggttacggctctaaacccgcatatcggatacgaaaatgctgcgaaaatcgcgaagctggctcataaagaggggctgacgctgaaagaagcggctctcaagctgaaccttttgacagaggagcagttcgacgaagttgttaaacctgaagaaatggtgaaaccgaaagcataa

SEQ ID NO: 3330 - DNA, 168 bp, Bacillus licheniformis
ttggcgcaaatcaggcttacggggaaaccggaggagattgaacgcattattcaatctttttctaagcattatgaggtttcatatgtatcgaaagaatacggtaaaacaaatccgaaatataaatatgcaaaagatacccgggtttatattgagctaaaattaaaataa

SEQ ID NO: 3331 - DNA, 1443 bp, Bacillus licheniformis
atgactcaatcggaattcaaggaacacatccatgaaaatctcgcaatgctccttccccatctcgagcataacgatgatctgattcaaaataaaaaaatgctgaaaaacggaatcattttttactttttgtactttaaagatttgaatgatgacaagaaaatccagaaggctgcgaaattgcttgtctccgatgacagctcctattcattggaggatgtccggctccgcttaaacaagctgaatgcggaacccgttacagcaaaaaaggacgcgattaacgcaatcttcaaaggaaaatgtctgctgttgatcaacggtttgaatactgtatttgcactgccgacagctgagaaaaagaaaagaagccttggagaagtgaatacagaaaacgtcgtcagaggcccgaaagtcggttttatcgaggatgtcgatacaaatgtggctctagtcaggcagcgtgtcccggataaagaactgaccgtggaaaaaatcccgctcggcaagagcaagtttaaagacgcgaccattctctatatccagggcaaagcggacgattcgatcatcaaagatcttaaaaagcgcctgaaaaaagttcagctggatgatattcaagataccggcgttcttgaagaattaatcgaagataataagtactcgccgtttccgcagatccagaataccgaaagacctgacaaggtttcttcagcgctgtttaatggacggatcgcaatttttgttgattactcgccatttgccctgatcgtgccggcttctttcggaatggtgatgcagtccccggacgatttttacgaaagatggatcgccacgaccttgatcagatttcttcggttcagttcgattttcatcaccctgttcctatcggcgttttatatttcgcttgtatcttttcatcaaggcatgctgccgacggctctcgctgttacgattgcgagcacgcgcgaaaatgtgccgtttccgccgctccttgaagcgctgattatggaagtgacgatcgagctcttacgggaagcgggactgcggcttcccaatccgctaggccagacgatcggcctcgtgggaggcgtcgtcatcggccaggcggcggtcgaagcaaatatcgtcagctctgtgatggtgatcatcgtcagcattatcgcccttgcttcatttactgtgccgcagtacggcatgggcctgtcgtttcgcgtgcttcgttttatttccatggtggctgcagccgtgttcgggctttacgggatcatattgtgcatgctcgccatcttcacccatttggctaggcaaagaagcttcggcatcccgtattttaacccgaaccattttttcagcttaaaacatacggatgaagccattattcgtctgccaacaaaagctcgggaggtgaaccgtaaaaatggatccaaaaaatcagcacgatcggattag

SEQ ID NO: 3332 - DNA, 1101 bp, Bacillus licheniformis
atggatccaaaaaatcagcacgatcggattagcacgtatgaagccgcttcgatcataaccagcacaatgctcggcgcaggcctgctgacgctgcccagggcgctgacgcaaaaaacgctgtcgccggacggatggatcgtattaatctttgaggggcttgtcttttttctcattatctacatcaatgcaaaaatcgttaaaaaacacaacgtcctgtctttttttgattacacaagagaaggctgcggctttataatcgggaatattctcaacctgttaatcgttttatacttcatgggcgtggccagctttgaagccagggcgatggctgaaatggcaaagtttttccttcttcagttcacgccgatgagcgtgacgattttcgcttttatcgtctgtgcaatttatttggttgtcgggggtatcagcgatatgtcaaagatattcccgttcttcctgtccgttaccattgtcattcttctgatcgtctgcggactgagcctgaatatgtttcagctgaaccatttgcggccggttctcggccttggtttggagccggtcagcagagctttgacggtcgtttccatttcatttttaggggtggagctgatgatgtttctgccgaaatacgtcaaaaacaaagaaaagctttttaaggcatcggcgattggatttgggataccgctcttcttatatatcctcacctttgcggtcgttgtcggggcgctgaccgcgactgaggtcatgacgttgacatggccgacgatctcgttgtttcagtcttttgagataagagggattttcatcgaaaggttcgaatcgtttttgctcgtcatttggacgatccagtttttcacaacgtttgtcgtctatacgtactttgccgcttcaggacttgaaaacgtattcggatggcctgtgaaaaaaaacgtcctcttcatcggcgttgtcatctatctagcatcccttgtcccgcgggacgccaaccaggtcagcgccttcagcgactaccttggatatatctttatcgttgtcttctgtgcacttccgcttatgatctttttgctcgtgtccatcaaaaggaggtttacttcttcatga

SEQ ID NO: 3333 - DNA, 1122 bp, Bacillus licheniformis
atgaaaaaaaagggaatgttagcagccctttctctgcttctccttttaacaggctgctgggacagcaggcagatcgaaaagcttagcatcgccatcggccttgccctcgataaaggcgaggacgataaaaacgtgaaattgacgtatcagtttcttgttcctaaaaagatcggacaagacggcagcgctcaggatccgtctaaagtggtgtccacctccggaaacacggtccatcaaaccatccgttccaccgctttgaaaaatttcccggtattctcgcagcatctgcaagtcctgattttctcagaggagcttgtatccgatatttctctggaagcattgatcaatcaatttattagggacaacagcatcagaaggagcagcgaggtctatatgacgcccggagctgccgacagcatactgaaggttgatggtgcaagtgaccctgcgtccgacgtgatccacagcatctctgaaaacagagcttcgacgatcaagctgctcaagcccgtcacattgaacgatatttcgattaaaatgcagtctgatttatcttatatcatgccgaaggttgtgatcgaaaaaggacagcttcagcttgaaggcggcgccgtgatcaaaaacaacaaataccatgcaaacctttcgccgtctcagatcgaagcgctgaatttattaactggcaatgtcatcggcggagtgatcgactcaaggcatgatggacatttgttctcgtatgaagtgttttcgatgacccaccgcgtgcgggcgatgaggcagaacggaaagtacaaattcgtcgtaaatgccaatattaaaggaaggctgtcagaggactggtatcttggagaggattcttttaatgaccaatatataaaaaacatagagaaatcggttcaaaaagacatcaaaaagcgggttgagcagctgatccatgtcctgcagcacgatatcaaaacggacgtcaccgatttttccgacaatgcgcggatcaattttccgaaggagtgggaaaaagacagattcaattgggacaaacacttcagcgaagcctatatcgactatcatattaaagcgacgattcaggactttggaacaaaaggtgcgacaaaaagcagatag

SEQ ID NO: 3334 - DNA, 366 bp, Bacillus licheniformis
atgacaggcatttttttgattgcagcggcagtcattctgtccggattcattatcagtgatgtcgcctatgatccgtttatggaggattcgcagtcgatgcttttcttcacgatcggcacatacctcaccactccgtttttttgcttcatcggcggattcattttgctaggcatcggcaagttgatcgacttgcaggagaaacacaatgccatagtggccgagcggctcgacatcatttgccaaaacggtacagcgggcgaacatgcacgcgaagaaaacgaggccgcccaacttaccgcccgcacggttgaaacagattcattcactcttcctgcagccgaggatcgaaaatattggaacggctga

SEQ ID NO: 3335 - DNA, 624 bp, Bacillus licheniformis
ttgttaattgatgatcatgaaatggtgagaatggggctggccgctttcctggaatcccagcctgatattgaagtgattggggaggcatcagacggaaagcgcggcgttgaattggcgcttgaaaccaaacccgacgtgattttgatggatcttgtgatggaagggatggacggaattgaggccacgaaacaaatatgccggcagcttgccgatccgaaaatcatcgttctgacgagcttcgttgatgatgacaaggtctatccggtcatcgaagccggagcgctcagctatttgctgaaaacgtcgaaagcgagtgaaatcgccgatgcgatcagggctgcgagcgtcggagaaccaaagcttgaagccaaagtcgcaggaaaagtgttgtccaagctgagacattcagccggcgaacagccccttcatcaatcgctgacggcaagagaattggaaatcctcaaacttgtagcagagggcaagacaaacaaaggtattgccgaagaattatatatcaccattaaaacagttaaaacgcatgtgacgaacatcctttccaagcttgaagtcgacgaccggacacaagccgcaatctacgcccaccgaaacaaacttgtcgactga

SEQ ID NO: 3336 - DNA, 1065 bp, Bacillus licheniformis
atgagaacgaacagacttgcaaacattcaatggcgcgccgtccgcttatcccttggtgtcagctttacgatttttcttgctgtattgggctttatgctgttttattaccagctggatccgagggtgctcatcgtttccaggtggttcgggattccgtttatcgcgcttctcgcattgatcagcacagctgtcgggttcggctcaggctatatgttcggcaatcagctgaaaaaacggcttgaaaagctgatcgagtctattctaaagtacgaaaacggcaactttgcctaccggattccatcgcttggagacgatgagatcgggctggccgccgaccagctcaatgagatggccgaacggatcgaaagacaggttgcctctttgcaaaagctgtccaatgagagagcggaatggcaggatcaaatgaaaaaatcggtgatctccgaagagcggcagcgtctcgcgcgcgaattgcatgatgcggtgagccagcagctgtttgcgatttccatgatgacttcagctgttttggagggaatcgatgctgcggctgatgaaaagctcgctcaaaggctgaaaatggtcgaaaaaatggcggccgatgcccagaatgaaatgagggcgctccttttgcatttgcgacctgttacgcttgaagggaaaggtctacaagaagggcttgcagaccttttgaaagaatttaaagcgaaacagtcgatcgacatcgattgggagattgaggatgcgggcaaacttccgaaaggtgtggaagaccacctgttcaggatcgttcaagaagcgctctcaaacgtgttccggcattcaaaagcgacaaaagtcaccgtcagactgctgctcaggaacaaacagctccagttgaaagtcattgacaatggcgaaggatttaagatggatgccgtcaaaacatcttcgtacgggctgaactcgatcaaggaaagagccagcgaagtcggcggagtggcagaaatcatttcatttacgggaaaaggaacacaggttgatgtaaaggttccgatttttgaacaacaaaaaggagaggcttaa

SEQ ID NO: 3337 - DNA, 732 bp, Bacillus licheniformis
atgcgtcttacaaaaaaccagctgatcggactgatcatcgtactcttcggaatcagcatatttttgcaaaacagcgggcttggagacgcgttattctggccgctcgcttttctttttgccgggtattttctccacaaatattcccgccgctggctcgggtctgtcatgtatatttttgcaggctttctgctgctgaaagacatcttcagcattacattcagcctgttcggctttttctttgccgctttcttaatttatgcggggtaccggctggtgacaaatcagccggtatttgaccgccataagccgaaagacaggggaaaggaaaaggcggatttcaagccgcttcaggagaagaacagccctggccagcgcagcttctttttcggtgatgtaaaattgatgaaaacaccttttgacttaaatgacttgaatatctccgggtttatcggtgacgtgaaaatcgatttgtcaaaggcgattatttcagagggcgaaaacaccatcgtcattacggggttgatcggagatgtcgatatttacattccgtccgatcttgaggtgtccatcagctcttctgcattcgttggagacattgacgtcatcggcggccgaaaaagcggcatcggcaatcaaatctattccgagacagagaattacgagcagtcggcacgacgggtcaaaatttcgatttcgctgtttatcggcgatgtggatgtgcggttcatatga

SEQ ID NO: 3338 - DNA, 864 bp, Bacillus licheniformis
atgaaaaaaacggttggaaaactgctgatcatcgccggcattctcatccttgcaggcatgatgtttaatgggcgtgaaggcttttctttcttcggcttcgatgaagagtcagcccgcacatatcatgcacaggcggaagacatcgataaaattgacattgatgcaaagagtataacagtcaacattcaagctgaaaaccgcgatgatataaaagccgagatttcaggaaaaaacgtccggcttgattcgtccgaacaggggcgtactcttcagctttccgctcattcgaaaggcttttggccgtttttctggaagaaaaatgagctgattgtcaagatcccttctgaatataaagatgatctgtcgatttcttctggaagcggaaatgtcaaactgtccggcggcggtctgcatttgcgaaatgtagccttaaagtcgggaagcggcagcctcaaggccgatgaccttcaggcggaagacctttctgtaaaagggacgtcaggatcggtcaggctggaaaacgttcaaacggcagctgctgatatccgctccacatccggtaatacaaaacttgaaaatgtcaccggcaaactcagcatcaaacagacttcgggcaatttgcgcgcttcctttacagagatcaacgattctctgagcatcaaacagacatccggaaacaccaagctcagcctgcccgatgatgccgacatcagtcttgaagccgagtcgacaagcggaaacatcagtcattcctattcatttgaccaagtcgccaatgagaagcggacgctgactggaaaaaaaggaaatggaaaaaataaaatcgacatctcaattacgagcgggaatgtctcaattgagtaa

SEQ ID NO: 3339 - DNA, 684 bp, Bacillus licheniformis
atggctttaaaaagaatcagagacatgtttgtcgcatcagtaaatgaaggattggataaactggagaacccacgggtgatgctgaatcaatacgtacgcgacatggaaagcgatatcgccaaggcgaagcataccatcgtcaagcagcagacaattgaacatagttttaaaggaaaagtggaagaagccgaaaagcttgctgtcaagcgaagaaaccaggctcagctcgcttttgatgcgggtgaagaagaacttgctaaaaaggcgctctcagaaatgaagtattttgaagaaaaagctgctgaatacaaggacgctcaccagcacgcgaaaaagcagcttgctgaattaaaggaacagctggagacacttgaggttaaactgcgcgatatcaaagaccgaaagcatgcgctgatcgccagggcaaacgcggtgaaagcgaaagaacatatgaatgcatcatttaataaaatcgacagcgaaagcgcctaccgggaatttatgagaatggaaaaccggattgaagagatggaaacaagggtgaacagctatgctgaattatcagcttcatcaagcagcccattcggccgccttgaatatgcaaaagaagtggaagaagagctggaaaaaatgagggctaaaaagacaggcttggaaaagcagacacctgcgggaaatgcataa

SEQ ID NO: 3340 - DNA, 387 bp, Bacillus licheniformis
atgaatataaatgggaagtccatcatcggcttttttctaatcctttttggcgtctccctgttcttcggcggaggccatttcggcggattggttacaggtgctattggagcattgcttctattctattccgtgaaaaaatggaaggaaggacgccagtttgccgcggtactggccgcgatcttcggcatcatgtttttgggagggtcattgccgtttctgatcggcatcgcggttgctgcagcgatggtttatttcggatggaaaatgatgaagcaagatgacaaacaggatgacatcctttattcagagaaaacggagccttccgcagcttcatatgacacaggctttgatgcagagtgggaagactttttgaaaaagaataaataa

SEQ ID NO: 3341 - DNA, 954 bp, Bacillus licheniformis
gtggttaatcgggaggcagctgctatacggctgacggtttcgaaggatggagacggcgaatttcaaaccgttcaagaggcgatcgatgctttgcctgagtacagtcgggaacagaaagtgatattcattaaaaaaggagtttacaaagaagtcgttcatattccggctacaaagccgtttgtgaagctgatcggcgaaaatcgttacgagactgtgattacgtatgacaactatgccggaaaagaaaaggaaggaggagggaaatacggcacgaccggaagttcaagcgtgtttatttatgcggatcatgttgaagccgaaaatttgacgtttgaaaactcgttcgaccgcacgaaagtcgacacgaccgatacgcaagcggtggcggtttatgcgaaaggaaacaggatgacgttcaaatatgtcaggtttataggcagacaagatacactgtttgtcaatgacggtacacaatatttttatcaatgctatatagaaggcgatgtcgatttcattttcggaggagcaagagctgtgtttgaagagtgccagatccatagcgctgaccgcgggtccgctacaaacaacggttatgtgacagctgcgagcacgcatatcgcaaagccgttcggtttattgataacaaactgcagagtgacaagcgatgccgcagatggaacggtatacctcgggcgcccatggcatccgggaggagaccccgacgccatcgccagtgtgctatatcaccgctgcgatttaggcgcacacatcaagcctgaaggatggacggatatgtcgggcttttctgcggccgatgccagattgtacgaatacgggaatacgggtccgggtgcgatttcgcatgaggcccgaaggcagcttgccgatcatgaggctgagaaatggacaattgaaaacgtattggacggctggaatcctaaagttgaatcatag

SEQ ID NO: 3342 - DNA, 579 bp, Bacillus licheniformis
atgaaactctatacaaaaacaggcgatcggggaaaaacgagtttaattggcggaagggccgataaagatcatcttagagtggaagcgtacggcacactggatgaagcaaacagtttcatcgggctggctcagtcttatttaaaagcagaagaggcgctctttcatgatattttgtcagagttgaccgccatccagcatgagctgttcgactgcggcagtgatttggcgcatgtcaatgttcaggaagaaggcaagctcaaggctgaatcaatcaccatgcttgaagaacgaattgatgcctatgtcgaggaagcgccgcagctgaccaagtttattcttccgggcggaacagaagcggcatcatttttgcatgcggcgagaacggtcatcagaagagctgaacgaaagattgtcgctttggccaaagaagaagacattccgccgcttgcgctgccatacgtcaaccggctgtccgattatttatttgcggcggcgcgcattgtcaatcaccgtctcggggaagtggatgtcgaatatgaacgaagcgctgatgtattccggacaaagaaaaaatcatga

SEQ ID NO: 3343 - DNA, 747 bp, Bacillus licheniformis
atggaatttaatcagcaaacggccattatcacaggtgcaagccgcggcatcggcagagccattgcggagttgcttgcggataaaggggcaaatgtcgttatcaatgggacaaacgaagaattgctcaagtccctgtgtacacaattgaatactgagagaaagtgcgcttcttatgttgccggtgatgcaagtttgccagaaacagcctcgcttctcatcgctgaggcaaaacagcggtttgggcggatcgatattttggtcaacaatgccggcgttaatttgcgcaaaacgaccgttgatacgtcgcttgaagaatggaaaagagtgatagatttgaatttaaccggcacctttctcatgtgtcaggctgtcatcccggaaatgatcacgcagggcggcggaaaaatcgtgaacatgagctctacgacgagcaaaacaccgcatcacaatgcctctcctgcttacggtgcatcgaaagcaggcatcaactatttaacgatgcatttggcaaaggagcttgctgaacaccgcattcatgtcaacggcgtctgcccgggaccgattgaaacggatatgagcaagcagtggagcgaggagtaccgcgcagcagtcgtcgaacggattccgctgaaaatgctcggctcaccagagcatgtcgcaaacgttgtcgcctttcttgcctctgacaaatctgactttatgacaggcgaaaccattaatattaacggcggcacctatatgaactaa

SEQ ID NO: 3344 - DNA, 219 bp, Bacillus licheniformis
gtggtggctatgtatcatgaccaaggacacggcccgattaaggtgcttggccttgaagccggtgtgaacattgcagtcggcctgccgattatccgtacgagtgttgaccacggaacagcctttgatattgcgggaaccggcaaagccgatcctgcgagtatagaagaagcggtgagacaggcgatcatgctgtccggtacgcgtgagcggcatgcataa

SEQ ID NO: 3345 - DNA, 1170 bp, Bacillus licheniformis
atgaaaacgctttatcattttcgaacggccgcccgaattgaggctggtccacattcactcaatttgctcggcgattacttagatcaaattggattgaatcagattcgttcggtgtttattttaactcagccgtcgatcgtctctctcggctatgcagaccaaattaaagaagggcttgcaaagaaaggcatctcaagtgaagtcaacacggatatacagcctgagccgacggagcaaaatatcgaacaggtttttcagcttttttctgaaggaggccatgacgcgattttgggaattggcggaggcagtgtgcttgatgcggctaaaatcctctctgttctgaaaacaaatgaaaaaccgatttctgctttgattggcacgaatctcgttgaaaagcccggcgttccgcttgtgctgattccgacaacatccggaacagggtcagaagtgacgccgaatgcgattgtaacgttccctgagaaagaattaaagattggtatagtcagtccctatctgctgccgtcgcttgtgattttagatccagttttgacgaccggacttccaaaggcaatcacagctgcaaccggaatggatgcatttacacacgcactcgaatcctatatttccaacaaagcaaatccattcagcgacatgtttgcgcttgaatctatgagactgatttcctccagcattcagcaggcctaccatcatggagataacctggaggcgagagaaaaaatgctcattggcgccatgtatggcggaatggccttgacaagcgcaggaacagcggcggttcatgcgatggcttaccctctagggggaaaatacaagatttcgcacggtgtggccaattcaatgctgcttccgcatgtaacggccttcaacgcggatcatgtaactgaccgcctttcggacgtggccggcgtaattggaatcgagccaaaaggttcgaagtccagccaagcagagcgggttatacgaaaaattgaatagtggaccgccgatttaaatattccgcaaaatttaaagacattcggggtatcaaaagaggatgtgccatcgcttgctgaggcggctgccgacgtcaaaaggctcatggataacaatccaaagccgatgtctgttgcggagattgaagctgtctatttgaaattgctggatatgtag

SEQ ID NO: 3346 - DNA, 903 bp, Bacillus licheniformis
ttgaaagtagagggaattatccctgccatactgacaccgcttacaaaagaacaggcctttcatccgggcgcagccgaaaagctggtgaatcgtctaattgattcaggcgtccatggcatttttgctttagggacaaatggcgaatttcatttattctcgcaagaggaaaagcttcaaattgccgaaacagttgtaaaagcggttaataaacgagtgcctgttttcatcggagcaggtgaaaacagtactgaggcgaccatttctttattcaatcaaatggcggatcttggagcggatgttctttcgattattacgccatactttgttgcaccttcgcaggaggaattgtatcagcatttccgcacgatttccgaaaatgtcgcgcttcctgtcctgctctacaacattccgtcgagaacaggcgtatcattggagcccgaaacagttgaaaggctggcggcattgccgaacatcatcggcattaaggacagcagcggaagcttcgccaatattaaggcgtatcttgagcgtacaaaagaacagtccttttccgttctggcaggaactgattcgctgatcttagacacattgaaggcgggagggacaggagctgtggctgccacagccaatgtgtttccgcacaccgttgtttcaatctatgaatcttttaaacaaggaaacattgaagagagcgagcactatcaacagcagctgcagccgctccgtgatacgttttcactcggttcactgccggcgccgctaaaaaaagcagcggagcttgccggcatcgacgtcggaccgcctaaacgtccgattgcagaactgtcgggagagccgctgctaaaagtgaaaaagatgctggaaggctacggaattgaagcaaaactggcaaaggagcagtaa

SEQ ID NO: 3347 - DNA, 1284 bp, Bacillus licheniformis
atgattgatgtcatccgggtgtccggcggatatggaaaaacggatgtcttacaggatatcagttttgctgtaaagccgggtgaatttttaggaattcttggtccgaacggcagcggaaaaaccactttgctgaaaatgttgtcgggaacaattgccccccgaagcggcgaggtgctgcttgaatgccgttcagtcggggagtacaaaacgaaggagctcgctcgcaaaatggcggtccttcctcaaaaaacggagcaggccttttcctttacggtggaggaaacggtacagtttggccgctacgcgtatcaagcaggcctttttcggcagctgacggcggaagaccatgatatcgtgaagagggtgatgaagcagacagacacgcttcgcttcgcccaaaaatccatccatgagctgagcggcggagagcagcagcgggtgtatttagcgcaggcacttgcccaggaacccgaatatttgctgcttgatgaaccgacgagttttctcgatttgtcatttcaaaagagtctgcttgatttaatgaaacaagaaacggctgcatccaaactcgcagtggtcggggtgtttcatgatgtgaatattgcgagtttatactgtgaccgtctgctcctattaaaagatggaaaagcagaagttcttgaccgcccggaagcagctctttctgctgggcgcatcggacgagtgtatgatacggacatcactggactggaccatcctcagcgttcaaatccgcagtttacaattatggcgaaaaacatcccgcggaaaaccgagcccctctttttaaaagagcgaattgaacaatatttgccgcacggcatcgcatttttggcagaccgcccgctgcggcttctgtcctcagaaaggggctttgcttggagacgaaaacttattttcgacagcggaaataactctggatggccgcatggctcgtcagcttttgaacaggaaacgctgtttatccaacatgatgctgaattggctgactgccatattgtgtcggaaagcggtgatctttgcatcgtcggtatgaaagacacgatggggcgtttgatcatgtgggtgttagttgacggctgtttgcaggatggtcaatttgtgaaggcgataagcgctgcggcatttgccgcagcccagcatcatgttccgtgtagtgatgtccttgtagcggccactcaatccggccggtcagcggatcaaaccgcttttttgacacaaattcaaaataaaacagccgcttgtgtgaaagctttaaaagattaa

SEQ ID NO: 3348 - DNA, 1065 bp, Bacillus licheniformis
ttgctgaacatatttaccctgacgtttttaagaaataaccgttttgcggcatatgccttcagcctgctgtttttgtcggcatccgttcttatgggaatctctatcggatctttggagattcccattccttctattatgaaggtttttttggaagaatggtttggcattcaagggttaaatcccgatccgacagaggcgaacatcatcatgaaaatcaggctcccgagggtggttttggccgctcttgtcggcgcgggtctggctgccgcgggagccgggtttcaggggctcttgaaaaacccgctcgcggatccatatacgcttggcatttcgtctggcgcggccgtcggtgccgtggtcacgctgttttttgggattcagctgccggtgatcggaagttttacactgccgtttttaagcgttgctgcggctgttatcgtgatttttttggttttgttttttgcgcggctcgtacacccttcgttgaccctgtccgctttgattttaacagggatcatcttcagttcgtttttgggtgcgcttatttctctcatgatcgctttgaccggcgatgatttaaaaccgatcgtccactggctgctcgggagcgtatcgatgaggggctggggctatgtcgcgttgtttctgcccttttttgctgcgggcgctgccgcgcttttgatcagcgggagggaactgaatgtgatgacttatggcgaggaaaaagcgaggctgctcggcgtgaatgtgaagcggagtaaatatatcgttctgttggcgggagctattttaaccggcagtgcggttgctgtgtctggaaccattggttttgtcggcctcgtcattccgcattttatccggcttctgtcgattacggatcaccgtcatcttctgccgctctcgatgctgaacggcgcttcgttcctcgtgctgtcagatcttttgtcgagaaccattatcgagccgtccgagctgccgatcggcattattaccgcattgataggggcacctgttttcggctttatattaattcggcgctaccggggagggcgagttcatgattga

SEQ ID NO: 3349 - DNA, 951 bp, Bacillus licheniformis
atgaagaagtttgggcttttattgctgtcgctgctgttggctgccggcgtccttagcggctgcggccaagcgcaaaaaccggcagacgagcaaaaacaggagaaggcggctgaagcgtttccggtcaccataaaagatgcctcaggacaagaggtcaaaattgaaaaagaaccgaagaaaatcgtctctctgatgccgagcaataccgaaattacatacgccctcggcctggggaaaaaagtcgtcggcgtgacggattttgatacatatccaaaagaagtgaaaaacgttgaaaaaatcgggggcatggaatttaatacggaaaaaatcatttcgttaaaccccgacttggtcctggcccacgcttccagcatgcagagtgccgaagaagggctgaagcagctgaaagatgcaggaattacggtggtgactgtaaatgatgcggcctcttttgaagagacgtaccggtcgatcgaaatgatcggaaaggctgcaggcgcagaggatcaagcagcgagcctggtcaagagcatgaaatctgacctggctggcataaaagaaaaagcggcagccatatctaaagcagatcaaaagaaagtatttgtcgaagtgtctccggctccggacatttatacgaccggaaaaggcacctttatgaatgaaatgcttgaagcgatccatgcggaaaatgctgcttccgcgcagaaaggctgggccaagataacggaagaagcgatcgtcaagctgaatcccgatgcgatcgtgacgacaaacggcgaatccgctgtcagcgaaattaaaaaacggagcggctggagcggtgtcaaagccgtcaaaaataatgaagtatacgacgtggaccctgacctcgtgacccgtccggggccgcgattgatcaaaggggtcgaagagcttgctgaacatatttaccctgacgtttttaagaaataa

SEQ ID NO: 3350 - DNA, 681 bp, Bacillus licheniformis
atgccgataccgaaaaactatacgcctcaggtcagactttcagcaaaggaaaaagcgtttcaccaattgcagcgctggattgtagacggaacccttgaacccggcgaaaaagtcacggatgtcgatctggccgaagcgctcggcgtcagccgcacaccggtcagagaagcgcttcagctccttgaatcccaagggtttgtggaaatgaagccgggaaaagaaacaaagatcacgctcattcatcccgatgatgcgctggccgtctatcctccgctcgcacatctccaggctttggcggcagaactggctgcgccgcttttgacggaagaagagatcgccgagctcaaaaaactcgctgctcaatacgaaaccgcgtttaaagaggaaaggaaccacgatgcagctgaactggacgaacagttccaccatttgattacagaagcggctaaaaacccgtatgttcttcagttttctgccgttctgcagcttcatgtcagacggatgaagtatgtgtttttcaatcggcctgctgctccgaaaatgcagtccgccgccgagcattggaaaatcatcgccgcttttgaaaaaaacgatccgaaattggcggctgaagtgatgaaaaggaattggctccgtccgatggaagatattcataaagttttaaaaggcagggaacaataa

SEQ ID NO: 3351 - DNA, 792 bp, Bacillus licheniformis
atggatttaaagctgaaaaacaaactcgtgctcgtaacgggttctactgctggtattggaaaagcaacggcggaagcctttttggcggaaggcgccgaggtcatcgtaaacggacggacagaagaaaaggtccagtcggtcgttgatgagctttcccggcacggaaatgttcacggaattgccactgatttatccgatcctgaagaaagcagggcactggtcgaaaaaaccgctgaaatcggggagcttgatgtcctcgtcaataatatgggcttctttgaagtgaaggattttacagacgtgacagacgaagagtggctcaaatattttgaagtaaatgttttaagcgccgttaggctttgccgcgcgtttttgccggccatgctgaagcggaataagggaagggttctcaatttggcaagcgaggccggcattaaaccgcttccgcagatgatcccttattccatgacaaaaaccgctttgatcagtttgtcaagaggtttggccgaaatgacaaaagggacaaatgtgaccgtcaactctgttcttccgggacctacctggacggaaggcgtcgccaattatatggaaggtgccgccgctcaggagaaaaccgatttagacacctttgtcaaagattatttcaaagtgaatgagccgacttctttgattcagcgctatgcaaaaccggaagaagtggcgagtacgatcgtctacctcgcttccgaaaaagctgcggctatcaacggttcagctcaaagagtggagggcggaatcatccgctcgatttaa

SEQ ID NO: 3352 - DNA, 696 bp, Bacillus licheniformis
atggaatatgccgatatcctttcgatcaatgtagggaagccagaggaaattcagtttcaaaataaagctgtgtctaccggaatatacaagaagccggcaagcggccccatcttcctgtcatctactaatttcacgggggacggacagggggatctcattcatcacggcggcgcggaaaaagcagtgtgcgtctatccgtatgaacattatctcttttgggaaaaggaactgcaaagaaagctggaatacggagcatttggcgaaaatttaacgatcaagggtctgctggaggatgacgttcatatcggcgacatctttcagctgggtgcagctgttgtacaggtgagccagccgaggcagccctgctataaactaaccgtaaggtacggtatgccggacatgatactgaaggtacaagataccggatttacgggtttttactttcgcgtgctgaaagaagggttcgtctgtaaggagcatggtctgaaacgaatctcacgccaccctaaaggcattacgatttcatacgcaaatcgcatcaagcatcatgaaaagaacgatattgagggcatcaaaaaacttctcgaggtggaggaactgtcggcaaattggcgtgcatcatgtttaaaacggctgaacggctttgagccggatgaccgcgaaaggctgacgggaggtctgaagcagggttcttaa

SEQ ID NO: 3353 - DNA, 909 bp, Bacillus licheniformis
ttggagctaaagcaattggaatactttatggcattgtgccgggagcttcattttacccgcgccgccgaaaaactgaatatcgctcagccctcgctgagccagcaaatccgtttgcttgaacacgaaatcggaatgcctttgtttaaccgttcaggcaaacgcaccgtgatgacggaagcgggaaatattctgctccagcactgttacaatatctttcatgaactgtcacaggcgcgagacgcgatcagcgagcttcaaggtttaaaacggggaacgcttaaaatcggggcgcttttgaccgtggttaattatttgcttccccggaccgtggtcgaatttcaccgcagctaccccaatattgaattgtctgttttagggctgagaaccggggatatttacgaccggctgctgcaaaatgagctcgacttgggcattgtagcccagcgggtggaacatcgtgacttagaagccgtcccattccttacccagcatctcgccctcgcggcgcctgttgacaatccggttgcaaagcggcagtttgtcacgcttgacgtgttaagggagattccatccattttgctgcctgagacgtattttttgcggcagctgatcaacgaaaagtgccgcacgcttggattcgagccccggccggtcatggaaatgacaacgatggaatcgatcatgaacatggtcggtaaaggcatcggcgccaccattttgccgaaaggctatcttaatgctattggaaataaatccattcagacgattccgatacaaaagccggatttgacgacggagatcagcatcgtttaccgtaaaaacaagcatatgtgcgctgcaagccgggtgtttatgaaactgctgatttcctcggtcaaaagcgaaaccgctgatgcgccgccgcgttaa

SEQ ID NO: 3354 - DNA, 1311 bp, Bacillus licheniformis
gtgagtctgcagaaaataaaagaagagattgtaaagaagctgaaggttccggtatttccgaatcgctcatttgatgtcacatcgtttggggctgacgaaaacggaaaaaacgattcgaccgaagcgatacagaaggcgattgatcaagcccaccaagccggcggcggaagagtaacggttcctgaaggcgtgtttctttccggtgcgctcagattgaaaagcaatgtggatcttcatattgcaaagggagcggtgatcaaattcagtcagaaccctgaagattatctccctgttgtgctgacgaggtttgaaggagtcgagctctataattattcaccgctcatctacgcttacgaagccgataatattgcgataaccggaaagggcacgcttgacggtcaaggagatgacgagcattggtggccgtggaaaagaggaacgaacggccagccttcacaggaaaaagatcggaacgctttgtttgaaatggctgagcgcggtatcccggtcactgagcggcagtttggaaaagggcattatttgcggccgaatttcattcagccgtatcgctgcaaacatatattgattcaaggcgtcactgtgctgaattcgccgatgtggcaagttcatcccgtgctttgcgagaatgtgacagtggacggcatcaaagtcatcggacacggccccaataccgacggagtcaacccggaatcgtgtaaaaacgtggtgatcaagggctgccattttgataatggagacgactgcatcgccgtcaaatcgggaagaaatgcggacggccgaaggatcaacattccgtcggaaaacatcgtcattgaacataacgaaatgaaagacgggcatggaggggtcacgatcggaagcgaaatttccggcggcgtgaagaacgtcatcgcagagggcaatcttatggacagcccgaacttggacagagccctccgcattaaaacgaattcggtgcgtggcggcgttcttgaaaacatctactttcacaaaaatacggtcaaaagcttgaagcgcgaagtgatcgccatcgatatggaatatgaagaaggagatgccggagatttcaaacctgtcgtccgcacggttgatgttaagcagctgaaaagcatgggcggacaatacgggatcagggtgctggcatacgaccactctccggtcaccgggctgaaagtggctgattccgagatcgacggcgtcgatgttccgatggaactgaaacatgtgaaagaccccgttttttcgaatctgtatattaacggaaaacgctatgactcacacaaagcctaa

SEQ ID NO: 3355 - DNA, 1491 bp, Bacillus licheniformis
atgaaagactgcttgatgatcaatcctcaagataatgtcggcattgcgttaagagaattgcagaccggtgaaacggtcactgtcggagaacgaaccatcgtgatcaaggaaccgattttgaaaggccataagtttgctttaaaagacatcgctgaaaatgaaaacgtcatcaaatacggctttccgatcgggcacgccactgaaatgattcagacgggagagtgggtgcacacgaaaaatgtgaaaacgaatttgggcggtgtcgaagaatacagctacaagccgaagtttacggaaaaccgctatcaaaaagaaccgcttacatttaaaggctttaaacgaaaagacggaaaaaccgggatcagaaacgagctatggatcgtcccgactgtcggctgtgtaaatggcattgcagagctgatcatcaaagaatttaaggctgaggtcggctccatcgccccttttgaaagcgttcacgtattaaagcatcagtacggctgttcacagcttggcgacgatcatatcaacacgagaacgattttggcgaatgccgtcaaccacccgaatgcaggcggtgtccttgtgctggggctcggctgtgaaaacaacagcattcacgaattccgcgaagcgctcggcgattacgatcacagccgggtcaagtttctgctttcccaagaggtatcaaacgaagtcacggaaggcgtcaaactgttaaaggaaatttataagcatgcaaaaggtgaccaccgcgaagatgttccgctttctgaactgaaaatcggtttgaagtgcggcggatctgatggattttccggcattaccgcgaacccgctgctcggccggctctccgattttctgatcgcccaagggggaacggcggtgttgacagaagtgcctgaaatgtttggggcagaaacgctattgatggagcgggctgaaaatgaggaagtgtttcataaaattgtccgcttaatcaacgattttaaacagtactttatcgatcacaggcagcccgtctatgaaaacccgtctccgggaaacaaagcgggcggcattacgacattggaagataaatcgctcggctgtacgcaaaaagccggcacttcaaaggtggcggatgtccttgaatacggggacgttttgaaaaagaaagggctgaacctgctgagtgctccgggaaatgaccttgttgcttcatccgcactggccgctgcagggtgtcaaatcgttttatttacgacaggacggggaactccttttggcacctttgtgccgacgatgaaaatttcgacaaatacggcgatttatgaggcaaagcgccattggatcgattttaatgcgggaaaggtgctcgaagaccgatcagaagatgacgttttgaaggagctgacagcgtatttgatcgaagtcgcaagcggcaggcagctgaacaatgagataaacgatttcagggagcttgcgatatttaaaacaggcgtcacattataa

SEQ ID NO: 3356 - DNA, 1470 bp, Bacillus licheniformis
atggagaggctgtccaaacggataaggtctaagccgagccgccccgaacggattttgcaaatcggggaaggtaactttatgagggggtttattgactggcagattcatagattgaatgaagaaaccgattttaacggcagtgccgtcgtcgtgcctccgcgccgcggttcagtaacggcctttcaagaacaggatgggctttacacgctttatcttgaaggtttccgggaaggacgggaggttcgcgattctgctgtcattacatcaatcagcagagtcgtcagcagctatgagcattatgatgaatttatggagctggccgatctgccggatttgcggtttgtattttcaaatacgacagaggccggcatcatttatatcgaggaagaccgtctgtccgaccgtccgcagaaaagctatccagggaagctgactgcacttttatacagacgatacatgacttttcaaggaagcagggaaaaaggtctggtgatcctcccgtgtgagctgcttgaggataacgggaaaatactgaaagacattgtgctgcgctatacaaacgcgtgggcgcttgaacaagggttcatcgattggcttgaagaggcaaacgtgttctgcaatacgcttgtggacaggatcgtaccgggattcccgaaagaaaatgcacaccggcttgaagaggcggccggctatcacgattccttgatggtgaaggcggagccgtatcatttgttcgtgattgaagggccgaaatggcttcgagacgagcttccgcttcatgaggccggtctgaatgtcgagtttgtccaggatgtgacgccgtacaggataagaaaagtgagaattttaaacggcgcccataccgcgatgacgccggtcgcttatttggcaggccttgagacggttcgcgaagcggctgaagacgagcttatcggctcatttgtgaaagagctgatccagcgggaggtgctcgagacgatcgatatgcccgatagcgagcttgacaactacgtggaagagattctcgaccgctttaaaaacccgtttatccgtcacaagctgatcgatatttccttaaattcctttgcaaaattcaaagtcagaaatttgcccgtcttaatggaatatgcggaacgaacaggcaaacttccggctcgaaccgtatttgctttaagcgccttaatttatttttaccgaggccaacgggatggggatgatggggccattccgctgtctgacgacgatgaggtgctggctttcctcaaacggctctggacggaagagacagacgtttcgaacatcgcattccatgttcttgggtttgaaaaagtgtgggggcaaaatctgaacgacatgcccggattgacggacaagacggctgaatatttaagggacatgaaacaaacgggaatgaggaaggcgctggaaaaaatgatgaaaagccaaatggctgagctgggggacatgtaa

SEQ ID NO: 3357 - DNA, 999 bp, Bacillus licheniformis
atgtcagtaacgattaaagatatcgccaggctggcgaatgtatcgcacaccacagtatccagagcgctgaacaacagtccgctgataaaagagaacacgaaaaagaaaatactcgacatcgcagccgaaatgaattataaaccgaattttaatgcgaaaagccttgtcacgcaaaagtcttttacgatcggcctgtttttaacaagcctgacagacgggacgtcttcaagtttctttgcagacatcctgcgcggcgtcaacaaggtgatcgatgaaaactataatatggttgtcaggggaatcgacgattatcatgatttgtcatccattcaccgcaaccgctatgacggcatgattttaatcagccaaagcgaacaggatcaggcttttattgagcatgtcctcaaacagaatattccggtcgtcgtgctgaacagaaaaatcgaagggcactccgttgtcaatatactggcgaatgaacacgagggcgctttcctcgctgcttcatacttgatcaaaaacggccacaaacagatcgccatggtgcaggggaaagaaggctttaaatcgtctcaagaaaggaaaggaggctttcttcgcgcgcttcgcgactcaaaccttgatatgcccggcgaatacctcgttcaaggcgattatacgatgcaaagcggctttcgcgcggctgaaacgctgctaaagctgaagaatcctccgacagccctgttttgcgccaatgatgatatggcgatcggcgcgatgaacgccctctatgcaaacgggaaacgctgtcctgacaatatgtcgattatcggctttgacgatagcggattttcggcgtatacgacaccgtcattgacgacggtaaaaaaaccgactgaaaaaatcagcatgcttggtgcggaaagcctgctgtcattgatcgaaaacccgcaggcagaaggcgggcagacgctcatcagcacggagctgatcattcgcaattcagttaagcatctatag

SEQ ID NO: 3358 - DNA, 1389 bp, Bacillus licheniformis
atggaaatatcgacgaacaaacaaaccgaaacagtcgccgtcactcaagagaaattaagtttaaaagaaaaggtttcttacggttttggagattttgggaacggatttatgtttgaccttggacagctctatcttctgaagttttttacggatgttgccggcattccggcggcggcagccggaggcatttttcttgtgagcaaacttttcgccgcttttgtcgatccgattgtgggaacatcgatcgactacaggaagaatatcggcccgaaaggcaaattcaggccgtatctgctatacggaagctttgtgcttgcgattttgacgatattgaccttcatctcgccgaatctgtcaccgacgggcaaactcatctacgcttatgcctcatacatgctttggggtctcggctattcctttgtcaacatcccttacggctcgctcggggctgccatgacgcaaaactcggtggaacggacttcgcttgcttcctttcgccaagccggctcgctgggcgccctgtttgtgacgagcattgttgtcatcccgatgattgtcaggtttgacaaccctgcggttgcctatccggtcgtcatggggctgatgtcttttctgggtgtgttgtttttctacatttgctacaggaactgtcaggaacggatcgtcgtaaaagatgagaagtacaaacaggaaaaagtgacattcaaagcgatttcaaagacgttttttacgaacaagccgctccttacgctaatattcatgacaatttttacgatttcagcctataaccttaaatccgcgatgctgatttatttcgcgcagtataacctcgggaacgccgaactgatggcctacatgaatttcatcatcatcggctcatcctttatcggcgtcatcatgctgccgaagctcgtgaagctttttgggaaaaagcataccgccattttggggctcgcggtttctgtctgtgccgatctgatcaattttttcgcaccgggcaatgtctttgtttttacgattctcgcaagcatcgccttcatcggcatcagcattccgaacggaatcacctgggcattcgtatcagatgcgatcgattacggcgagtggagaacaggggaacggaaagaaggaacggtatactcgctgtttaatttttcgagaaagctggctcagtcgctctccggcttcctgtcagggatcggtctcagcatcatcggctatgtgccgaatgcggcccaaaaagcggggacgctgctcggcattaaagcgattctccttttgtatccggcagcagcgctgacggcggccattctcgttctcggctacctgtaccgtttgacggatcagaagcacgccgaaatggtcgcggaaatcaaagcgagaacatag

SEQ ID NO: 3359 - DNA, 1422 bp, Bacillus licheniformis
gtgaagccgtttttgaatgacgattttcttttaacgaatgaaacgtcgaaagtgttgtaccatcagtatgcaaaaggaatgccgatcatcgactaccactgccacttgagcccgaaggagatttacgaaaacaaaacgtttaaaaacctgaccgaagtatggctctacggtgatcactacaagtggagagcaatgagggccaatggaatatccgaagagtttattacaggagatgcgtcagacgaggagaaattcagcgcctgggcaagaacggttccgatgacgattggaaacccgctctatcattggacccatttggagctgaggaggtttttcggcatcgatgaccggcttgatgaaaagagcgcgccgcatatttgggagcgggttaacgaacagctggccggaggagggttcggcgccagagacttgattgaaaaatcaaacgttgaaacggttgtcacgacagatgaccccacagacagtcttgaatatcatgtaaagctgaaagatgaagactttaatgtaagcgttttacctggatttaggccagacaaggcgatggaaatcaatcaagagggttttgccgcctgggtgagaaagcttgaaacagctagcggtatgaagatagcgaattatgacgattttttgaaagcgcttaaaaacagaattgactttttccatgaagcaggcggacggatatcggatcatgccatcaatcaaatgatgtacacggaaacagatgagagcgaagtgcgcccgatttttgcaaaggtgatgaacggggaaagcgcctcgcctgaggaagagtgcaaattcaaatccttgaccttgcactttttgggaacatgctatgcggagaagggctgggcgatgcagctccacattaacgccctccgcaacaacagcagcaaaatgtaccggaagctcgggcctgatacgggatatgatgcgattaatgatcaggatatcgcaaagcctttgtgcagctttctcgattctcttgatcgaaaagatgcgctgccaaaaacgatcttgtattctttaaacccgcgggacaatgtcgtgatttcaagcctttgcggaagcttccaggacggccggataccggggaaaatccagcacggtaccgcctggtggttcaacgatacgaaagacggcatgctcgaacaaatgaaatcgcttgccaacatcggtctattgagccgttttatcggtatgctgactgattcgcgcagctttctttcctacacaagacacgaatatttcaggcgcctgctctgcgatgttatcggcacatgggttgagaacggcgaagcgccggatgatatcgaactgctgggccggatcgtaaaagggatctgctacgaaaatgcaaaacactatttccagtttgaagtgaaagatcgtttgaaagcttag

SEQ ID NO: 3360 - DNA, 1758 bp, Bacillus licheniformis
atgaagctcagaggaaagctcgttctccactttgtcagtcagatttttttgattctcggtcttgttctcgcgaccttgctgttatccttcatttttttcgctctccgattaagcgagagcgaagcggatacaggcttggcaaaagccacttcagacacgtttgaaagctgggtcagcgtggatgacaataacaattggcagatcgaagatatcttgaaatcggctatcgacaaacagggaggctggcttcaaatattagacggcaaggagaaaaccgtttattcctaccgtcttcctgcggaaattcagaggcagtaccacagggaagacctggtatccgtttttgataaaaaaagaattaaaaaatatcaagtcaacttctggtctgccaatttcaatggtgaagactacgtgattttattcggatgggagtcgaaaagcgatacgatcctgtcctatttggaaaaagaagagaaggatatggcagacctttcttcctataaaaaaagcacgcttgatttcattaagaaaaacaaagggtccgtctatttgttcagcgaaaaagggaaaatgctggactcgatctaccaggacatagattacagccagggaatcaatgagctggagcttttaaaatacggatcaaagccatggaactacgagcacgagttttcatacaggcgattaagcgcgacagaatggctgatcgccgctacgccgaacccgatttttaatccggatcatgagttcaacaggacgatgatcgggctcgctttaaaaatcgttctcatcgtgatcggcgttctgatcttattgatgtcttctatgaccatttggtattctttcagattcggcatgccgatcatccatacgattaaatggatcgtcaacctttcaaaagggcgatttgaagaaccgagaaaccggaaaggccgcccgcgaagccggaacaaaaaagggaagcgaaaacagccgtaccggctgttcacagaagtgtttgaatcgatggagcagctgacggaaacgctgaaaaaagacgagcaaaaccgcaagaaaatccaaacgacccgggaggaatggatcgcagggctctcccatgacttaaaaacgccgctcagcacgatttacggctacagcatgatgctggagtctccaaactatgagtggtcaaaagaggaaatccgcgaaatcggccaggcgatgaaagaaaagtcggactacatgtcacagctaatcgaagacttgaacttgacgtacaggctgaaaaacgacgctttgccgattaaacgccagacagtgaggctcgtgccgtttttaaagagcttcgttgaggagtttaagcgccattcattttcagaagggtacaacgtgtcttttgaatacaagcaagtagataccgagtttgcgatagacaggggctggttccgaagagtcttggaaaacctcctcgccaacgccgtcaagcataacaaaaaaggcactgacatcaaggtgatccttgaagaatccaagcaatatattattcttaaaattcaagacaacggaagaggcatggactctgaaaccgtctcaaatttattcaaccgctactacaggggaacgcatacaaaagatgcgacagaaggaagcggtctcggccttgctatttctttggaacttgtccacctgcacgacggctgcatcgcagttgacagccggacaggccgagggacggaaattacgatggaatttaagaaaaaccctaaagccgccaaataa

SEQ ID NO: 3361 - DNA, 729 bp, Bacillus licheniformis
ttggaaaatgcgacaattttgattgtggacgacgaagacgccattgttcaaatggtcaagcgcgtcctcacgaaggaaggattttcagaagttctgaccgcaagcagcgcagaagaagcgctcgacatcgtgaaaaaggacaccgtgcacttaatacttctcgatgtcatgatgccgggacagacaggatttgatgtatctcctgaaatcaggcggcacaccaacgctccgatcttcttcttgacggcgaaaacatccgatctcgataaactgtcgggttttgcctacggggctgatgattatattacaaaaccttttaatcctctggaattaatcgccaggattaaagcccatttaaaaagaacgtatatacataaagaagttgcagctgcttcagtatcttcagcctacgaatatgaacgctttatatttcatcccgactttgcggagctgatcgtggacggcgaaacggtcagctgctcggcgcagctgctccagctcctgcaatatttttgcgatcatccgaacagggtgctttccaaggatcaaatttatgaaaaagtgtggggcgttccatcttatggagacagcaacaccgtcatggtacatatcagaaagctgagggagaaaatcgaaaaagacccgagcagccccgaatatattgtcacgattcgcggccttggatataagttcgttcccaatcctgcacgaaaagagagcgaaggatga

SEQ ID NO: 3362 - DNA, 813 bp, Bacillus licheniformis
gtgtctctttcaacaaacaacctggggatcggctacggcgaacagatgattgtcgaaaacttaaacctccacataccaaaaggaaaagtgacgaccatgatcggtccgaacgggtgcggcaaatcaaccatattaaaaacgatggcgcgcatacagcgttcgcgaacgggcgccgtttatttaaacggcaaagcgatccaccaaatgtcgacgaaggatgtagccaaacagatggcgattcttccgcagacgcctgaggcgccaggcggtttgaccgtatatgagctcgtttcttacggccgttttcctcatcaaaagggaatgggcaggctttcggccgatgaccgccgcatggttgaatggtctctccaagtgacaggaatgttgcctttttatgaccggccgatcgaagccctttctggaggacagcgccagcgcgtctggattgcgatggcccttgcccaagaaacggagctcttgctccttgacgaaccgacaacctatttggacttggcgcaccagcttgaaattctgcaactgctggaaaagctcaatcaagaagaaggccgaacgattttgatggtcattcacgacctcaaccatgccgcccgcttcgctcatcatatggtggcgctgaaccggggtgcgattgtcaaagagggcgcccctcatgaagtcatgacatcagaagtattaaaaaaggtgtttcagattgatgctgaaattatattagacccgcgcacaggaaaaccggtgtgcctgacttacgatctattgaaaaaagaagaggatcagaggctggcaaccggatga

SEQ ID NO: 3363 - DNA, 1014 bp, Bacillus licheniformis
atgctcaagaaaaacaacagacgggcgggtgcggtgatgctcgtcatggccgtgctgacggccgccgtgtttttattaagcatgaacatgggagaaatccgcatcgacccgcttgctacattgagaacactgttcggctttggaacgccgcaggatgaacttgtattatttgaattccgtctgccgcgcatgatcctcgccatgctgatcggtgcaggggttgctgtctccggagccgtctggcaggggatatcccggaatgacctggccgatccggggatattgggcatcaatacgggagcgggttttgccgttgtgctgttcatcttctattttcagggagacgttggcaacctgcaaaaaggattcgttttttccctgccgatattcgcatttttgggagcctgctttgcagtcgtttccatctatttgctggcgtggaaaaaaggcttgaatcccattcgcctcgttttggtcggcatcggagtgaatgcggcgttttcggcggccatcttaatgctgcagcttaaaatggacccaaatgactttatgcaggcggctgtttggctgtcagggaatatatggagttcgaactggagctttgtctcggccgtgctgccctggattgtcgtgctgattccttttatcctctataaagcgcgctatttaaacgtgctgaatctcggtgatcagctcgcaacagggctcggaacggcagttgaaaaagagcggcgcacactgcttctgtcggcagccgcgctgagcggcgcgtgtgtagcggctggaggaaacattacgtttctcggtctcgtggctccgcatattgccagaagacttgtcgggccgaagcatcagcttttaatcccggcttccgcgttgaccggagcattgctctttttgctggcggacttaattggaagaatgatactggcgccttcggaaattcccgtagggcttgtcattgccgctttaggcgcaccgtattttatctatttgcttatgaaaacaaattaa

SEQ ID NO: 3364 - DNA, 1065 bp, Bacillus licheniformis
gtgagctcttacaaaaacatacatcatatcaacggcgcggatggcactgatgaagaacagagaccgatcagccgtccgctcggagctgtatttgtcctggccggcggaatcatgctgctgctttttggcgccgcattatcgattgcgctcggtgcggctgatataaagcttggaacggtttgggacgccatttttcattttgacgcgaaaaatacggcccatcaaattattcaggaactcagactgccaaggacggtaagtgcggctcttgtgggcgcctgcctggcggtttccggagccgtgatgcaggggatgacgcgaaatcctcttgcgtcgccggaaattatgagcgtcacgcacgggtcagctttcgcaattgctgttgcgtttgctttttttccaggaacctcatcgatcgggctgatgatctggtcatttgccggtgccgctcttggagcggggcttgtttttggaatcggaatgttttcaaaaggcggtcttacgcctgtaaagctggctttggccggtacggctgtcggcacgttcctgagcgctctttctacgagcatcgcgatccactttgatgtggcgcgcgacgtcagtttttggtatgccggaggtgtcgccggcacgaaatggctcagcattcagttgttgattccggcggcagcgctcggtttggcggtcgtttttgtcatcgcccgttccatcacggttctaagcctgggtgaggagctggcgaaagggctcggtcaatatacgaagacggtaaaagcgatcggcatcgtgtccgttgttctgctgacgggtgccactgtatccgttgccggtgcgatcggttttatcggattgatcattccgcatattacccgctttctggtcggggttgattaccgctggatcattccatgctcagctgtgcttggcgctgttcttctgatctatgcggatattgcggcaaggctggtcaacccgccgtttgaaacacctgtcggagcagtaactgcgcttgtcggcgtaccattctttctctatctggcccgcagggaaaggagtggactgtaa

SEQ ID NO: 3365 - DNA, 1404 bp, Bacillus licheniformis
atggaacagacaaaaaaatggggcttctggcttcttacggcttttgttgtcggcaatatggtcggctcagggatttttatgctccccagcacactcgcccagacggctagcccgctcggcgtaacggcggcatggctggtgacgggtgcgggggtgctgatgatcgcccttgtattcggccatttatccattcgccgcccggatctcaaagcaggtccgcaaagctatgcaagagctttattctcagaccctaaaaaagggaatgcggcaggttttacaatggtatgggggtattgggtggctagctggatcagcaacgtggccatcattacaagccttgcaggctatttgacgactttcttgccgatcttaaccgacggacgcgagctggttgaattcggcggacaccccgttacacttggccagctcttgacattcatcgtgtgtacgattttgttatgggggacgcattttatcctagtctccagcataaatggagcgggcaagctgaactttttggcgactttttccaaagtgcttgggtttgtcctgtttattgttgcaggtttgttcgtttttcaaacggcattattcgaatcattttattttccaatcgaatcagaaggcaaaagcatagggctgggcggacaggttcacaatgcggcgatttcaacgctgtgggcgtttgtcggcatcgagtctgcggtaatcttatcagggcgcgcatcatcccagcgtgatgtcaaacgcgcgaccattaccggcctgttaattgcgctcggcatttatatgatcatcactttaattacgatgggcgtcatcccgcacgatcagctccaggcatcagataaaccgttcgttgatgtgctgcacgtgattatcggcagcttcggcagcgtgattatggcggtcttggcaatcgtttctttgttcggatcgatgctcggctggattttaatcggcgcagaggttccgtatcaggcggcaaaagccggtgattttcctgctttctttgcgaaaacgaataaaaagggaagtccggtcaattcattgatcgtcacaaacgtgatgtcgcagatctttattttctcaacgatttcgggaacgatcagcgaagcctttacgtttttaacaacgtcggcgacgctcgcttaccttgtcccttatctcatagcggctcttttcagcttgaagctcatcctcaaaggggagacatacggcgagctgaaaggttcaagaacaggagacggcatcattgccttggccgctcttgcgtactctttatgggtcatcgtttcaggcacgtctgacttgaccacctttatcttgggaatcgggctgtttttcgtcggtcttgcgatctacccgttcgtctacaaaaagttcaaaaataatcaagtgtga

SEQ ID NO: 3366 - DNA, 471 bp, Bacillus licheniformis
atgacaggaaaaacacacatcatgggaggggtcgcttcttgtacggctgctgcttatttttacggatatgatccggtgttcatgacagcctcgggcgttatcggagcattgattccggatatatgccatacaaaaagcaagataggcagaaggcttccgattttatcagcagtggtcagttctgtcttcgggcacaggacgtttacacacagcctgctctttttgctcatcacggcattcgcggcacatttatattttgcagatcagagcatacttgtcggattgatggccggaatggcaagccatctgctcctcgatgccgggactgtaaacggcatcaaacttttctttccgtccgccattaaggttcgtctgcccctttacattaaaaccggcgggaaggcggaacaagtcgttcttgctgtgctcaccgttgtttcgtgctattttattgcgaacttgatcgcctga

SEQ ID NO: 3367 - DNA, 1860 bp, Bacillus licheniformis
atgaaagaacaattttttaaaaagcagtggtttttatgcctatccatatttttcatatggatgaagacgtacttcatctacaagctgggctttaatttacaaatcgacaacgcacttcaggaactgatcctgtttatcaacccgcttagctttctcatccctgtactcggcatcagcctcttttttcgcgaaaaatcgcagcgcatctatttaatcggggctaatgtcgtcctgacgggcatcttgattgcaaacagcattttttatggtttctacatcgatttcatcaccattcccgtcctgttccaggcaaaaaacctcggggggcttggaagcagttttcaggagctgtttaatccggttttcatcgcgcttttcctggacctggctctcatggtctggctggcaaaaacgcgcgaaagaaccggcaaaaagctttccgctaaagccgttaagatctactatgcggcagccgccggaacggtgctgtttaatctcgccctgtcggagctggatcagccgaagtttttaagctactcttacgacagggaagtgcttgtaaaaaatatcggcttgtatcagtttcatctgttggacggcatttcacagacctttaatttgacacaaaaagcggtcgctgatgaaaacagcctggcaacgatcgaaaactacacaaatgccgactacagcaaaccgaaccaagatatgttcggaattgccaaaggacgaaacgtcatctttgtaacgcttgaatccacccagacatttgtcatcaatgaaaaggtgaacggccaggaaatcacgccgttcatgaacaagttcattcaaaaaagctattatttcgaccatttttatcagcagaccgaacaggggaaaacgtccgattcggaattcattgtcgctaattcgctctatccgtctctgagcggttcggtgttttttacgaagagcgagaatgcgtacaattcgatgtataaaacactggcgaaccacaattacagaacatcggttttccacgccaaccataaaaaattctggaacagggacgtcatgtacaaagccctcggcatcgacagcttttatgacgtctcccattttcatgtgacacctgaaaattcaacgggctgggggctgaaggataaggagtttttaacgcaatcggccgacttgatgaaagacttgccgcagcccttttacagcaacctgatcacattgacgaatcattttccatttcaaattgatgacgaggataagctgatcgatgagtacgattcagagagtgacattttaaaccggtatgtcacgactgtacgctatgaagacgaagcattgaagcatttcatcgcaaaactgaagaaaaacggcctttacgacaattctgtgatcgtgttcatgggagatcactacggcatatcagaagcgcacaacgatgcgctggctcaatttttgggcaaagacgaaatcaccccctacgataccgttcagctgcagcgggtgccgctgattatccacattccgggggtaacggatcaagacccgaaaacgatatccgaaacaggcggccaaattgatgtcaaaccgacattgctccatttgctcggaattgatacaaaaggcatgattcaattcggcaatgacctgttttcgaaagaaagaatgcctttcgctgtgttgagaaacggcagctttattacagatgattatatctacacgaaaaatacgtgctacagcaaaaaaaccggggacatgatcaacgatggagaggacaaatgcggccctctcatcgagaaggcgaatgaagaactttccctttccgataagattattaacggtgatttgctgagattttacaaaaaataa

SEQ ID NO: 3368 - DNA, 1452 bp, Bacillus licheniformis
atgagtgaaacacagcacaagacaaatcaattgccgattgttgccgtcttgattatggggacatttatcgccattttgaatcagacgcttttgacgacggctctgcctccgattatgagggacttaaacattacgccggggcttgcccaatggctgacgaccgtttttatgctcgtgaatgggatcatgattccagttacggcttttttaattgaaaaattcacaacgagaaagctgttcatggcggcaatgtctttatttacggccggcacgctgatctgcgccttgtcattcagctttccggcgctgattgcggggcgcgtcgtgcaggcggctggcgccggcattatgatgccattgatgcagacggtgcttttattgattttcccaaaggaaaaacgcggatcagcaatgggaatggtcgggcttgtgattgcctttgctcccgctgtcggaccgaccctgtcaggctggatcgtcgatcgctatccttgggaagtattgttttacctgctgcttccgttcgccgtgatcgacatgattgccgcgcactttattttaaaaaatgtcaccgaacagacatcgcctaagatggatgttacttcaatcatactgtcttcgcttggcttcggcggcattttgtacggcttcagcagcgccggtgttgccggctggacgggtgcggacgtgctggccggcttcgcggtcggcagcgttgcgctgttttggttcatttggaggcagctccatttggaagagccgattttggagttcagggtatttaaatatccgatgtttaccttggcgacgattatcgggatggttgtctttatgtcgatgatcggagctgcgacgatcgtgccgatgtatatgcaggatatgcgccatttcacggcgatggagtcgggaatgatgctgtttccgggagctgttgtgatggggctgatgtctccgattaccggaagaatttttgacaaaatcggcgcgcggattttgagcatcaccggtttgacggcgatcttcgtgaccacattgctcttgacccatctgacaaagacgacgccttttgcatatttgtctatcgtctatgcgattcggatggtcggcatggggatggtgctcatgcctgttacgacagccggcttgaaccagctcccgcgccatttgattcctcacggaacggccatgaacaatacaatgagacagatgtcaggatcgatcgggacggctgttctcatcaccatcatgacacagcgtgcgcttcttgaccctgccggtccgtcttcggatacagcgatgattcacggcgtcaatctggcatttatgaccgctgctgcattgtcgggaatcggattggttctctcattctttattaagcagcaccgccgcggacggctcgacggcagcaaaagaaaacaagcgaaaggccgcttggccattcatgagaaatga

SEQ ID NO: 3369 - DNA, 840 bp, Bacillus licheniformis
atggtaagcagtttaaaggacactgtgacattacataacggtgtgaaaatgccatggtttggacttggagttttcaaagtggaagaaggcagccaagtcgttgaatctgtaaaagcagccattaaaaacggataccggagcattgacacagccgctatctatcaaaatgaagaaggcgtcggcaaagggattaaggaatcaggcgttccccgcgaagagcttttcatcacgtcaaaggtttggaacagtgaccagggatatgaaaaaacattggcggcttttgatgaaagccttcgaaaactcggccttgactaccttgatttatatttgattcattggccaggaaaagacaaatataaagatacgtggcgcgcacttgaaaagctgtacaaagacggcagagtgaaagcgatcggagtcagcaatttcaatgtccaccatttggaaagcttattggaagatgcggaaattaaaccgatggtcaatcaggttgaattccatccgcgcctcactcagactgagcttagggactactgcaagaagcaaggcattcaggtggaagcatggtctccgctcatgcagggaaaactcctcgatgatcaggtgctgactgacatcgctaaaaaatacaacaaatccgttgctcaagtcatcctgcgctgggatttgcaaaatgaagtcgtcaccattccgaagtccatcaaagaacaccgcattattgaaaatgccgacatttttgattttgaattatcggcggaagatgtcgaaaaaatcaacgctcttaataaagatgagcgcgtcggtccggatccggacacaatggttaacggattcgaataa

SEQ ID NO: 3370 - DNA, 861 bp, Bacillus licheniformis
atgaaacattacggtgcaatagaagcaggaggcacaaagtttgtttgtgcagtcggaacagaaaagggagaaatcatagacaggctgacgatcccgacggagacgcctgaagagaccattggaaagctgaccgatttcttcagcaagtatcagctcacatcaatgggagtgggctcttttggacctatatccgttgcaaaaaataaagaggattacggatacataaccaataccccgaaattagcctggaaggggtacccgtttattcccgaattggaaaaaaggcttggcattccggtttcgtttacgactgatgtaaacgctgccgcgcttggagagctgacgaaaggagaggcgcaaggcctggagagctgcttgtatatcacagtcggcacaggaatcggagcaggagcgattgtcggcggccggctcgtacagagcacgctccatcctgaaatgggtcacctactcattagacggcatccgcaggatacgtttgaaggaatctgtccgtatcacaaggactgccttgaagggatggcatcgggcccggcgcttgaaaagcgatgggggaaaaagggcaaggatttggctgaaaacgaggaagtttgggagcttgaagccgactatttagcacaggccctcatgcaatatatcttgattctgtgccctgaaaaaatcatcatgggcggcggtgtcatgaagcagcagcagctgttcccgctgattcgcaaaaagctggccgaatatttgaacggatatgtcgacctgcctgatcttgaagaatacatcgtgccgccgggccttggcgacgatcagggaatcaccggagcgcttgctttggctcattccatcggttga

SEQ ID NO: 3371 - DNA, 1125 bp, Bacillus licheniformis
atgaagcatccattcgacaatttccgttctttattcccgaaattgtctgatcatgttcatcttgccgcatgttccggaagcgcattggctctgcctgttgccaaagcggtcgatgagtatcagaacggccttttaacagccggtgcagactggaaagcacatctcgacaagatggatgagaccaaggaaaaattcgcccggctgatcggtgctgaaaaagaagagatagccgttttgccgtcagtatctgacgcagtggccgctgtggccgccgcaatgccgcagccaccccgtcgaaggcagatcgccttcacggatatcgattttcctgctgtcggccaaatttggcttgcgcaagaccgcttcaaagatcacctcatcatcattcaaagcgaagatgggatgattgacttggaacaatacgaaaaagacgttaccgatcagacgctcttgacgtgtgtgccccatgccggctatcggaacgggtttaagcaagacataaagcagattgccgagattgttcatcagaaagggtcgcttttattcgtcgacgcctatcagactgccggccacattccgattcatgtcaaagacatggatatcgacatccttgcggcggggacgcgcaaatacatgctcggcattcccggaacagcttttttatatatgaaacgcgaactttgcgaacaatttgagccaaaaacggccggctggttcggaaggagcgcgccatttgccttagattcaggctttgcggaaggtgcgaaacgcttcgagtcggggacaccgtcatttatcagcatatatgcggcagacgcggcattgaagctgctgcttgaagcggagcccgacaggatcgagccctatctgcggcagcttgcggcattctctttgcaatacggtgcggaaaaaggcctgaagatcacaggacccaacaccgtacataacagaacaagcctgatctcggtgtatgccgaagaagccgcccgtgttgaatccctcttgcgtgaaaagcatatcatcgtctcaaagcgaaacaacgtcataagaatagccccgcatttttacaatacaaaggaggaaatcggatttgtgatggatgagatcgcggcaatcgtaggctaa

SEQ ID NO: 3372 - DNA, 411 bp, Bacillus licheniformis
atggagctttatatcgaaggtgaattagaagagcataggaagctgccgcaccgaaaagttttgtttgccattttggctgttttgctagggtccgggattaccatcggatatatcgtgtatacgcatttttattcgatgaatcatctgccgaaaggaaattggtttcagtcttccggttcgccgaatcaagcatacaacctgaatttgtatagagtgaacaaaggcgggggaacgaactccccttccgtcagaggggaattgacaacggttgccaccggtgaacgaaagaatatctattggggatacgaagaagaacatgccaaaatcgaatggcaggacaaataccatgtgtccatcaacaacaatgtgctggacgtcagaactgatatatatgatggaagaagagagtga

SEQ ID NO: 3373 - DNA, 2331 bp, Bacillus licheniformis
gtgcaggaaaacggtcaggaatggctggaagaggaaaaacgaatccggcttgttttaaaggaattggatcaaaagcttcattctctaaagggaaaaaccggcggattgaaggaggatatcatcgatttacggaaacatttttggagcgatgtcaccgtaaacatagccgatgaaaatgaagcggttgaaacattttttagcattaaacagcaggctgaggttttggctgagagggaaaggagccataagcagttttacagccagctgaaaaacctgttaaaagtgaaagaatcgccttatttcggccgcgtagattttttggaggacggcgaagaaaacgctgagtccgtctacatcggactcgcctctttaatgtatgaaaaagaagagcggtttttgatctatgattggagagcgccgatttccagtctgttctataactatggacccggcgcggctcaatacgaagttccggacgagacggtcaggggaacgattgagctgaaaaggcaatttctcttcaaaaacggacagctgaaagcgatgtttaatacggatatggcgattggggatgaagtccttcaggaagtgctggggcagcaggccgatatccagatgaaaagcatcgtcgcgacgattcaaaaagaacagaatcagatcattcggaacgaaaagagccgctttttaattgttcggggagcggctggcagcggaaaaacgtcggcggcattgcagcgggccgcatatttgctgtaccgcggccgcgggcagatcgagtcgagccagatgctgctattctctccaaacctgctttttaacagctatgtcgccaatgttctgcctgagctcggagaggaaaacatccagcagacgacgttccaggaatttgtagcgcgccgccttggaaagcaggtaccatgcgagactccgttcgatcagcttgaatattgtttaaccgcttcagacggtgaggagcagcgcatccggatgaaatcgattgaattgaaatccagtctggctttcaaaggcatcatcgatgattacgtcaaatatttggcaaaagggcacctggtgtttaaacatatcacctttcgcggaaaaaggatcatcacaagcggtcagatgcggaaatttttcgcggcccttgatcattcagacacgctgtccaaccggattgaacaaacgggaaaatggctgttgcagctcctgaataaatatgaacgccaggaaagaaaaaaagactgggtcatcgaagaaagcgagctgctggataaagaggaatacttaaaggcttataaacgtcttcaggaggaacagcgctttacggagaatacgtttgacgattatgaaagggagcgaaacctccttgcctccatcgttgccgaaagggagttcaagccgctcaagcaagtggtaaaagcgttcggctttattgattttaaaggaacataccttcagcttttttccggacgctataccccgcaaacgcgccctgatgactggcagagcatttgcacattcactcagaaaagctttcgttttgagaagctgctttatgaagatgccgtcccttttttatatatgaaaaacaagctgaaaggcggggggaaaaacacggcaatccgccatttattcattgatgaagcccaggattacacgccttttcaacttgcttttttggagagcttgtttcccgcgtgcagcatcacgatgctgggagacttaaaccaggcgattcttgcccatgcctatcacgataagacgcttctgtcgggaggcgtgtttgaaggcgaaaaaacggagatcatcaccttgaagcgcagctacaggtcgacgaaagaaattgttgaattgacaaagcgcatcatcgaagggggcgaagagatcgaagcttttaataggaacggcaaaaaaccgactttgacaatatcagccgatcctcatgcacaccataaagagatggcttcccttatgaccgcccttcaaaaagaaggacttgagacgattgcagtcatctgtaaaacagtccgggaatgcagggatgcgttccagcatcttcagcagcatgcagagcttaaactgatcgataaagaaacgagaacgtttcaaaaaggcgtggtcgtcattcccgtctatttggcgaaagggatcgaatttgatgccgtcatcatttatgacgcttctgaaaagcaatacaaaaaggaaagagagcggactttattttatacggcgtgcacgagggcgatgcatgagctgcacctcttttccattggaaaagaaacgcattttttaaacggcgtcccaaatgatatgtacacgagaagagagtga

SEQ ID NO: 3374 - DNA, 609 bp, Bacillus licheniformis
atggcttgggaagtgttgagcatcatcggaaccgtcgcttttgcgatcagcggagcgatcgttgcaatggaagaagagtatgatattttaggagtttatatattggggattgtgacagcgttcggcggaggggcgatcagaaacctgctcatcggagttccagtgtccgccttgtgggagcaggggagtctgtttctaatcgctcttgtctcgatcacgatcgtttttttgtttccgaagctcctgttaaagcactggagcatctggggcagcttttcagacgcgatcggtcttgccgcatttgcgatacaaggagccctttatgccgttcacatgaaccatccggtcagcgcagtgatcgttgcggcggtcttaacaggaagcggcggcggaatgatccgggaccttctggccggaagaaagccgcttgtgctgaaaacggagatttacgccgtttgggccgctttgggcggattcattatcggcatgggctgggcggagaagccgctcacgttgtatatcctgtttgctttgctggtcgcgtgccgtgtatgttcgtacatgttcaactggaagctgccgaaccgttcgctgcggtcccacagctga

SEQ ID NO: 3375 - DNA, 351 bp, Bacillus licheniformis
atgggacaggaggtcatcatcgaaaaagcgaaagccgagtgggcgcacgaatttgaagctgaaaaacaacagctcgcagatgtcctcggaaaaaaagttctcgctatcgaacaaatcggcagtacctctgttcccggccttgcagcaaaaccggtactcgatttgatggccggcgtgagcagtctcagcgaagcttcagttggatcgaaccgcttcaggagctcggctatgagcacgtatttcacgaagccttcccagccaggcgtttttttcgaaagggaaagcggagggcgggcacacgccatctgcacgtatacatttttcaaagcgaagaatggaaaaatcagctga

SEQ ID NO: 3376 - DNA, 486 bp, Bacillus licheniformis
atggagtgtaagattcgcaaaatgaaaaagaaagacatccctcaagtacagcagattgccaaaacaagctggaatcatacgtatgaagggatcattcctttcgatattcaagagaagttcttgcagaaagcgtacaatgacgaaagaatgcagcagcgtttggaacactcgttaatgctcgtttcggaagcggacggaaaaatcgtcggctttgccaactactcctttgtcagagaaggaggggtagcctatctcgcagccgtttatttagctccggaataccagggaaaaggcatcggaaccgcattattggaagaggggatgaaccatttaaagggagtgaaaaagatctttgtagaggttgaaaaagaaaaccgcaccggaaaaaacttttacaaggcgaagggttttgaggatgtcgccgaatatgatgaagatttcgaagggcatatcctcaaaacagtcagaatggccttgcacgtataa

SEQ ID NO: 3377 - DNA, 414 bp, Bacillus licheniformis
atgaaaaataaactgctttttctgtacggcgcctggatcgtctcattaacggcgacgctaggcagcttgtacttcagcgaaatccgcaaatttattccttgcgaactgtgctggtatcagcggattatgatgtatccgctcgtgctgattctcggaattgcgacatttcagggcgatgcccgcgtgaaaaaatacgtgctgccgatggcggtgatcggcgcaggcatttccctgatgcactacatggaacaaaaaattcccggattcaacggcattaaaccgtgtgtcacaggagtgccttgctcagggcagtatatcaattggttcggtttcatcacgattccgtttctcgcccttattgcatttattttgattatcatttttatgtgctttctcaaggggaaagacgagtaa

SEQ ID NO: 3378 - DNA, 696 bp, Bacillus licheniformis
gtgaagaagaaacagcagtcaccgatgaaatttgcagtgattatgacagtcgtggtcgtttttctgatcggcgcacttgtcgtaatcaacaatcaaacccaaaatgcttcgcaaacctttgatgacaagccttcaactgaaggacagccgcttctaggcaacaaagatgcggctgtaacgatcacggaattcggagattacaaatgtcccagctgcaaacagtggactgagaccgtctttccggatttgaaaaaggattacatcgataaagatcaagttaatttttcatatattaacttcgtcaatgaacagcacggcagaggctctgaattgagcgccctcgcttccgagcaggtatggaaggaagatccggattcattctggaagttccatgaggcgttgtacaaggcgcagcctgacaatgacacgatggaaaacgagtgggcgacgccggcaaaattggcggacatcacggaagccaatacgaaaatcaaacgcgataagcttgtcagcagcttaaatgacaaaacgttcgctgagcaattaaaaacggacaattcgctcatcaacaaatacggtgtagactcgacgccgacgatctttgtcaacggcgtaaaaatcgacaaaccgtttgattatgacaaaatcaaagaaacgatcgagaaagagctgaaaggccagtctgatgaaaaataa

SEQ ID NO: 3379 - DNA, 2112 bp, Bacillus licheniformis
atggaaaaggtgaaacaggagtacacgctaaacggccttgactgcagcaattgcgcacaaaaaattgagcatgagatagccggtatgaaggggattgaagcgtgttcggtcaattttgcaacaagcacgctgactgtccaagtcgaccaaaacagcggcgaagacatttctttaataataaagaaaaaagtaaccgagatcgaaccgcacgtcaacgcgacgctgaaggaagggacaaaacaggccccaccagaaagcgacggacggtttaaaaaaacggttgcaaggcttgctgcaggaaccgttctcggtgcggcgggctttctgcttcccggcggcaccgcagccgagtggcttctttttttcctagcttacctcatcatcggcggcgatgtcgtattaagggccgtcaaaaacatctttcgcggccgggtttttgatgagcactttttaatgacgatcgccactctgggggcatttattattcagcagtatcccgagggtgtggcggttatgctgttctatcaaataggcgagctgttccagggagccgcggtcacccgctcccggaagtcgatcagcgatttgatggacatccgtcccgactatgccaatcttcaaaccgaaggcggaacggtcaaagtgtctcccgatgaggtcaaagccggcgatatcatcatcgtcaagccgggagagaaagtgccgcttgacggcaaagtgcgggcaggcaaatcgcttgtcgatacgtccgcattaaccggagaatccgttccgagagaagccgctcccggaacagaggtgctgagcggatttgtcaacaaaaacggcgtgcttgaagtggaagtggacaaagaatacagtgaatcaaccgtttcaaagattcttgacctcgttcagaatgccagcagcagaaaagcgaaaacagagaattttatcaccaaattcgccaagtattacacgcctttcgttgtgataatcgcgcttcttctcgcttttgtcccgccgctgattatttcaggcgccctgctgtcagattgggtgtaccgcgcccttgtctttttggtcatttcttgtccgtgcgcgctcgtcgtttccattccgctcggctttttcggcggcatcggagcggcgtcaaaagcaggtatactcgtgaaaggcggcaattatttagaagcgctgaatgatgtcaaatacgccgtttttgacaaaacaggcactttaacaaaaggggaatttgccgttgtcaagctgtcgcctgcaagccatgtcaaagaagatgaactgcttgaatatgcggcgcttgccgaacatttctccggccatccgatcgccgagtcgatccgtgaagcatacgggaaggaagtacaagcggaccgcatcaaagattacagcgagacggccggcttcggcgtcagagcggttgtagacggagccgtcattttagccgggaatgccaagcttatgaagaaagccggcatacagtatcaaaaggaaagtgaaatcggaactgttgtttatgtagccgccggcgatacgtttatcggctcgattgtcatcgctgacgaaatcaaagaggatgccaagcgtgcgatctccgctttgaaaaaagcgggtattaaaaaaacggtgatgctgacgggcgacgcgaaagacaccggtgaggcggtcggcgaacagctgtccattgatgaagtgcatgcggagctacttccgcagcacaaggtggaccgtattgaaacattagataagcaaaaacttccaaaagaaaagctgctttttgcaggagacggcatcaacgatacgccggtcttggcgagagcggatatcggggttgccatgggaggcctcggttctgatgcggcagtcgaagcggctgatattgtgatcatgacggatcagccttcaaaaattgcggaagccatcagcattgccaagcggacgaggacgattgtctggcagaatattatttttgcactcggcgttaaaggagtttttctcatcctgggtgcttttggcatcgcgacgatgtgggaagccgtcttttcagacgtcggtgttacccttctggctgttttaaatgcgatgagggtattaaaagtgaaagaaatgtaa

SEQ ID NO: 3380 - DNA, 1215 bp, Bacillus licheniformis
ttgaaaaaatcgtgtctgatgatcgtctgcctcgcctttcttcttgctttttccgcaggctgcaaaagcagcaccggcacaaagcatacggaagaaataaaagtctgggattactttaccggcaagcagcaggatctttatcatgagcttgtcgaacagtacaatcggtcccaggaccggtacaaggtcgtaacggagtacattccttttaatgaagtgaaaaagcagctgtctgtcggtacagccggcaatgccatgcctgacgccgtattccttgacaatgtcgacaatgcttcattcgccgctatgggcgtgctcgaagatttgacggagaaaatcgaacaatgggggcaggctgaccagttttatgaggggcctctatcatcagccggatatgaagagaagtactacggcatccctttcgcaagcaatgcgcttgccttgttttacaacaaagacctcttgaagaatgcagggatctccaaaccgcctgaaacgtggagcgatctgaaaaaagcggcggaaaaaacgagcaaaggccaaacgaaaagatttgccctgtcagccgtaaaatcagaggaaagcgcttttcaattttatccgtttcttttgtcttccggagcagatctaaaacagctgaattcaaaagaagcagcctcttctcttcagtttttaacagatctgatcaagaaaggcgcaatgagcaaggaagtgttaaacgccacccaggatgatctggccagacagtttgcagcaggtcagctcgccatgatgatcaacggctcctggaatattgaacggctggaagaagccgaagacttaaattacgggattacctatatcccgaaagatcaaacattcgcttctgccctcggcggcgaaaatattgccgtcgttaaaggaaaaaacaccgccggcgcctgggattttatcagttggctgatcgatccggagcggctcgaaacgctgacagcagaaacaggcgtgtttccgccgcgcaaagatttgctcgaatcatcgagccattggaaaacagatgataatttaaaagccttcattccaatcatagagatcgcatcagcccgcggcccttcgaaagactggccgaagatttcggaagctttgcagactgccctgcaggaagcattgagcgaaagcaaaacgccgaaagaagcgctggatgaggccgcgcaaaaaatcagcgccttaaactag

SEQ ID NO: 3381 - DNA, 894 bp, Bacillus licheniformis
atgatcagagccattgtccgtaaatgggaagggtacttttatttgtttccggcagttctttttatgcttgctcttatcggttatcctctcatctacaacatgattctcagctttcaaaacgtatcgcttgcaaatatagcctcacacgatatcagctttatcggaatcgaaaattatcagcggcttgcccaggataaaatattttgggcatctttaaaaaacacgctgctttacacggccggaagcgttgtatttcagtttgcaatcggctttttgctcgctttgtttttcagcatgaagttcaggcttgccccgtttctcaggggattgatgatggtgagctggctcatcccgctgacggttacggcgcttttattcaagtttatgatggcttcaaacgaaggagtgttcaatcagctgctcctatcatggggaatgatcgacaccccgatcccctggctgtcagacccgaatatggccatctggtccgttatcatcgccaacatctgggtcggcattccttttaatatgctgctcatatccgctggactcagctcccttccggaagacgtctatgaaagcgcaagccttgacggcgccaatgcttttcagaaattcatccatctgacactgcctttattgcggccggtgatcactgtcgtcatgatgctcggcttcatttatacgttcaaagtgttcgatcttgtgtttgtgatgactggaggcggtcccgtggacgcaactgaagtcctgtcaaccgtcagctaccgctactcctttgacgaatttcaattcagcatgggcgcggcaagcgccaatgtcctgtttcttattcttcttttggtcagtctcgtctatttgcggctgatcaaaaaagatgaggtgatgtcgtga

SEQ ID NO: 3382 - DNA, 822 bp, Bacillus licheniformis
gtgaaaacgaaccaaaaggaatggctctttaacattattggcgtcctcgttacagccggctttttattccccgtttactggatgattgctacggctttcaaaagcgatgccgaattgtttaaaacaccgcctttattgtggcccgagacattccgcacggccggctttgaagctgtgttcacttctggcgtcgccggatactttttgaacagcctcctgatttccggggcggctgccgtcatcgttctcatattggccgttccttccgcctacggcttggcgcgctttcggatcaagggcaaaaaaatgttcattttactgtttctcatcacgcaaatgctgcctgccaccgttgttttgactccgctgtttatcgcctttaatcaactgaacatattaaatacgtatatcggaccgattttgacgggggcaacgctcggcgttcctttttctgttttaatgctcagaaccttttttcttgggattcccaaggaccttgaggatgcggccaaaatcgacggctgcagccgttttaccgcgttcatccgcatcattttgcctatcagcgtacccgggattgccgtcagcggagcggtttctttctttttcacatggggagatttgatttacagcatgacattcaaccgaaatcaggagctgtggccgctgacggccggcatttacaatgtgatcagccaatacggaatccagtggaatgatctgatggcatttgccgttttatcggttctgcctgtcatcatcatttttatgctgcttcaaaagcagcttgttaaaggacttatcaatggatctatcaagtaa

SEQ ID NO: 3383 - DNA, 2310 bp, Bacillus licheniformis
atgaaattttcagacggctactggctgacgcgcgaaggatatcacatcaacacgccgaaagaagcctacgaccgaatgattgatcagcaatcattgaccgtgtacgggcctgtcaaagcggttcaaaagcgcggggacacgctcgacacccgcatgctcaccgtcagattttcgagtccccttgaagacatgatccgtgtgcaagtgttccattttcaaggggaaacgcctcggaaacccgactttcaactgcatacggcagatgttgaaccggtcatcaccgaacacgatgatgcgttgaccttccaaagcggcagcctgtgcgtcgaagtgagcaaaaacggttggggctaccaattttcacgtgatggacagagcctgaccgcaagcgaatcgaacagcctcgcctatatcacaagcgatgacgggcgcacctttatgagggaacagctcaacatcggcgtcggcgaattgctctacggccttggcgagcgttttacggcattcgtgaaaaacggccaaaccgtcgacatctggaatcaggacggcggaacaagcacagagcaggcatataaaaatgtgccgttctatttgtcaaacaaagggtacggtgtttttgtcaatcatcccgagctcgtctcgtatgaaatcggttctgaagtcgtatccaaagcgcagttttcggtcgaaggagaatcgctcgactattttgtcatcagcggcgccgaaccaaaggatgttttgaaacgctatgccgcgttaacgggaaaaccggcgcttcccccggcctggtctttcggcctctggttgtcaacatcgttcacaaccgactattccgaggagaccgtgacccgcttcatcgacgggatgaccgaacgcggcatcccgctcagcgtgtttcattttgactgcttctggatgaaagaatttgaatggtgcaatttcgaatgggatgaacgatattttaagcagcctgaagccatgctcagccgcctgaaagaaaagggcctgaaaatatgcgtctggatcaacccttacatcgcgcaaaaatcaaagctttttcaggaaggaaaggaaaacggctacttcttgaaaaacagccggggggatgtatggcagtgggaccggtggcaggccggaatggccatcgtcgacttcacaaatgaaaaagcgcgtgactggtattgttcaaagcttgaaagcctgctcgacatgggggtcgactgctttaagaccgatttcggagaacggattccgagtgacgctgtttactttgacggatcagatcccgaaagaatgcacaattattattcttatttatacaacaagaccgtatttgacttgttgaggcaaaagcgcggcgaacgggaagcggtcgtgtttgcaaggtctgcgacggccggcggccagcaatttcccgtacactggggcggggattgttttgccagctatgattcaatggctgaaagcctgcgcggcggcctgtcgctttctctttcaggcttcggcttctggagccatgatatcggcggatttgaaagcacggcaacagccgatttgtataagcgctggaccgcattcggcctcttgtcgacgcacagccgcctgcacgggagcgagtcataccgcgttccgtggctgtttgacgaagaagcggccgatgtcatgcggtattttgtcaaactgaagcacaggctgatgccttatttgtacgccgctgcacatgaagcgcacgctgaaggcattccgatgatgcgggcgatgctcctcgaatttcccggagacaacacctgccactggcttgacagacagtacatgctcggcggaaggctgctcgtcgctcccgtttttcaggaagacggcgctgtccgttattatttgccaaaaggcacgtggacacaccttttgacgggaaaagagacggaaggcggagaatggaaagaagaacggtacggctatatgaggcttcccctgttcgtcagggaaaacacactgctgccgctggggcaggaatccgggcgacctgattatgattatctcgacgatgtgacgttctgcctctatcatttaaaagacggctgtacagccgaacagacgatttacaatgaaaagggcgaagcaatgacactcagagcttcacggcatcaaaatacgattgccgtgaaaacaacgggcgtccaaaagaactggaagctgctcctccgcggtctttctgtcacctctgttattaacggagctgcggaagcgcttcaggagggaacagcggttcagccaaaagaaaaagaacgggatgtcttcatttatttctaa

SEQ ID NO: 3384 - DNA, 2946 bp, Bacillus licheniformis
atgctgaaaacggtccgcatcatcatattgggcgcaatgtgcacgatcctttccgccgccggtttcgatccgccgcagcccgcagccgctaaaagccaggctgatgaatatgagtatccctttcaagatcccagtctccctgtacaaaaaagagtcagcgacttgctttcacggctgacccttgaggaaaaagtgtcactgatgcatcaatatcagcccgccgttccccggctgggcattcccgcttttaaaacgggcacagaagcgcttcacggcgtcgcctggctcggggaagcaaccgttttcccgcaggctttcgggctcgcgcacacatgggaccgctatttaatcaaacaaatcggctcggcggtcggtgatgaagtccgcggcttccaccaccttgatcccgcggcaaacggagtcaacgtctgggcgccggtcgtcgatctgctgcgtgatccaaggtggggaagaaatgaagaaggctattccgaagacccctttttaaccggggaaatagcaaccgcctatgcctccgggttaaggggcgatcatcccttctatttgaaaacagttccaaccttaaagcattttcttgcctataacaacgaaacagaccggggattcagctcctcaagcatcgatcccaggaacatgcacgagtattatttgaagcccttcgaaacagcaatttccaaaaaagccgcgtatggactgatgccggcctacaattctgtcaacgataaaccggccattttgagcccgctgctcgacagtacagtcaaacgtagatgggccggagacgatttcttcatcgtcagcgatgcctttgatccttccggaatcgtcaatgaccacaagtattatgacagccacgaaaaagcccatgcccacgccgtaaaagccggcattgacaactttacggatcagggggaaaatcccgagctgacgagaaacgccttaaccggtgccttaaagcaaggccttatttctgaaaaagacctcgatcaagccttggccaatacgttcagcatccgttttcgcacgggcgaatttgatccggacgaactcaatccgtacagccgcctgacagatgacgtcatcaacagtccaaagcatcagctgctggcgaaaaaagcggctgaaaaagccattgttttactgaaaaacgaccaggatctgcttcctttcaatgcccggaagaatgaaagcattgcagtcatcggcccgttcggaaatgcgctttacgaagattggtacagcggaacgatgccgtatcggaaaaccccgcttgacgaaatcgcggacaaaatcggcaaagaccgcgtctcctttgctgaaggtctggaacaaagcggcttcaaatccgcgctgaccggaaagtttgtaactgcaggccgggacggcaaacaaccgctcacagcagcggctgataagcttgagaaaagcgcggcattcgatgcggcggattggggagaaagcatcttcaccctccgcgcccaagcgaacggcctctatgtctcgcttcaggatgacggccggctgatcgctgatcagaaacagccgaacggccggaccgttaaagaaacatttcagttcgaacagcagtctgacgggacatttgccatcaaaaatacggcaaacggcaaatatctcaccgccggtaaagacggcacattaacagccgccgccgaaaagccggcaacagcagcggaaaagttttcaaagacgatcatcaagagcggtacggatgaagcggttcagctggcaaaatccgcggacaaagccatcgtgtttgtcggcaacaatccttacatcaacggccgggaaaccgaagaccggaaagatattacactccctccggcccaggaaaatctgctgaaagctgtttctaaagccaataccaatacggtgcttgtcgtaacgagcagctatccgtttgctctcaactgggcaaaagcgcacattcctgcgatcatatattccgctcacggaggccaggaggcgggaagcgcattggcggacattctctatggagatgtaaatccgggcggacggctgacgcaaacttggcacacctcagtcaaagaactgccggatatgatgaattacgatatcatcaaagggaaaagaacctataaatatttcgtaggcaagccgctgtttccgttcggccacgggttatcctatacagcgtttcgctacagcgatttaagcctttcctctgacagcatcaaaaaagacggatctgtcacgattcgcgtcaacgtcaccaatacaggcggaagaaaaggagatgaagtcgttcagctctatacctctcccctgtttaaaacacgggttaaacagccgaacctggacctgaaagattttcagcgggttgaactggcaccgaaagaaacgaaaaccgtgacattcaagctgaaacagacagaccttgccttttgggatgtgacgagagaaacatttgccgttgaaagaggcccttacagaatatccgtcggcagctcggcggcggacatccgcaagacaaagcggatcttcgtccaaggcgaaacaattcgggaacggaacttgcgccgaaagacaaacgctgaagactacgacgactacaaaggcgtgctcatcaccgaagaatccaaatacggcggcgatgcggtaaaaagcagtacaacaaacgcgtggatcgcctaccatgatgtccgcttcaaaggcgaaaaaaggatagaagcaaaggttgcaagcagcggcgccggcgaaatcggcatcttcctcgaccatcctcaaaaaggaaagcaaatcggttcgttaaaagtgcctgacacatccggattgcaaaactggaaaacggtaaaagcttccgtccgaaaatcgacaggcacccaccgcgtcttttttgtcttcaaagggaaagttgcaatcgattcgtttcaatttgaaagataa

SEQ ID NO: 3385 - DNA, 744 bp, Bacillus licheniformis
atgaaacccgcaattaccgtaaaagatttatatgtttcttatcacggcgcagaagcgctccgcaatattaatttctcactcgatcaaggaatgatggcgggcattatcggaccgaacggcgcaggaaaatcaacgctgttaaaatccatgctccaattgattccaaaagataaaggcgacgtccgtctgctgggaaaaccgctcaaagatgtacgcaagcaaatcgcctatgttccgcagcgaaatgatatggattggacgttcccgatcaatgtcctcgacaccgtcatcctcggcacgtatcctgaactcggccttttcagacgtccgaaaaaacgcgataaagactgggcgtatcactgtcttgagaaagtcgggatggctgcatatgccaagcgtcagatcggcgaactgtcaggcggacagcagcagcgcgtttttctcgccagggcgctcgcccaaaaagcagagctgttctgtcttgacgaaccgttcgtcggtattgatgtgacaagtgaagaaatgatcgtcagcatcttaaaagaacttcgtgatgaaggaaagaccgttcttgtcgtccatcacgatttgagcaaagcggacagctacttcaatgaattaattttgctgaacaaagagctgattcaaaaaggccctgtctccgacatcctcaatcccgacgtgatgatgaaagcctacgaatctcagcttccgttcctgcaatcgaaaagaggtgcgatctga

SEQ ID NO: 3386 - DNA, 861 bp, Bacillus licheniformis
atggagtttatccatggtttgatggaatattcgtttctgcaaaaatcgctgttcacctcgattatggtgggcatcatttgcggcgtcatcggctgctttatcattctcaggggaatggcgctgatgggagatgcgatttcacacgcggttcttcccggcgtcgccatctcttatatgctcggcgtcaattttttcttcggcgccgtctttacgggcatcctgacggctctcggaatcggctatgtcagccaaaacagccggattaaaaacgattcggccatcggcatcgtatttacggcctttttcgccgtcggaatcatattgatcacgcttgtcaaaagctcaagcgatctgtaccatatcttattcggaaatgtgctggccgttcgttcatcagacatgtggatcacgctcgtcatcggagtcattattcttaccgctgtctttttattttacaaagagctgctcatcacctctttcgacccgacgatggcggctgtctacggcttgccgaaccggctgatccactactttttaatgacgcttttaacaatggtcacggtcgcatcgcttcagaccgtcggcatcatcctcgtcgtcgcgatgctgatcacgcctgccgcaaccgcttatctattgacggaccggctgtgggtgatgatctatttgtccgctttcctcggcgctttgtcagcggtcatcggccttggattaagctatacgtacaacctctcctcaggagcggcaatcgtgctcgtggctacgattttgttcggactttcctttacgttttcaccgaaacaaggcgtgctttggagagctgtgaaatcaagaagaaaacgggcagcgcttcaacaataa

SEQ ID NO: 3387 - DNA, 930 bp, Bacillus licheniformis
atgaaatggaagcaaacattagcaattgcggcggcattgattctgattctcgccgccggctgctcctcgaaaagcagcagcgaagaaaacggaaagctgaaggtcgtcaccacctactccattctttatgacatcgtcaaacaagtcggaggggatcacatcgatttatacagcattgtacctgtcggaacagacccgcatgaatacgatccgcttcctaaagacgtgcaaaaaacgacggacgccgatgtcgtcttttacaacggattgaatttggagacagggaacggctggtttaacaagctgctggaaacagctgaaaaagacggtgatgacgcccctgtctacaagctgagcaaaggggtcaagccaaagcatctcaccgctaagggaaaagaaacggaagaagatccccatgcatggctcgacattgaaaacgggattcaatatgcaaagaacgcaagagacgcgctgatcaaaaacgatcccgaccataaagaagactacgagaaaaacgcggaagcctatatcggcaagctgcaaaagcttcatgatgaagcggtgaaccgctttaaagatataccgaaagagcgccgcgtccttgtgacaagcgaaggggcttttaaatatttcgcttcggcctacggcgtcgacgcgcagtatatttgggaaatcaacaccgaaaatgaaggaactcccggtcagatgaaaaaaatcgtcgacacagtgaagaaaaaggacgtcccggccttattcgtggagacaagcgttgacccgcggagcatggaaagcctttcagccgaaacgggcgtgccgattaaagcaaaagtcttcaccgattcgatcggaaagcccggtgaagcgggagattcctattataagatgatgaaagaaaaccttgaccggatccatcaaggcctcgccgaataa

SEQ ID NO: 3388 - DNA, 327 bp, Bacillus licheniformis
gtgaaatctggatatgaggaatgcatcaaagcctgccgagaatgtcttgaagcctgcaaccactgctttgacaaatgtctgatggaagaagaggctgggatgatggccgaatgcatccgtcttgaccgggaatgcgcggagatgtgcggttacgcaattcaagccatgacgcgcaacagcccgtatgccgaagatatttgccagctttgcgcaaaggtttgcgaagcttgcggcaatgaatgcagccagcacaagcatgaccactgccaattttgcgctgaaagctgctttgcatgcgcggaagcgtgcagaaaaatggcttcttaa

SEQ ID NO: 3389 - DNA, 780 bp, Bacillus licheniformis
atgaaagacagcgtgtttcaaatgacttctgacacatatcaatctctcagcgattcagaacggcatttgctcgagtacatttatcagcacttagacgtcatcgccactttatcgattgtaaaattaagcgaggatgcaaatgtttcaacagccacgattgtcaggttaatgaaaaaactcggatatgacggctacacttcttttaagtatgcattaaaagaaaaacaccacctcggacacgctccgctgatggatgatatcgacagccaaattaaacaggccgtgctaaagaatgaaagagaagttctggatacgattaagatgcttgatatcgggttgatcgaagatgccattcaaaaaatcagcaatgccgaaaaagtttacatcttcgcaagaggattgtctgaaatgattggaaccgagatgacgatcaagcttcagctgctcggcaaaaactgcgagatgcacagcgacccgaatattatcagaggaaagtcaaaaacactggccaaaaaagacctcggcctttttgtttccttgaacggcgagacagaagagcttgttgaagccgctcaaaatttcaaattgcaagccatttccaccattacattaacgacaaggatcgattcgcgtcttgcgaaattatcagagatcgtactggtcgggtttaaaggggaacaatcattttttcccgattatgaagtccgctctcgcctccctctgcaagtcctctcccgcatcatgctggactcatatgtcatccgcaccgctcatagctga

SEQ ID NO: 3390 - DNA, 915 bp, Bacillus licheniformis
atgatctatacatgcacgatgaacaccgcagtcgacttattcgttgaaaccgacgagctgcttcccgatgttgtcaaccgtactaaagatgaagattatcagccaaacggaaaaggcgtcaatatttcatttatgctcaagcgccttggtcttgacaataccgcgcttggctttacaggcggattcaccgggcgttttattgaaaatgaactgctgaatgaaaaaatcgtcacagactttgtcgaagtggaaggcatctcacggatcaatatttttatcaattcaacccgggaattcaagattgtaaacaaaggaccgctcatatctgaagcccgaaaacaggagctgatcaacaaaatccgtcaaatcccgccgggccgcttcttatttatttcaggcagtcttccgagaggagtccctgatgacatgtacctttcgctttccgagattgccgccgaaaacaaactgaaattgatcttggatatcagttctcccgtcctattagattgtctttcataccatccttacctgattaagccgaatgaacaggagcttgccgcatttttcagccggaagaaagcgctgtccgaagaagaaatcatccattgcggaaaggaacttctcgaccgcggcgctgaaagggttctcatctcccgcggcaaagacggagccctttatttggaccgccaaagaacattaaaagcgaccgccgctaaaggcaaagttgtcaatacagcatgtgccggcgatgccatgcttgccgtattcgtcggaaaacaggagctcggctgttccgttcctgaagcactcaggcacgcctctgccgccggttccttgacggcattctcgaaaggactcggtgatgtgtccaaactcgatcaaacagcttcacaaattcaaatcactcatttataa

SEQ ID NO: 3391 - DNA, 1401 bp, Bacillus licheniformis
atgaaaaagttcaaaatcatcgcggcaaccggctgtccaacagggattgcccatacatttatggctgaagaggccttaaaacaggctgccgccaaactgggtgtggaaatcaaagtcgaaacacacgggcaaatcggcgttcaaaacgaactatcgccagaggacattaaacaagccgacggggtcattgtcgcggcagacaaagatgtaggcgcagagcgttttgcaggcaaacgtgtccttgacgtcccggttgcgcggggcatccgggatgcggaatctttaattcggacgctgatgaacggcgaagcgccgatttaccgcggacaaactgcggcaaaaacagaggatgaaccaaaaacaggcgaatccgcttccatcggccgtaaaatatataaacatttgatgaacggggtttcccacatgctcccatttgtcgtcggcggaggggttttgattgcactttcctttttattcggcatccattcagcggatcctgaacatccaagctacaacgcttttgccgaattgctgaataaaacgggcgcattcggattccagctgatggttccgattttatccgcctatatcgccgattcaatggcaaaacgccccggcctgattgtcggttttatcggcggcatgatcgccagcacgggcggagcgggttttctgggcggcatcgtatccggttttttggcgggactgatcatttacggcctctcgcatgcacttaaaaaaatgcctcagtcacttgaaggactaaaagcaatttttctttatccggttatcggcatttttctgatcggtgcggtcatgtttttcctcgtcgaaccgatgacggccattaatgaggggatgaagggctttttagccgactttcaaggggcgaacccaatcattctcggcttgatcatcggctgtatgagcgcatttgacatgggcggcccggtcaataaagccgcttatgtcaccggtactgctcttctcgctgaagggaaccaatatttcatggcaggcgtctccgccgcgtgcatcacaccgccgctcgttattgcgtttgccacattgcttttccgcaaatatttcagccagcaggaccgaaatgcaggacttgtcaattttattctcggcgccactcatattactgaaggcgctatcccgttcgccgcaaagaaaccaatccctgtcattccgattttgatgatcggctcttcggtttcggcaatattaacatattcattcgcagttcaagtacctgccccgcacggcggattccttgtacttcccgttgtaacaggagcctttcaatgggtgctgtcgattatcatcggatcgcttatcggtgccttcttatacggcttttaccaaaaacggacatatgaaaaagagaaaggctga

SEQ ID NO: 3392 - DNA, 459 bp, Bacillus licheniformis
atgaaaacagcagctttaatcaaaaaagagcacatctatctacaagaaacgctatcttcccaagcggaagcttttgaccggctggctcagatcgcatatgaatcaggagcagccaaaacaaaacaagcggtcattgacggattggcgcaaagagaggctgaaagcacgaccggctttatcgacggcttcgccattccccatgcaaaactgaaggacatcacagaagcaactgtcatcatcattcaaaacaaggcaggaatcgaatggaacgcgcttgatcagacgcctgtcacgttcatcattgcattattgatacccgatgccgaggcaggcagcacacatctcaatctattatcatcggtgtctcgcatgcttgttcacgaagatgcgaggcagcagctgcttgaagcctcgagtcctgacgacattctgagcaccttctcaagctatttatcttaa

SEQ ID NO: 3393 - DNA, 852 bp, Bacillus licheniformis
atgctgacaaatacgaaaaaaatgctgctggacgcacaggcaaacggctatgcggtgccggcctttaacattcataaccttgaaaccgtgcaggccgtgacagaagcggctgaagccttaaggtcccccgtgattcttgcggctactccaggaaccttcagctatgcagggcgcgactatattcaagccattgcagaaacggccgcggcgcgctgctcgatcccggtcgccctccatctagatcatcatgaagaaattgatgatattcgcgagtctttatcattggggacgaaatctgtcatgattgatgcttcgcaccatccatttgccgagaataccgcaattacggcgagtgtcgttcaatatgcccggcaaaaagatgccactgtagaagccgagcttggaaggctcggcggacaggaagacgatttgatcgtggatgaagccgacgcttattataccgatccggatgcagcaaaagagttcgtcgagaaaaccggaatcgattcgctggcggtggcaatcggtacagcccacggtctttactcaaaagagcccaatatcgattttgagaggctggccgcgattcaaaaacgggtttcagtcccgctcgtcctgcacggcgcctcaggaatttcagagcaagatgttagaaagtgcatcaagctaggctgtgcaaaagtaaatatcgcgactgaattaaaaattcctttttcagataaactgcgccgatatttgcatgaacacgccgatgcaagcgatccaagaaaatatatggcccccgccaaagaagccatgaaaaaaatcgtccaagaaaagattttgatgtgcatgagcaatgacagatactaa

SEQ ID NO: 3394 - DNA, 165 bp, Bacillus licheniformis
ttggaggaatccgtcttgaaggataagacagtgctcgtttggacggtttcagcggttgtttatgtaggaattgtcatgcttgtatacagcatattggccggtcgggaaccgatacccgatgaaaagccccatgacggtcatgctttagaagagcatgtcaaatga

SEQ ID NO: 3395 - DNA, 2445 bp, Bacillus licheniformis
gtgaaggatatggacggacaaaaagaagccaccctccaaatctctggcatgacctgcgccgcctgtgcggcgcggatcgagaaagggttgaaaaggcttgacggcgttcaggacgcaaatgtgaacttggcgctggaaaaatcaaaaatcgtttatgatccggggcaaatcgaagtcggacagctggctgagaaagtcgaatcgctcggctatcaagttcctgcggaaaaagccgaatttgcggtttccggcatgacgtgtgcggcttgcgccaaccgggttgaaaagcgcctcaacaagctgtctggcgtcaaaagcgccgccgtcaactttgccattgagactgcgacagtcgactatcatgctggcgcggtttcgccggaggagatgatcgaagccgttgaaaagctcggctacaagctcgagctgaaaaaagaccgaactgcggacggtcgggcggaacaaagagaaaaagatattcagcgtcaaaccggcaaatttattttttcagccattttgtcttttccgctgctctgggcaatggtcagccatttcaaattcacgtcatttatatggctgccggggatgttcatggatccctgggttcagttcgcgttggccacaccggttcagtttatcgtcgggaagcagttttacactggggcttataaagcgctgcggaacaaaagtgccaacatggatgtgctggtcgctctcggcacgtctgccgcctatttctacagcttgtatttaagcattgaaagcctcggtacaaaccggcatccggacggcctttactatgaaacaagcgccatcctcttaactttgatcattttaggaaagctgtttgaagcgaaagcgaaagggcgttcatccgaagcgatcaaaaagctgatggggctgcaggcaaagacagcgaccgtcgtcaggaacggcgaagagatgaccgtgccgattgaaaacgttttggcaggcgacatcatgtatgtgaagcccggtgaaaaagtaccggcagacggggagattgtcgaaggtcgttcagcgctggatgaatcgatgatcaccggtgaaagcatccctgttgacaaaacggttggagatccggttatcggcgctacaatcaataaaaatggatttttaaaagtcagagcagaaaaagtaggcaaagatactgcgctggcgcagattataaaagttgtggaagaggcgcaaggttcaaaggcgccgattcaacggctcgcagaccggatttccggggtttttgtgccgattgtcgtggcgatcgcggccatcacatttttcatctggtatttggcggtcagccccggcgaattcggcacggcgctggagaagctgattgcggtgcttgtgatcgcatgtccgtgtgcgctcggcttggcaacgccgacatcgatcatggccggatctggccgcgcggctgaattcggaatcttattcaaaggcggcgaacatttggagacggctcaccgcttggagacgatcgtgcttgacaagacggggacggtcacaaatgggaagcctcagctgacagatgtgcgccctgaaccatggatcgatgaaacatcgtttctcaagcttatcggtgctgcagaaaaaagctctgaacacccgcttgctgaagccattgtcgaaggcatcaaagagaaagggatagaacccgcctcagcagacagctttgaagcgatacccggctatggtatcgaagccgcagtcaatgaaaagcggattttgatcggtacaagacgtctgatggaaaaccgtgatattgacattcaagatgcgaacggcgaaatggaagagctcgaaacacaaggaaagacggcgatgcttgccgccgtcgacggtcggtttgccgggctgatcgccgtcgccgatacgattaaagacacgtcgaaggcagcggtgaaaaggctgcatgatatggggctggaagtcgtcatgatcaccggggacaatcggcggacggcagaagcgattgctgctgaagccggcattcaccacgtcatcgccgaagttctgccggaaggaaaagcggatgaggtgaagaaaatccaggcaaaaggcaaaaaagtcgcgatggtcggcgacggcatcaacgatgcgccggcattggcggcggccgatacaggtatggcgatcggaacagggactgacgtcgccatggaagccgccgacgtcaccttgatccgcggcgatttaaacagcatcgccgatgcgatcctcatgagcagattgaccatcaaaaacattaaacaaaatcttttctgggcgtttgcctacaacagcatcggcattccgttcgcggctgtcgggcttttggctccgtggatcgcaggtgccgcgatggcgttcagttcggtctcagtcgttctgaatgcactcaggctgcaaaaggtgaagcttgattggaggaatccgtcttga

SEQ ID NO: 3396 - DNA, 210 bp, Bacillus licheniformis
atggaacaaaaaacactgaaagtcgaaggcatgtcttgcaaccactgtgttcaggcagtagaaggaaacgtcggaaagcttggcggagtggagtctgtcaaagtgaatttaaacgagggcaaagtcgaagtatcgtttgattcaggcaaagtctcgctgaaggagatcatcgatacgatcgaagaccaggggtatgatgttgcaggctga

SEQ ID NO: 3397 - DNA, 303 bp, Bacillus licheniformis
atggcagatcatcatgaacacgcgttaaatcccaaaagctctaaaggaaaagaacaaatcacaaaccgcttaaagcggattgaaggacaggtcagaggcattcaaaagatgattgaaaatgaccgctactgcgtcgatattctcgttcaaatctcagctgtgcaagccgcgatgcaaaaggttgctttcagcctgcttgaggatcatacccaccattgcgtcgcaaacgcgattaaaagcggtgagggagaagaagccatcgaggaactgcttgatgtgtttaaacggttttcaaaatcatga

SEQ ID NO: 3398 - DNA, 552 bp, Bacillus licheniformis
atggcgaaaaagattttaatcgtaacgggcgatgcagttgaagcgctggaagtgtattacccttattaccgctgtcttgaagagggctatgaaacgacgattgccgcaccgaaaaagaaaaagattcatacggttgttcatgacttcctggattgggatacatacaccgaaaagccgggctatttaattgacgcgcatgcttcatttgatgagattgacccgtccgaatacgacggcatcatcattcctggcggacgcgcaccggaatttatccggatgtacgattccctgctgaaaatcgttgctcatttctttgaggaaaataaaccggtcggcgcgatttgtcatgcgagcctgattttcacaagcctgagagaacatctgaaaggccgggagctgacggcttacatcgcctgcaaaccggaagtcgaagccgcgggcgcgacttatgtcgaggagaagcttcatgtggacgccaacctggtctcaggtcatgactggtccaatctgccggagtttatgagagaattttttaaagcgttaaacaaataa

SEQ ID NO: 3399 - DNA, 762 bp, Bacillus licheniformis
atgcttgtagctgaaagacaccaaaaaatcgtcgagcttgtcaatctgcgctcgagcgtacgcgtcacagaactgagcgagcttttttccgtcacggaagaaacgatcaggcgcgatttggaaaagcttgagaaggaaaataagctgaaaagaagccatggcggcgcagtcagcgtgcagactgaagaaagagaggtgcattttcgcgagcgcgaaattacaaacgtaaacgaaaaaaagatgattgcatttgaagccgtcaagcatgtgaaaagcggggaacggattattcttgatgcaagcacgacggcatggtacatggcaaaagcgcttgaaaacatcccgctgaccgtcattacgaattcagtcagagtcgcgattgaactcagcaaaaaagaaaaggtgacggtcatttcaaccggcgggatgctgctgccgcaatcgatgtcatatgtcggccctttggctgagcgctcccttgacatgtatcacgtcaacaaaacatttctgtcttgcaaaggcgtcgaccctgcgagcggcttgagcgattcaaacgaaatgcaggcgctgttgaaaaaacgaatgatcgaaattgcggacgaaacgattttgatggcggacagcagcaaattcggaacccgtgctttctcgcaaatcgaccgccttcatgaccgatacagggtcatcacagattcaggaattgacaaagcaaatcttgcccgcttgaaagacataacagagaacatcacgatcgtcggctga

SEQ ID NO: 3400 - DNA, 1482 bp, Bacillus licheniformis
gtgacgattctcgcctttgatcttggtgcgtcgagcggcagagcttatgcaggtcatgtggacggcggtctgatcaaagcggaggaaattcaccgttttccaaatcagcccgttcaggcgggaaaacacctttattgggacattctcaggctttatcatgaaattaaacagggcattttaaaggcgaaaaacggctgtggacgaatcagctgcatcggaatcgattcatgggcggttgacgtcggttttctcgatcggaacggagagctgatggggaacccttatcattaccgcgacccttacacggacggaataatgacggaggtgttgaatgaaatcggaaaagaagagctgttttccagaaccggtattcagcttttgccgttcaacaccatctttcagctccgggcgctgaaaaaagcgaattctccgctgttggattacgcggacacactattaatgattcctgatttgctgcgctattttttaacgggcgagaaaaaaagcgaatttacaaatgcgacgacaacccagctgttcaacccgaaaacgtctgactgggattgggagctcatcagccttctggggatcccggccaagatttttccaaaagatatagcaaagcccggaagcgaagcggggaggctgtcgcaatcagtgtgcggcgaattgtctgtgcccgccgtaccggtgattgccgtcggcgaacatgacacggcttctgcagttgtcggcatccccgctgaaacggatgactttgcatatttgatttgcggcacctggtcgctgatcggaaccgaacttgacgctccgctgatgacaaaacaggcgctcgattggaattttacaaatgagggcggtgccggcggcacattccgttttttaaaaaacattatgggattgtggctgttccagcgctgtcaggcggattgggaaaaagatgggatcagctattcgagcgccgagcttgtcaaacttgccggacagtcagaagcattcaggtcggcggttgacccggatgacccggtgtttctcaatcccgtccatatgcctgaggcgatcagagagtactgccgtgcagcagggcagcacgtgccggaaacgcccggacagatcatccgctgcgtgctggaaagccttgcgtttaaataccggttcacctttgaacggattgaaaccttgacaggaaaagaatatgacggacttcacatggcgggcggagggattcgaaatgaactgctctgccaatacacggcgaatgtactgtccagaaatgtatgggctggaccgtcagaggcaagcgccatcggcaacattgccgtacaggccgtcgcgctcgacatgttttgggatattcagagcgcccggaaagcgatcaaggcttcctttcctcaaaaaacgtatgtaccggaagatacagaagcgtgggagcgggcataccgccgctatacaagtcagattctcggcgccgcttcccgctga

SEQ ID NO: 3401 - DNA, 1224 bp, Bacillus licheniformis
atgatgaatgaccgggcctacgctttatttgaagaacagcagaaagacaggggaatcagcctttctgaagcaaaggaaaaattgaaagcgcttaaaatcgagacgccttcatggggatacggggactcgggcacgcgcttcaaagtgtttcagcaagagggtgtgccaagagatccgtttgaaaaaatggaagatgcatcagtcgttcacaaattaaccggaatttgtccttccgtcgccatccatattccttgggatcgagttgatgattacggaaagctgaaagcgcacgccgagcagcttggccttgctatcggcgccgtgaatccgaacttgttccaggacgatgactacaaattcggcagcgtcacaaacgtgaaagcggccattcgccaaaaagcgactgagcaattgctcgaatgcgtcgatattgcaaaacaaacaggctccaaggaaatcagcctctggcttgccgacggaaccaactatcccggtcagggcgacatcagaaaacggaaaaactggatgtatgagtgtctggctgaagtttacgaagctcttgacgatgatatgcggctcttgattgaatacaaattttttgagccggctttttatcataccgatctggcggattggggcatggcttacaatttggcgcaaaagctcggcccgaaggctgaggtgctcgtcgacaccggccaccatgcccaggggacgaacatcgagcacattgtcgcttatttgcttgacgaaaaacgtctcggaggctttcatttcaacagccgcaaatacgctgatgacgatttgatcgcgggcgctcacaacccgtacgaactgtttctcattttttctcaaattttggacgcctgccgtgattctgacccgaacgtccggaagacggccgaacatatttcgtatatgcttgatcaatgccataatcttgaaccgaaaatacccgctgtgctgcgctcggtcatgaatgtgcagactcaatttgcaaaagcgcttttgatcaacttcgatgaagtgaagaaagcgcaggaagatcatgacgtgcttgccgcagaggctgcgatccgcgaggcatttgaaatcgacgtcaagccgctcctctgcgccgtgcgggaggaaatgaacgttccgcctgatccgctcaaggcttatgcggaaagcggatatgcggaaaaaatcctggcacgcgggaaaggcggtgcaagctggtga

SEQ ID NO: 3402 - DNA, 390 bp, Bacillus licheniformis
atgaagggcgagacccattggatcataccggacggttttattcctccggaaagttccggaagcttgacgagccatgaagccatttgtgttttaaattgccatgaagaaaacgcaaaccttgcgatcaccgtatacttcgaagaccgtccgccgctcgaaggcatttccgagacggttcatggcaagagaacgaagcatatccgcacaagttctttgcaccgatcaggagaacgcattcctgaaaatgttccttatgcgatcgagatcgcaagcgatgtacctgtgatcgtccagtacagccggctggacacgacccagccggaacttgcgttaatgtcaaccatggcatatccgttaaaaacaagggggatgggcgtacatgatgaatga

SEQ ID NO: 3403 - DNA, 2070 bp, Bacillus licheniformis
atggtgaaatatttatggtcagagtctgaggctgcatcgctgcgtccgggtcttgccgagctcgtctaccgttccaatctgatcggcgctgaccgttcggtctgcaactggggcgggggaaacacatcgatgaaaacgacagaaaaggatttcagaggcagggacatcgaggtgatgtgggtgaaaggcagcggctcggacttggcgacgatgtcagcgggccaatttaccggactgaggctggatgatattcgtccgctgatggaacggagcagcatgaccgatgaagaaatgacggcatatttgtcccattgcatgatggacggaaagcatccgcggccgtcgatcgaaacgcttcttcatgcttttttgccgtttccgcatgtcgatcacacccaccccgatgcaatcatcagcatctgctgctgcgataatggaaaagagatcgcagaggagatatacggcagccgatttgtatgggtgccttatgtcagaccgggctttgctttatcgaagatgatagcagaaggtgtgaaaaacaacccgaatgcagagcttgttttaatggagaagcacgggctcgtcacttggggggaaacgtcgaaagaaagctatgatcagacgattgccgtgattcgcgaagcggaagcatatattaaaagccgttcggaagatcatcagccgtttggcggacagatggtcgagccgcttgcaccggaggagcggaaacggattttagccgatatcttgccggtcatccgcggcgctgtcagcggggaaaaacgcatgctcgtcacctggtgcgatgctgacgatgtgctcgaattcgcgaacagcaggcgcgcaccgtcgctttcacaggtcggcgccgcttgtccggatcacctcgttcatacaaagcgggtgcctgcctatattccgtggaatcccgctgaacaggacacagaagcgctggtcgaccggatcaaaaccgagattgctggatttaaagagtcgtatgccgcctattttcaacgaaaccggcacgaaggagacgagatgtttgaaccggcgcctcgcgtgatgctgatcccgggaatcggcatggtgacagcagggaaaagcctggcgatggcgaaggtcagccgagatttataccgccgggcgattgccgtcatgaagggaacggaagtccttggaaactttgtatctctcaatgaggaagaatcctacaatgttgaatattggccgcttgagctttataaattaacgcttgctccgccggaagccgaattttcgcgcaagatcgcatttgtgacggggggagcgggcggaatcggcagcgaggcctgccgccgccttgctctagaaggcgcgcatgttgtggtcgctgacattaatattgaaggcgcagaaaaaacagcggccgagattaatgatcaatacggtgcagaacgagcttacgccgtccgcatggatgtgacgaaagaagaggaggttcagacggccttcgaggaaatcgccctcaaatacggcgggattgacatccttgtcaacaatgcgggccttgcgacatcaagcccgcttgatgaaacgacgctcgaagaatggaacctgaatatgaatgtactcggaacaggatatttcctcgtggccagagaagcttttaagcaaatgaaaaaacaaggttcaggcggcagcatggtgtttgtcggttcgaaaaattccgtttatgcaggcaaaaacgcatcagcatacagctctgcaaaagcgcttgaggttcatttggcgagatgcatcgcggctgaaggcggaccgtacggaatccgtgcgaattcagttcttccggatgcggtgcttcaagggtcggccatctgggactccaaatggcgcgaagaaagagccgccgcctacgggattgaacccgaccggcttgaagagcattaccgcaaacgtacggctctttccgtcaacatttatcccgccgacattgccgaggcgatcgcttatttcgcttcagaaaaaacggcaaaaacgacgggatgcatgctgacggttgacgggggagtgccggccgcattttcaaggtaa

SEQ ID NO: 3404 - DNA, 1119 bp, Bacillus licheniformis
atgaaaaaaacactgcacgctccagtcaaactgatcatcgcaatttttatgatttgtacattttccatcggctttacagagtacgtcgttatgggtatattgacttccatttcaaaggatctctctgttccgatttcgtctaccggcctattggtaacggcatatgcgggaagcgtctgtctgacggggccgatcgtcaccatattttcggtaaaaatgccgcgcaaaccggtattgatcggcttgatgagtgtgtttgtactgtcgaatgcgctcagtttcctggcgccgaacttcaccattttgttggtctcaagaatcctatccgcatccattcatggtgcattttttgcaacgacaatggtgttcgtcagcgaaatggcaccgcccgaaaaacgggccgccgctgccgcttcaatgaacggcggcttgaccatcgccctgatgctcggcgtcccgtttggttcttatttaggcgatcttttcaactggcggatcgtttttctgatgatcgcatgcctcggattgatcggcctcgccggcatttggctgacggtgccgcacagaaaaccgaaagttgtccctaaattgatccatgaatgggatgtgtttaaaaataaacaagtccttttttcttttgctatcacgatctttggctattcgggcgtattcatcgcctacacgtttattgaaccgatgctgcggcattctgccggtttcgacagtctcggcattacagccgcccttttcgcctacgggtttggcggggtcgtcggcaatttctacgccggaaaggtgccgtttcacctgttaacccgctccatgatcggggtgatgatcgcgctcatggcgatccttgcggcctttccttttgtcagcggacatcctgccggcgccatcatcgtgacgtttttattcggagccggcgcgttcgcgttcggaacggtgccccttttgcaaacaaaggtcgtggctgcgtctgaacacggaacaacgatcgccacctccgtcagcatcgctgcatttaacttggccaacgcgctcggggcttggatcggcggactcattcttaatgcatcagagtctacacataccttgccacaggcggtgcgcttatga

SEQ ID NO: 3405 - DNA, 1266 bp, Bacillus licheniformis
ttgttaacgaataaacaaaaacaaggcaggcggtttgaaatgagaccaatgaaatcaaatgcttctttcattatgtattttgtgtgtatcagcgcttttttcgcatcgttgaatcaaaatatttattcacctatcattcctttaatcagagactcgtttcacgtttctgtttcgatggtaaacctgtccgtctcgctgttcatcttcattacagctgcgatgcagatcattgtcggctcgattgttgattttaaaggagcgagatttgtaatgatggcgagcatgatcgtaacggtcatcgccacaatcggctgcgcagcctcccgggactttggcctgtttctttttttcagggtgctgcaggctttggggactgctgcgcttccattaattgcggcaaccacaatcggatctctgtttaagggaacgaagcggggcagtgcgatgggaacttatcaaatgctgctttcccttgcaccggcagcggcgcctattctcggcggttttatcggggagcgctataattatccgggtattttttggtttttgacagtattgtctgttcttttgcttttcggcaatttgttttgctttccgcgcagccattcggagaaaaagaccaatctcagcgcgggcagcctgctgtcgcattataaggacatattcaaaaacagggcgggcaatgccgttttaatattaagctaccttattttctttatttatttttcaatgatcgtgtatttgccgattttgctgaccgatcactatcaccttgatctgcagatcgtcggcttgctgtatttgccgatagcggtcagcacgattgccggcagcgtgctgtttaagtggatacaaaagagattatcgctcagacgcctgtttttgatcggcaatctgaccgccgcagggagcgtcgtctgttttgccttttcccatttgttttcgcttttcgccatgtcggcggctctggttcttttcggcgttacgatggggctgattccgccgctcttctctacgatgatggcgaatgaatttgaggagaaccgcggcagtgcgatgggcatgtttaattttatcaggtatacgggaatggcctgcggtcctgttatatcaggcatgttattggggatgtcatcttctgttttcgttttcggctgtttcggtatcgtttatgccgcagccgcccttttgatgaccgcggtcatgcggaaagcagctcacacaaagacgctgcaagaaccaaacaaaaaagctgccaggtcttaa

SEQ ID NO: 3406 - DNA, 750 bp, Bacillus licheniformis
atgacagagcttataatggagagcaaacaccagctattcaaaaccgaaactcttacccaaaactgcaatgaaatattaaaacgcagacgccatgttctcgtcggcatcagcccgtttaacagccgattttccgaagattatattcatcggcttatcgcctgggccgtccgtgagtttcagagtgtatccgtgcttttggcgggaaaggaagctgccaaccttctcgaagcgctcggcaccccacatgggaaggccgaacggaaagtcaggaaagaagtctcgcggaaccggagattcgctgaaaaggcgttggaagcgcatggcggaaatcccgaggacatccatacattttccgatttcgcgaaccagaccgcataccggaatttgcggatggaagtcgaagctgcctttttcgaccagacgcattttcgcaatgcctgcctggagatgtcgcatgcggctatcctcggacgggcccggggcactcggatggatgtcgtggaagtcagcgcagacatgctggagctggctgttgaatacgtcatcgctgaacttccgtttttcatcgccgcccctgatattttaggcgtcgaagagacgcttcttgcttatcaccggccatggaagctcggcgaacagatctcccgtaatgaatttgccgtcaaaatgcggccgaatcaaggatatctcatggtttccgaagcggacgaaagggtggaatctaaaagcatgcaggaggaacgagtatga

SEQ ID NO: 3407 - DNA, 1221 bp, Bacillus licheniformis
atgaatcaatcgctaaaaacattcagcgtgttgtcagaacaatatcacgaaaatccgtatcagtatttctcataccttcgggaatctgatcccgtccattatgaagaatcgctggacagctattttatcagccgctaccaggatgtgcgccgcgtgctccagaatcaggacgtctttacaacgaaatcgcttgccaaacgggccgagcccgtcatgcgcggacctgtgctcgcccaaatgaaaggcaaagagcacacggcaaaaaggagaatcgttctgcgccgctttatcggggaatcccttgatcacctcacaccgctcatcaaagaaaatgcacaaaggcttttggccccgcacgtggagaaagggcggatcgaccttgtcaatgatttcggcaaaacattcgccgtttgcgtgacgatggacattttaggtttggacaagaacgaccaccaaacggtgagaaactggcacagcggcgtcgccgatttcattaccagtttgaatcaggcgcctgaggaccgggagcattccctcaaatgcagtgaacagctcgctgagtatttgaatccgattatcgaggaaaggcgcaaaaatcccggacatgatttaatatccatcctttgcacttccgaatacgagggagtggcgatgtctgaccgggacatacgcgcgctgattctcaatatattgcttgccgccacagaaccggcggacaagacgctcgcattaatgatttatcatttgcttcatcatcccgatcagatgaatgatgtgctggaagaccgcacgcttctccctcaggcaatcgcagagacgctgcgctacaagccgccggtgcagctcatcccgcgccagctttcacaagacgcggagattggcggagtcgagctaaaagaagggacgactgtattttgcatgataggcgcggcaaatcgcgatcctgaagcgttcgaggatcccgacaagttcaacattcaccgcagcgacctggaagtcaaaagcgcattcagcggcgcagccaggcatctcgcattcggttcaggcgtccacaactgtgtaggagcggggtttgcgaagaccgaaatcgagcttgtcgcaaatatcgtccttgatcagctgaaaaatatccggctggaggaagacttcatttaccgcgagacagggctttacacacgcggacccgtctcgctcaacatccggtttgatgccaaacattaa

SEQ ID NO: 3408 - DNA, 456 bp, Bacillus licheniformis
atgaataaaagtgaagcccaacagtttttaagcaacatgtatcaggacatcgtgtcggaaatgaatactgaaaaaattgccgattatttcagcgaggattatgttcaagtcacggacggcagtcacattgaccttgtgcagtttaaagatcacatacggacgctgaaaaacgttgcacgcaccataacggtgtcgccctttcatgaatttttgtttgacgagcgcctcgaaagcgcagcagtcagatatacggtcaaggttgtcaaaaagaatggagaccgggggagaattgatatcatcgcgatttttaaaatgaacggttttaaaatcgttcaatgtcacgagctttcacacgcgagcgaaggtacgaagggtattgaagagctggcgaagatcagtgaggcagcaattgaaaaagcctcctcccgggaggagaaggctttttcacaagattaa

SEQ ID NO: 3409 - DNA, 474 bp, Bacillus licheniformis
gtggaaaacaagacgtatgagcaggcatttcaagccgttcaggattttattctcaaaagagaaaagcgggctcagcatgaacagcaggcgttcgcagaggaagcctttcaagaagaagaaagcatgcgtaagcattggaccctgacccagcttcacattatctcgcttatcagcgaaagcgaagcagacgtcaacaacgctttcctggcagcaaaactccaaatttcaaaagcggcagtgacaaaagcggtcaatgtgctcacaaagcacggaatgatcgaatcgcacaaaaaaccgaacaacaacaaagaattgtattacacattaaccgatgaggggaaaaaactggccgacattcatgacaggatgcatgaaattgcaaaacagcgctacatcgagctgtttgatcggttttccgaatccgagctgcaaaccgtcatccgctttttaaacgaatggtcaaaacacatttaa

SEQ ID NO: 3410 - DNA, 597 bp, Bacillus licheniformis
atgttcaaccgggtttattttgaaaaagaggcgtggagcctgcttgaagaaagcgaccggacacaagtatacgcttatgcattaggcctgattgacggcgaattcgactggtgcgttgccgctgacggcggcctcgcggaatgggcggagacgttcagggtgctgcagggactggagatttgggaggagcacggagctaggatcgagcgcacaaatccggtgttcggccctggaatcgcagaaaggtttgaatgggcgtcaagccttgtgataagcgatcatgtgcaagcgtttatgaaaagagaggcggtgagaaaaagactgtcggaatggctcggagaagacggcttgctcgttattccgactgcccccggcccgccgccgctccgtggtctgccggaaaacgaattaaatgagagaagggcgcgcacgatgaaactgacgtgtattgccgggctcggcgggcttccgcagatcaccgtcccgttgccggcaaaaaacggcgagcctttggggctttcatttatcgccggctgcaaacaggatctgaagcttctggcttggactgaaaagcacgtgctatctcctcaagtatga

SEQ ID NO: 3411 - DNA, 666 bp, Bacillus licheniformis
atggagcatgattggagcgcttttataaaccgggatctgatggtcgatccgccatcggctgaaggaagcttgaaaaaactttcgtttgcggtaaaggatgtgtttgctgtagagggccatgctaatgcggcgggaaaccctgattggctgaggacgcacgaacctgccgaaaaaaacgcggaagccgttgacttgctgctgcgggaaggtgcaaggcttaagggtgctgcgcacacagatgagctgatgtacagcctcgacggagaaaatgtccattatggtacacccgtcaatccttgtgccatggacaaaattccgggagggtcttcaagcggatcggctgtggcggcagcctctgggatgaccgatttcgctctcgggacagacaccgggggatctgtcagaatcccttcttcatactgcggaattttcgggtttcggccgacgcacggcgaggtgtcggttgatggtgtcataccgctggcaaagagttttgacaccgtcggatggatgtcaaaagatattggagtccttcatgcggcgggccgcgtcctgcttagcgggcaggaggaggcaggggcatgttcaaccgggtttattttgaaaaagaggcgtggagcctgcttgaagaaagcgaccggacacaagtatacgcttatgcattag

SEQ ID NO: 3412 - DNA, 1050 bp, Bacillus licheniformis
atggtggacaaggttcgcacagggatattaggatacggtttgtccggttcggtgtttcatgcgcctttattatcagtgttagaagattatgagattcgaaaggttatgacttcaaggaaagaacaagtcaaacaggacctccccgaagcagaagcggtcagtacgatcgaagacatcacaaaagatccggacattgatctcgtcatcgtgaccacgccgagcggccttcattacgaaatggcgaaagagtgcatccgcgccggaaagcatgtcgttcttgaaaagccgatgacagcaacagcggaagaagcggaagagctcattaatgccgcgaaagaaaaaggcgtgcttctcagcgtgtatcacaaccgaagatgggataacgactttttgacgatcaaacagctcatcaaagaggggcgccttggagaggtcaacacattccacgcctcctacgaccggttccggccgaatgtcagacagcgctggagagaacagaaaggaccggggtcaggtgcactgtacgatttaggttcacacttgatcgatcaggcgcttcatttattcggcatgccgaacggcgtcaccgctcaagtgaccgctcagagagccaatgcggaaacagacgattacttccatgtcatccttcactatgatcagcgccaagtgattctccactcgggctcgattgttccggccaacggcccccgctaccaaatccacggctcaaaaggaagctttattaaatacggaatcgacggccaggaggatgcactcagagcgggtcataaacctgcaggcgatgagtggggagccgatcaacccgaatattacggggaactggccacagtcgaaggcgacgagatcaggaaggaaaccgtggaaacgctcccgggttcatacttaacttattacaagcagcttgcttcaagtattctagaaggcggcagcttgcctgtcacggcggaagaaggacgcgacgtcatccgaatcatcgaagctgcgcaaaaaagcagcgaaacgaatcaaacggtgttcttaaacaaataa

SEQ ID NO: 3413 - DNA, 636 bp, Bacillus licheniformis
atgacaaaaaccctttacattaccgctcacccgcatgacgaaagggcatcctacagcatggcggcaggaaaagcgtttatcgaatcttacaaagaagctcatccggatgacgaagtcatacaccttgatctttatcgggaaaacattccgcagattgatgcggatgttttcagcggctggggaaaattgcagtcggggtcgggctttgaacagctttctgaacacgaaaaagctaaagtcggccgtttgaatgagctgagcgagcaatttatcgcgggagacaaatacgtgtttgtcacgccgctttggaatttctcttttccgccggtgatgaaagcgtacttcgatgcggtcgctgtagcgggaaagacgtttaaatataccgaacagggaccgatcgggctgttaaccgataaaaaagcgctgcacatccaggcgagaggcggctactattcagaagggcaggctgcggaacttgagatggggcaccgctatatcagcatcatgatgcagtttttcggggttccggaatttgaaggtttatttatagaagggcataatgctgagcctgataaagctgaagaaataaaacaaaatgcgattgtccgagccaaagaattgggcaggactttttga

SEQ ID NO: 3414 - DNA, 969 bp, Bacillus licheniformis
atgaagaatcaataccgagtattgttgtattataaatatgttcatatcgataaccctgagcaatttgccgaagatcacctcaagttctgcaaagatttggggctgaaggggcgcatccttgtggcgggtgaaggaataaacggaaccgtgtcaggaaccgtagagcagacagaccgctatatgagtgaaatgaaaagcgatccccgctttgaagacatggtatttaaaatcgatgaatcagaagggcacgctttcaaaaaaatgcatgtccgccatcgcgatgagctggtgacgctccgcctggaagatgatatcgatccgaacgaattaacaggaaaatacctggagccaaaagaattttatgaggcgatgcagcaggaagatacgattgtcgtcgacgcacggaacgactatgagtacgatttggggcatttccgcggagcgatcagaccggacattaaagcgttccgcgaattacctgagtggatccgcgataacaaagaaaagctcgaaggcaagaaaatattgacttactgcacgggcggaatccgctgcgaaaaattttcaggatggctgaaaaaagaaggatttgaagacgtgtcccagcttcacggcggtattgtaacgtacggaaaagaccctgaagttcaaggtgaactgtgggacgggaaatgctatgttttcgatgaaagaatcagcgttccggtcaatcagaaagagcacgtcattgtcggaaaagattatttcaccggcgagccttgcgagcgctatgtcaactgcgcaaacccggaatgcaacaagcagatcatctgctctgaagaaaatgagcaccgctatttgcggggctgcacgcacgagtgccgggttcatccgcgcaacctgtatgtcaaagagcacggcctttcagaagaagaggtgcaagagagactcgaaaagctgaaagaagaggaacatgcagcgcagtcataa

SEQ ID NO: 3415 - DNA, 192 bp, Bacillus licheniformis
gtgagtctgcacgatgaaaaagagattgagaaattgctggaaaatttcacaccgatgatcaaaagcaaattagagagggaggatcttgaacaggagctgaagatgaagatttgcgaaaaagcggagatgcttttatgtcaagaagtgcctggtttttgggagtttataacagaattgctgaaagtcctttaa

SEQ ID NO: 3416 - DNA, 582 bp, Bacillus licheniformis
atgattgatcaaacgttactgcgtgcgaaaatcaaggagatcacaaggcatccgcttgtgaagcattttttgagcaacccaaggtatgagcggcttttcaaccacgtgttggaacatccggattctgaagaggcagagtgtctcgatcgtgaatttaagcgattttacaaaaaaatccgcatgatcaaatacatcaactcgatgatccggattttctccgtcgactttgataaaagagtccggaaaaaccgagagcgttttccattgatgatcgacgacagtccgaatctgcccgagccgccccgaggggatctgttagacgatgtcttggaacaggaagaggaattaagcgaacacctgcaagacccgatgctttatgaagcgtttttgcaattgacggacaagcagaaaaaagtgcttgcacaaatttatattcatggggtatccatgcaggaaattgctgactctttgggagaatcaaggcaaaatatttcaaaaattcataaaagggcactcgaaaagataagagagctgctgaattctaaagcagaggggaatgataacagtgagtctgcacgatga

SEQ ID NO: 3417 - DNA, 150 bp, Bacillus licheniformis
atggacagcgcattcattgaggaagcagcgaaacaaatcggcaatgtcggctttccagctgtattggcaatttacttgctcactcgttttgaaaagaaaatcgatgaactgatcgagctgatcaaagaaaaaaatgaaaccgatgattga

SEQ ID NO: 3418 - DNA, 1155 bp, Bacillus licheniformis
atggaaaaaaacaaacaaattccacagccgatcagaggagaaaaaggagcggaaacgaaaattccgcacaacgttgagcgcgaccgccaaaacccggacatgctcgtaccgcctgaaaccgaccacggaacggtgccaaacatgaaattttcattttccgatgtccataaccgtcttgaaaaaggcggatatgcacgggaagtcacagttcgcgagctgccgatttcagacaagcttgcttctgtcaacatgaggctgaaacctggggccatcagggagctgcactggcataaggaagccgaatgggcgtatatgctgtacggaaaagcacggattacgtctgttgaccaagacggcagaaactttattgaagatgtgaaagaaggagatctctggtacttcccgtcaggtctgccgcattcaattcaagcacttgaagacggatgcgaattcctgcttgtcttcgatgacggctccttctctgaaaacagcaccttccaggtgacagattggctggcccatacgcctgatgaggtgattgccgcaaacttcggcatttcaaaagacgtcgtcgcctctcttccagttgaagaaaagtatattttccaagaagcgatccctggctgtcttgagaaagacaaagttgaaagcccgaacggaacggtacctctatctttcagctacaatttgcttgaacaggaaccgattatatccatcggaggaaaagtatggattgccgattccacgaacttcaaagcatcgaaaacgatcgcttctgcgttagtggaagtcgaacctggaggcatccgggagctgcactggcatccgaatacagacgaatggcagtattacatttccggacaagcgaaaatgacggttttcgctgccgacgggcatgccagaacatttaattaccaggccggagatgtcggctatgtgccgttcgcaatgggacactacgtccaaaatacaggagatgagccgcttcggttcctcgaaattttcaaagacgaccactatgctgacgtttcgttaaaccaatggctcgcgcttgttccggaagagcttgtccgccagcaccttgacgtcggcagcgaatttacaaaaatgctctctaaagaaaagcatccggtcgtcaaatttgataagaaataa

SEQ ID NO: 3419 - DNA, 399 bp, Bacillus licheniformis
atgaaacatttcattatttgctgcatatcggttatattcgtttttttcgcccactttctcggcatttcgatcctgtttcatctgtcgggcgcgttttaccaaacagtcggatcattgctgctgtttacgctttgttataccggactgacctttgtcctggaaccggctgaaaaggtgctcatccacagtatgaaactgctgggcatcaatcggcggatcacggtttttgccgctgaaatgatcacgatcggatgtttatgggccgccatttataccgcggacgaattgctggacgacgttctgctgacaacctcggcggaaatcatgattgccgtttcgttttttacaattgataaaatcctttatccgcggcagaggtccggttcgctcttatattga

SEQ ID NO: 3420 - DNA, 486 bp, Bacillus licheniformis
atgaataaggttcttttcagacccggcatgtcgatcaaagaaattggcgaacagttgcaaggctatatcgccgcaaattggaaacaaacgcttgacgatcatcgcgaagctcttttaaaggtgtttcccgaattggaagacgcgacttacggggtctacctggaccacctgctgcctcctgtatttgaaagtctcgaacagtccggctttacaacgattcaaaatgcgggaaaaggcgatttttttatcggaaagggcttgaactttagacagtccatggaaaaatggggagctgacaactgccgctcacgtgtgttttgggttgtcatctccgatcagcaaaaacagccggccgggacgctgctctttgacttttatcactctcacgccggatttgatgtccccctctccccgcggatttacacgttggaagaaacggagagagaccgaattgttgctcacataaaacagataaaggagaactag

SEQ ID NO: 3421 - DNA, 543 bp, Bacillus licheniformis
atgtataagaccaatatcttacataagggagaaactcatgagaactttcgaagtgttgacactcctgtcttttgtcatgctgtttcagcaaaaaatgccgggaaagcttgcggcggcagccggatttgtgagtattggcgtgttggcggacttgcagctttattcaaaacttttgaagcagctcggcatgacgggcgacatcgacggcgaacgaagcgcggatatcgtgaaccggtacgttttggatttttcaacaagcatttaaaagaaaccggtggtaatcttgtacctgccaacaaaactggtatgtaccaaggtcgtcaggttactgtaacagagcacgtccttggaggatatagaaaaggcgggaaatccaacagcccatatacaagttttacaataaatcaaaaggttgcaaagggctacggtaaaaatacaatagaactcgacatatctgctctccgtaaagccatcaggtctggtgaagtgaaggatattgtaattttatctcctaaacaaatcgaaaggtttaatcaaaaatga

SEQ ID NO: 3422 - DNA, 285 bp, Bacillus licheniformis
atgcttctatattataaaaatgaatgcttgggtgaaataaaaggcgctactgttgaaggtgtctggatgtatggaacaatcattcctaatgaaaacatggaaaagttcaaagatttctttaaggctgtagtaaacgaggatgacccttttgccattgaacagtatagtgaagaatggttagatgatgaaaattggtttattattgatgaaaagcaaaaaaaggtaggtatatcccttccagggatttacgaaaatgataatgaaataaattggagatggagataa

SEQ ID NO: 3423 - DNA, 300 bp, Bacillus licheniformis
cttgcagcggaatagaaaaagccttcttcaagcggcaaaaaatcatcctgcacgctgcggtctggcatctataaggtaaaaagcccactgatgaaagggacggccgtccggcagattcaggaggctttagctgccctctatttctatccagacaaaggggcgaagaataacggcataggtggctattacgggccgaaaacggcgaacgcggtcaaacggttccagcatatgcacaggctttctgccgacggtatttacggaccgaaaacgaaagcaaaactcgaatccttactgaagtaa

SEQ ID NO: 3424 - DNA, 198 bp, Bacillus licheniformis
atgaggtcatccacttttaataaaaagaaaaaaggacgagggaaaatgagtatcaacaaaatcagatcagcactgtataagtcagctaaaattttaggagatgttaacgcggcgaaaaatggaacgctagggaaacgaatggcccgccgagctgcaggaaaaacagccggcaaaatattgggcaagctgttcaagtaa

SEQ ID NO: 3425 - DNA, 360 bp, Bacillus licheniformis
ttgaaacgaacagcagagtttaccttatcattaattgcaacaatctttttaacaattggttggtttttcacagctattttcacatttttttatggttttacaccagcagatgaagctgacatgggatttttctattacttattaatttatacttatttatcaattccacttcttgtgcttatttgggttgcaacatttaaagtcaaagcaaacagcaaaggctggggaattttcattctaattatgggtgtcctttataccttttctatttactttgtgtcaggcattctcttgttaattgccggtattatgatggtcgcaaaacaaaataataatagtagtaatgttatgtctgcctaa

SEQ ID NO: 3426 - DNA, 861 bp, Bacillus licheniformis; identical to SEQ ID NO: 484

SEQ ID NO: 3427 - DNA, 333 bp, Bacillus licheniformis; identical to SEQ ID NO: 485

SEQ ID NO: 3428 - DNA, 219 bp, Bacillus licheniformis
atgaaaaaatccgaacaaatattagaagccatagacgaactaactaaagaaaaaggtttcccgccatctgttagggaaataggtgaaagggttggtttaaaatcttcaagtacaacaaaaggtcatcttgaccggttgcgtaaaaaggggcttgttgattgggaagaaggtaagccgagaacattgcatattttgtataaagaaaaagccaccatttaa

SEQ ID NO: 3429 - DNA, 570 bp, Bacillus licheniformis
gtggagacgatagctaaaagagtctgtaaaccatttatcctattgctaacagctgtcttattagtaacctttgttgtacctcaaatttcacaggcaagcgaattttcgaattcccaggtgaaaagctattccgattctggtgattattcagaaaaggaattagaggaaatattaaagttttacttcgaagaagttggggaactaactaatgagggatatgttattaaaaacaaggaattgtttgataaaaaagttttggagggcgaccctgctgccttgaaactaaaagaattaatggcgtcagactcttcttttcagaagtctagttttcaggttgctagtgcaacatcttttggtaaatgtgttgtaaacaaaatgattggtagttatggaaatatagcgcgtcaatttttaaatggtgctatctttacatatatcaaaactaagcagtatgatttagccgcaagattaatgttcaaaactttgattaaatctgggatgaaagttaatgcagcgtctcttgcaatagagttgggatactatggatggaaatgtcgagggaagtggtaa

SEQ ID NO: 3430 - DNA, 231 bp, Bacillus licheniformis
atgaaggaaaacgaaaaaattaaatttatccaagatgaagttttgacagctgcagaagcaggcgagctcctcggggttacaaggcagcgtttaagtgcattggtgacttccgggaagctaaagcctgtgaagaaggtcggtacagttagcttgtttctccgtgatcatgtggagactcaaaagaaagaacttgaagctggccggaaaaaataccgcccatatgatgagtaa

SEQ ID NO: 3431 - DNA, 210 bp, Bacillus licheniformis
atgaaacaatattttaagcattacagctcattagacatggcaactatgctcatcctaatagcgggcatttttgcaattgattttgaaaaagttggtactctggggaaaatcacaggcatcattttatacctggctgtgatagttacactgttaaaaggattaattatgatttggagcgaaaaaaggcatgaaggaaaacgaaaaaattaa

SEQ ID NO: 3432 - DNA, 1023 bp, Bacillus licheniformis
atggatgaaaaacaaattcatatgccggatttgacagctcgaaatgcaatagacttttgtaataattcatttgactttgacggcataaagaaagtaatttttgattttaaatattcaaatacggtagagccttttggcatgcttatggttgcatcgaagctcagaagactcgtggaaagatacccaggtattatttggtgcgataatcatcatgataaagaatatgcaggacacatggggttttttcaaagttggagaattgattatggaaagaaaccaggagaagcatggggaagcaatacatatattcctataactgaactaaaagttagagatttaagaatagaatcatacaatcgcaatgaagtagtgcaaacaactattgaacgtaaatcttatgaactcgcaaaagtactgtcacagggcaataataatcttaaagatgtgcttggttactctattcgagaattaatgaggaacattgttgaacatagcacttctgaatctttctggtttgcaggacaatattggccatctaaagataaagttgaaattgcattgctggatgaaggtgtcggaatcgcacaagctttgggtgtcaacccaaatcttaacataaaaaacgataaagatgctctttatttgtctatagagcctggaatttcgggcaaggcttttgagtataatggtgtcatgcgaggacaatcaaattctgattgggataattctggatatggactgtttgttacaagtaaaatctgtcaacacggaggggatttcctgatatgttcaggtaaaaatgctctttctattaaaggcaaaggacattacctctatgatactgatctaacaggtacggcaatcaaaatgactcttaacacttctaatcttaacaaattcaatacatttcttatagatagtattgtacgtgagggggaggaaagagctaaagttaattctcataactcaaatttaacagcttctaaagtctcaagaatgctcacaaccacagaggataattga

SEQ ID NO: 3433 - DNA, 1530 bp, Bacillus licheniformis
atgaagacgctggatgttcaagcgctgcacaatgcaattgatcaaacgctggaacaattaaaacaacaatcagatgaattctctaaagtcaaaaaagcagttgagggcatcacatcacttgatgatgctttaaaaggaaaaggcggcgacgcgatccgcgccttttacgaggaatgtcacaccccttttcttcagttttatgatactttcatagaggaatacagttccacgctgaagaaaatgaaaagcgcgctgaattccctggaaccaaaccataacggatttatttcacagtcctttctcgaacacgagttggagaatggcttaaatgccgctgatcgcacaacaaaacatttggtttctaaggccaacgccacgatcgcaaaagtcagccatatcgtcgacttaccggatttgaatgacagcggttttcatgaacaaaatcagaaagcgttaaaggaaatcagcacgactcttgaaaagctgcatgcgtttgaccgcgagcaaaccaacgccctcaaaacggctgaaaacgatcttgagacgatgcagagatacatggcgcggctcgaaaagatgtataccggccctaaaattgaaatcacaggttaccaaaaaggcgcgattttaaagccggatgagatggataccctgagtggaaatcaagaaacagcgatgggtgccatgttgaaaaaagtcggagacaaagaagatgtggacactaacactatcgccgatccagaccgattaaaaaaattggcgacacaaaaggtttccaagaaagagtacacccaagaggaattgaatgaactgaaaaaagattatagagtatttaacgatacgctttaccgggcatacatagacggcgatacaatcgtcaagatagaacccgcctacacccttccagagaatgtggaaaaaagcgattttaataaaaatttcgatacggcgatggaatttacaggtgtgtatgatgcagtaagagcagcgtttggatatgaccttgcgacaggcgaaatcgttaaaggtaatggggatcgtttgatggccggattgagtgtcacaccttttggaaaggcatttaaatacggaaagcgcggcttcaagttatttaaaggtgaagaagcgggaaagaaacttgcgaaggtagataaaacaccttcctacggcaaacaatccgtaccaaaaggtccgtatcgcgaagtgcatggtttccctgcaaaagtaaaaccaggagctcaagaaaaacatattcctggaacaccaaactacaaacaagaaatagctaatggtcgtaaaaacaaaagcatcttctacggagataataaaacggcacaagaattgctagataagtttgcaggaaaaggcactctgttaaaaaatggggtcaaagagagagtagactttggcaaagtaataggaaaattctatgataaagatactggtaagtatgtggagactactagaggtttgatacattacagcaaaaacggcgctcatatagtaccttcagagcctttaaaaccttaa

SEQ ID NO: 3434 - DNA, 339 bp, Bacillus licheniformis
atgggatatgatcctttaatttcagcattaagaaagtataaaaataacgatttgataatagaatggaaaagtggattaaaggttattggagaacctgacacactctatgaaacagacaacggattggacgatgatgatgtcaattatatagaatatgacgcagtcgcatttcaagtaaataatattttatcccaacccactaataaagattgtggtgtatatgattggttaagacaaggagaaagttccttaattgaaatttcactttatgaagatacaccaagtgcagtatatttaacagacggtcagaaaatatgggagatggatagtgatgaataa

SEQ ID NO: 3435 - DNA, 1080 bp, Bacillus licheniformis
atggttaaagttgtgaagaattatgtgaaagtcaatcaatatactcggccagggttgaagttggcaggagtgaaagggattgtcatgcactggacggctactcctggcgcgtccgcactgaatgagcgaaattatttcaacggcacatgtatcgctgataaacgttacgcttcagcccattattttgtggaccgtaaagaggcgcagcacatcatccctgaaaacgaagtcgcatatcatgcccatgatcaaaatcgctgttatgtcagctttttaaaaccaaacgctaacacaacggcaatcggtgttgaaatgtgcgtcgaaaaagatggcaagattcacagccaaacgattcaaaatgctgctgaactggttgccgatctgtgcaagcgttacggcctttctacaaacaaaattgtccgccattacgatgtgacaaataaaagctgtccgactccctgggtgagggatgcaagccagctgacgacattcaggaaaaaagttgatgccttgctcggaaataacactgtgtcaaagacaacatcatccacgagccagtcaagcaaatccacagggaccattctgaaaaaaggggcgtccggttcccaggtcaaggcgcttcaaaaacgtttgattgccgctggcttctcactgccgaaatacggggctgatgggtcttacggaaatgaaacggtgcaggcagtcaaagctctgcaaaagaaagccggtattgcggtggatggaatttatggaccggcaaccgaaaaggcgctcgcggccattgaagcgaaaaagaaaaaatcatcatcaagcggcaaaaaatcatcctacacgctgccgtccggcatctataaagtgaaaagcccgatgatgaaaggaacggccgtctggcagattcaggaggctttagctgccctctatttctatccagacaaagaggcgaagaataacggcatagatggctattacgggccgaaaacggcaaacgcagtcaaacggttccaactgatgcacgggctgtctgccgacggcatttacgggccgaagacaaaggcgaaaattgaagctttattgaagtaa

SEQ ID NO: 3436 - DNA, 264 bp, Bacillus licheniformis
atgacaacattcgacaaaggcacggtcgttcggacggtgcttctttttattgcgttggtaaaccagactttgatcgtattcgggaagccagttcttccaatcagtgaagatcagatcaacacgctcgcagacgctttgtatttggccggctctgcggcattcaccatcattacgtctgtggtcgcttggttcaaaaataactatgtcactggcaaaggaaagcagcaaaaagaagttctaaaacaaaaagggttaacgaaatga

SEQ ID NO: 3437 - DNA, 294 bp, Bacillus licheniformis
gtgagaacaggaggatttcaggacatgcatcaaacaaatgaatgggacgtcttcaagcaggagattaccgaattgaaggccgatcacaaaacgcttgaacagcgtgtcatcacactggaaagggcgtctgatcgacacgatcaacagattatgtccatcaatgacaagctcaacaagattgaagagaacacaacatggattaagcgcagcataacgggcgcgatcatcacagcggtttgtacactggtgatctccgggattgcggcgcttttcattaattttattcaaaaataa

SEQ ID NO: 3438 - DNA, 183 bp, Bacillus licheniformis
atgaagtatcccactcttgccgatataaaacaattctatgattgggggtgttacacagatgaagaaatgcgggagtacgtaaaaattaagtggatcaccccggccgaatatgaagacataacaggccggagctatgataagcctgacactagtgtggatttaggaatgccaagcgcccaataa

SEQ ID NO: 3439 - DNA, 315 bp, Bacillus licheniformis
gtgaaatggctttacaaatatgatgagaaattcaattacatgccgggagaagaaattcaagtcgaagacgacgctgagctaccggaattttattgcgaagtaaaaccgcctgacggcctatacctagccaaatttgatcctgcgaaaggggaatggtttgaatcggccaccaaagaatatattgaaagcttgcagcctccggagcctgaaccgggcataactgatctattgaaaaaacaaaatgctttactctcattgcaagttgcgcgcctgcaggctgatgttgaagcgttaaaagggggcggggcatcatga

SEQ ID NO: 3440 - DNA, 1344 bp, Bacillus licheniformis
atgatttataaaaatacggctgtgcactttgatgtcaatgcacaagtgaagcgaagtgtatcagcaaatattcagttcagtacacaagatatcgggaccgcaaaattgtcgtttaacctgacaaaggacggtgtgcctttgccgattagtaaggcaacccatgccaagctattcatgaaatttactgacggcagccaggtctatgtcaatacagaagtcgaagacgcgctgaagggcgctattttttatgtcttaacgccggaacaaatcaaacatgccggtaccgttcacgcggagctttatgtcaaatatgataatggtcagaaaatgagtgtccataaattttcttttgagattgataaagctctcattgatgcggatatcgtgcccgttgccgaatactactttgaagattttgaaacgttcaaagctgaagcggaagaaatgattgatgacttgcaggcaaaatttgaaatgcttgataatatcgaaaccaaagagggagcccaagcaagagctgacgctgccgaaaccaatgcaaaagcttacatggataagcacgcatctaaaaaagacaatccgcacggtgtcacaaaagatcagatcggcttatctaaagtagacaatgtgaagcaggcgacaaaagcagagtttgatgagcaccacagcgataatactcgacacataaataaagctgagcgaacgaaatggaatgccggacagctttataaattaaccgatgacaacggcgggagaacgctaattcctgatgacactgacttattaaccttaccatcaggactttattatggtgtcagtaacaaagttgtgaattctccagaaccgaaggcggtcgagtggtttcattacgatgtttcaactaataatgcacgcaaaacgatcgtggtaactgctacggccaatcctaaaaggtggtttgggacaatccacactgacggatcatttaaaggttggcagagatttataacggatgccgacgcggaagttacctggcaatcacctactttgttaaacgggtggaagcagtatggaacccataaggttcagtttagtaaaaatgcccttggagaggttgaaattatcggctcaataaccggtggaacaattggttttgatgtgccggcttttatgctgccggctggatatcgccctatacaaatgcttcattttataggtgtagcttctagtcaaggcactggcaccactcctcagtaccatagaacccagatcgccactgatggaactgtttacattcagagttgttcaaatacggtaaacccaaacgaatttattactttcggttttaaatttaaggcggcttag

SEQ ID NO: 3441 - DNA, 1956 bp, Bacillus licheniformis
atgcaacggctgataaaagactatgatcaaacccggaattcccgttatcaagcacaactaagagcagatatgcaaagcatagaaaacagcttgaatgagcaagaaagacagattcaatcgcatcaaacatcaaaaaaagctcatacgtctgatcagattgctcacagcagcgggcttacagtatcccaagaaatcgaaactgccaaagcaagggccagaaatttagtgttaaatgccgacggaacgaacataaaggaagttgttgacgcgcgtgttgatcgtaggggaacaatttacccgactttatgggaccgtctggctgcagatgggcagtatattgaaacgagatttaactttaaaaatgcgcttaactatggtgcggacccgaccggaaaaagcccatctgcctgggccatacaaaaggcgctggatgaaattcgtcgagaaggcggcgggcagcttgtgataccaggcggtatttatttaatcgaaaaaagaatgattgtgtatgaaaatacccgtgtcactatggccgcggattgtgtacttcttagaggatgggccggcggattctttgtcaacggaaggccggatgatagcttcagcggcttttccggaagaagcaacatcattattgaaggcggtattttagacggtaactatgccaatatagacaaatacccgtctactgcgatggactcaatcattttaggtcatgcaaataatatttggattgaccgcgtaactttcaaagacacgattaccgcccatgccattgatgccaatgggatcaacaatctccagatcacaaggagcaatttttttggattcatagacttgagcggaaaacgccctttctcagaagccatacagcttggggaatttgttgaaatgggcgtcaatcaattcggagagtttgacggcacccctaatcaaaacgtttatatcgcccataatcattttggtaaatctgagctgttgggcggctggggttctgcgataggaaatcactatgctgtttatgatattttccaaaaaaacatcacaatctttgacaatacgattgaggactgtggttttgcaggagtaagaacgtttaaatggggcgaagttaagattttaaacaatcgatttaagcgcaataatgaatgtattcgaatttcccaagcagccggaggaattgaaagttctaaaaatgttgaaggagtccaaatgaatcgcccccaaaatgcacaaaacgtcttgattcagggaaatgatttttatgattacaagtcatacggaatcttatcgtttgggcaaatatataacaacgaagtcgcctggagcgatggcattcgtatttttgggaactactttaaattaaaggcaaaagagattggtgaatatgacgatgagcaagccataaaattagtctttgcaagaaatgctttcatctctgataaccggatttttgggggaagaagagggatgtggatagaaggctgttacaacacctttattgatcgaaattatgtttcctgtgttgatacagaagcaatctacgtcgaaaaaagcagagacaaaacttctaccgtgccgaaatcatatcacctttctattgatcgaaacgaaattaacactactggccgcaacggtattttcattcaaaactgcgatcactttgatgtgagagataataatgtgatgaataccaataaagagcaaagcagtacgagagggcgcggcggcatttatgtggaaaacggatacgacggacgaattgaaaatagccggatacgaggcgtcgagaaggcgtttgcgattttagtaaaagacgctgcaacagaggtgaatgtcaccaacacaaaagggactggccgcgtcatcgttcaaggagattccaattttaacgggtattatgggacaacaaaagatgactatattagaaaaatcattacaaaaagcagcagctaa

SEQ ID NO: 3442 - DNA, 792 bp, Bacillus licheniformis
ttgagagatgcgcttgattttgcgctgaagaatacagacttcaaatatatttttaagacgcctgagagtgaatttgaatcagcagatcaagaaaatttcggtgataaaaactcgacagagctaatggatgaaatcattgaggattatgggattgaaatagacgtggataattacaaaatttatatctacaaaaagatggggaaacggattaatttcaccctagattcgcgctataatatgcccggcatttcaattacaacaaactcgcaaaacagtacaacacgtgcctggggatacggggccttaaaaaaggggagcagtactgatgacaaaaaccctcagtacgagtttgagcctattttatacattcatccagacgaaaagaaattcttgattgaagggaagccacgctgggctgaaccgatcagggatgagcgctataaaaaagccagcagtatgatttctgcattaaaaaggcatgtgaatccatatccggaaatgacggtagaagctgatttccaaaaaatctatgagccgaagcttttagagatcgagcaagatttctggaaaggcgacaccatccatgtcttggctgatacggctgatggtatcacatttgaagataatgtgagacttgtgtccatccagtacaaccctctgaacccatacagcagtccgaaattgacgtttgcgaacttccgcaaagatatccaaagcataaatgtggatcaagcgaaaaggcttagagatcaaaaacgatatattgaccagcttttcaaaacgctcaggtag

SEQ ID NO: 3443 - DNA, 918 bp, Bacillus licheniformis
atggcaaacacagattttataaaggaaattgcaccagacgcccaaagagtctataaaaagtatgatattctcgcgtctctcattattgctcaagcctgtttagagagcgcatgggggacaagcgggctggtgcagaaagggaaaaacttattcggcatcaagggtacttataacggtcaatatgttctcatgtggacgactgaatatgataagagcggaaatgcaaccaaagtacaagctcgctttcgaaaatatccatcttggtatgaatcgattcaggatttagccaagttgtatgtgaacggaacgagctgggatccgaatcactataaagctgtagtcggcgaaaaagattacaagaaggcgagtgctgcacttgtaaaagctggttatgcgactgaccccaattatgcgacaaagttgaataatctcattcaaacctacaagctaacacaatatgacactgtgggtggggtgccagaaggacctgacgaaccggaaacaccgatacctgatccagaaataccaagcaaggaatatgacgggaaagacattacactcaatcagaatctgccgtcagataccgatttcccacagcttcatgtgtcaacaaaagacggaaaaaaggttgtggaaataacgggtgtgtcagttgatctgacagacgatacgacaggtaagaagagttttaccttcactatcacaaaaacgcaggagaacggcacagaatttgatttattggtggacgataacatactttatctggatgagaaaaaatttaaaccccaaaaatattcattacgggtgtcgaacttcatcaagagaaaaatgttattagtaaaaccgttacagcaagccacatattcactgtgctgcttattaacaacaggattcatgaaactgtatcaaagaaattaa

SEQ ID NO: 3444 - DNA, 837 bp, Bacillus licheniformis
gtgaaattattccttgattacgataatggtcttggggagcagagcttaaatagcctgcttcctttttttgaacctttaagcttcacacctgaagcaccggggattgatcgtgaaacggttagcatcccgagaataaacggagttgtccttccgcaacatcctcgggatgtcacatatacagaacgaaaaataaccgttgaattttatttaaattcaatcatcgctgaaaacttttatcaatttagacgggagctttacgcgcttttagttaagccgtttccctattatatctcgaccgatttattgccgaatctccgttttcgggtaacttgtgatggaaattttagtatcccaaaagaaaaggagaaaaactttgtaacgttcacagttgaatttaacaacatcacgggactggcagaatcgaaattcacttctctgacaaagcaaaattttgacgttgagcattggagcccaggcatgaacattcaaatgcgtgacgatctggaatacaggttcaaaaatcgaaagaggtttcaggtttataacactggtgatgcctatatcaatcctttggaacatgactacaatgtggccttatgggcggccggaaaaaatgtgacgatcatcaaccatacaaatggtgaaaagctgaaaattgaacaggaattaaaaaaaacgcagcgtgtttcttttattaagcaatacacagtgatcaataaaacacctattaaaacatccggcagactcccgggactcgatataggaatgaataagtttgaaatcttgaataccaatgattttgaaatcatatttgatacccgtttctactacgcgtaa

SEQ ID NO: 3445 - DNA, 3738 bp, Bacillus licheniformis
atgcctggccttctcgcaactgctgcagccggtcaaacagacctcggtgttacggcagatatcgtttctgacattttgactgaatttcatatcaaggccgaagacacaaaccgcgttgcggatgcaatgacatatacttttacgaattcaaacgccaccctgcaagagatcggccaaacgatgaaatatgcggctccggcagcaaaaacggcaggactcagcatggaagaattagcagcagcgacaggcattatggcaaatagcgggatcaaggctgatatggcaggaacagctttgcgagctacactgacccgtttatcatctccaccaaaacaagccggaaatgcgatcgatgaattaggtttgaaggtaaccgattcgacagggaaactgcgaccacttgcggatattatcggccagatcaatgagaaaacaaaagattataccgaaactgaaaaaattcgaattgcaaaacagttggctgggcagcatgctctttctggatttattactttaatgcacgcgggaaaagataaaattcaagaattcacaaaggaaatcgaaggaagcggcggcacagctgaaagagtagccaaaaagcaaatggacaacctggctggctctattgagtatctgaaatctgctacaaacaatgctgttatcacttttggaaatcagttcttgcctgttatccgggctacagctgacggactaacaaagcttgtaacctggtttgattcattgcccccttctgtggcgagtaccattgcgattactggcggtgcagtcactgtattttccctcttaggcggcgcgttcttactgttgcttggctctttgccaaaagtagcagcaggctggaatatgcttcggaccgcgggcggctatttaacgcggaatgtaaatcaagcatcgggcagtcttggcgtttattctacggaagccattgcagcgggcgcagcttccaggacagcggctgcaggtatgacaacaacatctgcggcagcggcagcagcatccacacgaatggggcgttttcatcagtcagccaatctggcaacaaccagagtcgggaggcttgaacaatcatccagcagaagtgctaaagccatgcgaggcctaggcggtgcttcacgtgttgccggcgttggccttggattgtttggcgggccagttggttcaattgccgggctaatactttcatttgctcctgagctcttaaaattcggtgggaatattttaaaggttggagccaatgcaattaaaggcgctggcggctttatgaaattagcaaaaagcggttttggcctattcaacattctcaaaaaaggagcaggagttgtcggccttttacgtggcggattgagcttgttaggcggtccagttggtcttgctgtgacaggagtgacacttttaaccgaagctggtacaaagtattatgacaatctgaagaaaagggttcttccatcgactattgactttggtgagggagtatcgaaggctactgcaaaagctgtgaatgcatatgaagatatgaatattaaagttacggcaaagctcaatacccttcgagcaacaaatacaaagatcaccaaggatattgccgatgatgtgacaaagcagttcactgaaatgggaaactcgctgaaaaagggatttcaaacaagtgctgattccgccaccaaggtgttacaggaattttatgcttcaaatgataaaacgtcagataaagaagcagctaaaatcctcaataaaatcaaaaatggaaatgataagaaacagaaggaaatacaaggttatgtggatcgggtaaatgaaatttacagaaccgcggctgaagaaaatcgaaaaacaacagcgaaggaaaacagagaaatagcagagatacaggggaaaatgttggctcaaatggagacggctcttactcgaagcaaggacgagcaaattaaaatttcaaggaagctgaaggaagaatcctctaacttatctgctaaacaggctgctgctgttgtgaaaaatagtaataaagcaaaagaaaaaacaataaaggcggccgaaaagcagcgtgattccgttattgctgctgccgatgatcagtattatgtaaaaggcacaatttcaaagaaagagcacgatgacacagttggaaaagcaaaaagccaagccaaaaaaacaattaagcaagcagaaaagacgcataaaggtgtagtcaaggaggcaaagcttcaagcttatggacatattgatcaagttgattttgagacaggtgaagtccttggtaaatgggatatttttgttctcgacttagctggtgttgttaataagattaccggtggaattaacacggttcttgaatttatgcatatcccaaccattccagagtggaagcctaaaggttacaatggccggtctgaaaaaatgcaaattgcgccaggagctgcatatgcgaaaggtacagactttcaccctggaggaaaggcgcttgttggtgaaaaaggatgggaactggcccatacaccaggcatcggaatgtatgtagtcggtatgggcggcccgcaaatttgggacctaccgcgcggcacatctgtacttcctcatgatcagtcaaaagagcttgcagcttcggggcttcctggatatgcaggcggggtcggcgacttttttaaaaaagccgctgaaggctctaagaaaatggtcaatggagctatttctttcggaaaaggtgttgtggacaaagtcggggatgttagttcaagcgctatggacttgataatcaacggcccaggaaaattaattaaaaaactgtttagcggcctgatcccgtataaatcgggaaaaggtattgattcgtttggaaccggcatactcaagactttaaaaaatggtgcagctcaatttttgaaaggagtcatgccagagccgtccacatttaaagggaccggaggaacgaaagccgtaaaccaatgggttacagaggctgttggtatagcaggggtgccactttcatggattccagggcttgtgaccatcgccatgaaggaaagcggcggaaatccaaatgctatcaacttatgggattccaatgcgaaagcaggccatccttcacaggggttgatgcagacgatcccgagcacttttaacgccaataagtttcctggacataataacattttgaatccgatagataatacgttggctgcaattaactatatcaagcgcagatatggagacattagcaatcatccaggcttaaaatcaatggcccgaggtggcggctatgttggttatgcaaaaggtggtatctcacctggacggggtggctcaaaatgggccatcttaaatgaacgagggtatgatgaaacaacgatcacggaagatccttcatacagggagcgtaatattgggctatgggctcggattggtagcaaacttggcgtacttccggatttacaggatgggatgatttcaaaagcactactcctgcttcaaaaagtttcggaaaagcccaaacagcagctaccacctaatgatttttctgtagacatcagccgtgttgtaaagaatcaagaaaaacaaatcagtatgatggcaaagcaaattgattttctaaataaaaatgtgcagctcttgcagcgacttttactaaaagacaacaacacatatcttgatggcagaaaaattgaccaatcagccggggatcggtttactcgaacttcattcataaacggggtgagatag

SEQ ID NO: 3446 - DNA, 708 bp, Bacillus licheniformis
atggcgcaacctatcggaaatatgattgttaaagtaggccttgatgatactggctttaatcgtggaatcgaaggtttaaagcggcaaatgcgtttagcgaattcggaaatgaaagcatccggtgcagtttataaagctgcgggcaatcagtctaagtttcttcaatcgcaaatagaaggactcaataataaataccgcatacaaggccgtttagttgatgagcatcgggcaaaatacaataagctggtcagagaaaaagggctggataatcgagaaacacagatacaaggccgtcggctgaatgatgcaattgccgttcatcaaagccttggaaatgaactgcaacgagtaacaaaacaatttgaaaataccacaaacagcacccggcgagcagcgagtgttttttctgtgtttaagcgcaattcaggagaagtatctaaagagttaaacgcggtgtatcaagcagcctcaaccgctggaaaggctctttctgctctcggtgcagcgggatcgtttgggattggaatgactgttaaagctgctgctgattttgaaaaagcgatgagccgtgtcggtgctttagcaaatgctacaaacgaccagatggctgatcttacaaaaacagcccgtcatttaggggcgacaactcaatatactgatggccaagttgcagaaggtatgcagtatcttgcgatggccggatattaa

SEQ ID NO: 3447 - DNA, 99 bp, Bacillus licheniformis
atgactgaaattgacgagatggatatttaccattacttagaagtcctggctcatgaaaataaaccaaaagttgttccaattgatcaaatatttttctaa

SEQ ID NO: 3448 - DNA, 363 bp, Bacillus licheniformis
atggctcaaaaacatatttctattaaattatggtttgaagaagaaggaaaatataaaacgtttattgctccccgtacaaacacaaagacgttgtttgaagccttaaagttagatgagacagcttctaaagcaaaaaatcttaaagaagtactcaaaagccttgaggatcgtatgaaattcattgtacgggtatttcacaatcaatttactttagaggattttcaagaaggattacagtcctttgaagtttccgatgaagtaagacgaattatgggagaaatcatgggctatgaagaaccagatgaggaagaagattttttgccagcagcggaaacggaggacttacagttgaaaacggaatag

SEQ ID NO: 3449 - DNA, 618 bp, Bacillus licheniformis
atgcctgaatacagttcagttaccggattggaaggcgttaaatttgcgcctttaaaaaaggaaaatggcttttatgtggctacaaaaattattgattacccttacgcaattaacgcgaaggtcaatacggaaacatcaacagaaaagcagtatgcagacaacaaactggtggatatggctgtcacgactggttccacaaaattggagcttgaaatgcgggatctgccaatggaaattttggaggaattgtttgggatagaagaaacagacgggatctatatgttcaaaaagaatgttatcgcgccatgggttgcgatgtctttctatgggccaaaagcgaacggcaagaatcgccatgtaggcttagtgaaagggcgtttttctcttccggatgatgaatggaaaacaaaagaagaaaagactgattttcagacggtcaaactttctgctgaatttatggagcgcgaacaagacaacgcctataaagtattggctgatgaggacgcaccgaatttcaatttggacaagttttatgaaaaagtgtttggcaatgcttataaaaatccggactcaggctctgataataaatccagcgtagacattggaaagacagtataa

SEQ ID NO: 3450 - DNA, 384 bp, Bacillus licheniformis
atgaatgtagcggaaagagctttgcaattaaaaaataaagtatttgaagcgctggaaactgatccggcgcttttattattggctgatcctgcaaacatttttgaacttgcggtgccgattggcatcaaaagcaaaccagcttatatcgtcgtacaggaattggactacagaactaccaagtgggctgatggaaagccgatcaaggacagcgctgtctatcaaattgatgtatacaacgattcatcctgcgatcagattttggctgccgttataggggtcatgaatagaatggattttcaaacaggaattttaatcaatgattttttaaaagatgagggtcttattcggaagggacgccgatttgaggccaatattttaatataa

SEQ ID NO: 3451 - DNA, 399 bp, Bacillus licheniformis
atgaaatttgaaatagaaatgcagggctttaaagaattagattcatatttatcctcactcgcaaggaaggatgaaaaaataaataaagctactgtaaaagctgggggcgctgttcttgcgaaggaaattaaaaagaatgctccccgttccaatattggggggagccatccccacattgatgaagatattatcgttggtaatcgtacgagaaaggaccccgatggtgagatatatgcagtggttggtcctacaaaagatacgaagttccgtgtccacttgcctgaattcggaaccattcatcagccggctaacccgtctattcagcggagtatgctaagtgccaatgagaggatgcttcaggcgatggcaagcgttataaaaagagggtacaagctatga

SEQ ID NO: 3452 - DNA, 309 bp, Bacillus licheniformis
atgctgaatgacatgcgatatcgaatcaagtttcaaaagaaaaaagaaggcggccgtctccctgtggaaggtgactatgaaacggtcgttgaatgctgggcaaaagctgaaggattaaaaggccgggaatattatgcggccgctgccgtcaagaaggaagaaacagtaaaatttacgatccgacaccgtgaaggtattggtaaacatatgcggattctttttcaaaaccaatcatatgaaatagaatctatcataccgaactattcccggaaaaatttcaccacaattagggcaaaggcggtggaataa

SEQ ID NO: 3453 - DNA, 303 bp, Bacillus licheniformis
atgactgaaacccaacaaaaagagcttgaagaggcgaaaaaattcctccgggtcgatggtgatctggaggatgatttaattcttgggtttatcgcttcagcaaaagaatacattacatccgcaacgggcctgaaatttcctaataattcagctcgcgcagatttgtgtgtaaaggcttttgtaactcactggtatgaaaaccgtgaaatagctggcacaacttcaaaccttgatggagttctgacaacgttgatcaatcaattaaaatacacagtttcggagactgatgccgatgctgaatga

SEQ ID NO: 3454 - DNA, 426 bp, Bacillus licheniformis
atggcagatcaatttttaaaccaaagtaacggcgtattcacttctgcggaggacgatggcacgggcaaaccggtaacgcccgtttatttgaaggacaacagcgaagaaaatcctttatacatcaaaggaatgcaaggggaacctggtccgcaggggccacaaggaccaaaaggggacaagggagatactggcccacaaggcccacaaggagaaccaggaccccagggaccaaaaggtgacaaaggtgatcctgctgtcattgaagaaaaaagcattacccatgaaatgcttggtgaaaaggtagtaagaagcaacaacgtaggaactggtagcatcatgatggacaacttaaacagcgaagtaaaggccatttttgaagacctacaaaagcaaattgatgaattaaaaggcggaacatctagttaa

SEQ ID NO: 3455 - DNA, 1284 bp, Bacillus licheniformis
ttgaaacagaaaaagttattgagacttgatattcaattttttgccgggggcggaatgtccaaaaaagaacgagaattgcgccagaccttggcggaaaaacgtacaagaattgaagcactgaccgatgaagggaaaatggacgaagccaaaaaactgcttgctgaggctcaacaaattaaagatcaaattcaaacatatgaggatttacgaaacatgcaggtttcatatgcacaagaagagccgcagcaagatccagaggcaaagaacccgcaacagccaacggatgatatcgccaaaacagatgcgaaaaatcatgctcagctttttgcatctgcccttagaacaggcaaagtaccacagcctcttgccgcgatgaaagaaggtgtggatgaggacggcgggcttattgtaccgcaggatatctccacgaaaataaatgaaaaacgacgtcaatttgatacgttggcaaatctcgtcgatgtcattccggtatcaacaaacaaagggtcaagggttcttgaaaaactagcggatatcaccccgttagtaaatcttgaggaattagcagatattgaagaattagagaaccctaaatttgaaaacataaagtatagcattaaagactatgccgggattttggttctttctaatgatttgcttgcagatacacaagaagcacttttgcagtacctttctaattggcttgccaaaaagtcggccgtgacccgcaatacgttgattcttaatcaattaggaacacttgcaaaaaccacagtatcgaagcaggacgacattaaagacattctcaatgtcaaacttgatccggctattaatgccacgactaaagttgtcacgaaccaatcaggatttaacgtgttagataaactgaaagacgctttcggccgttacctgcttcagccgaaccctactgatccaactaaaaaattattgttcggtaagccggtatccgtcatttctgataagtatttgccaaacggcggtacaaaaacgactccaaaatatccattaatcattggagaccttaaagaagctgtcaaactctttgatcgtcagcaatattccattttaacgacaaatgtcggtggtaaagcattctaccgtaactctacagatatgcgaatcattgaacgtgaggacgttgtactttgggacacggatgctgttgtttacgcggaatttgcatctattaaagacgctgttcccgacaatgaaactccaagtaccggcgacacagaagataaatcagttgacgttggaaaataa

SEQ ID NO: 3456 - DNA, 732 bp, Bacillus licheniformis
atggcaacggaacagaagaagaaaaacaagtattggaacatgaaggttctgaatgattcgactgctgaaatcacgctttacggttctattactggcgaaggatggtttagcgagagctcgtccaaggcctttcaggctgagttgaaaagtttaggtgacgtgagctctattgatttgtacattaattcgcccggtggggatgttttcgaggggcaggctattcattcgatgcttcagcgtcacaaggcaaaaatcaatgtctatgtggatgcactggctggaagtattgcttctgtcattgcaatggccggcgataaaattacgatgccaagtaacgccatgatgatgattcacaacccatacatggggatggtcgggaatgccgcggaattccggaaggcagccgatgatctggataagattactgaaagtatcgtttccacatatcttgcgaaagcaggagacaaactggacgacgggactttacgccagctgctggatgaggaaacctggctcaccgccgatgaagctttaaattatggcttgatcgatgaggtttcagagtcaaaggatgtagcagcctgcattgatcatcaggtactggcacattttaaacatgttccaggcaaaattgttgctcaatctactgctgaaagtccggctgaagaaactaagccggatgaattactaaaacaaaagatcaatatgaaacttgaactcttaaatctttaa

SEQ ID NO: 3457 - DNA, 1311 bp, Bacillus licheniformis
atgctattaagccgtttaaagagcggaataaaaaatgaaattgctgaagaggatagcggttcccttctccatccggttgattggttcaaaaatatttttgctggatctgaaagcgcatctggtgaaagggtatcaacaaaaacggccgttcttcatccggatgtatatgcctgtgtgattgttttggcggatgatattgcgaaactgccgattaaactttttcagaatcaaaatggaaacatacaacaggttcaaaataaagtcagcgatatcattctgaacaaagtcaatgactatatgacaagctttgtgtggaagcggcttttggttacaaggctttgcacttggggaaacagctacaaccttttactttttgataaagacggaaatgtgacgggtatcagaccattggatccggaagcaaccaacacaaatattgatcccgataacgggcgtgtttggtactccacaacgattgacggcagataccgtgagtttttttatgaagaggtgctgcattttaaaaacctgtctcttgacggaattgtggggcaaactccgatttcagttattcgggacaatatagggtcaaatagagctgccacaaaattcaacgcgaaattttacaagaatggcggtgcaccgttcggtgttgttaaagcgccgacccttttagatcgaaaaagtaaacaaattcttagagaagactgggagcgggtgaatgcggggcagtctattgcagttttagacgccgggcttgattattcacaggtaaccatgcctatgaaagatgcccaatttattgaatcgatgaaatggaatcgccaacagattgcatcgatttataaggtgcctccgcataaaataggtgagctggacagggcaacattttcaaatattgagcaacaatccttagattatgtcaaaaccactttacagccaatcgtcacaaatattgaacaagagttaaacgataaggttttgacagagaagcagcagggagctggctattactttaaatttaacctggaatcagagcttcgcggggatagtaaatcacgtgctgaattttataaaacgatgcaaagcgtaggcgcctttagcgtcaatactattcttcaaaaagaggacatgacaggtatcggggagatcggcgatgagcattatggaaacttaaaccttgttcccctttcaattatgaaagagtatcaacttagcaaggtcaaacggtcttcaaatcgcctgaaagggggtgatggcaacggaacagaagaagaaaaacaagtattggaacatgaaggttctgaatga

SEQ ID NO: 3458 - DNA, 192 bp, Bacillus licheniformis
ttgaaaattttaaaaaccttacagctatttttagaggatatcttgcttattgcgggcatggtattcatttcaatagccatatatcgaataaacgtaaacgcgggtttaatcgcaaccggtgtttttttattttctcttgccagcttggcaggatttgttcgtcaaaaaaataaggatgagggagggaaatag

SEQ ID NO: 3459 - DNA, 1710 bp, Bacillus licheniformis
atgaatacaattaaacagtttatgattgattactcgcgcgatgtgatatcgggcgagattgttgcgtgcgaaaagcatatatgggcttgtcagcggtttttaaatgatattaaaagagaaggaacaagagagtttccttacgtgtttgacgatgaaaaagcccgtcgctttctttactggatgacgcaattcaaacatacaaaagggccattagctggtgaaaacatagttccagatcgtattcaaatctttattttcggtaatgtttatggctggattcataaagatacaggataccgccgttttacaaaagtgtattggcaggttggccgtaaaaatgcaaagactcagagtctagcatgtgttgcatcctatgaagcaatggcaaacaatgagaaaatgtctgaagtttatataggggcaacaaagacggagcaggctcaaatatgttggaaggagataaaagcccaaatagaagggtgcgaacttctaaacaaacctgagcaaaaatacaggattgcatacagcaccattgaacacccaaaaacaaattcaaccatcaaagctttatctaaagatgcagggaagaccggtgacggatttaacccgcaatgcggcataatcgatgaatatcatgctcataaaacgtcagagatttacgatatcctggagtcggggatgggcgcaagaacgcagccgatcatggttattatcacgacagcggggcacgagttaaacaatccggcctatcgtgtggagtatgattatgtttcacgtcttctcgatccaaacaaagtagagacaaatgaacagtattttgtcatggtgaacgaaatagataaagacgatgacataaaggatgaaaggaattggataaaggctaatccgatattagcttctcatgaagttgggaaaaaatatttgcgagatcgtcttgaaatggctctggctgttcctgaaaagatgagggatttcctgaccaagaatatgaatgtttgggttaatatgcgcgacggtggatacatggatatgcaggcttggaaggattgcggatctgatcagttccctgatttatccggccgtgagtgctatgtagggattgacttgtcaaaacgaattgacctgacagctgtctcgtttattttcccattggataatgggagctttgctgtggatagtcacggttttatgcctgaagataccttctatgagcgcatgaagacagataacgtgccgtatgatttgtggaaggaaaagaactggttaaccgtcaccgacggcgctgttgtcgattatgactatatcagggcttacattaaaaaaatggagaaagagaaaggctggcggatcaaagaaattgcctatgacccgtataatgctacacagtttgcccaacagatggaggcagacggatatgtgatgattgaaattcggcagggtgttgccacactttcagagcctacgaaagacttccgcgaaaaagtgaaggcgaaaaagatcatccataataaaaacgatctgctgacttgggctatggggaacgccgttacaaaagtggatgcccaggaaaatataatgctggataagtccaagtccacacaacggattgacccggcagccgcgcttattaatgcacatgttcgggcttcacaaattgatacggcgatcgacttaaacgcttatattcagtctggatctttcagtctgtag

SEQ ID NO: 3460 - DNA, 516 bp, Bacillus licheniformis
atgccgagacctgcaaaatccgcagcccttcaattaatacagggcaatccaaataaaaagaatacgaaagagcttgcagccagggccaaacatgaaaaaaagttgaaaatgcgctctgaaaatatcaaaccgcctacctggctggataaggtggctaaaaaagaatttaagcggattgctgctttattatctgaggtggaaattatgacggaggcggatatcagcatgttagccgcctattgtaatgcctattctcagtacatttctattacaaaaattattgaggaagacggcatcatgattcatacagagggtcaaggtgaaaacgggaagccggtcaagttgattggagaagagcatcccctactgaaacgacagaaaaacttctatgatcaaatgaaatcggctgctaatgatttcggactcacaccgtctgcacgtgccaagctcgcgatcacgaaaacccaggaagaacgggagaagactttagcagaaaaggagtttagtaatgtatga

SEQ ID NO: 3461 - DNA, 375 bp, Bacillus licheniformis
atgccgcctaaaccattaagggagtgcaaggcctatgggtgtaaggcccttacccgagagggctactgccctgaccataagcacgtccagcaggaggaaacgaaacattacaacaaacattcaagaaacaaaacattaacaagtttttataaatcaacagattggaaacgaacaagagaacttgttttgcttcgagacaatcgtctttgccagcgatgcttgagagaacatcgattcactcctgccgacatggtccatcatattgtggaggtgaagcaggactggtccaagcgtttagacttttcaaaccttgaaagtctctgcaatgcttgccataacaaggttcacggcgaccgaagcaagtcggtcaagtag

SEQ ID NO: 3462 - DNA, 225 bp, Bacillus licheniformis
atgtttcattgcaaaccaaatgtgatgccgccaattgtacacccgactaattgttgtcaaactcatactttttctaaaacaattgtgccgcatattcatccgcagcatataacaaatgtgcatcataagcatttccagcatgtgcatcaatatccacacacttattctagttacgatcctgttacacactctcatactcattgtggtaaaccatgttgtaactag

SEQ ID NO: 3463 - DNA, 381 bp, Bacillus licheniformis
atgtcaaaggaacagctatcttttctcgatgatgtggacgaaaaagccgtccggaaaatagtcatcaaagaattgaaaaattaccgcgcgctcaaagtccaattagagaataaaaaagaatgttcatctgccggctttaacattttcccttccctccgggattcatttaccgttaatgaactcaaagtcaaacagatggaacgggctttacaaaacagcttggacgatgaagaacgtttgattatcgaaaagaaatacctgacggctgccagggtgaaagacatcaatatttatatggaactcggcatgaaaaaggatacctattatgaaataaagcagcgggcaatctgccgtattgcaacagcactcggaattatctga

SEQ ID NO: 3464 - DNA, 126 bp, Bacillus licheniformis
ttgtggaggaaaactaggggggcaatcatgatatatgtgattatagggatcctcattcttgccgcttcattcatctggatggagattgcagaaagacggattcaggaatgggaaaaagaaaaatga

SEQ ID NO: 3465 - DNA, 273 bp, Bacillus licheniformis
atgaaaaaagctattgccacaatcgtaattctgctgcttgtcgcgttggcggcaggttgtgagtcatgggatagaatggtgaaggattttaacgcatccaataatggattagaacggacggcaactgtctacgatcagaacggaaataagatcaaaacatacaaaggcaaatttgatgttgaagtcaatgactatgggaataaggtgaaattcgacctggacggaaaacgaatcatgatcagcaatgcagttgtgattgtggaggaaaactag

SEQ ID NO: 3466 - DNA, 514 bp, Bacillus licheniformis
atggcatttgtaggttttgaagaatcacaagaggtgcggcagttggccgaaagtttaatcgataagcatcacccacatttaaaagatgaagaaacacattggtttttacatccgggaaggtaacaacaaatgggccgggaaggcaaaaaaatgcacggcctttgagcgccatatgaccgattacatgctttttgtattcatcaataaggaagcctggaagacgatgaacccagagcagcgcgccgccctggtcgatcatgagctttgtcattttacccgcgcggaatgggaggaaccggatccgaatgactcaagcaaatgggttactatgtacgggcccgcagaagatcccgacagctgggggatccgcgagcatgacgttgaagagttttcggaaatcattgagcgtcacggtctttgggaaaaagggattgaatcatttgctgctgccgtccgagaggctgactatcaaatgaatattgatgatgtgaaaagacttcaaagggtgaaatga

SEQ ID NO: 3467 - DNA, 707 bp, Bacillus licheniformis
atgacgattattcactataactattcggatacagaattaaaaaatattctcgacagcatgatcattattgtggatacgagggagcagaagaaccagcatgttcttgactatctccgcaaaaagaacgtatctatcaaattcaaagggatgaagacgggcgactattctgccatgatcccgaaaaacgaggaatacgggattagccgggacatgtatttgaacgctgctatcgaacggaaaaatggagttgatgagctggttcaatccattaaggaccgttctcggtttgaaaatgaattgatccgtgcagccaaacaccccttcactcttcttgtggaggatctggaaggctaccaaaaaatattgaacggaaaatatcgctcacaatataagccgcaatctttgcttggcagcttaaaaacgtttgaagtccgttacaatttctcaaccgtttttattaatccgagcgcgaccggaaactatatctatcaccattttcattatatggcccgggagctgttaaaggggggccttgtgtgaatgaattaatgaaggccctttattgtgaaaggaaaaaggacgagcttaaagcgcggctgcttaaaatggggtattttaaaacgcctgacggccggcagctgtacgagctttcattggctgaattagacgcaatattcaaaaagaaattgattgaaaggggaaaatga

SEQ ID NO: 3468 - DNA, 456 bp, Bacillus licheniformis
ttgtcaaaggtgagggaaatgcacccaaaacaaatttgtgaagaccttgcctttttaggttcacctttagttctggatggggatgacctttatattgagcatccggagaacgtctatccagaacttgtggaatttgttcagtcacataaaaaacggatcatccagtatttaaaaggtgaatactcagtgcaggatcataaagtcaaacagaccattgataaaatcatcaattattttatgggcatagatcaagaaatgaatccaaaaatagacgactggttcaatcatgagtgggatgcggcaatcaaagccgcgagattgcttgttctattttgggagaacggctggagagatctgaacagctccgttgcgaattttgaggatgaagaaacggacaaactctctttagaaatctatgaaagggccatgtcgtactttaaggggaagaaagcatga

SEQ ID NO: 3469 - DNA, 372 bp, Bacillus licheniformis
gtgaattcaataatgaaaatagatgaaatgaccttaacggaaaaaaataaattgtatatcaatcaaaaaagagaaattgataggttgaacaaagtcattgaagacttagaaaaacaactaagtgttcggaatgaaaatgatgaacaatcattaatatcaacatttttgaaaaagtattcctctaaaatttccaaacaacagattgaggctaaacaactttatcaagaatatgaaaagtgggtcaaaagcttattactaggcaaaagaaatttttataatgttgtagctacctatggttatgaattcaaacgaggtaaaggaaataagctctttgtcaaaggtgagggaaatgcacccaaaacaaatttgtga

SEQ ID NO: 3470 - DNA, 2418 bp, Bacillus licheniformis
atgtacgaatttaaaaacataccgcaagagctaaaaaacgcccctcagtggattttatggcgttccgaagaacgtgacggtaagaaaacaaaagtgccgtaccagattgacggcagcatggctcaatccagtaataaaagaacctggtcgacattcccgaccgttttgaaattctataacgatcgagattatgacgggatcggcttcatgttttcaaaagatgatccgttcatcggcatagacatagatcattgtgtggaggacggtgtcttgtccccattcgctgaggaaatcgttcaggccattagcagttacaccgaatattcacccagcggcaaaggagtccacatcatcacaaaaggtaagatcccattgcgggggccgggcacaggtaggaaaaatcctgaacttgggctggaagtataccgccatggccgttatttcacctttaccggcaatagtctcgggatcggggccgttgaagaacgaacggacgagctcaaagagcttttcgagaaatatttgaaggataaaaaagaagaatcgaaaccttccaaactccctgctgcttcatcccgtgatatgagcaacctctctaataaggagatatgggaaaggatgttcaacagcaagaacgggaagagcattcaggatctgtttaacggtcatctgataaatgatgatcactcggccacagatatggctttgtgtaatcatttggcattctggacggataaggatcccgcaaaaatggattcaatgtttcgcgaatcaggtttgttccgggagaaatgggatcggcagcattcatccgatggcgctacatatggagaaatgaccattgccgcggccgtttattctactcatacgacaatttctgatttgctggaagagcagcaggaacagccgtatgaaatatatatttcccatcccgaaaattctcaagttgaggataccgaagagatcattgacactccgccggcgtttcatttgacggagctcggcaacgctgaacgaattgtctactaccacggaaagaatattcgatattgtaacgagcttgactggctgatctggaacggcaagcgatgggaagaagacagcaaacggaaaattgaagctatcaccgccaagacattacgggcgttgtacggcgaggctaaggccacagaagacaaattccgaaaaaagcagctgaacgattgggcgaagaaatgcgagcgccgcaacatacggatgaacacaattttagatgttcggccaatggtttcagtgaggaagcaggaactggattcccacaaatatctttttaattgcgataacggtgtgatcgatctaaaaacaggcgaacttctgccgcatgatcgggatctgcttttcacgaaaatatctcctatctcttatcaaactgatgccgactgcccgaactggaaaactttcttggaaagtatttttatagatgaccagggcacgccaaactatgaaattattgatttcatgcaaaaggcaattggctattcgctgaccggggacaccacagaacaggtcatgttctttctatttggaaatggtcggaatggtaaatcaacttttatcaatactgttcagcacctgttcggggactatgggcggcagacaaacagcgacaccttcataaagaagaaaaatgacagcgccataaacaatgacattgccaggttggacggcgcccggtttgtgtcggctgtcgagagtgaagagggacagcagctgtctgaatcgttggtgaagcagatcactggcggagaaaagatgtcagcgcgttttcttcgccaggaatactttgagtttacaccggaatttaaagtcttctttaccacaaaccataaaccgatcgtgaaaggcagcgatgaaggtatttggcgccggatccggctgattccgtttactgtcacgattccaaaagaaaaagtagacaagaagctgccgcagaaactggctgcagaaatgcctgggatccttcgctgggctgttgagggctgtttgaagtggcagaaggaaggcctgggagaaccggaagcgatcaagaaggcaacagatggctatcgggaggatatggacattctcggtccattcatggaagaaagatgcatccaacatccgaaggccaaggtagaggccaaggagctctataaagattacaaagactggtgttttgaaaatgacgaaattgaactgaagaaccgggctttttatcggcaactcgaaattcgtggatttaaaaaatatcgcggcaactataacaaaaattattttgatgggatcggtttaataaaagaaaaccgagatttgcataagcaattaaatcctttgaaacagaggcagaatccatcggaattaaaaagtaatgtcacaagtattcaaagaaaaaaattataa

SEQ ID NO: 3471 - DNA, 438 bp, Bacillus licheniformis
atgtttacagtagaccacagcaaaggtgaagcttttgaaccgattaaaccaggagaatacgaagcgacagttatcaactttgaagccaaaacggctgcatccggaaatgagcgccttgtcgtagattatgaaattcgttctgacgttgagcagccatgccagggccagaaaattctatacgacaatttcaccgttacggaaaatgcaatgtggagatttcaccaagcatcaaaggccgcgggttttccaaacggaatgcaatttaaggatcatatcgaatgggccaaggcgtttctgaataaaccggttcgcctgcttgtcggggaaagagaacataacggcaagaaatatccagaagtcaaagcgtttaagccgtcagaagcgccagcaccggaaaccgaaccaattaatatcagtgacgatgatataccgttttga

SEQ ID NO: 3472 - DNA, 933 bp, Bacillus licheniformis
atgtttcaagtcacaaacgcacagcgtgaaaaagaaaaggcaattgtcggctttatcgggccgagtggatccggaaagactgccggcgccctgctagttgcttacggaatgatgcgggaagcatacccggatgcaagtgataaggaagtctggtcaaagattggtgttgtggatactgagcaccgtcgcgccaaactgtatgcaaacttgcaatttgatgatgtacggattggcagcttcaagcacatcgattttacaccgccttataccacagaacggtatcaaatggctcttgaagcaattaaggaagccggtgcagaagttgtcataattgactcgctttcccacaattgggcgggggaaggtggcatcgttgaaaaacatggggaaatgcaaggtaactcatttcaaaactggggtaaacttgcgcccgaaactacgaaattaataaaaacgttaacgcaaaatgacgttcacattctggcgacgcttcggaccaaaactgagtacgttgttgagccgaacagtgaggggaaaatggcgccgcgtaaggtcgggaccaagcctgtgcaaaaagacgaaatggagtatgaattcatgctcaatttcaatattggtattgatcatttggcggaaacatcaaaagataatacccgcatgtttgaaggatcttcttttaagctcaatccagaagtcggccgcaagctttaccaatggcttgagctcggtattgacgtgaaagcagaggaagaagccgaacggattcgattgattgatgaaattaaaacaatcgtcgccggcaacgaaacagccgcccagatgattgaagaatttcagatcaaagcaaataaaaaacttgatcaatggactattaagttggcatctgccgcacttgatagattacaagctttaaagactaaggaggaaaaataa

SEQ ID NO: 3473 - DNA, 558 bp, Bacillus licheniformis
atgaatcctttacaggcgtttgaactaaacgagatttcaaataatagcctgcagcaggagagccgtccacagtttgagattacggacatgaatagtctaaattgggcgtttcggaaaatagctgctttaaagacacaggaaaaagaaatcaaggctctggcggcaacggaaaggcagcgtatcgatgaatgggaaactcaggagctaaaacctctcgcggacaatctggcgttctttgaaaaactggtcagcgtttatcactcaaagcagctcgttcaggatccaaaagcaaaaacactttccacaccttacggtaagtcaaaaagccgcacaattaaagagcagcctaagccaaccgataaggatcagcttctcaagcatgtgaaagaggccggtctcactgaatttatcaaagaagatgtcaaatggggcgaccttaaaaaatctctgtccattaaagaggtggacggcaaaaaggttgtcgttgatgaaaatggacaagttgttccgggcgtagaaatagaacctgcctccacaagcttcaaagtggaggtgtaa

SEQ ID NO: 3474 - DNA, 243 bp, Bacillus licheniformis
atggatcaaaaacagattgactcagtattgcaccttgtcgaatatgcattgagaaatggtgggaggattgacattgtctatcactgtaaaaatgaaaaggcagctcttcaaaacgtgaaagatgccgctgaaaatttgaacacagagattaatcagcgttcctatgataatagcttttggtacgagactgaaattaacaggaaaattcaaatgactgcattttatccgtcagcttatgaataa

SEQ ID NO: 3475 - DNA, 111 bp, Bacillus licheniformis
atgaatatcgaacatccaatgatcacggagatcaaccgttacggatatcctttggaatatttgaaagacgaggtagaaaaggaggatgaaaatggatcaaaaacagattga

SEQ ID NO: 3476 - DNA, 267 bp, Bacillus licheniformis
atgaacctaaaccgatttctaaaagctgaccgtgaaaaggcggaaaggctgttcatttcaacgcgagatcttatttcggaattgcctgccgcgatcgaggaacatgattttgaaggatgtgtagaaattgctgcaacaatcattttaaattgcaaggatcttaaacggatggagcacccggaacaggttgttcggcttcacgaaatcgcgtccaaatttgcgaacaggggattaaacgtttcaactgtaaggagatcgtttcaatga

SEQ ID NO: 3477 - DNA, 381 bp, Bacillus licheniformis
atgaaactaaattatgattgtgtccgctcaattcttctagaattagaggaaaatttaactcttaacgatggcgtcactttatatcagctcaaagattttgagacattcaaagagtatggctatgaaacttccgtttacgctttaaccaagttaatcgaagctgactttttaaacggttcggtttcgcgcgcagacaataagattgactatattggtgttggctctattacttgggatggacatcaatttttagacaacattcgtgacaatgctgtttggtctaaaacgaaagatgccgttaagtcgttatcaagcgtttccttgtccatactttcaaatgtcggagaaagcatcacgaaaaagcttatcggtttagaataa

SEQ ID NO: 3478 - DNA, 171 bp, Bacillus licheniformis
atgacaaataaaaatattattgtttattcaaaaaaagatggcgtcaacagattattatctatcgacaccaacgatttgatttctttgacaaaattcattgaagatcattatccgaaagagaaagattttatctacgccttagtgcaaggtgtagaaattaaattattctaa

SEQ ID NO: 3479 - DNA, 555 bp, Bacillus licheniformis
atgaaaacacaactcaaagtgatcgagggtactcgaaagccagaccactactcaatctaccacaggatgtttcaaaaagcggtaattgagagtgcgagaaaaatacaaagaactaatcaaattgacacagacgatttcaagaaaatcgcgtttgctggaatcaagatgatcaacctggagaaggctagatcacgccgtttcctagaagtaaagctgcgtttaattgagttcattcaaaccgtaataggaaagcttacacccggagaattgatgcagatgttccccatccgtaagcagtatgatggtgaaaagtttggaatgaaagactatttcagtaccatgcatgctgtcaaagaaaaaggaatagacaattgcataggaacggaagaagaggtattcgatttcctttgggattatcagaatccggatatcactttattcatggttaccttagtatcgacagttagtgatttaggaagagcctcaggacaaaaaagtctgtttgaagaattcgctgataaaaacgacattgctatagatgttatgacccattga

SEQ ID NO: 3480 - DNA, 795 bp, Bacillus licheniformis
atgaatctatcaattattgaaaagaataaccaacgtgttttaacaacaacccagttggcagaaagctatgggacgaataaccgtcggatctccgagaattttaaacgtaacataaatcgctttaaagaagggaaacatttttactctttgcaagggaaggaaaaacgggattttatcaaccatacgcaaattgaggatggttcaaaaaacgcccaaacgctctacctttggacggaaaaaggtgcatggcttcatgcgaagtcactaaataccgatcaagcctgggacgcttatgaaatgcttgtggatgagtattacaacgtcaagcaaactcaaattgatacatcccagttaagccctgaactacaaatgttcaagcaaatttttgattcagtagcccgtacacaactaaagcagcaggaacaagacaaacgccttgatgctgttgaaaagaagcaagacaacattaaagaagttctttcgcttaatcctactgaatggaaaaagaaagtgaacaagatcatcaatgctattgcgctatcaaaaggcggtttccaagcctatgcagatgttaggaaagaaagttatcaattgttggaagatagagcgaggtgtcgtttatccattaggcttacgaataagaaatccgaaatggccttaaacggtgtgcctaagtcaaaaatagacaaggtaaacaaaatggacgttattggcgatgatgctcgcttgactgaaatttatctagcgatcgtgaaggaaatggccattaagtacggtgtgggtgaggcgtcatga

SEQ ID NO: 3481 - DNA, 639 bp, Bacillus licheniformis
atgacagtaggagaaagaataagaagtagaagaaaacaactaaatatgtcagttgaccagcttgcccaaaaactgaaaaaaaacagggcaacggtttacaggtatgaaagtaatgaaattgacaacatgcccttgacagtactagaacccttagcaaaggcattgaatgttactcctgcatacctaatgggatgggaaagcacagaacctgttcagctatcaaccaaatacccatactacccgataggcatatccgccggccttcctttatgcatagacagcatagatgagaacaatgtggagtacatcttaataccggacaaccttatgggcaaatgggcaggtaggaaagacatctttatgatgcggattaatggcgatagcatgaataggattatgccccacgactcactgattgcagtaaggcctgtaccattatccaatctacgcgatggagatatagtggtttacagtgacggcggggattatgctgtcaagagattttaccgcagggaagataaagttatatttaggcctgattcttccgatttaaattttacggattacgtaacatctgctgataacatcgatttaagaattcacggaaaagtagttctatatatcgcagaattagattaa

SEQ ID NO: 3482 - DNA, 1095 bp, Bacillus licheniformis
atgcctgtctataaagacaaggaaaggggaacatattattttatcatatcctatacaaacagaaatggagaatacaaacagataaaaagaagaggatttaaatcaagcggagaagcgaagagggctgaagcagaaacccttttacgactagaaactgacgacggagaaaatgaagataatccaacttttgaatttgtcgcaaaagaatacttgaaatggtacaaaaaaagaagaaaggcatcatcatatttaaaaacaagtagcattataaatactcacttgataccaaggttcgggagcaagaaaattaacaacattcgttcaagggacataatgcgttttcagaatgatttgcttgatagatatgccgttgcgcacgtcaaaaagatacatcaagttttatcggctgtatttaactttgcgattaaacaagagtacacaaaagataatccagcacgtttagcaggaaatgtggatatagaagaagataaacacatcaattattggacgttagacgagtttaaagcgtttattcaacacgtagatgatcagttatattatgcactttttatgacactctattatagcggtatgcgaaagggagagttattagctctcacatggggagatattgattttgacagtaacactataaatatcgataagaccgtttataaccgaatagtgactaaaccaaaaacaacatcgtctatacgaaaaatcatgatgcctaaacacgtaatgaggttattagctcaattaaaagcaaaaaccaagacaaaaatgacatatgtagtatttggggaatttcatgaccacatttcaactacaacactagatagaaaatacgctgaatacgttaaggcggcaaaggttaaaaaaattcgtctacatgatttccgccattcacatgctagctatttaattaacaggaacacaatcccatctgtcgtggcaaaaaggctcggtcacaaggatgtgggcacaacactcaacatatacagccatttatatccgagcacagaaaaagaagccgtcctcaaaatggaagacgacttcaagactgctgaaattattcaccttaaagaagcttga

SEQ ID NO: 3483 - DNA, 474 bp, Bacillus licheniformis
atgccaaagggagaagggaaggttgtttcccaaaataaaaaagcaaatcacgattatttcatagaagaaacatacgaaacaggcatcgtgcttcaaggaacggaaatcaagtccattcgcgccggtcgggtgaatttaaaggacgcgtttgccaaaattgaacgcggagaagtgttcctccacaatatgcacatcagcccgtatgagcaggggaaccgctacaaccatgatccgttgcgaacgagaaagcttttgatgcaccgcaagcagatcaacaaattgatcggtttgacgaaagagcagggatattcgctcgtaccgctcaagatttatttgaagaacggcttcgcaaaagtgctgctcggtctcggaaaagggaagaagaagttcgacaaacgcgaagacttgaagcgcaaagacgccaaacgcgaaatcgaaagagcgttccgcgacaggcaaaaaggcttgatctaa

SEQ ID NO: 3484 - DNA, 2304 bp, Bacillus licheniformis
gtggaaaaagaagaatttatggataagcttctctcctttatgaaagaagaagcatataaacctcttacagttcaggaactggaagagatgctggaaatcaccgattcggacgaatacaaagagctcgtcaaagctcttgtaacccttgaagaaaaagggcttgtcgtcagaacgagaagcaaccgctacggtttgcccgaaaaaatgaatctgatcaaagggaaggtgtcggcgcacgcgaaaggcttcgcgtttgtccttcccgaagactcctcgcttgacgatgtcttcattccgccgtctgagctgaacacagcaatgaacggagataccgtgctcgtccgcctgagcacagaatccggcggtacaaaaaaagaaggggccatcatccgcatcatcgagcgcaacattcagaagattgtcggcacatacacagagacgaaaaacttcggcttcgtcattcccgacgataaaaaaatcacgaatgacatctttattccgaagcacgccaaaaacggcgccgtcgagggtcataaagtcgtcgtccgcctgacaagctatcctgaaggccggatgagtgcagaaggggaagtcatcgagattctcggtcataaaaacgatcccggcatcgacattctttcgattattcataagcacggcctcccgggagactttccggctgaggcgatggaacaggccggcaatacgcctgatacaatcgatgagaaagatcttgaaggcagacgggatctgcgcgatcaaacgatcgtcacgatcgacggcgcagatgccaaagacttggacgatgccgttaccgtcacaaaactcaaaaacggccattataaactcggcgtccacattgccgacgtcagccattatgtaacggaaggatctccgattgaccaggaagcgtatgaacgcggcacgagcgtctaccttgtcgaccgggtgattccgatgatcccgcacaggctgtcaaatggaatctgctccttgaatccgaaggtcgacaggctgacaatgtcatgcgaaatgctcattaatcctcaagggcaagtcgtcgagcacgaaatttttcaaagcgtcattaaaacgaccgagcggatgacttattctgatgtgaacaaaattttagtcgatgatgatgaagagctgaaacagaagtatgaggcccttgtcccgatgtttaaagacatggaagacttggctgcgattctgcgcggcaagcggatggaacgcggagccgtcgactttgactttaaggaagcgaaggttctcgtcgacgaagaaggaaaagcgaaggacgtcgtcttgagagaacggtcgactgctgaaaagctgattgaagaatttatgcttgtcgccaatgaaacggtcgctgagcactttcattggatgaatgttccgtttatttaccggattcacgaagatccagatcaggaaaagctgcagagatttttggagttcgttacgacattcggctatgtcgtcaaaggaacggcgggaagtatccatccgaaagcgctgcaaagcgtgcttgaagaagtcagggatcgtcctgaagaagccgtaatttcaacggttatgctcaggtcgatgaaacaggcgaaatacgatccgcaaagcctggggcacttcggcttgtcgactgaattctacacgcatttcacgtctccgattcgccgctatcctgacttaatcgtccacagactgatcaggacctatttgattcagggcaagacagacgaagcgacaagggaaaaatgggccgagaaactgcctgagatcgccgagcatacgtcaaatatggaacgcaatgccgtagatgcggagcgggaaacggacgatctgaaaaaaaccgaatttatgctggataagatcggtgaagaatttgacggcgtcatcagctccgtcacgaacttcggcatgttcgtcgagctgccgaacacgatcgaagggcttgtccacgtcagctttatgacggatgatttctaccgttatgatgaacagcactacgcgatgatcggcgagcgcacgggcaacgtgtaccggatcggcgatgagattacggtccgcgtcgttgacgtcaataaagacgagcggaacatcgattttgaaatcgtcggcatgaaaggctcccgccgccggcagaagccggagccaaagcagaaaaaggcttcaaaaagagaggctccatcggctgacaaaggggaatggttcaccaagccgaaaaagaaaaaagtaaagaaaaaacgcggttttcaaaacgcgccgaaacaaaaacgcaagaaaaagaaaaaatag

SEQ ID NO: 3485 - DNA, 747 bp, Bacillus licheniformis
atgaaaattgtcaaaccacaacctttcacatttaaaggcggaaaaaaagccgtcctgctgctgcacggatttacgggcaacacggcggacgttagaatgctcggaagatatttgaatgaaaaaggctacacatgccatgcgccccaatataaaggccacggcgtgcctccagaagaacttctctccacaggaccggaagactggtggaaagacgtcatggacggatatgaatatctgaaatcggaaggatatgaacaaatcgccgcttgcggactgtctctcggaggggttttttcattgaaattgggttacactgtacccataaagggaattgttccaatgtgcgcgccgatgtacatcaaaagcgaagagacgatgtacgagggtgtgcttgattatgcccgcaattataagaaatttgaaggcaagacagcggagcagattaacgctgagatggaagaattcaaaaaaacgccgatgaacacgttgaaagcactgcaggatttgattgccgatgtcagagagcatgtggacatgatctattcgcctacatttgtcgtgcaggcgcgccacgatcatatgattaatacggatagcgcaaacatcatctacaatgaagttgaaacggatgataagcagctgaaatggtatgaagaatcaggtcatgccatcacattggataaagaacgcgaaacactgcacaaggatgtgtatcaatttttagaaacgttggattggcagacataa

SEQ ID NO: 3486 - DNA, 231 bp, Bacillus licheniformis
atggccgcatttttaacggtcttattagtgattgtaagtatcgtattaatcgttgtcgttttactgcaatccggcaaaagcgccggattatcaggcgcgatttccggcggagccgagcagcttttcggaaagcagaaagcaagaggacttgatttgattcttcaccggatgacggtcgttttaaccgtgcttttctttttcttaacgattgcgcttgcttactttgtataa

SEQ ID NO: 3487 - DNA, 285 bp, Bacillus licheniformis
gtgaaaaataccgggattgtccggagaatcgatgagctcggcagagtcgttctcccggtcgaaatgcgcagggtgctgaatatcaatgaaaaggacccgctcgaaatatataccgacggcgaaaacatcattttgacaaaatacgccgcaaacatggcatgtttgatgaccggcgacatcaccacgaaaaataaaacgtatgcgggcggcaaaatcgtactcagcccgcgcggagcggaaatgctcctggaagatatgatggcggcactgtcagaaaagaaataa

SEQ ID NO: 3488 - DNA, 318 bp, Bacillus licheniformis
atggtaaaagtattgacaaaagttaacaaatcgtatatgttcaatgtagataaaaagaaacataagagattagaaaggggagtaatcatggtaaaaaagattcatatcaaaagagattttgttctccagtacatgattgaacacaatctctccttaaatcagcttgccattgaaatcggcgtatccccggcgacactcagcagagttttaaatggcgaaaggaggcccggacaacttgtgatcggaaagatgattcagtatttcaacaaaaaatttgaagatctcttttattataaagatgttgacaaaagtcaataa

SEQ ID NO: 3489 - DNA, 408 bp, Bacillus licheniformis
ttggccatgacgaactttggacaccatttacgacaattaagggaacggaaaaaactgaccgtcaatcaactggcgatgtattccggcgtcagttcggcaggcatttcgcgaatcgaaaacggaaagcgcggcgtgccgaagccggcgacgatcagaaaactggcggacgctttgaaagtcccgtatgaggaactgatggcatctgcaggctatatcagcgcgtctacagtccaggaagcaagaagcagctatgattccatttacgacatcgtgtcacagtacgatttagaggacctttctctgtttgacagcgaaaagtggaaggtgctttcaaaaaaagacatcgaaaacctggacaaatatttcgactttctcgtgcaggaagcaagcagccgaaacaaaaactga

SEQ ID NO: 3490 - DNA, 399 bp, Bacillus licheniformis
atgacaaggttcggcgagcggctcaaagagctgagggaacaaagaagcctgtcggttaatcagcttgccatgtatgccggtgtgagcgccgcagccatttccagaatcgaaaacggccaccgcggcgttcccaagcccgcgacgatcagaaaattggccgaggctctgaaaatgccgtacgagcagctcatggatattgccggttatatgagagctgacgagattcgcgaacagccgcgcggctatgtcacgatgcaggagatcgcggccaagcacggcgtcgaagacctgtggctgtttaaacccgagaaatgggactgtttgtcccgcgaagacctgctcaacctcgaacagtattttcattttttggttaatgaagcgaagaagcgccaatcataa

SEQ ID NO: 3491 - DNA, 678 bp, Bacillus licheniformis
atggaagtgctgcagcagctttggacgtattacgcgcaaaacggcggctatgtgctgggggaattttaccgccactttttaatgtcggcatacggcgtattgttcgccgccgtcgtcggcatcccggccggcattttcatcgccagataccgtaaaatcagcaaatgggtcttttccatcactaatgtcattcaaacggttccggcgctggcgatgctcgccgtcttgatgcttgtcatggggctcggcgcaaacacggtgattctttcattgtttttgtattcgctgttgccgatcattcgaaacacatatacgggaatcgccagcatcgagcatgcctatcttgaatcagggaaggcgatgggcatgacgaaatttcaagtgctccggatggtggagcttcccctcgccttgtcggtcattatggcggggctcagaaccgcgctcgtcatcgcgatcggcattacggccatcggcacgtttgtcggcgcaggcggcctcggggatatcattgtcaggggatcaaacgcgaccaacggaacagcgatcattctagcaggcgcgatcccgacggcgctgatggcgatcatcgccgatctgttcatgggatggctcgagcgtgcgctgagccccgttaagcatcataaaggcaagacgccgaatccggatgccgcttaa

SEQ ID NO: 3492 - DNA, 918 bp, Bacillus licheniformis
atgcaaacaaaaaaactgagacggctcggcgccgtcatgctggtcctctcgcttttgatcagcggctgtgcgctgccgggccttggcggggcttccgataaaacgatcaaaatcggagcgcaaaacctgaccgaatccgaaattcttgccaatatgatctcgcttttgatcgagcatgatacggatctcaatacggtgctggtcaaaaacctcggctcaaactatgtgcagcaccaggccatgctcggcggagacatcgacatttctgcgacgcgctattcgggaactgacctgacaagcacgcttggaagggaagcggagaaagacccgaaaaaagcgctccgcatcgtacagcaggactttcaaaagaaattcaactacaaatggttcgattcttacggatttgacaatacgtacgcttttacagtcacgaaagaactcgctgaaaaagggaactatgaaaccatatccgatctgaaaaaagacgcggatcaactgaagcttggcgttgacaatgcatggctgaaacgaaaaggcgacggatatccgggatttaaacaggaatacgggttttcatttggctcgacctttccaatgcagatcggactcgtttatgacgccgtcaaaaacggcaaaatggatatcgttcttgcctattcaacagacggcaggatcaaagcctatgatttaaagctgttaaaagacgataaacgctttttcccgccgtatgactgttcgccggtcgtgccggaaaaagtgctgaaggagcatccggagcttgaagagaccatcaataaactgattggaaaaatcgacaccgaaacgatgcaggagctcaattacgaagtcgatggaaagctgaaagagccttctgtcgtcgcggccgagtttttaaagaagcacaattattttgagtaa

SEQ ID NO: 3493 - DNA, 654 bp, Bacillus licheniformis
atgaatcagcttgtccaatttcttcagcacaacggcggggaaatgctttataaaacatgggagcacttatatatatccattttcgcggttctgctcggcatcattttcgcggttccgctcggtgtcgttttaacgagaatgaaaaaaggagccggcgtcgtgatcggcgttgtcaacatcattcagacgctgccgagtttggcgatcctggcgttttttatcccgcttctcggagtgggaaagattccggcgattgtcgcgctgtttttctattcagtcctaccgattctgagaaacacttacacgggcgtaaaaggcgtcaatcaaaatttgcttgagtcaggaaagggaatcggtatgactgcatgggaacaaatccgcctggtcgagctgccgctatcggtgccggtgatcatggcaggcatccggacgtccaccgtttacttaatcggctgggcgacgctttcggcttttatcggcggcggcggtctcggcgactatatttttatcgggctcaacctgtaccagcctgagtacattatcgccggagcggtgccggttacgatactggccatcgtgatcgactatattctgtcgaaaaccgaagacaaagtcacgcctcaaggattaaaagggatgaaggaagtatcataa

SEQ ID NO: 3494 - DNA, 1140 bp, Bacillus licheniformis
ttgctgaagctagagaatgtatcaaaggtttataaaggcggaaaaaaagcggtcaaaaacattaaccttgatatagcaaaaggtgaatttatcgtctttatcggaccgagcggctgcgggaaaacaacgacgatgaaaatgatcaaccgcttgattgaaccgacttcaggaagcatttacatcgacggagaaaacataatggatcaggacccggtggagctgcgccggaaaatcggctatgtcattcagcaaatcggactctttccccatatgacgattcagcagaatatcacgctcgttccgaggcttttgaaatggccggaagaaaagcgaaagaagcgggcggaggaactgctgcagctcgttgatatggggccggaatatttgaaccgctaccctcatgaactaagcggcggacagcagcagagaatcggcgtgctgcgggcgcttgcggcagagccgcccctcattttaatggatgaaccgttcggagcgctggacccgattacccgtgattcgcttcaggaagagttcaaaaagcttcagaaatcgctggacaaaacgattgtctttgtaacccacgatatggatgaagcgattaagcttgctgacagaatcgtcatccttcgcgccggcgagatcgtgcaagtcggatcgcctgacgacattttgcggaaaccggcggatgaattcgttgaggaatttatcggaaaagagaggcttcttcagtcccgtcctgacatcgagcatgtcgaacaagtaatgaacccgaatccggtcacgattacgagcgaaaaaaacctgactgaagcaattcaagtgatgagggaacgccgcgtcgattcactgctcgtcgtggacgaacacaatgtcttaaaaggatatatcgatgttgaaatcatcgatcagaaccggaaaaaatccgtcacagtcggggaggttgtcaatgagaatgtttactccgttcaaaaaggaacgctcatcagggataccgtccggaaaattttgaaaaggggattcaaatatgttcccgttcttgatgaagagggccgccttgtcgggattgtcacaagggcaaaccttgtcgatatcgtgtacgactcgatttggggagatgaagaaacccttgttcaacgttaa

SEQ ID NO: 3495 - DNA, 540 bp, Bacillus licheniformis
ttggaggaaaacgctttaaaagtgattgaacaagcggaagaacatttcatagaaaaaatcgccgaaaatatgaatacatacggtctatcatcaactgtcggccgcgtgctcgggatcatctatatgaacagaaagccgatgaccttaaatgaactgtcagaagaaacgggcatgagcaaaacgagaatgagccaggtcgtccgcgaaatgatcgatttaaatatagctgaaaaagtttttgaaaaaggcgtccgcaaagatctgtacgatgtcgaacaagactattatcaaacgtttatttcattgtttacggccaactggagcaaagtcgccaaaaagaacaggatgattgggaaaaaaatcagaaaagagctgttggaggcgctcgaggaagaaggccttacgcctgaaaccgaagctaaaatcaacgagctgctggctgaaacaaaacaatggatcgattactgcgagtggcttgacaatctgatcgcgtttttggaaagcgaagagatcttcaagcatgtgccaaaaccttcataa

SEQ ID NO: 3496 - DNA, 633 bp, Bacillus licheniformis
gtgtttgcttttatcatccacgtttttgtatcattgttcgccgtcacaaatccgatcggcaatgttccgatctttttagcgctcacagaaggctacgaagcgaaagaacgcaccgcattggcgagaaaggccgcggttttatcgtttctgatcctgatcgcgtttctcatattcggagagtttatcttcaggctttttgacatcaacatccatgcgctgcgaattgccggcggcatatttatattcggaattgcctacaacctgctgaatgcaaagcagtcccatgttcagtcgctgcatcatgctgagcatcgcgagagcaaggaaaaggaggatatatcggtgacgccgctcagcattccgatcatttcggggccaggaacgattgcgacggtgatgagcctttcggccggaagccgcagtctggtgcattttggcggaatgatcatcggcatcgccgccgtcctcctgctgacgtttgcggcctttcattattctacgctgatcagcaacaaattgggccagacggagatgaacgtgatcacccggctgatgggcctgattttggctgtcgtggcggtcggcatgatcggaacgggattgaaagggatgtttccggtgttggcgggataa

SEQ ID NO: 3497 - DNA, 714 bp, Bacillus licheniformis
ttggccggcggcagtgatggcggaaaaggagcagctgaaacgccgcaggcagctagatatgcggaggcggcgaaacaagcgtcttccatgtatttttcctattgtttaaaggtgctgaaacgaccgtttatcgaaatgaaaaacgccggagaacagcacgtcctcaacagcatcaccacaatggtgatatttgcgctttcggtgccgctgatgttttatttcggcctcaaaggcttctttgacgccatgggggactattccggagtattcggccgctcctacgcaatgccgacattttttgatatcgtcgtaaagcccgctgttacctttgctatttatattttcttattatttgtttttacatacgcaggcgtgcgcattcggggtgtgcaagcggcatttaaggaagtgctcgggcggttcggagcggtgcttattcctttcgtcgcccttctgctcgccgctttgcttttatcattcatgcaaacgggtttgtttatatatgttcttttctttgccctttgcggcatcgcctttttaattccgccggctgtcatctcgagctatcacgaaaaagcggaaggcgctgttgatacgatttacgcgacgctgatcgtctatttgctgacatttatgtcggtgcggatcatgggagatttgtttcttgaatatatcggaaggatcggaggctctatattagggcggctgttttag

SEQ ID NO: 3498 - DNA, 1768 bp, Bacillus licheniformis
atggatttttgcaaggaatgtggaagggaacgaacaaaaaatgcgctgtattgcaagcattgcggcgcgcgggcggacgaggaacgagcttccgacccggcggcaaggtatcagcgtgcgatgacacgaaaaagaatcatcatcatggcggcaatcgcggcctgcttgattttattgtttgccggctataaaaccggtgaagcactcacatcaaaggaaaaactgatttccgattttgaagccgccctcgatcagaaagatgccaagaaagcagcaaaactgcttcaatcatcagacgtggatctggctgtcacggagaaaaacgtcaagccgctcttggattacttgaaagaacacccggatgaagaaaaagaattgatcacatccttaaaaagcggtgccggccatccattgatgacgatcgaaaaaaagggcaggcgtttttggatctatgaccgctatgtcttgaacacggagcctgtctacttaacggttaagacaaactataaagataccggcctgtttgttaacggcaaaaaggtcatcacaacagaaaaagaaaacttcgagaaaaaaatcggcccgtttgtccccggtacttacgaggtgaaggcaaagctgaaaagcggaatcgccgatcttgaaggtcaccgccctccaaggtgatgtgaaggttaatgcggaccttaacgggcacatggcaaagcttgtctttgaagaaggctatgaaaacttgaaaggaacgctctggatcaatgatcaggagatgaagatcaatccattcaaaggaactgaattcggacctgtgctgactgacggttcaatgtctgctcaggttgaggcgcaatttccgtgggggaagctgaaaagcgaaaaaacgccgattgaaggtgaagaaatcgaagtcaatcttgcatcagacaaagggtttatggatgacatgatgaccgctgtcgtcaaccatacaaaggaagcagcaaaggcctttgcaagcggcaatgtcagcggcatgacaatggccgccccgtcttatcaaaaccgcctgaaagaggtcacggacgggctgaaaagcagcagcacctactataaaggcacctacttatctactgtatttgatcttgattcgttccggctatacaaagaagacgggcaatggaaaacagagctcaaagggattgaaaagcacaaatcggcctattatgacgactacattgcgcctaaactgaaagaaaacgatagcggatatacgtacacattggtctattccgaaggcaagaaaaagtggctcatcgaaaaaagcgatcctgaagccgttatcgatatcgagcatcaaaaagaaatcaaaaatgacaatccgaaggaatacacatcggcatgggcctcagcgaaaggggccatgaacaatgcatcagcaggcgaagagctcaccgaccaaaaggttgctttcgccattgaagcgtatttatacaggctacaagacgccatcaacacaaacgatttcggcctcgtccgcgacagcttgaaagaaggaagtccgctgtacaacgatcaaaagaaactggtcgctaaactgtacaacagcgggacagaggaggaagtcgtccaattcagcgtaaacagctggaagcaaaacgggcgggaggcaacgattaagacaacggagaaaattaatattatcaaaggcggaaaagaacagttaaaaacgtatcattggacatatcacgccgccatcgaggacggcagattgctcttaacgtcaatagaataa

SEQ ID NO: 3499 - DNA, 948 bp, Bacillus licheniformis
atgaaacgttttaaatggtttgcactgttcgctgcgcttatccttttattagccgcctgcggaaatcaagataaagatcaatctgcggagaagaacggcagcaaagattcctatactgtaaagcacgcaatgggaacagcgacaattgacggcactccgaaaaaagtcgtcgtactcacgaatgaagcgacagaagcagtgctcgcacttggcgtaaaacctgtcggcgccgttcaatcctggctgggagatccatggtatgaccatattaaagataaaatgaaaggcgtagagaacgtcggaacggaggctgcgccgaatattgaaaaaatcgcgagcctgaagcctgacttaatcatcggcaacaaaatccgccaagaagaagtatacgacaagctgaaagcaatcgcgccgaccgtatttgccgagacattgtcaggggaatggaaaaacaactttaagcttactgccgaagcgctcaataaaaaagctgaaggcgaaaaagtcatcgctgactttgacaagcgcgttgaagacattcatgaaaaactaggcgataaagtgaaacaaaaagtctctctcgtccgctttacagatgctgatacccgcatctatcacaaaggatcatttgccggaacgattttggatcagctcggttttgcaaggcctaaaggccaggaagccaacgatctcggacaaatggaagtgacaaaggaacaaattcctgatatggacggggacgtgcttttttattacacgtatgagacaggcgatgacaaagcaagcgccattgagaaagactatgtcaatgatccgctctttaaaaacttaaacgtctccaaaaaaggaaacgtccataaagtgagcgatgccatctggaatacagcagggggcgtccttgcagcaaacctgatgcttgatgatattgaaaaatactttttaaaatga

SEQ ID NO: 3500 - DNA, 393 bp, Bacillus licheniformis
ttgactaagtttttattgagtggtttctaccttttcggacttgtcatgctgagcaattggtcgatttcttttggtgaaatatttggagccggcaattcagccgtttttcaattatcggaagcggtgctttttacgtttatcatcgggtgctatacaggtcttcctttgatttatgccaaattcactagatctgaaacgttgttttttacaaatcaaaaggtcttcctcatcaccttaggattaggcgtgctgctttcctgttcggcttacagccttcagcaagccctctctcccatcgcgattgcgctgttgtcgatcattggttttttgatcgttggcatcagcggttttcttcccgcctggtttctgaagcctgcgaaaaatctgcgataa

SEQ ID NO: 3501 - DNA, 633 bp, Bacillus licheniformis
atgcagtcgaaaacagtatatctttatgcattccatacaatgtcagattgggaatatggatatttaatggccgaactgaactcgggaagatatttcaaaaaagatgcggcacctttaaaagtcatgacaataggagtgaataaagaaatggtgacgacgatgggtggactgcgcataaaaccggatatctcccttgatgagtggacgcccgagagtgcggatctaatcattttacccggagggaatacttggggagaaaagattcatcagccgatcttgaaaaaggccggcgaagctttagagcttggcgcgatggttgccgcaatatgaggtgcaactgcgggactggcgaatagcggatatctggattcaagaaagcatacaagcaatgacttggcctatatgaaaatggtctgtcctcattataaaggagaaccgttttatgagatgggacccgcggtatcaaatgggaatctggttactgcatcaggagcggctcctctcgaattcgcaagggaagtgctgaaaaaattagacgtgtttgcaccggatacattggattcatggtatcaactcaataagaccggtcaacgtgaatacttcttcaagctaatgaattcaatcaataaatga

SEQ ID NO: 3502 - DNA, 1293 bp, Bacillus licheniformis
atgccatacattgttgatgtttatgcacgtgaagtattagactcccgcggtaacccgacggttgaagttgaagtatacactgaatcaggagcttttggacgcgcgctggttccaagcggagcttccactggcgaatacgaagctgttgagcttcgcgacggcgacaaagaccgctaccttggaaaaggcgttttaacagccgttaacaacgtgaacgaaatcatcgcacccgagcttatcggctttgatgtgactgagcaagtatcaatcgacaaattgctgatcgaacttgacggaactgaaaataaaggcaagctcggcgccaacgccatccttggtgtatcaatggccgttgcccgcgcagctgcggatttcttgcagattcctctataccaataccttggaggattcaactctaaaacgcttcctgtaccgatgatgaacatcgtaaacggcggagagcatgcggacaacaacgttgacattcaagaattcatgatcatgcctgtcggtgcggaaaacttccgcgaagcacttcgcatgggagcacaaattttccacagcctgaaatcagtcttgaaagaaaaaggcttgaacacagctgtaggtgatgaaggcggattcgctccaaaccttggatctaacgaagaagcgcttcaaacaatcgttgaagcgatcgaaaaagcaggattcaaacctggcgaagaagtgaaattggcaatggatgctgcatcttctgagttctacaacaaagaagacggcaaataccatcttgcaggcgaaggcgttgtaaaaacgtcagctgaaatggttgactggtacgaggagctgacttctaagtacccaatcatctcaatcgaagacggccttgacgaaaacgactgggaaggccacaaacttctgactgagcgtcttggctcaaaagttcagcttgtcggtgacgaccttttcgtaacaaacacgaaaaagcttgctgaaggaatcaaaaacggcgtcggcaactctatcctgatcaaagtaaaccaaatcggtacattgactgaaactttcgatgcgatcgaaatggcgaaacgcgcaggctacactgccgttatctctcaccgctccggtgaaactgaagacagcacaatcgctgacatcgctgtggcaacaaacgcaggacaaatcaaaacaggtgctccgtctcgtacggaccgtgttgcgaaatacaaccagcttcttcgcatcgaagatcaattggctgaaactgcgcaataccacggtattcaatctttctacaacttgaataagtaa

SEQ ID NO: 3503 - DNA, 1536 bp, Bacillus licheniformis
atgagtaacaagttagccgcgctcatcattttagatgggtttggactaagggacgaaaccgtcggaaacgccgtagcccaagcgaaaaaaccgaactttgaccgctattggaacaagtatccgcaccagacgctgacagcttcaggagaagcggtaggtcttccagacggccagatgggcaactcggaagtcggccatctgaatatcggcgcaggccggatcgtttaccaaagtctgacgcgcgtgaacgttgcgattcgcgagggagaattcgaacagaacgaaacattccttgcagcgatgaagcacgtgaaagaaaaaggcacaaacctccacttgttcggactgctgtctgacggcggagtgcacagccacattcaccatttatatgcactcttgaaacttgccaaaaaagaaggcgttgaaaacgtctatattcacggcttccttgacggccgcgatgtaggcccgcaaacagctgagaagtacatcaaagagcttcaggatcaaatcgaagaaatcggcgtcggcgagatcgcaacattgtcaggccgctactattcaatggaccgagacaagcgctgggaccgcgtcgaaaaagcgtaccgcgccatggcatacggagagggaccgaaatatcaaaatccgctcgatgtcgtgaaagattcttatgaaaacggaatttacgatgaattcgtgattccttccgtcattacgaaagaaaacggcgaacctgttgcgacaatcaaggacaacgatgcggtcattttctacaacttcagacccgaccgtgcgatccagatttccaacacgttcaccaatgacgacttccgcgacttcgaccgcggagacaagcatccgaaaaaccttcatttcgtttgcttgacacatttcagtgaaacggttgacggatacgtggcattcaaaccggtcaatctcgacaacacagtcggcgaagttttatcccaaaacgggctgaagcagcttcgcatcgctgaaactgaaaaatatccgcacgtcacattctttatgagcggcggacgcgaagaaaagttcccgggcgaagagcgaatcttaatcgactcgcctaaagtcgcaacatatgacttgaaacctgaaatgagcgcatatgaagtaaaagatgcgcttgtcaaagaaattgaggctgaaaagcataacgcgatcatcctcaactttgccaaccctgacatggttggacattcaggaaaagtcgagccgacggtcaaagcaatcgaagcggttgacgagtgcctcggcgaagtcgttgatgcgattcttgcaaaaggcggctacgcgattattacggccgaccacggtaacgcagacgtgctgattaccgaagaaggcaagccgcacaccgcacatacgacaaacccggttcctgtcatcgtcacaaaagaaggcgtgacattaagagaaggcggaatcctcggggatctggcgccaactcttttagacttgctgggtgttgaaaaaccgaaagaaatgacaggatcgtcattaattcaaaaataa

SEQ ID NO: 3504 - DNA, 762 bp, Bacillus licheniformis
atgagaaaaccaattatagccggtaactggaagatgaataaagtgctttcagaagctgtcagcttcgttgaagaagtgaaatcttccattcccgcagcagataaagcagaagctgttgtctgtgcgcctgcactgttccttgaaaagctcacatcagctgtaaaaggcacagatctgaaagtcggcgcgcaaaacatgcattttgaagaaagcggagctttcacgggtgaaatcagccctgcggctttgaaagaccttggagttgaatactgcgtcatcggccactccgagcgccgcgaaatgtttgctgaaacggatgaaacggtcaacaaaaaagcgcatgctgcatttaaatacggcatcgttccgatcatctgcgtaggtgaaacgcttgaagagcgcgaagcaaacaaaacaaacgagcttgttgcagaccaagtgaaaaaagcacttgcaggtttaacaactgaacaggtagctgcttccgtgatcgcttatgagccgatctgggcgattggaaccggcaagtcttcaactgcacaagatgcaaacgaagtatgcgcgcacatccgcaaaaccgtggcatcagagttcggacaaactgcagcagacagcgtccgcattcagtacggcggaagcgtaaaacctgcgaacattaaagaatatatggccgaatccgatatcgacggcgctcttgttggcggagcaagccttgagccgcagtctttcgtgcaattattggaggcaggtcaatatgagtaa

SEQ ID NO: 3505 - DNA, 1185 bp, Bacillus licheniformis
atgaacaaaaaatcagtaaaagacattgatgtaaaaggccgcgttgttttctgccgtgttgactttaacgttccgatgaaggacggaaaagtgacggatgatacgagaatccgcgccgcacttccgacgattcaatacttaacagagcagggagcgaaagttcttcttgcaagccacttgggccgtccgaaaggccaggtgtcagaagagcttcgcttaacgccggtagccgcacgcctcggcgaactgatcggcaaagaagtgaaaaaagcggatgaagcttacggcgacgccgtcaaagcgcaaatttccgaaatgaaagacggagatattctcgtattggaaaatgtccgcttctatccgggagaagaaaagaatgatcctgagctttctaaagcgtttgccgacctggctgacgtttatgtcaatgatgcattcggagcggctcaccgcgcccatgcttcaacagcaggcatcgctgaacaccttccggctgttgcaggcttcctcatggaaaaagagcttgaagtgctgggcaaagcgctgtcaaaccctgaacgtccgtttacagcgatcatcggcggcgcaaaagtaaaagacaaaatcggcgtgattgaaagtcttcttgagaaagtagacaacctgatcatcggcggcggtcttgcttacacgttcgtcaaagcgctcggccatgaagtgggaaaatccctgctggaagaagataaaattgaattggctaaatctttcatggaccgcgccaaagaaaaaggcgtgaacttctacatgcctacagacgtgcttgttgctgacgatttctcaaacgacgccaacacgaaaatcgtgccggtaagcgaaatccctagcgactgggaagcgcttgacatcggcgaggaaacaagaaaaacatatgccgacgtcatcaaaaacagcaagcttgtcgtttggaacggaccgatgggcgtattcgaaatcgacgcgttcgctaaaggaacaagagctgtcgctgaagcattagcagaggcaaatgatacatactctgtcatcggcggcggagactctgcagctgctgtagaaaagttcggcttggctgacaaaatgagccacatttcaacaggcggcggagcttcccttgagtttatggaaggaaaagaacttcctggcgtcaaagcattgaacgacaagtaa

SEQ ID NO: 3506 - DNA, 1008 bp, Bacillus licheniformis
atggcagtaaaagtcggtattaatggttttggtcgtattggacgcaatgtattccgcgcagcattaaataatcctgaagttgaggttgtggcagttaacgatttgacagacgctaacatgcttgctcacctattacaatatgattcagtacatggaaaattggacgcagaggtttctgttgacggaagcaaccttgttgttaacggtcaaacaatccaagttacagcagagcgcgatccttctaaactaagctggggagagcaaggtgttgaaatcgttgttgaatcaactggtttcttcacaaaacgcgcagatgcggcgaaacatttggaagccggcgcgaaaaaagttatcatctcagctcctgcgagtgaagaagatattacaatcgttatgggtgttaacgaagataaatacgatgcggctaaccaccatgttatctctaacgcatcttgcacaacaaactgccttgcgccgtttgcaaaagttctgaacgacaaattcggcatcaaacgcggtatgatgacaactgttcactcttacacaaacgatcagcaaatcctggatcttccgcacaaagactaccgtcgtgcgcgtgcggcagctgagagcatcattcctacaacaactggtgctgcgaaagccgtttcccttgtacttcctgaactgaaaggaaaactgaacggcggagcaatgcgtgttccaacaccaaacgtatcacttgttgacctggttgctgaacttgacaaagaagtaacagcagaagaagtaaacgcagcgcttaaagaagcagcagaaggcgaacttcaaggcgttcttggctacagcgaagagccgcttgtatctaaagactacaacggcaatacaaactcttctacaatcgatgctctttctacaatggttatggaaggcagcatggttaaagttatttcttggtatgacaacgaaagcggatattctcaccgtgttgttgaccttgccgcttacatcgcaaaacaaggtctttaa

SEQ ID NO: 3507 - DNA, 1041 bp, Bacillus licheniformis
atgaatcaactaatacaggctcagaaaaaattattgccggatcttctcgatgtcatgcagaaaaggtacaaaattttgcagtacataaggctgactgaaccgatcggcagaagaagccttgctgccagcctcggcatcagcgagcggattttaagggcggaggttcagtttttaaaagaacaaaatctactagagattaaaacaaccggcatgatattgacacctgaaggatccgacctgctgaaagttctcgaagatacgatgaaggacgttttaggtttaactcatttggaaaatacattaaaagagaggttgaacctcgacgaagtcatcattgtatcgggagacagcgaccagtccccatgggtcaaaaaagagatggggagagcggccgtcgcatgcatgaaaaataggtttacgggggaaaatatcgtcgccgtaaccggaggtacgacacttgaggccgtggcagaaatgatgacgcctgactcgaaaaaccgcaagctgctttttgttccggcaagaggcggactgggcgaaaacgtcaggaatcaggccaatacgatttgcgcccatatggccgagaaagcttccggtacatacaaactgttatttgtgccggggcagctgagcaaagaagcatattcttctatcattgaggaaccttctattaaagaagtgcttcagacgattcaatcatccagtatggtgattcatggaatcggggatgctaaaacaatggcagaacgaagaaatacgccaaaggaagatttgaagaaaatagaagaaaatgaggcagttgcagaagcgttcggctactatttcgaccgccacggggaagtcattcacaaagtgcacagcgtaggcatccagcttgaggatctcgattcgatcccgaacatcattgcggtggcgggaggctcgtcaaaagctgacgccatagaggcatacttcaaaaagccgcgcaatacggttttgatcactgatgaaggagccgcaaaacagttattaagggaagcttcttccctcaatataaattaa

SEQ ID NO: 3508 - DNA, 1008 bp, Bacillus licheniformis
atgtcagaacagcatttcaaaaatacgaagtattccgtattaaatctgtctcctatcgtacaaggcggaaatgcggaacaatcttttaaacaatctatggatttggcgcagcatgccgaaaaatgggggtaccacaggttctggctggctgagcaccataatatcgaaggtgttgcaagctcggccacctctgttttgatcggctatatcgccggaggtactaagaaaatgcgcatcggctcgggagggattatgctgccgaaccattccccgctcgtcatcgccgaacagttcggaacgcttgaatccctttatcccggcagaatcgatttaggacttggacgcgctccgggcactgatcaattaacagcgcgcgcattaagaagaaacataagcagcggggaggattttcccgagcagcttgaagaactgcggcaatattttaagccgtcgggcaatgtaagaaatcatgtgcgcgccataccgggagaagggcttgatgtgccgatttggcttctcggttcaagcggattcagcgcccggcttgccggggagctcggtttgccgtttgcatttgcggctcatttttcgcccgccaatacgctgcctgccttggaactgtatcggagttcgtttaagcccggcgtcttgaaggagccttatgcgatggtcggggttaccgttatcgcagccgatacggatgcgaaagcgcagcgcctggcaacgtcgcactatcagaagtttttggatcttgtccgcggcgctccgacacagcttaagccgcctgtagatgatatggaacagatttggacgccgcgcgaaaaagcgatggtgaacgagcagctcagctcaacgatcatcggcgggccggacagtgtgaaagaaaagcttgaagagttcatccggacgactcaggcgaacgagatcatgatcaattcagaaacatttgaccatgctgacagacttcgctcgttcgaaatcattgcagatgtatggaaaaacggataa

SEQ ID NO: 3509 - DNA, 1368 bp, Bacillus licheniformis
atggagaaagacatgcagaagctcgagcgcacgatgacatcgcggcatattatgatgatggcattgggcggagcgattggggcaggattatttaaaggaagcagcaaagcgatcgatttggcggggccttcggtcatgatcccctacttgatcggcggcgtgattttgctgtttattatgcaggggctggccgagatggctgtccgaaacagcgaagccagaacattcagggatctggttcaatcgatattagggccgtatgccgcttattttttggactggatatactggaaaatgtgggttctcaatattgcggctgaggctgttgtcgccgcgatgtttttgcagtactggctgccggggctgccgatttgggtgctggcgctgttcgtttcactcgtcattacgagcgtgaatttgctttctgtcaaaagctttgccgagacggaatactggcttgctctcattaaaatcacagtgattgtcgtctttattatatccggatttatcttgttatttttctcttttggacaacattcggctgtcggctttactcatttgacagaccatggcggcttcttcccgaatggcgccggagggctgattacagccatgcttgtcgtgatctattcctacggcggaacggaaattatcggggtgaccctggcggaaaccaaaaatcctgagaaggttgtgcctaaagccgtgcggggaacgttaacgcgcattattgctttttatcttctgccgtttttcgtgatcgtcagcttgattccatggaatcaagtgaacggggtgtcggagagtccctttgtcatggtctttaagatgatcggcgttcccggagcggatcatttgatgaatgcggtcattttactggcggtcatttcttctatgaactcagggctttacggcgcctcccgtattttgtatacacaggcgtcagacggaagaatgccgaaaatcttttcgaggctttctgcgagaaaggtgccggtttattcgattctattatgcacttcgttcttatacttgggcgtattgttttcactatttgccggcagccaaacgtttgaatatttgatggggtctctcggctataccgtccttgtgatctggatgctgattgccgccgcccatttaaaatcgaggaaacggaatcaaacagctggaaacggctactatgtcaaatggttcccttatacgacttgggtggcaatcatttcgctgacagccatactgatcggtgtcatcctgaccacgtcgattgtcattacattggtgacggcggggatctatttgctcattagcgctgcttatttctttaaaggaagaaaccagacagccggccaaacggccgcttcttaa

SEQ ID NO: 3510 - DNA, 474 bp, Bacillus licheniformis
atgaaaaaactcttgtttatggtgatcttgtccgtattgacgctcgtctttggttcatcgtccgtaagctttgcgaaggacattcctgaagacaggtatacaacacctacagatgctgaatttagccagattaaagagattttaaacgaggctgatgtcgaaaccggcaatttgcagaaggattacggtgtgatcgtcaatgatcctgctgaaaaggtcggcgtcatatcggacattcctgccgaaaaagatgactggagccatgtcagcttccattcttactatgtcgacctcaacagcggcacactcattgctgatgttcaatttgaattcacgcaaaacgatgacggtacatcagaaaccgagtacaaaaacgtaacaaacggaggcaggtacttcgtcaaaatggatcaagacggaaatgtcattgatgaagcaacaaccggcgacatgtcgattttgtggaaatactag

SEQ ID NO: 3511 - DNA, 927 bp, Bacillus licheniformis
atgaatgtggtgatcgaggcaaaagggctgatgaaaagctacggcgccaaaaccgtcgtcaaccatgtcgaccttcaagttgaaaaaggagagatttacggattcctcggccgcaacggtgcggggaaatctacgtttatgaatatgatcacaggcattatccagccgacagccggcagttttctgctgttaaatgaagcttcgattgaaagcgtcaagcaccgcatcggcgttttacccgattatttgaccctctatgattcaatgacagcggtcgggcatttgaagtattttgcaaagctgaacggacggaccgtatcgactgagcgttgcgaagaagtcttagagagggtagggttcactgagcatactgaaaaaaaagcgggcgcgtattcattcggtatgaaaaaaaagctcggcatcgcccaagcgatcatccatgatcccgagctcatctttttggatgaaccgacatcaggtgttgatgccgaatcggcactccacattcaaaagctgattatggatttgcaaaaagaaggtaagacggtatttatgacgtcacacaacctgcatgaaatcgagaaaatctgtacacgaatcgcgatcatgaaaaacggccgcattttaatggaaggcacgctcgatgagttaagaaggcatttcatgtcgaacataagcgttcacatccgccattcgaatattcccgagcagcatttcggcctgatcgaccgatttcttgagtcagctggtgaaaacgttcaatttaagcaccatgagatttcgatcatcgtcaattcagaagaaaaaattcctgccatcgtcagagtattaacgaactgcaaggtgggaatctacagaatccacgtcgatgaaccgtcgcttgaagacatctttatcgacagctcggaggaacgcgttgtgtcttga

SEQ ID NO: 3512 - DNA, 690 bp, Bacillus licheniformis
atgcgggcagtgtgtctgaacgaatttatcagtctttttaaaagcatcaagtcgattattgtcattattattatgttttgggtgagctataagactgcgggattgattgaacaggcgcctgcggatgtcgtgcgggaattggatttaggaagcgatgcaggcgcgatcggaacggccgttatcgtgtttgctctcggtttcctgtttatcgcggggctttcccatgacatgatcaaccgcgaagtccatacccggacggtcagatttctcgtgacgaaaacgtcgcggatcaagatcattctgggaaagtttcttggcgtctggctgttttggtttttctgcatgctcgtttcttatgccttggtgatgatcgcctcaaaagagtttttatggctgagttatgcagacagcatggcttttcttacagctgcgatctctttgaaccttttattttcgatcgtgatttcaaggcccgccgtgtcaatgtttttcggaatcgtgtttgctctcgtttttccagcggtcagtttatgggctgtttattcagagaacggcatgatcacctggtttaaatatataacgccgtactattactccgtactgggcggttcttttattttcatcaactttgtctacgccgccatcgttctttgcggtgcgatcgttttgtttaaaaggagagatttataa

SEQ ID NO: 3513 - DNA, 723 bp, Bacillus licheniformis
atgacaaacggaacaatccacaacaaagacggctttttaaaccggattgctgaaaggctcggccgcaacaggcgttctgcaggcgtcaccgttcccgattatatccaccagccgcagcacagggtatatcaaggctatacacaggatgagcttgtcggcgtcttaaaggaccactgccggaaaattcacacggagctgattgaaacagatgtcatcggcttgcatgatgccttgtatgaacaagcagcgcgatttggaggcgggcctgtcatgatcccgaaagatgaccgttttaaagagtacggactgtcaggcctgttaacggacaagtggccgaatgaagggacgaaagtgtgggaatgggatgcagcggccggagatgagaacatccagcgagccgaacaggctaacatcggcgtgacattcagcgagatcacgcttgctgaatccggaacggtcgtcctcttcagctcaaaagacaaaggacgttccgtcagcttgctgccgacgacatatatcgcgatcgtcccgaaaagcaccatcgtcccgcggatgacacaagcaagcgcaatcatcaaacaaaagattgcagacggcgacgtcatcccgtcctgcatcaactatgtcactggaccgagcaattcagccgatatcgaaatggaccttgtagtcggcgtccacggccccgtaaaggcggcatatatagtcgtggaggaccggtaa

SEQ ID NO: 3514 - DNA, 1434 bp, Bacillus licheniformis
atggcaatgaagatcggaacgcagaaatttaaagagcgcgtgtcagacgggctcgacaacgagtttatgaggggggccgtttcaagcgcgcaggagcgcttgagagcgcgccgtcttgaggcggcaaaagagctcgggaactgggaagaatggcggtctctggccgaagaaatcaggcagcacgtgctggaaaatctggattactatctagaacagcttgccgaaaatgtcgccaaaaaaggcgggcacgttttctttgcgcagacggctgaagaagcgacaggctacatccgcgatgtcgtgaaaaagaaaaacggcaaaaaaatcgtcaaatcaaaatcaatggtgaccgaagaaatcaacatgaacgaggcacttgaaagcgacggctgcgaagtggtcgaaaccgatttgggcgaatacatcctccaaatcgatgatcatgatccgccgtcacatatcgtcgcacctgctttgcataaaaacaaagagcaaatccgcgacgtcttcaaagagcggatcggctaccgcaacaccgaaaagccggaagagcttgtcatgcacgcgcgcgccgtgcttagaaagaaatttctcgaagctgatatcggcattacgggctgcaattttgcaattgccgatacgggatctgtcagccttgtcacaaacgagggaaacggacgtctcgtcacgactattccgaagacgcagattaccgtgatggggatggagcggatcgtcccatcattcgacgagtttgaagttctcgtcggcatgctcacaagaagcgcggtcggacagcggctgacgagctatatcacggcgctgacagggccgaggctgcccggtgaagcggacggcccggaggagtttcacctcgtcatcgttgacaacgggcgttccaacattctcggaacggagtttcagtccgtccttcaatgcatccgctgtgcggcctgcatcaatgtctgccccgtttaccgtcatgtcggcgggcattcttacggttcgatctattcaggtccgatcggggctgtattgtcgccgctgctcggcggatatgacgattataaagaactgccgtacgcatcttcgttatgtgcggcttgctctgaagcatgtccggtgaaaatcccgcttcatgagctgcttctaaagcacaggcagcgcatcgttgaaaaagaagggcgcgcgccgatatccgaaaagctggcgatgaaagcgttcggcttgggaacttctgcgccatccctttacaaaatgggctccaaatgggcgccggcagccatgaagccgtttaaagaagacggcaagattacgaagggaccgggtccgttaaaacagtggacccagatacgcgacttccccgcgccgaacaagtcaaggttccgcgactggtttgaggacagacggaaagagaagggggaagacaaatga

SEQ ID NO: 3515 - DNA, 717 bp, Bacillus licheniformis
atgaaagtatcactgtttatcacgtgtttggttgacatgtttcagtcaaatgtcggaaaagcgactgttgaactgctggagcggctcggatgtgaagtggattttcccgaagggcagatctgctgcggccagcctgcgtacaacagcggctatgtcaaagattccaaaaaagcgatgagacggatgattgagacgtttgaatcagctgaatacgtcgtcagcccttcaggatcgtgcgcttttatgttcaaagagtacccgcaccttttccgggatgaaccggcctgggcggaaaaagcgcagcggctggctgacaaaacgtatgagctgaccgattttatcgtcaacgtattgaagattgaggacgtcggggcgacactcgagaaaaaggcgacttatcatacgtcatgccatatgacaaggcttttgggagtcacggacgcgccgatgaagctgcttcggcatgtgaagggactggagttcacgccgctgccgcgcaaacacgactgctgcggattcgggggcactttctcggtgaagatgtcgcaaatatccgaacagatggtcgatgagaaagtggcgtgtgtcgaagaaacagccgccgacgtgttaatcggggcggactgcggctgcttgatgaatatcggcgggcggatcgggagaaagaacaagccgattgaagtcatgcatatcgcagaagtgctgaacagcagataa

SEQ ID NO: 3516 - DNA, 741 bp, Bacillus licheniformis
ttgaaatacaaacaaatcaagacgaaaaaaatatatgaagaagtcgcggaagcgcttcttgaatcgattaaaagcggagagcttgagcccggcgacaagcttgactccgtccaagcgctcgccgacagctttcaggtcagccgttcggccgtaagggaagcgctgtccgcgttaaaagcgatggggatggtcgaaatgaagcagggggaagggacgtatgtgaaaaggtttgagcctgagcaaatttccatccccctttcggctgcacttttgatgaaaaagaaagatgtcgctgaactgctcgaagtccgtaaaatacttgaaatcggggcagtttccagtgcggctcaaaaacgcacggaggatgatctcggacgcatgcaggaagcacttgaggatatgaagctggcggacgggaacggcgaacttggcgaaaaagccgacctcgcgtttcaccttgcgcttgccggcgcttcgcagaacgatctgctgaaaggcttgatgaatcatgtgtcatctctcttaattgagacgatgagggagacgcgcaaaatttggctgttctcgaagaatacaactgttaagcgcctttatgaggaacacgaagccatctatcaggctgtgaaggaaaaagacggccaaaaagcggagcaagcgatgcacaatcatctgacaaatgtggaaaatgtgctggcctcatattttgaagaaacgaaacaagccgacgagccggctatttaa

SEQ ID NO: 3517 - DNA, 1692 bp, Bacillus licheniformis
atgggatggacgcaagattatactccgctggggaacagtttgctgctctcttcgcttgcagcgcttataccgattttgtattttttctgggctctggcaatcaaaagaatgaaagggcatacagcaggcttgacgactttgctgatcgcactcgtgctggccgttttcgtatacggcatgcccgctcagcaggctgtgatgtcggcttcgcaaggcgcggtttacgggctgctgccgatcggctggattatcgtgacttcagtttttttgtacaagcttacggtgaaaaccggccaatttgaaatcatcaggagttcggtattgtcgatcacagatgaccgccgtttgcaagcacttttgatagcgttttcattcggggcatttttggaaggtgcggcaggcttcggcgcccctgtcgcgatatcggctgcattgcttgtcggcctcggctttaatccgttgtatgcggcgggcatatgcctgatcgccaacacggcgcctgtcgctttcggagcgatcggcatcccgattatcgcggttgaagggccgactgggattcctgcgatggacatttcaaaaatggtcggacgccagctgccgtttttatctgtatttattccgttttatttgatcatcatcatgagcggtttcaaaagggctttggaagtgctgccggccattctcgtgtcgggcgtctcttttgccgttacacagtatgtaagctcaaacttcctggggcctgagctcccggatattttgtcagctatcgtatcgcttatcgctctcgctgtattcttaaaattttggaaaccgaaaacgacattcagattctcacaagaaaaggaaatggccgctgcagcggaggcgcagcagcttgaacatcaaaaggcctcatactcggcggggcagattttcaaggcatggacaccgtttttgctgctcacggcaatggtctccatctggggaattccatctgtcaaacaggccttgacgggccattatgaaggttcaaatccattgctgctgttcataaatgatatcggcggcaggctgacgtttgcacccggcgtgccttttttgcacaatcaaattctcgatggttccggaaaaccgcttgaggctctttacaaacttgatctcgctggatcggcaggtacggcgatcctgattgccgccgtactgacaaagtttgtcacaggcatgccttggaaagaatggggcgccgtatttacagattcgctgaaggaactcggcaagccgatattaacgatcgcttccgtcgtcggttttgcctatgtcaccaattcttcgggcatgagcacaacactgggcatgtcccttgcgatgaccggttcaatgttcgcattcttttctcccgttctcggctggctcggtgtgtttataaccggttcagatacgtcggccaatttgctgttcggaagcctgcaaaaaatgacggcacagtcagtcggaatggagccggtgctgtctgtggcggccaactcttcaggcggcgtcacaggaaaaatgatctctccgcagtcgattgcggtcgcctgcgcagccgtcggactggcaggaaaggaatccgacttgcttcgctttacactgaaacacagtctgtttcttcttttcctcgtttgcatgatcactttcctgcagcatcatctgttttcgtggatgatcccgtaa

SEQ ID NO: 3518 - DNA, 1311 bp, Bacillus licheniformis
atgaacttgcatgtacagcagcagcaaacggcaaaacttcacttgacgcaagggcttgcccaagccattcatatgcttcagtattcgtcggccgagctgaacagccggattgatgaactctcattggaaaaccccctgatcgaacgaaaagactccgatattccccgatcattttaccataaaacgaatcgtcatttgcaaaatgaaggaataagccgctctgagacggcccattcccgtgaagatgttaaaagcgctttgaaacggcaggcgctcgatctccagctgtcaagccgcgaaaagcgggttttcagctatttggtcgaatcacttgatccaaacggatatgtgacagaagacatcgcctttatcgcttccgagctggctgtcaccagagaagaagctgaagaagtcttgggcaagctgcagactcttgatccggcaggcatcggggcgcggtcgctacaggaatgcatcctgatccaattaaagcgtctgcccaaggagacggcaaaagcggaaaaagtcatttcctcatactttgacctgtttgccaaaaagggatggaaagagctgtcagagagagcggggctttcgctttcagagcttcaggacattcaagaccttgtcgcagaactgtcgccgcgtcccggattgatatatggcacagatgatggcgaagtctatgtcgagcctgatttaatcatttcagcagaggatggaaaattggtgcttgagctcagcagccgttcttttcccgacatccagcttaacgcgttttacgagccgtttttagagcgtcagtcaaaagacgaggcgaccgcttatatctctgataagttcaagcagtggaaatggctcgacaatgccctcaggcaaagacgggaaacgatgcggagggtgatggcggaaatcatggtgcggcaaaaagattattttttaaaagggaaagacgaactgaagccgctcacattaaaagagatcgctgatgccctcggcgttcacgaatcaacggtaagccgcgcagtcaaagggaaaatcgtgcagacgccttttgagctttgcgagcttaaacggtttttttcggcgaaggtaaaggacgccgctgacgggcatgcgtcaagtcacacagtcaaagcgcatctgcgccggctgatcgatgaagaagataaaatgaaaccgctttcagatcagaaactggccgaccttttaaacgaaaagcacggcgttgtcatatcgaggcggaccgtcgccaaataccgtgatcagctcaatatactgccttcgtctgtaagaaagagatatcaataa

SEQ ID NO: 3519 - DNA, 216 bp, Bacillus licheniformis
ttgacagagcttttctccgtgccctatttcatagaaaattttaaaacccatattgaaatgcatccaaatgaggataaaatccacgcgatgaacagctactaccgttcagtcgtttcaacgcttgtgcaagaccagctgacaaaaaacgccgtcgttttaaaacggattcagcatttggatgaagcctacaacaaagtaaagcgtgaagaagcatag

SEQ ID NO: 3520 - DNA, 978 bp, Bacillus licheniformis
atggcgattacatattccatggacagcttaaagcataagctggcagaaattttggatgtcattccaaggcattcatcagtcgtttacttggactacccgctatacggaaacgtcggggatctattgatcatgaaaggaacggaagctttttttgaagcatacggcatcaaggtgcgcgaaagatggaatgcggagaatttcattccgggccgccgcattccaaaggacgccatcattgtttgtcaggggggcggcaatttcggcgacttgtaccctcacttccagcagttcagagaacgggtggtcgaacattacccggacaaccggatcgtcattctgccgcagtcgatttattatgagcatgaagaaaatataataaaaacgcgcggcattttggcggctcacccggatctgcacttattcacgcgggaaaaggcatcattcgattttgccgtcaagcgtttcgaagaggtgaaaaacatcaaaatgatgcccgatatggctcaccagctctggccgatcgcggcacctgccgaaaagccgtccgagtccgttctgcggttgatcaggaccgacaaagaagccaacagcagcctgcagaaagcaggggagccggacacgtacgattggaacgtcatcttatcagaaggcgacaaacgcggaatcaaacgcctgcagacgatcaatgtcctcaacaaaaaagcgggcaatccgctgccgatcgcttcttattggaaacgcttttcggacagcctcgtcgacaaatcaatccgtttcttcagccgctatgaatcagtcgttacttcaaggctgcacggccacatcttatcgtgcctgctcggaaaagaaaacgtagtgattgacaactcctacggaaaaaacgcgaattactacaatacatggatgaaagacatcccgaatacgaaactgattcaaaaccatcagacagaagcagaaaaaccgcctgttcacgtatga

SEQ ID NO: 3521 - DNA, 1146 bp, Bacillus licheniformis
atgagtcagaataagcgaatttatttatcaccgccgcacatgagcggagacgaggagcgctatgtagccgaagcgtttcggacaaactggatcgcgcccctcggtccccttgtcgacacatttgaagaaaagcttgccgcctatgcggggacgtccggagccgcggcagtcagctcaggaacagctgcgatccacctggccttgaaattgctcggcgtcggcaaaggcgatacggtcttctgctcttcttttacgtttgtagcgagcgccaatccgatcatatatgagcaggctgaaccggttttcattgattctgaacgggatacatggaacatgtcgcccgaggcgcttgaacgggcgcttgacgaagcggagcgggccaggaatctcccgaaagccgtcatcgtcgtcaacttgtacggccaaagcgcgaaaatggacgagattatggccatttgcgatcgatttgccgtgcctgtcattgaagatgcagccgaatcgctcggttctgtttataaaggcagaaaaagcgggaccttcggacgcttcggcatttattcgttcaacggtaacaaaatcatcaccacatcgggcggaggaatgctggtcagcgatgatgaagacgcgttgaagaaggcgcgctttttagccactcaggcgcgcgagccagccattcattatcagcacgaaaaagcgggctacaattaccggatgagcaatgttctggccggaatcggcatcgcacagctcgccgttctggatgaccgggtacatgccagacgggcggttttcgagcgctataaggaggcgctttccggtatcgaaggtatagaattcatgcctgaggccggcatgtcaaaccgctggctcacgacattaacgttagacacagcaaagattcaaacaacaccggcggacatcatcgaacagctcgcaaatgaaaacattgaggcccgcccgttatggaagcctttgcacagacagcccctttttaaaggcgcggccttttatccgcacgatgaccagggctctgtctgctgcgacttatttcagcgcgggctctgcctgccgtcaggatcaagtatgacgcgaaaagagcaggaccgggtaattcaaatcgttgccgaccggattaaatataaatga

SEQ ID NO: 3522 - DNA, 627 bp, Bacillus licheniformis
atgcaaaacgtggtgatcatcggagccggcggccatgggaaagtcgttcgggaacttgtaaaagagcggccggatacggagcttgccggtattcttgatgaccggtatgcggagcttcatgttgagaacggtctgtatcgagggccttcagctgccgcagaagaacttgcgcggcttcatccggacgcgaagttcgtcctggctgtcggccaaaacagcatcagacagcagctgtatgaacgcattggtcttccgcttgaccggtatgcggttttgattcatccctctgctgttgtcagcggttcggcccggattcaaaacggcgccgttgttatggcatcgagcgtcatccaagcggatgcagacgtcggcatccacgcgattgtcaacacaggtgcgatcgtcgaacacgacaatcggatcggcgattacgttcatctttcgcccggaacggtgttaaccggcggcgtgacagttatggaaggcgctcatctcggcgcgggaacggcggtcattcccggaaagacagtcggacgctggagcgtgacgggagcgggggcagccgtgattcacgacattcctgataattgcaccgcagtcggagtccctgcaagaatgatcaaataa

SEQ ID NO: 3523 - DNA, 603 bp, Bacillus licheniformis
gtgctagcgaaacggtttttcgatcttgcattgtcagttattttgctggtcgcgctcagtccggccatgattctgacggcttgtctcatcagatggaaaatcggctcgcctgttttatttcgccaaacccgtccggggctgaatggcgagccttttacattatataaattcagaacgatgactgatgaaagagatgcagcaggcaatctgctaagcgatgaaaagcggctgacaaagacggggcggctgatcagaaaaacgagccttgacgaattgccgcagctgatcaacgttatcaaaggagacctcagcctcgtcgggccgcgcccgcttttgatggagtatatccccctttatacgaagcggcagtggagacgccacgaagtcaagccgggcatcacgggctgggcgcagatcaacgggagaaataaagtgacatgggaggaaaaatttgaactcgatgtctggtatgtggatcatcgttcttttttgcttgatctcaaaatccttttgttgactgtcgtaaaggttttgaagtcggaaggcgtcagccaggaccggcatgtgacagcagaaaaatttacagggagaaggaatgcctga

SEQ ID NO: 3524 - DNA, 1194 bp, Bacillus licheniformis
ttgggggatgtgcaggtcgcgcttttgatcggcagcctgctgtttttattgacctttgtgatgtcggggtttgccgccggtccgtttttcgccaataaaatctatattacgagcacgatccaagccatccaaatgctgattcgcgttctgagcgtattgttgattttcgcgtggtttgcaccgaagatctggcacattcagctcgccgctctcatcgcaaccgcttcggcgtgcatcctgtcgatctttttctttaagagattgattccatggtttacgttccgggtgagggatatgtcgtttgcaaagtgcaaaaaactgcttcaggcgggaggatggagctccgtcagccaagtcggcatcctgctgtttctgcaaatcgatttaatggtggcgaatgtgatgctgggggtttccgaatccggcatgtacgcggcgatcattcagtttccgctgttgttgcggacgctttcgggaacgctagcggccgtattttcacctacgattacactctattattcaaaaggcgacaaagaagggctcgtccgttatgccaatcaggccgtcaggtttaacggcatcctgctcgctttgccggcggcgcttctgggggggcttgccggcccgtttctgtcgctttggctcggcccttcattcgaacatttgaaatggctcttactgatacatgcgggctatttggttgtttcattaagcccggcgccgctgttttacatctttaccgcctataacaagctgagaacaccggcgctgaccacggttgccttcggcgttgtcaatttgctgcttgccatcgtgctgagcggcccggcgggactcggcctttacggaattgcgctggccggtgcggcagctttaacgctgaaaaacgtcgtcttcactccgatttatgcatcaaagattacgggtgaaagaaaaagggtcttttataaaggcatatacgggccggttgccggcgcttcatttactttggctgtctgttacgctcttcaatacttattttcgatcgtcagcctgctgtctttgtttgtcacggcactggctgcgacgttggcttacggcctgtttgcctatttcgtcatgttgacgaaagcggaacggcgcattgtcacaacgaagctgcaagcataccggtgttctctatccttcccgtttcaaaagggattttttaaataa

SEQ ID NO: 3525 - DNA, 384 bp, Bacillus licheniformis
ttgaataagacatttgttttgaatctcggcgccaatatggcgtcttttttattatcggtgctgttttcgatgtggctgacgccttacgtcatcaagaccctcggtgttgaggcgtttggatttgtccatcttacacagaatatgatcaattacttttcgataattacggtcgccctgagcgcggtcgttgtccggtttttttctgtttccgcccacaggggagcgcttgatgaagcgagaggctatatgaatacctatatcgtttcatcactggtgctttcagtcatcttgttttttccgctcggcggcacggtgttttttatcgatcagatcattcgcgttcccgccggtctcttttgggggatgtgcaggtcgcgcttttga

SEQ ID NO: 3526 - DNA, 1020 bp, Bacillus licheniformis
atgaagccatttatcagtatcattgttccgatgtacaatgtcgaagattatatagaagaatgcgtcgattcgctgcgcaggcagacgctgaaaaatattgaaatcatccttgttgatgacggctctcccgacagatccggggagatagccagaacgtactgcagcctggatgccagagtgaaagtgattcataaaaaaaacggcgggctgagctcggcgagaaatgccggtcttcaagccgcgacaggagattatgtcgggtttgtcgacggtgatgattttgtattgcctgccatgtttgaaaacatgtacgccgctgccaaaaaagacgacctcgatatcgtcatgtgcgggtatcataaacattccgatacggaagacgcctacttcccgccgccgctgccgaccgatcgcctcttgttgagctgggatattaaacgcgagctcaaaaaggcgcacgaaacccgcttcatctggtatgtgtggcggaatttgtacaggcgcgacctgctgaagaaaaaccagctgtacttttttgaagacattcgttttgcagaggattcgccgtttaatttgtacgccttttatgcagcgaaacgagtgagagcgatcgatgaaggctactacatgtacaggtgcaacccggacagcctgacagaggcgccgtttaaaccgtacatggatgaaagcctgaaaaggcagtaccgggcgaaaaggagattctatgagacgtttcagcttttggatgaatgtgcggacgatttggaaacgtacacatgcaaacatcaaattccgatgcttttagccaatgcctgtgcggaaccgaagccttcaaagcaggtgaggcggcacattaaagacattttgtcttaccggatggtgcagtcgtgcgtcaaagccacgtctctccgcaaccgcaacctgttaatcggccagcggctcgttttattgctatgcaagctgaatattccgattctgctcgaattgttttttaaacgaaatctgcccagtaagggatga

SEQ ID NO: 3527 - DNA, 1080 bp, Bacillus licheniformis
atgacctttcaggaactgaagatcaatcttgcagaatggcttttgctcaaggtgaaatatccttctgaatatgtgatgggaacgccgggtttaaggcgctttgaacaatataaaggcaagaaaaaaatcattctgactttaattccgtcccatgataatttgggagatcatgcgattgccctggcaagccgcacattcatagaaaacgagtttcccgattttgagttaattgaaatcggcattaacgatatttacaaacatgcaaaagcgctcatgcgcatccgccaccccgaggatatggtattcatcatcggcggaggaaacatgggggatttgtaccgcaatgaggaatggacgaggcgcttcattatcaaaacattcaagcattataaaatcgtccagctcccggcaactgcgcacttttccgagacgctccgcggcaaaaaagagctgaaaagggcgaaaaaaatctacaactcccatcgccggctgttcatgatggcgcgcgatgatacaacctatcaatttatgaaacagcacttctcaaaccaaacgattgtaaagcagcctgatatggtgctttatttaaagaaagaacagcagtctgaaagagaaggtgtgttggtttgtttaagggaggataaagaaagctttctcaggccggaagagcgtaaaaagctgctgaaggctgtcggcgacgagtatggcggtgcaaaaacttttacaacgacgatcggcaggagggtcagccgcgtgtcccgcgagaaggagctgaaccggctttgggatcagctgagaggcgcggaggtcgtcgtgacagacaggctgcacggcatgattttttgtgcgataacaggaacgccgtgcgtcgtgatccgctcttttgatcataaggtgcttgaaggctttcgctggctgaaagacgttccttcgatgaagcttgtggaaaatcccgatgcggcagaggttctcggcgcaatcgaagagctggtcaagaccggtgactcgcatcgtgagaccccggcaagggatcattatttcgcagatttaagacggaaaattatgggtgatgtccaatga

SEQ ID NO: 3528 - DNA, 1032 bp, Bacillus licheniformis
ttggaaaatccagcagttagtctactggtcgctgtttataatacagaagcttttttgccgaattgtttgcagtcgctgatcagccagaccttgaaaaatattgaaatcattatcgtcaatgacggttcaacagacggaagccagaagatcattgatcattacgcccgaaaggacgggcgcattaaaacgattcagcaggacaatcagggcctcggcgctgtccgcaataaaggcatcgaagcggcgtcaggcgagtacttggcattcatcgactccgacgactggattgagccggactattgccagtctatgtatgaaaaagcgaaggatgaggatgccgatcttgtcatctgtgattatgccgttgaaattcaggataccgaaaaaacggtctgcccggacatcgggaagaactatgaaggaaagccgaaagaggcatttatgaaggatttgttaaagggtaaagtaagcggcttttcctggaacaagctctacaggcggagtctgattgagcggcataagctcgttttcccgctccgcgacgagctggaaaacatcgaagatcaatatttcagcttcagatgccttctatatgcgaataccgcggcgttcgtgactaagccgctttatcattacagggtccacctggcgtccatcgtccaaaagtatcaggcagggctgtttgaagacggtctcgctctttatgaagcaaacctggactgcctgacaaagcacggagagctcccggctttaaaggaggcgctgcacgtctttatcgtcaaccacggctgcatcagtattttaaatgaatgcaagagccgaaacaaaaacccttcaatagaaaaatataaaaatatccgcagcatatgcgcctgtccggaattcagggggaaaatctccgcagtggacatgtcggcattcgattccaagaagaagcttttgcttatgctgattcgcttgcggttgatgccggcagtgtatggatttgcggccatttaccagaaaatgatcgagcacagaatgaagaaatag

SEQ ID NO: 3529 - DNA, 1104 bp, Bacillus licheniformis
atggctgtctacatgttgaatatggggattgttttcgtctggtcatggtttgcgaaaatgtacggcagggaagatcacaggctgccgacgggctaccgtccgaatgcgatcctcaccgtcgttccgctcgcgtctttgattatcgttgccggcttaagatacaaggtcggaacggattaccacacatatatgctgctttacgaattagccggaaaatacaacagcatttgggagatattcggtttcggaacaggcaagtcgtcgacggacccgggatttaccgcactcttatggattttaaatcagatttcagccgatccggcgctcatgtttgccgtcgttgccgcgattacctatatctatattgtcaagacgctttatgtgtatggaaggccgtttgaattgagcatgtttctgtttatcggcatgtttcactattatgcttcgtttaacggcattcgccaatacatggcggcggccattctgttttgggcggtgcggtatctgatcgatgggaagctggtgcgctatatgatcgttgtactgatctgttcgctttttcattcttcggcattgatcatgattccggtttatttcatcgtcagaagaaaagcgtggtcgcctgtcctctggtgcctgatgctcgtctttttggcggggacttttctgtatcaaaaatttctgtccgtattcctagtcgtgcttgaaaacagtcaatacggacattatgaagaatggctgatgaagaatacaaacggcatgaacgttattaaaatcatcgttcttcttctcccgctcgcacttgccttttgcttcagggagcagctcagaaagcgctggcccgaagtcgattatatcgtaaacctttgtctgatcggtttcctgttcggaattttggcgacaaaggatgtcatttttgcgaggttcaacatttatttcgggctctatcagctgattctcgttccttattttgtacggatttttgaaccgaaatcaaacgcgcttctttatgttttgattttgatctgttacttcttatacagctttatgctcatgccgttcgactcgtcggtattgccgtacagaacgatttttgaacgttga

SEQ ID NO: 3530 - DNA, 1161 bp, Bacillus licheniformis
atgaatgacggaagcgtgagaccaaaacgggtgcttcacatcgtaagcggaatgaaccgcggcggcgcggagacgatgattatgaatatataccgccacacagacaggcggcatattcaatttgattttatttcccaccgggaagaaacgtgcgattacgacccggagatcatcacgcgcggcggccgggtgttttatgtaccgagcatcggtcggtcgggtcctgtcgcctacatcaaaaacatcagaaggattttggttgagaaagggccttatgccgccgtacacgctcatacggattttcagacgggctttgccgcattggcggccaggctcgccggcgttccggtcagggtctgccattcccacaacacggcctggaagcctaacccccggttttgggatacatggcagcttcttgcattccgccgcttgattttctccagtgctacggctctgtgcgcttgcggcaaagatgccgggcgttttttattcggcgcaaagaagatgggtgaaaacgcggtccatcttttgcaaaacgggattgaacttgaccggttcaaagaagcgaacggcgtttcaaaaacgaatgcgaaaaagagcttcggtatcaaagaagacgcactggtgatcgggcatgtcggccgtttttttgaacagaaaaaccacgcgtttctgctcgggcttgccgcttattgcaagaaatcgggcataccttttcaagcggtgttcgcaggtgacggtccgctgcgcagacagatggaagaaaaagccgctgctctcggtgtaaaagacgacattctgtttctcggcgtcgtcgaagatatcccggctctcatgcaggcatttgatgtatttgtcatgccgtctttgtttgaagggctacccctcgtactggtcgaagcgcaagcgtcagggctcccctgcattgtatcagacaacattacggaagaaaccgatttgggactcggcctgctgcaacgtctcagcttaaatgccggttttgaacggtgggctgaggatatcagccgtgctgctcagccgaaaaagcctgcatggccggaaatagagagaagccttgctgagagaggctatgatgcaaaagcaaatttggcgagactgatggacatctattcaatctccgcagcagaaggacagtga

SEQ ID NO: 3531 - DNA, 843 bp, Bacillus licheniformis
atgatagggggtcaaaagccgaaagtttctgtcattatgggagtctacaattgtgagaacacgatcgcagagagcatcgagtcaattttaaatcaaacctataaaaattgggaactgattatatgcgacgatgcttcgacagacgggacatatgctgttgccaggcggtatgccgatcattacgcagataagattaagctgatcaaaaacgagaagaatcagcggctggctgcctcgttaaaccactgtctccaatacgccggcgggaaatatatcgcgcgccaggacggagatgacatctctttgccgaggcggtttgaaaagcaggtcgcgtttttggaatcgcaatctcattatcatgtcgtcggaagcggcatgatggccttcgacgaaaacgggattagaggcgtcagaatgcttccttcctctccagaaccgagaatcatggcgaaagggacgccgttttgccatgcgacgatcatgatgagagccgacgtctacgaggcgctggacggctatcgggtcggccggagaacaagaaggatggaagatgtcgatttgtggcttcgtttttttgaggcgggcttcacgggctacaaccttcaggaagccttatacaaagtaagggaagacgaatcggcgtttaaaaggagaaagctcagctactcgattgataatgcgtttatcgtctttgccgcctgcagacggctgaagctgccgctatcggactatatttatacaatgaaacccatcatcagggggcttatgcctccttttatcatgaacagatatcataaaagaagattgatgaatgaaggcggaggggtcgtaaaacatgaatga

SEQ ID NO: 3532 - DNA, 1149 bp, Bacillus licheniformis
atgacaagaacggttttgttttgcgctactgtggattaccatttcaaggccttccacctcccgtatttaaaatggtttaaagagcaggggtggaatgttcatatcgccgcaaaaggagatatgacactgccctatacagataaaaaatttgatatcgatatcaggcgttctcctttgaatgcaagcaatatcgctgcctatcgggagctggcgcgaatcattgacgaacaccggtacagcatcattcattgccacacgccgatgggaggcgtgctggcaaggcttgcggcccggaaacagagaaaagaggggacgaaagtgatctataccgctcacggtttccacttttgccaaggtgctcctttaaaaaattggctgctgtattatccgattgaaaaagggctgtccgctttgaccgattgcctgattacgatcaatgaagaagatttcgtccttgcaaaaggcttgcgaaaagcgctgcgcacggaaaaaatccacgggatcggcgtcgatacggagcggtttcatcctgtcagtgaaacagagaaaatgctgctcaggaaaacatacggtttcaaagaagacgactttatcctcatatatcccgcggagctgaacgcgaataaaaaccaggccttgctcatcgaaacggcggctgctttaaaagacagagccccgaacttaaaggtcgtgtttgcaggaaaagggcagatggagcaaaaataccgaaatcacgctgaacaaaaaggcgtttcttcgctcgtcatgtttgccggttttcaaaaaaacatccacgaatggattcagcttgcagacgtgtctgtcgcctcaagcatcagggaagggctcggcatgaacctccttgaaggaatggcgtcaggaaagcccgccgttgcagcggacaaccgcggacaccgggaagtcattcaagagggcgtgaacggatttttggttccgcagggagacgccggaacgttcagcgaccggatattgcagctgtaccgtctgccttctttgcgaaaaaagatgggagacgcggggagacgaacagccgccgctttttcccagcagcgcaccgtcaaagaaatggcgggcatttactcttcctttatggataacgaaacagttgaaaggaggctgaaaggatga

SEQ ID NO: 3533 - DNA, 1818 bp, Bacillus licheniformis
ttgacatatcggagaaggctttccattattaccgcactcgattcgtacttggttttgctgtccatctttatcggatatcagctgattttgccatcatatgatttatacccttcggaaatgctgctgatgacttcactgatactgcttggcgctcagcatttattcgcccattgcttccacctttataaaaaagtatgggagtatgcaagcatcggtgaattgtatgtgctgcttaaatcgattacattgtcccatcttgtgacggcggccctcgagctgtttttctttcaaaacgttccggttcgtcttttatgtttaagctggctgttccagctcattttgatcggcggatcgcggatgatgtggcgcatcatcagggaacaggtgaacaaagaaagcaaaggatctctaagggcgcttatcatcggagcgggctctgccggcagtttgattgcaaaacagcttgtgcagaagccggaattgaacattaagcccgtcgcctttatcgacgatgacaaaacgaaataccggcttgaaatcatgggtctgcccgtcttaggcgggaaagagcagattatgcaggcggtccggcaatggaatatcgaccggatcatcatcgccattccatctttgagcgtcactcagatgcaggaaatgtacaaggcgtgtgcgcaaacaggtgtcaaaacgcaaatcatgccgaaaatagacgaaattttgcttggcagacatcctgtcggccagcttcgcgatgtcaaagcagaagatttgcttggaagggagcctgtccagctcgatacgagcgaaatctccaatacggtcaaggaccgcgtcgtacttgtgactggggccggaggttcaatcggctcggaaatctgccggcaaatcagcaaatttaaaccgaaatcgatcattttagtcgggcacggagaaaacagcatccattcgatcctgcttgaactgaaggagaaattcggaaagcatgtcgcctattatcccgaaatcgcggacatacaggacagagaaaaaatgtttttgctgatggaacgctacaaaccgaatgtcatttatcatgcagctgcccacaagcatgtaccgctgatggaaaaatgcccgaaagaagctgtcaaaaacaatatcctcggcacgaaaaacgtcgctgaggccgccgacgaaaccgaagtggagacatttgtcctgatatcgtcagacaaagcggtcaaccctgccaatatcatgggggcaacgaagcggttcgcggaaatgctgatcatgaatctcggcaaaacgagcaaaaccaaatttgtcgccgtccgcttcggaaatgttctcggcagcaggggaagcgtcattccgattttcaaaaaacaaatcgctaaaggcggcccggtcactgtcacacaccaggacatgacgaggtacttcatgacgattccggaagcttcaaggctcgttattcaagcgggggcgcttgccaaaggaagacagatattcgtgctcgatatgggcgaaccggtcaaaatcgtcgacctcgccaaaaatcttatccagctttccggctatacgacagaacagatcaaaatcgaatttacaggcatccggccgggagaaaaaatgtacgaagagctgctgaatcaaaatgaagtgctggcagagcaggtttttccgaagattcatatcggcaaggcggtcgacgtcgaatggacggtgctgaagtcatttatggatgaatttatgtatttgtcagaccgcgagctgagagaacgcttgttcaaagcgatcggccagcacgagaaaaagctggtgacagcgcactag

SEQ ID NO: 3534 - DNA, 693 bp, Bacillus licheniformis
ttgggtattagaaaaaaacgctctcgcaaatatcaatcggcgcttgtcgcattgcatcagccgaacacgccgatcgtcgaacagtatcggacgatcaggacgaacattgagttttcatcatttgagaagccgttcaagtcattgctcattacatcgggcctgccgggagaaggcaaatcattctcggcttcaaacttggcgatcgtattttcgcaacaggaaaaaaaggtccttttgatcgacgcagatttaagaaagccgacgatccataaaatttttgagctcgataaccattcaggtgtcacaaatgtattaatgaaaaaatcgacgctggaaaatgtcgtccagcaaagccaggcggaaaatctccatgtgctgacaagcggtccgattcctccgaatccgtccgagcttttgtcgtcgcaggcgatggaggacctgcttgcggaagcgtacgaccaatacgatttagtcatccttgattcgccgccgcttttgccggtcgcagacgcgcaaatattggcgaatcaggtggatggaagcattcttgtcatcctcagcggaaaaacaaagcttgataacgcgatcaagtctcgggacgcgctgaattcttccaaaagcgaactgctcggcgccgtgctgaacgggcggaaagtgaagaaagcgcgccaatataattacgcaaccatgtaa

SEQ ID NO: 3535 - DNA, 753 bp, Bacillus licheniformis
atgaaagaaaatattgattttagagaactgattgcaatcttgcgaaaaagaacggttcttattctcgttttgacaataggtgtaacattgacgaccggaatcattcagttctatgtgctgacacctgtctatcaggcatcgacgcagatcttggtgcatcaagtaggggagaaaaaggggagcgccacatacagcgatattcaaatcaatcttcaatacacacggacattccaagcgcttttgaaaaacccggtgattttggagcaagtcaagagagagcttgatttaccttactctgccggccggttgggtgaaaaaattgcaacgagcagtgaaagcgaatctgagattataaatatttcggtccaagatgaaaatcagaaacgggcggccgatatagcgaacactttaactgcggtgctcaaaaaagagattaagcaaattatgaacaccgatcgggtaaccgtcctgtcaaaagccgaaatagtcgattcgccgacacctgtcagaccgaattacaaaatgaatattttgctggcattcggcgccgcattaatgaccggaatcgctttggcgttctttttggactttatcgatgatacggttgcaagaccgtctcaagtcgaaaaggaagcgggattcatttatttgggaagtattgagcaaatgaagcataaaaaaagtctgtttcgcggggaccccgatatgaatatccgcgtaaaagcaggaaggagtgagccgcttgggtattag

SEQ ID NO: 3536 - DNA, 459 bp, Bacillus licheniformis
atgatcggaagagtcatccgaatgtacagaaagagaaaaggctactccattaaccagcttgctgatatagcaggcgtatcaaaatcatatttaagcaaaattgaacgcggcgttcacagaaatccgtcagtcgaattcctgaaaaaaatctcccgggcgctgaaagtcgaattaaaggaattgtttgataccgaagtgatcctttatcgccggactgagcaggaagatgagtggagaacccatcttgtacaggccgtgcaggccgggatgaaccaggaagaactgtttcaattcacacatcgcctcaagcagaaaaagaaagaacgggcgctttatcgaaacagagagctgacccgggcgaatatcgacgaatggagagcccttatgctggaggccaaagaaatgggactgaccgtcaaagaagtagaagcgtttttgatgaggacaaaaaatcattaa

SEQ ID NO: 3537 - DNA, 525 bp, Bacillus licheniformis
atgaaagtattagtgctcgcatttcatccgaatatggagcagtcagttgtgaacagagcatttgcagacacattgaaagacgcaccgggcattacattgcgcgacctttatcaggaatatcctgacgaggccattgatgtggaaaaagaacaaaaactttgtgaagaacacgatcggatcgtcttccagtttccgctttattggtacagctcgccgcctctcttaaaaaaatggctggaccacgttcttctctacggctgggcatacggaacaaacggcacagcgcttcgcggcaaagaattcatggtcgctgtatcggcgggcgctcccgaagaagcctatcaggccggcgggtcaaatcattatgcgatcagcgaactgttacgcccttttcaggcgacaagcaacttcatcggtactacataccttccgccttacgtcttctatcaagcgggcacggccggaaaaagcgagcttgctgaaggtgcgacacaatacagggagcatgtgctgaagtcattttaa

SEQ ID NO: 3538 - DNA, 1281 bp, Bacillus licheniformis
ttgaatcacccgattcaaaaaaagtcaaatgtacgctgggttgtcgcgtttatgatgtgggctgcgattgccatcaattatattgaccggacagttctttcggctgccgctccctatattaccgaggagttcaacttgacacccggccaaatgggaatcatcatgtccggtttcttctggtcgtacgctttgctgcagctgccttcaggctgggcggccgacaagtacggtcagaaaaaaacgctcggttttgcggttgtttggtggtctgttgctacggcgctgacgggtcttgcgacaggcttcaaatccctgctcgggctgcgggtcgcactgggagtcggagaggctgctgcatatccgagcaatgcggggattgccgccaaatggtttccgaaaaaagaaagggcgacagtagccggaatttttgacagcgggtcaaagtttggcggagctgttgcaatgcctttgatcgcctggatgatagcggtctttgactggaaactgacgtttcttttgatcggacttgtcggtgtcgcgtggggaattgtctggatgattttctttaaggagaatcccgcagatcataagcgcgtcaatgaggcggaactggcccatattcgggaagggcaggctcacatggaagaaacgggcggcggccagccgctgaagtggtatcagctattcaaatatcgcaacatatgggcgatgtgcattggatttttcatgatcaattataattcttacttctttatcacatggctgccgacataccttgttaaagaaaggggcatggatttaatcgagatggggattatggcgtctctcccgcttttgactgcaatggtcgtcgaagtcggagccggatggatgtccgaccggatatatgcaaagggaaaactgtcgctgacagccgtccggaaactgtttttaattatcgggcttgtcatggcttcgtgcatcggttttgccgcttttgcagattccgctatcctggctgtcatccttctttgtgtagcgaaatcgggaacgactgtcgccgcgtcccaagtctgggcgcttccgggggatgtggctccgaaaaatatgacgtcgatggttgccggtattcaaaatacagtctctaatatgggcggagtggtcggacccatcattaccggcttcatcgttggcgcaacgggttctttcgtgccggcgctccttttttcggctgctttgatcatcattgccattttaaattatctattcctattgggaaaagtgaaacagattcaagtataa

SEQ ID NO: 3539 - DNA, 951 bp, Bacillus licheniformis
atgaaagtcgtatgtacatcaccgtcatttgcgaaatactcagacgatcccgtcttgtttttggaaaaaaagggcatgtcgctggaacgccttcctgcagatataaccgaggagcagtttattgaagcagcagaaggagcggatgccgcgatcgtggcgtttaaccagattacgccgtatgtcctggatcgtctcccttctttaaaaattgtctgcaaacatggcgtcggtgtcgacaatatcgatctgcacgctgcgaaagagcgcaacgtctgggtgacgaatgcccccaacgccaacaagcatgcagtcgccgattttgtattcggtctcatgctgtcggctgcaagacagattcctgcagccgacagggagacaaagctgggaaaatggccgaggatttttggatctgacgtttacggcaaaacactcggcatcgtcggacttggcatgatcggaaaagaagtcgccaaacgggcgcaaggcttcaatatgactgttttagcctatgatgtgtttcctgatcgtgcattcgcagccgatcatcacatccattttacagagcttgatcagctcttgaaagaatgcgactttatcactcttcatatgccgctcacagccgaaacggaaaacatgatcggtgaaaaagaattagccgctatgaaagaaacggcttatctgatcaatgcttcaaggggaggcatcgtgtccgagtgtgcgttatatgatgccttggcgagcgggggcatcgctggagctgcgcttgacgtgtatcaaaccgaaccgctgaagcagcaccctctctttgagctggaccgttttatcgccgtgccgcatatcgcggggtatacccgagatgccgtacagaaccttggcatgatatgcgtcaaaaacatcgctagtgtactgatcgacaaacaaaaaccggagtttgtcgtcaacgggttgtga

SEQ ID NO: 3540 - DNA, 999 bp, Bacillus licheniformis
atgaagaaaccggttatcggcattacaatgggcgacgcggcaggcgtcggtccggaaattatcgtaaaagccctcacgtcccgcgaagtgtatgatatgtgcaggccgctcgtcatcggcgatatgaaaatgctgaaaaaagccgccttccaaatcggatcagaggttgttattaacaaggtcgggcatccggacgagggcggttttgtacatggaaagatcgattgtctcgatattgaactgctgcctgaaaacctgcctgtcggaaaggtgtcggctgaagctggaaacgccgctttccatttcgtgaaaaaagcggttgagctcgctaaaaaaggctgtattcaagcgatttgcacagcgccgttaaataaggaggcgctgcataaaggcggacaccgatacccggggcatacggaaattctcgctcatttaacgaatacaacagactacagcatgatgctggcttcgccaaagctgaaggtgattcacctgacaacgcatcaagggctgatcgaggcgattcagtcgattacgccggagcggacctataaagtcatccgtctcgcacatgatacattgacaagagccggattcgaacagccgaaaattgctgtttgcggaatcaacccccatgcaggggaaaacggcctgtttggaagcggcgaggaagaacggcaattgcttccggggattgagcaggcggcagctgagggaatcgatgccggcggcccataccccgcagacacgctgttttacaaagctgtcagaggagatgttgaccttgtcgtagcctgctaccacgaccaggggcatataccggtcaaagtcctcgggttggaagagggcgtcaacattacagtcggattaaacggcgggatcatacgcacctctgtcgaccacggaaccgcatttgacattgcggggcagaacaaagccgatgaaagaagcatgctcgctgctttgcggtcagccgctgagctggcgcccaaatcgtag

SEQ ID NO: 3541 - DNA, 1272 bp, Bacillus licheniformis
ttgaaaattgcaatcatcgcggatgatttgacgggagcgaacgactgcggcggtcagcttgttcattacgggatggatgtttccgtcaaactcgacgccgaattcaccagacgggaaacggaaggcgtcgttattttcaatacggacagcagatcgctgccagccgcagaggcgaaggcgactgtgaaaaacatcagtgaacacatctcccggcaatcgtttgatatcgtctacaaaaaaatcgacagcacgatgagaggaaatatcggagccgagcttcaagcgatgtacgaagtgtttcagccggactttgtgctgatcgctcccggctaccctcaaaacggacgccaggttatcggcggcatccattatgtgaacggcgtaaagcttgaagaaaccgaagcggcaaacgatccgaaaacgcctgtagccgagtcgaatattcaaagattaatagaaaagcagactcgaaataagagcgggcatttatcatatgaagacatccgccgcggacacgggcatgtccgcaacaagctggaacgctttcgggcggaggggatttcatatgtgacggccgattcggttcacgaatccgatctgcaggggctggcgcttattctggagagtttgccgtattctatcattttggccggttcggcaggcttgatgagctgtctgcccaaagcgttcaatctgaaagaaagggagctcggtcaaaccgttccgtcttccgaccagccgatcatgtttgtcgtcggaagcatgagtcggacggggagggaacagcttcacgaactattcgccggacgtgcggctgaaaaaattgaaatgagatcagagcgcgtgctgtgcggcggagctgagaaaagaaacgagttcgaacggctgaaggaaagggcggcggacgtccagcgccgttcgaaacacatcgtcctctgcacctcagacaatgcggcagagacacagaagattggtgaaagccgcggactcaccccagttcaaacgagcaatgcggtgtccggtgcacttggcgaatttgcgggcgagctgattcaagcttttcatgtgaaacggctgttcttaaccggaggtgacacggcatatcaagtgctgcatcagcttcggattcatgagatacgattgctggacgaagtagagcccggcattccgctgggagcagccggtgaagaattgtacattgtgacaaaggccggaaattttggctcgcgttcggtgatggcaagtgcggcaatcaagctacaaggaggataa

SEQ ID NO: 3542 - DNA, 1167 bp, Bacillus licheniformis
atgccagcgaattatcaatttcggacagccggtcatatcgttgcaggtgaacattccatccgccggctgaaagatcatgtgcgaacgattgtaccgaaggcggacagggcgctgattattacccagccgtcgatcgtcaagctcggcgcgatcggagaggtacaggctcagcttacagagatcggcattcagtcagatgtttgcacagccatattgccggaaccgaccgtacaaaatattgaagacgtatttagaggcatccgtgagaaacgatacgacattctcatcggaatcggcggaggcagcgttttggacggaacgaaaatattgtccgtgctgcaaacgaattcaaaaaaggtcgaggagctgctcgggacagatttggtcgaaaagccgggaatcccgaccgtgctgattccgagtacttcggggacgggcgcagaggtgacgccgaacgcgatcgttacgcttccagaagaggaattgaaagtcggcatcgtcagtccgcttcttttgccgaaacttgtcattcttgacccggtcatcacccttggattgccaaaaccgattacggcggctaccggaatggatgcattcactcattcgcttgaatcgttcatttcgacgaaagcaaacccgatcagcgatatgttcgctttagaatccatcagattgatttcggcaagtattgtggaagcatatgaaaacggttcatcgatacaagcgagagaaaacatgctgctcggttcgacgtatggcggaatggcgctgacggctgccggtactgctgccgttcacgccctcgcctatccgcttggggggaaataccgaatttcccacggtgtcgccaattcgatgctccttccgcatgtgatggagtttaatatggatgccattacagaacggctgtctcttgcggcagaaacaatgggaatcgttgcatctgatttgaccgccgaacaagcggctgaggccgttgtgcagaaaataagagagtggacggagcggctgaatattcctcaggatttaaaagcgttcggcgtaaccgcaagcgacgtggacgatttagccgactcagcttcaaaagtgacgcgcctgcttcataacaatccgaaaccgctcagtctggaaaatataaaagacatctatcgaaaactaatcaactaa

SEQ ID NO: 3543 - DNA, 888 bp, Bacillus licheniformis
atgggattcgtaccaaaggggatttatcctgctatgctgacaccgctcacaaaagatcaaagcattgatgaatcggcattgaaacagctgacaaaccatttgatcgatgctcatgtacacgggctttttgcgttgggtaccaacggggaatttcatatgttcaacatcgaagacaagctgaaagttgcagaaatcatcattcaagaaacggccgaacgcgttcccgtcatggtagggagcggaggaaacagcacagaagaagcgatctggctttctaaggaaatagagaggcttggagcagatgcgctgtcggtcatcacgccattctttattccaccgacacaggaagaagcggcggtgcattataaaacaatcgcggcatccgtttcacttccgatccttttgtacaatatcccttcaaaaacaggtttccatttagaaccagaaacagtggcagagcttgcaaaagtggacaatatcgttggaattaaggacagcagcggaaactttgaaaacatacaacagtatatcgagcagacgaaaaatgacgacttttccgtttttgcaggcaccgattcgctcatattgaaaacgcttcaagcgggaggagcgggagcagtcgcagcaacagcaaatatgcttccggatatcgtaacgtctatttaccaccattgggcagagggtgagactgaaaaggcggaggctgcccagatggagcttcagccgcttcgcgatacgtttcgtttaggtacgatcccggcggcactgaaaaaagcggttgagctttattcgatccctgtaggcccgccgaaagcgcccgtcaaagaactgaccggtccggcgcttttggaggtcgaaaaaatggttgcttcctatcaatcaaaatag

SEQ ID NO: 3544 - DNA, 1719 bp, Bacillus licheniformis
atgaaagtgatggcaattgctccatatgaaggactgaaagagctgatggttcaagtggcaggcggcgagaattttgaattcgaggcggcttctggagatttagagaagggcgtggagctggcgaaacaagcggaagcaaacgggactgatttgattatcagcagaggtggaaccgctgagctgatccagcaagaagtttccattccggttgtggatatcgaagtgtcgggatacgatatgctgcgtgtgcttacgcttgccaagggctatcccggcaaggcggcaattgtcggatttccgatgattgccgacggcgcatcggcggtgtgcgaaattttggatattcggatcgacgcctgcaccgtatcagacgaacgcgatgttgaaccggtgcttcttcagctcaaagaacagggctatcagatcattatcggcgatgtgatcacaattgagaaagcagagcagctcggtttaaacggactgcttttgacatccggaaaagaaagcattgccaaagcttttgcatacgctaaaaaactgtattcctttttagagagcatcaagcagaagtacgctgtgccgtatcacattttacaaaaggccgagaccggttatgcagtatacaacaagacattgcggccggtttttcaaaacggcgtatttgccgaacatatcggcttgctggataatctggaagagctgatcggggaagcggaaaagaagggagtcatccattttagactccgaaagcatgggcggacatggaatatcacggggcgcaggtttttcgtatcagacgaggcattgaccgtatttaccgcggaaaatgcaaaagatgttcgcgtttcttctttgcccggggcaacgattctttctcctttgcggatgagttatatggaaacatcaaggaacgaaacgatgcagaaggtgctgaaaaaagcagagttgttctcggcaaggcgggaacccgtatggatcaatggagcgcccggctcagggaaagagagcttggccgggctgatccatatgaagggggaggacaagcatgagccgtttcgaaaaatcgatgccggtttgctgtctgaagcagaatgggaacaggcttgtgaaagcgaagaattcttttcagggagaggaacgctatacatcaaacaagtcgatcgcatgccgccgtcctcgcaacggcttttactcaggcggatcagcgaaccgtatgatgggccgaggctgatcgtttcttcttcccgcaggcgcgccgaggaattttcaagcgatttatatgatgcgctttgtcatttggaactggacgttccccctctttccgaaagaaaagaggatattttgcatctggcttatctgtttattgcggaaagcaatgaggcattcggcaaacaaatcgtcggctttcgaaacgaagctggtgttctgcttgaagaagcgaaatggccgggcaacctcagccaattgagaaaaacggtccaaaactgtgtccttgaagcgcagggcgtatatatcgagaagactgacgccgaacgggtcctgagccgcttgaacgaggaagaaagagaagacatcgatttatccggaacgcttgaagagatcgaaaaaaggatcattcaaaagatctatgccgaagaagggaacaatcaaacaagaacagcggaaaggctcggcatcaacagaacgacgctttggagaaaattgaaatcgtcagattga

SEQ ID NO: 3545 - DNA, 324 bp, Bacillus licheniformis
atgaattcagctgtcgatcataaagaatgctcttctttaattcaggatgtattgaaaattttctctggtaaatggtcatttttagttctcgccgaactcattcagggcaagcggcgattcaacgagctcagaaggaacttgggaaacgtcaacacgaaaggattaactgacacattaagacatcttgaagaaagcggcatgatttcccggaaggtgttcccaacggttcctgttactgtagaatataaattaacagaaaaaggtaaagagttccacagcatttttaaagagatggccgcatggggggggaaatggcttccgtaa

SEQ ID NO: 3546 - DNA, 1095 bp, Bacillus licheniformis
atgaaaaaacaatacgagtctttattcaccccgtttacttttaaaaacggaatccaattgaaaaataggatcatcatgccgccaatggggcattcatcctcattgccgggaggattcatttctgacgacgaactggtctattatgccgcgcgggcgacagaagtcgggatggtcatcacatctgcgacaaccgtacagcccggaaccggatttccaggcatccccggagctgagaacgatgatcaaatccctggactaacccggcttgcagccactttaaagaaacacggagcaaaagcaatcctccagctcttccatcctggagccaaaggtatagagcggacggtcagcgccagcgccgtcgctccgaatcaaccgaatgcaccggtgccgagggcgctgtctgagcaagaaattcaagaccttatccattctttcggccagacggcgcgaagagcgatagaagccgggtttgacggagtcgaaattcacggcgcaaacgggtttctcatccatcagttcttctctccttattacaaccggcgcaatgacggctggggcggcactttagagaaacggatgagatttccgcttcagattatagaagaaatcagacgcgtagcggatagctgccataagccgtcctttatcatcggctacaagttttcgcccgaagagccggaaacacctggaatcacaatggatgaaacgttgtctttcgtcaatgtactgcgggagcaaggattggattacctgcacgtatcactggttgatttccggtccttgccgcgcaggggtgcagacagatcccgcgcaaggatggaactgatcaaagaagccgtccaagaccgtctcccactgatcggagccgggcaagtacacacaccggaagacgcccttcaagcgctggaaacaggagccgatctcatcggaatcgggcggggtctcctgatggatccggagtggctacaaaaagttcgagccggaaaagaggacgatattcaaacaaccctgtcaagacatgatcagcggaagctcgcaattccagatgccttttgggaaagtataccgatgtatattgatttcagcgattga

SEQ ID NO: 3547 - DNA, 1449 bp, Bacillus licheniformis
atgaacatcaaaaacattgctaaaaaagcgtcagccttaaccgttgctgcggcactgctggccggaggtgcgccgcaaacctttgcaaaagaaacgcaggattacaagaaaagctacggattttctcatatcacaagacatgacatgctgaaaattcccgagcagcaaaagagcgaacaatttaaagttcctcaattcgatccgaaaacaatcaaaaacatcccttctgcaaaagggtataacaaaaatggagagctgatcgatttagacgtatgggacagctggccgctgcaaaatgccgacgggacggttgctacataccacggctacaatcttgttttcgcgctggcgggcgatccgaaagacgtcgatgacacatccatctatttgttctatcaaaagaaaggcgaaacttctatcgacagctggaaaaacgccggcagagtgtttaaagacagcgacaaatttgttccagacgatccgtacctcaaacatcaaacacaggaatggtcaggttctgccacgctgacaaaagacggaaaagtccgactgttttacacagctttttccggcacgcaatacggcaagcagacgctgacaacagctcaggtcaatttctctcagccggattcggacacgctcaaaattgacggtgtagaagatcataaatcggtctttgacggcgccgacggcacggtataccaaaacgttcagcaattcattgacgaaggaaactacagctccggcgacaaccatacgatgagagacccgcattatgtggaagaccgcggccataaatatctcgtatttgaagccaatacgggaacaaaaaccggctaccaaggagaagactccctattcaacagagcctactacgggggcagcaagaagttctttaaagaagaaagcagcaagctgctgcaaggtgcgaacaaaaagaacgcttcgctggctaacggcgctctcggaatcatcgaattaaataacgattatacactgaaaaaagtcatgaagcctttgatcgcctccaatacggtgacagatgaaatcgaacgggccaacctcttcaaaatgaatggaaaatggtatctgttcacagattcaagaggatcaaaaatgacaattgacggcatcggttcaaaagacatttatatgctcggctatgtatcaggttcattaaccggaccattcaagcctttaaacaaatccggacttgttttgcatatggaccaggattacaatgacatcacgtttacttattcacactttgccgtaccgcagaaaaaaggcgacgaagtcgtcattacaagctacatcacaaacagagggatttcgaacgagcatcacgccacgtttgcaccaagctttttgctgaagatcaaaggatcaaaaacatccgttgtcaaaaacagcatccttgaacagggacaactaacggtaaacaaataa

SEQ ID NO: 3548 - DNA, 1548 bp, Bacillus licheniformis
ttgaagaaggcagtatataagcggatcagcattttaactgtttgtcttggaatcttcatcatgatatttctttcagtccgggaaacagaaaaaaagggagaatctccggatacaccggaatatcgtgcagctttccatttgacaacccctgacaaatggaaaaacgaccctcaaaaacccgtctatttcaatggagaatatcattactactacctctataaccgagactatccggacggcaatggaacagagtggcgccacgcagtatcagatgatctcgtccactggcaggataaaggggttgccattccgaaatatacgaataaaaatggcgatccctggtccggttctgtcgttgtcgactcaaaaaacacagccggcttcggcaaagggacgatcgtggcggttatgacgcagccgtcggccaatgacgggaaggaagagcaatttttatggtacagccaaaatggaggaaaaacatttaaaccttacggtgaagagccggtcttgcctaatccgggcaccgtcgatttcagagatccgaaagtgatctgggatgaacaggatgataaatgggtgatggcgctggctgaaggaacgaaagtcggcttttacgaatcgcaaaaccttaaggaatggcgttatacaggtagttttcaaacagaaaatatcggcatcatcgaatgtccggatctgtataagatgcgggcggatgacggaacatataaatgggttcttggagcaagcgccaacgggaaagggaccggcaagccgaatacttatgcatactggacaggcagcttcaacggcaacgaatttacggcagacgaagcagaaccccagtggcttgattacggatttgactggtatgcgggcgtgacatttgaggacggcgaaacgaacgatccgtacgagaaacgctatgctttggcgtggatgaataactgggattatgcaaaccggacgccaacatggaaagacggttttaacggaaccgattcgatcgtccggcaaattcggcttaaacataaaggcggagatcgatacagcctcgcctctcatccaatcgatcaattggatgaattaaccgaatctgccgatgaattggatcgcatcgaagtgaacggatcaaaaacgctgcagattaaggggaatacctatcagcttgaggcagatatctcttgggacgaccttaaaaatgcgggtttcaggctcagagaatccgcggaccgaaaacgccatatcgatgttggaatttcggctgaaggcggatattcttatgtgaacagaggatttacgggacagcctgacagcacccgcacctatttggaaagcaaagcaccgtttgatccggaaaaaaaacgggtccatttcacaattatcgtagatcaaaacactgtcgaagcatttattgatgacggcgaaacgacgcattcaaaccttgcatttcccgacatgaatgatacaggcatcacactctttagcgaaaatggaacggccgtctttgaaaatcttaagatcaaacatttgcgttcaatccgcgattaa

SEQ ID NO: 3549 - DNA, 318 bp, Bacillus licheniformis
atgggttatgtgaacttggacaagagtaacctgacagatcagcagaggcttgtcgtggcttcagagctgcaaaataagaagaaatcgaagctgattgtatttcttttatggtggtttctcggaggcgttgccgctcacagattttatctggacgagagaaaaggctacgctgtagccatgttgcttctcggctggattacattattcatttggccttttattgacggcattatctgccttgtcaaaacaacggacgaagtaaatgaagaaatcgaacaaaagattatagcttccgtattatctaaacctgcatcatga

SEQ ID NO: 3550 - DNA, 597 bp, Bacillus licheniformis
atgaatttaatacctacagtcattgaacagacgaaccgcggggaaagagcgtatgacatttactcacgcttgttgaaagaccgtatcattatgctgggatcagcaatcgatgacaatgttgcgaactccatcgtatctcagcttctattccttgaagccgaagatccagaaaaagatatcagcatctatatcaacagccctggcggctccatcacagccggtatggcgatttatgacaccatgcagtttattaaaccgcaagtctccacgatttgtacgggaatggcggcatccatgggtgcgttccttcttgcagccggcgagaaagggaagcgctacgctcttccaaacagtgaagtcatgatccaccagccgcttggcggagcgcagggtcaggcgactgaaattgaaattgccgcgaaacgcattctttcattgcgcgacaagctgaacaaaatccttgcagagcgcactgggcagccgcttgaagtaatcgagcgcgatacagaccgcgacaacttcaaaacggctgaagaagcaaaagaatacggcctgattgataaagtgcttacacgcaatatcgacgcacagaagtaa

SEQ ID NO: 3551 - DNA, 576 bp, Bacillus licheniformis
gtgaaaacggtatgcgtatattcaggatcaaatatgggggcggacccggagtacaagaagaaagctgcagagcttggcgtttatattgccgagaaggggcttcgccttgtttacggaggatcgagaatgggattgatgggcgtgattgcggataccgtattggaaaacggcggggaagtcgtcggcgttatgccgaaaggcctttttacaggggaaatcgttcatcagcagttgacggagctgatcgaagtgagcggcatgcatgagcgcaaagcgaaaatgagtgaattagctgacggctttatcgcgatgcccggaggcttcggcacgtttgaagagctgtttgaagtgctctgctgggcgcagatcggcatccatcaaaagccgatcggactttacaatgtgaacggctattttgaaccccttcttaaaatgctcgaatacagcgttcaagaaggcttttcgaacaaatcgcaccttgagctgattcatgcttcggcaagccctgcggagttgatcgggaacatgaatgattatcgctaccctgtcctcgagaaaaagtggaaggatttatag

SEQ ID NO: 3552 - DNA, 375 bp, Bacillus licheniformis
atgacaatcacagacgcggagcaatggacaaaggcattttacagggaaagaggatggagcgaatacggacctttcatcaggatgggatttttaatggaagaggctggcgaactggcgagagcggttagagcatacgaaatcggaagggaccgtcctgacgaagcaaaacggccggctgctgaactgaaaaaagaactgatcgaagaaatgggcgatgtaatgggggaatttgatcatgcttgccggcatatacggtgtttcattggaagacatgatggatgcccatcgctgcaaactgacggaacgatttgcaggagagcatcatcaagatcaatgaccgcctttacggggaggcagatttggagcctgtgctga

SEQ ID NO: 3553 - DNA, 942 bp, Bacillus licheniformis
ttggagcctgtgctgacagacctcattcgttcaaaagccgttcagcgtctgaaagggattcatcagggcggggcctcttttctcgtcaatcccgcatggaacatcagccgctgtgagcacagcatcggagttatgcttttgatccgcaggcttggcggaagcctggaagagcaaattgcaggtttgctccacgatgtttcccatacggcattttcccatgtggctgatgatgtatttaacatggaaaacgaagattaccatgaacagatgtttcggcaatgggtcaagcaatctgatatctccgggattctgcatacatacggattccatgatgaagacatcttatatgacgagcaaaaatggacgctgctggagcagccggctccttcattatgtgcggatcgcatcgattacacgcttcgcgactctttagcctatggatttggcgatccggtagagattggacgatttttagaaactggattgaccgttgctgaaggcgaaatctgctgcacttcggcagagcatgccgaatggttcgcccgcctttactatcaagaagtgattgacttctttatgaatcccctcaatatatatgcgctctgtaccctcagccaaatgctgaaagaggcgcttgacatgcgtgttattgcggggcgcgattttttcaaaaccgacacggaactgcttgcgatgctaaagcaaaaagcgcgcttccgggaaacgctggtaaagctcagcacagcgagcaagcgcgttaaacaaggcgacgaaggcgattttacttttcatcaaacattaaaggtgagatggatcgatccaaaagtcgctgttaacggaagaaaaatccccgcctccacactttcaaagaacgtccttctgatgaaagaaacggcaatagccgccatgaaaaaaggcgcatatgtaaaagcagcccaataa

SEQ ID NO: 3554 - DNA, 1620 bp, Bacillus licheniformis
atgttacgattttcaggcagatttgaaggatacagccttaagcggtttcaaaaagatattgtagcaggaatggtcgttggagtcgtcgcgattccgcttggcatggcttttgctatagcctcgggggtgaaaccggaacacggtctttacacagtgattgtcgccggtattttgatttcgcttctcggcgggtcgaaataccagattggcggaccgacaggggcctttgtcccgatcctgttcgctattgtgctccaatacggatttgagaatctgctgattgccggttttatggccggagtgattctggtcatattagggctgctaaaactcggcaagatcatcaaatttattccgcggccggtgatcatcggatttacggccggaatcgcggtgattattttcaccggagaaatcgccaagtttttaggcttgagaaatgtcgagaagcatgagagtttttatatgaatatgagagaggttgtcatcaacctgaatacgctcagcttttacagcattttgacggctgtcgtatcgctcttctttgtgctgtttacgccaaaggttctgccgaaagtgccgggagcgctcgcaggcttgcttgtatcaacggtcatggccacgatgctgtttcccgaacaggtggtgacgatcggatcagcttacggcgaaattccgcgcagcttgccgagctttcaatttcctgagttgtcattggaaaaaatcatttacctgatgcctcccgctcttgcgattgcaatgctcggaggaatcgaatcgctgctttccgcgatggtggcagacaatatgaaggggacaaggcatgacagcaataaagaacttgtcggccaaggaattgcgaacatcgccgcaccgctgttcggcggtattccggcgacaggtgcgattgcccgtacggcgaccaatattaaaacgggcgctgcttctccgatttcaggtatcgtacacggtgtgttcgttttattggttctgcttttgtttgcgccatacgcttcccttatcccgcttgcaagcatgtcgccgattttgatggtggttgcttggaatatgagtgagcggaaagagtttataaatattttgaaaattagaaattcagactctgccgtgcttgtcgtcacatttcttttaaccgtttggcaggatcttgtgtttggggtggcggccgggatcctgctggcgatcatcacctttatcgccagaatgagcaagtcgttccgcattaaaaaagatgtgtctgaatcgatcgtccagtcggcagctgcagcggaagaaaagcattttcaacgctctgtcagcatctattcggttgaaggcccgctgtttttcggctcatcgaattcattggaggattcaattttggacaaaggccacccgccaaaactcctcatcctgctgatgaataaagtagactacatggactcttccgcagaaggcagcctgatgacgatcgtcaaccgtgtccaccagcaaaacgggaaagtgatgatcgtgggtcttcagcagcagccgcgtgagcttcttcataaaacagggctgtttcataagatcggcaaaaagcattttgtcgacaggcctgaacaaatatttgacgtgacataa

SEQ ID NO: 3555 - DNA, 591 bp, Bacillus licheniformis
atggcgattttaacttccattttgaagcacaatcagtcttttgtagaggaaaaggggtacgagttttacgaaacgacgaaatttcctgagaaaaaacttgtgattttgacatgcatggacacgcgtttattagaactgctccatcatgcaatgggtttaaaaaatggagacgcaaaaatcattaagaatgcgggagccgttgtttctcacccttttggaagcgtcatgcgcagcattcttgtggctgtctatgagctgcaggctgaagaagtctgcgtgatcggccaccatgagtgcggaatggcaagcctgaacgcttcatctatccttcaaaaggccaaacagcggggtgtcgatgatggctgtctcgaactcctgcagcattcgggcatcgatttggacacatggatgacgggctttgacagcgttgaagacagcgtcagccacagtgtgaacatgatccggaaacatccgctcttgtcttcagacgttccggtgcacggattggtgattgatccaaagaccggccgtttggatgttgttgaagatggttattcacgtgaagacgtttcgctttcggaagtgcgatga

SEQ ID NO: 3556 - DNA, 972 bp, Bacillus licheniformis
atgaaaccgtttgtatatgtcacaaaaccggtcccaaaagaaatcgaagagatgctcgctgaacattgcgaatatgaaatttggacttcgcgcgagcgtattcccagaacgaccctgctcgagaaaatcaaggaagcggacggccttttgacctcaggaacaaaaattgaccgtgaattattatccaatgcactgaagttaaaaatcgtcagcaacaattccgtcggctatgacaactttgatattgaagcaatgaaagaaaaatcggtcatcggcacccatacgccatatattcttgacgacacagtcgcagaccttgctttcggtctgatcctttcctcagctcggcgaatcgccgagctcgaccgctacgtccgcgagggaaaatggaccaaatcagaggacgatgaaagcttgttcggatctgatgtccatcaccggacgctcggcatcatcggaatgggacgaatcggcgaacaagtcgccaaacgggcggccttgggttttgatatggaagtgctctattacagccgcagccgcaaacccgatacagagaaaaaaaccggcgcggtttatacgggctttcatgagctgttggagcgctcggatttcattgttctggtcacaccgctcacggatgagacataccgcctcatcggcgaagcagaattcaaaaaaatgaaaccgtcgtccattttcatcaacatctcccgcggtaaaacagttgacgaacaagcgttgattcaagcgctgaaagaaggatggattaaaggagccggacttgatgtatttgaaaaagagccgattgaaaaagacaatccgctcctaagcctttccaatgtaacccttgttccccacattggatcatccacccatgtcacacacgtcaacatgctgaaaagcgccgttcaaaacctgattgacggtcttcagggcaaacggccaaaagatatagtcaaagaactgagataa

SEQ ID NO: 3557 - DNA, 600 bp, Bacillus licheniformis
atggaacaaaacagcaaaattattcagccaagcattttatattacggaacaccagtcattttactcagcacaatgaacgaagacggttccacgaatctcagcccgctgtcatcttcttgggcgctcggggattcgatcgtactcggtattggaaccgaaggtaaagcattggaaaatttagagaggcatgctggatgcgttatcaatgtgccggattcatctttatggagaaatgtagaacggctggcttcctataccggcaaacgattcgttccggaagaaaaaaagcggctcggctttacttaccttaaggagaaatttgaagccggcggatttacggccgcggattccttggcagtgaaacctgaaagagtcgccgattgcccgcttcaaattgaagcggaagctgtcaacattcgcattccggaacattccccgtattttgccgtcattgaaacaaaagtgcttcatgtgcacgcacatgaagcgattttaaaaggggaacaccacatcgatcctcaaaaatgggaacctttgatttatcttttcagacactattttggcttaggaggagagcttggcaaaacgttccgcgcctga

SEQ ID NO: 3558 - DNA, 696 bp, Bacillus licheniformis
atgaacgtgaatccaaatatcgccgaggtcgccaagcttgtcaccgatccgtcgcgggcggcgattttaaccgcattgcttgatgaccggtattatacggctaccgagctggccggatatgcgggaatcaagcagcagacagcaagctttcacctttccaagctgcttgacgccgagatgctgacatgcaggaagcaaggacgccaccgctattacaggctcaaaaacggaaagattgcacaatcgctggagaccctgcttaacatagcgccccctgcggaaattcgctctttccggcagtcagctgaagatcgggcggtcagaaaagcgcgcacatgctatgatcacctggctggatcgctcggcgtcacacttgcggatcggctcgtggagatgggcgtattgaaagaagaagagacggcttttacagtgactgaagaaggggaagcatttttgaaagagcttggcatcgatgtcagggaagtcaaaaagaaacggcgctctttttgccataaatgcctggattggagtgaaagacggcatcacattgccggcgccttaggctccgcattgctcgatgccttcatccgcatgggctggatcgagcggcgcccgcatacacgggccgttgcagtcacgcccgccggcgcaaaggaactttaccgcctatttcatatttccattgaaaagaactga

SEQ ID NO: 3559 - DNA, 456 bp, Bacillus licheniformis
gtgaaaaaaatattatcaactcttgcgcttgggtttgttctcgcgctgggctttctggcggggaacctttttacaagctcagctgaagggccgcaggcagaaaaaggcggcaccgttcagtcaaatgaagtcatcaatacatttgaaggtgttgccgactatattgtgaaatacggcaggctgcctgacaacttcatcacaaaagccgaggcgtcaaaattaggctgggatccgcaaaaaggcaatctggcagaagtagcgcctggaaaaagcatcggcggcgatatctttcaaaacagggaaaagctgcttccagatgcatccggacgcgtatggagagaagccgacatcaactatacatcgggattccgggggtcagaccggatcgtctattctaacgacagactggtttataaaacgactgaccactataaaacgtttacgagaatgagatga

SEQ ID NO: 3560 - DNA, 276 bp, Bacillus licheniformis
atgaaacaagtcactttaaaaggagaaaagatcagaagtgtatcagatcttcacaaagaattaaaagaacagctggagcttcctgactactatggcgaaaatcttgatgcgctgtgggattgtctgaccggctgggtcggcatgcctttgctgatagagtggaagaatgtcgagaaaagccggatttacttgggcgatcaagccgaggcatatttgcagctttttcgcgaagccgaagaaacactggacggctttcagctgaaaacagaaggatga

SEQ ID NO: 3561 - DNA, 759 bp, Bacillus licheniformis
atgacgacgatgctcgattcgctgtttaagaggattggatacaagccaggtcagcaggtgacatttgccgacttgcccgagtttttatcgctgctggctttgcagtttccatttgaaaatggcgcggttttaagaaacgaacggatttcgatgacgaaaacagagctgacggaagccttgctgaacaataaaaggggcggtttatgctatgatttgaacgcttttctttactatgtgctgacagagctcggcttttccgttcacatggtccgcggaacggtatttaatgcaaaagagcaggcgtgggcgctgacgggaacgcatgtcgccgtaattctgcgggaaggtgatgaaacctatctgctggacactggattcggcatcaacctgccgcttgcacccgttccgttctcaggtgaacctgtcccctcaaaaacaggagcttaccgtatcagggaaacaaagacggataaaggggattaccttcttgaaatggataagggagatgggtggcagatcggctatgcattttcgctgacgccaatcgatgaagctgtgcttacatgcgtgcgggatgcaattttcgatgagaaggcgtcgccttttaataaaaacccgctcgcttccaagctgataaaggacggaaagttaattttgacgaaggatcacttcacaaagcagacagggggcggtttgacgaaagaggatgtgaatgcaggagatttccaaaccattttcgttcattcattttttgactga

SEQ ID NO: 3562 - DNA, 270 bp, Bacillus licheniformis
atggttcaacaaaaagtggaagttcttttaaaaacagggcttcaagcgcgcccagcggcattgtttgttcaagaagccaaccgttttcaatcagatatttttctggaaaagggagataaaaaagtgaatgccaaaagcatcatggggctgatgagccttgctgtcagctccggatcggaagtcacgctgatcgctgacggatccgatgaacaagatgcccttgatgcactgactgcatatgttcaagagaaagaagctaaacctttatga

SEQ ID NO: 3563 - DNA, 951 bp, Bacillus licheniformis
atgtcatttgcatcggaaacgaaaaaagaacttacaaaccttgaagtaaaggattgctgcgcgaaagcagagctctctgccctcattcggatgaacggttcattgtctttctcaaaccgaaaagtggttctcgacgtccagaccgagaacgcggccatcgccagaagaatttacacattgctgaagaaacaatacgatgtttccgttgaactgctcgttcgaaagaaaatgagactgaaaaaaaacaatgtctacatcgtacgcctgatcgaaaatgccaagccgattctcgaggacttgaaaatactcggagacaactttgtcattgccagaaacatctccgaagacttagtcaaaaaacgatgctgcaaacggtcttatatgagaggggcatttttagccgggggttctgtcaacaatcccgagacatcttcttaccacctcgagattttttcgctgtacaaagagcataatgattcattgtgcaggctcatgaatcagttccatttaaacagcaaaacgcttgagcggaaaaagggatacatcacgtatctgaaggaagccgaaaaaatcaccgagtttttgaatgtgatcggcgcgcataattcgctgctccgctttgaagacgtccggatcgtgcgcgatatgagaaactcggtcaaccggctcgtcaattgcgagaccgccaatttaaacaaaacgatcggcgcttctctgcggcaggtggaaaacatcaagctgatcgacgaaagaatcgggcttgatgcgctgccggaaaagctgagggaaatcgctcagctccgcattgattatcaggaagtaacattaaaggaactcggggaaatggtgtcgagcggaaaaatcagcaaatcgggcatcaaccaccgacttaggaaactggatgaaatagctgagcagctgcgttcaggacaatctgtctctttaaaatag

SEQ ID NO: 3564 - DNA, 954 bp, Bacillus licheniformis
atggcagatcagaaaaaaatcgcaatctttggcggaggaactggcctttcggtactgctcagaggattgaagcagcagccggtagacatcacggcgattgtgacagtcgcagatgacggcggaagctcggggaggctgcgcgacgagctgaaaattcccccgccgggggacgtcagaaatgtcctcgctgcactgtctgatgtcgaaccgcttgttgaagacctgttccagcaccgcttctctaaaggcggcgatttaatcggccattcattgggaaatttgattttggcggcgatgacgaatataaccggtgatttctttcacgccgtcactgaaatgagcaaagtcttaaatgtgagaggaagggttctgcccgcggccaataccagcgttgtccttcatgcggaaatggatgacggacagatcatatcaggggaatcgacgattccgtcttacgggaagcggattaaacgggtgtttttaacccctgaaaaaatcgaacccgttccggaaacgattgacgtgatccgcggcgccgacctgattattctcggccccggaagcctgtatacgagcatcttgccgaaccttctcgttccgaagataagggaagagatattaaacgccccggcaaaaaaagtttatatttgcaatgtaatgacccagccgggagaaacgctgtactacagtgcggcagaccatgtaaaagcgcttaaccagcatatgggcggtccgtttatcgatacgatcctcgtcaacaatgaggaaatcccggacgacattcgggaacgctatgcgaaggagcaggcacagcccgtccagtttaatattgatgatctgtctgcgatggggcttgaggtcatcaaagatcagattgtgacatacgagaatggcgtgatccgtcatgatacacataaagtcgcttcgctacttgttgatttgttaaaagaatag

SEQ ID NO: 3565 - DNA, 888 bp, Bacillus licheniformis
atgaacgcgaatggaggccatgatatacagcttgtgatcataaccggaatgtcaggggcaggaaaaacagtggcgattcaaagctttgaagatctcggttttttctgtgtcgataatctgccgccatctttgctgccgaaatttttggagctgatgaaggaatcaagttcaaaaatgagcaaagtcgcccttgttatggatttgcgcggccgcgagttttttgacagcctgattgaagcgcttgatgaaattggggaaacatcctggattaccccgcgaattttatttttagatgccaaggattcggttctcgtttcaagatataaagagacaagaagatcccatccccttgcgacaacgggcctgccgcttgagggcatccaaacggagcgggagcttctcgaagagctgaaaggccgttctcaaatcatctatgatacatccgatatgaagccgaaagacctgcgcgaaaaaatcgtccagcattttgcggcagatcacggacatacctttactgtgaatgtgatgtcattcgggtttaaatacggattgccgatcgacgctgatctagtgttcgacgtaagattccttcccaatccgtactatatcgacagcatgaggccgctgacggggaaagaccaggaagtatcttcatatgtgatgaaatggaacgaaacgcaaaagtttcttgaaaaattgaccgagctgctgagctttatgcttccgtcatacaagcgagaaggaaaaagccagcttgtcatcgcgattggctgcaccggcggacagcatcgttctgtgacgctggctgaataccttgccgattattttaaaaaggactactatactcatgttactcaccgggacatcgagaagaaaagcagaaaatag

SEQ ID NO: 3566 - DNA, 465 bp, Bacillus licheniformis
ttgcaaagagtgacgaattgtgtgctgacttcaggtgataaagtcctgttgctgcaaaagcccagacgaggctggtgggtggcccccggcggcaaaatggaaagcggggaaaccgtcagggacgccgttatcagggaataccgcgaagagacgggcctgtatgtgctgaacccgcagctgaaaggaatattcacctttatcataaaggaaaatgatcaggttgtatctgaatggatgatgttcacattcgtcgccgatcattatacaggcaagcatgtagaagaatcagaagaaggcatcatcaggtggcatcaggcgggggacgtcggtagcttgccgatggcgccgggcgacgtccatattcttgattttatgctgaaaggcaaaggactgcttcacggcacctttacgtatacgcctgactttgaattgctgtcctatcgcctcgacccgcaaggcgaataa

SEQ ID NO: 3567 - DNA, 951 bp, Bacillus licheniformis
gtgtcagaagaaaaaatgtatgacgtcattattataggagcaggtcctgcgggaatgacggcagccgtttatacgtcaagggcgaacctgtcgactttgatggttgaaagaggcgttccgggcggacagatggccaatacggaggatgttgaaaactatccgggatttgaaagcattctgggacccgagctttcaaataaaatgtttgaacatgcgaaaaagttcggcgctgagtatgcgtacggcgatattaaagaagtcgtcgatgaaggagactataagatcgtcaaagcgggatcaaaagaatttaaagcgcgcgcggtcatcatcacagcaggcgccgaatataagaagctcggcgtacctggcgaaaaagagcttggcggccgcggcgtttcttattgtgcggtttgtgacggcgccttctttaaaaacaaagagctggtcgttgtcggaggaggagactccgctgttgaagaaggcgtgtacttaacccgtttcgcttcgaaagtaacaatcgtccatcgccgcgataagctgagagcgcaaagcattcttcaggcgcgcgcgtttgacaacgaaaaagtcgactttctctggaataagacggtcaaggaaattcatgaacaagacggaaaagtcggcaaagtgacactggtcgatacggtcacaggcgaagaagaagagttccggactgacggcgtctttatctacatcggtatgctcccgctttcagagcctttcaaaaacctcggcattacaaatgaagagggctacatcgtgacaaatgaacagatggaaacaaaagtcgaaggcatttttgctgcgggagacattcgcgagaaaacccttcgccaaatcgtaacggcaacaggggacggaagcattgccgcacagagcgttcagcactatatcgaagagctgaaagagaaagaaaaggctgtaaaataa

SEQ ID NO: 3568 - DNA, 1461 bp, Bacillus licheniformis
gtgggaaagtacacttctgaacatcataaagattcgagaattgtccagctgttccaagatgggcaatatttttatcataaagggctcaaagcatacagagagcgaaatttatcccgcgcgagcaagctcatacagagagcgatttttcttgaacctgaaaacacgggaatgctgtcccaacttgcggttatttatacggaaatgggcttttatcagcaatcaaacgaacttttggactttatcctgaagaacatcaacgaaaaaatgactgaatgctactattttaaagcgaacaactatgcgcacctcggtctttttcaagaggcctataaagcggcggagacttatttaaaggaagatccggacggcgagttcagcgaggaaaatgcggagctgcttgatttattggatatgggagaggaagatcagggctattcgcagttcgatcaggacgacctgattctgaaacaggatcgggccaaatcactgctggaaaatggacagcttcaggaatcgatcgcgatgcttgaagaaattatttccgattaccctgagttttggtcggcttataacaatcttgcactcgcatacttttatgccggggacgttcagaaagccaaaacgacggtttttacggtcttggaaaaaagtcatggaaacctgcatgcgctttgcaatcttcttattttttatcactatgaacgacgggacgataaggtcgaggcgctttccgaacagctttcaaatatttatccgatgctttttgagcaaaggtataagctcggtgccacgctagcccttgtcggccgatacgatctcgggtttaaatggctgaaatcactctaccgcatgggatttgaaggggatgagaccttttattactggcttgcctgctcggcttattacacgggccgcgttcaatttgcccggtctgtatggaaaaagatgcaggaagagtatccggatgacgcccgcatggagccgtggaaagaacggaaggaaaagagacctgtccagcgaccgctcgaggagcgccttgccgcatattatatcagcggaagaaaaggggaaaaagcccagctgaaagcggtgcttgattcacagatggcaaaaacgccgtttgaagatcagtttgtcagacttgtgctttacggggaaagcggtgcagccgttgattcaaaagacgcgctacttgcttacaggactgcaaaagcgattgaacaagcggatcagtcggcgatggagcaggaggccatgtgcttttggattttccatgtcattcagcagatcagggcttacgggcttcagctgaaaaatgccggcgggcttgcggcagcgatctattacatttggaagacggagcatcaggagcgtttgacaaaagccgaaaccgctaaaattttccaaatatcgcccgggacgctttcaaagtatgaacgtacattaaaagagcatctatag

SEQ ID NO: 3569 - DNA, 480 bp, Bacillus licheniformis
gtgaaaaaaggcggatcaatagaattgacgcattactcagaagaacattcagctgcgcttctcgaatttgagcttcctgaagaacagcatcgatttaccgctcttccgaaagaggctttaaaacggacggacggccagtttccaatcgtaattttaagcgaaggcgagcctgtcggattttttatcctccatgcgaccgagagggtaaaagactattcggacaacctggacgccatgctgttaacggcgctatccggcgacagaaagcaccagggaaaaggttttgcaaaagaaggaatgctcaaacttccagagtttgtctccaaggagttcacccattgtcatgaagtcgtgctggttgtgaacgtgaaaaacaccgcggcccagcacctgtatgttaaagccgggtttgccggcacaggggaaagaaaaacagggccgatcggagagcaaatcgtgatgaaattgaacatcaaatag

SEQ ID NO: 3570 - DNA, 633 bp, Bacillus licheniformis
atgatcaaggcagacgagttgacatttaatgaagccggcttgatcccggcgattgtccaggatgcagcgagcaaagaagtgctgacacttgcttatatgaataaagaatcgtttgaaaaaacgctggaaacgaaggagacatggtttttcagcagatcgcgcggagagctctggcataagggagcgacgtcgggtaacattcagcgtgtgaaagacatcaggcttgactgtgatcaagatgcgctcatcgtgcttgttgaaccggcggggccggcctgtcataaaggaagctacagctgtttctcgcccggcgaacatatcagacagactgatggcggccgctttgacatcatcaatgaacttgaaaccgtcattgccaaacggcaggctgaaatgcctgaaggcgcatatacaacatatttgttccgtgaaggcgttgataagattttgaagaaagttggcgaagaagcggcggaagtcatcatcgctgcaaaaaaccgtgatcctgaagaactgaaatgggaggcggctgaccttctttaccatctgctcgttttgctgagggagcagtcccttccgcttgatgatgtgcttggcgtcttgaaagagcgccatgaaggatctgaatcataa

SEQ ID NO: 3571 - DNA, 759 bp, Bacillus licheniformis
gtgatcacaaaacgaatcatcccgtgtttggacgtaaaagatggacgcgttgtcaaaggtgtacaatttgttgaattgaaagatgccggcgacccggttgaactggctgaagtatatgatcatgaaggcgcagatgagcttgtttttctcgatatctcggcttcccacgaggggagaaaaacgatggttgatgtcgttgaaagagtggcggccaagctggcgatcccgtttaccgtcggcggcggcatcaatcgtttggatgatatgaaaacgatactgcgggccggagccgacaaagtttccgtcaatacggctgccgttctccggccggaactgataacggaaggcgccgactttttcggctctcaatgcattgtcgtcgcgattgatgcaaaatacgatccagaagctgatctgtactatgtttatacacacggcggtcggaaaaaaacgaaccttgaggccgtttcctgggcgaaggaagccgttcggcggggagcaggtgaaatcctgctgacaagcatggattcagacggagaaaagaacggatttgactgcaggctgacaaagcttgtgtcagaagccgtttcagtcccggtcattgcatccggaggcgcagggcgtgcggaccacatgtatgatgcgtttgcagaaggccgggcggacgcggctcttgccgcatctatctttcattacaaagaaacatctgtaaaagaagtaaaagcttatttaaaagagcgcggggtgaatgtaagatga

SEQ ID NO: 3572 - DNA, 738 bp, Bacillus licheniformis
atgagcgagtttactgtatatcctgccattgacataagaaacggcaagtgcgtcaggctcatccagggagattacgaaaaagaaacgatttacggtcattcccctctggagatggcctcacggtttgctgaagagggggcaagctggattcatcttgtcgatttggacggcgcaagagaaggcaaaaaagtgaacggcggccacgtcataagcattgctgataagcttgacgttaaagtgcaagtcggcggcggcatcaggaccgaaaaagacgtgtatgactacttgtcgcaaggcgttgagagggtgatcctaggcagctctgccgtatcaaataccgagtttgtcaaaaaaatgctgaaggcctacggagggcacatcgcaatcggtcttgacgcaagggacggatttgtttcgactgaagggtggcttgagacctcttccgttagagcggaagagcttggccgcgagcttgcaaatgaaggtgcagaagtttttatcttcactgacattgcgactgacggaatgctgtcaggacctaatatcaacagtacagtggagcttgccagggcaaccggcaaacaagtcattgcctccggcggcgtcagttctctcgccgatcttgaggcgctcgcttcccgcgcttcggaaggcgtctctggcgctattgtcggaaaagctctttataccaaccaatttaccgtggctgaagcgcttgaaagggtggcggcaaagtga

SEQ ID NO: 3573 - DNA, 639 bp, Bacillus licheniformis
atgatcggtgtcatagattacggaatgggaaacctgtacagcgtttctaaagcgcttgaacggattgatgccccttattttgtgtccgagcatccggatgaactgaagagagcggacagctatatccttccgggagtcggcgcttttcgggatgcaatggagattttaaccgagaacggcctgaaaacatttattcaagctgccgcaaacgaaggaaaacctcttctcggcatatgcctcggcatgcagcttttgtttgaagaaagcgaagaacacggggcgtcagaagggctcggcctgttgaaaggaaaagtcgttaaactgaaagactgtgatcaagcgggaaatcgcttaaaagtgcctcacatgggctggaatcttctcaaagtccaccgcgactcgccgcttttgccaaaagcgaaagaaggattcgcgtatttcgttcattcgtattatgtcagcggaatcgaagaggaagctttgcttgcaagcgccgaatacggtgtgtgtgtacccgctgtcgtcggtcttggcaatgtatacggggcccagttccatccggaaaagagcagtacggtcggcatgttgatcttagagcggttcaagcagtttacacaagaacagaaggtgaaaaaatga

SEQ ID NO: 3574 - DNA, 585 bp, Bacillus licheniformis
atgagaaaagccgaacgggcaagaaaaaccaatgaaactgatattaaattatcctttcatattgacggagaaggaaaagcggatattcaaacggatgtcccgtttatgacacatatgcttgatttatttacaaaacacgggcagtttgacctttcaattgaagcgaaaggcgatgttgaaatagacgaccaccatacgacggaagatatcggaatttgtctcggacaggcgcttttggaagcgctcggagataaacaaggaatcaaacgctacggttcgagcatggtgccgatggatgaagcgctcgcccaggttgcgattgatctgagcaacaggccgcacctcgagttcagagctgaattcccaagcaggaaaatcggaacatttgatacagagcttgtccatgaatttttgtggaagtttgcactggaagcgcgaatgaatctgcatgtcatcgttcattacggtacgaacacacaccatatgatcgaggccatttttaaagcgctgggacgtgcgcttgatgaagcggcattgatcgatccgcgggtcaagggaattccatcaacgaaaggaatgctgtaa

SEQ ID NO: 3575 - DNA, 1281 bp, Bacillus licheniformis
atgaagatcaaatccatcagcggaaatacgtcggtttcactaaaacgctctattgacgccggaacggaggaacaaagaaaagcagtccgcggcattatcgaagaagtgaaaaagaacggaaatgcagctgtttccgcattcacaagacaatttgacggagcggatgtggccggctttcgcgtttccgaagaggaaatcaaggaagcatacagcgcgctcgaagaacgtgatctcgagattattcaggcggcgattttcaacattaaagaatatcatgagcgtcagctcgcaacatcttggttttaccaccgcaaggacggaacgatgctcggccaaaaaattacgccgcttgattcagcgggggtgtatgtgcccggcggaacggctgcttacccatcatccgttctgatgaatgtcattccggcgcttgttgcaggcgtcgaccgcattgtccttgcctcacctccgggaaaagacggtaaattgtcggcgggagtgctggctgctgctgcggagcttggcgtcacagagatttacaaaatgggcggtgcccaagcgattgccgcattggcttacggaacggaaacgattacccccgtcgataaaattacgggacccggaaatatttacgtcgccttggctaaacgggaagtattcggccaggttgatatcgatatgatcgcgggtccaagtgaaatcgccatactcgctgacagtacggcaaactaccgggaaatcgccgcagatctactttcacaggctgaacacgatgcgatggcatcgagcattcttgtcaccgattcagagacgcttgccgaatccgttttaaaagaggtttacagacagctcgaacatcttccgagaaaagagattgcacggcagtcgattgacaactatggcctgatctatgttacagagacgatgaatgaagcagtttccgtcatcaatgagctcgctcctgaacatttggaaattttaacagttcaacccgatgcgctgctgggacagatcaaacatgcgggcgccattttcctgggccgctacagttcagagccggtgggcgattattttgcaggccctaatcatgtcctgccgactaacggtacagccagattttcaagcccgctaaatgtgacagacttccaaaagcgctccagcatcatttcctacagcagggaagctttccgcgcgaatgctgagaaaattgcggcctttgccagattggaagggcttgaagcccatgcaagagcaattgaatccagaaaccgggaggaagactga

SEQ ID NO: 3576 - DNA, 642 bp, Bacillus licheniformis
atgggtaaggaattgacgattgcgatgccgaaagggcggatatttgaggaagcggccgatatgcttcgaaaagcaggctatcagctcccggaagaattcgacgattcgagaaagctgatcattcaagtgcctgaagaaaaccttcgctttatcctcgctaagccgatggatgtcacaacatatgtcgagcacggggtggccgatgtcggaatcgcaggcaaagatgtcttgctagaagaagaacgagatgtctatgaggttcttgatttaaacatcagcaaatgccgtcttgccgtagccggcctgcccgagacggcggcagacaccgttgcgccccgggttgcgaccaagtacccgaatgtcgcatcaagctacttcagagaacagggagaacaagtggaaatcatcaagctcaacgggtcgattgaactcgctccgctgatcgggcttgccggccgaatcgttgatatcgtatcaacagggcagactttgcgtgaaaacgggctagttgaaactgaaaaaatttgcgacatcacatcccgcttaatcgtaaatcctgtcagctatcgaatgaaagacgcagtcatcgatgaaatggcttcaagactttctcttattgtggaaggagaaaaagcaaaatga

SEQ ID NO: 3577 - DNA, 1170 bp, Bacillus licheniformis
atgtttgaaaaaccgcatggcatgcgggatacgctgcctatgcttcacgaaacaaagaaaaaggtgcgctcttcattaacagaggtgatggctttgtgggggtatcagttcatggagacgcctgcccttgaatttaatgacacgggcggtgcgcagtcggccacattggatcagcagacggttaaactccttgatcaggaggggcagacgctcgtgttaaggcctgatatgacggctccaatcgccagggtggcggcctcaaagcttcataaagacgatcatccgctcagagtaggctatgctgcaaatgtgttccgggcacaggagcgtgaaggaggacgccccgccgaatttgagcaagtcggcgttgaactgatcggcgatggatcgacaagcgctgacgcagaagtgattgcgctcgtcattttttcgcttaaaaatgccggcctgacttcatttaaaatctcgatcggccatgtcggtattttagacgccttgtttgtggaagttttagggaatgaagaaagggctcatgtcctgcggcgctatttatacgaaaagaactatgtcggctatcgggagcatgtaaaatccctcaatttatcctcaattgataaaagcaggctgctggagcttttggagctgaggggcggtattgaaacgtgcagcagggcggcatccatcgtcgattctgaaaaaggaaaacgtgcggttttagaacttgaaacgctatgggagacgctcggcgattatggttgcacagacgacattaagctcgatttaggcatggtcagccatatgagctactataccggtgttttgtttgaaatctatgctgaaaacgtcggctttccgatcggaaacggcggcagatatgatcagcttctcggccgcttcgactcacccgcaccggcaaccggtttcggcatcaggactgacaggctgctggaagcattgaagccggcggaagaacaagaaaagatcgatgtcgtcatcttcagcacagaacagagaaaagaggcaatcagatttgccgaagaagaacgaagaaaaggcaaaaaagtcgtcatgcaggacttagcgggaatcggagatattgatcaaatgacaaagtcttttcaaaacgtgacctattttatcggagccagaaaggaagagaagcatgggtaa

SEQ ID NO: 3578 - DNA, 735 bp, Bacillus licheniformis
atgaaatttttcaaaactcttttttttatttttttcgtagcagttcttatgaccgccgttcttatactgttttctaaagatgcgttaagcccgttagccgaaatgttgcacagcagccataaaactgctgctgacaatgcgaataataaaggagagcgtcagccgcttgacgttccgctgatcaaccaaatggacccgccgaagctttataacggctgtgaagtcgccagcctggcgatgatcttaaactacagcggatatagtgtcacaaaaactgaacttgccaatgaggtgaaaagagtgcctctgcaatatgaaaacggcttaaagggaaatcctaacgacggctttgtcggcgatatggaaaacggacccggactgagtgtctaccatggcccgatttacgatttggcccattcatacgcaggtaataaagcggtcgatctgacgggaagtgagccgggaaaaatttatgaacagctgaatcagggcagaccggtttgggtcatcaccactgtacatttcaccccagtcaacgatatggaaacatggaatacaccgtcaggcaaagtcgatgtgacgtacagcgttcacagtgttgccgtgacaggctatgatgaggattacgtttatgtgaatgatccgtacggatataaaaacagaaaaacagacagagaaaattttgaaaaatcatggaaacagatgggcagtcaggcgatcgtgatcgccgcctaa

SEQ ID NO: 3579 - DNA, 666 bp, Bacillus licheniformis
atgaagagattagcaggtacggttattttgtcaggtttgctcgtatgcgggtttggacaggctctgcctgaaaaagctttggccgccgaggtcgttcacaaaacgatcgtagtcgagaaaggccaaacgtatgacggaaaaggcaagcggctgattgcaggtccggagctcggggacggcagccaacgcgaggatcaaaaaccgattttcaaagtggaggatggtgcaacgctcaaaaatgtcgtgcttggcgctcctgctgctgatggtgttcacacatatggaaacgcttccataaacaacgttgtttgggaagatgtcggcgaagatgccttgactgtcaaaagcgaaggaagtgtcacgataaacggaggatcggcccggcttgccgcggacaaaatctttcagattaataaagcgagcacatttaccgtgaaaaattttactgccgatcaaggaggcaaattcattcgccagctcggaggctcgacatttaaagccgtggtcaatattgataactgtacgattacaaacatgaaagaggcgatcttccgaaccgacagcagtacaagttccgttacaatgacaaatacaagatactcaaaagtcggtcagaaatggatcggtgtgaagcatgctacggaaagaaacaatcatgaattttaa

SEQ ID NO: 3580 - DNA, 519 bp, Bacillus licheniformis
ttgagaaaaacgaagcgctacccggtgtccggcgccaattccttatggcacatctatcagacggttccgttttttaaagtagtcaaaaactttattgtcattcaggcggcgcgctatacgccgattcttggaatgaaaaactggatgtaccggacgtttttgcggatgaaaatcggagagaaatgctcgtttgctttaatggtcatgccggatatcatgtttcccgaaaaaatctcagtcgggcgaaacaccgtaatcggctataatacgaccattttggcgcacgagtatttaataaaagaatatcggctcggtgaggtgatcatcggcgatgaagtcatgatcggagccaatacgacgatcctcccgggcgtcgagatcggagacggcgccgtcatttccgccggtacgctcgttcataaagatgtgcccccgggcgcttttgtcggcggcaatccgatgcggctgatctatacaaaagaagaaatggaaaaaagattggagacccccgctgaataa

SEQ ID NO: 3581 - DNA, 648 bp, Bacillus licheniformis
atgaaagttaatacggttttatttgatttggatggaacgctcatcaatacaaatgagctgattatcgcctcatttttgcatacgctcgatcattatgcaccgggacgctataaacgggaggatgttcttgctttcatcggaccttccctttatgaaacgttctcaagcattcaaaaggataaggctgaagaaatgatcaccatgtaccggacatttaatcatcagatgcatgatgaactggtaaccgagtatgagacggtttacgagacgcttgaacgccttgcggaagaaggctataagctcggcatcgtcacgacaaagctgcgggacaccgtcatcatggggcttaaactgactgggcttgatgcctttttcgagacggttgtgacgctggatgacgtcgagcggccgaagcctgaccccgagcctgttttgctcgccctttccaagcttggcagccgtccggaagaagccattatgatcggtgataattaccacgatattttagccgggaagaatgctggaacgaaaacagcaggcgttgcatggacgattaagggagaagaaagcctggccaaacacgagcctgattttatgcttcagcaaatgagcgacctccttcacattcttggggtggagaaagtttga

SEQ ID NO: 3582 - DNA, 948 bp, Bacillus licheniformis
atgaagggaactttaaaagccggcgctgtggcggggctgaaaacaacgtggacgcttggaaaagtgatttttcctgtcacgctgattgtcagccttcttcagcatacaccggtgatggactggttgatcaaactgatcacgccggcgatggggattttcgggttgtcaggggaagcggcgataccgcttgtgctcggcaacatgctgaacttgtatgccggaattgcgggaattttaacgcttgatttgaccgttaaagaagtgtttattttagcggttatgctgtcgttttgccacaacttgattatcgagtcgactgttgcttcaagggtcggaatcaaaatatggctgattttgctcgtgcgcatcggtctcgctgttttttcggccattatcatcaaccttgtctggcatggcgggcaggatgcggccaaatacggcttaatctcagcgaaaagcgccgctccttccggctggtttgacattgcgctagaagccgtgaccaaggcgggtcttggtgtccttcagcttgcagccatcgtaataccgctgatgatcatcattcaatatatgagagacctcggctggctgaatgctttttcaaagtggtttgcaccgataacgagaatgcttggaatgaaagagaacacctcaatgacaatggttgccgggctgacgatcggccttgcatacggggccggcgttatgatcaaagcggtcgaagaagacggcgtcagcaaaagggatgtcacgcttgcttttatttttctcgtcgcctgccacgcggttgttgaagatacattggtatttatcccgctcggcattccggtctggcctcttttgttgatcaggcttgcgaccgcggttctgctgacgatcgcgatttcgcgcttctggagaaagccgggttattccgttcgcagaaaggaagctttgtatgaaagttaa

SEQ ID NO: 3583 - DNA, 813 bp, Bacillus licheniformis
atgaatgaaacgattgaaccattaaatccgattgcttttcaactggggccgatcgctgtccattggtacggtattatcatcggccttggcgctttgctcggtttgtggctggcagtcagggaaggcgaacggaggggactgcataaagacacctttgtcgatttggtgctttttgcgattccgattgccattttatgtgcaagagcatattatgtcatttttcaatggggttattacagtgaacatcctgaccagattattcaaatatggaacggcggccttgcgattcatggcggactgatcggcgccgtgctgacgggaatcatttatgcgaaagtcaaggggctttcgttttggaagctggctgatatcgctgctccaagcattctgcttggtcaggcgatcggacgctggggaaactttatgaaccaggaagcgcacggtgaggcggtctcaagagcgtttttagaaaacctccacctgcctgattttatcatcaatcaaatgtatattgacggacaatactaccagcctacctttttgtatgaatcgctgtggagctttacgggagtcgttgttctgcttcttttaagaaaagcgaatttaaagagaggcgaactgttcttaatctacgttatttggtattcgatgggacgctactttatcgaaggccttagaacggacagtctgatgctgacggagaatcttcgcatcgcacaggttatttcgatcgtactgatcctctgtgcagctgcgctgatagcctacagacgtttcaaaggcagagagattaaacggtatcaggagatgtag

SEQ ID NO: 3584 - DNA, 933 bp, Bacillus licheniformis
gtgccgaaagttcgaacaaaagatgtgatggataaatttaagcttgagctcatcagcggagaagaagggatcaaccgcccgattacgatgagcgatttatcaagaccgggccttgaaatggctggttattttacatactatccaaaagagagggttcagctgctggggaagactgagattaccttttttgaaaagcttccagaggaggaaaaaaagcagcggatgctgtcgttatgcacggaaattacaccggctatcatcctttcccgtgatttgccgattccgcctgaactcgtggaggcatccgaagaaaacggcgtgcctgtgcttcgttccccattaaagacgacgcgcctgacgagccgtctgacgaattttcttgaaagccagctggctccgacaactgcgattcacggcgtcctcgtcgacgtttacggcgtcggggtgctcattatcggaaagagcggggttggaaaaagcgaaacggctttggagcttgtcaaaagaggccatcgccttgtggcggatgactgcgttgagatcagacaggaagaccaggatacattgatcggaagcgcgcctgaattaattgagcatctcctggaaatcagaggtcttggcattatcaatgtcatgacgttatttggcgcgggggcggtcagaagctttaaacgaattacccttgtcatgagcctggagctttgggagcaaggaaagcagtacgaccgcttagggcttgaagaagaaacaatgaaaattattgatacagacgttccaaagctgacaattccggttcgtccgggaagaaaccttgccgtcatcatcgaagtggccgcaatgaacttcagactgaagagaatggggctgaatgccgcggagcaatttacccataagcttgcggatgtaattgaagatggtgagcttgaagaatag

SEQ ID NO: 3585 - DNA, 480 bp, Bacillus licheniformis
ttgaaatacaatattcatgatacaaccgtgctgaacgaagacattttgacaccggaagaaaaagagacatgggttctttatatgaaagtactgactgctgccggcttgggggatgtctccgaatggatgaagctcgatctcagcatgccgcaaatgaaggttttaatgcttctgaacaaccacggcacactgaaagtctcagaaatcgccgaaaaaatgggagcttccctttcgaatatgaccggactgctcagccgccttgaacaggcgaactttatcaaaagaacacattccgagcaagaccggcgaacgattgtggttgaattaaccgaagatgcgaaggggatttttcggagcctttacaaaaaagggcatgaaaagctcaaaagagcgcttcagaagctgaatgaacaggaaaaaaacaaagtgaatgaaggccttacaattcttgaaaaagcgttaaaagccgatgatgaatag

SEQ ID NO: 3586 - DNA, 1560 bp, Bacillus licheniformis
gtgaaccaaaagtgggctgtattattgtttacgatcggcgtgtttatggctgctttagacaacggcatcatttcagcggcactgacgacaatcaatgattcttttcaagtatccccctcatggggagcatggggcatcacgctttatacgctcggtttggcagtcagcgttccgatcgtcggaaagctgtctgaccggtatggacgcaaaaagctgtttatcatcgaagtcttgctgtttggcgccggttcgctgctcgttgcattgagccaaaacttcccgatgttcttgttggcgaggctgattcaatcgcttggcggaggcggaatctttattatcgggagctcgcatattctcactgcgctgcctaaagaaaaacagggaaccgccttggggcttttaggtgcgatgaacggaatcgcggcagtgctcggtccgaatatcggcagctttattttggatatgaccggaagctggcactggctgtttttgatcaaccttccgattgccgcagcactgatcatcctcagcgttccattgatgaaggagacaaaaggcggaacacgaaaacccctagatctggccggaactgtgatattgtctcttgcgattttagctgtgatgtacggaataacgaatataaacggacagcgcctgtctgccgtcttgtccgatccaaaggtttacttttttctcctgatcggctgcgcgctgtttgcgggactcattttttacgaaaagcgcgtagagctgaagggaggcgacccgatccttgcctacagtttattaaaaaacaaggtgtttcaatggacgctttttatcggatttttatccggcggactcttggcagccgttatttttattcctgcatatgcggaacaatatttgcacgtcgctcctgaaaaagcggggtattggatgacgcctcttgcgctggcttcagggataggagccgggctcggcggaatgctcgccgatcgaaaaggaccggtaaaggcggcccggctctctggcgtcatttcgttcgccgggtttttgctcttgtcctcctgggtgacagagaagtgggaatttgttttggcaagcatcatcgcaggggtcggttttggctttctgttaggcgcgccgttaaatatgcttgtatccgaggcggcaaaacaggattacgggacagcgctcggtacattatcgctcgtcaggcagatggggatgaccttggcgcccgcgctgtatgcaggatatataacggccggctacgaaaatatcggcacacatatcaaacataagctgaatgatgcagggatcactctgaaggggtttgcaggcggtgagacggacgtatcaaggctgagcgaatccctcagccaaatttccgacccaaaagtaaaagacatcataagcgaagcgatccatgaaagtgtgggagcggggttttttaacctctacttcacagccgccgtcctttcacttgcagtcattgcttctgtcagcgttttatcgctttataggaaaaaacaaaccgacacggcaagccgtctaaaaaaagacgtgacaaactaa

SEQ ID NO: 3587 - DNA, 3990 bp, Bacillus licheniformis
atgaaaaagtacagaaatcgccaaacccttttattgttggccgcagttttactttttgccttgcagatcccgatttcgtccgcatcgggtgaagagcatattcagcctggttcaccggttatcaggcatactcctgttgaacaagttcaaaaaggagatgacatatatttttccgcgcaggcggccgccgacacggtcattttatattacaagcagcatgacgaattgccgtatcgggcgattccgatggaagttgagccgggcagacagaacgcctatattgccaaattggaaagcgaatccatagcatccggcaaagtccagtactacattgaagctcaagtcggcgactcctctgtgaagacggatgtgtatactgtcgccctgaaaggcatgcgtacagatacacaaaagcttccggagctgttgatcacggaaatggtagtcgacacgtcaaacaccggtggaaaggacggctatgaatttattgaagtttataacaataccaataaagctgttcatctgaacagctacaaaatcaagtacagacatcctgaaaagggcaaggaatcagacgtcatctggccttttgagcacgatgatgtggcgattccttccggtcaaacacacgtgttttgggtgaaaaaccgctcaaacggtcatctgacggaaagtgatttcaatcggtattacggtgttcaccttcgtgaaggcaaaacgcttactgctctcaaagggggcggcatggagaatacggcgccgagagaggtgatcatctgcacaaacagcggagaagaggtcgcatccgcccgttatcaaagcgagccggataaaaccgatgtcgccaaaaataaagcgcttctgtatcgatatccgctggacggaacgaagcatatgaaaatcatatcggccggggaagaaaaaccgtcgcctggttcgcttctgaagacgcaggcaccttcacagacggtgacggttatgccggacagagaaaagccggagatccatgatatgacggatcatcaagctgtaaaaccgggtgaaacgatccagctcttagctgatatgaaagacaatcggcaagtgaagcaggcgcagtttttctaccgcatgaatgatgatgagcggtttaccgaagtccgtgttgaaaaaagccgcaatgacggcctgtaccgccacaatatctattttgccgaactcattggcaaagaaaaagtggagtactatatgcgggccggtgatggatcaaatgtttcgtcgactgaaaagaaaacgataccgctcgaacagcgcattttgaagggactcaggctgaatgtaagcgaaggcggaaccgtttccggaaaaatgctgttgaaagccacatcagaaaagccgccttctgaaacgacaattcgtattgacgggattgaacaaaaagaaggtgaaccggcgcttgaaaaaaaagcctactttgctttcgatgtcaatcaaacgaatctgtattttaaaaatgctgtaacgatcggcaggagagttcaaaaagtttttgacgattcgcgccgccggtatgcgacaattacggtcccggtttctccggatgaatttaaaaaaggaaagccgttttcgattaaagttcgttcaggcacgaaatcaacaccatttgaacaaactgcagaagaaaacagggatgattttgtcctcaagaacccccgcctcatactcgcggatgggaccatcatccgcgatgagcgatacgacgatccgaaagccgagcttccggccggtgacggccctggggcgcatgaatggtatgaattccgttttacgattccggaagccaagtttgcatcgcttgcgagtcaatggcatacacgcgcctggaacgaagggcagcacatcgttgaagcggagaatggcgaagaaaggctcatccgcagggtaacggtcgataacacaggtcctgagatcaaaacgtcattaaaagacggcaggacgtataaagggtcgtttgagatcaatgcggccgcacacgataaatggagcgggatgaaaagcataaaagcctttcttgacggcaaaaagattgcgcttccctatctcgtatcttctgcccgcctggatgcgggaaagcacgagttgaaaataaaagcggaggacagcgccggcaacctgtcaatcgtaaaaaaggcattttacattaaagaggaaaagccggacaagcccgctcgggtcaaaaatacacccggcagcacacatgctaagctcgccgtccgcgtcaaggacccgacaaaagataagatgaaagtgtcattccatcagggatttcagtacacagtaaaagacgaagagcatgttgatgtgtcagcgaacgaaagcgggacggaacctccgcaaagctttgcggtcaggggggaaaaggcgctgacaaaagaagagcgcagcggcatgtccgcacttgacggaaaaggttttgaaacctcatcaacaacaaagtttccgtaccatcgctttgatgtaaaagtggatgaaaatacggggccgaacgacaaggtggaagtgctgtggcgcgggagttcgcttcccggcagaaaagtctccatgttcgcctggaactgggccagcaagaggtgggagacgcttgcattccatgttgcaaaggatggcaaaccttttaccctcaaaggaagcataaaagccgccgattatatccgccaatccaaggcgagcatcatcattcaggatcaaattcagctttcgcaaaatgactatacatttgtgtggatgtctgatacgcaatattattcggaaagctatccgcacatttttgaacgtcaggtcaagtggatcgcggaacaaaaggacaagctgaacattcagtacgtctttcatacgggggatcttgtggatgaagcggatcagccgctgcaatggaagcgcgccgaccagttcatgaaagttctcgacgacaatcaagttccatacggcgtgctggcgggcaatcacgatgtcagccataaagaccggtcatatttgaaattcggcaggtacttcggggagaggcgttttaaacaaaaaccgcattacggcgggtcttatcagaataacaaagggcattacgacctcatttccagcgggggcaacgactatatcatggtgtcgatggggtggggaatcggaaaaaaagaactgcagtggatagatgatgttctgaaacgccatcccgatcgaaaagcgattttggcatttcacgagtttttgcttgtcagcggaagcagaagtccaatcggggagaaaatatttgaacagatcatcaagcggaatccgaatgtgattgccgtattgagcggtcactatcacagctccaacttaaaagtcgacaagcttgatgataacggggacggcaagccggatcgcaaggtttatcaaatgcttgccgactatcagggcggtcctgaaggaggccaaggttatttaagaattctccatgtggatccgaagcatgacacgatccatgtcaaaacgtattcgccatatcttgatgactataacttttatgatccgcaccaatttggcccgaaggacgagttcaacattaaaacggatctgaaaccgaggaagaaaaaggttaaaaccgattattttgagctgaatgtcttttcgaacaaggaaattgggaaagcaaaaacggtgaaaagcggaaagacggcttccgtgacgtggaaagatttgcagccgaatacaacctatttctggtacgccgcagcttcagatcaatacggcggcaacagcaggtctcaaatgtggagattgacgacaaaagacgatggcatgaaatcctttttaatagatcaaacagccggggcgggctcggccctgaggcaattgtcggggagccccccgccggccgggatgattttaaagaaagggacaaacctcccaattgctgaaatcagcttgtggctggcggcggttttcctttgcgaacgcaaaaagcatttgttttcctaa

SEQ ID NO: 3588 - DNA, 360 bp, Bacillus licheniformis
atgatgagatggattataaacgttcttgtcaatgccttattattaattgtcattgccggttactttgatgcggttcacgtcagaagcatcggagcagccattacggcaagcttgattttatccatcttaaatatgtttgtgaagcccgtgctggtgattttgacgctgcccgtcacagtaattacgctaggtttatttttgtttatcatcaatgcgatcactctttatatgaccgcgtccattatgggggacagttttgacctggacggctttgggacagccatttttgcgtcgatcgtcctgtcggtttttcacttgctcattcaaaaagcaattatcgaaccgatgtccagaaaataa

SEQ ID NO: 3589 - DNA, 201 bp, Bacillus licheniformis
atgaaaaggctatttcgatccgaaacagacagaaagattgccggggtcgtcggaggtcttgctgaatatttaaatatggatgcgtcattgctgagaatcattacggttctattatttatattttcgaccggagttcccgtcctgctgatttatattgtctgggtattccttgtgccgaatgaaggagacgtcaacagatga

SEQ ID NO: 3590 - DNA, 1095 bp, Bacillus licheniformis
atgaagcatgagaaagaacgaattttaaaattggtcgaggaaggaaagctgtctgcaaaagaggcgctgatcctgatcgaaaaacttgaagaagactacaaggaaaccgagagcaaggtgacagccctgtctgaggatgtcattgattcggaggacttctacagcgaaaagaaaaaagaaccgaagccttcgatcggttcaaaactgttcgaatggattgataccgctgtaaaaaaagtaaaagaagcagacttggatttgaatttcgggcactcgtacgatgtccagcatatattccagtttaaagacactgatttttcgactctggatattcagcttgccaacggcagcgtcaaccttgtaccatggagcgattccgacatcagagtcgaatgccaggcaaaagtgtaccgggctgaaaatcaggatgaagcaaggcaggcttttctccagcatatcgactgcggtgtggaaggcgataagttcatgatccgtaccgagaaaaaaacgatgaagaccaaccttaccgtctatataccggacaaagagtacggcaaaatccgctttaaactgtttaacggcccggtcagaggggaacatttaaacgtaaaagagctgtccgccaaaacgacgaacggcgtgctgtcgttctctgctctcacggcaggaaaagcttcattggaaactgcaaatggacaaatcaaactagccgaccatacttgcggagagattgaagcggaaaccatcaatggattgatcgaccttaaaggttcatgcgaggcgcttgacctgcagagctttaacggcaatatcgcggcaacagtcaaaaatccgcactgccggacggcatatgtgaaaacaacgactggaagcgtagagttgaatgttccccgggactgcgctgttacagcggagctgaaaagcaatctcggttctctgtctcatgatctttcagatgcagaaattttaaaggaaaaaaacgagacaatccagaaggaaatgtacctaaaagcaaatcaaaatcatgatcatagcatgaccgtgtttttggaatcgaagacaggatcgatccatttaaaccatacacaggagtga

SEQ ID NO: 3591 - DNA, 327 bp, Bacillus licheniformis
atgacgagaaacaacgcgctgatttcttcaatttgttattttagtgttttttttgccccgcttattttgccaatcgcagcgtattttataacagatgatcaagaaacgaaaaagcatgcgatgcgttcgcttatttcgcatattattccgtttataagcgtagtcatattggcagcaggcgcgataagcggtacgcttatctttggtgacggcggttatttggcggtcattttcatgatcggaggtttcgtttttttcgggatcatcagtttgattattgtggtctggaacgtagttcaagggattaaaatgctgactcaggcctaa

SEQ ID NO: 3592 - DNA, 231 bp, Bacillus licheniformis
atgaaacagaaatcggaagtatacgcctcatccgcctcccagcttcttagtctgattcaggaacaaaaaaggatgaatcaggagatcgtgaaccgattggaatcgatcaattccgctcctccgctttccagcgaaatccgctatttaaaggttctgctgaacagcagcagcacccatattttaaacagtatgagtgaagcgaccaaacacatcagccggactgaacgttaa

SEQ ID NO: 3593 - DNA, 273 bp, Bacillus licheniformis
atgtcacgtcggcagctttttcaatggccgaatgatccgcggcaagctttgttcaaaaagattttcattgctcttttattcaatagctgttataacgtaaaaaaacaaacaataaagggggatggggtgatgaagatcgatcgcatggatcatttggtactgactgtaaaagacattgatgcgacatgtgatttttacagccgtgtgccggggttgaatgcggtcacttttcgagaaggaagaaaagcgcgacattcggcaggcaaaaaataa

SEQ ID NO: 3594 - DNA, 2874 bp, Bacillus licheniformis
atggcaacgaaacgaattgaggtgaaaggtgcaagggcccataacctgaaaaatatcgatgtctctattccgagggatcagcttgtcgttttgacaggtctttcgggatcagggaaatcatcccttgcgttcgatacgatatatgcagaggggcagcggcgctatgtcgagtctctctccgcatatgcccgccagtttttaggacagatggacaaacccgacgtcgatgcgattgaaggcctgtcgccggcgatcagcatcgatcagaaaacaacgagccggaacccccggtcgacagtcggaacggtgacggaaatctacgattatctccggctgctgtttgccagaatcggaaagccggtttgccctgttcacggcattgaaattacctcgcaaacgatcgaacagatgacggacagaattttggattatcccgagcggacgaagatccaggtgcttgcgccgatcgtctcgggaagaaaaggatcgcacgtgaaagtgctcgaacaaatcagaaaacaaggctatgtgagagtccggatcgacggcgaaatgaacgacctctcagaggacatcgagctcgaaaagaataaaaagcattcgatcgaagtcgtcgtcgaccgcatcgtcataaaagaaggcgtaaccgcccgtctcacagactcgctcgaaacggcgctccgcctcggcgaaggccgtgtgatcatcgacgtgatcgggcaggaagagctgctgttcagcgagcaccatgcctgtccgcactgcggtttttcaattggggaactggagccgaggatgttttctttcaacagcccgttcggcgcatgtccgagctgcgacggcctcgggtccaagctggaagtcgatgtagagctcgtcattccaaacgatgagctgtctctaaaggagaatgcgattgcaccttgggaaccgcagagctcccaatattatccgaagctgcttgaagcggtatgcagccactatggaatcgatatggatattccggtcagagacctgccgaagcaccaccttgagaaaatcctctacggcagcggaggcgagcagatttatttcagatatgaaaacgacttcggacaagtccgggaaaactacattgagttcgaaggcgtcatccgcaatatcgaaaggcgctataaagaaaccagctcggattatgttcgtgaactgatggaaaaatatatggctaatcagccgtgcccttcatgcaaaggctaccgtctgaaaaaggaatccctcgccgtgctgattaacggccttcacatcggtaagataaccgaaatgtcggtagctaacgcccttcaatttttccgtgaacttgatctttcagaaaaagacatgaagatcgccaacctcattttgcgggagattgaagaaaggctcggattcttgaacaatgtcgggcttgactatttgacgctcagccgcgcagccggcactctgtcggggggagaagcgcagcggatcaggcttgcaacgcaaatcggctcaaggctgaccggtgtcctttacatccttgatgagccgtcaatcggtcttcatcaacgcgataacgaccgcctgattgagacgctcaaaaacatgagggatatcggaaacacattgatcgtcgtcgagcatgacgaggatacaatgcttgccgccgattatttaatcgatatcgggcccggcgcgggtgtacacgggggagaagtaatctccgccggaacgccggaagaagtgatgaacgatgatcaatctctgacagggcaatatctttcagggaaaaaattcattcctcttcctgccgagagaagaaagcctgacaaccgctttatcgaggtaaaaggggcaaaggaaaacaacttgaaaaatgtttccgtgaaatttccgctcggcgtgttcacagctgttaccggggtatcgggatcagggaaaagcacgctcgttaatgaaattctccacaaaacgctggctcagaagctgcatcgggctaagacgaaaccgggagaatacaaagaaataaaaggaatcgagcacctcgataaagtgatcgatattgaccagtctccgatcggccggacgccgaggtcaaatccggccacatataccggcgtgttcgatgacatccgcgacgtgtttgcccagacgaatgaagcgaaagtcagaggatacaagaaagggcgcttcagctttaacgtcaaaggcggacgctgtgaggcctgcaaaggcgacggaatcattaaaatcgagatgcacttcctgcccgatgtatacgttccttgtgaggtttgccacggaaagagatacaaccgtgaaacgcttcaggttacgtacaaaggcaaaaatatctctgacgtgcttgagatgacggtcgagaatgccgttcaattttttgagaacatcccgaaaatcaagcgcaagctgcagaccctctatgatgtcggtcttggctatattacgctcggacagccggctacaacgctttccgggggagaagcgcagcgggtcaaattggcatctgaacttcaccgccgttcaacgggaagatccctttatattttggacgagccgacgacaggactgcacgtcgatgatatcgcaaggcttttggccgttctgcagcgcctggtcgacaatggagatacagtgcttgtaatcgaacacaatctagatattataaaagcggctgattatttgatcgacttgggtcctgaaggcggagacggcgggggaatgatcgtggctgccggacctcccgaagaagtcgtgaaagtcgaagggtcatataccggccgttatttaaaaccgatcattgaacgcgacaaaaacagaatgaagaagcggcttcaagaaaaagaagctgtcagaccgtaa

SEQ ID NO: 3595 - DNA, 1986 bp, Bacillus licheniformis
gtgaaagaccgctttgaattagtctcgaattatcagccccagggggatcagccgaaagcgattgatcagcttgtcaaaggaatcaatgaaggcagaaagcatcagacgcttttgggggcaaccggtactggaaagacgtttacgatgtcgaacgtgattaaagaggtcaacaaaccgactctcgtcatcgcccacaacaaaacgttagccgggcagctttacagcgagtttaaagaatttttccccaacaacgcagtcgaatattttgtcagctattatgactattaccagcctgaggcctacgtgccccagactgatacatttatcgaaaaagatgccagcattaacgatgagattgataaattaaggcactctgccacgtctgctctttttgaacgcaaagatgtcatcattgtggcgagtgtctcttgtatttacggcttgggttctcctgaggaatacagggaaatggtgctctcgctcagaacggaaatggaaatcgagcggaatgagctgctcagaaagctcgttgacatccaatatgcgcggaatgacatcgattttcagcgcggaacattcagggtgcgcggcgatgtcgtcgagatctttccggcttcaagggatgagcactgcgtccgagttgaatttttcggggacgaaatcgaacggatcagggaagtggatgccctgactggcgaaattttaggggagagggaacacgtcgcgatcttcccggcttcccacttcgtcacccgggaagaaaagatgaagaaagcgatcataaacattgaagaggagctggaagagcgcctcaaagcgcttcgtgaagaaggcaagctccttgaagcgcagcgtctggaacagcggacgagatacgatttggaaatgatgcgcgaaatgggcttttgctcgggcatcgaaaactattcaagacatttgacgcttcgtccggcaggttcgactccatatacgctgctcgattactttccggatgatttcctgatggtcatagatgagtcgcatgtcaccataccgcagatcagaggaatgtacaacggagaccaggcgagaaaacaggttctcgtcgatcatggattcaggctgccttccgctttggataaccgtccgctcaggtttgaagagtttgaaaagcacattcacaacatcgtgtatgtgtcggctacgccggggccttatgaacttgagcatacgcctgaaatggtagagcagatcatccggccgacagggctgctcgatccgattattgaggtaaggccgattgaagggcagatcgatgatctgatcggtgaaatccagcagagaatcgagcggaatgaacgcgtcctcgtcacgacgctgacgaaaaaaatgtccgaggatttgacggattatctgaaggaaatcggtatcaaggtcacgtacctgcattcagagattaaaacgctggagcggatcgagatcatacgcgaccttcgcctcggcaagcatgacgttctcgtcggcatcaacctgctgagggaaggactcgatattcctgaggtttcactcgtcgccattcttgacgcagacaaagaaggctttttgcggtccgaacgctcgctcatccaaacgatcggccgcgccgccagaaatgccgaaggccgcgtaatcatgtatgccgacaaaatcaccaactcgatggaaatcgcaatcaatgaaacgaagcgccgccgcgaacagcaggaggcttataatgagaaacacggcattacgccgaaaacgatcaacaaaaagatcagggacgtcatccgggcaactcatgctgctgaagaccaggaagaatatcaagtgaaagaggagccgaagctttcgaagatgacgaagaaagagcgggaaaaagtgatcgctcaaatggaaagcgacatgaaggaagcggcaaaagcgcttgactttgaacgcgccgccgagcttcgcgacttgctcctagagttaaaatcggaaggatga

SEQ ID NO: 3596 - DNA, 234 bp, Bacillus licheniformis
gtgtttacaaaagccgtttttgcactgatatttccttttattcttgtcttgttttttacaagggtgacctataaccattacgtcggaattgcgctcactgcagcgctgttgttcgcttcatatttaaaaggttatacggaaaccttttttattgtaggacttgatatcgcctcgctcgtcgccggttcgctctatgcggcaaaaaaggcgggcgaaaagaaggaagactcatag

SEQ ID NO: 3597 - DNA, 294 bp, Bacillus licheniformis
atgaaaagggcttttctcgcaggtgctttcgtttgtttaatagctgtattggtttcggctgcggccggggattggacgctgattttcaaagtttcgggagcagccggcctaggcgcgattctgttgtctgctttatgttcgggcgtatttgtcagcggtgaccggttcaggggaaatcacgatgcagaaacgaaagagcacggggagtggaacagcaagctggcaaacgctctcgccattttcgccatgccaaacctcctggccgccggaatatcgttctttttcgccttttaa

SEQ ID NO: 3598 - DNA, 1212 bp, Bacillus licheniformis
ttgtcagttgaagaaagcttaattgaacttttaaaaggagcaggattgttctttttgcacccgctcttctattttatgatgattatgagtcttgcttacggctatgcccggatcaaacgtgaaagaaagacgttccatacgcgtattgaagatatttatgacgagttcaaatttacatattccaagggacttctggcaggacttgtactgtccattgtttcgttcggcttggggctgtatctcccgatgggcatgctggttttaatagcggcggtcagcgttgccgcagctttaactttcagacagagtctgctgtcagcggcatatacgcttggcgtgagcatcgtcgttggtttatgtattgaatacaccggtttcggagcgcttgacgcgtttctgccgcagctgtccctcgcgaattggtcggctgctgccgtcttgctcggacttctgttggtggcggaaggagtgcttgtctataaaacggcacatatcaaaacgtcccctgcgattgtcatgagcacaaggggtctcccgatcggacagcagattgcgggcagaacctggcttctgccgttgtttattcttattccgggacatgcgatcgaatcatctgttccgtggtggcctgttttgtcatttaacggcggctttgagctcttgtggattccgtatttcatcggcttcggccaaagggttcaaggatcgcttccgattgaaagcattaaaattacagcgaagcgcatcagcgtgcttggcatcatcattctgctgatcgcggccggaagcatatggtggactccgcttgccgcccttgccgccggagcagcgatcgcaggaagggcctttttatcctggaagcagcggatgaacgacaattccgcccctttccatttttcaaagagagaccagggcttgatggtgctcgggattattccgaacacgccggcagccgatctcggtctcaagatcggcgaaatcatcacgaaggtcaacgggattgaagtgaaaaatgcggcggacttctacgaagcgctccaaaagaacagggctttcttcaagcttgaagtcgtcggtttaaacaatgagattcgttttgaacaaagagcttcttatgaaggggagcatcatgagctcggcatcatctttgtaaaagaagaggatgcggtgatgaagcatgccgaggcagcagcctcagcagaaacagaataa

SEQ ID NO: 3599 - DNA, 354 bp, Bacillus licheniformis
ttgaaaagggcaagtattgtgagagagaaaaaatactatgaattagtggagcagttaaaagttcgatcacaagacgttacgttttccgctacaaaggcagtaggattgcttatgctgttcagcagatacctcgtgaactacacttcggtcgaaagtgtggaagatattaatgaggattgcgcggaactttatttcaactacttgatggacaaccacaagcggctcggcatcaatctgaccgacatcaagcggtcaatgcagctgataggagatattcttgatgtcgaggtcaatcattacctgaaagatttttctttgtcgaatgtgacgctttggatgagccaggagaaataa

SEQ ID NO: 3600 - DNA, 1440 bp, Bacillus licheniformis
atgaatcagaagattgtgcggctcatcattgcgctcagcctgttatgcggcttggtaacaggcgccggcccgattccgttacatgatgtcgtttcaaaagcatcagcggctgaagaagctgcagccaaaagcaccgctagaaacgaattggagaaaattgagaaagcatatgacctgatttcaaatgaatatgtggagcaggtcgacagggaaaaactgttggaaggagccatacagggcatgctttcaacattgaatgacccatactcggtctatatggataaacagacggcaaagcggttttcagattcccttgattcctcttttgaaggaatcggtgcagaaatcggaatggaagacagaaaaatcattatcgtttctccttttaaacagtctccggcagagaaagccggattaaagccgaacgatgaaatcattagcatcgacggcgattccatgagcggaatggatttgaatgacgccgtattaaagatcagaggcaaaaagggatcgacggttacactgaaagttcaccgacccggaatgaaagaccagctgacatttacgattaagcgcgatgaaatcccgctggaaacggtgtttgcttccataaagaaagtacaggataaacctgtcggctatatcgcaatatcttccttttccgaacatacggcaaaagattttactgctgaactgaaaaagcttgagaaaaagggaataaaagggctcgttttggatgtaagaggaaatccgggcgggtacttgcaaagcgtggaagacattttaaaacattttgtgacaaaagatcatccgtatatacaaatcgccgaaagaaacggaaataaaaaacaatacttctcaaaattaaaagagaaaaaaccataccctgtgagcgtgatcacggacaagggcagcgcttcggcttcggaaattcttgcaggcgcattaaaagaagccgagggctacgacgtggttggcgatccttcctttggaaagggaaccgtccagcaggcggtgccgatgggagacggtagcaatattaagctgacgctgtacaaatggctgacacctaaaggaaattggatccataagcagggcattcagccgaccgttccagtcacgcagcctgcatatttctcggcggggcctttacagctgaaagaacccctcaagccggatatgaacaacaatgaaattaagcgggcgcagttcctgctgaaaggactcgggtttgtccccggccgggaagacggctattacaatgaaagcacaaaaaaagccgtcatggcgtttcaggcagcaaacaagctgaagcaaacagggatcattgaccaaaaaacggcaaatacaatgaacctgcggattgaggagaaaaagatggatgaaaagaacgatcttcagctgcaagccgcattaaaagtgctgtttaacaaaaagtga

SEQ ID NO: 3601 - DNA, 1110 bp, Bacillus licheniformis
atgaaagtgacaactgtcgacagtcgacaatttgaaataggggatgatccaatgaaagtattcaacattgccagcatacccggtgacggggtagggaaagaagtcgtacctgctgcacaacgagttttgaaagcggtttcggatgttcacgggggactctcatttcggtttacggagtttccatacagctgtgagtattatttggaacacggggaaatgatgcctgatgacggcttggagcagctgaaagagttcgacagcatctttcttggggctgtaggaaacagcaagcttgtccccgaccatatttccctgtgggggctgctcattaaaatccgccgcgaatttgaacaggtcatcaacattagacctgcgaaatatttgcaaggaatcaagtctccgctggccaacccaaaagatttcgatctgcttgtcgtcagggaaaacagtgaaggggaatacagctcgatcggaggcagaatcttcagggatgaagatgaaatcgccattcaaaatgccgttttttcaagaaaaggggcggagagggcgatgcgctttgcttttgagttggcggctaagcggaaaaagcatgtcacaagcgcaacaaagtcgaacggaatcgtttattcaatgcctttttgggatgaagtctttgagaacacggcaaaagactaccccgatattaccgcagattcgcagcacattgacgcgctgtcggccttttttgtaacgaggccagagaagcttgacgtcattgttgccagcaatttattcggcgatattttgaccgatatcggggcggcgattatgggaagcataggtgtggcgccggccgccaacattaatgtaaacggcaaatatccatctatgtttgagcctgtgcacggctctgctccggacatcatcggaaaaggaatcgccaatccgatcggccaaatttggacggcaaaaatgatgctcgatcatttcggggaagaagaactcggtgcaagattgcttgacgtgattgaagacgttctaaagagcggctacttaacgcctgatatcggcggttcaagtacgacggatgatgtgacagaagaaatcatcaagcgcgtgaggaccatataa

SEQ ID NO: 3602 - DNA, 1251 bp, Bacillus licheniformis
ttgaaaagaaagcttatgacgctggggctgaccgctgtgctcggatcgtcggcagtgctgatccccttaaaaagcaaccatgctttagcttatgaagacttggagaaaaaaaagagcgacgttcaaagcaaaaaatctgaaaacgagtcaaaactcgaaaaaacgaaacaggagctttcagagcttgaatcaaaggaagcaagcctgagaagcgagatcgagaaaatcgaccgtaagatgacggacacgaatgaaaagctggaaaagaaaaatgaagaaatcgataaaacaaagaaaagcatcgaagagctgaaaaagcaaataaaaaagcttaaagaaaagattgagaaacgcaataaaatattgaaagaccgtgttcgctcaatgcaggaaaacggcggttctgttcaatacatagatgtgcttctcggctcgaaaagcttcggggatttcatcagccgcgcgggtgcggtttcgacaattgtagaagctgataaagacctgatggaagagcaaaaacgcgatcttcagcttgtcgaggaaaaggaaactaagctgagcaaggatcttgaaagccttgaaaaagcgctcaaagacctggaagatttaaaaaagacgctcgacaagcagcaaaaagagaaagcaaatgtcatgaaaaaagtgaagcaagataaagatcatgcacatgaagaacttggttcactcgaaaatgaagcagaaattttaaagcgccaggatgaagcgatcaaagccgaagaggcgcatcgcaaaaagcaggaagctgaagcgagccgccaggcttcaagcggccaatcggaagcttcctcatctaaaccgtcggcaccaagcagctcaggctttatccgccctgcttccggcacatttacttccgggttcggaaagcgttcgctcggaaatcacttcggcgtagacatcgccaagcgcggttcaggcgttccgatttatgcggccgccgccggaacggtctataacgcccattactcgtccagctacggcaatgttgtgtttattacccataacatcaacgggcaaacatatcagacggtctacgctcacatgtcttcaattaaagtgcagacaggccagcgtgttgaacagggacaagtgatcggaacgatgggaaatacaggccaatcctacgggcagcatcttcactttgaaattcataaaggcctttggaacaacgcgaaatccaatgctgttgatccggccaattatataccgctttaa

SEQ ID NO: 3603 - DNA, 891 bp, Bacillus licheniformis
atgattagaactctcggacggcatttgcgcgagagcttaaaatctctcgggagaaacgcgtggatgactttcgcatccatcagtgctgtaacagttacacttatcttggtcggcgtgttcatggtcatcatgctgaacgtatacaatatgacattaaaagccgaacaagaagtcgaagtcaaagtgctggttgacttaacggccaaccaggatcaaaaaaatacattggaaaaagaaataaagaaaataccggaaatcagcagtgtcaaatactcatctaaagatgaagaactcaaaaacctgaaagacagctttggggaagacgggaaattctttgcgatgttcgagcaggaaaacccgctgaacgatgcatttgtcgtaaaaacaaaagaccctcaagacacaccgaaagctgccaagaagcttgagaagctgaccaatgtctataaggtgacatacggacaggagcaggtagaccgcttgtttaaaatcagcaatgtcgccaaagtcatcgggattgcattggtcatcggcctgctgtttacggcgatgtttttaatttctaatacgatcaaaattacgatttttgcgagacgcaaagaaatcgagattatgaaacttgtaggtgcgacaaactggttcattcgctggccatttttcattgaaggtttgctcttgggtgtatgcggttctatcattccgatcgctattttgctcggaacgtatcatcatgccgttcagtggatcgctccgaaagttcaaggcactttcatacagctcttgccgtacaatccgttcgtcttccagatttcagcgatcctggtgctgatcggagccgttatcggtgtatggggaagcttgatgtcgattcgcaaattcttaaaagtttaa

SEQ ID NO: 3604 - DNA, 687 bp, Bacillus licheniformis
atgatcgaaataaaagatgtatataagacttattccaacggggtctcggcgctgaacggaataagcatctctatatatcccggggaatttgtttatgttgtaggaccgagcggagcaggaaaatcaaccttcattaaaatgatttaccgcgaagaaaagccttccaaagggaagattgtcataaacaataaaaatttggcgcagctcaaagaaaaagagattccttttatcagaaggaaaatcggcgttgtattccaagactttaaactgctgccgaagctgacggtgtttgaaaatgttgcatttgctttagaggtcatcggggagcgcccagaggtgatcagaaaaaaagtgcttgaagtgcttgatcttgtccagctgaagcacaaagcaaggcaatttcctgatcagctgtccggaggagaacagcaacgggtttcaattgcgcggtcaatcgtcaacgaccctgatgtcgtgatcgctgacgagccgacgggaaaccttgaccctgagacgtcttgggaaatcatgaagacgctcgaagagatcaacaaccgcggaacaacagtcgttatggcgactcataacaaagaaatcgtaaacaccatgaagaaacgggtcatcgcaatcgaagacggggtcattgtgcgtgatgaagctagaggggagtatggttcttatgattag

SEQ ID NO: 3605 - DNA, 327 bp, Bacillus licheniformis
atgaaaatgaagctgtttactctgtttatggctgtttcttttgtgctggctgcctgcggcggcaataacaacgaaagcaaagagaaaaatacaggcgggcaagcaactgcaaccgacggggaagagatttaccagcaaaactgcacaggctgccatggtaaggatttggccggcggttccgctccgagtttgaaggaagttggcggcaagtataaggaaagcgaaattaaggacattgtagtcaacggccgcggcggaatgcctggcaatcttgtagacgaaaaagaagctgaagcggtcgcgaagtggctttcagagaaaaagtaa

SEQ ID NO: 3606 - DNA, 855 bp, Bacillus licheniformis
atgaatatggacaaaacgagatatcaattgtttacggtgctgcgtgactacggctatatcctgtttggatcagccgtcgtcgctgtgacatttaatatgtttttgcttcccaaccggattgcagccggcggagtcagcggcatcagcaccattttgcaatcgttcggctttgaagccgcctatgtgcaatgggcatttaatattcctttatttattgccggggttctggtactcggaggaaaattcggcatcaagacgcttgtcgggtctgtttttctcccgtttgtcgtatacgtgacgcgggacattgctccggcgacagagaatccgctcttggccgccattttcggcggtgtcggcatcggagtcgggatcgggatggtctttctcggaaggggctcgacaggcggcactgcgctggccgcgcaaatcattcataagtacaccgggctgtcgcaaggcaaatgtttggcgctgattgacggaacgatcgtcctgtccgcgatgtttgtttttaacatcgaacagggactttatgctatgcttggcgtttatatatcaagcaaaaccatcgatgtcatccaggtcggattgaaccgttccaaaatggcgatgatcattacgaaccgggaagaggaagttcgacatgcggtactgaataaaatcgacagggggattacgaaaatatcagcggtcggaggctatacagatgatgagcggcctattttgatgtgcgtggtcggccagaccgagttcacaaagctgaaacaactcgtaaaacacattgatgagtctgcatttgtcattgcgatggatgcttcagaggtgcttggcgagggttttaaacgcgcataa

SEQ ID NO: 3607 - DNA, 984 bp, Bacillus licheniformis
atggctgaccccgacttttggggagatcagcagaaagcgcagacgatcattaatgaagcgaatgcgttaaaagactatgtcaacacgtacaaaagtttaagcgagtctcatgaagaactgcaaatgacacatgatcttttaaaagaagatcctgaccaggacctgcaaaatgaactggtcaacgagctgaaaagcttaacaaagcagtttaatgaatttgagctccagctattgttaagcgagccttatgataaaaacaatgcgatccttgagcttcacccgggagccggcggcaccgaatcacaggattggggttcaatgcttctcagaatgtacaccaggtgggcagagcgccgcggattcaaggtggaaacccttgattaccttccaggagatgaggcgggaatcaagtctgtcactctcctgattaaaggccacaatgcctacggttatttaaaagccgaaaaaggcgtgcacaggctcgtcagaatttctccgtttgactcttcagggcgcaggcacacgtcgtttgtgtcttgtgatgtcatgcctgaattcaacgaagaaatcgacattgagatccgtacggaagatattaaagtcgatacgtacagggcaagcggcgccggcggccagcacgtcaatacgacagactccgccgtcaggatcacccacttgccgacaggcgtcatcgtcacttgtcagacagagcgatcacaaattaaaaaccgcgaacgtgccatgaaaatgctgaaatcgaagctgtatcagcgcagaatcgaggagcagcaggcacagctggacgaaattcgcggcgaacaaaaagaaatcggctggggaagccagatccgctcatacgttttccacccgtattctctagtgaaggatcatcgaaccaacacggaaatggggaacgtgcaggcggttatggacggagacattgactctttcattgacgcatatttgcgttccaagctttcctaa

SEQ ID NO: 3608 - DNA, 2526 bp, Bacillus licheniformis
atgcttggaattttaaataaagtgtttgatccgacaaaacgcacgctcagccgttatgaaaagaaagcgaacgagattgatgcgctcaaggcagatatagagaagctttcagacgaagctttgaagcaaaagacgatcgagttcaaagagcgccttgaaaaaggcgaaacggttgacgatcttttggttgaagcgtttgccgttgtcagggaagcttcccggcgcgtgacaggcatgtttccgtttaaggttcagctgatggggggcgtcgcccttcatgaagggaatatcgccgaaatgaaaacgggggaaggtaaaacgctgacttccacaatgcccgtttacttgaacgctctgtcagggaaaggcgttcacgtcgtgacggtcaacgaatacctggcgagccgcgacgctgaagagatggggaaaatctttgagtttctcgggctgacggtcggcctaaacctgaacagcctgtcaaaagacgagaagcgtgaagcctatgcagcagatattacgtattctacgaataatgagcttggctttgactacttgcgcgacaacatggtgctttataaagagcagatggttcagcgcccgcttcattttgcggtcatcgatgaagtcgactccattttgatcgatgaagcaagaacgccgctcatcatttctggacaagcggccaaatccaccaagctttatgttcaggccaatgcgtttgtccgcacgctaaaagcggatcaggactacacatacgatgtgaaaacaaaaggcgttcagctgactgaagaggggatgacaaaagctgaaaaggcatttggcatcgaaaacttgtttgacgtccgccatgtcgccttaaaccatcatattgcccaggcgctgaaagcccatgcggcgatgcataaagacgtcgactacgtcgtcgaagacggtcaggtcgttatcgtcgactcttttacaggccgtttgatgaaaggccgccgctacagcgacggacttcaccaggccattgaagcgaaggaaggccttgagatccaaaatgagagcatgacgctcgcgacgatcaccttccagaactatttccgaatgtatgaaaaattggctggaatgacgggtaccgcaaaaacggaagaagaagaattccgcaacatctacaacatgcaggttgttacgattccgaccaacaagccgattgcccgcgatgaccgaccggatttaatttaccggaccatggaaggaaaatttaaagctgttgcagaggatgtcgcccagcgctatatggtcggacagccggtacttgtcggtacggttgcggttgaaacatctgaattgatatcaaggctccttaaaaataaaggaatcccgcatcaagtgttgaacgcgaaaaaccatgagcgggaagctcagattatcgaagatgccgggcaaaaaggcgcggtcaccatcgcgaccaacatggcgggccgcggaacggacatcaagcttggcgaaggtgtaaaagagcttggcggactggccgtcatcggtacggaacgccatgaatcaaggcggattgacaaccagctgcgcggacgttcaggccgtcagggggaccctggtatcacccaattttatctgtccatggaagatgaattaatgaaacgcttcggcgcagagcggacgatggcgatgcttgaccgcttcggaatggacgattcgacgccgatacagagcaagatggtttcaagagcggtcgaatcttcacagaagcgtgtggaaggcaacaactttgatgcccgtaagcagcttctgcaatacgatgacgtgctccgccagcagcgcgaagtcatctataaacagcgctttgaggtcatcgattccgataacctccgctccatcgtcgaaaatatgattaaagcttcactcgagcgggctgttgcttcatatacgccgaaggaagatctgcctgaagagtggaatcttgacggccttgtggagcttgtaaatgcgaatttccttgatgaaggtggagtggagaaaagcgacattttcggaaaagagcccgaggagattacagagctcatttacgaccgcatcaaaacgaaatacgatgagaaagaagagcggtacggctctgaacaaatgcgcgaatttgagaaagtcatcgttctccgcgaagtggatacgaaatggatggatcacatcgatgcgatggatcagctgcggcaaggaattcatctgcgcgcttatgctcagacaaacccgctccgcgagtatcagatggaaggctttgcaatgtttgaaaacatgatcgcggcgattgaagatgatgtagccaaattcgtcatgaaggctgaaatcgaaaacaaccttgagcgcgaagaggtcattcaaggacagacgacagcccatcagccgaaagaaggcgatgaggaaaaacaagcgaagaaaaaaccggtccgcaaagcggtggatatcggacgcaatgatccttgctactgcggaagcggaaaaaaatataaaaactgctgcggaagaacagaataa

SEQ ID NO: 3609 - DNA, 564 bp, Bacillus licheniformis
ttgatggagttcaacgtcagaggagaaaatattgaggtaacaccagcgttaagagaacacgtcgagaagaagattggaaagcttgagcgttattttgaaaataacgttgatgcgattgttcacgtcaacttaaaattctacaatgatcaggaatcaaaggtggaagtgacaattccaatgacagacctctctctccgtgcggaagttcaccacgaagatatgtacaatgcaatcgatctcgcaacgaacaaactggaacgtcaaatacgcaagcataaaacaaaagttaaccggaaattccgcgaaaaaggttcttcgaagcatgtttttgcagaaggaaacggcatcggaacggccgtgcaggaagacattgaggatgaacagccgcaggttgtccgtcaaaagcgctttaatttaaagccgatggataatgaagaagcgattttacaaatgaatatgcttggacacagcttctttgtattcacgaacgccgaaaccaatctgaccaatgtggtctaccgaagaaacgatggaaaatacggtttgatcgagccgaacgaataa

SEQ ID NO: 3610 - DNA, 378 bp, Bacillus licheniformis
ttgacaagcaccgacgattacatgctcttaacgacttattatcagcttttgtttacgattgaagaggggttttgctatttaatagaagcgaatcaagatttggcgaagacagaaggagagcggatttttaacgatttaatctatgctttttttcagttggattcgtcgcacgctgttttgctgtcgattttggagacaagctgtgccaaatcttcgattcgtttttttgacagagtcttccgtgagtttgacagcttgatctactacaattatccgtctgctgaatttcagcatgacttgatccatcactttttaccgctttatcgggaatggatgaaaacgatccaccaatgcatgaaaccttatgtcatccattaa

SEQ ID NO: 3611 - DNA, 342 bp, Bacillus licheniformis
atggaaaagattgagctgctctacagcgaaacaaaacatatgctcgctcaaataaaaggcgccccggaaagcgacgagctggttcaggcaattgaagattttcttaaaaaacgcgatggcttgatccgcgagatcaagccgcctctttctgagacggaaaagcggcagctgcagcaggtgacggatatggagccattgatcatggccgaactgaaaaggctgcagcaggctgtcaagcaggagctgcttcaggcgaagcagaagcgtgccatgcatcattcctatatcaatccgtacgccaacatgacgattgacggcacatattatgacaagcgcaaatag

SEQ ID NO: 3612 - DNA, 402 bp, Bacillus licheniformis
atggctttaaacaatccgtatgcagcttatcagcaaaattcaatcaacatggcgactcctggagaattgacgcttatgctatttgacggctgccttaaatttatgaagctggcgaaacaggcgattgaacaagaggatatggaaacgaaaaatacgaaccttgtcaaagctcaaaacattatacaggagctcaatatcacccttgatcggaaagtcgaattggccgcttcgatgggggcgatgtacgagtatatccaccgccgcctgattgaagcaaacattaacaatgacaaagatatcgtggcggaagtcgaagggtatgtcaaagatttacgcgatgcctggaagcaggcgcttcaaattgaacggcagggccggttcggatcgggcggactggcataa

SEQ ID NO: 3613 - DNA, 1482 bp, Bacillus licheniformis
atggcgatcagaatatcaggattagcttcaggtatggatatagacgacattgtcagcaaattaatgaagacggagcgcgtcccgcttgataagcttactcaaaagaaacagactttggaatggcagcgcgacagctatcgtgaaatcaatacgaaaattaaagatttgcaggaatccatcaaccttatgctccgtcccagcacgtacggcgcgaaaaaggtgacaagctctgacgagtcggcggttacggcaacaggcaccacgaatgcggcgtcaggcacgatccaagtcaacaagctggcgactgcggccacctataaatcttccagcctttcagggtataccgggagcgatcaaacgctaactttccaagtgacagcacctggagaaacgactgcgaaaaaagttgaaatcagcgtcagcagcacggatacgctggatgacatcgtttccaaagtcaacaaatcaaatttgggcgtaaccgctatgaaagaaaagatttataacggttctgaatatgtagaaacgatcgctttcacatcaaaagcaaccggcgcagggggcagcatacaggcagctgatgatgcgacggcgagctttatgtccaatcagctcggatttgcgcttgatgccgacaacaagctgacagccagccaagccggccaaaacgccgaagttgtcatcaacggattgcagattgagaagacaacgaacaactttaccgttaataatgtgacatatcagttgaagaatacgacaaacagccccgtttcgcttgatgtagcgactgatgttgacgggatttatgaaaagattaaagactttgtcacacagtacaacgaactgatcgatatggtcaacggcaagctcacggaaaagaaataccgcgactatacgccgctgacagaagaacagaaaaaagatatgacggaaaagcaaattgagctgtgggaagaaaaagcgaaaagcggattgttaaggggcgacacgattttaagcggcgccaccaatcaaatgaggacagatttttattcgaatgtctctgtgaacggcgaatcgctgcagctcactcagtttggaattacgacatcaagcgtatacagtcagcgcggtcatttagagatcaacgaagaaaagctgaaagcgaaaattaaagaagaccctgacagtgtggcaaacctctttatggcgggaacgagcagcacggaaaattacaatgaaaaaggcatcatgagacgccttcagacggttttgaccgatacgaagaagcagattgaagataaagccggaaattcagcaatggcaaacaatcaatttacaatcgggaaaaacttgaatacagttgaatctgatatttcgtccatgaataaccgcctgacacaaatcgaaaatcgctattatacaaagttcacggcgatggaaaaagcgattcaaaaaatgaatgaacaatcgacatacttggcgcaattgcttggacaataa

SEQ ID NO: 3614 - DNA, 342 bp, Bacillus licheniformis
ttgtcgatcaatagattgtcatctttagaacccattattgatgcttacaaaacacagatgttgaataaacagtatgaagctgtggaacgcccgcagcagacggacgctgcagaatttacatttgctcagcttgaaaaaaccatacaaggcgcaaacaaccttttggagccgtcgcaggtgcacctacagtttgtgcttcacgaaaaattgggagagtattatgtgaaggtcgtggacaatcggacagaggaagtcgtccgcgagattccgccaaaggagtggctcgatttttatgcggcgatggcggaatttatggggttaattgtcgataaaactacatag

SEQ ID NO: 3615 - DNA, 933 bp, Bacillus licheniformis
atgagaatcaaccacaacattgcagcgcttaacacgctgaaccgtctgtcagcaaacaacggcgcaagccaaaagaacatggagaagctttcttctggtcttcgcatcaaccgtgccggagatgacgcagcaggtcttgcaatctctgaaaaaatgagaggacaaatccgcggtcttgaaatggcttctaagaacgctcaagacggcatctctcttatccaaacagctgaaggtgcattgactgagactcactcaatccttcaacgtgttcgtgaactagttgttcaagctggaaacactggaacacaacaaactgaggatttaacagctatccaagacgagatcaaagcattaaaagacgaaattgacggcatctcagaacgtacggaattcaacggtaaaaaattgttggatggtactttcaaagcaccagcagatccagcaaacccagctgcaggtgaaaaatctttagttttccaaattggagctaacgcaacacaacaaatttctgttaacattgaaaaaatgagcactgatgcattaggagtcaaagatcctgcagatactacgggcagaactctagtaaccaaccaatcagttaaagatatcgatgtaactaaatttgctgataatgcagcaactgcaacagatgtaggttttgatactcaacttaaaatcgttgattcagcgatcaaccaagtatctgcacaacgtgctaaacttggtgcggtacaaaaccgtctagagcacacaatcaacaaccttggtgcttcttctgaaaacttgacagctgctgagtctcgtatccgcgacgttgacatggctaaagaaatgagcgagttcacaaagaacaacattctttctcaagcttctcaagctatgcttgctcaagcgaaccaacagccgcaaaacgttcttcagttgcttcgttaa

SEQ ID NO: 3616 - DNA, 225 bp, Bacillus licheniformis
atgctagtcttatcccgcaagctcaatgaagcgattcaaatcggagacgatatcgaagtgaaaatcatatccgttgacggagatcaggtgaaaatcggcatcgacgcgccgaagcatatcgaaattcaccgcaaggaaatctatttggcgatccaggaagaaaacagccgggccgcttccatctcaaacgatttgcttgcgaaattatcctcacaaaaaaagtga

SEQ ID NO: 3617 - DNA, 432 bp, Bacillus licheniformis
atgatcattaaaacaaagtatcacggagaaacgcaaattcaagaagaccagacaatcgtgtttaaaaacggcctgcctggatttacaggggagaagaagttcgtcatcctgccgctttccgaggattcgccgttcgtcgtccttcagtcggtgcagtcggaagagctggcattcattgtcgccagtccgttcgtctttttcaaagattatggctttgatcttgatgaaacgacggttgaacttcttgaaatcgaatctgccgaagacgttgaagtaatggcgattttaacgatcgaagagccattcgagaaatcaacggccaatttgatggcgccgatagtggtgaaccgcagaaagatgcttgccaagcaagtgattttgcatgactcttcttatctgacaaagcagccgataggaggggaagcatgctag

SEQ ID NO: 3618 - DNA, 567 bp, Bacillus licheniformis
atggagatgcctaggctgatcatgcaaaatatccccggccgcatcggtttaacaacgacgccgccagatttgaaaatggaacagccgcgcgctgacttgaaaatcgagcagccgccggccgaactgaagattacaaccaccccttcaaagctcacgattgaccagacaaaagcttgggaagacttagaaagaaagcatatatttaaaaggattgaagaaggggcgcagcagggctatcaggattggctcgccggaatggcacggaccgctgaagaaggagacgaaatgatgcggatcgaaatcgaaggcaatccgcttgcagaccaggcgaggcggaacagcgagcctgaaccgattcaaatcggcgttcattttacgccgtcatttgacagggtgaaaatcgcatacgaaccggctaaagtgaacattgaagcgacgccgcgcaagcctatcatcgaagcaacgccgaataaaccggttgttaactatacgccgggcagtgtgaaggttgacatgctccaatatccggaggtaaaaatagatgtggaatacccaaaacaaaagtaa

SEQ ID NO: 3619 - DNA, 912 bp, Bacillus licheniformis
atgcgggtaacccaagggatgattgcaaaaaattctttgcgctacatcaattcaagctatggaaaactggataagcttcaatcccagatttcttcgggaaaaaagatcacaaaggcatccgacgatcccgtcgtcgcgatgaaaagcctgaagtacaatacacagctgtcccaggttaaacaatatcaaagcaatgcctcgcaagcttttacatggcttgaaaacacggaaacgaacattacagaaggcattgatatcatggcgaaaatcagggagctgaccgttaaggctcaaaacagtacaaacggcaaggatgaattaaatgcgatcggggtcgaaatcggccaactgaaagaccagctgattcagatcgccaatacgcaggtcaacggccgctacctttttaacggaacgaactctgacgtcgctccgatcacaaaaaacgccgatggtacttacacatacaattttgaaaactatacaagcagctctgacgttctcatcaatgtttcgccaaacgcaaccttaaatgtaaactcaaatccgatttcggctttcggcggacaatcaagcagcggacaaaacgtctttgaaatgattgagtctctcgaaaatgccttaaaagcgggaacaatggaaggaatggaaaacgccctttcagacattgaccagttctccaatcagatgagcaatgagcggtctgatatcggagcgcgctacaaccggctcgaattgatcaatgcgcggctgagcgaacaggaagagacggcgacaaaggtattgtcagacaacgaagatgttgagcttgaggagatcattactgaatttattacacagcaatcggttcacagagctgcacttgccgtaaatgcgaaaatcgttcagccgacactggttgactttttaagataa

SEQ ID NO: 3620 - DNA, 1524 bp, Bacillus licheniformis
atgacaaatccaacttttttagggctggaaatcgcaaaaagaggcttgtccgcgcagcaatcagctctgagcgtgacagcaaacaatatatccaacgccaataccgaagggtattcaagacagcgtgttacatttaaagcatcaaccccttatccgtccgtatcaagagactctgtcggacttgcaggccagatgggtacaggcgttgaaatcggttcggttgaaagggttagggacagctttctggactatcaatacaggacgcagaatacaaaggccggctattacaatgcaaaagtggacgcttttaaccaaatggaagggattatgaatgaactgaacgacaccggactaaacaaagttctgaattcattctggaattccattcaggaattgacgaacaacgcccacgaaccgagcgctgcttctgttgttgcgcaaaaagggcaggcggtcgccgatacatttaacactctgtatgaatcgctgacaaccgttcaatcaaatttaggcgaccagattgatcaaaatgtgatgacgattaactcgcttttgtcccagctgaacagcttgaacgagcaaatcgccaaagtcgagccgaacggctatctcccgaacgatttgtacgataagcgtgatcagctccttgatgaactgtcttcaatggttaatatcaaagtcagctatgcgaaaaccggcggcaatccactcgcaaccgctgaaggcattgtgtcaatagaagtccttgacgtaaacggccagtctctgggcaaggttcttgacgggccaaacttcacgactgaaactgtcaaagtgaattacgacaacgatacaggccttgtgacgggcgtttccctcggcgggacggacatcggcatcgattcgtttactagcaaagggtccctgctcggtttaatcgaatcttacggatatatgtcaaacggtgaagaaaaaggtttgtatcccgaaatgctcgcagatctggatacgatggcgcttgcttttgcgaaagagtttaatgcagtccatcaaagcgggtttacttcatcgggagaaccgggaggcattttctttgaatttaccggaggagaggctgagcctgcaaagggagccgccggcaaaatcaaagtagccgatgagatcatgaattcaaaaggcgataaagtcgccgcatcgctgaatggtgaagcgagcgacaacgccaacgcgacaaatctcgctaatgtcttcaccaagaaaattcaaatcggtgacaaaacgacgaccgttttagactattacgcaggcatcatcggtgaaatgggcgtaaaagctcaggaaacaaacagactggccaaaaatacagaaacgcttgtaaacactgctgaattgaacagacagtctgttagcgccgtatcattagacgaagaaatgtcgaacatgatccaattccagcatgcttataacgcggctgcgagaatgattacgctgcaggacgaagtcctcgataagattattaacggcatgggtgtcgtgggaaggtag

SEQ ID NO: 3621 - DNA, 477 bp, Bacillus licheniformis
gtgaaacgggtgattgaagagctggagcgcttatgcgtgctgcatgaacatctgctgtctctgtcggaacaaaaaacggaggcgctgaagacgaacgaaataaaggcactttcagaaatcgtgacgaaagaacaaaagtatgtgcaggccattgaacaaacggagcagtcccgcattgaagcaactaaaagctgtatcggcagctcggacgcgacgatcagcgcatgtatcagcaaagctgcgggcggcgagaaaaaggtgctggaacagctgtatgccaagctctcacagctcgtcacccgtttgaaggatgtgaacgatttgaacaagcagctgacttttcagtcgcttcaatttatctcgcttacatttgatatgctccttccgaatgaaggcggttcgaattacggaaaagagcagcagccaaaccagacaggcggggtgaaacggctttctttattcgattcaaaagcttag

SEQ ID NO: 3622 - DNA, 267 bp, Bacillus licheniformis
atgaagatcaaccaatatggaacacaacctgttaatccttatcataaatcatttgaaaaacaaacagcttcttcacagggagcagcccagccggaagacaaagttgagatttccgcgaaagcaaaggagctgcaaaaaggccctgatttaatgaaggagcgtcaggagaaaattgcccagctgaaagcagccgtggagaatggaacgtacaaagttgacggcaaaggcatagctgaaaaaatggtcaatttttataaacagcaataa

SEQ ID NO: 3623 - DNA, 420 bp, Bacillus licheniformis
atgagtcaattggcgaattgtccaagatgtaacgcattgtttatgaaaagcagttttcaaaccgtttgcgcttcatgcttgaaagaagaagagcgcgcgtatgaaattgtttataaatttctgaaaaaacaggaaaaccggcagtccacgatgtttcagatcgtagaaaaaacaggtgtcgaagaagagttaatattgaagtttattagacagaaacgcattcaaatctctaatttcccgaatctcggctatccgtgcgaaaggtgcggcacgcttattcgggaaggacgttattgcatgtcatgcgagcaggatttggcatcgcaaatgagtcaattagaccagctggagcagcttgaaagagagagaaataatagttctaaaggcacgtactatacctttaagcccaaaaatgactga

SEQ ID NO: 3624 - DNA, 735 bp, Bacillus licheniformis
atgaaaacccgctttgcgcaagcaatcgaagagggagggaataaactgaattgtttaatttgtgcagcgcctcttttacattctctctcatggcattcttttttctttttacgatcagaagagaaaatatgcagggaatgtaaagagaactttatcgagatcaaaggaaccgtatgccctaagtgcggacggccacaggggagcgaagagctgtgcggtgactgcgcaaaatgggaggccaatccgttaacccgctctcttttgaggcaaaaccgctctgtttatctctacaatactttcatgaaagaagtccttgcccgttttaagttcagaggtgatgctgaactggtcttcgcttttgccccttcatttatcagcgcttttcaacaatacttccgccgcagcccgtctgttttagttccgatacctctcagtgaagaacgtaaagcggagaggggatttaatcaggcggagcgtcttgcttccttattacaaatacccgttattcatcccttgatcagaatcgaaaatgaaaaacaatccaaaaaaagcaggaaagagcgaattaagccaaaaaccgtttttagaaccgaaaaggggtcagtaaagaatctggatgtcatattgattgacgacttgtatacgacaggagcgacccttcatcatgccgctgattgcctgatgacatccggagaagcaaaatctgtatcatcatatacattaattagaagctaa

SEQ ID NO: 3625 - DNA, 285 bp, Bacillus licheniformis
atgctagtcaacgccaaagaagctgttttggaagagttgtttgatcagtatatcgatcagctgcacatgagctgtacgtgcagcaggtgcagggaggatgtgctcgccttggctttaaatgcagtaaaaccgcaatatgtaacagatcagtcgaagctggcttacataaaagcagagctcgttgacaaacaaaagaatacatcaatgcttgtcaccttggctgaagctgccagaaaggtgaatgaaaacccgctttgcgcaagcaatcgaagagggagggaataa

SEQ ID NO: 3626 - DNA, 1401 bp, Bacillus licheniformis
ttggaggtgattcacatcgaacaaccggcattctatacccgtgaattgcggtcatgtttggagcagcgccaccttctgaaaagcgaacttccttttcgtgaatccgtcgttgattggcatatccaagaaggcttgataaaaacggaggaaggtattaaaaaaacgaagaaaggctttatttgtttgaggtgcggccagcacgaacgctcatttttcgcccggtatccttgctatcggtgcagtaaatgctgcgtgtactgccgatcctgcgtcatgatgggcagggtgagcgattgtacgcctctgttgacttggcacatgcatgtcagccataaatgggcgcctgttcatacggagtggaaaggcgcgctttcagcaggtcaggagaaagcggccaaatccattatcaatgctatacgaagaaaagaagaactgttggtctgggcggtttgcgggtcggggaaaacagaacttctctttcaagggatcgaattcgcgctgaacaacggcttgacagtatgtatcgctactccgagaaccgatgtcgtactcgagcttgctccgcggtttcgccaagcctttccaggggtggaaattgccgctttgtacggaggaagctcagacgttgggaatctctcgccgcttatcatttcaactacccaccagctgctccgctataaagaagcatttgacgtgatcatcatagatgaggtggatgcttttccgtattctattgataacacgctgcaatacgctgttaaaaaatcggcaaaacggcaaagcgctcacatctatttaactgccacgccttcagcagatatgaaaaaaagggctgagagcggaaagctggacaccgtccgtattcccgcgagattccaccgcagccccttgcctgaacctacattgatttggtgcggaaattggaaaaagagtttgaaacgaagaaaagttccttttcgcctcaaaaaatggctttttaagcaccaagaactgcagcaaccggtttttttattcgttccctctgtccctgttcttaaatctgtggtcagtgtgctgaaaaaggaaacatttcgcgctgaaggagtttatgccgatgaccctgacagaaatgaaaaagtgaaccggtttagggaaagtaagcttgaggtgctcgtgacaacaacgattttggaaagaggagtgaccgtcaaaaaagcgcaggttggagtattgggggcagagtcggcggtttttaccgaaagcgccctcgtccaaatggcgggaagagccggcaggcatcccgagcacacagatggagacgtctgtttctttcattacggcaggacaaagtcgatgaatgcggcacgacgtcatattcaaaacatgaataaaatgtctaaaaaggaaatgttgattgactag

SEQ ID NO: 3627 - DNA, 843 bp, Bacillus licheniformis
atgaaaacagcagtagtaacagacagtacggcatatatacctaaagacctgcgtgaccgctacaatattcatatgatacctctcaatgtgatctttggagagacttcatacagggaagagatcgatatgagctggaaggactattacaaagaagtaaaagcccacgaaaatctcccgacgacttcccagcccgcctacggcgagttgatttctctctatgaaaaactcggtgaaacatatgacgcggtcatcagcatccacctttccagcggcatcagcggaacattcaacagcgctgtatcagcaagcggtatgcttgaaggaattaaagtgtatccgtttgattcggaaatcagctgcatggctcagggtttttatgcgatcgaggcggctgagatggcggaaaaaggagcggctcctgaggaaatcatccgccacttggatcatatgaaaacctcgatgagggcttattttatggttgacgacctttcacatttgcaaaggggaggacgtctgagcggcgcccaggcttttgtcggaagccttttaaaagtaaagccgatcttgcattttgagaacaagctgatcgttccctacgagaaaatccggacgagaaaaaaagcgatgaaccgtttatttgagctttttggcgaagatgccgagaaaggaaagccgctgagagcggttgtgattcatgccaaccgtgaagaagaagccgatcaaataatcgaagaattgtcgaagcaatatgcacatgtcgaattttataaaagctatttcgggcctgtgatcggcactcaccttggtgaaggagcgatgggtatcgcctggtatacagtataa

SEQ ID NO: 3628 - DNA, 690 bp, Bacillus licheniformis
gtgactaaagtaaatattgtaattattgacgatcatcagttattccgtgaaggtgtcaaacggattttggatttcgaacctacctttgaggtagtggccgaaggagacgacggagatgaagcggctcgcattgtcgagcactaccatcctgatgttgttatcatggatattaatatgccgaatgtgaacggagtagaagcgacaaaacaactggtcgacttgtatccggaatcaaaggttattattttatccatccatgatgacgaaaactatgttacacatgcattaaaaacaggagcccggggctatctgctgaaagaaatggatgccgatacgctgatcgaagccgtgaaagtagtagctgaaggcggatcttatctgcatcctaaggttacacacaatcttgtgaatgaattccgccgtcttgcaacaagcggtgtatcatctcacgctcagcatgaggtgtatccggaaatccggagacctcttcacattctcacaagaagggaatgcgaggtactgcagatgctggcggatggaaaaagcaaccgcggaatcggcgaatcattatttatcagtgaaaaaacggttaaaaaccatgtcagcaacatccttcaaaaaatgaatgtaaacgacagaacgcaggctgttgttgtagccattaaaaacggctgggtagaaatgagataa

SEQ ID NO: 3629 - DNA, 1158 bp, Bacillus licheniformis
gtgagcgtttccaaaatggactccaaagttttagattcaatcattatgaagatgttaaaaacggttgacgggagcaaggatgaagtctttcaaatcggagagcagtcccgccagcaatacgaaggcttggtagaagagctgaaacagattaaacagcaggtcaacgaagtcatcgatcttggagacaggctggaagtgcatgcccgccatgcgcggaaccgcttgtcagaggtcagcagaaactttcataaattcagtgaagaagagattcgcgaagcttatgaaaaagcccacaaactgcaggttgaactgacaatgatccagcagcgggaaaagcagctgagagagaagcgtgatgatctggaacggcgccttttggggcttcaggaaatcatcgagcgttcagaagggcttgtcagtcagattaccgtcgtcttaaactacttaaatcaggatctgcgccaggtcggcgttctccttgaagatgcgcaggccaagcaggatttcggactgcggattatcgaagcccaggaggaagaaagaaaaagggtctcaagggaaattcacgacggtcctgcgcaaatgctggccaacgttatgatgagatctgaactgatcgaacgcatcttcagagacaaaggaacagaagaaggctttcaggaaattaaaaacctccggcaaaacgtcagaaatgctctttatgaagtcagaagaatcatttatgatttaaggccgatggctttagacgatttgggattgataccgacgctcagaaaatacttgaacacgatcgaagattatcatggaaaagcaaagattcatttccaatgcatcggagaatccgaagaaagaagaatagcaccgcggtttgaggttgcactattccggcttgcacaggaagcggtgacaaacgccttaaaacactccgaatcaactgaaattcatgttaaagtagaagtgacaaaagattttgtgacgctgattatcaaagacaatggaaacggctttgacttaaaagaagtaaaaggcaagaagaacaaatctttcggtctgctaggtatgaaagaaagagtcgatttgctcgaaggctcaatgacaatcgattcgaaaataggtcttgggacatttatattgattaaagttccactgtctttgtaa

SEQ ID NO: 3630 - DNA, 639 bp, Bacillus licheniformis
atgctgcaaagctatctgactgttgcaggtgaagggacccatgaaatcgtgattgaaaaatcccggtttatatgccacttgagccgcgtcagtactgaagaagaagcacagaactttatcaaccacataaaaaagcagcattggaatgcgacgcataattgctcggcttacgtcataggagaaaatgatcaaattcaaaaagcgaatgacgacggagaaccgagcgggacagcgggcgtaccgatgcttgaagttttgaagaaacgcaaccttaaagatacatgcgccgttgtgacgagatatttcggcggcattaaactcggcgcaggaggattgataagggcttacggaaaatccgtgtcagaggggctgaaccatgtcggcgttgtcgaactaaagctgatgcgggtcatgcacaccactgtgaactatacatggatcggcaagcttgaaaacgagcttcgcgagtccccttatcaaataaaagacgttcactatgcagacgatgtcgaatttgaaacgtatgtcaaggaaagcgaaaaacaggcatttacggaatggataaccgaattaacaaatggcaagagtgagaatagagaaggcattcaagtctatttggaagaagcttttaataattaa

SEQ ID NO: 3631 - DNA, 1077 bp, Bacillus licheniformis
atggctgagcgtattaaagtgaaagtgcggaaaaaaaagaataaaaagagaaggctgattaaacggtttatagtccttatgctgctcgcacttctcgcagtcggcggagtgggcatatataaaattataaacacgatttccgcggctgacggcacttatgatgagcttgaacgcggagagaagtcgaagctcagggacgatgttgttgatattcaaaaaaagccgttctcgattctttttatgggggttgaagattattcgacaaacggcgagcacggccggacggattccctgattgtcgtgacgctcgatcctaaaaagaagtcgatgaaaatgctgagcattccgcgggacacaagggttcatttggccagcgacacaaccggcacaaaaacaaaaattaatgcggcctatgcaaaaggcggcaaggatgaaacaattgagacggttgaggatttcctcggaatcccgatcgactactatgcaacggtcgattttgacgggtttaaagatgtcatcgatgaaatcggcggaatcgatgtcgatgtgccgtttgactttagcgaaaaaagcgatgtctccaaatcgaagagaatctattttaaaaaaggaaatatgcatctaaatggtgaggaagctcttgcctacgcaaggatgagaaaacaggataagcgtggagacttcgggagaaacgacagacagaagcaaattttaaaagccgctcttgatcaaatctcaaaaccgcaaaacctcgctaaaattgatacaattgcccaaaaagcaagcaaaaacattcagacgaattttagaatcacgcaggcgctggcgcttcaacaaatttacagcggctttgccggcgatgatatcaaaacattaaacatcacaggacaggatcttacgattgcaaatgtttactactttgagcctgaccagcaaaacctggaaaacgtgcaaaatgaattgacccatcatttgtacccggactcagctgccgattcgagcggaacatcgtctgaatcttccgcaaccgctgacggtgcggacagctcagctgaatcgtctgctgcttcttattga

SEQ ID NO: 3632 - DNA, 375 bp, Bacillus licheniformis
atggatgatcattaccttggacaaatcgaacaaatagtgaaagcattgtataaatcctggtcttcagattcaagttcaaaatggagtaaggataaccctgccaagggacaatgcggcgtaaccgcgctagtcgtaaatgatatattaggtggagaaataaagaaaacaaagctgcctgaagggtggcatttttataattttgtcaatggtaaaagatatgatttaacggtttctcaattcaaagaagacatcctgtatatggatattccctcaaatagagacgaggcattctcagataccagcgaaaaacagtataattatttaaagcatagtatgatcaatcatttgccttgttcaaatagtaagttacgctag

SEQ ID NO: 3633 - DNA, 1065 bp, Bacillus licheniformis
atgtcttatgaacgcactgtaattgcgttttttgtctctctcattactgttttaattattactccgcttgtcaaacgtctagcaatcaaatccggggtcgtggatcagccggataaacgaaagatacatgataaagtaatgccgagaatgggcggtttagccatttttataggagtattgaccggttcgtttgccggcggcctttatgaaaacagaataacagcaattacactcggtgcttttatgatcgtaattttaggcattgtagatgacaaatacaatttaagcgcgagaattaaatttatcgtacaagtattagtagcctgcatcatcgtcagtacaggcttgaaaatggaatttttatcgattccgttttgggatcttcgctttgatttggggtggctcgcatacccgttgacgattttgtggatcgtcgggatcaccaatgccatcaatttaatcgacggattggacggactggctgcgggtatatccgtcatcggcctctcgacgattgccgtcatggcgttttctgccgataaaatcttgatcttctctttgtcgctggtagtcatcggaagcacggtcggctttctgttctacaacttccacccggcgaaaatttttatgggagacacgggctcgctgtttttgggctatgtgatctcggttctgtcgctgctggggctgtataaaagcgtgactctgttcagcgtcgtcatcccgattattatattaggagtgccgatatttgacacgacatttgcgatcatcaggcggattttaaacaagcagccgatttcggctcccgataaatcgcatattcaccacaggctgatggccttcggcctgtcccatcggaaagccgttatcgtcatttatttaatcggcgtcgtcttcagcctgagcgccattcttttaaaaaccgcaaccctatgggtgtccatcttcatcatcttcggcttaatactgttcatgcagatcatcgcagaggtgacaggccttgtaaatgagcagtacaagccttttacgaagttttacaggcggatggtgaagaggaattaa

SEQ ID NO: 3634 - DNA, 1182 bp, Bacillus licheniformis
gtgaaagcagatcaattcatacacgtcatagtagcgacaggtgaatgggggcaggatcagctaagatacagaaggcaccgccttgctgagtttttagcaggccgcaaggagacgaaggaagtcatttgggtttgtccgtctgaaaatccttcccgtgagacttttacattgcttgacaacggaatcaagcaatttgcagtcaaagattttttgaaaaagaaaatattcaggtttgcccgctacaaagatgttttctatcaaagcaagctgaagccgctgcttgaccggctgaaagaagacgttcagggagaaaaggtgtgcttatggtacaccttccccggctttccgctgctgtcgtcgctttatcaatgggatcaggtcatctatgactgcagcgacctgtgggcggccccgatcagcggtagccaaagccttgtctcaggattcaggcaaaaggtcatttttgaagctgaaggcagaatcatcaaagctgctgatacgattttttgcacttccgaatacttgcaacaaaatgtagcagaccggcttcaaggagagacaaagccggtttttacaatcgaaaacggtgtggagtacagcttgtttgcagaaaatatgcaaaaagcggatgtattgaagggaagggaaggaaccgtcctcggctttatcggaggaatcaagccgaagctcgattttaagctcgtcaaagaagctgccagaacaaaaaaagagtggacatttttatttgtcggtcctgacgggacaaacggagacgaagattttaaagcgcttcttgaagaagataatgtcatctggacgggccccgctgcgccgtcagaagtaccagcttatatgaatgtagtggatatcggtatcatgccgtataaaccgtcgccatataacaatgcggtatttcctttaaagctgtttgaatttttggctgccggaaagcctgtcgcaggtatgaacctcccttcaacggaaaaggttgaacaggaacacgtttaccgtcatttaacaggaaacgaccccgctgaatttacagcggtttgtgaagagctggagcttgcgcatgatgatgtttcccatgtggaactgcgcagaaagatcgcacgtgaaagagactggcatcatctatttttaatgatgcttgataaattgaacttgaataaggatgcataa

SEQ ID NO: 3635 - DNA, 759 bp, Bacillus licheniformis
atgacgaggcaaaaacctttaatctctgtcattacgccttcctataacgcggaggaatttatcgaaaaaaccattaagtccgtcttaaatcagacgttttccgactgggaaatgatcattgccgatgattgctcaacagatgggacaagagacattttgaagcgctatgaagaagatgatgagcggatccatgccatttttctgaaagagaatcaaggtgctgcagcggcgcgaaatgcggcgctcagcaaagccgaagggcgctatgtcgcctttttggacagcgatgatgtttggaaagcagaaaagctggataagcagctcgccttcatgagaaagcatcagcatgctttctcatttacggcatacgagctgatcagccaagacggcgaaccgcttcataaaaccattcatgcacccgtaagccttacatatgatgatgtattaaaaaatacgatcatcggctgcttgacggtgatgattgacagagaacaaacgggtgatatccggatgccgaatattagaacccgccaggatttggcgacatggctgtccgtattaaagcgggggttcaaggcatatggactgaacgaacccctcgcggaataccgcatcgttgaaacatcgatctccagaaacaagtggaaggcggcgcgaaaaacctggtacgtatacagggaaatcgaacgacttcacttgatgaaagcgacatggtgctttttccattacgctaagaacgcagtaatgaaaagattataa

SEQ ID NO: 3636 - DNA, 675 bp, Bacillus licheniformis
atgaatttaatcaaacgtattgctggtagagtgaaaaagtttattgtggcgattattgcgcttcctcttattcttggtcttgtcggctattttatgccgaagggaagcgttgctccatctaattacacggctactgtaacgatatcaaccgggaactatggagaagcgaagtacaacaatgcaaagcaagtgccgctgctgttgaaaaacgaagcttttttaaaggacattttcccggatatgccggaagaggatctggcgcaattgaaagacgatctggcgattgaaatcagaacggattcacttttcaacttaagctacacagggcctgataaacaggaaacattggatactttaggaaaaattaaagatgcctatatgaaaggcgataaggcgctgttctcaaaaagagaagaagtcattgaaaagaatattaaggcgcttgaagacgaaacagtcagcgctgattccaaagttgacaaacagcggtttttgtatgagcttgaaacaagcaagcttgatatgaaggctgctgaagaaattgagccgttgatcgtgcttgataaccaggctgccggcatgtcgcctaagaaaagagcggtgctgggcgtactgatcggtttagcgctgtcattttttatcattgtcattccggaagttttcagagaacgttaa

SEQ ID NO: 3637 - DNA, 1455 bp, Bacillus licheniformis
atgagtctcaaacgttccgcggtcaatgttctggtttggctcgccgcattgaccgcagggttagcattcgttgtattggcccagtccaatgcaaaaaaaatcttgctggcgtgtctaattttgattgcgctggctgtgatcgttgtgctccggaagtatttgtcgtccgagcaattgctgatgcccgtattatatctgctcatcgctgcaacttttgccaacaatgctttttttgcgattaaattgggctttttcagcctgtttccatatcgaatacttctgattctggcaggattcttattcatagcggaaatgttgaaaggcagccagcaccttgaaaagtggaagcaggtgcatgtcaaaggcattctgatgtttttcgcgttttggttctgctatggactgatttcgctgctatgggtcaagtctgccactgatggcataaaatatctgttcctattggcaatgggaatgtttttggtttttctggttgtcatgttttttcaaaaaatggatcgtattctcgcgttttattacatatggcttgtcatgaccgtatttttaatggtcatcgggttttacaatcactttacgttaaaccacctgccgagctcgaccctttataacgggccgcactataaacagcactatccgacatccgtttttttcaaccagaatgactttgcgacatttctgtccatcagctttttcttttatttatcttttttcaaaaacattaaaaacagctacttaaaaatagcggggctgctccttgcgttctgttcggcatacttgattttcctgactggatcaagagccagcatcctgggggtcatagccggccttgccgtttatgtgttcattttgctgccgaaggtgcttaaaaaatgggcgctcatcgccgcagctgcaggatgtatcgcttttgtcacactgtttgcaggaaagattaccggagctttttatacatactttttggctccgcaaaccgcacacgatttcagcgagccgctgccatccaatgtcgccagggcgaatttgttgaaaaacgccgggcattatgtgctggatacttacggatttggcgtcggcgccggcaatgtgccatattatttggagcatcatgcactgttcgatacggaccgggtcgtggaggttcataactggctcgttgagatcatgacgaattttggagtggtgatgatgctcggttatttaacgatgtacatttatttaataaccgtgctttacagatattataaaagatcgcttggaagacggccaaagcttcttattgaaggtttgacagccgcgctcgtcgccttccttgtgtcaagcatcagtccgagttccgtctcgaatttatatttccattgggtgttcctcgcgcttgtgattgcgacggttaatacctttagagtctgcggaacggatgaaaccgaacagtataggtga

SEQ ID NO: 3638 - DNA, 930 bp, Bacillus licheniformis
atggaaaaagtactagtgacaggcggatgcggatttatcggctcgcatattgctgaacagcttctaaaagaaaattaccgggtttcaattcttgataatttaactacgggacaccgctccaacattgacggtctcccaattgacttttatgagcaggatatcacgaagccggaagtcatcgacgtcatcaaaagcattgatcccgattatattgttcatttagctgcacaagtaagcgtagcggagtctgtcagcgattttttaaatgatgaaaacatcaatatcagaggatcgctccatatcattaaagcagctggtgaatgcaatgtgaaaaagatcgtctttgcatcatcagcggctgtttatggaaatccggattacctgcctgtcgacacccgtcaccaaacaaacccaggctcaccctacgggctgacgaagcttacagtggagaactatttaaaactggcttatgatctatatggaaccgagtattgcattttgcggtacagcaacgtgtacgggccgcgccaggatgcaaaaggagagggcggcgttgtatcgattttctccgatttgctgaccagcggcaaggctccggtaatttttggagacggagaacaatcacgcgattttatttatgtcggtgatgtagcttgtgccaacgtaaaggcgctaaaagctcaatcaaacgtttgtttaaatgtttcaaacggcttttccatcacggtcaatgagctgtttacagagatgaaaaaagcgacgaactctgagctttctccgatttatcaagatgaacggccgggggatatccgccacagcacactgtgtaatgaagaaacaaagaaaatcttaaactgggaaccaaaaatgccgcttgctgaaggactggaaaagaccatttcatattataaaaaagaaatgaatacgtaa

SEQ ID NO: 3639 - DNA, 1335 bp, Bacillus licheniformis
atgttgaaaagaatcgctgtcattggaacgggatatgtcgggctggtgtctggaacttgttttgccgaagtgggaaactcggttgtctgctgcgatattgatgctgaaaaaataagaggactctcagccggagtgatgccgatttatgaaaacggcctaaaagaacttgtggataaaaacgtaaacgaaaatcgcttatttttctctactgatattccaaaagcgattgaagaagctgagattatttatattgcagtcggtacaccgatgtcggaaacaggggaagcggatctgacatttgttaaatccgttgccgaaatgatcgggaagcacctgaacggctataaagtcatcgtcaacaaaagcactgtccctgttggaacaggaaagctcgtacaagccattatagaacgcaattcaaaaggggaattccctttcgacgtcgtgtcgaatccggaattccttcgtgaaggaacagctatttacgatacgatgaatatggaaagagcagtcatcggcgcgacaagcgaaaaggctgctgccattattgaagagcttcataagccatttcaaacgaaaatcgtcaagtctaaccttgaaagtgcagaaatgattaaatacgctgcaaatgcatttttggctacaaagatctcgttcattaatgatatcgcgaatatttgcgaaagggtcggagctgatgtatccaaggtgtctgaaggcgtcggactcgacagcagaatcggcagtaaatttttaaaagccggaatcggctttggcggctcttgcttccctaaagacacgatggctttattgcaaatcgcgaagtcagtcggttatccttttaaattgattgaagctgtcatcgagacgaatcaaaagcagcgcgcccacattgtgcaaaagctccttgatgtgttcggcgatttaaacggcatgaccatttcggttcttgggctggcattcaagccgaatactaacgatatgcgctcggcgccgtctctggatgtcattccgatgctgagaagcctcggtgctaaagtcaaagcgtttgatccgattgctgtacctgaagcagaaaagcttctcggcgatcaagccgtttacagcgaagatctgtatgagacgattcaggatacggatgcgtgcgtcatattgacggagtggccggaagtacagaacatggatattgccaaacttaagtctgctttgaaaaaccccgtcttaatcgatggaagaaatatatttgaaattgaacaaatgagaaacgaaggcatgatctaccattcaatcggacggccggaagtacagggagaaggaatcctgaccaacgtataa

SEQ ID NO: 3640 - DNA, 1179 bp, Bacillus licheniformis
ttgaaggttctttggattaccagcgtttatccaagcagtcaaaggccgggagaaggcgtttttcatgaaacacaggttcaggcgctgcagatgcagggcgttgatgtgacggtcatatgtccattgcctgtgaatcctgctcctctcaggctgctgaaaaaaaaataccgtcaagtgcgaacagtcccggaatatgaagaaagaaaaggcatcccggtttacaggccgccgtatacggctttgcctggacagctaaaatgggctcagccgcatcgccggatcgcaaagtctgtattgaggacgatcgagaagcacgggcttgcgccggatcttatccatgcccatttcgcgatgccatccgggggtgccgctgccgttgtttcacagaagctgaaggttccttatgttctgactttgcacggaagcgatgtcaatatttatccccattacagcaaaggcgcttttcgagcatttgaaacagctgtgcattccgcagcaaaagtattggctgtcagcgaagcgctgaaagccaaaacgaaagaaatgaccggtgctgaaagctcggtgcttcctattggagtcaacctggaccggtttcaaaagccctccgcttcaacacttgaattgagggagaaactcggcctgccgcaagacaaaaagttgctgacgttcgtcggccgcttggtgaagggaaagggagtagccgagctggcagaagcggtcaggcagcttgatgacagctacagagctgtattcatcggcgacggaccggagaagcagaacatccgtcaaatcgccggtgaaaaagcagtattgacggggcaggtcgcaaaccatgagatatcagaatatctggctgcatcagatctgtttgtgctcccttcgtattctgaagggatgccgactgttgtcattgaagcgctcgctctcaaggttccggtgctttgtacggcggtcgggggggttccgtctttattcggaaagcatgaacaccttctgatcaagccgcactcggcttccagcataacagaagctgtcaagggatatttggaaggcggcaattggcaagaagccatcgctgaagagctgtatcaaacggtgcacgaggattatgacgcctttaaaaatgccggaaagctgctggatgtgtatggggatgttgtcaagaacaaaaattaa

SEQ ID NO: 3641 - DNA, 1440 bp, Bacillus licheniformis
atgtctaccattacgaaacaaatattaagcggtgcaaaatggacaagtgtttcaactttgatcgtcacggtcattcaaattatacagtttgcactgctcggcaatatcatgacaattgccgaattcggtttggtcggaatgctgaccaccgtaacgattttcacacaaattgtactcgatatgggattcggggccgctttaattcaaaaggagaacatcagtgaacgccaattatcgaccttgtattggctgaatatcctaacgggcatccttttgtttatcggcctctttttcctgagtccgttcatcgcagacttttatcagcgggacgaacttgtttttctagtgcggattttggccgtcatgtttttaatcgccccggtcggccagcagtatcaatatatgctgcaaaaagatctgaagtttaatgtgctgagcaaaatagaagcgggagtcaccgttttgtcttttgtgctcctgctcgttttggtttttctgatggatccgattgtggcctatgcattgtcacaagtttttcttaattcggttaaaggcatcatgttttttgctgtatatttaaaaaaatggcgtccttctttcgtctttgcattgggggaagtgaaagaatttttctcgttcggcgcgtttcagcttgcttcaaggcttgtaaacaggcttggcgccaatatcgacatgattttaatcgggcggtttctcggtgcggaagcattgggaatctataacctggcgtatcagattattacgattcccgtattaaaaatcaatccgatcgtaacaagggtagcgtttcctgtcttctcaaagaatcaaggggacaaccaaacgctgcgcgaaggctttttaaatatgacaaagcttctcgcgctgatttcattcccgctcctgatcggactgacgactgtttcagatttatttgttgaagtcgtcttcggagaaaaatggctgcaggccgtaccggttctgaacatcctcgcgattgtcgggctgctcagggttctgatgaatccgaacggatcggttttgctggcgaaggggcgagcagacctggcattttattgggacagcgggatcatgctcctttatgggctgtctctttacgcggcggtattaacgaatgatttgacgatcaccgcctggacatatgcagcgatcagcctggtcaatttctttatcggcagatggctgctcaaatatgtcatccagctgaagctgggcgaatatttcagaaccgttggaaaaccgctggccttgacgctgctcatggcattgctggctcttgtcttgagcgtcggcagcagacatctgcttcacggcgccatgcttcagctggcagtttccgtcgggatcagcgggattttttacggttttctggtcggcaaattttatcggcgggctatgagggcccaattaggaagatga

SEQ ID NO: 3642 - DNA, 660 bp, Bacillus licheniformis
gtgagtatcgacaaaagtttaagaatgtacaatgaatattcaagccagcaaacttattcctgtgctctatctaaaaaagcagtacgttatttatatatgaaacggataatggatatcgtcctttccttgattgggctcgctcttacactgccgtttattctgctgttttgtatattaatctgtatcgaaacaccgggttctccgttataccggcaggaacgcgtcggaaaagacgggaagcatttcaaggtgatcaagctgcgttctatgagaattgacgcagaaaaatccggtgcgaaatgggctcagaaggatgatccgcgcatcactgcagtcgggtcttttataagaagaacaagaatcgatgaacttccgcagttgatcaatgtgctggccggagacatgagcattgtggggccaaggcctgaaagaccgatgtttaccgctcagtttcaccacgaaattccgggatttaaaaaccgcttaatcgttaagccgggtttaacgggacttgcgcaggtgaacggaggctatgatatcagtccgagagaaaaattggtgcacgatctgtattacattcggaatttaacgtttcttctcgatttgaaggttatgctgaaaacgattaaagtagtattgactggcgaaggagccagataa

SEQ ID NO: 3643 - DNA, 1455 bp, Bacillus licheniformis
ttgttagggttctttttgtttgtgcctaatgtatttgcggccaactctgtcacaagattagacggtgcaaaccgatatgaggttgcggtgaacgtttccaagcaggggtggacaagtgcaagcactgtgattgttgcaaatggaaaggcatatgcagacgtcctttcagcgactccatttgcctatcgaaacaacgcgcctgttctattaacggaagcgtctaaactgccaacggccactaaaaaccgaatcagtcaattaaaacctagcaaagtgatcgtaatcggcggaaccgtcagcgttcaaaacggtgtcgtaagcgagatcaaaaagcttggtgtgtcatctgtcgaacgcatcggcggagcgaatcgctacgaggttgcggcgaatattgcgaataagctgccgagcaattcgaaagctgtcatcgcaaacgggacggcctatgctgacagccttgcgatcggcgcatatgccgcgagaaacggcatcccgattcttttaacatcgtcgaattccataccgacagcgacaaaaaatgcgatgaagagcaaaggaacaacatcgaccattgtcgtaggcggtgaagtcagcatctccagcagcgtttacaaacagcttgcttctccgacgcggatcggcggcagcaaccgctatgaagtcgcggccaatgtcgtcaagaaatattattcttctgccaagaatgcaatcatcagcaacggctatgcgtatgccgacggattaacaggatctgttctggcggctaagcaaaaccgtccgatgatgttcacgaatgcatcatctttgccgacaccgacaagagaagtgatcggttccaaaaacatgacgacgtttactgtgcttggcggaacggtttctcttcaatccaatgtcgtgtcacagctgaagaatccgatcgtcggcaaaaaaatcttcattgatgcagggcacggaggtacagacagcggtgccgtcggcaacggtttatatgagaaaagcgtgaaccttgatgttgcaaaattaattaatacgaaactatcaaacggcggtgctctgccaattatggcgagaacgaacgacacttacctgacgctcgcacagcgcgtgtcaaaagcgcagtcaaatcatgcggatttgtttgtcagcatccatgcaaactcggcaacgccagctgcttccggaacagaaacctactattatacaacatatgaatctgccaacagcaaacggctggcaaccgagattcaaaaccgtctctatgttgcattgaatacaaaaaaccgcggtgtaaagatcggcaacttccatgtcatcagggaatcaaaaatgccaagctgccttgttgaacttgcgtttatcagcaatgtaagcgatgcgacaaaactcaaaagctcgacttacaaagaaaaaggcgctaaagcgatttacgacggaatcgttgcttactattaa

SEQ ID NO: 3644 - DNA, 2145 bp, Bacillus licheniformis
ttgaaaaagatgaagcttctgcttctgtcgtcagtaactgccgcagctctgatgtttacacaatctgcccaggctgccgacaaaaccatttcggtaaagttaagcaattatttgggcaataaatcaagcgttgatgtcgacattaccggcgcatacgaaatcccgggctcgggaatcgccgcgacagagcggtacggcggggcgacccgcttcgatgtggcaaacaatgtcgcatctgccggatggacgaacccgagcactgtcgtggttgtcaatcgggacgcttttgcggacgcgctttctgcaactccgcttgcaaagaagtacgatgcgccgattctattaacggatgcgggtacgctgacggcgaaaaccgaaactcaaattgccaagatgaagcctgataatatcttaattatcgggggaacaacgagcgtttccaaaaatgttgaaaacacgctgaaaaagtatggggcaattgaccgcatcggcggcgccaaccgctatgatgtgtccaaaaacatcgcgagccggatggggtcctacagccaagcgattgttgccaccggcttagtcttttccgacgctctgtctatcgcgccttatgcggcaatgaacggttatccgatactgctctcagggaataatacaatccgaagcgattacaatattccgagcaaggttacgatcgtcggcggtccgttgagtgtcagcacaggcgttgaaaacacattaaagaaaaaagcggctgttacccgcatcggcggagcgaacagatacgaagtgtcagcgaacattgtcaacacgcttaacatgaacgcatcaaaggttttcatgtctaatggaacgacttttgcggatgcgctggccggttccgtccttgctgccaaacaaaagcatcctttgctgcttgtccaagcgggcagcctgccgactcctgttgcagatgtagtcgcgaaaaaaggaacacagtcttttgctttgcttggggggaccacctcgatcacggattcattgaaaaatagcctggcagatatgtttaccggagacggatactctgttaacgtgtcgagcggaaagcttgtgctctataaaaataatagagccgtcaaaacgcttggaacgtcatttacggcatcacctaaaaaatattcgacgtcaaattccatcagcatcaacggaaggccttatttaggcaagatgaagtttacgattgaatcaagcaaatatgttcggccgataaacgaaaacattccgttcgaagattatttaaaaggtgttgtgccgcacgaaatgccggcaagctggcagacggaagcgttaaaagcccaagcggtggcggcgagaacttattcggtcggttccgcaggaaaagtagtggccgatacgcaggcgtttcaagtatacggaggatacgactggaattcgaagacatccagcgttgtaaatgccacaaaaggacaagttttaaaatataacggcaatttgatttcagccgtttactcgtcaagcaacgggggatatacggaagcaagcgcagaggtatggggcggcagtgtgccatatttaattgccaaagcggatacatatgacccgcaaaacagctggtcgatttccttgaataggacgcagatcaataccagcggcttaaacctgagcagccctggcacatggtggaatacgacaaatgaaacgaactccgcctatttgtctggactgaaaagctggtttattaccaataaatatcctagtgcagaatctattaagattacgaaaatctcaagcctgaccctgagcagcgcaaaaactgccggtcagcggccgaaaacagcagaggtgaagttttcttactttgttaaagaaaaatcaaatggctatgttctatcaaacggaaaactttcagaaaaaacagcgacgatttccgtgacgacgactcaattaagatcgatgctgggcggcatgaatatgaagagcacgtatgcttctgtatccagcaatacgaacgcttttactctcagcggtaaaggattcggacacggcatcggcatgagtcagtacggagcaaatgccagagctgctgccgggcacgattacaagaagattttaagtttctactatccaaatacgactctatcaagctattaa

SEQ ID NO: 3645 - DNA, 321 bp, Bacillus licheniformis
atgaaaaaactcatagttctaacattatcaatgctgcttttgttgtcagcctgcggcacttcgggccaatcggaggacaagtcaagctcagacaataaaaatgcggcctctgaagaaaccgtcactaaagaaggttcattcgcggggttggctgacagccacacaattgcggtgaacattgacggcaaagaaacaacgcttcaagtcgatgaagatcttcaggacaaagtcaattccattgaagaaggcaaaaaagtcgaagtccaatatacaaaaggtgaaaatggcgttttggagctgaaaagcatcgaaacaaaataa

SEQ ID NO: 3646 - DNA, 921 bp, Bacillus licheniformis
atgagagctgaaaagaggaagaaaaagaaaaaaattctatatacaattatcgctttgattggcattttcgttctcagcacaggcagttatgcctattacttatggcataaagcggcatctactgtagcgaacattcatgaaaatattaacaaatcaaaaaaacgcgattcagctgttgacattgataaccatgacccgttttccgtgcttctcatgggtgtcgatgaacgggacggtgataaggggcgcgcagactccctcatctatatgacggtgaatccgaaaacgaaaacgactgaaatggtcagcatcccgagggatacgtatactgaaattatcggcaaaggcaagatggataaaatcaaccactcctacgcattcggcggcgttcagatgacggtagacacggttgagaacttcctcgatgttcctgtcgactactttatcaaagtcaatatggaaagcttcaaggatgtcgtagatacgctcggcggcattactgtaaacagtacattcgctttcaactacgacggatattcattcggcaaaggcgagattacgctgaacggaaaagaagcgctcgcttatacgagaatgaggaaagaggacccgaacggcgacttcgggcgccagaacaggcagcgtcaagtcatcgaaggtatcattaacaaaggcgccaatatatcatccatcacgaaattcggagatatgttcaaagtgatcgaaaacaacgttaaaacgaatctcacgttcgacgatatgtgggatatccaatccggctataaagaagcccgctcaaaagtcattcagcatgagctgaaaggcgacggcacaaaaatcaacggaatctattattacaaagccgacgaaagttccctttccgacattacagccgaactgaaagaaagccttaataaataa

SEQ ID NO: 3647 - DNA, 1143 bp, Bacillus licheniformis
atgaagaaactaaaagtcatgacagtattcggcacgcgccctgaagccataaaaatggctccgctcgtgctagaattaagaaaatatcccgaaattgagtcttatgtgacggttacagcccagcacaggcaaatgcttgaccaggtgcttgaagcttttaacataaagcctgattttgatttgaatatcatgaaagaaaggcaaacgctggctgaaattacgtctaatgcgcttgtgaagctggacgagctgtttcagtctatcaaaccggatattgtgcttgtccacggtgatacgacaacgacatttgcggggagtcttgccgcttattatcaccagatttccgtcggccatgtagaggcggggctcaggaccggaaacaaatactcgccgtttccagaagagctgaacaggcagctgacgggatcgattgccgatcttcattttgcgccgacagagcaggccgaacagaatctgctccgcgaaaataaagatcctgagacgattttcatcactggaaatactgcaatcgatgcacttcgcacaacagtaagggacggctattcacaccccgttcttgaaaaaatcggaaatgataagatgatcttgcttaccgcccaccgccgggaaaatttagggaagccgatggaaaacatgtttaaagcgatcaggcggatcgtcgaagagttcgacggcgtccaggtcgtttatcccgttcatctcaatcccgctgttcgtgaagcggctgcaaagcatttcggcgatttgaataaagtccacctgatagagccgctcgaagtcatcgattttcacaactttgcagctgaagctcacttcatcctcaccgactctggaggggtgcaggaagaagcgccgtcgctaggaaagccggtcctcgtgcttcgcgatacgacggaacggcccgaaggcgtccaggccgggacgcttaaactggcaggcacggatgaagataagatttaccagctgactaaacagctgttgaccgatcaagatgaatatcgaaaaatgtccagggcttcaaacccgtacggggacggacaggcttcgcggcgaattgcggaggcgctgctttatcggtacggataccgaagcgcgcggcctgatgtgtttaaagataaataa

SEQ ID NO: 3648 - DNA, 879 bp, Bacillus licheniformis
ttgaagaaagttcgtaaagcgatcattcccgcagcgggccttggaacacgtttcctccctgcaacgaaagcgatgccaaaggaaatgcttccaatcgtagataagccaaccattcaatatattattgaagaagccgttgaagccggcattgaagacattatcatcgtaaccggtaaaagcaaacgagcgattgaagatcatttcgatttctcgccggagctcgaacgcaacctggaggaaaaagggaaaatcgaactccttgaaaaagtgaaaaaagcgtcaaatctcgctgatatccactatattcgccaaaaagaaccaaaaggactcggacatgccgtttggtgcgcccgcaactttatcggagacgagccgttcgcagtgctccttggagacgacattgtccaagccgaaaaacctggccttcgccagctgatggacgagtacgaaaagactctctcatccgtaatcggcgttcagcaggtgcctgaagaccaaacgcaccgctacgggatcattgatcctttgacaaatgaagggcgcctataccaggtcaaaaactttgttgaaaaaccaaaaccgggcacagcaccgtctaaccttgcgattttgggacgctatgtctttactcctgaaattttcatgtacttagataaacagcaaatcggcgcaggcggagagatccagctgacagatgcgattcagaagttaaacgaaatccagcgcgtattcgcttatgacttcgaaggcaaacgctatgacgttggagaaaaactcggttttatccagacaactctcgaatttgccatgcaggacgacgaactgaaggattcgctgattccatttatgcaggaccttctggcaaaagaagaagtttaa

SEQ ID NO: 3649 - DNA, 912 bp, Bacillus licheniformis
atgaaactaaaagtttcgtttcgaaatgtttcaaaacagtatcagctttatgaaaaacaatcggataaaattaaagggctgttttttccgaataaggataaaggtttttttgctgttcggaatgtctcctttgacgtgtacgaaggggagacgatcggatttgtagggattaacggatcgggaaaatcgacgatgtccaacctgctggcaaaaatcattccgccgacaagcggtgaaatcgaaatgaacgggcagccttccctgattgcgatttccgcaggattaaacaatgcgctgacgggcagagacagcattcgtctcaagtgcttaatgatggggctcacaaataaagaaatcgatgagatgtatgacagcatcgttgaattcgcagaaatcggcgagtttatcaatcagccggtcaaaagctattccagcggaatgaaatcccggctcggctttgcgatctcagtgcatatcgatcccgatattttaattattgacgaagcgttatcagtaggtgatcaaaccttctatgataaatgtgtcgacagaattaccgagtttaaaaatcaagggaaaaccatattctttgtcagccattcaatcggtcaaattgagaaaatttgcgatcgggtcgcctggatcgataatggcgagcttcgcatgtttgatgacacaaagacggtcgtaaaggaatataaagaatttatcagctggtttaaaaagctttccaaaaaagagaaagacaaatataaaaaagagcagttagccagccgcaaacaggtcttgtccgaagaagatctggctcatctcgaaaaagacaagaataaacaaaaatctttggcaaatatcattccgattgcaggtttgtccatcctggtcgtattggctgccggagcgatgtttgtttaa

SEQ ID NO: 3650 - DNA, 828 bp, Bacillus licheniformis
atgaatgcattagtgaaaatactgaaagaacaagtaacatcgtttcctttaatcttgcgtttggcagcttacgaaacaaaatcaaaatatcaaatgaattatttgggcgtgttatggcagtttttgaatccgctcattcagatgctggcttattggtttgtatttgggatcggaatcagaaagagcagtgagatgattacgggggtcggcgaagtgcctttcatcatatggatgcttgccggtttgattccctggttttttatcagcccgacgattcttgatggttcaaacagtgtatataagcgaatcaacatggtggccaaaatgaattttccaatcagctctcttccttcagtggcgattgcggctaacctgttcagctattttgtgatgatggcgatttatgtcattgtgctgcttgcgtttggcatttatccaaatcttcaatggcttgaatatatttactatttgttttgcatgattgtttttatgttcgcattcagtttgtttaattcaacgatcagtgtactggtcagggattatcagtttctgctgcaatcggtgacaaggctgttgtttttcctgctgccgattttttgggatatctctacgcagctgggggacaagcacccggcattgttgaacgtgattaagctgaatccgcttttttatattatcgacggatttagaaacagctttttcgacggaagctggttcttcgaagatataacatatacgttgtatttctgggctttcacattattgctcttgactgtaggatctgtcctgcatatgaaattcagggacaggtttgttgactttctttaa

SEQ ID NO: 3651 - DNA, 3618 bp, Bacillus licheniformis
atgaacaaaaaagttttgaaaagaaaaataaaatttattaaagaccctattgagaactatctcaaaaaaagaaatcatagaagaaacaataagtacgctaaattttataaaaaattgaatgttgtggacaacacaattttatacgaaagccgtgatgggaagagtatcactgacagtccttttgcaatatttgactatttgataaaaaatccagaattcaaccattataagcatatttggactattgcagattttgaagcgctcgagccagttatctccaagtataaagatatgccgaatgttgagtttgttaaaagaaattcagataaatacctgcaatatttggctactgccaagtatctaatcaataactctacgttacagtcattttttatatgcaaagaagaacaagtatatataaacacatggcatggaacgccactgaaaagcatgggatttgatattccaggaaatccagcccattcacaaaacgtacttagaaactttataagtgcagattacctgctgagtccaaataagcatactaccaatatgtttttgaacagctataagttagaagggctgtacagcggtgagatcattgaagaaggctatccaaggattgatttaacccttaacacgagccccgaagagtttaaaagttatttaaaagacttaagtttactgatctcaaatgataagcaaacgatcttatacgctccaacatggaaagggaatagtgtatcaaaagtaaaaaacgacgtttttcaaattatttctgatatgaattatttagaggagaaaatcggcagtgattataatgtgttaattaaagttcacccgtttttatatagtgaggcttctaaagtttcagagttaaaagggaaactgatacctgactttattgatactaaccagttgttaagtactgtcgacatattaataactgactattccagcatattttttgattttcttgtcactgatcggccgattttgttttatatgtgggatgccgatgactacaataaacaacgaggaaaatatattaacaatgaagatcttccaggtcctgtcctatacaatgtaagggaattagtcgaagcaattggcaatattcatcaagtgaaatcagaatttcaaacaaattatgaaaagaataaagtgaaatttacgaatcacgacgacggaaatgttacgaaaagagtagttgagaaaatcttcaaaaacaagggacaattgaatgtaattagagatctggataaaaagaaagaaaagatcttgatctatccaggaggaatgaaaaataacggcattacatcttctttccttaatttaatgaataatattgactttgataaatatgatgtaagctgttttatgaaaactccccactcaagagaggttctaaacaatatcaacaaagtgaataaaaatgttaggttcatatttaagcctggtttaccagtttacacgttgtttgatgtatataaagataagctggtgcacaataggggagctaacggtaaacttgaaaagaagttgtacccagaggatgcatatttaagagaacataaaaggctttttggaaaatctaaatttgattatgtaattgatttcagcgggtacagcttatactgggccaagtatttagtttgtgcagatgcaaaaaagaagatttgctatatgcacaatgacctcttgtcagatagtgaaagattggttaatgggcgtcgtccgcacaaaattaatctgagaggattattctctatttacaataaattcgataagctagtaagtgtttcaaagggaacgatggagttaaataaaaagaatcttgctatatatgctgatgaggacaaatttgactatataatgaactctattaatcctgaaaaaattctcgggatcgatcatttaaaagaaaaggatactgagaaattagcaatcgctgaacagaaccatgaagaaatcatagccaataaaagttttaaagcaagggcaaagattgtaaatgtcgaaggcttcttcattatcaattcactgtttgataaagtgaatcaaaaattaacaccggctaaggaatttgaaaataaagaagtcaccataatacgagaagctcatacgaatgatggaaaagttttttataaatttactatagatgacagtattattgggtggctgaacctagaggcttttgagttattgccagacagcattttacttgagaggaaagtcaataaactggcagtcattcaacaccctaatggaaacgacatctggaataaaccttataaaactttagatgtacaaaaagtatcttccagcaaacaatataaagggattatcgttgaggtagataaagaagtcagaactcaacattctttctacagcagaatatatattaatgatatattaatagggtggattgataattcagcattgaaaattgtaaaagagtatcagtcacatccagaggatacagaaaagcaatctgcgataaagaatgaaaaagccaaaattaagcgcaaaaattataaaaaacactcaaagattattcaggggctggagaacagaacattagaagaaataaagatgaatttattcgcgactattacaaatggcgaaaattatacaatctggaccaaagcctatcctaataacgggtgtaaagaaatatcaactgctgaagaatttaacgataccattgtcattgtcaaaaaaagccataagacaaaagaaggggaatactaccggttctatgcagatggaaaagcaattggatggttggactctagagcttttaatattatagaagagcctgtcattgcaagaagcagagaagtgaaatacaatgcgattgtgaacttaagcgatgctgactttatatataataaaccttttgatttacctggatgtacacctatagaggactatcaaaaattcaatgaacaagaagtggaaattgttgaagaagctcttacacaagaaggcacttattgcaaagcagtcttaaataataaagtgttggggtggataggacgcaaatctttaaatgtaattgagcctcctggaataaaagtaggtaagactcttgttccttatccatctgaatgtaactacaactttgttaatatgggcagactctcccctgaaaaagggcaagataatctaataaaagctttccatactcatattcagagttatcctgatagcaggctttatattttaggggatggtcctttaaggaaagatctccaaaaaatagtggacagtttggaacttcaagattacgtctatctgatgggacaactggaaaatccgtttggtttcatgaaaatgtgcgactgttttgtactgtcttcccattatgaaggacaaccaatggtattattagaggccatgactttaggaatgagaatattggcaactgacattattgccaatagaacagttttagaaaacggcagatacggaaccttagtagatgatagtatagccggtcttgaaaatggtttaaaagcagtaagaacagagattaatactgttatgcaagcttttgattataatgagtataataaaaaagctatggataccttctacaaagttttgaactaa

SEQ ID NO: 3652 - DNA, 2136 bp, Bacillus licheniformis
atggatagtgcaattccgatagaatttcagctgcgagaaataaaaattaacgacgctcgcctctattttgtgttcgaaagttctatctctcttaatcatgtcggtattttggcagtgaaccgcaattcgaaaaaagagatgcgtgtaacttgtaacaaaataagcgattcagggcagttaaaagcagcggagatatctttaaataacctttctaacctgataatagacgaaacggtcattgatttttatgtgctatatgaaaataatgaaaaaaatcaatgtaaaaagaggatttacacagcctcaaaaccgattgagctgtattggcatcaggatcgagtcaaacagttcatttatttgccgtatacgacccgaaaaggccacttcgctcttgatgtttcacggagaaaagcagtagcggaaccggacagcattaagttaagctccgaaggaaaactaatgatcagaggctatacttttctgctcgatgcggaagaatgttcgataataaaaagcagaaagctggttttaaaggaaattagccaaaacgataaagaaagggttttcaatttccctttaaaaggcgttcagcgcgtcgatttgtcagctgattcttctgatcatgccgttggatttgaggcggaaatcgatctgaaaaagctgtatgaggagaacaggatgcctgctttctttaagttttatatagaatacgtaggtgaagatgctgcaacaggggaggaaatcgctataaaaagcagggcattcaagcttatagatgatatagaaagtttttcaattgttaacacaaaaaaaggaccggctcgttttcacatttatccgcagaagcgaaaacggggtatgcgtctaagaatgaatgactatacgatcaaaacccgtgcggtttattttgccaaaggaaaaggaaaaaggctgatgtcagtcatacgcaaaggcaagaataaagcaaagaaaaagatttcgggcatggtgaagagagcatactattttacttttggactggccggcaaactccctgttaaaaagaaaaccgtcatttttgaaagctttgccggcaagcagtacagctgcaatccgagagcaatttacgaatatatgaaggaacatcatccggaatacaacttaatatggagtgtaaatccgagttatacagaaatttttgaagaaaaaaatgtcccttatattcaccgattcacgctgaagtggctgttcgccatggcaagggccgaatattgggttgtaaacagccggcttcctttgtggatcccaaaaccaaagcacacgacatatgtgcagacatggcacgggactccgctgaaaaggcttgccgtcgatatggaagaagtgcacatgccgggcaccaacactgagaagtacaagcaaaatttcactaaagaagcatcgaagtgggactatttaatctccccgaatcgctattcaaccgaaatctttgcccgcgcttttcaatttaacaaaacaatgattgagtccggctatccgaggaatgactttctgtatacggacaaccgcccggaaacgatgaaggccataaagagaaaaatgaatatccccgaagataaaaaggtcattttatatgcaccgacatggcgggacgatcagttctataaaaaaggaaaatacaaattcgaccttgatttgaatttggaaaagctgcgagaggagatcggcgataattatgtcatcgttttaagaatgcactatttagtcgcggaaaactttgacctatcgccgtacaaaggattcgcatatgatttctcatcatacgaagatattcgcgaactttatatggtatctgatttgttaattacagattactcttcagtattctttgatttcgcaaatttgaagcgtccgatgattttcttcgttccagacattgaaacctatcgtgacaagctgcgcggcttttattttgactttgaacaagaagcaccaggaccgttggtcaaaacgactgaggaagtaattgagaaaatcaaggaaacagagacatctgactatcgtctgcctgacatttttgagcctttttatgaaaagttttgttacctggagacgggcaattcaactgaaaaagttgtaaaaacggtatttaaataa

SEQ ID NO: 3653 - DNA, 408 bp, Bacillus licheniformis
atgaagaaagtcatcacatatggaacgtttgatttattacattggggacatatcaagttattggaacgggcaaaacaattgggggattatctcgtcgtagcgatttcgactgacgaattcaatcttcaaaagcagaaaaaagcatatcacagctatgagcaccgcaagctgattcttgaaacgatccgctacgtagacgaagtcatcccggaaaaaaactgggatcaaaaggtacaagatgtgatcgatcatgacatcgatgtatttgtcatgggggatgactgggaagggaaattcgacttcctgaaggatactgcgaggttgtttaccttccgagaaccgaagggatttccacgacgaagatcaaagaggaaatcgcgaacctttaatgtcggctcagttaaataa

SEQ ID NO: 3654 - DNA, 783 bp, Bacillus licheniformis
atgctgcaaacggaaacggttcatcatcttgcatatgttaacggggatttgcccggatttttgaatcatcttgaaaaatcctttatcgaccgcaatgagggggcatttatcgcaacggtaaaccctgagatcgggtatgcggctgcaaaagacaaggattattttaaaacagtttcatctgctgactttatccagccggacggaatcggcatcgtcctgacgtcaaggctgatcaacagcagattaaaatcgaggatcgcggggtacgatgtatttatcaaccttctcagcttggctgaccgcaaaaagaaaagggtctttttatacggggccaagcaggaggttattcaagctgttgcagatcggctttcaaccgaatatcccggaattgagctggccggatactcacacggctatgtcaaagacaaaggcgaagttgcgaagcaaatcgcggctgccaagccggacatggtttttgtcgctctcggatatcctcatcaggaaaagtttatttatgaacataagcatctatttcctcaggcgattgcgatcggcatcggcgggagcttcgacgtgttcagcggaaaagtgaaaagggcgccgaaaatgttcatcaagctgaatcttgaatggatgtaccgcctgctgaccaatccgacaaggtggaagcgcatgctgaacatcccgaaatatgtcttctccgttctgaaagaggaaagagttcaaaaacagcggcactactatccggagcagatcaaagagcaatctaaaatcgatttgtag

SEQ ID NO: 3655 - DNA, 1164 bp, Bacillus licheniformis
atgaatatacgttctttattggttatggtttactcggccggtctcgctttgaccggttttattttcagattggtaaaagcgcgcgacagagctgtattgcttgtttcctttccggataatgcgcgcgcgctgcttgatgagtatgtcagcagcagccggccgtttgaaatggaagtcctctatacaaggcacgccgtttcccttgcagatgaatatccttccgttcgatcgcaagtgatcaacgagaaaaatccgattcatctcataaaagccgtataccgaatgttcaggtgtaaattcgtgttgacggataattattttctgctgacaagtgttttgaataaacgccctcagacgacatgcattcaaatttggcatgcgtccggcgctttgaagaagttcggactcgaagatatcggaaaccgctatcgatccgccggcgatatcaaacggtttaaaaaagtgtatcgttcatttgatcatatcgttgtcggctcggaaaaaatggcggatattttcaagcggtcattcggcttgggagatgaccgttttttgcggacgggtgttccgttaactgatgagtattttcatgccggaagacaaacagcggagcgtccggaccaaaaggttattctgtatgcgccgacatacagggactattgtttgacgtccgttcgtctccctttctctaaggagcagctctccggggaactgcagggagaatttttgctgctggtcaaactgcatccggccgtgcgggaacagattgcttttgaagagcacgaagggctgatcaaagacgtatcagacgttccgttaaaggatttgctgatggaaagcgacatcctgatttccgactactcgtcggtcgcctttgagtacgctttgttaaataaaccgattttgtttttcacgtatgatatggcagagtataatgaaaaacgcggactgatcgatgattttgaagcagtcattcccggcaaagcctgcatggacagcgaaatgctgctgaaagaaatcaaagaaatgtccgatacaaaggaagagatcaagaagtttgcggaagagtggcatcaatattcaacaggtgatgccagcatgcgcctgttgaactttatgagcgagcatatgacggcaaatgaaaaaagaccggccggttcctaa

SEQ ID NO: 3656 - DNA, 2631 bp, Bacillus licheniformis
gtgaaaaacattagaaaaaccgttatttttgctgcaatcattttgctcgtacatacggcagtcccggcaattcctgctttagcagcatataccgatacttccgtctacaaaattgaaacagcaaaagagtttaatagcgaaagcgaagcgctcaaagcagccgaacaactgaaaaaggacacgggatggaaagccgaggtcaaaccttcagggaaaaacggcacaacatacgttttgacatcagaaggtgtcgaaggggagagcagagcaaaaaatctgcttttgcagtttgaaaaagaaaccggtttgaaggcgtcctatggtccgattggaaaaaaagaaccgttttccaaagcggtatcaaaggaatttgccggtgaagaaaaagccaaggaatgggcgctccaatttgaaaaagaaaccggtctgaaagcaacctatacacttgcagggaacagggaagcatacgtgaaggttgccaccggaggaatcgaaggcgaagacaacacgaaagccatcctcgatcgttttcaaaaagcgaccggcctcaaagcgtcgtatgcaccatacggagcgggacaagcgatcgtcaagctttattctgcagaaatcgcagatgagagcaaagcgaaaagcctgcttgtccagtttgaaaaagaaacggcccttaaaggaacgatagagaccgtaaagaaacaacagcctaaatataaaattgcgacaagttcgatacaaggcgaaacaaacgcgaaaaacctgctgaagcagtttgaaaaagagctcaaagtcaaaggggcatatgaagccgccggtcagccggcacagctatacaatgtgaaatcgggatattttaatgacgaaaagagcgcgaaaaatgccgccggacaaattaaaaagaaaaccggtctcgcctcaagcacggaaaaggtaaaaggtacacgcttctggatcgtaagcatgaaaagcgtagacagtcaaaacctcaaaaaaatcgacgcctttttcaaaaagaaaacgtggcgttatactgctgcaaaggcggggaaaaagcagacatctttcagaatcgtttccgtcccgctttcagatcaaaagaaagcaaacgatggcatccggttttttaaaaacaaaaatattcaggcttctgcgcaaagcaccggcagcacgaccgtcagccgcttccggattgcgtctgctgaaaccgccgttcaagcgcgaatcaataaagggcttgaattctttaagaaaaacggtgcggcgggaacggccggatcaacaggaaaaaaagtgtacagccactatcagctgacaacggaatccgtatacgaacagaacaaagtgacgcaggcgctcaatttctttaaagaaacaggcattcacgcagaggccgtgaagaccggccaatattacagccgctacaaactgagttcggaagctctgatcggcacggaacaattacagcaggcgctcggatttttcagcaagcggaatataccgggcaagattgaacaaacgggtgagtacggctacaggcagtaccgggtgacgacaggtcgaatcacaagcaaagcagatctcgacaagggcttgaatgtctttaagaagaacaatgtcagcgcaacttaccaaacaaagacggtcagcctgtttcatatctcgatcaatgaacaatttacagggaaagaccgtgcggatgctgccgccaatcggatcaaaacgaattacggctggccggtgaatgtcgtcaaagtgaaaaacggcccgcaaatcacaacgactgactacggaatcacgctcagccagatgatcgataaacagatgaaagtcagcccgcaaacggatgcgccggcttatgtttcattgagctacatcaatacggcgaaccaaaccgtcacggctgatctgctgaatatcaggtcaagcccccttgtgacaggcggcaacatcatcggacagctgcaaaaaggggataaagtcaacatcatctcccaggaaaacggctgggcaaaaatcagaatgaattggcgaaatgccagcagggatgaagtcgagaaatatgtcaatccggaaaatttcacacaagacagctcggcatacttccaatttttaaaactgtcgcaaacggccggattgaatgctgccgaggtcaatgcaaaaatcctttataataaaggggttttgacaggcaaagggcaagcgttcatcgacgcggcgagagcatacagcatcaatgaactgtacctcatttcacactcgctccttgagacgggcaacggaacttccgagttggctaaaggaacgatgttcaacggcaaaaaggtttacaatatgtacggcgtcggggcttacgacagcaacccgctttactacggcgcaaaatacgcctatgaacaagggtggttcacacctgaggccgccattatgggcggagccaaattcatcggtgaaaaatacattcaccacccgacttacaaacaggacaccctctataaaatgagatggtctccgaatgcccttcaccaatatgcgacagatgtcggatgggcttgtaagcaggtggggagaatgtacagtctgtatacattgctcgatcaatatacgctgtactatgatgtgccggtttatcggtaa

SEQ ID NO: 3657 - DNA, 951 bp, Bacillus licheniformis
atgactcaatcaccgatatttctgcagcctgagtttaaagagagaatctgggggggaacggctttgcgcgagtcattcggctatgacattccctccgatttgacaggtgaatgctgggccatttccgcccatccaaacggtccgaacatcgttgcttcaggtccttacaaaggaaaaacgcttgccgagctttgggacgaacaccgtgaattgtttggaggtgcagagggggaccgtttcccgctgttaacgaaaatacttgatgccaatcaagacctttccgttcaagtccacccggatgactattatgcaggagagcacgaaaacggggaactcggtaagacagaatgctggtatatcatcgattgcaaagaaggagcagagatcgtttacggccacacggcgagaacgcggactgaactggtcaccatgatcaacagcggtgattgggacaacctgttaaggcggatcaaaatcaaaccgggcgatttttattatgtgccaagcggcacgattcacgctctttgcgaggggacggtcgttttggagacacagcagagctccgatacgacgtacagggtatatgattatgaccggaccgatcaaaacggagaaaagcgcgaacttcacctgacacaggcgatcaatgtcacaacagtaccgcatgtagacagctatgttgacgaatcgacagaaactcaaaaaggcattaccattaagacatttgttgaagccgaatatttctccgtatataaatgggagatcgacggtgccgctgagctgacccaggatgcccctttcctcctgtgcagcgtgattgaaggagaaggaaagctcactcagggcggcgaattatttccgatcagcaaagggacaaattttatcctgccggcggaaaccaatgactttacaatagaaggaacatgtgaactaatcgtgtcacacatataa

SEQ ID NO: 3658 - DNA, 513 bp, Bacillus licheniformis
gtggaattcggcgaaaagacaagaagaaaaggacagagtgaagcatctatgaaagtgatgaatattatccatgacagcatcgtagacggagaaggactgagaacagtcgtgtttttagcgggctgcccgcatatgtgtgaaggctgccataataaacaaagctggaatatcaataacggatttgatatgagtgtagacgaagtattcgaggaaattatgaaaaacccgcttacaaacgtcacctattcaggaggggagccgcttttgcatgcaggcgaactgatcgagctgtcagaaaaaattaagcagcattccgaaaaggacatctggctttacagcggctatacgtacgaacaaatcttgaagaatgaaaagcacagcgccttgctggcctattgcgatgtcctggtagacggcccgttcgaactcaaaaaaagggacttgacgcttctttacagaggaagctcaaaccagcggattattgagtttgcatcatcacaagcagaagcctga

SEQ ID NO: 3659 - DNA, 1869 bp, Bacillus licheniformis
atgacaacaggctttaaagaacagggattattgcaattgacagaaacatttcatgatatcgtcgggtatggaaatcacgatattatgcaggaaaatgccaacgtagacggccgctccccgatggggcaaatgagccggtttgcatccgagagttccagacattatgcgctccattacttaatgtcgccggaaatcaagaaagcagtcgatgacaactttatataccctcacgatttagactatatgccgagcgggacaacgacttgctgtcagataccattggtccggctgttaaaggagggattccacactggccacggctccctcagggaaccgaaggacattatgagcgcattgtcactcgcatctatcatttttcaatcgaatcaaaatatgcagcatggcggccagtcattcccaatgttcgattacgatctggcgccttacgtccgcaaaacgtacgaaaagcatcttgcgaaaatcaaacaatacccgacaactttgacagaagaagagataagggaaagagcgtgggaagaaacggacaacacaacttaccaagcgtgcgaagcatttatacataacgccaacagcatgcattcgaggggcggcggacaggtgccgtttgtttccattaattacggcacggatacgtcaagggaaggccgccttttgatcaaaaatattcttaaggcgacaaaagcaggcctcggcaaaggtgagacgccgatttttccgattcagatcttcaaaatgaaagaaggcgtgaacgttgatcaaacagaccctaactatgacttgtaccggcttgcattggaaacgagcgctgaaaggctgtttccgaacttcagctttatcgactcgcccgtgaacaaacctttttatgacggaacgccggaaagcgaaatcgcttatatgggatgcagaacgcgcgtcatgtccaatattcatggaaaagaaaacagcgtcggcagagggaatttgtcattcacctcgatcaacattgtgaaaatagcgctgctcagcgaaaacgttgaacagttttttgccttgttaaaccgctacatggatttaacgattcaacagctgcttgaacggtacgcctttcaatgcaagaaaagagcaaaggactttaaattcctgtattcacaaggcatctggcatgaaagcgagaagcttgaacctgaggacacgctcgaggatgtgctaaagcacggaacattgagcatcggatttatcgggctggctgaagctttgactgcattgaccggaaaacatcacggagaaagcgaggagtcgtttgaactcggcaaaaaaatcgtccagtcgatgagagataaggccgatgaagccacagaaaaacacaaattgaacttttccttgatcgctacgccggcagaagggctttcagggaaatttgtcaaaaaagacaaagtggagttcggttcgatccgcaatgtcacagaccgggtgtactatacgaattcgtttcacatccctgttcactataagctgactgcggtcgaaaagatcagaaaagaagcgccgttccacttaatgtgcaatggagggcacatcagctacatcgagctggacggagacccgaaaaaaaacattaaagcgatggacatgcttgtgaccgccatgcgccggtcaggcatgggctacgcctcgatcaaccatcctgtcgaccactgcaaggcgtgcggatttaccggaatcatagataatgaatgcccgcagtgcaaaaaccgggatgaggctttgatcgaacgaatcagacggattacaggatatttagtcggagatatgtcaaagtggaattcggcgaaaagacaagaagaaaaggacagagtgaagcatctatga

SEQ ID NO: 3660 - DNA, 984 bp, Bacillus licheniformis
atgaaaattaaagcaacgattgaacgtgtgccgggcggcatgatgatcattccgctctttctgggcgcaacgctgaatacatttgcaccgggaaccgcagagtttttcggcggatttacaggcgccctgattaccggaacgctgccgattttaggagtatttatcttttgcgttggcgcgacaatagattttcgttcttcaggatatattgcgaggaaggggctgacgcttctgatcggcaaagtcggctttgccgcattattgggtttgatcgcagcgcagttcattccagacgaaggcattcaaagcgggttttttgccggactgtccgtgctggcgatcgtagccgttatgaatgaaacgaacggcggtctgtatttggcgttaatgaatcacatgggaagaaaggaagacgccggtgcttttgcctttatcagcacggaatcaggcccgtttatgacgatggtcactttcggtgtgacagggcttgcggcatttccttgggagacgctggctgcaaccgtcatcccgtttttactcggctgcattctcggtaaccttgaccctgaattgcgcgatttgttcggaaaagtcgtaccggcgatcattccgttcttcgcattttcacttggaaacacgcttgattttaacatgttgattcaatccggccttttaggcattgttgtcggcgtatcagtcgtcattctctcgggtgcatctctatacttgctggaccgctttgtcgcaagaggagacggtgtcgcgggagtagcggcgtcatcaacggccggggctgcggtagccgtcccgtatgcacttgccgatgcaaaccccgtgtttgcgccggtagctgattcagcaaccgcgatcatcgcgacaagcgtcattgtcacctcgcttctgacgccgcttgcaaccgtctggatcgaaaaacggacgaaacaaagaaaatctccgaaacaaatgacgattgattacaagtaa

SEQ ID NO: 3661 - DNA, 624 bp, Bacillus licheniformis
ttgaccgtaatggaaatgtctatgatcggaaaagtgcaagagcagctgggcgaggccgggctgatcgcagtcgtccgcgcagacggtaaggaggctgctgaggagaccattcacagactgatcgacaaagggattactgcgattgaaatcacatatacgacgccgggagcgtctgagctgattgaaaaatttgcgggaaaagacggtcttcttgtcggagcgggaacggtggttgaaagcgaacaggcgagggaagccgcggcagcggggtcaaaatttatcgtcagcccgggtttttcggaatcactggctgaggaggccgcatcattgcatacattttttattcccggcgtattaacgccaagcgaaattatggaagcggtctcaaagggttttcgggttcttaagctgtttccagggggaacatccgggattccttacatgaagaacctcgccggtccttttccgaaggttcggttcataccaaccggaggaatccatcccggcgatgtggagaagtggcttgatgccggagcattggcagtaggtgtgggaagccagctgaacaaagtgtcagaagcggatctccagcgcatctttcagcggcgggctcagcagaaataa

SEQ ID NO: 3662 - DNA, 966 bp, Bacillus licheniformis
atgtcgcttgatgtgatgaccttcggagaatcgatggctatgttttacgcaaatgaagcaggcggactgcatgaggcgtcttcgttttccaaagctcttgccggagcggaaacaaacgttgccgtcggactgtcgcgcctgggttttcgggtcggctggatgagcaaggtcggcgccgattcgcttggaacctttattttaaatgaattgaaaaaagaaggcgtcgacatttctgaagtcaaacgcaccgcagaccggcagacgggcatactgctcaagtcaaaggttgaaagcggagaccctgatgtcacatattatcggagcggatcagccgcaagcacgatgagcattgatgactacccggcagagtatttcaagcaagccaaacatatgcatgtgacgggcatacctcctgcactttcaagggaaatgaggggcttcgcccgccacgccgttcaccagatgaaaaaagacgggaagacgatttcgtttgacccgaatctccgcttccagctttggccggatcagcagacaatggttcatacaattaatgaaatcgccgcgcaggcagactggtttctgccggggatcaatgaaggaaaactcctgacaggctgcaattctcccgaggatatcgctaaacattatgtaatgcagggggtcaaggtgattgtcatcaagcttggaaaagaaggggcttattacaggacatcggaaaaagaaggttatgtgccgggttatcaggtggagaaggttgttgatactgttggcgctggcgacggttttgccgtcggcatgatcagcggccttttagacggacttccgctggaagaagcagttcagagggccaatgcgatcggagcgctggccgtcatggctccgggggatatggacggtctgccgtcaagggatcaattgaaagcttttatggctggagagaaaaacaaccaaaaaataggaggttga

SEQ ID NO: 3663 - DNA, 1017 bp, Bacillus licheniformis
atgaaggataagcaaacagcgaaagtaaccatcaacgaagtcgccgcacatgcaggcgtatcaaaatcaacggtttcccgttatatcaacgggaagattgatgccatttcaccgaaaaaggtgaaaagcatcaaaaaagcgatcgaggagctcaattaccgcccaagccagatggcacaggggctgaaggtgaaaaaaagcaaagttatcggatttttggtcgccgatattacaaacccgttttcagtagccaccttgagaggggtggaagaggtttgcgatcagtacggatacagcatcatggtctgcaacacggacaacagtcctgagaaagaaagggagatgctgcacaagctgaacgcgcattacattgaagggctgattattaatacgacgggaaggaacaacgatgtgctcttggatttaatcagccaggatgtatcgattgtgctcgttgaccggaaagtgcccgggctcaagatcgatgcagtcacaacgaacaaccgcgaagtgacaagtcaaatcgtcaatctcatgtatgacaaaggctatgcccaggtcggtctgtttaccgaaccgattaagggaatcagtccaagggaggaaagggcctccgcctatacagaaatcgcgctggaacgaaacgccggcggtacccctctcgtatatgaggctgacgtcaaagacaaagaatctctattacagtccgtcaaaagctttttggaaatgaaagaagggaaaaaagccattcttggaaacaacgggcttctgatgctgaaaatcatcagctgcctttatgagcttggcatttcaattccggaagatgtcggaattgccggatttgatgatacagaatggtataaattgatcggtccgggcattacgaccatcgcccagccgtcgcatgaaatgggcagggtcgccatggagcggatcatcaaacggattgaaggagacgaaagcgccccgcagacgattcagcttgaggcggagcttgttctcagacagtcgctgtag

SEQ ID NO: 3664 - DNA, 744 bp, Bacillus licheniformis
ttgtttgttgaaaacaaactgaatatgttttattcgcatgaagacagggtcgtgatcggcggagccgttccagtaaaggagtccatagcgctcgatgccggcgattttttaaaaacggactatttcctagaacggcgcgaaatcgggattgtgaatgtcggcaagcccggtgcggttaaagtcggtgatgaagaatacgtactggagcacaaagactttctgtatatcggcctgggaaataaagacgttttcttctcaagcttgaatgaaggcggggccaaattttatttcatctcggcgacggcacaccaaaagtatccggtgcaaaaagcttctctttcagagctcccatacgatcatttaggagaagaagcctcttcaaatgttcgtaatctatacaaagtgattcatgcagacggcattcaaagctgccagctgatgatgggcattacgtttcttgaacctaataacacatggaacacaatgcctgcgcatgtccacgaccggcggatggaggtttacctgtatcttgatcttgctgaggatgcaaaggtgtttcatttcatgggcgaaccgacggagacccggcatcttgtcgtcgggaacgaacaggctgtcatttcacccgcgtggtctgtccactcgggctccggcacatccaactactgctttatatgggcgatggccggagaaaactacacatttaaggacatggatgctgtcccgatgaatgtcattcggtaa

SEQ ID NO: 3665 - DNA, 765 bp, Bacillus licheniformis
atgggatatcttgaatcgtatttttcacttgaaggcaaaacggcgcttgtcacaggcccgggaacgggaatcggcaaagggattgccgaagcgctggcaaaagcgggagcggatatcatcggcacttcgcatacgagcggacttgatgaaacaaagcggctgatcgaagaagccggcagaacgtttacttcttatcagcttgatatgggcaaccttgacgaggtcgaggcttttgcaaaagaggtgcctgaccgccatcaaattgatattctcgttaacaacgccgggacgatccgcagagaaaaagcggctgatttttcccgggagaactgggaagcggtgatcaatgtcaatttgaacagcttatttttgctgacgcaggctatcggccggcagatgattgagcgaaagcaagggaaaatcatcaatattgcctctcttctttcatttcaaggaggcattcttgtccctgcatatacggcaagcaaacatgcagtagccggattgacgaagtcttttgccaatgaatgggcggcttataatgtccaggtcaatgcgattgctccgggctatatcgcgacgaacaatacaaagcagatccgcgacgatcaaaaccgcaatgccgaaatcttaaaacggattccggccgagcgctggggtcagccggatgacattgccggcgccgccgtattcctttcgtcgccggcatccgattatgtgaatggacatgtgttagccgtcgatggcggatggctggcaaggtaa

SEQ ID NO: 3666 - DNA, 1134 bp, Bacillus licheniformis
ttgaaagccgtaacgtttcaagggcctcagcatgttgaagtcagccaggtggaggatgccaaaattgaaaaaagcgatgatatcgttgtcagaattacttctaccgcgatttgcggttcggatctccatctttatcaagggaatttccctcttccaaaaggcttccagctcggccatgaaccgatgggaattgtagaagaaacaggacctgatgtaacaaaagtgaaaaaaggagaccgggttgtcatcccgtttaccgttgcctgcggacattgcttttattgcgaaaacaagctggaaagccagtgcgacaatgccaatccccattatgattcaggcgggtattttggctactcggaaaaattcgggaatcaccctggcggacaggctgaatatttaaaagtgccgtttggcaatttcacgccgtttgtcattcctgaatcatgcgagatggaggacgagtcgcttctgtttttatcagatgtcctcccaaccgcgtattggagcgtgcttcacgcaggcgtcaaaaaaggggacactgtcattgtgctcggctgcgggccggttggattaatggcgcagaagtttgcctggatggaaggggcgaagcgggtcattgcagtagactacttggactaccgcctaaagcaggctgaggcattaaaccgcgttgaagtatttgactttacaaaatatcctgatatgggcgagcatttaaaggagattacaaaaggcggggcggatgtcgtgatcgactgcgtagggatggacggcaaaaaatctccgcttgagtatctggagcaaaaactgaagcttcagggcggcacgctcggaccgattcaaatttctacaaaggcggtcagaaagtgcggaaccgtacagattacgggggtatatggaagcaattacaatatgtttccgctcggcgcattcttttccagaaatgttacgctaaaaatggggcaggctccggtcatccatttgatgccggagatttacaagaagatcgaagagaatcaatttgatccgaaggaaatcattacgcaccagcttccgcttgaagaagccggccgcgcttatcatttgttcaacgaccatgaagatgattgcattaaagtaattttgaagccatag

SEQ ID NO: 3667 - DNA, 1434 bp, Bacillus licheniformis
atgaagggaaaaagatcgaatgcctggctttatttttttggagccttgggcggtgtgctctacggttatgatacaggcgtcatttccggggcgattttgtttatgaaagatgaacttgggctcaatgcctttacagaagggctggttgtcagcgcaatattaatcggggcgattttcggatcgggtttgtcaggcaggctgacagaccgcttcggccgaagaagggcgattatgtcagcggctgtgctgtattgcatcggggggctcggaacggccctggcgccaagcacggaatatatggtggctttcaggatcgtgctcggccttgcagtcggctgttcaacgaccatcgttcctttgtacctttcagagcttgctccgaaggaatcccggggcgcgctttcttcattaaatcagctgatgattacgatcgggattctgctctcttatttgatcaactatgcatttagtgatgcaggcgcatggcgctggatgctgggattggcccttattccgtcaatcggccttttaatcggtatctttttcatgccggaaagcccgcgctggctcttaacaaaaggaaaagaagagaaagcaaggcgggttttgtcaaagatgagaggaggagagcgggtcgatcaggaagtcaaagaaattaaggaagcggaaaagcaggaccaggggggcttgaaagagctgctggaaccgtgggtgcgcccggcgttaatcgcaggggtcggactggcatttctgcagcaatttattggaaccaacacgattatttactatgccccaaaaacgtttacgaatgtcggatttgaagattcggcggccattttagggacagtcggcatcggaacggtcaatgtcctgatgacgcttgtggcgatccgcttcattgacaggattggccggaagccgcttttattatttggaaatgccggaatggtcatcagtttgatcgtgctttctttttctaatctctttttcggcaatacctctggtgcggcatggacgactgtcatctgcttaggtgtgttcatcgtcgtatttgccgtcagctgggggccgatcgtctgggtgatgctgcctgagctgttcccccttcatgtcagagggataggaaccggagtatcgactttaatgctccatgcagggaacttaattgtgactttgagttttccggtcctcatggaagcgatgggcatcagttacctgtttctgtgctatgcggccattggaatcgcggccttcctgttcgtcttctttaaagtaacagaaacaaaaggaaaagtctggaagagatcgagcaggatttgcgggacaagcaccgcggaatcacggcaactgacacacagccggttgaacgataggcaaaaggatgggcaaggccccatccttttttgtgtgaagaggccggccgatcatggctga

SEQ ID NO: 3668 - DNA, 957 bp, Bacillus licheniformis
atgctacgatcgcagcgaacgaagaaaaagagactaagaaaatgggtgaaatactcactgtttttcattgccttaatcctgacggcgacggcagccgcaggcggctatgcgtactataaagtggcgaacgcctccaaagatgcgcaagtcaccctttccagaggtgaacagtccgtcaagcggattaaagagttcaaccctaaaaaagataacttctccatcctgttgatggggattgatgcccgtcccggacaaagcatggacaaagaacgaagcgatgcgatggttcttgccacgttcaacagaaaagacaaatcggtgaaactattgagcatcccgcgggattcctatgtcaacatccccggacgcggctacgataaaataacgcatgcccactcattaggcgggcgcgaccttagtacagaaaccgtcgaaaacctgctcgacattccggttgattacgtcatggaagccaatttttcagctttcaaggaagtagttgatgaactcggcggtgtaccgatcacgatcaaagaagactatattgtccggcagattaaaaaggatacgaaaggcaaagtcaaccttcaaacaggcgagcagacgctgggcggagaagaagccctcgcttatgtaagaacgagaaaagccgatacggacttgaagcgcggcgagcgccagatggaagtcatcaaatcgattatcaacaaatccaaatcgcttacttccattccggcttacgacgatatccttgatacagtcggaaagaacgtatcgatgaacttgtcgctgaatgatgcaatcggactgatcccgtttatgacgtccattcaaacggtcgatacccttcaattgaaagggagcgattatcaaccgggcaaagtctactatttccagcttgatcaggaaaacctcaacgaaattaagcaggaattaaaacagcagttagatgtataa

SEQ ID NO: 3669 - DNA, 861 bp, Bacillus licheniformis
atgagattaattgcgatcgatttagacgggactcttttaaataccgaaagcaaaatatccgcagaaaaccgggccgctatcaaaaaggcgctcatttcagactgcatcgtaaccatttgcacgggacgggccacatttgacgtaaaagcgcttctgaacgatttggatattccgattatcgctgcaaacgggggaacggtccacgatttcaactataaactcctaagcagaacgctaatggacaaggaagcgggaaaaaaggccgcccaatacttaacagatcatcaaatctatttcgaggtttatacggacgatgcgctgctttctccttatgacggagagcagaagcttaaagcagagctcgatatcgtcacaagcgccaaccctgatgaagacagggatacgctttggcaaggcgcactgactcagtttaaacaattcggcatcaaacccgtccccgacattcgcgagatttttaacggagacgaacatatttataagctgttgtgcttctcatttgatatggaaaagctgaagaaagcaaaagatgatctttctgcctttccaaaactgggactcacttcttccggaagacatatcatcgagattctgcctgatgaatccggcaaaggccgcgctttaaaagagctggcccgccactatggaatcgagaaaaaagacatctacgcgatcggcgacagcccgaacgatctgtcaatgtttgaggaagccggccatcggatcgcgatgggcaatgcaatcgatgagctaaagcatatcagcacctttatcacgaaaagcaatgacgaaaacggcgtcgcttatttcattaacaaactgctggaaaatgaatatcaataa

SEQ ID NO: 3670 - DNA, 1245 bp, Bacillus licheniformis
ttgataaaaaaagcggcaaacaaaaagttggttttgttttgtggaattgcggtgctttggatgtctttatttttaacgaatcataatgatgtacgcgccgatacgatcggcgagaaaatagcggaaactgccagacagcttgagggtgcgaaatacagctacggcggagagaagccgaaaacggggtttgactcgtcaggctttgtgcaatatgtgtttcaatcgctcgatattacgcttccgagaacggtaaaggaacaatcgactcttgggagcagtgtcggccgtcagcagctcgaaaagggggaccttgtctttttcaagaatgccgagctggaatcggacggaccgacccatgtcgccatctatttgggaaatgatcaaatcatccacagcacaaaatcaaacggggttgtcgtgacaaagcttgaaggcagctcttactggagctcggggtattttaaagcgaaaaggatcacaaaagagcctgagatttcgatggatcctgtcgttcaaaaagcaaaaagctatgtcggtgttccttatgtatttggaggcaactctccggatctcggatttgactgttcggggttgacccaatacgtcttcagagaggtgctcggcgtttatttgccaaggtcggctgaacagcaatgggctgtcggtcaaaaggtgaagcttgaagatatccggccgggtgatgttttgtttttcagcaatacgtacaaaccgggaatatcccataacggcatctatgccgggggcgggcggtttatccatgcgagccgttcaaataaagtgacgatatcctacttgtcggcttcctattggcagaagaagttcacaggagtcagacgttttgacaacatgtccctgccaaaaaatccgattgtatccgaagccatcaggcatatcggcgaagtcggttatcaaaaaggcggcacatcgcctaaagaaggctttgatacggctgggtttatccaatatgtctacaaaacggcggcaggagtggagcttccgaggtatgctgacaaacaatacagcacgggtaagaaaattaccaaacaggagcttgagcctggagacatcgtcttctttaaaggaaccactgttatgaatcccgccatctatatcggaaacggccaggtcgttcttgtcaccttgtctgccggtgtaacgacagcagatatggagacgagcgcctattggaaagataaatacgccggaagcgtcagaattgagtag

SEQ ID NO: 3671 - DNA, 168 bp, Bacillus licheniformis
atgaaatttgtcagagccatttggccgttcgtaggtttagttttgatcattgcattcatgtctgctttcaagtattctgatgaattgtcaaacgatgaaaaagctaaaatctctacggagatccaaaaagtgaatcagcaggatcaaacaacagaaaacaagcaataa

SEQ ID NO: 3672 - DNA, 1170 bp, Bacillus licheniformis
atgaaaaaacaactgaactttcaggaaaaactgctgaagttgacgaagcaggagaaaaagaaaacaaacaagcacgtctttatcgtattgcccgttattttctgtttaatgtttgtctttacttgggtcggaagcgccaaaactccttcgcaaatggacaaaaaagaagatgccaagcttacagctacttttgttggcgatatcatgatgggaagaaacgtagaaaaagtgacaaacttgcacggttcggaaagtgtcttcaaaaatgtgaagccgtactttaatgtgtcagattttatcacaggaaactttgaaaaccctgtaaccaatgcaaaggactatcaagaggcagaaaagaacatccatctgcaaacgaatcaagaatcagtcgaaacattgaaaaagctgaacttcagcgtactgaattttgccaacaaccatgcgatggactacggggaagacggtttgaaggatacgctcaataaattttcaaatgagaatctggagcttgtcggagcaggaaataatcttgaagacgcgaaacagcacgtatcctatcagaatgtgaacggcgtaaaaattgcaacgctcggttttacagacgtctacacaaagaactttacagccaaaaagaacagaggcggagtgctgccgctcagtccgaaaatctttattccaatgattgcggaagcatcgaaaaaagcggatcttgtccttgtccatgtgcactggggacaagaatatgacaatgaaccgaacgacagacagaaggatctggccaaggcgattgcagatgccggagcagatgtcatcatcggcgctcatccccatgttctcgaaccgatcgaagtgtataacggtactgtgattttctacagcctcggcaactttgtatttgatcagggctggtcaagaacacgggacagcgcgcttgtacaataccatttaatgaatgacggcaaagggcgctttgaggtaacgcctctcaacattcgcgaagcaacgccgacgcctttaggcaagagcgacttcttaaaacgaaaagcgatcttccgtcaattgacaaaaggaacaaacctcgactggaaagaagagaacggaaaattaacgtttgaagtcgatcatgcggacaagctgaaaaataataaaaacggagtggtgaacaaatga

SEQ ID NO: 3673 - DNA, 450 bp, Bacillus licheniformis
atgtttggatcagatttatatatcgccctcattttaggagtcttactcagtttgatttttgcagagaaaacgggaattgtaccagccggcctcgtcgtaccgggttatttgggacttgtcttcaatcagccgattttcatgctgctcgttctttttgtcagtttgctgacgtatgtcatcgtgaaattcggactttccaaaattatgattctatacggacgcagaaaattcgcagcaatgctgattacgggaattcttttgaaaatcggttttgattttatatatccggtgatgccgtttgagattgccgaattcaggggaatcggaatcatcgtgccggggctgatcgccaataccattcaaagacagggattaacgattacgcttggaagtacgcttttattgagcggagcaacattcgtcattatgtatgcttactatctaatctaa

SEQ ID NO: 3674 - DNA, 1182 bp, Bacillus licheniformis
atgtgggtaatgctattagcctgtgtgatcgttgttgggatcggcatttatgaaaaaaggcgccaccagcaaaatatcgatgcgctgcctgtccgagtgaacatcaacggtatacgcggaaagtccacggtgacaagattaacaacagggatattaatcgaagcaggctacaaaacagtaggaaaaacaaccgggacagacgcaaggatgatttattgggacacaccggaagagaagccgatcaaaagaaagccgcaagggccgaatatcggagagcagaaggaggttatgaaagaaacggtggaaagaggggccaatgcgattgtcagtgagtgcatggccgttaatcctgattaccaaatcatctttcaggaagaattgcttcaggctaatatcggcgtgatcgtgaacgtgctggaggatcacatggatgtgatgggaccgactttggatgaaatcgcagaagcattcacagcaaccattccttataatggacatttggttattactgatagtgagtataccgatttctttaagcaaattgcaaaagaaaggaacacaaaagtcatcgtcgcagacaattctaaaataacagatgaatacctcagacagtttgagtacatggtattccctgataatgcgtctcttgcgctcggtgtagctcaagcgttgggcattgacgaagaaaccgcctttaaaggcatgctgaatgcgccgcctgatccgggagccatgagaattctgccgctgatgaacgccaagaatcccggacatttcgtcaacggttttgcggccaatgacgcagcttccactttaaacatttggaagcgtgtaaaagaaataggctatcctacggatcagccgatcgtcattatgaactgccgcgccgacagggtagacagaacacagcagtttgcggaagatgtccttccttatattgaagcaagtgaacttgtgctgattggagaaacaacagagccgatcgtcaaagcatatgaagcaggcaaaattcctgcggacaagctgtttgattttgagcacaaatcaacggaagaaatcatgttcatgctgaaaaacaagcttgagggccgcgttatttacggagtcggaaatatccacggagcagcggagcctctcattgaaaaaatacaagattacaagattaagcagctcgttagctag

SEQ ID NO: 3675 - DNA, 981 bp, Bacillus licheniformis
ttggctacgattaaagacgtcgcacttgctgcaaaagtatctgtcgctacggtttcccgggtattaaatgagacgggatacgttcatgaagacacgagggcgcgcgtgctgaaagcgatggaagaactgaattaccacccgaatgaagtagccaggtctctctataaaagggagtccagactgatcggactgctgctgccggatatcacaaacccgttctttcctcagcttgcccgcggcgttgaagatgagatccaccgcctcggctttcggctcatatttggaaacagcgatgaaaatctggaaaaagagcttgattatatgcagacgtttaaacaaaatcatgtggtcggagtcatttcagcgaccaattatccggatgcgccaaattatcaagacttgtccatgccgatcgtctttcttgaccggacgggcgagaatgcgccggctgtatttgcggacagccgcgaaggaggcagaatcgcagcggctgagatgatcaagaggaacgcgaaacggattacgctgattaaaggaccggctcaccttcagactgcaagagaccgtttcaacggagcgctggacgtgctaagcggagccgatatcgattttcacgtcatgaaaaccgagacattttcatttccggaagcccaaaaacgggcggcggagctgtttggcacatatccggaaacagacggcgtgatcgcaagcaatgacattgtggcgacagccgttttgcatgaagccttaaaacggaagatcaaagttcccgatgaactgcagattatcggctttgatgacataccgcaaagcgaattgcttttcccctctttatcaacgatcaggcagcccgcctatgaaatgggaaaagaagctgcaaaactgctgcttagattaatgaaaaatgaatatattgaacaatcggcagttcagatgccggttgcctttattgaaagacaaacgacaagaaaggcggaatga

SEQ ID NO: 3676 - DNA, 882 bp, Bacillus licheniformis
atgagtaaaatatgcgtgatcggcagctcttcgatggatttagtcgtgacatcgcccaagcggccggccgccggagaaacggtgcttggcgaatcttttaaaacggttccgggcggaaagggggccaaccaagcggtagccgcggcccggcttggcgccgaggtccatatgatcggctgcgtcggcgatgatcattacgggaaagccatcctcgacaattttcaagccaatggtgtcttgacagactatgtggaaccggttacaggtcaggaaagcggaaccgcacatatcgttctcgcagacggcgacaacagcattatcgtcgtcaaaggggcaaatgaccatgtcacacctgaatacgttcaaaaagcgctgcctgcgattaaacaggcagacatcgttctgattcagcaggagattccggaagaaaccgtcgattatgtcagcggactgtgcagctctctcggcattcctctcctgctgaatccggcaccagcccgtccgctacgcccggaaacggtcgaacacgcggcctacatcacgccaaacgagcatgaagcttcggtactgtttcagggcatgtcccgggaggaagcgttaaagcgctatccggagaagctgttcatcacagaagggaaaaacggcgtccgctatcacaatggtctggaagaacgtgtcgttccttcattccctgtcaatgcgattgatacgacgggcgccggagacaccttcaatgcgggatttgccgtcgcgctttccgaaggacaaagcatcgaatctgccttgcgctttgcgaaccgggcggcttccctgtcggttctgaaattcggcgcacaaggcggcatgccaaaacgggatgaagtggagcgtgaactgtcatga

SEQ ID NO: 3677 - DNA, 396 bp, Bacillus licheniformis
atgaaaaaacacggaatattaaacagccatatcgcaaaattgctggccgatctcgggcataccgataccatcgtcatcgcggacgccggtctgcccgttccgcccggcgtccccaaaatcgatctcgcactgacattgggtacgcccggatttcgagaggttacaaagctcatcgccgatgaaatggttgtcgaaaaagtgacggcagcccaagaaatagaaagcgtcaatcccggtcaagccgcatttttaaaagcggaattttcaaaccaaaagattgactatatcccgcacgaagcattcaaaaaggcaacgagccaggcgaaagcggtcattcgcacaggggaagcaacgccttatgcaaattgcatcttgcacgcgggagtgatcttttag

SEQ ID NO: 3678 - DNA, 1482 bp, Bacillus licheniformis
atgcatattaaaatgaaggacatttttaaagcctttggccaaaaccaggtgctgtccggcgtttccttcgagcttcaagaaggtgaagtccacgctttaatgggagaaaacggcgccggaaagtcgacactcatgaatctgttgactggacttcacaagctggacagcggaacgatcgagatcgacggaaaagaaacgtatttttcagatccaaaggaagccgaacagaacggaatcgcctttatccatcaggagctgaacatttggcctgaaatgaccgttttggaaaatctgtttatcggcagagagctttcttccaaacttggatttttaaacaacaagaaaatgaaagcgctagcaaaagagcagcttgaaaggctcggtgtctcaatttctcttgaaaaagaagccggagactgttccgtcggccagcagcaaatgatcgaaatcgcaaaagcccttatgacagacgcgaaagtgatcatcatggatgaaccgacggcagcgttgacagaaagagaaattgaaaaactgttcggcgtcattagagcattaaagaaaaacggcgtctccatcgtctatatatcccaccgcatggaagaaatcttcacgatttgcgacaggatcacggtgatgcgcgatggaaaaacggtggacacgaaacggattcccgacaccgactttcatgaagtggtgaaaaagatggtcggacgggagctgaccgaacgctatcctgaaagacagccaaatccgggacgcgtcgtcctcgaagtcaagcaggcatccaaaaaaggagtcttccaaaatatcagcttttccgtccgctccggcgaaatcgtcgggatttcaggactgatgggtgccgggcgcaccgagctgatgagagcggttttcgggctcgatccgcttgactcgggagacattttcatcgaaggcaaaaaagcggcgctcaaaaaaccgagcgatgccgttcaaaagggaatcggctttattaccgagaaccgcaaggatgaaggacttgtgctcgacacgtccatcagagaaaatatcgcccttccgaatctcgccagcttttcgccgaaaggatggattgacaaaaaaagcgagcaggaatttgtcgatcttctgatcaagcggctgacgatcaaaacggaatcgccggaaacccacgcgcgaaacctttcaggaggaaaccagcaaaaagtggtcattgccaaatggatcggcatcggccctaaagtgctgattttggatgagccgaccagaggcgtcgatgtcggcgcgaaaagggagatttatcagctgatgaacgagctgacagaccgcggcgtcgcgatcgtcatggtctcttcagagctccccgagattctcgggatgagcgaccgcgtccttgtaatccatgaaggaacgctaagcggagagctatcaagaaatgatgccacgcaagaacgaattatgacactcgctacaggaggacggtaa

SEQ ID NO: 3679 - DNA, 963 bp, Bacillus licheniformis
atgaaaactcaaccggctgtgaaaaaaagccttaatgttgattctgtaatgcaaaagctcggtccgtttctcggcctgatcattctcgtcgtcatcgtatcattgttaaatccgagctttttagaaccgttaaatattttaaacttgttaagacaagtcgccattaatgcgctgatcgcgtttggcatgacctttgtcattttaaccggcggcatcgatctttccgtcggagcgattttggcgctgtcaagcgcattgatcgccggaatgatcgccggcggcatcgatcctgttttcgccgtcatcatcggctgcctgatcggagccctgctcggcttggtcaacgggctgttaatcacgaaaggtaaaatggccccgttcatcgcaacacttgccacaatgacgattttccgcggattgacgatggtttatacagacggcaatccgattacagggctcggcaaccactacggcttccagcttttcggacgcggttactttttaggcatccccgtccctgcgattacaatggcagccgcctttatcatcctctgggtgatccttcacaaaacgcctttcggccgccgcacatatgcaatcggcggaaatgaaaaagcggccttgatctcgggcattaaagttccgcgcgtcaaaatgatgatttattctcttgcaggcctattatccgcgttggctggagccatcttgacgtcacggctaaactcagcccagccgacggcaggcacttcctatgaactcgacgccatagccgcagtcgtattaggcggcacaagccttgccggaggaagaggacgaattgccggcacactcatcggcgtcctgatcatcggaacgttgaataacggcttgaacctgcttggcgtctcttcctttttccaaatggtcgtcaaaggtgtcgtcattttgatcgcagtcctgctggaccgcaagaaatccgcttaa

SEQ ID NO: 3680 - DNA, 915 bp, Bacillus licheniformis
atgaaaaaaacattaacggttttcaccgcattggcgcttctgtttctgtccgcctgctcgctggagccgccggaatgggcaaagccgaataaagaaaaaggaacggatattaaaatcggtttatctgtctcaactttgaaaaatccgtttttcgtttcattaaagaacggagttgtcaaagaagccaaaaaacaagggatagaagtgattgtcgtcgatgcacaggacgattcggcaaagcagacgaatgatgtcgaagatcttctgcagcaaggcgttgacgctttattgatcaacccggcggactcctccgccatctcaactgcagtccaatcggccaattcgcttggcattccggtcgtcacccttgaccgctccgccgaaaacggaaaagtagaaacgctcgtcgcttcagataacgtaaaaggcggacaaatggcagcggactttattgtggagcagctcggcaaaggcgcaaaagtggctgagcttgaaggcgtccccggcgcatcggcaacaagggaacggggctcagggtttcataagaccgctgatgacaagctgaatgtgatcgccaagcaaacagccgactttgaccggacaaaagggttgaacgtcatggagaacctccttcaaggaaaccctgatattcaagcggttttcgcacataatgacgaaatggcgctcggcgcgattgaagcgatcagaagctcagggaaagagattcttgtcgtcggcttcgacggcaatgaagatgcggttaaagcggttcaggccggagacatgtcggcaacgatcgcccagcagcctgaattgatcggcaagctcgccgtacaagcggcccgcgatattttgaacggcaaaaaagttgaaaaaacgatacccgcaccgctcaaactggaaacgaaaaagtaa

SEQ ID NO: 3681 - DNA, 762 bp, Bacillus licheniformis
atgaaaagtgcaagcaaacaaaaaataattcagcccgttgataagaacctcgatcaagtctatcaggtctcaacgatggtatctttattggacggaatttacgacggggatttttatatgtccgaagcgaaggagcacggagacttcgggatcggaacgttcaaccggctcgacggcgagctgatcggttttgacggtgagttttaccgtctccgttccgatggaaaagcctacccagttcaaggaagcgattgttctccattttgctcgctggctttcttccggccggatatctatcacgaaatcaagcagcggatgccgcttgaggcgttcgaagaagaaatgaaacggatcatgccgagtgaaaacctgttttacgcgattcgcatggacggaacctttaagaaagtcaaaacgagaacagttgaacttcaggaaaaaccgtatgtgccgatggttgatgcggtaaaatcacagccgatctttgattttaatgatattacggggacgatcgtcggcttttggacaccgcaatatgccaacggaatcgcagtttccggcttccatcttcactttatagatgaagaccgcaatgtcggcggacacgttttcgattatgaaatcgaagaatgcacggtgcaaatttctcaaaaactcaatatgaacctcagattgccgaatacgcaagatttctttcaagcggatttcaataaacacgatcttgcagccggaattgaagcggccgaaggcaatcccgagtaa

SEQ ID NO: 3682 - DNA, 1719 bp, Bacillus licheniformis
ttgaataatgtagccgctaaaaatgaaactcttactgtaagaggagcagagcttgtggtggatagtctcattcagcaaggtgtcactcatgttttcggtattccgggagcgaaaatcgatgcggtgtttgacgtattgaaagacaaggggcctgaattgatcgtttgccgtcacgagcagaatgcagcatttatggcggcggcagtcggacgattgactggaaagcccggtgtttgcctggtgacttcaggtccgggagcgtctaatttagcgaccggtcttgtaacagccaatacagaaggagatccggttgttgccctggcgggtgctgtaaaaagagcggatcgtctcaaaaaaactcatcaatcgatggataatgcggcgttgtttcagccgattacgaaatatagcgcagaagtggaagatgcgaacaacatacctgaggctgtaaccaatgcattcagagcggcggcttctggacaggctggcgcagcgtttctcagctttccgcaggacgttacggccggtccggcaactgccaagccggtgaaaaccatgccggcgccgaagctgggcgcggcttcggacgaacaaatcagcgcggccatcgccaaaattcacaatgcgaaccttcctgtcgtgcttgtcgggatgaaaggcggaagacctgaagcgattgaagcggttcggcgtctgctaaggaaagtgaaactgccgtttgttgaaacataccaagcagcgggtacgctgtctcacgatttggaagaccagtacttcggccggatcggactattccgcaatcagcccggagacatgctattggaaaaagcggatgtcgttttgacggtcggctatgatccgattgaatacgatccggtcttttggaatggaaaaggcgaacgaagcgtgattcatcttgacgaaatacaagccgatatcgatcatgactatcagcccgaaatcgagttgatcggcgatatcgcagagacgttaaaccatattgaacatgattctctgccggtttccatcgacgagtcctttgcacctgtccttgattacttgaagaaagcactggaggagcaaagcgaacctcctaaagaaacaaaaactgatcttgttcatccgctgcaaatcgttcgcgatttgcgtgaactgctgagcgatgacataacggtgacttgcgacatcggctcccatgcgatttggatgtctagatatttccgcacctaccgtccgcatggactgctgatttccaacggcatgcagacgcttggggtggctttgccgtgggcgattgcagcaacgctggtcaatccgggacagaaagtcgtgtctgtttccggggacgggggcttcctgttctccgcgatggagcttgagacagcggtcagattaaaagcgccgatcgttcacattgtctggaatgacagcacatacgatatggttgcgttccagcaggagatgaaatacaagcggacgtccggagtcgacttcggcggaatcgatattgtaaaatatgctgaaagctttggtgcaaaaggtttaagggtcaattcacctgacgaattggcagaggtgcttaaagctggtcttgatgcagaggggcctgttgtcattgatattccggtcgattacagcgacaacattcatttggccgatcagcgttttccaaaaaaatttgaggaacattttaataaagaagcctctaagcaatcttga

SEQ ID NO: 3683 - DNA, 879 bp, Bacillus licheniformis
atggagctgcgccatcttcgttattttatggttgttgccgaagaactgcatttcggaaaagcagctcttcggctgaacatgactcagcctccgctcagccagcagattaaacagctagaaagtgaaataggcgtcaccttgctgaagaggtcaaaaagagccgtcaggctaacggcggcaggcggggtctttttaaaacaaatcaaggaaggactttcccagattgatcaggccgtcgacatggctcagcggacggcccgcggggagctgggaagactcgtgatcggctttgtcggctccgcaacatacgagatcatgcctcccatcatcagggaataccgaaaccggttcccgtccgtgcagatcgatcttcgggagctttcaacccccaatcagatcgatgcactgctaaacgggcatattgacatcggggtgctgcatcccccgttgggaaacgacgaactgaagtcatacacggtaaaaaaaagccattgtgtccttgcacttccaaaacaccacccgttgacagaaaaagcccgggtacatttgaaggatcttgaagaagaatcgctgatcgtcattgccaaagaagcgtggccctctttatacacggaattcaatttcttgtgtgaaaaagccggatttatccccaacatcgcccaggaagctacagaataccaaatggtgatcggcctcgtatcggccggaatgggaatcgccgtcgtgcctacggcggctaaacgattatttaaccttgatgttgtatacaaagaaatcgaagactttccccttcgcgccgaatggattaccgcacatcgaaaggacaaccgcaatccggcacttaagcatttcatcgaaatctcagatcaacactcatag

SEQ ID NO: 3684 - DNA, 1584 bp, Bacillus licheniformis
atggagaagctgaagatcggttcgaaacaaatggttgtcagtcctcattatctcgcttcgcttgcaggcagcatcatcatggagaagggggggaacgcgtttgacgccgctgttgcagtaagcgcgtgcctagctgttgtctatccgcatatgacaggactcggaggggatgccttttggctgatgtatcacaatggaagcggggagatcaaagggtacaatggcagcgggcggtcggggcggaaagcggaccgggatcagtataaaggagagcgcgccattccggtcaggggcccaaggagtgcgattaccgtgccggggatggtggacagctgggccgaaatactggctgcgtacggccgtctatcgcttcgagaggtgctgaagccggcgattatgtatgcagaaaaggggttcccggtctcgcctgatcaatgtcaaaacacggtgaaaaacgctgaatggctttcctgtatgccgatcactgcagatatttatcttccgggaggaaaaccgccctctccaggtgagcgttttgtgcagaaagagctcgcgcgcactttgacgttgatcgctgagaaaggaagagacaccttttataaaggggaaattgcccaagctttagcagcctatctccaaaacaacgggggcatcttgaaccttgaagatttcgggctgcatcgaggggaatgggtgtctccgctttcctccacatacagaggatatgccatctatcaaatgcctccgaattcacaaggatttaccggtcttatgacattgaacattttggaaaactacgactttggcatgatcgagcacggttctttcgagtattatcatctgcttatcgaagcattgaaattaagtttttccgactgcaacaaagtattgactgacccggaattctcacagattccgcttggacgcctactggacaaagagtatgcccgggagctggccgcaaaaatcggactgccggcgcttcaggcggagagccggccgctcggcagcgatacatcttatgcagcagcagtagatgaagacgggaatgctgtttcgtttattcaaagtttgtatttcgaattcggctcaggtgtgacagctggagataccggcgtcattttgcagaacagaggggcgtttttctcgcttgatcccgaccatgtcaatacgctggagccgggaaaaagaacttttcatacgctgatgcccgccatggcgtttagaggcggcaagccgaaattcctttacggaacgcaagggcaagggggagaaggacagccgcagacgcagacggctcttattacgagaatggtagattacgggatggatccgcaaacagctgttcatgaaccgagatgggtatggggcagaacatggggagagcgggtggaaggtgtaagaatagaaagcagagtggcgcctgaagtgattgcaaaactgcgaaagcatgggcatcatgtaaccgttgtcggtgaatttgacggggtgatgggtcatgccggaatcattgagattgacgatcaaggcttcctgagaggggggagcgatccgagaagcgatggggcagcaatcggcatttaa

SEQ ID NO: 3685 - DNA, 477 bp, Bacillus licheniformis
gtgagcctcgactaccatatgccaaatttaattctcgatgaaacggataaaaaaatcctttcgatcttgcatgaggaaggaagaatctcttatacggatttaggaaagcgtgtgggactctcaagagttgccgtacagacgcggatcaacaacttgattgaagaaggcatcattgaaaaattcacagccgtcatcaatccagtcaaggtcgggattcacgtatcggtgtttttcaacgttgaagtcgaaccccaatatttagaggctgttgccgttgctttggaaaaggagcccgccgtgacaagcctctatcatatgacagggccgagcaagctgcatatgcacggcattttcgcaaatgatcaggagatggaggaatttttgacgaagcgcctgtaccccctgaaaggcgtggtgagcgtcgactgccagatgctgattaaacgttataagagccgaatgggaatgaagctttaa

SEQ ID NO: 3686 - DNA, 570 bp, Bacillus licheniformis
atgaagcacccttaccgggaactgatcatcgcaatgacaagaacgggaatattgggctttggcggcggcccatctgttatcccgctgatccgtcatgaagccgtttctaagttcaaatggatcgatgatgatgaattcggggaaattttggcgattgccaatgcgctgcccgggccgatcgctacgaaaatgtcggcatatttaggtcataaagtaaaaggcgttcctggtgctgtcgttgctacagcagcccatatcatgccgacatgcgccgcgatggccgccttgttcgcagccgttaatgtgctcagccactcaaaaatcgtaagcggcatgatcggcgctgtcacccctgtcatcgccgtcatgctcggcatcatggcttacgaatttgggcaaaaagcattgaaaggcttcggcttgctgaccggcgtgcttttctttattcttgcgtttttgggtcttcaagtgttttccatccaccccggcatcattgtcatcctgtttttaacgtttaaattaaaaagaaaagcggcccgagaaaaggataaaggagtgtccgcttcatga

SEQ ID NO: 3687 - DNA, 537 bp, Bacillus licheniformis
atgatcatcttttatctgttttgggccttctttattgcaaacttattgggctacggaggcgggccagcttcaattccgcttaattttgaagaagttgttcagcattttcactggctgtcaaaagaggaattttcaaacatgcttgcgcttgcaaatgcgctgccaggcccgatcgccacaaaaattgcagcttatgtcggctacagcgtgctcggatggcccggtgttttcattgctcttgccgcaactgtgcttccctcggccatcgcgctcgttttgctgctcaagctgatcggccgctaccgccagtcgcaggtcgtcaaaggaatgaccttgtcggttcagccggttatagccgtgatgatgcttcttttaacatgggaaatcagcggcgacgcgatccattcgatcggcatggttcaatcacttgtcatcgcgctgatctctttagtcgccttgacgaagttccgcgtccatccggctttcctgatcgtggcggccttcgcttacggcgggcttgtcattccgctgctgtag

SEQ ID NO: 3688 - DNA, 753 bp, Bacillus licheniformis
atgatcgatattcattgccacattcttgcgggcgttgatgatggagcagcatgtatgaatgacagtttagaaatggctaaacaagccgccctccaggggattcatacgattatcgccacaccgcaccaccgaaacggtgtatacgaacatccaaaagaagccatccttgcagctgtttcgggtttaaagacgagaatgcaaaaggaaaacatcccggttctcattacccccgggcaggaaatccgcctgtacggcgaattgaagcgcgatcttgagcgcggcagactgctcagcctcgccggcacaaagtatttgctgattgaacttccttaccaccatgtcccgcgttatgccgaaaaggtgctgttcgatctccaattaaatggttacattccgatcatcgcacaccccgagcggaaccttgaattgatggagaatcccgatctgctgtaccgcctcgtcaaaaacggcgcctgcgcccagctgacatgttcaagtcttgcaggccgtttcggcagaagcgtcaaacggctcgcccgccgctttcttgaagcgaacctcatccactttatcgcatcagacgcccacaacctcacgacccgatctttcttttttgatacagtagaaaacgattacggccgcgatttcttgaacgtgtttacagaaaacgcgggcctgctcctggaaaaccgggagattcataaagaaacaccgcgtcccgtcaaaaagaaaaagctgttgggcctgctgtga

SEQ ID NO: 3689 - DNA, 723 bp, Bacillus licheniformis
atgagagatcatatcggctttaaagatgtgttcatcgttttgaaaaaaagattcgttctgatcgcactgatcaccattgcggctgctttgtccagcgctgccgtcaacttttattggctcaaacccgtctatcaggcatccgcccaaatcctcatcaacggccgtcaaacgtcgaacttcaccgacatccagaccaaccttgaacttatcaacacatacaacgtcattatgaaaagcccgatcattttaaataaggttaaagacgaacttaacctttcggaaacggctgaagacctgaagcaaaaaatcacggttatcagcgaaaatgaatcgcagattgtcagtatctccgcgactgacaaggattattccaaggcggcggatatcgcgaatacagtcgccgccgtatttcaaagagacattggcgatattatgggtgaaaatgccgaaatcagccttgttgcgaaagccaatcccgatcattcacctgttcccgtcagcccgaacaagaagttcaacatcgctctttttacagggttcggccttctgtttggcgctgggctagcatttttgctcgagcttttgaaaaataccgttcgaaatgaagaagacatcgaaaaagatctgaatgttcacgtgttgggaaatattctgtatgtaaaaccgaaaaaaggacaggccaggaagctggaaagctttgtcggcaaagaccatacattctga

SEQ ID NO: 3690 - DNA, 1599 bp, Bacillus licheniformis
atgcttcaagacatgatctcaaaaacggttgtgatggatgcagctgaacagtttaagcatgtactgccgtgcacagaagaaaacattcagctcatgaaaaaagcccttattttatacagacaggattccgtctatcgggtcaagccgatgagcgggcatacggtcagcgcttacgtccaggacgttgtcccggtaaaggtcttcatcgacctcgccgacgttaaaaaaagcagctgttcctgccctgctcaaaacatgtgccgtcatgtgcttgccgtttacttatatctatatgcacaatatgatcgattgggaacatttacggagttttggaaggaagcgcaaaaacgccgcgaaaaccgggagattctcggacagcttcagcgcggaatgaagccccgcagccacacgctcgatcaatggacctcctttttcaatacggagttcagacgctgggaggagcatacgcctaaaaaccagcaaacgatgcaatacctttactacgggtatttttcagctttaaaaaagcggacgcctgcggagccggagctgaaaaaaatgtatcaaatccacgcggctcttgcgacatggcttgctatgcattcactcgtcgagaaagggcgcatcgatcctgaaaaagatttttactcgctgaatccttatatcgaacagctgatggatacgatctacagctcgatcgatgaactgaaaacatatgcgctatcgttctcccttgacccgtttttagaaaaaacccccggcgtgattcgggaactgctgctcaagaaagatattttccagtatgaaaggctgcggattttcggggagatctggagtgcgcttctatcccggccaaactggctgaagcgggagctcgatgtgctgaacaatctggagccttcgcctgaaatacaattcggcaggctgcatcttgaatttctgctgaaaaacgatgatgtgattcttgatcaagccggatcgttttcaccggagattcttccgtatacgtttcaatggctcagtgtcatgaccgccaaaaaggactggaagcgcctgaaaaaatggtatgaacaccttgagcagctggcggccggcttctgcagactggataaaccgtaccgggaaatacgcgatgtactaagcgaattcttcctgtttctaagcgattacagcaaaaacgcaaaagaagagcatgtatttgaacggtattgcaaagagtgccttccttatacatttactgaatacagccattttttatataacaaaaaccgctttacggagtggatggagatccacagccttgtcggtttttcaatctctgagatagggcagaacgccttgaaagacattgcggcagcggctcctgaagcattgatcccttcctatcacagagaaatttccgggctggttgaacaaaaaaaccgctcaagctacaaagaagccgtcaaacaattaaaaaagctgcgcaccctttataaaaaagcgaaaaaacaggatgtctggaaccggtttatggagcagttttcagcccgctataaacggctgagagccttccaggaggagcttaagaaaggaaagttgatcgatggcgagtcttaa

SEQ ID NO: 3691 - DNA, 2766 bp, Bacillus licheniformis
atggcgagtcttaaggaaatcgtaatacatgtcgaacagtcagaagactatacatttattttatcttgtcatgacggggatcatcagtttcttacgcgaaatgaaatggaaaggcatttgtttcagtggcacgaatcgtctttttacggaacatttctcgaggaagccggtttagatacccctgcggttctgctgtccccgtggatggcggtcgaatttctcggcaaaaactcatttaattcattcagcgacatcatccttactgaggaaactgaacctttgatgaaaacggcttccaccatttatgagtttatcgcagatgaagactttcttcccgactatgaagcatggaagcaggaaatgctgcgctggaaagataaagaagggattttggaaggctatacagccgaatggttttcacacgctgtcgaagactacatcaactacaatgacgaattaaaagcaaaatgggaatcgattgtcgcacattcccccgcagtcaccacatttcagggacattttcttgatgaagacgattttcttgaaacgattggctggcatgaaaaccctgtgccgtttaccgtcggactccgcttaaatgaacctgactttgacggagacgattggaaaatcgaactgtttttgcgcgacaaaaaaagcggagccattcagttctttgaaggcttgaacaggctgaaaaaatcgtggcaggcatacgctgataaaatcgaccgagaacaagacaggttccgccaaatcgtgccctggctgacgatcgaatcggggacgtcgcttttaacggaagaggaagcatggatcttcctgtccgaagctagcgaaacacttgtcagcatggggattgaaattctgctgccgtcatggtggcaaatcgtgagagacagcaatatgctgctgaaagcaaaagtgtcatcggctccccgcggcgagtcttttgtcggaatgaatgcattgatggacttcaactggcgttttgccaccaatggaattgaactcacagaggaagaattcgagcagcttgtcgccaataaaagacggcttgtcaatatacgcgggcagtggatcaaaatcgacccgaattttatcaaacaaatgaaaaagctgatggagcgggcagaaacagaggggcttcatatgtctgacatcctggcgcgcgagctgacagagcggagcgaaacccgcgaggatgatgatctgttcgatgcttccgcattcagcgatgtacggtttgaactgtcctatcagctgaaaaacatgatcagaaagctgagccagcgcgatgatctcccgtcatacccggtcagcaaatattttcacgggacgctcagagcttatcaggaagacggtttgaactggctgatctttctcagaaactgcggcttcggcgcctgcctggcagatgatatggggctcggaaagaccattcagatgatcgcctatttcgcctatttaaaagaacagggacaacaaacgccgtctcttatcattgcgccgacttccgtcctcgggaactggcagcgcgaactcgagaccttcgcgcccggcctgacggcagcgctccactacgggccaaaacgccctaaaggtgaagcgtttcagacatcttacaaagatgcggatatcgtcttgacgtcatacggcctcgcccaatccgactttgacgatctcagcagcgtcgcctggaactgcatctgccttgacgaggcccaaaacattaaaaatgcgcacacgaaacaatcccgttcaatcagaaagctgaaaggactgcatcatatcgcgctcagcgggactccgatggaaaaccgcctgacggagctgtggtcaatctacgatttcatgaacaaaggctatctcggaagccttggcagcttccataagcgttttgtcctgccaatcgaaaaagaccgcgacgaaaaacggatcgaacagcttcagcagctgatcaaaccgtttttattaagacggacaaagcaggacaaagaagtcgcgctcaatctgcctgagaaacaggaggaaaaagagttcgttccgctctccgcagaacaggcttcactatatgaacagcttgtcaaagatacgtttgaacatatgtcaagcctcgccggaatgcagcgcaaagctctaatcttaagcatgctcggcaagctcaaacaaatctgcggccaccctgccctttacttaaaagagaccgggagcgagctccttaacggaaggtcagtcaagctcgaaaaactgctggagctgacgaagacgattcgcgaaagcgatgaaagctgcttgattttcacccaatatctcgggatgggagatatgatgaagcgcctgctcgagaagtcattcggcgaaccggtcaagtttctgaacggcagcttatccaagcttgaacgggacaaaatggtggagcagtttcaaaacaaggaatttccgattttgatcttatcattaaaagccgggggcacaggcctcaatttgacggccgccaatcacgtcatccattatgacagatggtggaatcccgcggttgaaaatcaagcgacagaccgcgcctacagaattggacagaaacggttcgtccacgttcataaactgatcaccaccggcacaattgaagaaaaaatcgaccaaatgctcgaatcgaagcaatcgctgaacgatcaaatcatccaaagcgaaaattggatcaccgagctttctgagcatgaacttgaggagttatttaccctgaacgcttcggctattacaggttaa

SEQ ID NO: 3692 - DNA, 879 bp, Bacillus licheniformis
atgaaaatgattgcggtcgatttagacgggacgctgttaaacagtgaaagcaagatctcaaagaaaaatatcgatgcgattaaaaaagcgcgggaacacgggattgaagtagtagttgccacggggagagcatcctttgatgttcaaacgatatttgagccgacaggtattaaaacatggattatcagtgccaacggagcggtgattcatgatcctgaaggcagcctttaccattcggtgccgcttgatcggaaacgggcagaaggaattcttcgatggcttgaagaaaataactactattatgaggtgttcagcgatgaagcaatcttcacgccgcaaaacggccgcgagctgcttgacattgagctggaccgcttgaaaagcgcaaatcctgaggcagacctatcaaggctggaactcgcggctgaacagcagctcagccaaaacggatacgcgtacatcagctcctataccgatctgtttttagccggaaaggatgttaatgtatataacatattagctttttcttttcataaggaaaagctggaaacgggctggaggcaatttgaagatgcacaagatattacgcttgtcacttcagccgagcacaactttgaaattgagcatcttcaggcgtcaaaagggctggcattggagaagctttcacacaagctcggcatttcccttcaggaaacagctgccgttggagacagcctcaatgatttttcgatgctgaagatcgcggggaaaagctttgccatgggcaatgcgcgcggagacattaaagagatggctgatgaggtgacgctcactaatgatgaaaatggcgttgctcacatcctgcatcagctgattgaacagcaagtcaaaccggtttaa

SEQ ID NO: 3693 - DNA, 771 bp, Bacillus licheniformis
gtgtaccaagaggaaaggctaatttccatcatcgactatttaaaagagcataaacggatttccgttgaacaaatttgttctttattcggagtttcaagagatacggcaaggcgggatctggttaaactgcaagagcaaggcgccattatcaggacaaggggcggggcgattctgcccaccgttcatgatgaggtcaaagactattcgggcaggctgggcatggtttccgaagaaaaaagcatgatcggaaaagcagccgcttctttaatcagagaaggcgaccgcattattttggacgcttccacgacagtccaatcatgcgcagagcatttgccggatgtcaattgcacgatcatcaccaattcgattaaccttgcggacgttctttcctcaagaaaaggggctgacatccgcctgcttggaggaaagcttcaaaaagagcaccggtttttgtacggcgcctctgtcattgaaaagctgtcatgctatcatgttgataaagcgctgatcggcgtggtgggggtttctgaacatgggcttacaatcgcccatgaggaggacggaatggtgaagcggaaaatgatttcccaagcgaagcaagtcatagcgcttgccgaccattcgaaaatcgggagaacggatttttaccgatacgctgaactcagtgacattgaccttctcattacagaccggctgccgtcgaaaccgtttcagaagctgcttgatgaacacgatgtggagctgcttgtggctgaacatcacgatacttaa

SEQ ID NO: 3694 - DNA, 666 bp, Bacillus licheniformis
atgaacatgctgattgattcagcgcatataccggagattgaaagattgcttgattcatttcccgctggcggcgtcacgacaaacccggcactgatcgcaagggagaacaagccttttaaacagcagattcaagatattcggcggcttcttcccgagcatctgcctctccatgcccaagtgatcgccgaccattggcgggatatggtcgatcaggcgaaggcactctataactggctagatggaaacgtgtctgtgaaaattccggtgacgactcaagggctttacgcgatcagaaagcttgcggctgaaaatatccagaccaccgggacaacggtttataccgctgcacaggctgtactggcggcaaaagccggcgcctcctatgtcgcgccgtatgtcaatcgcattgatcaagagtatggtaatggcgctggcgttgtcaaaacgattgtcggcttattcaacacaaactgtttaaattgcaaagtgcttgcggcaagctttaaacataaccgtcaaattcttgccgtcatggaagcggggagccatgaggcgacaatcagccctgagcttataagccgtttggctgatcatccggctgtagatcgtgatatccatgcgtttcgtgagatttggcactctcaatatggaacattttcattttaa

SEQ ID NO: 3695 - DNA, 786 bp, Bacillus licheniformis
atggagatgaataaaggaaaagtggcattgatatgcggcggcggccaaagtctcggagaagcgctgtcctaccggatggcagaggcgggatatgacatcgcggtcgcagacatcaacggcgagaacgccgaaaggacggcagatcatgcagccggtcaatacggggtcaaatcgctgtggattcaagcggattttacaaaggaagccgatgtgaaaaaaatgatcggcagggtcacggacgaattcaataaaatcgatgtgatggtgtacagtgcgggaatcgccaaaagcaataaaatcacggattttgaacttgaagactgggaacggaccatcgaggtcaatttgaccgggtattttctttgcgcgagggaaacgtcaaaggtcatgattgagcagggaagcgggtcaatcattcaaatcaattccaaatcgggaaaagtcggcagcaagcataatacagcttattcagcttctaaatttggaggggtcggtctcacgcaaagcctcgcgcttgatcttgccgaacacaacattcgggtgaacagcattatgccgggaaacttgttaaaatcgccgatgttccaaagcttgatcccgcaatacgcgaaaaagctcggcattccagagagcgaagtagagcgcgtgtacaccgaaaaagtgcctctaggacggggctgtacgtatgatgacatcgccaatgccatcttattttacgcctctgaccaagcatcttatatgacgggtcaatcgatcaatgtaaccggggggcaggtcatgcattaa

SEQ ID NO: 3696 - DNA, 372 bp, Bacillus licheniformis
atggtcatgctttatgaaacaaaaataaacagaatcggagctcaagcagcggcgttttcagatgaaaagatgctcatattatttggtgaaggtgctccggatgaattgaaagattattgtttatcaattgatataaagcctgtagaaggcgacttcaatgaaggcgatgagctcatactgggcggcgagacctacaaaattacagccgttggcggagccgttcgtcaaaacttggcgaatctcgggcatataacgctaaaatttgacggatcagtttcagccgaactgccgggaacactgtaccttgaacgaaaagaacaactgccggaggtttcagcaggagactgtattcaagttaaaagattctcataa

SEQ ID NO: 3697 - DNA, 1008 bp, Bacillus licheniformis
atgagttcctatcgttcggttgaagtttcaaaagggcctggagggtttggcggacctctggtgatcacgcctgatgaagagagaaataaaatcgtgtacgtcaccggcggaaacaaacccgattttgcggatcatttagctgagctgacggggtgcaccctggtcgacggctttaaaacgacagtacccgaaagcgaaatggccgctgtgatcatcgactgcggagggacgctgcgctgcggactttacccgcaaaagcgaattccgacgatcaatgtgatggcgaccgggaaaagcgggccgcttgccgcccatattacagaagatatatatgtttccggagtaaaaaaagagaatattaaactgctgggagctgtggaggagcctgaacagtctaatattccagaagaaaaacaaatacaaaataaacaaaaccattatagcacagagaaaaagattagtgaacagcagtcgccgaaagggatgatggcgaaaatcgggatggccatgggatcgatcgtcagcacattttatcaagctggacgggaagcgattgaaaccgttatcaaaacaattcttccgttcatggcttttgtggctctattgatcggcatcattaaagagtcaggcatcggagacatttttgccaaatatttatcaccatttgcaggctcactgcccgggttgctactaatctcgcttgtttgttcatttccactgctttccccgttccttggaccgggggcggtgattgcacaagttgtcggttctctgatcggcgttgagattggcaaaggaaacattccgccgaatttggcgctgcctgcgttatttgcaatcaattcacaagccgctgccgactttgttccagtcggtctgggtcttgcggaagcggaagtcgaaacggttgaagtcggggtgccgtcggtgctgtattcgcgttttctcacgggggcgccaaccgtttttattgcttggctggccagctttggcatgtatgacagctga

SEQ ID NO: 3698 - DNA, 549 bp, Bacillus licheniformis
atgaaaaacgtaacatggcttgcggaaaagtttatggacttattcaggcatggcggagaagtgtttgtcggtatgcttacagacatcgttcctttattgattatgctgcttgtcgccatgaatgctctgatacgcctgataggagaaaagcgcgtagaagcgcttgcgaggaagtcgggaaaaaatccattgaccagatacatggttttgcctgtcatcggtacgttcatgctcgcaaatccaatgacgctgtcgcttggcaggttcttgcctgaaaaatacaaaccgagctattatgcggctgcatcctattcgtgccacacgcataacggacttttcccacacgtgaatccgggcgagctgtttgttttccttgggattgccgcagggattacaacgctcgggcatgaaacgacggagcttgctctccgctatcttttagtcgggattgtgacaaactttctcaggggctgggtaacggatatgacaacggcttatgtcgcgaaacagcagggcattgccttgaaagattcgattgatcttaaataa

SEQ ID NO: 3699 - DNA, 444 bp, Bacillus licheniformis
atgatcatttactttatcatcgcccttggagctgcatggcttctccagagcgttttaggtttttggcaaatcaggcatttcaatcgaacgttcgccgcgtacaggcgtatagggagagtcgcggtcggaaggaagaccggcttactcagagccggaacggtcgtcctgtttgtcatcgacaaacgcaacaaaattttgaaggcatcaaaaatgcaaggtgtcaccgtcttttcaagaatcagacctttaaaagggtttgaaggaaagtatttgctgaagatcggacaagcggagcttgcccggcacgaccgcctcacacgtcttgcaattgaagatgccttgagaacattcgacatcatcacgaaagggggtgatgttccgcagaagaaaacacggcttcaaaaactgatgagctttcaaatcaaaaaaagaggtgaaatatga

SEQ ID NO: 3700 - DNA, 963 bp, Bacillus licheniformis
atggaaatgagggatgataaacgccttctgatcaaagtctgcaaaatgtactacgaagaggatatgacacagagccagattgcaaaagcaacagggatatacagaacaaccgtcggacgtatgctgaaaaaagcgcgtgaggcaggaatcgttaaaatcacgatcgatgaccatgtcgggacacactatgatttggaacgggagctcgaacagctgctcgggcttaaagaagtgtacatatgtgatgcaaaaccggaacaaacagctgaagacaagaagaaactcgtcggcaaagccggagccgaaatcttaaaacgagtcgtgaaagacggggatacggtaggcttcgcatgggggacgacgatggcgggaatgatcggggagtttcacggcgtcaaaaaacggagcgcttcattcgtgccgctggtcggcggtccgggcgccatggatacgaaatatcacgtgaacagcatcgtctacagcattgcgggtgactttggaggcacgccttacttcatagatgcggcagccgttgtcgaaaaaaaagaaacgaaggaggaaatcgtcaagtcccactatttcaaaaaaatagaaaggctgtggaacggccttactgtggcagccgtcggaatcggggcgccgcttagttcttcaaatatgatctggaccggattttacggcgatcaggatatcgagcgccttgaagaaaaacatgcagtcggagatatatgctcgcgtttctttgatcgttcgggagctttagtagaaacagagattcatgacagaaccatcgcgatagacatcaacaggttaaaggatttggaatattccataggtcttgccgaatcccatgaaaaagttccttcgattatcggggctgcaaaaggccgctatattaatgttttagtgacaactgccgaaacagccagagaaattgccgaggaggtgagaaatcaatcatga

SEQ ID NO: 3701 - DNA, 348 bp, Bacillus licheniformis
atgtttaatgagatcatgctcgtcgggcgtttgacaaaagatcccgaactgcggtatacatctgacggtgtccctgttgcaaatgtgacgctggctgtcagcaggcctttcaagaacgcagcaggcgaagtagaagcggactttgtcaattgcactctatggcgcaaaactgccgtgaacacagccgaatattgcgaaaaaggctccatcatcgggctgagcggaagaatccagacccgccaatacgtcaattcagaaggcgaacgcacctttattacagaagttgtcgcccggtcagtcagatttttgggagaaagccggaaagcgcatgagccggctgatgcttaa

SEQ ID NO: 3702 - DNA, 372 bp, Bacillus licheniformis
atgaaccatttttacttaaaggaagtatttgtgatcgcaagcaattcagctgctgactgccgtcaatatatgcctatgatttgcttttcagccggtaacaaaaagcacgaaatcagcacatatgcaaatgaaggcatcatgtttcgctatgaaacgaaggacggaatggaaatatacgaatttcaagtaacgcttaaacagaaagagttgtcattccgtctgtatgcttgggacgggggctcatatgtccgcgtatactcagagcggtggctgtcatctcctgttttttttcagtttctgaaaaatacgtatttctcaaataaaaatgaaatgatttttatgattagtggaagaaaaaagcaaaaattatga

SEQ ID NO: 3703 - DNA, 414 bp, Bacillus licheniformis
atgaaaacctttaggcttattgatttaaaaattgtccgccaggatgacacttcaaagcggcttgaggagttcccgctgatcgacggccttatcattaataaggaagacggagaaaaccactggatggttgaaggtctggtttctaaagaataccggtattttttcgaatatctccttcaggaaggcaaagaagtgaaagcatatgtaacgatcacgaaaaaaagcaaccgcccagcacagctgttagcgaaggtcaaaaacatcacggtgctcggcgagcatgtttccgtcttattggacggcaaaatggtcagctcaaagctgaggaaaggctccgacaagattttggaagatttaatgaaagaaggatattccggagatcggcttcttgaagcatttaagcaaaatatataa

SEQ ID NO: 3704 - DNA, 381 bp, Bacillus licheniformis
atgtggaaagaatttaaaagttttgcgattcggggaaatgtaatcgatcttgcaattggtgtcatcatcggaggcgcctttggaaaaatcgtaacttcgcttgtcaatgatttgatgatgccgctcctcggtcttctgcttggaggcctggatttttccgcgctgtcgttcacatttgttgatgccgaaattaaatatgggctattcattcagtcgatcgtcaatttctttattatttcgttttccatttttctatttatccgctatatctctaagctgaagaagaaggatgccgaagaagaaaaagctgctcctgatcctcaggaagaattgcttaaggaaatacgggatttgttaaaagagcagacaaaccgttcttag

SEQ ID NO: 3705 - DNA, 435 bp, Bacillus licheniformis
atgcttgatgctcagcaaattaaagaaatcattccccaccgctatccctttctgctggtagaccgtgtgacagaagtagaggaaggaaaacgggccgcgggttataaaaatgtgacagtaaatgaagagttttttaacggacactttccggattatccggtgatgcctggtgttttaattgttgaagcgcttgcgcaagtaggtgcggtggcgcttttgatgaaggaagaaaaccgcggaaggctcgcgttttttgcgggaattgacagctgccgcttcaaaaagcaggtgaaaccgggcgatcagctccatcttgagcttgaagtgcttcgtttccgcggttccatcggcaaaggaaaaggagtcgcaaaagtggacggagaagtcgtgtgtgaagccgaattgatgttttctcttggtgaaaagcaggaataa

SEQ ID NO: 3706 - DNA, 816 bp, Bacillus licheniformis
atgatcacggcttcaaacacaatgtttgaactgcaaaaacaaattgataatatcagccataatcttgcaaataccgatacaacgggatataaggcgaaaaacacgagcttttcggagctgatcaggcagcagattgaacaggtaaacgagaaaaataatgaagtagctgcaagcagaaagacgccgccaggacttcgcctcggcgtcggagccgtcatgaccgaccggctgacgcataagcagggaagccttaaggagacgggccgcgatcttgatattgcactgacttctccttatcagtacttccaggtcaatgtcggcggggaagtgcaatatacaagagacggggcattttaccttacgcctgcggcggggaacgccaaccagatgcagcttgtgacgaaagaaggacatgccgtccttgatgaaaacggaaatgccatccgcttcaaccagcgctataaacacatcaaagtcgatgaatcgggaagtgtcaccgtttcgtcagacaatcagggagaagcgccactgcgttttaacctggggatcgtccgggctgtcaaacctcaggctctaacagaagaaggaagcaaccttttttctgtcagcgatgaattgagagcaacggctcttatcaacctgaacggagccgggcggcaggacatttctctaaaacagggattccttgaatcatcaaatgtcgacgtatcgaaggaaatgaccgatctgatctcttcgcagaggtcatatcaaatgaattcccgcgccatcacgatgggcgatcaaatgatggggctgatcaattcagtacgttag

SEQ ID NO: 3707 - DNA, 840 bp, Bacillus licheniformis
atgttaaaaggactttatacagcaacttcagcaatgatcacccagcagcgccgcacagagatgctgacgaataatatcgcgaatgcaaatacgccgggatataaagaagaccaaggatcaatacgttctttcccggaaatgcttttgagccggattgagtctgattctttcaaagccggcagcgcttcgcgttcgttttcaacacagacgccaatcggttcaatcaatacaggggtttatatgcaggaactgaagcctcaattttctcaaggcgatctgcaaagcacgaatgagccgacagatattgcaatcagcgaagccgaagttccggtcaacggcgaaacaaacgataaagcggcgcttttctacgcggtccggcttgaaaatggggatgtacgctattcaagaagcagccgtttttctttaaatgaaaataatcaattgacaataaacggccgactcgtcctttcaacggaaaaccggccgatcacggtgggaagcgagaattttcaagtcgctgaggacggaacggtgactgaaaacggccaaaatctggggaggatcgatgtcagaatcgcgctcgatacgagaaatttagcaagagaaggcgatgatctgtatcgtactgaaaacggtgaggcgctgccaagcgcagtcggcaatcctgaagtcacttattctgtcaagcaggggatgaccgaacggtcgaatgtcgacgtgacgagagcctatacggaaatgaccgctgcctaccgctcgtttgaagccaaccaaaaagttcttcaggcttatgataaaagcatggaaaaggcggccaatgagattggaaggatcggataa

SEQ ID NO: 3708 - DNA, 1002 bp, Bacillus licheniformis
atgtttgcaagggatattggtattgaccttggtacagcgaatgtgctgatccatgtcaaaggaaaaggtattgtcttaaatgaaccatcagtcgttgctcttgacaaaaacaatgggaaagtgctcgctgtcggtgaagaagcaaggagaatggtaggacgtacacctgggaatattgttgcgatacgtccattaaaagacggcgtcattgccgattttgaagtaacagaagccatgctgaagcatttcattaacaagctgaatgtaaaaggtcttttctcaaagccgcgcatgctgatttgctgcccgacaaatattacttctgtggagcagaaggccattagagaagctgccgaaaaaagcggcggaaagcatgtatatttggaggaagaacctaaggtggccgcaatcggagcgggaatggatattttccagccaagcggaaacatggtagttgatatcggcggtggaacgacagatatcgcagtcatctcaatgggcgatattgtcaccgcctcttctattaaaatggctggggacaagtttgatcttgaaatcttgaactacatcaaacgcgagtacaagctgctcataggcgaacggacagccgaagatattaagattaaagtcgcaactgttttcccagacgcacgtcacgaggaaatttccatccgcggccgcgacatggtcacaggattgccgagaaccattacggtaacgagcaaagaggtggaggaagcgctgcgcgaatctgtatctgtcattgtacaggctgccaagcaggtgctcgaaagaacgccgcctgagctgtcagccgacattatcgacagaggcgttatcattacaggaggcggcgcattgttaaacggtcttgaccagcttcttgccgaagagctgaaagtgcctgttctcgttgctgaaaatccgatggattgtgtggcagtcggtacgggtgtcatgcttgataacatggacaagcttcccaagcgcaaactgagctga

SEQ ID NO: 3709 - DNA, 276 bp, Bacillus licheniformis
gtgcacgattacatcaaagagcgaacaatcaagatagggaagtacatcgtggagacgaaaaaaacggttcgtgtgatagcgaaggagtttggtgtttccaaaagtaccgttcacaaggatttgacagaaaggctgcctgaaattaatcctgacctggccaatgaagtaaaagaaattcttgattatcataaatcaatcagacatttgcggggcggagaagcaacaaaactaaaatacaagaaagaggaaatctttgaaagagaacccgtgcaataa

SEQ ID NO: 3710 - DNA, 111 bp, Bacillus licheniformis
gtgggagtatttcaaaattctacttggaaaagcataaaacgaagaagctgcgcaaatagcgaattttttcacaagacggatctcatttcacacttctcacatccattttag

SEQ ID NO: 3711 - DNA, 429 bp, Bacillus licheniformis
atggaacatatcaatcgaaagattattcaccagctcaatcaaagcactcggatggttgctaaaaaaacgaatgaacagctcgaagcgtacggcctttacggttcacagtggtcgatcctatattgtcttcacacctacggaccgatgacgcagaaagacatatggacttatttgcacgtcgaagcgccgactgtgacaagaaccgtcagccgcctcgaaaaaaacggctgggtcgaacggatacagggcgatgacaaacgggaaaaagtcgtcaagatgacagaagaagccaaaattaaatatgatgacattcaattaaaaatgaaagaatttgaagaggaaatgctttccgtatttgaagaacgggataaaaaaatattccaaaggctgttaagtcaattgttagaaggacaccaggaggagttgtag

SEQ ID NO: 3712 - DNA, 1194 bp, Bacillus licheniformis
atgaagcaagctgaacccatttggaccagggattttatcatggtcgttttgattaatttgtttatattcgtctatttttacgcactattgaccgtgcttccggtctatgcgatgcaggagctcggcggctccgagtcagagggcggccttttgatcagcggcttcatgctgtccgcgatttttgcaaggccgttttcgggagctgttattgagcgttttggcaaaaagagaatggcactcatcagcgtcgtgctgtttactttggcatcatttctttatatcttcattcacgatatctacctgctgcttggcattcgctttttccaaggcatttggttcagcatcatcaccacggtgacgagtgcaattgcagccgatttaattccgccggcccgccgcggggaagggctgggctattttgctatgtcgatgaatttggcggttgtcatcggcccgtttatcgccttgaacctgctggataaaatgagtttttccgatctgtttattttattttcaggaatcgtcactgtagccatcctctgtacggcactggtgcggattcctaaaggaaacgacatccgttcagctgtgttcaggctgtcattttccaacatgtttgaaaagggcgcgattcggattgcaacggtcggcttgttcgtgtcgttttgttattcaagcgtgatttccttcatctctgtttatgccaaatccctcggccttattgaagcaagcagctatttctttatggtgttcgcggtgacaatgatgatcacgcggccgtttacgggaaaactgtatgataaagtcggcccgggagtcgtcatttatccgtccattatcattttttgcgccgggcttttcctgcttgcttttacaaacagcagtgcgatgcttttgctatccggagctgtcatcggcatcggctacggatctatcacaccgtgccttcagaccttggcgatccagtcttcgccgcctcaccggagcggctatgcaacagcgacttattttacgctgtttgataccggcatcgcagtcggatcctatgttttcgggttggttgtggcacaagccggtttttcaaacatttatttattctcaggcgttttcgtgctcatcaacctgtttctgtatacatggagccaaaaacctgcatccgcaaaggagaagcgggatatatcaatggctgaataa

SEQ ID NO: 3713 - DNA, 579 bp, Bacillus licheniformis
ttgaactattggctttttacacgcattcatcaattagcaaaccacaacgacatcctggatggcgccatgattttgattacagaaaaagcgatttatatgtatgcgctcattttgcttttgatctggatattcggaaaccgttcttataaaataaccgttcttcaggccggtgtgacgggtattttcggattggcggcaaattatttgctgtcattggtttactatgagccgaggccatttgtcgctcatcatgtggacgtattgattcaccatgctgccgacgcctcatttcccagcgatcatacaaccggggcgttagccatttcgatcgctttttggctttatcatcggaaaattggaagctgcctgattgctttcgggttattgacgggcttttcccgtatttgggtcggacaccactaccctgttgacgtattgggcagcattttggtcgctttattcgtatcacttgttatgtttagattctccacgtatgtgcagccgctttttgaacggatcatttcactctatgaatcgatcttgcggaaattgcggaaagcggtatccagaacggtataa

SEQ ID NO: 3714 - DNA, 930 bp, Bacillus licheniformis
atgagtaaagtacttatttttggccacaaaaatccggatacggatacgatttgttcagcgattgcatatgccgaattaaaaaaggagctcggcatggacgcagagcctgtccgcctcggcgaaatcaacggcgaaaccgaatacgcgcttaagaaattcaatgcagaagtaccccgccttgtgaacactgtcgcgaatgaaacagacagcgtgattttggttgaccataatgagcgccagcagagcgtcgatgacttggatcaggttcgcgtgcttgaagtcatcgaccaccaccggatcgccaactttgaaacgagcgaccctctgtattaccgcgcagagcctgtaggctgcacggcaacgatcttaaacaagctctataaagaaaacggcgttgaaattaaaaaagatattgcggggctgatgctgtcggcgatcatctcagattccctcttattcaaatccccgacatgcacggaagaagatgtcaaagctgcaaaagaattggctgcgattgccggcgttgatgctgacagctatggactagatatgctgaaagccggagctgatttgagcgcaaagacgattcctcagcttctttctctggacgcaaaagagtttacgatgggaagccataaagtagagatcgcgcaggttaacactgtcgacacaaacgacgttctctcccgcaaagaggaagttgacgcagaacttgcaaaagcggtatctgaaaaagggttggatttatttgtgtttgtcgtaactgacattttaacaaacgactcggttgtcgtcgcttcaggacaagctgcacaagcagtggaaaaagcgttcaatgtcacattggcagacaacacagcgacactgaaaggcgttgtatcgcgcaaaaaacaaattgttccgccgttaaccgaagccttaaaaggttaa

SEQ ID NO: 3715 - DNA, 822 bp, Bacillus licheniformis
ttgttcaagcatacgaaagtgctgcagtaccctgccaaacctgaaagacccgaccctgtcttcgcaaagaaaatgcaggagatactcggcggccagtacggagaaatatctgtggcgatgcaatacctttttcaagggtggaatacgcggggaaatgaaaagtataaagatttgctgatggatacggcggcagaagaaatcggacacgtcgaaatgattgcgacgatgattgcacggctgcttgaagacgctccggtttacgagcaggaaaaagcagcagacgatcctgtcatcggcgccattatgggcggaatgaaccctcatcacgcaatcgtttcaggtctgggggccatgcctgaaaacagcaccggcgttccttggaatgcaggctatattgtagcgagcggcaaccttctggccgacctgcgcgcaaatgtcaacgctgaatcgcaaggcagactgcaagtcgcacggctgtacgaaatgacggatgacaaaggcgtacaagatatgctcggttttcttttggcaagagatacgatgcaccaaaaccagtggattgccgcgatcaaagagctggaagaaaaagaaggcgtcatcgtgcccggtaccgttccgccagaatatgaaaaagaagaagtttcgcactctttatacaatttttcggatggagaagaaagcgcacagtttgagtggctgatagggaaggcgccggacggagcggaatttcactatgagagcggccctgtcgcatatggagaaaaaccggtcttgaagcccgctccaaaacgaagccacaatacacctgactatggagaataa

SEQ ID NO: 3716 - DNA, 738 bp, Bacillus licheniformis
atgataaaaaatacttctcaccgcccttttccactgcctgaaggaccgtggatgatgacgcaaacatggaatcatgtattatttgcccattgggctgtcgatcctgaagccattcgcggacaaataccggcggccttggaattggagacattcaacggaaaagcgtggatcggtatcttgccttttctgctgacaaatatgcgtccccgttttttgccgccctttcctttcatcagcagatttcccgagctgaatgtccggacatatgtagcatataaaggcgtcccgggcatttattttttcagtcttgacgccgcttcgcgcttggccgtcgccggcgcgcgctcaatgttccacttgccttatttttacgccgggatgcgctttgcacaacataaagaccgctttcagctgacaagcaggagaaaacgttcacaagcagagttttatgcagaatatcaaccggtttcggagcctttctcagctgataaaggaacgcttgaatactggcttgctgaaaggtaccgtttgtacaccacgcataaaaacgagctctattatgaagatatccaccattcagagtggcagctgcagcaggctgaagctgatatttttccggatccgctcacaagcgcaaacgatctcacactcccagacaccgcgccccttcttcattatgcaaaaaggcagcacgtcttattttggccgctgaaaaagtgggaaagtgaagaaacataa

SEQ ID NO: 3717 - DNA, 408 bp, Bacillus licheniformis
atgaaactgaaggacatcatgacaaccaatgctgaatgctgcgagccttctgccccgattgcggaaattgccggtaagatgcgtgattacaatgtaggttcaattccggtctgcgagaacggaaaattgacggggatcgtttcagaccgggatattgttatcagatgtgtagctgaaaatgaaacagatgcggctgctcgggatatcatgagcacacagatggtgacagggcgcccggatatgtctgctgaagaggctggtgatctgatggcggaacaccaaattcgcaggctgccgattgttgaagatgaccgtcttgtcggaatcgttgctttgggggatctctccgtctcacatgcggatgagaaagcgggagaagctttaagcgaaatttcaaaaccggcttaa

SEQ ID NO: 3718 - DNA, 957 bp, Bacillus licheniformis
atgagagtttttcagggagagggctggacatggtatcagcttggccctcacgaaaaaacaacagcacaagggctgatccagcccgatcattggccggaatgccgaaactggtttcaaggcgttccctcggccaacatcaattgccttgatatcaatgctgccgttcaaggcaaggaagcgatctacggttcatatatttacgaccaggaagcggaagttcaacaaaaccggacagcatttcatttttacttaacgaaagactattttttcacaatgaatttagatatctcgcaatttgaagaggcaaacagaaggccgatcgatcaacacttaaagcgatgcaaagacgcccctgaagtgttcctggtcctgctgggcgaactgatgagaatgtatttgaaggaacttgagcactttgaagttcaccttggaaaagtaaggtggggatttcatcatgacaacaataaaagcatcattgaactgattcataagcggcgtcacgaactcctggtcataagaagtttaattttatcgatgaaaaaggttgcaatgggccttaaagaaacttttttaaccaaatcgtttgacgaaatcgaacagcgcaggacgttttacgaaatcgacagaggcatgtcattgatcaaagagtatgcgaatgaaatcaattatttgcttcattccgaggaagtggtgacatcccacagaggcaatgaaatttttaaagcgctgacgatttttacgacgatctttacgccgatgacggctttcggcgccctgtggggaatgaacttcgaagtcatgcctgaactctctttaaagtacggctatttattttcgcttattttaatcgccgtttcgaccgcccttgtgtattggtatttgaaaaagaaaggctggaccggcgatttattgagggataaaaaacgatatatgaaaaggaagggctcttttaaatag

SEQ ID NO: 3719 - DNA, 1290 bp, Bacillus licheniformis
ttgaagctgattgcagtagcaggattaatcgcatttacgggctttttcgtcgcggtcgaattcgccatcgtcaaagtaaggcggacaaagatcgaccaattgatcattcagaaaaaaaagggcgctcttgccgcaaaagaagtgacctcgcaccttgacgaatacttgtcagcctgccagcttggaatcaccgtgacggcattgggcttgggctggcttggtgaaccgacgatgcagaccttgctgcatccccttttctcaaaaatcggcttgaacgagtcgattacacatattctttcatttttggccgcttttttatcagttacttatctcaatgttgtcgtcggagagctggcgccaaaaacgatcgccattcaaaaagcggagaccgttacgctgctttttgcacagccgatgatctggttttatagaatcatgtttccttttatatggctgctcaatcattcagcccgcatgatcacaagtctgttcggcctgaagccgaccggtgaacacgaattggcctattcggaggaagaactgcgaacgcttttatctgaaagctatcgaagcggggagattaaccaaaatgaattgaaatatgtaaacaatatttttaaattcgacgaacgtacggcaaaagaaattatggtgccgcgcaatgaaatgaccgtcttatctcttgacgacagtttaaaaaaagcgaagcagcttatcaaagaaacgaagcacacccgcttccccgtcatggaggaagacaaagatcacatcaccggaatgatcaatataaaagaactgctgctggcggagcttgcaggggaattttctttagaaacaaaatcgctaaagccatatatccatccggttatccatgtgattgaaacgattcccgtctaccagctgttcgtcaaaatgcagaaagagcatacacatatggcgattctcgtagatgagtatggcggaacatcgggtcttgtgacggttgaggatattgtcgaggaaatcgtcggcgacattcgcgatgaattcgatactgaagaagtatctgctgttcagaaactcgaagatgaccattacatcctaaacgcgaaagtactggtcagcgacgtaaacgacctgcttggaattcatttatcagatgaggagattgatacaatcggcggctggatgctgacgcagaatattgagagcaagcccggaacgacgatcgaaagtgaaggataccgttttaaagtaaaagaaatggacggacatcgaatcgttgcagttgaggttgaaaaaaccgcttaa

SEQ ID NO: 3720 - DNA, 1212 bp, Bacillus licheniformis
atgcagatgggggatacagtatttatgttcttttgcgctttgctcgtgtggctgatgacgccgggcatcgctttattttacggaggccttgtaaggagcaaaaatgtgctcagcaccgttatgcacagtttatcttcaattgccatcgtttctatcatatggattttgttcggctattcactcgctttcgctcccggaaacccattgatcgggggtttggattggatcggactgcacggtgtcggttttgaacccaatgccgattattcggagacgatcccgcatacgctttatatgatgttccaattgacatttgccgtcctgacgactgcgattatttccggaagctttgcggagcgcatgcgctttccggcctttattcttttctcggtgctctgggcggttttcgtttattcgcctgtcgcccactgggtatggggcggaggctggcttgacgagctgggagctattgattttgccggcggaaacgtcgttcacatttcttccggggtagccggtctggtcgttgcgattgttctcggcaagcggaaaaatatgagcgacaccgcccctcacaacctccttctgaccctgctcggggcgactttgatctggttcggatggttcggtttcaatgtcggaagcgcgctgacgatcgatgaagtcgccatgaccgcttttatcaacacgaatacggctgcggccgcggggctgatcggctggattttggcagaatggctgattaataagaagccgacgatgctcggcgccgtctcgggagcgattgcgggactcgtcgcgattacgcctggcgcaggttttgtcacgccattctcatctgtatggatcgggcttatcggaggaatcgtctgtttctggggggtgttttcgctcaagaaaaaattcgggtacgatgatgcgctcgatgccttcggacttcacgggctcggcgggacatggggcggaatcgcgacaggtttgttcgcgacgacatctgtcaacgcagacggtgccaacgggcttttttacggagacatcagtctcctttggaaacagctgattgcgattgctgcaacatatttgtttgtcgcaatcgtcacatacgctattattaagatagtcagtatcttttttaaactccgtgcctcagaggatgaagaatcattgggcctcgatcttacgctgcacggcgaaaaagcgtatcaagattaa

SEQ ID NO: 3721 - DNA, 351 bp, Bacillus licheniformis
atgagcggtcaaatgtataaagtggaaattgtaacccgtcctacaaactttgaaaagctgaaaacggagctggccaaaatcggggtaacgtccattacgttttacaatgtacacggatgcggcctgcaaaaagggcatactgagctttaccgcggggtcaaacgcgaaagcaatgtgtatgaaaggttaaaagtcgaaatcgtcgtcagcaaagtgcctgtcgaaaaggtggccgagacggcgcaaaacgtcctgaaaaccggggaacccggtgacggcaagatcttcatatacgaaattaaaaacaccatcaacatccgcacaggcgaggaaggtcctgacgctttataa

SEQ ID NO: 3722 - DNA, 573 bp, Bacillus licheniformis
atgaacaccattccttacgtcattgagaaaacggctgccggtgaaagatcgtacgatattttttccagacttttaaaagaccggatcattatgatcggttctgaattcaacgatgacctcgccaatcgggtcaccgcccaattgctgtttttgtcagctgaagacaatgaaaaagacatttcgatctatatcaacagcccgggcggatcaacttccgcgggatatgcaattttggatacgatggattatgtgaagcctgatgtccgcacgatatgcgtcggaatggccgcttccatgggagcgattctcctcgccggcggagcaaaaggcaaacggtatgcactcaaaaacagcgaaatcatgatccatcagccgctcggcggcgtcaaaggacaggcgacagacatggagatttcagcgaagcggatcatcaaactgagggaaaaaatcgagcgcttctttcacgaacgaacgggccagcccattgaaaaactaaaagccgacatggaacgcgattactttatggatgcggacgaagcgaaggcatacggtgttattgatgctgttttgtaa

SEQ ID NO: 3723 - DNA, 606 bp, Bacillus licheniformis
atgaatgaattagaacagcaagcgctgatgaagtattgcctgagaatgacaggcgataaatgggatgccgaggatttagtccaggatacaatcctcaagttaatggaaatcaatcgaacagacgcgtcacatgcttatcaaaagacggttgcaaagcataaatggattgacctgctcagaaaaaggaagcgcgaaagctttctgtctgaagataatctggaagacgggcgggcagagcgcatgaaggcggccgatgacttcgagcacctgctgaaacagctttccggtattttaacaccgaagcaattaacgatttttctgctcaaagatgtgttttcctttcagctgcacgaaatcgccgagacgctcggtaagcccgaatcatccgtcaagtcgcttttatttagatcgcgtcagcgattaaaaaggctttctccggaggttctgcaaaaggagccggcggacggggatgacgaacacatcggtctgcttgttcgggcgatattgcatcacaaccccgatgatctgctcgaatttgccaaacagacatggcgtttcgacgcttcacagccgtcttgcatcagcatgatgaggtgcgctgcctag

SEQ ID NO: 3724 - DNA, 876 bp, Bacillus licheniformis
atgaaagaggaagaaaagaatcgtacttccaaaatcacaaagctgcaacaattttttcgtaaacgctgggtatttccggccatctatttgacaagtgccgtcgttgtattaaccgccgttctatggtatcaatcggcttctaacaacgatgtaaaagaccagcttgcagacgatggcaagaaatcagcctatgataaccgggatgatgcggtagaagtaggcaaaccagtcgaaaatgtcgcaatgccggttgctgattctgaaaatgtttccgtcgttaaaaagttttttgaaactgacgcaactaaagaagagaaagaagcagcacttgtaaactataataacacgtacagcatgagcaaaggtatcgacttggctgagaaagacggaaaaacatttgatgtttccgcatctctaagcggtacggtcatcaaagctgcaaaagaccctgtactgggctacgttgttgaagttgaacatgaagatggtttatcaactgtgtatcagtctctttctgaagtaagcgtcaaacaaggtgacaagattgaacaaaatcaagtcatcggaaaagcaggcaaaaacctttacaatgaagaaggcggaaaccatgtgcattttgaaatccgcaaagacggtgttgcgctaaacccgctgaacttcatggacaagccggtctccagcattgaaaaagcaatggaggaacaagcgtctgaagtgaaagaacctgctcagccttctgttgaagaaaagtcaaaaacagaagacaaagcgaaagatcaaacagatggaaaagacgacaaaaccaagcgggaagattcgtctgaagggtcagaaaatcaagacggaacccagtctgacgattcaagccagtcataa

SEQ ID NO: 3725 - DNA, 498 bp, Bacillus licheniformis
atgaaattacgaatcgccaatcgggaagaccttcccgcagtagtcgatatttacaactccaccattgcgtcgcgaatggtgacggcagatacagaacccgtcacgcctgaagaaaggctgaactggtttttgagccataccgaagaaaggcctctttatattgcagaaaatgaaaaacgggatatcgtcggctggatcagctttgaatcattttacgggagacccgcctacgccaaaaccgccgaagtcagcatttaccttcatgaagaccaccgcggcaaaggggcgggttctgcggtgcttgaaaaagcgcttgaagctgctccaaagcttggaatccgttctttaatggcgtttattttcgctcacaatgaaccgagcatgaagcttttcaaaaaatacggcttcaccgagtggggacactttcccggaatcgccgagatggacggaatccggtacgacttaaaaatattaggaaaagaattgaatgaagcctga

SEQ ID NO: 3726 - DNA, 444 bp, Bacillus licheniformis
atggatatggaacgtttccatcaaatgccggcctttatgaaagaggaaatggataacctcaagcgcgtggcggcgccgttcttaaagaaaaggctgatttttctttttatcgcgattccgctgcttcttgcttcatttgtttatctttcctctttttgggggcaggcagcttatggaaccgattcaatgataaaaatcggctgcgctgccgcaggtgcagcattcggcatggcgctgttcagagagtcgtcataccaaaaaagaaatgttcagcaatcggtgatgaagtatatattggaacggatgcaaacaagcgaagtgctttccgatgaacggaaaagccgctacgttcgggcggtcaaagaagagccgtttactgtaatgagaagctttttggaatttttaaatgaagaagagatcagaaggcgcaggctggctgaatga

SEQ ID NO: 3727 - DNA, 1467 bp, Bacillus licheniformis
atggatattattaaaaatatcagtatcacatcgatatttctcggttttatattagttttaaatacgcttttggcaatcgttgtgatctttagggaacgccgggatgcaagctcctcctgggcctggctcttggtgctcttctttattcccgttctcggctttatcctttatttgctcttcggccacaatttgagcaggaatcacctttttcaatgggaagaccgaaagaagatcgggattgaaaaaatattggaacagcagctgaccaagctgaaaaaccgcgagtttgaatttcgcaataaagcgacggcggacagcaaagacttgatttatatgcacattttgaataaccacgccgtttttacagaagacaatgcggtcgagctgttaacggacggacgccagaaattcgacaggctgcttcgcgatattgaaaacgccaaagaccatattcatcttcaatattatatttataaaggcgatgagatcggcaaaaagctccgggatgcgctcatcaaaaaagcaaaagaaggcgttgaagtccgcgttttgtatgatgaattaggatcaagaagcctcaggaaaagctttttcaaagagctgaaaaaagcgggaggatttgtcgaagtctttttcccgtcgcgctttaaatttatcaatttgcgcatgaattaccgcaaccaccgcaagctcgtcattatcgacggcgtcatcggctatgtcggaggatttaatgtcggagacgaatatctcggtctgaacccggcctttggctattggcgggacacgcacctcagaatcaaaggaacagcggtccactcgattcaaacgcgttttatcctggattggaatcaggcctcgcaccatcacgacattacatatatgccaaaccattttcctgacatcgactcccacggaaacatcggcatgcaaatcgtcaccagcggccccgattcagaatgggagcagattaaaaacggctatattaaaatgatatcaacggcaaagcggtccattcttattcagacgccttattttataccggacgcaagcctgctcgatgccctcaggatcgcttgtctgtccggcgttgacgtcaggatcatgattcctaacaaacccgaccatccgtttgtgtactgggcaacctattcttacatcggcgaacttttaaaagcaggcgcctccgtatttatttacgacaacggttttatccatgcgaaaacgattgtagtagatgaggaaatttcatcggtcggcacggcaaatattgatatgcgcagcttcaagctcaattttgaagtgaatgcatttttatatgatgaggaaattgcgagaagccttgtcctatcatttgaaaaagatctgcaagtgtcaagggagctgacctttgaggaatatttaaacagaagcaaatcgatccgcttcaaagaagccatttcgatcctgctgtcgccgattttatag

SEQ ID NO: 3728 - DNA, 1434 bp, Bacillus licheniformis
atgaatagaaggccgttcaatcaaaggacggttgtcagcattgtatatgtaacagccatgtttatggctgcgatggatgcgagtgtcatcaacatggcattgcctgccatcatgaccgaatttcaaacattgccgtctgctgcaggcacagttaacatcggatacttagtcagcttggcggtctgtcttcccgcagccggctggcttggggaccgctttgggacaaagcgtgttttcctagccgcgctttcgatatttacagctgcatccgccttatgcggaatcgctgacaatctggcggcgttaaacgcatttcgcgtgatccagggggccggcggcgggttgattacgccggtgggaatggcgatcttgttcaggacgtttcctccgcatgaacgggccaaaatttcgagagtcctcgttcttccaattgccgtcgcgcctgcggttgggccgatcatcagcgggtttctgacagatcagctgtcatggcgctggattttttacattaatattccgatcggaatgatcattctgctgtttggcctgttgtatcttcatgaacatttggagccggaagcgggcagatttgattggcttggattccttttggcggcgccgggaatggcgttggcggtttttgcactcagccaggggcctgcgcgtggattcggctctccggatgtgcttgcagcaggggccgggggaatgatgctcctcgcaatcctcgtttttgtcgaactgaaggctgagcatccgttgattgaacttcgcttattgaaggaccgggtttttggaatgatgagcgtcatttcgcttctgacagcaggcggactgcttggcatgctctatatatttccgctgttgtgtcaggaagcactcggctactctgcgacagatactgcgctgattacgtttcccgaagcattaggcttgatgctggcgtcccagctgatgccgaggtcgttggcaaagcttggcccgaggcgggtcatttccgttgcgctgttaggcgctgctgtgctgtttgggctgctgagcctgaccggatatgggtcaaatctttggcttctcaggctgctgctgtttttagcgggctttttcttggggcacgcggttggtgcggcgcaggttgtttgttttgccaacatttcatcatcctcaatgggccgggcaacaacgctgtttaatgtgcaaaaccggctcggatctgcctttggagttgctgtcatgtcgtgcgtccttgctgtgctcagccagcccagcgcaggcatagagcctgatttatcagcttaccggacagctttgctctgtgcagccggtttcctcatggctgcgcttttcatcgcactcaagctcaaggacgctgacacaggccgtcaaatggacaagcatgcttcagcacccaaaggtgcggcagcttctggtgagtaa

SEQ ID NO: 3729 - DNA, 225 bp, Bacillus licheniformis
atgacaaatccttttgaaaatgaacacggcacatatgtcgttttaatgaatcaggatggccagtattcactctggccggccttcattcatattccggcagggtgggaggtcgtctgcggggaagcgagccgcagcgcctgtatcgactatatcagctcgaattggaccgatctctcgccgaacagcatcaagctggttgcagaagtacacggcggtcagcaatga

SEQ ID NO: 3730 - DNA, 7158 bp, Bacillus licheniformis
atgcctgaatgtcaacataaccgaaagccattatcaggagcgcaagccgggatttggtttgctcagcagcttgatccggaaaatccgatctacaatacagctgaatacgttgaaattaaaggcccgcttgatcaggagcttttcgaaaaagcgctgcgccatgtcattaaagaagctgaatcatttcatgccagatttggagaagatcaagacggaccatggcaagagatcgttccgtcaacagattttccgctacattacattgatgtcagctcagaaaccgatccggaacaggcggctaaaagctggatgatggatgaccttgcccgtccggttgatctgactcgcggcccgctttttacagaagcgctttttaaagcggcgcaagatcattacttctggtatcagcgaactcaccatatcgcaacagacgggttcagctttacattgatcgccgagcggctgtcaaaaatatataccgcattgatgcagaacaaatcgatcgaccagagcggagcctttggctccctcgatttgattctcgcggaggaaacggcttaccgtgcatcagaacagtatcaggaagatcggcgattttggcttgggcgtttcagcgatgaaccggaggtggtcagccttgccgaaagggcgccgcgtacctcttcaagttttcttcgcaggtctgaacacctgccaagtgaggatgctgatcgtcttctgtctgccgcgagcagaatgggggcaacttggcacgaaaccgtgatggcagcagcagcaatatatgttcaccgtctgacaggggcaaatgacgtcgttctcgggatgccgatgatgtgccgcctcgggtcagccgctcttcatattccgggaatggtcatgaatctcctcccgcttcgaattggcatgcagccgcaaatgagcataggagagctagtcaagcaaatctcgggtgagatgatgaagctgcggcgccatcagcattaccgccacgaagaattgcgccgggatctcaagctgcttggcgaaaaccagcggctgttcggtccgcagcttaatttgatgccttttgagaaccgcttgaattttgccggctgtcaaggcatcgtgcataatcttgccacgggacctgtggacgatttgtcaatcaacatttacggccgtccggacggtggcgggctaaaagtaaacatggatgcaaaccctgctgtttatcatgcggatgaacttgaagatcacggcaatcgttttcttactcttctgaaaacgattgccgtttgcgaacaaactcagccggtggggacgttggacattcttctccctgaagaacgcgctcaaatattgattgaatggaatcaaacagaacacgggcttcccaaagagagtcttccgcagcgatttgaaaggatggcaaaggagtgtcctgaatctccggcagtcgtttgcaatgataaggttctcacttattccgaattaaatcaaaaggctaatcaactggctcacttgctgatcgatcagggggcgaaacccgagacatttattgccttggcgttgccgcggtcagcggaaatggttgtcagcatgctcgccgttctcaaagctggagcggcttatttacctatagatcccgattatccggctgacaggatcgagtatatgctcaacgatgcacagccgctgcttgttatgaccagcaaggaagcgcaagacacgatcggttcgcaaatgccgaagttaatcctcgatgaacaaactgttatggagaaaatgtccggctgttctgaagaaaatcccggcgaacagcattccggcaaccagccggcatatatgatttatacgtcgggatcaaccggcagacctaaaggcgtggtcgtacaagctgaaagcttattcaattttttgctgtcaatgcaggacatgttcgcgcttaatcaagatgaccggctgctggccgtcactacaattgcattcgacatctcagcactcgaaatttatttgccgctgatcagcggatcagcagtcgttcttgccgagaaggaaacggtacaagatccgtccgaattggccaaaatgattgaaacatacgaaattacaataatgcaggctacaccgaccctctggcatgcattggcctcgagcgccccggaaaagctcaaaggtcttcgtgcgcttgtcggcggcgaagctttgcaatccagcctggcccggcaattgcagcagctcgcgtgttctttaacgaacctttatggaccgacggaaacaacaatttggtctacagccgctgcgctggaaggcaactgtacggaacctccgggaatcggctgtgcgatttggaatacgcagctttatgtcctggacgccggattacagccagtgcctccgggaacggctggagaactttatgtggcaggaacaggggtagcgcgcggctacttgaaccgacatgctctcacggctgagcgctttattgcgaatccatacgggccgcctggatcgcggatgtaccggacaggcgacatcgtgcgctggcgcgaagacgggtcgcttgattatatcggccgtgcagaccatcaagtcaaaattcgggggttccgaattgaaatgggagaaatagaagcggtgcttgcaaatcatccggttgttaaacaagctgctgctatcgttcgtgaagaccagcccggtgacccgcgtttattcgcgtatgccgttcccgcttcgggagaaagccttgatcctgccgagcttcgccgcttcgttggtgagacactgcccgactatatgattccgtctgcatttgtcatacttgatgaactgccgcttacgccgaacggaaagcttgaccgcaaatccctgccggctccggcggtgagtatgcatacaggcggacgcgagccgaggactccgcaagaggaaattttgtgtgatttatttgctgaggtgctgggggtgccgcgagtcagtattgatgacagcttttttgacctcggcggacattcccttctggcaggcaggctcgtcggccgcattcgggaaatgctcggcgtcgaactcggaatcggccgtttattcgatgagcccacagccgccggacttgccaaacagcttgatcaggcgcagagcgcccgtccggcattgcgcaaaagagagcgccgcaaggagattccgctgtccttcgcacagcggcgcctatggtttttgcactgtttggaaggaccgagcccgacctataatattccggttgtcgttcatttaactggagatttggaccaaaaggcgctggcagctgctctgggtgatgtggcaacaagacatgagccgcttcgaacaattttcccggatcagcaagggacaacacaccagctgatattggaagaggatcaatcgcgtcccgaactcactgtatcccatgtcagcgaacatgagttggaaaaagtcctggctgaggccgtccggcaccgttaccatttagaaaaggagcctccgtttcgcgcccagctattcgtactcggaccggacaaatttgtgcttcttctgcttttgcaccatatgatcggcgacggctggtctttaatgccgctgacccgtgatttggaaaccgcctataatgcgcgtctgcaaggtgaggcacctgtttgggagccgctttctatacaatatgccgactatgccgtatggcaggaatatctgcttggcagtgagaacaatccggacagtctgattgccaaacagctcgaatattggtcgaaggcattggaacatctgcctgatcagctggagcttccgactgatcacccgcgtccgtcggaatctagctacagaagcggtacgattgatctcagcattgacgaacagctgcacggccgcctgttcgatttgtcccgcagcaccggagtcagcatgtttatgattttgcagtcggctcttgccgcactactgacacggctcggagcaggccatgatattccgctcggcagcccgatagcgggaagaaacgatgatgctttaggcgaaattgtcggattgtttgttaatacgcttgtgcttcgaacagatacatcgggtaatccgagttttcgggagcttctgaacagagtcagaaaagtaaaccttgcagcgtatgagcatcaggaccttccgttcgagcgtcttgttgaagtgcttaatccgcgcaggtcaagagcgagacatccgctgttccaaattatgcttgcctttcaaaatacgcctgaacctgagcttgacctttccggcctcaagtcagacattgaaattcgcagcgtcggagcagccaagtttgatttgacgattgagcttcgcgaacatcgaaaagcggacggaacacccgcaggtatcggcggatttcttgaatacagcacagatttatttgagcgaaatacggttcaaacattggcagaacggcttgtcaggctgctggattcagcagcagacgaccctgatcagccgatcgaaaaactcgatattctccttccggccgaacgggaaaacatgctggctgattggagcaaatcgtccaacagcataccttgttcatctttgcccgttttgtttgaaaagcaggcggcaaaggatccggaagctgttgcggttatatgtgaaaataatgcgctcacatacggcgagcttaataaacgcgctaaccggcttgctcatctcctgatcgccaaaggggtcggccccgaacaatttgctgccctggcgctgccaagatctttggatatggttgtcggattgcttgcagtgctgaaggctggcgcggcatatgtgcccctagatccggactacccggcggaaaggatagcgtttatgttgaatgatgcccatcctgtctgcatcgtaacgagttcagcggtagaatcaaatctttctgttcccggatctgttgaaaggattgtactcgatgatccttgtatacaagaggaactgaaaggatgcgctgctgcgaatccgtgtgatgccgaccgcaccgcgcctttgctgcctcttcacccggcgtatgtcatttacacatccggttcgaccggcaagccgaaaggagtcgttgttccgcatcaaaatgtcgtgcggctgttcggagcgactgaccaatggttccatttcggcgctgacgatgtttggacgatgtttcattcttacgcatttgacttttcggtatgggaaatttggggagcacttctcaatgggggccggcttatcgtggtgcctcatacaatcagccgctcgccggccgaatttctcaatcttctcgttcgcgagggagtgactgtgctcaatcagactccttcagcattttatcaattgatgcaggctgaccgggacaatgctgagacaggaaagctcctttccttgcgctttatcatttttggaggggaagcgctcgagctgaagaggcttgaagattggtatgaacgccatccggatcatttcccgcggctgattaatatgtatggaattacagaaacgacggtgcatgtcagctatatttctctcgatcagcagactgcggcacttcaagcgaacagcctgatcggccaggggattcccgatttaggtgtatatgtgcttgatgagtatcttgaaccggtgcccccgggcgtcaccggagagatgtatgtgtccgggggcggtctcgcacggggttacttgggcagacccgatttgacagcagaccgctttgtcgctgatccgtttggtccgccgggaacccggatgtaccgcaccggcgatcttgcccgcaggcgccaggacggctctctggattatatggggcgggccgaccagcagatcaagatccgcggcttcagaatcgaactcggcgagatagaagcggtgcttgtccgccatcatagagtgaatcaagccgctgtggtcgtaagggaaggccagcccggggacaagcgtctgatcgcctacgttgtcccggcgtctgaagaagaaaccgatccggctgagctgcgacggtttgccgcaggcactctgccggagtacatggtgccttccgcatttgtaaaaatttcagagctgccattgactccaaatggcaaacttgaccgaaaagcgctgcctgagcctgactttgccgcggctgttaaagggcggggcccaagaacaccgcaggaagaaatcctgtgcgatcttttttcagaaatcctcaatgcgccgagagtcggtattgatgacggattcttcgaacttggcgggcattctcttctcgccgtacagctgatgagccgcattcgtgaagcgctcggagtcgaactcggcatcggcgacctgcttgaagcgcctacagtcagcggacttgctgaacggcttgaatccggcggcaggcaaagtgcgctggatgtaatgcttccgctgagaaccggaggcagtcaagatcccctgttctgtgtgcacccggccggaggcctcagctggtgttatgccggtttaatgacggcactcggcaaggaatacccgatatacggccttcaagcccgcgggatcgcaaggcaggaagagctacctgatacgctcgacgacatggctgctgattatattcggcacattcgtacgattcagccaacaggcccttatcgtctgctcggctggtccctcggaggcaatgttgttcatgcgatcgcaactcagctgcaggaacaaggggaagacatatcgcttcttgtcatgcttgatgcttacccgaatcacttccttccaattaaagatgcgcctgatgagcaggaagcattgattgccctcttggcattgggaggatacgacccggacagccttgacggggcaccgctgaacctttccagtgcgatcgatattctgcgccgcgacggcagtgcgcttgccagcctggacgaggctgcgatcttgaacttaaaggagacgtatgtgaattccgtccggattttaagcgaatataagccccgcgtctttcatggcgatattctgtttttcaaatcaaccgtgataccggaatggtttgatccgatcgatccggagtcatggctaccttatttgaacggaaacattgatattcatgatatggattgccggcataaagatttgtgccagccggagccgctggccgaaatcggacgtcgggtttcggaaaagctggacgacttgaaaaaagatacggataagtag

SEQ ID NO: 3731 - DNA, 927 bp, Bacillus licheniformis
atggccattcctgccatcttaccgtaccaaatgccagaagcatcaaatatgccgaaaaacaaggtgtcatggactcctcatccgaagcgtgcggcgcttctgatccacgatatgcagcaatattttctcaacgcttaccgttacggcgagtctccggtcacagatctgctggctaatatcaagaagcttcggaagcgatgtgccgagctcggcatgccggttattttcacggctcaacccggcgcccagacaccggaagaacgggggcttctccaagacttttggggacccggaatcggtcctgatcccgatgagcagaagatcgtggatgagctgaaaccgaatgaaggcgacattgttttgaccaagtggaggtacaatgccttcagaaaaaccaaccttttaggcgtgctggaggagcaggggcgggatcagctcataatcaccggaatctatgcccatatcggctgcctgatgacggcatgtgatgcttttatgcaagatattgaaacatttttcgtcggagatgcggtggcggatttctcattaaagcatcatgaaatggccatcacatacgcagctgaccgttgcagtgtcacaattactgcggaacagcttctgagccgactgaaagatggcgaaagccatgaacacgcaaaagaaagctctcatgcactgacaaaacagattattcgcgaacaggtggcatcgcttcttcttgaatcgccggaaaagataagcgacagcgaaaatttgatctaccggggaattgattccgtgagaatcatgagtctcgcagagcgctggcgccgagcggggcgggaggtgtcgtttgtagagcttgcggaggacccttcgattgaaaactggtggagactgttgtcctcctctaaagaagcacctttgccaaatgcagactatcaatga

SEQ ID NO: 3732 - DNA, 1623 bp, Bacillus licheniformis
atgctgaaaggatgcacgacatggccgaaggagtttgcggataaatatcggaaggagggatgctggcgaggcgaaacttttggaaaaatgctgagggagcgggccgaaaaatacggaagccgcattgcccttacatacggagatatccatttaagctatcgtgagttagacaggagagccgattctttggctggcggtcttttaaagctggggatcaaaaaaaatgatcgcgtcgttgtccagctgccgaatatcatcgagttttttgaagtttgctttgcgctcttccggatcggagctctgcctgtttttgcgcttccatcgcatcggcatagcgagatcacgtatttttgcgagttttctgaagctgctgcctacattattcccgatcgtcacgcaaagtttgactaccgcaagctggcgagacaggtaaaggagaagctgcaagggctccgtcatgtcattgtcgccggggaaccggaggagtttgaagcgctggcaagcctttatgatcagccggcacctccgcaaaacgtctatccagaagatgtcgcctttcttcagttgtcggggggaagcacaggtctgtccaagctgatcccgaggacgcatgatgattatatatacagcttgagggtcagcgcagagatttgcaggctcgatcacaacagcgtatatcttgcggctcttccgatcgctcacaattatccgctcagctcgccgggagtgctcggtacgctgtacgcgggaggccgagtcgtccttgcatcaggaggcagcccggatgaaaccttccctctgatcgataaggagagggtaacgatcacgggactcgtaccgccgcttgcgttaatctggcttgatgctgcttcggcgcgccgggacgacttgtcaagcctccaggtctttcaagtcggcggagcgaaattcagcgccgaagctgccagacgcgtttcatcggtgtttggctgcaaactgcagcaggtttatggcatggcagaaggtctggtcaactataccagacttgatgatcctgaagacacgatcgttcacacacaaggcaggccaatgtctccgtttgacgagattaaaattgtggacgaaaaaggacgcgaacttggacccggacagacaggagagctgctgacaagaggtccatatacgattcgcggctattacaaagctgaggagcacaatgccaaagcgttcactgaagacgggttttaccgtacgggagacttggttaaagtcaattcatcaggctatttgattgttgaaggacgagctaaagaccagatcaacagaggcggtgagaaggttgccgcggaagaagtggaaaaccatctgctcgcacatccgggggtactcgatgcggcggttgtctcgatgccggatcaatttctcggcgaaagggcgtgtgcatatattatccctcgcggcgctgcaccggctcaggctgagttgcaatcgtttttgagagaaaggggccttgcagcctacaaaatacccgaccgggtagaaatggttgaagatttcccgcagacaggcgtaggaaaagtcagcaaaaaagagctgcgtgcggcgattgctgaaaaaatgtctgcagctgagaatgtcagatga

SEQ ID NO: 3733 - DNA, 1191 bp, Bacillus licheniformis
atgatagaacgtcatgtcgtgtcagaagcgcttgcagatcagctgttaaaggaatatcaggccggtgcttcattctttttctcttcccctgagcggaccattctggcggaaggtgtttttgcttctgtttctcaaaccgaagagcaaagccttgctcagcggactgcggaagttctgaaaaaagccagggagaacgggcaggaaaatccgattgtagttggagctgtgccatttgacgatgcaaagccggcgcagttaaccgtgccggtcgaagcgtggcatgcggggccgctgacatgtgaagaagacgataaagaggtgcctgaacctgccctgcacccctatgatgtccagcagattccaagcccggaagcgtatatggccggagtcagacaaggattggcaggtatagcagcaggagaatacagcaagatcgtcctttcccggtcattgcagctgacctcgccgatcaaagtcgatatcggtcaattgctgcgaaatcttgcccgccgcaatacaagcgggtacaactttgccgttgatttaaccgggcagtcatctgaagcgcctcgcaccactttgataggcgcgagtcccgaactgcttgtatcacggtccgggttctgcgttacggcaaatcctttagcaggttcaagacctcggagcgatgatcccgaagaagatcgaagacgggcggctgaactgcttgcttcgcctaaagaccgtcacgaacatgcggtcgttgtcgaagcggttgcttccgcgctcaggccgttttgccggaagctggaggtgccggaaccgtcgctcatcagcacgccgacgatgtggcatctttcaacggaattgaagggagagcttacagacctctctgtatcatcattggagcttgccgccgcccttcatccgacgcccgctgtctgcggcacgccgacgaatgcggcgaaagaagcgattaaacagattgagccgtttgaccgcgggtttttcacaggtatggtcggctggtgcgacgcggacggtgacggagaatgggttgtaacgattcgctgtgccgaggcggaggaacacgcgcttcgactgtacgcaggtgccggaattgtcgccgggtcgaagcctgaagacgaacttgccgaaacgtctgcaaagtttcggacaatgcttcttgcgatgggaatgaacagtgagtaa

SEQ ID NO: 3734 - DNA, 771 bp, Bacillus licheniformis
gtgaaaggcaaggttgctttggtgactggggcttcgcaaggaatcggcaaagaagtggccctggcgcttgctggacgcggggtgtttgttgcagcggctgatcaaaatcgaaaagggctgcttgaacttgaagacgaacttgaacaaaaaggactgcagggttcaggttttgccgcggatgtgggcgacagtgccgcagttgaccagcttatcgccgatattgaacgcgagatcggtccgatagacatgcttgtcaatgtagccggcgtgctcagaacgggtctgatccattcgttgagtgatgaagattgggagaagacgttcaatgtcaactccaccggggtttttaacgtatcgcgtgccgtcgcccgccggatggtaccgcgcaggactggagcgatcgtgactgtcggatcaaatgcggcagctgtgccgcggatgcacatggccgcctacgcggcctccaaggcggccgctttaatgtttacgaaatgcctcggccttgaacttgccgagtacaatatccgctgcaatatcatatcgcccggatcaacggataccccgatgcagcggtcgctatggcagtgtgaggaagctgcgcaaggcgtcattgaaggatcacttgaaacattcaaaacgggaatcccgctcggaaaattggcttcgccggctgacattgcagatgctgtagtatttttgctgtctgacggggctcgtcatattacgatgcacgatttgcgcgtcgatggcggagcaacgcttggagcctga

SEQ ID NO: 3735 - DNA, 849 bp, Bacillus licheniformis
atggctcaagaaaaacttcagcagtctgtcaatgctgctgaatgcatcccggttgcgataccggggacagaacagcggtgcatgcgttcactggatgggagccgcacatatcggatttttattgcgaaaccatttggggaacagccgcccgcaggatatcccgtgatttatctgcttgatgccaattccgtgtttggaacgatggtggaggcgttgcggatgcagtcgcgccgtcccgataaaaccggtgtagggacggctgttattgtcggcatcggttacgagaccgacgctccctttgaccgggggcggtattatgattttactctgccggaatcgggcgctgagctgcccatgaggcccgatggagcagactggccggaaccaggcggggcgaaagcttttctgtccttcatcgaacagcagttaaagccggagatcgaacaggaattcacgattgatgtgaaaaggcaggcgattttcggtcattccctaggcggactttttgtcctgcagaccctgtttacaaaaccggatctatttcagacatatatcgccggcagtccgtccatccattggcatccgtcattttttgataaagagcatgactttgtttcgaagttgcaggaagctgatggcgatgtaaaggtattgcttggggccggagaactcgaaaagacgcataaaagcgggatgaacgacaatgcaaaaaggctggccgaccgcttggccgctttggaaagtcagggggttcgcgcggagtaccatgaatttaaaggggaaggtcatatatcggttctgcctgtgttaatcagcagagcgctgcggtttgccttcaagcctgattga

SEQ ID NO: 3736 - DNA, 1020 bp, Bacillus licheniformis
gtgcctaaaaaggttgcagtcatctatgctgtttttattgtgctgattctcacaatctgttatctcagcataacagtaggatcgtttgccgtacatccggctgagctgttatcaacattgcttcacatcaacccgaatgagcaatacgccattctcctgtttgagctgcgtcttccaaggattgtgacggcggcactcgtgggtcttgggctcggcattgccggttccgtcatccaggcgatgacaaggaacggactggccgacccgggaatcctggggattaatgcaggtgcgggggcggcgatcgtcggctacatgctgatctttcaaggccagaccgaaacgacaagcctgctcgctgcaatggggatgccattcttcggcttgatcgggggcattttggctgcaatattcatttttatctttgcctggcacgccggcaacttggattcgggcaggattattctcgttggaatcgcgattaattcagggttcagcgctgtttcgctttacctgtcattgaagatgaatccgaatgaccacgaaatggccatggtttggaaaaacggaagcatctggtcggcgaattggacgtatattcaagcggcactgccgtggctgcttgttcttattccatttctgctgatgaagtccggcctgctcgataccattcgctttcatgaagatacggtgaagagtctcggcgtatccgcgaatattgaaaaggtggtgctgctcacggcttgtgtcggcattatcagcgcctgtgtggctatttcggggagcatggcatttgtcggcctgattgctccgcacatctcgcggaggctcgccggcgtcctgcaccgccactcattgctgttaagcggattgatcgggatgtttctcgtattgtgcgccgattttgccggaaagctgctgttccagccgtccgaggtgcctgcgggtatcattctcgccattttcggtgtgccgtacttcttatttttacttttcaaacaaaaaaagactgttcattag

SEQ ID NO: 3737 - DNA, 1005 bp, Bacillus licheniformis
atgcattcaaagcaaatgacccgcatcattatgatcgccgctccgtttgccatactgctgtctgtttttctgtcggtatgttacggtgcaaaacagcttgagcccgaggtgattttttcggcgctgctgcattttgatccaggcaacacagatcatcaaatcatttggcattcccgtcttccgcgcgctgtcggcgctcttttaatcggagcggcgctggcggtgtccggtgcgcttatgcagggtgtcacccgaaattacttggcttccccgtcgattatgggcgtttccgacgggtcagcgtttgtgatcacgctgttgatggtggtgattccgggttcatcctctctggagatgatgggctattcgtttatcggatcagccgtcggcgccggccttgtcttcggcctcgcctcggtgattccaaacggttttatgccggttcaacttgccataatcgggacggtaacaagcatgctgctcagcagtctgtctgcggcgatatcgatttactttcaaatttcccaggacgtcagcttctggtacagcgcgaggctgcatcaattgaatcccgagctgctgaagtatgccgtgccgttttttgtgatcggcatcattctggcgctctctctcagcaaaaaagtgacagctttatcattgggcgatgacatttccgaaagcctcggccagaaaaagcaggccgtcaaatggacagcgatggcagcggtcgtcgttctgacaggctgctctgtcgccatggcgggaaaaattgcttttgtcggactggtcgtgccgcatattacgcgttttctcgtcggatcggattacagccggctgatcccgtgctcctgcgttctcggcggcgtttttttgacgctggccgatcttctcagccggctgatcaactatccgtttgagacaccgattgaagtcgttacttcggtgatcggcgttcctttcttcctttatttgatcaagagaaaaggaggggagcagcgtgcctaa

SEQ ID NO: 3738 - DNA, 957 bp, Bacillus licheniformis
atgagaaaaatatcaatatttctatttattctccttctcgcgcttggcgcagcgggatgcgggaacagcaaagaaaaggctggcggcgatggcaagagcacagcgtcagctgagaagagcatcgagtacctcgatcatacatacaaggtgaagatcccggccgaacaaatcgtcattacgggaagcgtggaatcgatggaagatgccaagcttctggatgttcacccagccggtgccatttccttctccggaaagttcccggatctgtttaagagcattactgacaaagcaaccgctgtcggcgaaaaaatggagccgaacctggagaaaatccttgagctgaaaccggatgtcatcctggcttcaacgaaatttcctgataaagtggtgaaaaaactggataacatcgcgacgacgattcctgtttcccatgtttcttcaaactggaaagacaatttaaagctgctggctgaactgacaggcaaagaagataaagcgaagcagattatttcggattatgaagccgacctcaaggaagctaaaacaaagcttgagaaaacggcaaaagatacaaaagcgctcgttgtcagaatcagaaaaggcaatatctttatctatccggaagacgtattcttcaattccacattatacggtgagctcggcttcacagctccaaaagaagtcaaggcggcaaaagcccaggagttggtttctttagaaaaactgagtgaaatgaatccggactatatgtttgtccaattctcagacgatgagaatgccgacaatccgaatgcgctgaaagatctggagaaaaatccaatttggaaaagcatttctgcagtgaaaaatgaccgtgtatttgtcaatgctgtagacccgcttgcgcagggcggaacggcatggagcaaggttgaatttttaaaggctgcagctgagaaattggcgcagaacaaatag

SEQ ID NO: 3739 - DNA, 1596 bp, Bacillus licheniformis
atgaaatcttcttatttctatcgtctcttgcaaattgatcatataagaaagcccggcgatcttccggatgaacagcagctcgcagactctttcgttttgatctttcatttgaagggtgaaggcagaatcgatatacaagcatcaggcagacccctccaaaaagaaacgctgtatatcgttccgccttatgaaacattcggaatcacagcttcgtcagaggaaatcagcgtttatctcatcaggctgcagccctactgctatgaagaccgccgcctgacgcttcaagcagacaccgaccctgacgctttttccgaccttcagatgatgaatgtccatcctgtcggaaatctggcctcccgtcttcaggaactttccgccttatggccggcatcttcagcgctccaggagctgaaatgccaagcagatctgcagcagcttctgtacgatatctattcggccaaactgactcatcccgaaaacaccgcatcagccataggaaaaacaaaggagtatattgaggagcattcagatgcacacctgacgcttgatcaactcgcgcaaatggccggaatcagcgcgaagcactacagcgaaaggttcaaaaagctgtacggtcaaagcgtgacagagtttatcactgagacgcggatgacgaaagcgaagcagctgatggcaaaagcgagctacaagctgagggaaatttcaagccaaatcggatatcaggatgaattttatttcagcaggacgtttaagaagcatacaggcttatccccgaccgtttatatgaaaaaaaggcgcagaaagctggctgcctacggccagaacacgatcggacagctgataccgcttcacctcattccttacgccgcttccctgcatccgaagtggacatcatattactataagcattacgcggcagatattccggtccatctgagcgcataccgctttcacgagccgtgggaagaaaacctgcggacattgtcatcggctgacccggagctcattatcagcatggacagcgtgtctcacgaggaacgggaacagctccagtcgatcgcggatgtcttctttttgccttcacaggaacaatggaggaggcattttatgctgaccgcatcccatttggacgaagaagcggaggctcacaaatggctgctgtcttaccagcgtctcaccgagaccgcgaaagaggcgctttatccgatctgcggacgccgaagctttttgtttttgcgcttgcataaacacgagatttatctggcgcataaccgttctgttcaagatgtatttttcggcgaccttggctttgaatcggctgtgtcgctggaagaaccgactgaccgggccgtgtcgatcgaaacaatcgcagcctatcagccggatatcattatgattttcatttttaaagagccggagacgctggcattctacagggagcttcagcagtcggctgcttggcaggatttgaaagcggtgcggcatcaccgggtgtatcaggtgaattctgatccttggcgggaatattccgcatgcagccatgaacgaatcatccgccaggcggttcggctgctgtccggaaaaaatccattttaa

SEQ ID NO: 3740 - DNA, 393 bp, Bacillus licheniformis
ttggaaatgacagacagcatgaaaaaatcgcttgatgcgattgcaaaatggggaaaaataaccggagtttttatgattatcgccggaggcatctatgcctttttcggaatttctttgcttatcatcggagccgctccaggtgtgctgatgattttttcaggaatctatcttcttaaatcggcaaacgccgctcagaaaatgagtcatgacatgccgcaagaaccgcatgaagccttgcttgataactatgtgaagtttatgaaatggcaatttttctacttactatcgaatattgtgatcttcattttatgcataatcgtttttttcttcctgatctttttaggtgttctagccgattcttacagcgggtatgatccttattattacgaatga

SEQ ID NO: 3741 - DNA, 861 bp, Bacillus licheniformis; identical to SEQ ID NO: 484

SEQ ID NO: 3742 - DNA, 333 bp, Bacillus licheniformis; identical to SEQ ID NO: 485

SEQ ID NO: 3743 - DNA, 642 bp, Bacillus licheniformis
atgaaaatcggtattatcggtgcaagcggtaaagcgggcagcatgattttaaaagaagcatcagaaagaggacacgaagtgacggcaattgtcagaagtgcgtcaaaaatggcgaacagcgatgcagctgtcattgaaaaagacattttcaacctgacagcggcagacatcaaaggactggatgttgtcgtcaatgcattcggcgcggccccagggcaggagcatctccatgttgaagctggaagaaagctgattgaactgtttaagcaggttcctgaaacaagattaatcgtcgtaggcggtgcaggcagcctttatgtcgatgaggaaaaaacaacccagctgtacgatacgcctgagtttcctaaagaatacttgccgacggctaaaaatcaggggcagaaccttcaggatttgaaagaagcagatggactgaaatggacgttcatcagcccggcggcattttttaatccggaaggaaagcgaacaggttcttatcaaaaaggtcaggaaaacttaatcgtaaacaccgccggagaaagctacatcagctatgcagactacgccattgcagtggtggacgaggctgaaaaaggcgagcatgtcaatgagcgtttcactgttgtcggagaagctcaataa

SEQ ID NO: 3744 - DNA, 402 bp, Bacillus licheniformis
atggtgaacacccgtctttcagtggccattcatatattgtctttaatcgccgcaaacccgcgggaatcttcggaaatgatcgccgggagcgttaatacgaacccggttgtaatcaggcgcatgatcagccagctcaaaaaagccggtattctgacgtcgcggccgggagtggccggggcaagcctgaaaagagatcccgaagatatatctctgcttgatatttaccgcgcggttcagccgcatgaggaattatttgcgattcatgacaagccgaatccaaactgtccggttggaagacaaattcaaacaacgcttgatcaaacgtttcacagcgttcagcaggcgatggagaacgaattggccagcaagtctcttaaagacgtcttaactcatctcttttaa

SEQ ID NO: 3745 - DNA, 540 bp, Bacillus licheniformis
atgaaggagataacagaaggaaaagcagctttggatagccggcttgagccgaatgaagagatcagatctattattctttgcgcttataacgcgagactgtctgcacgttacactccgtacagaggcgtgcttgccgccactgacaggcggttcatgttttattcctccctgtttggctccccttttcatcttgacatccgctatgatgccgtcacctcgtttcgccgcgaaaaagggctggtaacaagaggcgatcatctcgtcgtgatgaacaacggggatcgggaagcatttcaatattttagcggctgtgatcctttagagacattcgtcgaagccgttcgaaagctaaagaaactgcctgaagacatcattcattctgaaaaacgccggctccgggatgtgcccgcagccggctgctcagttattaatatcgtacttctctccatacctcagcactttataaattgccattccatcagaaagatgattttcggaatacctcacgggaatcaaagcaaaaaatacataataggttga

SEQ ID NO: 3746 - DNA, 480 bp, Bacillus licheniformis
atgttcggactgcaggatattgtcaaattcctctggtcgttcttgatcgtttttcctgccgtgtcggtgcttcatgtcttgggccacagcgccatggcggtgttgttcggcgggaaatcttcgcttgaaatcgggatgggcaaaaaattgctgaaaatcggccctgttcaaatcagaagtgtctacttcatggattccttctgcaaatacggggatttaaaatacgataaccgtttcacgaatgcgatgatttatgctggcggatcgctgtttaacttaatgtctatatttattatcaatctgctgattatcaaagacatcatacccgaaaatatttttttctaccaatttgtttatttttcaacctattatgtattttttgctttgattcccgtgaggtattccgaaaatcatctttctgatggaatggcaatttataaagtgctgaggtatggagagaagtacgatattaataactga

SEQ ID NO: 3747 - DNA, 1029 bp, Bacillus licheniformis
gtgaacaccaacagtgaacaagttttggatcagaaaagccggccgcttcgggatttaagaatttctgtcaccgaccgctgcaacttaagatgtacgtattgcatgcctgcagaaatctttgggcaggattatccgtttttgccaaaaggcgaactgttgtcctttgaagagcttgaacgattggccaagctgtttgttcatcagttcggggtagaaaaaatccgtctcaccggcggagagccgctgatgagaaaagatatgccggaattagtcgggaagcttgcagggatcaaagggattcgcgatattgcgatgacaacgaacggcgttttgctgccggtttacgctgacaagctgaaaaaagcggggctgaaacgtgtaacggtcagcctggattccctggatgatgagcgtttcaaatcgatcaacggaagaggcgtttccgtcagcaaggtgctggccggaattgaagcggcgaaaaaggccggactcggcgtcaagatcaacatggtcgtccagaaaggggtcaatgagaaggatattttgccgatggcccgctatttcaaagaaaaaggccatattttgcggtttattgagtttatggatgtcgggaacacaaatgaatggaaccgtcagtcagtggtggccaaagcggatatcatccggatcatcaatgaagatatgccgattgaaccgatcgacccgaactacgaaggagaagtcgcaaaacgataccgatacctggacggctcaggagaaatcggttttatctcttctgtatccgatgctttttgcaccacatgcaacagagcaagactatcggcgaaaggcgagcttttcacatgtcttttcgcatcaagcgggtttgatttaagaaccttgatcagaagcgggcagaccgatcaggagctggcggaggcgatcggcaccgtctggcggaatcgcgatgaccaatattctctcgaccgcgctcttgcaaaagcggttccgcggaaaaaggtgaaatgtcctatattggaggataattga

SEQ ID NO: 3748 - DNA, 792 bp, Bacillus licheniformis
atggggaaaaacatcacaacaagccgaaaaattttccgttatgataatggagagctggtgcagcaagaagatcagatggcgacggaattccccctgactgtcatggtgaacggcgaggaatttgtcacgcttgtttgctcgccggacagcctggaagaactggtgatcggatttctcgcatctgaaggggtgatccgatttaaaaatgagattaaaaggtttacaatagatgaaagcctcgggttcgcatatgtcgaccttgtcagcacaaaaaagctgcagctgaaggattacacaaagcgggtgatcggctcctgctgcggaaaagggaggcatttttatttccagcaggacgtcaaaaccgcaaaaacagcgattgacggcgtgaccattacgccagagaactgtttgaagctgatgcgcgacatgcagaaaagcagcaagctttttcaccatacggggggcgttcataatgccgctttgtgcagcacagacaagctgattgcagtcagatctgatatcggaaggcataatgcgcttgataaattgtacggatattgtttgcttcatcaggttcctgtgcgcgataagctgatcgtattcagcggcagaatttcttcggaagtgctgcttaaagccgcgaaaatcggggtttccgcggtcatttccaagtcggcgccgaccgagctggccattcagatggcagaggagctgaatatcatgacgattggttttgcgagaaaccggtcattcaatgtatacacgcatcacgagcgaattcagttttcataa

SEQ ID NO: 3749 - DNA, 1263 bp, Bacillus licheniformis
atgaaaaaagcgaaaaacaggtggctcattgctttatgtgctgtaggcattcatttgtcaatcgggtcggtatacgcatggagcgtctttacaaacccgctcgctgaaaccttcggctggagcctcagccagatcagtctgacgttcagcatcgctattttatttctcgggctttcagccgcatttttgggacacttcgtcgaaaaacacggccccaaaaaagcaggcatgctcgccgcacttttcttcggagctggcgtgacgttttccggcttcgccgttcagatcggctcccttcccctgctttatttgttttatggagtcttcggagggatcggactcggcgtcggctatattacacccgtatcttcgcttgttaaatggtttcctgaccgccgcggcttggccacagggcttgccattatgggcttcggatttgcggctttgatcagcagcccgatcatgcaaaagctgatctcagcggtcggtatagccaacaccttttttattctcggcatctgctactttcttgtgatgatgctctcttcgctttacctcgccccgcctgaagaaggctggcagcctgaaggattttcaaccggaaaaagcggaagagcacaaagcgctgatatttcccagctgacggcaaatgaagcgattaaaacgaaacgcttttattatttatggctgatgctttttattaatgttacgtgcggaatcgccatcatatcaatcgcttcaccgctggcgcaggaaagtgcgggcatgtccgccgccgcggccgccgcgctcgtcggcgttttgggcgcatttaacggtttagggcgcatcggctgggcctctgtatctgattacatcggacggccgaatacgtataccgtctttttcgccatacagctgatcgccttcccgcttttgccgttcatttccgacaaggccgccttctctgttttgatggcattgatctatacgtgctatggcggagggtttgccgcaattccggcttatatcggggatttgttcggaacaaagcagctcggtgcgatccacggatacattttaacggcttgggcggcggcagggcttgcaggcccgatgttctcttcttgggtacgcgatgcaacagggagctacagccaaagcctgacggtgtttgcggcactgttcgccatcgccctgttcatttcgatattcattagaacggacattaaacagttgcggaaaaaagcggcggttcatgtctcaaactcgctaaaaggatga

SEQ ID NO: 3750 - DNA, 2352 bp, Bacillus licheniformis
atgggaaaaacaaagcatcaaggtccgatgaagctgaataaaaagcccgcgccaaaactgtgggcgtcttgggcgccgatgggactcggaaaggtaaagccgaagcatatcagagatacgatgaaaacagcgtgggacaataaagacaaccttccgtacgcctacagaattttgacgcaaggcgtgtgcgacggctgtgcgctcggtgtgtccggactccgcgatcagacgctcacaggccctcatttatgcacgacgcggctgaacgtcctgcgcttaaatacaatgcctgcgatcgaggacaaatggctgtccgccgacatcgaacagctgcgaaagctggacagcaccgagctgagaaagcttggacgcatcccctatccgctgtcgagaaaaaatggtgaacgatcgttctcgagaatttcgtgggatgaagcgctcagccgaatcgcggacaaaatcaaatcgattgataaacggcagctcgccttttatttaacagccagaggcataacgaatgaggtgtactatacggccgcaaaagcggcgcggtttatcggcacaaacaacattgacaacgcctcgcggatctgccactcgccaagcaaaacggctttaaaaaggtcccttggcatcggcgcctcaagctgcagctaccgagactggatcggaacggatgtcctcgtcttctgggggtctgtcgctgccaataatcagccggtgtcaacaaaatacatgtatgccgccaaaaaagcgggaacgaaaatcattatgatcaatccgtaccgggagccatcgatggagaaatactggattccatcgatacctgagagcgcccttttcggcaccaaaatcaccgatgatgtttaccaagtcaatatcggcggcgacattgcctttatgaacggggtgatgaagcactggtttgaaatggagcgggaggcaccaggttcaagcattgaccgcgcctttatcgatgcacacacaaacgggttcactgagcttaaacagcacatcgaaaaacaaaattggaagacgcttgaagagtcatccggcatatcaaaagagagaatgaaagaattcgccgtcttgctggcccgggcgaaaaccggcgttttcatttggagcatggggcttacacagcaccgttttgcgaccgacaacatttcacaggtggcaaatctcgcccttttacaaggattcatcggcagaaagcattgcggcgttatgccgatcagagggcacagcggtgtgcagggctctggagaaatgggtgccgatcctttcgtcctcccaggcggtgattttgacgaggaaaatgccgcacggatcgagaaggtttggggcttccgcttaccgacttggcaaggcgatacgatcggccagacgatcgaaaacatgctgctgccgagcggaagcgaaagaaaagtaaaagtgttttatacaagcggaggaaactttttggagacgatgccgaaccctgattttatcaaaaaagcattgcaggaagttgaagtgagagtccatcaggacatcatcttcaatacctctaccctggtcgatgccaaagaggaagtcatcattctccctgcgatgacaaggtatgaacagcctggcggaggaacctcgaccagtacggaacggatggtatacttcagccccgaaattaaaggaccgcgcatcggagaagcccgttcagaatgggaaatttatgtagatctcgccaaacgggtccggcccgaagacaaagaactgatccattttgacggcgctgcggaaatccgtgaagaaatcgctgctgccaaccggaattatgacgggattcagcatttaaaaaaacgcggagatgtctttcaatggggcggcgcctggctttgtgaaggcggtgtttgtccgacggcagacggcaggggcaacctgatccctgtcgatcttcctgaaaacagacaaacggaaggacgctttctcgttacgacaaggcgcggaaaacagttcaactcgatgatttatagtgaaaaagatcctttcaacgctgcagatcgccgggatgtcatgatcaatccaaaagatgccgaggagctttatattcaagatggagaagcgatcgttctattcaaccgctacggaactttccaagggcgggcaaaatatgccggcgtacaacgcggaaacacggcagtctactggccggaaggaaatgtgctgatccctaaaggcgtatacgaaaaccatgcccgtattccggaatacaacacggcggtcatgattgaaaaggcggagattttccattcgagaaaagatccgcgctatgcagaaaaacgaatcgaagaactcgaaatgtcgaccgattag

SEQ ID NO: 3751 - DNA, 693 bp, Bacillus licheniformis
ttgaaaaagaggtttgctctgttgacaacgttcaccatgcttttgtcattggcgccggcagcagcttttgcggctgaaaacggaaatgcggacaacagcaaaaaagatgtcaatgttgcagttgtgcttgacgcaagcggcagcatggcacaaaaggttgaaggagaaagaaaatttgatattgccaaagaatccgtaaccgattttgccgacctgctttcaagcgatgcgaatgtcatgctgaatgttttcggacataaaggcaacaataaaaactcaggaaaagaagtatcctgcggtacgactgaaaccgtctatgatctgcagccgttttctttcaattcattcgaaaacgctttaagcggaatcaagcctacaggctggtctccgattgcaaaatctctttatgatgtaaaagatgatcttgccgataaagatgggaagaattatgtctacatcgtgacagacggtgaagaaacatgcggaggggatcctgttcaggcagcaaaagatctgcgcaaatccaacattaaaacgatcgtcaacattgttgggctggatgtaaaaaccgtgaaagaaaaagcaaagcttaaaaaagtagctgacgccggcggcggaaaattgattgaagccgactcagcttctgattttaaaaaggtatggaaagaagaaggcgtaaaactgtctcagtaa

SEQ ID NO: 3752 - DNA, 687 bp, Bacillus licheniformis
atgaagaagaagatgacattgggcattttgaccgctatggttctcagtcttggttcgcctgcttttgcagctgagaaaaaacaggaggtaacagttgccgaagatgcgcccaacgttgcgattatgcttgatgcaagcggcagcatggctaaaaagatcggcggggtctcaaaatacgagcttgccaaaaatgaagcgttcagctttggttccaagcttgaaaatgcaaacgtgctcatgagagttttcggttcagagggaaacaataaaaattccggaaaagtgcagtcctgcaatgcaatcagaggggtgtacggcttccaaacgtatgacgagcaaagcttccgcaattccttaaacggcatcggaccgaccggatggacaccgatcgcaaacgcgctgcaagatgcaaaaaacgcgcttgaccagctggacaacaacgggaaaaacgtcgtctatctgctgacagacggtgaggaaacatgcggaggcaatccggtaaaagtcgcaacagaactgcgcaaatccaatgcggttgtcaacgtgatcggctttgattatgaaggagacttccacggacaattgaccagtatcgcagcagctggcggcggtgaatatttccaggcaaaaactaaaaatgacatcaaaagaatttttactcaggaagcaattgagctttctaaataa

SEQ ID NO: 3753 - DNA, 1017 bp, Bacillus licheniformis
ttgaaacagctcataattgtactagcaggaatctgcacgctgattttactcataccaacactgcttgtcctcccttttcacgggggaccgggggcaattaaaacagagaaacacgctcagcaacacgaggaaaaaaagaaagtcaccttaaaagagtctcccgtttcaattccggtctacagaacggctgaccggaaagttgaagacattccgcttgaagagtatgtcatcggtgtcgttgcctcggaaatgccggcagattttgatatcgaagctttaaaagcacaagcgctggcagcccgcacatacattgtgaggcaaatggtgtcagagcaagctgtacagtcgccgaaaggctcgctggtcgatgatacgcagatgttccaggtgtataaaaacaaagaggagctccgcaggctgtggaagaaggattacgattggaaaatcaaaaaggtgaccgaagctgtagccagtacgcaaggcaaaattttaacctatgagcataagcctattgatgcttcgttcttctcgacgagcaacgggtacaccgagaatgccggagcttattggacaagtgatattccgtacctgcaaagcgtgaaaagctcctgggacacaaaatcgccgaaattcctgaaccataaaacgtttactgtcgctgaatttgaacaaaagctcggtgtcaagctgcccggttcaaacagcatcggagagatcaccgaaagaacgccgggaaaacgcgtagcgactgccgtcatcaatggaaagaagcttgagggaagagatattcgcgaaaagctcggcctcaaatcggcagactttgattggaaacgcgacgggaatcagattacagtcacgacaaggggatttggacatggagtgggaatgagccaatacggtgcgcattatatggcgaaagacggcaagaaagcagaagacatcgtcaagtattattacaaaggaacagccgtatccaatgcagatgaatttttaaataaatacatggcgaaaaaataa

SEQ ID NO: 3754 - DNA, 1311 bp, Bacillus licheniformis
ttggaaaaaatcatcgtccgcggcggtcgaaagttaaacggcacagtcaaagttgaaggagcaaaaaatgccgttttaccagttatcgctgcatctttattagccagtgaagaaaaaagcgtaatatgtgatgtgcctacgctctccgatgtatatacgattaacgaagtgttacgtcatttaggcgcaagtgtacattttgaaaataatacagtaacggttgatgcatctcgcactttgtctacggaagctccgttcgaatatgttcgtaaaatgcgcgcatccgtattggtgatgggtccgcttcttgctcgcacaggccattcgagagtggctttgcctggaggatgtgcaatcggttcaagaccgatcgatcagcatctgaaaggctttgaagcaatgggggcaaaaattaaggtcggaaacggctttattgaagcgactgtagaaggccgccttcaaggagcgaaaatttaccttgatttccctagtgtcggagcaactgaaaacctgattatggctgcagctttggctgagggcacgacaactctcgaaaatgctgctaaagagcctgaaatcgttgatctggctaactatatcaatgcaatgggcggtaaaattcggggtgccggtacaggcaccattaaaattgaaggcgttaaggcgcttcatggggcaaaacatacgattattcctgaccggatagaggcgggaacgttcatggttgccgcggcgattaccgaagggaacgtactggtaaagggagcggttcctgagcacttaacatctttaattgcgaaaatggaagaaatgggcgttcaaatcttggaagaaggagacggtcttcggatcatcggtccttctgaattgaagcctattgatttaaaaacaatgccacatccaggtttcccgactgatatgcagtcacagatgatggctcttttgatgcgcgcaaatggaaccagcatgatcacagaaaccgtctttgagaaccgcttcatgcacgcggaagaattccgccgtatgaacggagatattaaaatcgaaggccgttctgtcatcattaatggtcctgtgcagcttcaaggcgctgaagttgccgcaacggatcttcgcgccggcgcagctcttatccttgctggccttgttgctgacggtcatacacgcgtaaccgaattaaaacatttagaccgtggatatgtcaacttccaccaaaaacttgccggtctcggcgctgatattgagcgcgttaacgatgaagaagcagttcatattgaaaataaagaagttgtatccgatttaaatgcataa

SEQ ID NO: 3755 - DNA, 744 bp, Bacillus licheniformis
atgaagacaaaacaaacggttaatgcccttatttttattgtggttttatttttaattgttcatgtctttcaatcgcttgaagcagcgggcaatacgccgcttgaacagctggcggaaggtttgagccgccatgatgtcgagcttgaagagtggaccatgcatacaaaaaaacagcttaccctaagtgaaaaagatttttttgcaaaactgaaacatttcaagaaacagcatcgacaatatgaatggactttaacgcgggaagacgacgatacagttaaagcgacaggtgtttttcaggacaaaaaaaatcatatcaattccaaaatacatttggtatccacccacaaaaaccagagacttgtttcgtatttattgtatgagcaaaaaggcgcgggaccacgggaaaactggaatgctacatataagcagtttgaacgggatgcattcgacataatgcgagaaaagaccgcaatttttacttgtctaaagggccatttaaatggtatgatgaatgttgttttgcaaaaaaaagcaaatgagctagtacatgaatttgatgcaaagtcagttgaagatttaattgaaccaaatttcgtttctatttctgcttacactaacgagtggaaagaatccatcaagacagaaaaacaccgtatgaatttgcaagtctcgcttagaaatgcgggaatgggcgaaaaacttaccgtcacggttggcacaccaatcgtcacgactgaatattaa

SEQ ID NO: 3756 - DNA, 234 bp, Bacillus licheniformis
atggaagagatcggacaacaggctgctgtcagtatcatcgttcatcttttttttattgcattgacttggtgggctcttctggcggtcaatattgatccgcttatcaggaaaggaaaagtcattcaggcgagggtgttaatgatcatcattacaatcgccgtcggctccaccgtcagcaattttttcttggactatctttattattccagacagcttcaaaatttattttcatga

SEQ ID NO: 3757 - DNA, 396 bp, Bacillus licheniformis
atgaagaccttaaaagtcaatatcgttactcccgacggcccagtatacgatgcggatatagaaatggtaagcgttagagcagagagcggtgagcttggtattttacccggccatattccgacggttgctccgctaaaaattgctgcagtccgtctgaaaaaagacggtcaaactgagctggttgccgtcagcggggggatagtggaagtccgccctgaccatgtcaccattctggcccagacggcggaaacatctgaacaaattgacaaagaacgcgccttggccgcaaaacggcgtgccgaggaacgtttgcaaaagcaaactccagatgttgacattattcgggcagagcttgctttaaaacgcgcgattaaccggttggatgttgcgagatag

SEQ ID NO: 3758 - DNA, 1422 bp, Bacillus licheniformis
atgaaaaaaggacgcgttagccaggtattagggccggtcgtagatgttcgttttgaagacggtcacttgcctgaaatatataatgcgattaaagttacacataaagcgcagaacgagaatgaagtggacatcgatcttacccttgaagtagcgcttcacttgggtgatgattcagttcgtacaattgcaatggcttcaactgacggtgttacacgcggaatggaagccatcgacctgggagagccgatctccgttccggtcggaaacgtaacactcggccgcgtatttaatgtactcggggaaaatatcgatttggatgagccgcttccggctgatgctgccaaagatccgattcacagagaagctccaaaatttgatcagctatcaacagaggttgaaatcttagagacgggtattaaagtcgtcgacttgctcgctccatatatcaaaggcggaaagatcggtcttttcggaggagcgggagttggaaaaaccgttttgattcaggagctgatcaacaacatcgctcaagagcacggcggtatctctgtattcgcaggtgtcggcgagcgtacgcgtgaaggaaacgacctttactatgaaatgaaagattccggcgttatcggcaaaacggcaatggtcttcggtcagatgaacgagccgcctggtgcgcggatgcgcgttgccttgaccggacttacaatggccgagcatttccgtgataaagaaggccaggacgtattgttctttatcgataacatcttccgattcactcaagcaggatctgaagtatctgcacttcttggacgcatgccgtcagcggttggttatcagccgacgcttgcgaccgaaatgggtcagcttcaggaacggatcacatcaacaaatgtcggatctgtaacatcgattcaggcgatctacgttcctgccgatgactatactgacccggcgccggctacgacgttcgctcacttggatgcgacgacgaaccttgagcgtaagctgtcggaaatggggatttatcctgcggtcgatccgcttgcatccacttcccgtgcgctttcgcctgaaatcgtcggagaagagcactatgaagtggcgcgcagcgttcagcagatcctgcagcgctacaaagagcttcaggatatcatcgcgatgctcggaatggatgagttgtcagacgaagataagcttgtcgtcagccgtgcgcgccgcgtacaattcttcctgtcgcaaaacttccacgtagctgaacagtttacaggacaaaaaggttcttacgtacctgtcaaagaaacggtaaaaggcttcaaagaaatccttgaaggtaagtatgatcaccttcctgaggacgctttccgccttgtcggccgaatcgaagaagttgtcgaaaaagcgaaagaaatgggtgtagaagtataa

SEQ ID NO: 3759 - DNA, 807 bp, Bacillus licheniformis
atgagtcaaattacgaaagcccaggaaatggtttctgcttcaaagctgaaccgggctgaaaacaaagcgaaatcgtttgttccttatatggaaaaaatgcaggaagtcgttgccgatatcgcagtcggatacaccggcaaacacccgatgatgtcaagccgcccagtgaagcggaccgggtaccttgtcatcacagctgaccgcggcttggcgggggcgttcaatgcaaacgtactccgcaaagcgtatcaaaggattcaggaacgccatcaatccaaagatgagtatgcggtcatcgcggtcggaagaatggggcgcgatttctttaaaaagcgcggaattcctgtcatttctgaaatgacggggatcagggacgaagtgacgttttcagaaatcaaagatttggcgaacagcacggtgcaaatgtatattgacgaaacctttgatgaactgtatctgttctacaaccattttgtcagcgcgatttcccaggaggtaacggagaaaaagctgctgcctttgacagatattgcgcctaacaagaaaaagacgtcatttgagtttgaaccggatgaagaagagattctggaagtgctccttccccagtatgcggaaagcttgatttttggcgcgcttcttgacagcaaagcgagcgaacatgctgcgagaatgacggcgatgagaaatgcgacagacaatgcaaaagagattatcgccgatcttgaactgtcatacaaccgtgcccgtcaggcatccatcacgcaggaaattacggaaattgtcggcggtgcagctgctttagaatag

SEQ ID NO: 3760 - DNA, 1509 bp, Bacillus licheniformis
gtgagcatcaaagctgaagaaattagcactctcataaaacagcaaattgaaaactatcagtctgaaatagaagttcacgacgtaggtacggtaattcaggtcggtgacggtatcgcacgcgtacacggccttgataactgtatggcaggtgagcttgtcgaattttcaaacggtgtgctgggcttagctcagaaccttgaagaatcaaatgtaggtatcgttattttgggaccttacaaagacatccgtgaaggtgacgaagttaaaagaaccggccggatcatggaagtccctgtcggcgaagagctgctcggccgcgttgtcaacccgctcggccagcctgttgacggaatgggcccggttctcacaagcaaaacccgtccgatcgaaagcccggctcctggagttatggatcgtaaatccgtacacgagccgcttcaaacggggatcaaatcaatcgatgctttaattccgatcggccgcggccagcgtgagctgattatcggtgaccgtcaaacgggtaaaacgtcgattgcgatcgatacaattctgaatcagaaagaccaggatatgatttgtatctatgtcgcgatcggtcagaaagaatcgacagtccgcggcgttgtcgaaacgcttcgcaaacacggcgcccttgactatacgatcgttgtgacggcttccgcttcacagcctgcccctctattgtacctcgcgccgtatgcaggggttgcgatgggagaggaattcatgtacaacggcaagcacgtgctggttgtgtatgacgacctttcaaaacaggctaccgcatatcgtgaactgtccttgcttcttcgccgtcctcctggtcgtgaagcattccctggggatgtattctatcttcactcccgtttgcttgaacgcgctgcaaaattgagcgacgccaaaggcggaggatctttaacggcacttccgttcgttgaaacgcaagcaggcgacatttcggcgtacattccgacaaacgtcatttcgatcactgacggacaaatcttcctgcagtctgatttgttcttctctggcgtgcgtcctgcggtcaacccgggattgtctgtatcccgtgtcggcgggtccgcgcaaatcaaagcgatgaagaaagttgccggtacgctgcgccttgatttggcatcataccgtgagcttgaagcattcgcacaattcggctcagatttggataaagcgacacaggcgaagctgaatcgcggtgcccgtacggttgaagtacttaaacaggatctgcacaaaccgcttcgcgttgaaaagcaggttgcgattctctatgctctgacaagaggcttccttgatgatgtgcctgttgaggatatcaaacgttttgaagaagagctctttatgtatcttgaccaaaatcataaagatctgctcgattcaatcgcccagacaggaaaccttcctgccgatgaggacatgaagggtgcaatcgaaggctttaaacgtacgttcgcgccaagcaactaa

SEQ ID NO: 3761 - DNA, 555 bp, Bacillus licheniformis
atgagccaatcagctgtctccaaacgctacgcagccgctctgtttgacattgcccttgaatccaagctggtcaatgaaatagaagaagagctgaccgtcgttaagaagatatttattgagcataaagacctcaatgccgttctgggtcatcctaaagtgcccgctgaaaagaaaaagcagattttaaaagactcgttcggatccgtttcgactgcagtcttacatacgctttatcttctcgttgaccgcagccgcacgtcaatcgtcccggatctcgcggacgaatatgtcaaaatggcgaaccggttccgcgggacggaagatgcgatcgtatactctgtaaaaccgctcagcgaagaggaaatttcctctttttctcaagtgtttgcaaaagaagcaggcgccgcttcactgcgcgtcagaaacgaagtgaatccggatctgatcggcggtgtgaaaatccgcatcgggaaccgcatttatgacggcagtgtaagaggaaagcttgaccggatagaacgtcaattagcaggcgaaaatcgaaagaaggggtga

SEQ ID NO: 3762 - DNA, 498 bp, Bacillus licheniformis
atgggtgcaggagtagggtttaacgccggaacaatgctgttccagcttgttgccatgctgattttgttagcgctcttgaagaaatacgctttagggccgctattaaatataatgaaagagcgtgaagactacattaccggagagatctcctctgccgagaaaaagaatgaagaagcgaagaagctcattgaggagcagcaggcgcttttgaaagaagcacgcgaagaatcccagtctctgattgaaaacgcgaaaaaactgggtgaacagcaaaaggatgaaatcatcaaggctgcgcgccaggaagcagaacgcatgaaagaatcagccagaagcgagatcgtcaaagaaagagaccaggctgtcaccgcgctgcgcgagcaggttgcatcattgtctgtgatgatcgcttctaaagtaatcgaaaaagagctggacgaacaagcccaggaaaaattgatccaagactatcttaaagaagtaggagaaagccgatga

SEQ ID NO: 3763 - DNA, 735 bp, Bacillus licheniformis
ttgaatcacgaatctagaattgttaatttcttaggcctcaattttgatttaactagcattctaatgattactgtgacaagcatcatcgtctttctgatagcggtgctgaccacaagaacactcgcgatccggccgacgaaagctcagaactttatggagtggattgtcgactttgttcgcaatattatcggcagcacaatggatcttaaagtcggcagagactttctcgcccttggcataaccctgctgatgtacatatttgttgccaacatgctcggccttccgttttccataacagtaggccacgaattatggtggaaatcccctacggccgatccggcggttactttaaccctcgccgtcatggtagtaggcctcactcattactacggagtgaaaaggaaagggttgggggagtataccaaagatttcttcagaccaattccatatttagtgccgctcaaaatcattgaagaatttgcgaacacattaacattgggattgcgtctttacggtaatattttcgccggcgaaattctgctcggccttcttgccggactggcaaccaacttctattctcaaagcattttcctggggctggttggaaccattggagcggttgtgccgatgatcgtatggcaggcgttcagcttgttcgtaggtacaatccaggcattcatcttcacgatgttaacaatggtttacatgtctcacaaagtaagtcatgaacactaa

SEQ ID NO: 3764 - DNA, 318 bp, Bacillus licheniformis
gtgttaggctatggatttctgccatatcaggcaatttttttaggcctgattaccggcactgttttcagctatttcaatctctggctgctggccaaaaggatgcaggccttcgataaagcagtggcaaagggcaaaatgatccgttctctcgggactgcttccagattgtgcaacgccattatcgcggcggccattgcttataaataccctgaatatattcatttggcaggcgtcattgtggggttgatgacaatttatcctgtcattatgatagattcctttatccagctaaaacgttcatcaatggaagagaggtga

SEQ ID NO: 3765 - DNA, 630 bp, Bacillus licheniformis
atgggaaaggtatatgtgtttgatcaccctcttatacagcataagcttacatacatccgggacgtaaagaccggaacgaaagaattcagagagcttgttgatgaggttgcaacgctgatggcatttgagattacgcgagacctgccgctggaggaagtgaatgtagagactcctgtgcaaatggcaaagtcaaacgtcatcgccggaaaaaaactcggggttgttccgattctgagagcagggcttggaatggtagacggaattttgaagctgattcctgctgcaaaagtcggacatgtcgggctttaccgtgatcctgaaacattgaagcctgttgagtattatgtcaagcttccatccgatgttgaagaacgcgaattcatcgtcgtcgatccgatgctggcaaccggaggttcggcggtagaggcgctgaacagcttgaaaaaacgcggcgcaaaaaatatccgctttatgtgtctgatcgctgccccggaaggtgtagacgaagtgcagaagcatcatcctgacgttgacatttacattgccgctctggatgaaaaactaaatgaaaaaggatatatcgttcccggattgggcgacgccggagaccgcatgttcggaacgaaataa

SEQ ID NO: 3766 - DNA, 1248 bp, Bacillus licheniformis
atgaaacatttacctgcgcaagatgaacaagtttttagcgccattcaagatgagcggaaacgtcaacagtcgaagattgagctgatcgcttctgaaaactttgtaagcgaagcggttatggaagctcaaggctcggttttaactaataaatatgcggaaggatatcctggtaaacgctactacggcggttgtgagcatgtagacgtggcagaggatatcgcgcgcgaccgcgccaagcagattttcggcgccgagcacgtcaacgttcagccgcattccggcgcacaagcgaacatggcggtatacttcacgattttggagcacggtgacactgtgttgggaatgaaccttgctcacggcggacatttaacgcacggcagccctgtcaacttcagcggtgttcagtacaacttcgttgaatacggcgttgataaagagacgcagtatattgattacgaagatgtccgtgaaaaggcgctcaaacataagcctaagctgatcgtggccggagcaagcgcatatccgcgcaccatcgattttaaaaagttccgcgaaatcgctgatgaagtcggagcctatgtgatggtggacatggcgcatatcgccggacttgtagcagcaggtcttcacccgaatcctgttccttacgctgactttgtgacgacgacaactcataaaacgcttcgcggaccgcgcggcggcatgattctttgccgtgaagagtttgcgaaacaaattgacaagtcgatcttccctggaattcaaggcggaccgttaatgcacgtgatcgctgcaaaggctgtttcctttggcgaagctttaaaggacgaattcaaaacatatgcccaaaatgtcatcaacaatgcgaagcgcttggctgaaacattgaaaaaagagggtatcgagctcgtatccggcggaacggataaccatcttgtgctggtcgacctgcgctctctcggcattaccggaaaagtggctgaaaatgtacttgatgaagtcggcatcaccgtcaacaaaaacgcgattccttatgatcctgaaaaacctttcgttacgagcggaatccgcgtcggtacagcagctgtgacgagccgcggctttgatctggaagcgatcgaagaagtgggagcgatcattgcgcttgcccttaaaaaccatgaagacgaagcgaaacttgaagaagcaaaacagcgtgtagaagcgctgacaaacagattcccgttgtataccgggcttgattactaa

SEQ ID NO: 3767 - DNA, 543 bp, Bacillus licheniformis
atgaaaaatcttgaacagacatggcgttctatattagatgaatttcatcagcaagcgaatttgcgcgaaggccacatcgtcgtcatcggctgcagcacaagcgaggtggccggaaggcgcatcggcacttcgggaagcgaacaaatcgctgaagcggtctacaaaggactggaagagctcagggacagaacaggaatcgccctcgcttttcagtgctgcgaacatttaaacagggcgttggttgtcgaggaagaaacggcgaaagcataccgtcttcccgttgttttcgccattcctgtcccgaaagcggggggatcgatggcttcatatgcctataaacatatgaaggctcctgttcttgttgaacaaatagaggccgatgcggggatcgacatcggcgacacgtttataggaatgcatttaaagcctgttgccgttcctgtccgcgtctctcaaaaacagctaggcgaagcgcacgtgacgcttgcgcggacaaggccgaagctgattggaggcgtccgcgccgtctatgaagcggagtag

SEQ ID NO: 3768 - DNA, 450 bp, Bacillus licheniformis
atgaaagtaatcattgcatcagatcacggcggaatcaatatcagaaaagaaattatggcattgatggacgaattgaacatcgaatacgaagattacggctgcgaatgcggttcaggatctgtggactacccggattatgcgtttccggtcgcgcaaaaagtggcgaacggggaagccgacagaggcattttaatatgcggaacaggaatcggcatgagcatttccgccaataaagtaaaaggcatccgctgcgcccttgtccacgacgttttcagcgccaaaatgacaagagagcacaatgacacgaatgttcttgcgatgggtgaacgggtcatcggccctggtttagcgagagagattgcaaaggtttggcttacgactgagttttcagccgggcggcacgccgtccgcatcggaaaaatcgccgattatgaagacaagcatgaataa

SEQ ID NO: 3769 - DNA, 456 bp, Bacillus licheniformis
ttgaacatattatttgtctgtactggaaatacgtgccgcagcccgatggccgaagcgctctttaaatctgcggctgccgaaaaaaatctggatgtctccgtcaaatctgccgggttgtttgctcctgaaaacggaaaagcttctttatatgctgtcgaagcgctttttgaaaaaaacatcgctctgaatcatacatcttcacagctttccgaggagaaggtggaatgggctgatcttgttctgacgatgacagagcagcacaagcagctggcagtacatgaattttcaaagagccaagataagatctatacgctgaaagagtatgttaatggagatggcggggacattattgacccgttcggcggttctctcagcgactatcaaagaacgagagatgagctggagcagctgctgagaaaattggcggaaatgcttgcgaagaaatctcaggaatag

SEQ ID NO: 3770 - DNA, 561 bp, Bacillus licheniformis
atgaatgttgatgtgttaataggcgaaatcctgacgctttcgatgatggcttttgcactcggcatggatgccttttcagtcggtcttggaatgggaatggccaagctgaaaaggaaccaggtttttcaaatcggcgtcattattggattgttccatgtcatcatgccgcttggcggaatgattgcgggacagtttctttcgggtgcgcttggtgcgctggcgggatatattgggggagctcttttattggtgctgggcattcagatgattgtcgcatcttttaataaaagcggggagcagatcatctctccgcacggcttcggcttgttcgtttttgccgtcggcgtcagccttgacagcttttcagtcggtctcagcctcggcctctacggaacgaaaccgatattaacgatctttctgttcggtttgttcagcatggtgttaacttgggcgggccttctgcttggaaaaaaggttcaaacgtggctcggcgcctacagcgaagcgctcggaggagccatcttgctgagcttcggtctgaagcttttgctgcccatttaa

SEQ ID NO: 3771 - DNA, 1044 bp, Bacillus licheniformis
atgaaaacaaaagtatggactgtggatgtaaaacgcgatttgtccacaaactgtccacaaattgcacaggcggcaagactgcttcagcaaaatgaaacggttgcttttccgacagagactgtttacggtcttggtgcaaacgccaaacacagcgaagcagtagctaaaatatacgaagcgaaagggcggccgagcgacaatccgctcattgtccacatcgctgaaattgaacagcttgcagaatttgcggaagttgattcgcctcaggccgaaatgctgatgaagcgtttttggcccgggccgctgacccttgtgctgccgtgcaagcccggggtgttatccacaagggtgacggcggggctcgacacggtcgcggttagaatgcctgatcatcctgtggcgcttgagctgattagacaggccggcgttccggtggctgccccgagcgcaaatctgtccggaaaaccgagtccgacgaaagccgagcatgtcgtcaacgatttgaatggacggattgcgggtgtcgttgacggcggccctacaggagtaggggttgaatcaacagttgtttcatgcaccggtgaaattccggtcattttgaggccgggcggcgtcacaaaagagcagctcgaagaagcggccggccccgtcttgattgaccagggcctcaccgacgaaaaaaaggcgcctatgtctcccgggatgaaatatacgcattatgcaccggaagcacctcttgctattgtgaacgggggagttgaggatattcaacggctgatcgaccaatatcagaaagacgggatgaaagtcggtgtccttacgacagaggaacgggccgatgtctatcaggccgatgccgtccgcatctgcggcagaagagaccgacttgaaacggttgccgccggtttgtatgacgttctccgcagctttgatgaagaacgtctcgattttatttttgcggagtcttttcctgaggaaggagtgggccgggcgattatgaaccggctgttgaaagcggccggccaccgcgtaatcgaagcgtag

SEQ ID NO: 3772 - DNA, 444 bp, Bacillus licheniformis
atgttctaccaattgaggttagcggaaacgaaagacatgaatgcgatcgaagcatttttaaaaaaggcggggacaagccataagggtcttgaggaagcgaagagccagtttatcatgatggaagaccctcccgatgaaatcgtcgcctgcctcggaatggaggaatttgaaaacaaaaaaggactgctgcgctcgcttgtcgtgtctgacaagctcagccaaggccacatcgtttccttgtttcaaagcatgcaggtattgtgcgaaaagcgaggaatccaaaccctttatttagtagccaataagcgaacatcgatggatttccttgaagtgctcggttttaaacaagctgcggcaattcctgatgagctggatgaatccgagcatgtttcagactcactgaacgtaaacggagcggttttaatggagaaaacgtcaaattag

SEQ ID NO: 3773 - DNA, 666 bp, Bacillus licheniformis
atgaagaaatcaaacattgcctgtatgtatatttttcttttattaataggagcgcttgcaaatctcacgacggaagagactgcccaatcatcaggcgggcagcctgccgtgattcctgatgaagcgattcggctgcggattttggcaaacagcgacagcgggagcgaccagagcgtcaaacgcaaaatcagggatgaggtcaataaacaaattacgaaatgggtggaaaacctgacctcggttgaggaagcgagacaagtcatcaggtcgaagctgcctgaaatccaagaggttgccatggatgtcatgaaacgcgaaaatgttcggcaatccgtgtctgtccgttttgatcgtgtttcatttccgacaaagctatacggcaatatggtgtatccggccggagaatatgaggctgttttaattacattaggcaagggagagggagccaactggtggtgcgtcctgtttccgccactttgctttcttgatttttccaatggggaagccgtaaagtcgcctgaagacgaacaaaccgctgccggagaagaccgccgggaagaaaaaacagacgcggcggatgaaacggtatctggcatagataaagataaagaagacaaagaagtgaaattttttcttgtcgaatggattaccgggcttttttcttaa

SEQ ID NO: 3774 - DNA, 1185 bp, Bacillus licheniformis
atgaaaaaaatatttctattcggctgttcgttttattttctagtaggggttatccatattctgctggggagcctgtcaccgtacatcattcaagaatatcaacgggatcttcatgatctatccttcctgatctttttccaattcaccggttttctaaacggcgtcctgcttgcgccgatgtttgtcagacgcacctctcatacggctgtattgacgtttggccttcttcttattctcgttacgcttttaggtgttttcctttttgatatgttcatcttttttgtcatcatgggatttttgctcggctttggcgcgggtactttagaaacgacgatgggggcgtatgtgattgcgcaagataaaaatgcgaaagggatgaatattttagaggtttttttcggattaggcgcgctgctgtttccttttcttatttatatccttacggaacgatatgcctggcatttccccttgtatgctttatttatcttcgtttttgtgctcgcgtgtatgtgggtggtttatttgcgcagaaaaacccccggcactgcttccggtcagatggcttatcaggaaaaaccgactgtatcagccatatttgaaaccggaaggaaagaaaaaaacattttcctctttctcatattcgcttttgtgtatgcgggtatcgagaccaatttcgcaaactttttgccggcgctgatgctggaaaaaggggctgaagaaatcagcgtgatcagcgtcacgtttttttggacggggatggtatgcggacgtttattgacaagtatttttggcggacgcataacttccgttgcctttctgatcttcagcgccggagccttgactgttttgcttttgattctcgcgtggtttccggttcatcaaacacagctgctcctcgtatttttcatcgggctgtcggcagccggcatttttccgtgcgccgtcactcttgcctcgttggctggaaagccttttacagaggaaatcacgagtctcttcatttcgtccgcaagtctgggaggagcgcttctttcattcttgatcggctgggcgattgatgcaagcgcagccgctgtcttcccgtttttgctgttcggcggattggggggcttgctgctggcgatcagcgcggtgatttttttatccggcctgcaaaaaaacaagcagagtcatttggatatgtag

SEQ ID NO: 3775 - DNA, 1047 bp, Bacillus licheniformis
atgaaaatcggaattataggagccggaggaattgcaaaagcccatgcgaaagctctttcaacagtcaaaggtgccgagctttccgggttttttgatatcaactcgcttgcctctcgtaaatgtgcgtttgaatacggaggaactgcctttaccagtatgcaggagctgttgaatcagtcgacggcagtcatcgtttcatcgccgaacttttgccataaagaacatgcgcttgaagcgatggctgcagggaagtatgtattgtgtgaaaaaccgatggctgtctcaatggaagaagcggaggagatgaaaagcagggcgtctcaatccgcttatattccgatcatgggcttcaattaccgccatctcacattcgttaagcgcctaaaagatatgatatccggcaatgaacttggagatattttgtccatcaatgtccattttaagaaaaacagcgccttgagaagaaaaaaatatacttggcgcgatcattcgaaaagcaacaaaacgagcggggcattaggagatttgggcgtgcatttaatcgatctcatactctatttgttcgacagcccgtttaaactggacagtttaaaagtcaaaatgatgacggtcgtcaaagaaaaagaacaaaaacaggtatatgttgatgatcattcagaagtatacggccagcttgaaaatcatgtgtttgtcaatatgattacgtcaaaatgcacaaaatcggatgagtgcggcttcagcatcgaggtcaacggccaaaacggcgtattttactatcattcacggcagaaaaatcagtttttgctgagggccggattgacggagcagatgataacaatgccggacacgtggctgacagaccctgaaaatgaattttacggatgggccgattccttcagagttcagctgatccaatggatgaacggaattcgggatcgcaattttgcatctcttgccacttttgaagatggatacaagacgcagttctacttaaatgaatttttcaataaaggtcagcagctgtccctttcaaaacaagcaaactag

SEQ ID NO: 3776 - DNA, 849 bp, Bacillus licheniformis
atgtcgtatcatgaaacactttcttttcacaccttgcagcaagtaaacaagccgaagtacgccgtattttgcgattttgatgagacatatttcgcccacagcatcaccgatgaatcgagaaaagcgctcatggaccttgaaacatttattcattcgcaccatcttgatcacaagattttgctcggctgggtgaccgggagcagcctgtcatccgttcttgcaaaaatgaagcggggaggctttcgatatcttccgcattttgtcgccggtgaccttggcactgaaatcacttatttctctgaagaaggccaagtctctgataaagattgggaagcccgattgcaagaatcaaatttctcccatgatctggtcgaagaaatcaagcagactctctctaaaaaatatgagattgcgcttgtgcctcagactcagcatggcttttcccgctataaaatcaactattactataaatcgttggaagagagcatagataagagggcgcttgaagccatcaggcggcttgcaagagagcatggaataggagtaaatatcaatcgctgcaaccctttggcaggcgatccggaaaacagctatgatgtggactttatccccttgcggacaggcaaaccgtacattgtggattttatattggataaattcgcgatagagagggagaattcatttgctttcggcgacagcggaaacgatgtggatatgctaaaaaaaaccggacatggttatctggtggggaatgcgacagcagaagccaagtcgctccattcccgtatgacagaaggcagctatacggctggaattttagaagtgctaaaagcccatatcaaacgataa

SEQ ID NO: 3777 - DNA, 1314 bp, Bacillus licheniformis
atgaaaaccgcaaacgaaaacatgacttgcacgagcaaacagctatttgtccttctgaatgatttgaaggaaggaaagctcgctggtgaatgccgtatagacgacacactggccaatcaaaaattaaaagagacattgcagcaggatcaattcgacataaccgccaatttgctgaacagaatggattccccgccctccagagttgactttatgccgcttcatcgactgatcacagaagaagaagtagatgacgtggttcatgcggtgaaagacgtgctgccgaccgggcaatttacaagcggtttttatgttggcgtatttgaagctgaaatagctgcttttttgagcaaaaagcatgtcatggcttcatccagcggaaccgatgccatgattgtcgcgctgaaggctgcgggtgttggacaaggtgatgaagtcattatgcctgcaaacagctttgctgcaacggaaaacgccgtgctcgcagctggaggcactccgattttctgcgatattgaccctgttacattttgcatggatccttcagaaattgaagcatgtgtcactttgaaaacgaaatgcattttgcctgtacacctttatggaaagctgcctgacatggaagccattgcaaaaaccgctgataaatacggcatcccgattattgaagacgcctgccaggcgatcggcgtttccgatctgggaaaaaacagcctttgctccatattaagcttcaatccgtataaaaatctcggcacttgcggaaaagccggcgcaattgtgacggatgatccatcatttgcatccgcatgcatggaatatatgtatcacggctttgaactgaatcaaaaaaataaaaaggcggctgactacggctttaacgctaagattgataatctgcaagccgctattggactggcaaggatgaaatatctttctttaaataatctgaagcgcttatatttagcagatcgttatattgcgcatttgcagcagtatgaagacagaggtctgatcaaattgcctcaaatgaccgatgatcatgtatggcatttgtttacaattaaaatactaaacggaaatcgtgaccaagtcaaagatatgatgcttaaatttcataatgtccaaacagatatatactacccgattttatcccatcatcaaaacacaccacttgtaaaagccaattatcggcacacatcactgccggtcactgaatcagtgcataaacaaatgcttcagcttcctctctatccggggctcaccgtagaagaacaagacaaagtaatggaggccttaattgatgtcgtatcatga

SEQ ID NO: 3778 - DNA, 990 bp, Bacillus licheniformis
atgcctacgattgacgaaattgcaaaattaagtaatgtgtcaaaaacaactgtttcaagagtactgaacgatcatccctatgtatctgaagaaaaaaggaagcgggttttggaagtcatcgaaaaattggactacatcccgaacacgtctgcacgaaagctcagatccaacaaaacgatgtttctcgcagtgtctgtcccacacgcggaccaccccttcttcgctcagcttatgaagcatatgtccgctgaagcgctgaaacaccaatacaaagtcattgtgtttcagacgttttatcaaaagcagaatgaactgaaagtactggagctgctcaagaggaaagaagtcgacggcgttatgctatgcagccttgaaaatgaatgggaagacatcaaaaaatacgtcaaatacggtcccgtggttatggcaaatgaattccacgccgaagcggacgtgccggtgatctgctatgacgaattcgaagccggatataaaggaacggagctttttattcaaaaagggcatcatttaatggccttttgctgtgacacgatacacagcaaggcccagattatgagaaaagaagggtttatgaaagcattgtctgatgcaggtttgcgtttccaggagaagtggatgttcagccacgcatttaccattcatgacggcttccgcattatggaccagatccacaacatgtccgaaaagccgaccgccatttttacgggaaacgaccaagtggccgcaggaattattaaaagggcccgatattatcaatatgaagtgccaaagcagcttgcagtgcttggatatgacaatcaatcgatctgtgaggtgaccgatccggaaatcacgacaatcgatatacctgttgaagagctggctcaaaaagccgtatgtgcaatggtaaaccttctgaatggggaaagcggcttacagagggatgtcgtgacactgtcccctgcattaaaaataagacaatctgtttag

SEQ ID NO: 3779 - DNA, 867 bp, Bacillus licheniformis
atgaaaacaatttttgaagccctcaggtgggcttcttcttatttgacggaagcgggaagagaccggaatgccgcggaaattttgctgacagatcagctgaacatcgaccgcagcaaactgttggcaagcttccatgatgtcatatcagagtctgattttgcgaggtttaaaaaatctgtcgagcttcatcatcaaggagtgcctgttcaatatatcaccggaaaagagtccttttacggaagggaattttcggtaaatgaacacgttctgattccgcgtcctgaaacagaggaagtcgttgaagctgtcctttccgaagcggaaagagtttttcacgggacagatcgtcttaaagctgtcgatgtcggtacaggaagcggggcgattgcagtgacccttgcgcttgagagcccgcgtttttccgtcacggcgacggatatttcggaacaagctttaagtaccgcaagacacaacgctgaccggcttggggcgaaagtggatttcctctgcggtgatttgcttgaaccgcttatcgcgcgacagaagaaagctgatgtcatcgtttcgaatccaccttatatatccgaggaagacatgaggacgctgtcagatgtcgtccgtctccatgaacccgccggggctttaacggacggtgctgacggattgcagttttataagcgtttcatgaaggaaattccatctgtcatcgcagatcaggcactggtggtgtttgaaatcggctggactcaggggaatgccgttaaagacatgtttcaccggttctttcctgatgctgacgtgcgggtgaagaaagatcttaatggaaaagaccgcatcgtctgcgcggtaattgaacaacatagttaa

SEQ ID NO: 3780 - DNA, 1071 bp, Bacillus licheniformis
gtgttagaccgtttaaaatcgatagaggaccggtacgaaaaattaaatgaactattaagcgatccggaggttgtcaacgatccgaagaagcttagagaatattcgaaagaacaatctgatttacaggaaacagttgaagtatacagacgttatcgtagcgcgtcggaacagctgagcgatgctaaagcgatgcttgaagaaaagcttgactccgacatgcgcgagatggtgaaagaggagatttccgaactgcaggaagaaatcgagtcgctcacagatcagctgaaggtattgctgatccctaaagatccgaatgatgacaaaaacgttatcatggaaatccgcggcgcagcgggcggagaagaggccgctttatttgccggcaacctttaccgcatgtacagccgctacgcagagctccaaggctggaaaacagaagtgatggaagcgaatatgacaggtacaggcggatataaagagatcatttttatgatcaatgggaacggcgcatactcaaggctgaagtatgagaacggcgcacaccgcgtacagcgcgttccagagaccgaatccggcgggcgcatccatacatccacggcaacggtagcctgcctgcctgaagcggaagaggtagaagtcgatatacatgaaaaagacattcgcgtcgacaccttcgcatcgagcggtccgggagggcaaagcgtcaatacgacgatgtcagccgtccgtctgacccaccttccgacaggtgttgtcgtgtcttgccaggatgagaaatctcagatcaaaaacaaagaaaaagcgatgaaggttctgcgcgcgcgaatttacgacaaatttcagcaggaagctcaggctgaatatgatcaaaaccggaaatccgccgtcggaacaggagaccgctctgagcgcatccgcacgtataactttccgcaaaaccgcgttaccgatcacaggatcggcttgacgatccaaaagctcgaccaaatccttgaaggcaagcttgatgaagtgattgacgccctgattgtagaggatcaggcaagcaagcttcagcaggcggagagctaa

SEQ ID NO: 3781 - DNA, 384 bp, Bacillus licheniformis
atgctggaatcgattcatcacatcgccatcatatgctcggattatgaagcatccaaaacattctatgtcgacaagctcggacttgagattctgagcgaaacgtacagaaaggatcaggaatcatataaactggacctctcattaaacggccgctatgtcatcgaactgttttcttttccggatccgcccgcacgccttaccagacccgaagctgccggactccgccatttggctttcacggtggccgatcttgaccagaccgtcaaggagctcaagcaaaaaggcatcactgctgaaccgatccgcaccgatcccgggacgggcaagcgctatacgttcttctccgacccggacggcctgcctttagagctttacgaagcatag

SEQ ID NO: 3782 - DNA, 561 bp, Bacillus licheniformis
atgaatactgctgatgcggcaaatgaactgggggtttcaaccaaaacggtgcagcgttgggtcaagcagctgcaactgcccgcttcccgaaatgagcttggccactactttttcacggaagacgatatcgccattttaaaagaagtaaaagagcagttgaaaaacggtacgcctatgcaggatgtcacggtcaaacgcccgaaaaaaaccttcttcatcaagaaaaacgaaatgattcaaacgaaagagcctgcactgcaattgaatgagcggctcgaagaaaggctgcagcgttttttagagcatgaacagcttgaacgcgagctgctccaaaagaaaatcgccgagctggaaagaaagctggagcaaaaagcggacgaggtcgtctcctaccagcttctgcagcaaaggcgcgaacttgaagaagaacggcagcagatcaagcatctcgagcagaaaatcagccaattggaaagcatgaaccgccgggaaaaagatacagccgtcagaagagaagaaaaaaaaccgaagagcaaattgaaatcgatcttctctttttaa

SEQ ID NO: 3783 - DNA, 957 bp, Bacillus licheniformis
ttgagctttttaaatattttaatcctccttgcgccaatattttttgttattgcgctgggatggtttgcgggtcactttggaagctatgatgctaaatcagcaaaaggggtaagtacgctcgtaacgaaatacgcgcttccggcccactttgtatcaagcattttgtcaacgccaaaagataagttttacagccagattccgcttatgatttcattggtaatcggtatcgttggattttacgttattattttgcttcttttacgatttttgtttaaatacgatttaacagatgcttcaatgttctcattgaactcagcacagccgacattcgcctttatgggcattcctgtattgggcagcctgttcggcatgcaggaagttgcgattccaatcgcgattacgggaattgtcgtaaatgcgatgcttgatcctcttgcgatcatcgtcggaaccgtcggccgttcttcaaaaaaacaaacggaaacgacggacagcatttggaaggtgacaggaaaatcaattttacacggtttgtctgaaccgcttgcttttgcaccgcttgcaagtatcattcttgtgttattcggtctgcaaattcctgaattgccgcagaaaatgcttgatatgctcggagatacgacttcaggaatcgccctattcgcagtcggggtgactgtcggaatccgcaaaattaaattcagcatgcctgccttgagcatcgctttattaaaagtcgctgctcagcctgctttaatgtttgtgatcgcgatggtcgtcggcctttcttctgccgacatgacaaaagcggttctgctcgtggcattccctggttctgctgtggcggccatgattgctacaaactttgaaagccaggaagcggaaacggcatccgcgtttgtgatcagtgcggtgctgtcaattatttcgctgccgatattgattgcaattacagcttaa

SEQ ID NO: 3784 - DNA, 1704 bp, Bacillus licheniformis
gtgaacaacatgagaagaacgaaggaaggacatttggagacttctttgcggggtaaagacgttctttccattccaacgctaaataaaggtgttgcattttctcttgaagaaagaaagaacctcggtctagaagggcttctgccgccgactgttctcagccttgatcagcaggcagaacgggcttacgaacaattttcccgtcaacctgacagacttcgccaaaacgtatatttgaacgatctgcaaaacagaaacgaagtgcttttctataaattattgcaaaaccacctgcgtgaaatgcttccggttgtctatacgcctactgtcggcgaagcgattcaggaatacagccacgaataccgcagaccgcacggcgtttacttgtcaatcgatgatatggacggaatcgaaacggcttttaaaaacctgcaggcatctgctgatgacatcgatttgatcgtcgctacagattccgaaagcattttggggatcggcgactggggcgtcggaggcatcaatattgcgattggtaagcttgcagtatatacggcggcagcgggaatcgatccgagccgcgttatcccggtcgtactggatgtcggaacgaataatgaaaaactgctaaacgatccgctctatatcggaaaccgtcatccgcgtgtagaaggcgagcgctatgaacaatttatcgacgcttatgtcgaaacagcattgaagcttttccctaacgcgcttctacactgggaagatttcggaaataaaaatgcccgcaatatcatgagtaaatataaccataaaattgcaacatttaatgatgatattcaaggaacaggggctatcacgctggctgcgattttagcagctgtcaaaaagaccggcacgtctttgaaagaccaccgggtcgtcatcttcggacctggttctgctggtataggaatcgctgaccaaatccgcgacaccatggtgcttgaagggctttcagaagaagaagccaaccgtgcattctggacagtcgattacagaggattattaacgacaggcatggatcaaatcatggatttccaagaaccgtatttgcgcgatacggaagaagtgaaagattggaaacgcaatgaaaagggagagatttcctttgaggaagtcatccgtcaagtgaagcctacgatcctgattggtacatcaggtgttgccggcgcctttagtgaagaaatcatcaaagagatggcggctcatactgagcgtcctgtgattctgccgatgtcaaatccgacacatctggccgaagctgttcctgaagacttgttcaaatggacggacggaaaagcgcttgtggcgacgggaagcccgtttgaagctgttgagtacaatggcgtgaaacacgaaatcggacaatccaataacgcttttgtattccctggattaggcctgggtacaatcgttgcgaaagcgaaagtcatcacaaacggcatgtttgctgcatctgccaacgcggtcgcgaacatggtggatcatgaaaagccgggtgcaggtcttctgccgaaaatcgacgacctgcaagacgtatccgttcaagtggcgatcgacgttgtaaaagctgccattaaagacggcgtggcccaagttcagcctgaagatgtcgaaaaggctgtccgcgaagccatgtggcgtccggagtataaaacaattgttgcaaaacaagactaa

SEQ ID NO: 3785 - DNA, 585 bp, Bacillus licheniformis
atgtacatcatgaagcaaagcggctggcttgaactcatatgcggaagcatgttttcgggcaaatcagaggagctcatccgccggatcaaaagggcgacgtttgcgaagcaggaagtcaaagtgtttaaaccagccattgataatcgctacagcagcgaatcggttgtatcgcataatgggacatccattgtgtgccatgccatcgcatctccggaagaaatttttcaatacataagcaaagaaacggatgtcatcggcgtcgatgaagtgcagttttttgacgaaacgattgtcggcacgttaacttctctggctgatcagggctaccgtgtgattgcagcaggccttgatttggatttccggggcgagcctttcggcgtcgtgcccgatctgatggctttagcggaaacggtgaccaagctgcaagccgtgtgctctgtctgcggatctccagccagccgcacgcagaggctgatcaatggaaaacctgcttcttatgacgatccggtcattttggttggggcctccgaagcatatgaagcgcgctgccgccaccatcatgaagtgcctggaaacccgaaatga

SEQ ID NO: 3786 - DNA, 201 bp, Bacillus licheniformis
atgaaagcaggaattcatcctgagttcaaaaaagcaacagtcaaatgcgcttgtggaaacgaatttgaaacaggttcagtaaaagaagaggtacgcgttgagatttgttctgaatgccatccgttctacactggccgccaaaaattcgcttctgctgatggtcgtgttgatcgctttaacaaaaaatacggtcttaagtaa

SEQ ID NO: 3787 - DNA, 1284 bp, Bacillus licheniformis
gtgaaagatgtatccatttcatctttggaaaatatgaaattaaaagagctgtatgagcttgcaaggcattataaagtctcttattacagcaaactgacaaaaaaggaactgatttttgccattctgaaagcaaacgccgaacaggaagatctgctgttcatggaaggcgtattggaaatcatccagtccgaagggttcggctttctcagaccgatcaactactcgcctagttcagaggatatctatatttccgcctcacaaatccgccgttttgatttgagaaacggtgataaagtgtccggaaaggtccgccctccaaaagaaaacgaacggtattacggcctgctgcacgttgaagcggttaacggcgacgatcctgaatcagcaaaagaacgcgtgcactttccggcattaacgcctctttatccagatcgccagatggtgcttgaaacgaagccgaatcacctgtcaacacggatcatggacatgatggcgccggtcggctttggacagcgcggtctgatcgtcgctccgcctaaagcgggtaaaaccatgctcttgaaagagatcgcgaacagcatcacaaccaatcatccggaagcggagctgatcgtgcttcttatcgatgaaagacctgaggaagtgaccgacatcgaacgttcggttgcaggagacgttgtcagctcaacgtttgacgaagttcctgaaaaccatatcaaggtggccgagcttgtattggaacgtgcaatgaggcttgttgagcataaaaaggacgttatcattttaatggacagcattacaaggcttgcccgcgcctataaccttgtcattccgccgagcggcagaacgttgtccgggggaatcgatcccggcgctttccaccgtccaaagcgtttctttggagcagcccgcaacattgaagagggcggcagcttaacgatcctggcgaccgctctcgtcgacacgggctcgcggatggatgacgtcatctatgaggaatttaaaggaacagggaacatggagcttcatcttgaccgttctcttgcggaaagaagaatctttcctgccattgatattcgccgttcgggtacgcgtaaagaagagcttctcgttccgaaagagcaccttgatcgtctgtggtcaatccggaaaacgatgtctgacacgcctgacttcgtcgagaaattcatgagaaaaatgaaaaagacgaaaacgaatcaggagtttttcgatattctgatccaggaatggaaacaagccaatatgtctgctgcaaggcgctga

SEQ ID NO: 3788 - DNA, 966 bp, Bacillus licheniformis
atggaaagaagcttatcgatggaacttgttcgtgtgacagaagcggctgcgctaaagtcagcgcgctggatgggaagaggtaaaaaagacgaagccgacgacgctgcgacaagcgccatgagggatgtgtttgacaccattcctatgaagggaacggtggtaatcggagaaggggaaatggacgaagcgccgatgctttatattggagaaaagctcggcaacggctacggccctcgagtagacgtagcagtagaccctctcgaagggacgaacatcgtcgctagcggcggatggaacgctctcgcagtcattgcggtggctgatcacggaaacctgctgaatgcgcctgacatgtatatggataaaatcgctgtaggtcctgaagctgtaggctgcatcgatattgaagcgcctgtgattgataacttgaaagctgtggcaaaagcaaagaataaagatgtggaagatgttgtagccacgattttgaaccgtccgcggcatgagaaaatcatccatgagcttcgcgaagcaggcgccagaatcaagctgatcaatgacggggacgtggccggtgcgattaacaccgcttttgatcatacaggcgtcgatattttattcggctcaggaggcgctccggaaggcgtactctcggctgttgcactcaaagctctcggaggggaaattcacggaaagcttcttcctcaaagtgaggaagaactgagacgctgtgaaaagatggggcttgatacgggcaaagtgctccgcatggaagacctcgtcaaaggagacgatgcgattttcgccgcaactggcgtcacagacggagagctcctgaaaggcgtgcaattcaaaggatctgttggaacgacccacagcgtagtcatgagggcaaaatccggtacggtacggtttgtggacggaagacacagtctcaagaaaaaacctaacctagtcatccggccataa

SEQ ID NO: 3789 - DNA, 1290 bp, Bacillus licheniformis
atggaaaagttaaatatagctggcggcgatcctctcaatggcacagtacatataagcggagcgaaaaacagcgctgtcgctctcatacctgcgacgattttggctgattcgacggttacgcttgaaggccttccccatatttcagacattttgacgcttcgcgatctgctgagagagatcggcggaaacgttcactttgaaaagggagaaatggtcgttgatcctgcgccgatgatcagcatgcctttgccgaatggaaaagtgaaacagcttcgggcttcttattacttaatgggcgcgatgctaggacgctttaagaaagcggtcatcggccttccaggcggctgccaccttggtccgagaccgattgatcagcatatcaaaggttttgaggcgctcggagccgaagtgacaaacgaacagggtgcgatctatctgcgtgcggaggaattaaaaggcgcgcgcatttatcttgatgtcgtcagtgttggagcaacgatcaacatcatgcttgccgccgtgcttgccaaaggcagaaccgtaattgaaaacgctgcgaaagaacctgagattatcgatgttgccactcttttaacaagcatgggagcaaaaataaaaggcgccggtacggacgtcatccgcatcgaaggcgttgaatcgcttcacgggtgcagacactcgattattccggaccggatcgaagccggcactttcatgattgcagctgcttccatgggacaagaagtgctgattgataatgtaattccgacgcatttggaatcgttaatcgccaagctccgcgaaatgggggttcgaatcgaagaaagcagcgagcagattttaatggtcggcggacagaaagagctgaaaccggtcgatttgaaaacgctcgtataccccggctttccgaccgatctgcagcagccgatgacatcgcttttaacgaaggcaaacgggacgagcgttgtcactgacaccatttactccgctcgcttcaaacatattgacgagctgagacgcatgggtgcgtcgatgaaggttgaaggaagatcggcgatcattaccgggccagctcctttgcagggcgccaaggtgaaagcgagtgatcttcgggcgggagcatgtctcgttgttgccggtctaatggcggaaggtgtcacggaaatcaccggtttggagcaccttgacagaggctacagtcagcttgaagaaaagctgacaaagctcggggccactgtctggcgcgaaaaattgacagaccaggaaattgaacagctgcaaaactcgtga

SEQ ID NO: 3790 - DNA, 636 bp, Bacillus licheniformis
atgctgttttttattgatactgcaaatttagacgaaattaaagaggcgcacgctctcggcgtgcttgcgggagttacgacaaatcctagtttagtagcaaaagaaaacatttcgtttcatgaccgtctgcgtgaaattaccgaagtggtttctgggtcagtcagcgccgaggttatttctctgaaggctgaagagatgattgaagaaggaaaagagcttgcgaaaatcgcgccgaatattacggtgaaaattccgatgacgcctgacggcctgaaagctgttaaagcattaaccgatctcggaattaaaacgaacgtcacactgatcttcagcgcaaatcaggcgcttcttgccgcaagagcaggagctacgtatgtttccccgttcctgggacgccttgacgatatcggccacaacggcctcgacttgatcagtgaaattaaacaaattttcgatgtgcacggtttggacacgcaaatcatcgccgcgtccatccgccatgcgcagcatgtgactgaggccgcgctcaggggagctcatatcggcacgatgcctctcaaagtcattcaccagcttacaaagcacccgcttactgataaagggatcgaacagtttttggctgactggaataaataa

SEQ ID NO: 3791 - DNA, 858 bp, Bacillus licheniformis
atgcctttagtatcaatgacggaaatgttgaataaagcaaaagaaaacggatatgctgtcggacaatttaacttaaataaccttgagttcactcaagcgattttacaagccgctgaagaagagaaatctcctgttatcctcggtgtatcagaaggtgcgggacgctatatgggcggttttaaaaccgttgttgcaatggttaaagcgctgatggaagaatacaacgtaacagtgcctgttgcgattcacttagaccacggttcaagctttgaatcttgtgcaaaagcgattcatgcgggattcacttccgttatgatcgacgcttctcaccatcctttcgaggaaaacgttgcgacgacttcaaaagttgttgagctcgctcatttccacggcgtatcagttgaagctgagcttggaactgtaggcggacaggaagacgacgtaattgcagatggcgtcatctacgcggatcctaaagagtgccaagagcttgttgagcgcacaggaatcgactgccttgctcctgcattaggttctgttcacggtccttacaaaggcgaaccaaaccttggatttaaagaaatggaagaaatcggaaatacaactggtcttccgctcgtacttcacggcggtacaggcattccgactgccgacattaagaaagctatttctttaggtacggcaaaaatcaacgtcaacactgaaaaccaaatcgcttccgcgaaagctgttcgcgaaacgctggctgcgaagcctgaagagtatgatccgcgcaaatacctcggacctgcacgcgaagctatcaaagaaacagttatcggcaaaatgcgcgaatttggttcttcaaacaaagcataa

SEQ ID NO: 3792 - DNA, 375 bp, Bacillus licheniformis
atgaatgagaagattttaatcgtagacgaccagtacgggattcgggttctgctgaatgaagttttcaataaagaagggtacaaaaccttccaggccgcaaacgggattcaagcgcttgacattgtgaaaaaccagcgccccgacctcgttctgctcgatatgaaaatccccggaatggacggaattgaaattttaaaaagaatgaagatcatagacgaggggatccgcgtcatcatcatgacggcctacggagagctcgacatgatccaggaatcgaaggagctcggagccctgacacactttgctaagccttttgacatcgacgaaatccgcgatgccgtcaaaacgtatctgcccataaagtccaacggatag

SEQ ID NO: 3793 - DNA, 531 bp, Bacillus licheniformis
ttgcttaaaattttcaccactcaattgacgggaatcttcaaccggattcaagagggcgaggcccaatcgatagaggacggcgcccgcttgttggctcaggcggtcatcagtgatcattcggtttatgtatacggaaaaaatgaattggaaggcattttgaaagaagcgatgtacagttctgaaccgttcccctcagtcaaaccgctgcagaaggacgaagaaaactggcccgattttgaaatgacggacaaagtgctgatgttctgcgccggttcagcggatgacgaagaactgaaaatggcggaaaaactgtatgaaaaaggaatcggacttgttgtcgtctccccttcgggaaaagacggcgtcccgatcgcatccttcgccgatgtccatatcgattcaaagctgagaatgccgcttcttcccgatgaagacggaacaaggtacggatttccgtccctgatggtcagcctctatatttatcatgccctatcctttacattaaaggaaatcctccaggaataccaataa

SEQ ID NO: 3794 - DNA, 1512 bp, Bacillus licheniformis
ttgaatgtcaccattcaaaaatttgacccgtatatcaacgtagacccgggtacgatgagcccgtatcagcacggtgaagtgtttgtaaccgacgacggtgcggaaacggatcttgacctcggccattatgagcgctttatcgacatcaatttaaataaatacagcaacgtgacaacaggaaaaatctattccacggtgctgaaaaaagagcgcagaggcgattatttaggcggaaccgttcaggtaatacctcatatcacaaatgaaattaaagaccgtgtattccgcgccggaaaagaaacgcacgctgatgtcgtaatcactgaaatcggcggaaccgtcggtgacatcgaatcgctgccatttcttgaagcgatccgccagatcaagagcgatgtcggccgcgacaatgtgatgtacatccattgtacgcttgttccatatcttaaagcggcgggagaaatgaaaacaaagccgactcagcacagcgtaaaagaactgcgcagcctcggcattcagccaaatgtcatcgtcgtgagaacagaaatgccgatttctcaggacatgaaagataaaatcgcgctcttctgcgacattgatcctaaagccgtcatcgaggctggagatgcggatacgctctactccattcctctcgaccttcaaaaacaaggcctggacagcctggtttgcagccacttgaagctggattgcagagaagccgatatggaagagtggaaagaactcgtcaaaaaggtgaaaaatctgtccaaaacggtaacaatcgctttggtcggtaaatacgttgagctcccggatgcttacatttcagttgtagaatcgcttcgccatgcgggttatgcgtttgatgcagacattcaagttaaatggatcaatgcggaagaagtgacggaagacaacgttgccgatcttgttcaaaatgcggacggtattcttgttccgggcggattcggagaccgcggtgttgaagggaaaatcacgacagtcaaatatgcccgcgaacaaaagattccgttcttcggcatttgcctcggaatgcaggtggcatcgattgaatacgcgagaaacgtgctcggccttgaaggagcgcactcagccgaaatcgatccgtctacaccgtatccgattatcgaccttctccctgaacaaaaggacattgaagacctcggcggaacactgcgcctcggactttatccgtgcaagcttcaagaaggatcgaaagcatatcaggcatatgaaaatgaagtggtgtatgaacgccaccgccaccgctacgaattcaacaatgagttcagacagcagatggaagaagccggttttgtattttccgggacaagccctgacggccgtctcgtagaaattatcgagcttaaagaccatccatggtttgtcgcgtctcagttccatcctgaatttacgtcaagaccgacaagacctcaggctctgttcagagacttcgtacatgcttcgctaaagacttcggaaaagctgtaa

SEQ ID NO: 3795 - DNA, 516 bp, Bacillus licheniformis
atgagtttgaaacaatactcagaggaacagctaaaggaaatggctttagttgaaatcgcatacgaaattttctcggaacacaaaaaaccgattacattccaggagctaacagatcaagtggcttccttgcttggaatggggaaagaagagctggaagaccgcatcgcccagttctacacagatttaaatatcgacggacgctttttggcgctgtcagaccaaacgtggggcctgcgcagctggtatccgtatgatcagcttgatgaagaaacccagccgactgtaaaagcgaaaaagaaaaaagcgaaaaaagcggttgaagaagatcttgatcttgacgaattcgaagaaatcgacgaggatgatattcttcttgacgatgtcgaagaagatttggacattgacgccgatgaattcgatgaaatcgatgaagccgacgatgatgagctggatgatcttgaagacgagatcctggatgatgatgaagattttgatgaagaggaagacgaagagtaa

SEQ ID NO: 3796 - DNA, 1140 bp, Bacillus licheniformis
atgatctttaagctgagcgaagagcaccaaatgatacagaagatggtgcgcgactttgcccatcacgaggtggagccgactgcgaaagagcgggatgaggaagagcggtttgacatggaactgtttgcaaaaatggcggaattggggctcacgggtataccgtggccagaggaatacgggggaatcggcagcgactatctcgcctacgtcatcgcggttgaagagctttcgaaagtctgcgcctcaacgggtgtcaccttgtctgcccatacatcgcttgcgggctggccgatttatgcatttggaacagaagaacagaaacaggaatatttaaagccgatggcccgcggcgaaaagataggagcctacggattgacggagcccggttcaggctccgatgccggcggcatgaaaacgaccgcagaaaaaaaaggcgatgaatatattttgaacgggacgaagatctttatcacaaacggcggaatcgcggacttctacatcgtgtttgccaaccttgccccggaacagaaacacaaaggcacaaccgcctttatcgttgaaaaggacttccccggcttttctgtcggaaaaaaagagaggaaactgggcatccgttcatcaccgacaaccgaaatcatctttcaggactgccgcgtgcctttaaaaaaccgccttggcggggaaggtgaaggctttaaaatcgcgatgaagacgctcgatggaggcagaaacggaattgccgctcaagccgtcgggattgcccagggcgcatttgaggcggcgaaggcgtatgcgaaagagcggaagcaattcggcaggccgatcgccgagcagcagggcatcgcttttaaactggctgatatggcgacggagattgaagcttcaaggcttttaacctaccaggcggcatggctggaatcagaaggactgccttatggaaaggcttctgccatgtcaaagctttacgcaggggatacggccatgaaagtgacgacggaggccgtgcaaatattcggcgggtacggctacacaaaggattatccggtcgagcgctttatgcgcgatgcaaaaatcacacagatctatgaaggtacgcaggaaattcagaagctcgtcatttcgagaatgctgatgaaataa

SEQ ID NO: 3797 - DNA, 1131 bp, Bacillus licheniformis
ttgaattttcagtttacagaagagcagacccgcatgcagaaggttgtaagggattttgtcaaacaggaggtcgctccttttgtacctgaaatggaaaaaggccgttttccaacctctcttttgaagaaaatggcggagcgcggctggatggggcttccgataccggctaagtacaacggggccggtcatgactttatcacctatatgatgaccatacatgagctgtcaaagaaaagcgccgttcttggtgcggttctatctgtacacacgtcaattgtcaccattcccattcttttaaacggtaatgagcggcaaaaagagcactacgttaaaaagctggcagcagggcagtacttgggagctttttgtttaaccgaaccgagtgccggttccgatgcgggcagtctaaaaaccagggccgaaaagcgcggcgatacctatgtgctgaacggaacgaaagtttttattacaaacggcggagccgcggacatttatcttgttttcgcttcaaccgatccggaggcgggaacgggaggcatttccgcttttatcgtggagaagggcacgccgggctttttcatcggaaaaaatgaagagaaaatggggctccacggttcgctaacggtcactttaaattttgataacgctgtcattcccgcccggcagctgctgggggaggaaggaatgggattcaaaatggccctgtccaacctggataccggccggatcggaattgcggcgcaggctctgggtatcgccgagggagcgctttctgaagccgttcaatttctaaaaaaacggtatccggacggagagctgtataagaacggccaagcgcttgcctttaagctggccgacatggcggcgaggacagaggcggccaggcttctcgtctaccaggccgcctcgttgaaacagcaaggcatgcagacggggaaagctgcttcaatggccaaattgttcgcttcggaaacggcgatgtatgtcgccggagaggccgtgcagctgctcggagatttcggatacacaaaggatttcagcgctgaacgatatttcagggatgcgaaagtgtgtgaaatttatgagggcacgagcgagatccagcggatcgtcatcggtaaacatttataa

SEQ ID NO: 3798 - DNA, 864 bp, Bacillus licheniformis
atgaaaaaagacacgatcatggtcatcggagccggccagatggggtccgggatcgctcaggtctctgcccaggccggatacaatgtttacatgtatgacgtatcacctgaacaaattgaaaaaggaatgaagcgcatttccggccagcttttcagacaggcggaaaaaggcaagctgccgcatgaagatgtgaagcaaatctaccagcgcctttctccgtcggctgcgctcgacgaagcgcgggaagcttttctcatcattgaagcggctgttgaacaaatggacgtaaaaaaagacattttcacgcggcttgatgaagtgaccgaagactcagcgatattggcatcaaatacatcgtccctgtcgattacggaacttgctgccgtcacaaaaaaacctcaaaacgtcatcggcatgcattttatgaacccggttcccgtcatgcagcttgtcgaagtcatcagggggcttgagacgagcggcgaaacatatgaaaccgtcgtggctgcggcggagcggatgaacaaggttccgatagaggtgcgggatttcccgggatttatctccaaccgcatcttaatgccgatgattaatgaggcggtttttgcactttatgaaggcatcgccgagaaagaaagcatagacggaatcatgaagcttggcatgaaccatccgatgggcccgttggctctcgccgatctgatcggtctggatacgtgtctgtatattatggagacgctgcatgaaggctttggcgacgataagtacaggccttgtccgctccttaaacaatatgtcagcgcaggacgactcggaaagaaaacgggcagagggttttatacgtatgaaaagcagccgacataa

SEQ ID NO: 3799 - DNA, 1179 bp, Bacillus licheniformis
gtggcgagatcagttattgcaggcggcgcacgcacgccttttggaaaactcgggggcgcgcttcagtcaaagacggctgcggagctcggcggaatcgccgtaaaagaggcattaaaacgttccggtgtaaatcctgaggatgtcgatgaagtcatcatgggctccgtacttcaaggcggacaggggcagctgccgtcgaggcaggccgcgcgttttgcgggactcccgtgggacgtcaaaacggaaacgattaataaagtgtgcgcttcaggtttaagaagcgtcacaatggcggatcagatcatcagggccggtgatgcggaggtcattgccgccggaggtatggaatcgatgtcaaacgccccttatttgcttcaaaaagcgaggtgggggctgaggatgggagacggggcggttaaagatttgatgatcgcagacgggctgacatgctcatttacgggcgttcacatgggctcctacggaaatgccgctgcgaaagagttggagattgctagggaagagcaggatcggtgggcgctcaggagccacatgcgagccgtacacgctgcggattcaggcgcgctaggagaagagatcgtcccggtcagcatccaagagaagcgggacggcgaattaacggtcgatcaagatgaagcaccgcggcgcgacacgtcaatggaaaggctgtcaaagcttgccccggtttttgaccataatgggacaattacggcgggaaacgcgccgggggtaaatgatggggcatgctcacttatcgtgatgaatgaagacaaggcaaaggaactcaatgtgaaggcgccggccgtcattaaagcgcacacatcaattgcagtcgaagcaaaagactttccgaaaacccccgggcttgtcatcagagaactgcttaacaaaacgggagctgagctttctgatatcaaactgtttgaaatcaatgaagctttcgctgcggttgctttggcaagcggaaagatcgcgggtcttgacatggagaaggtcaatgtcaacggcggcgccattgcgatcggccatccgatcggcgcgagcggagcaagaatcattttaacgcttatgtacgaattaaaacggcgcggcggcggtatagggattgctgccatttgcagcggcggcggccagggagacgccgtgatgatcgaggtataa

SEQ ID NO: 3800 - DNA, 2115 bp, Bacillus licheniformis
atgaatgtcttgctgtcgttgaatttcattgcgtttttaggtgtaaccgtttacgccgtttatctgttcgtctatttgatcagaacgagaatcagttacatcaggctcggacaaaaagaggattttgataagcggacgaaggagcgccttcaaaagatatgggagaacgtgttcggccaaaagaaactgcttaaagataaaaaaagcggcatcatccatgtcatgtttttttacggctttattctcgttcagttcggagcgatcgattttattttgaaagggctcgttcctgatcaaggcattccgcttggcggcgtctacccggcgtttacgttttttcaggaaatcgtcacactgatgattttaattgcggtagtctgggcttttcacaggcggtatatagaaaaactcgtcaggctgaagcgcaattttaagtcggggatcgtgctcatgctgatcggcggcttgatgtttaccgttttactcggaaacggtatgaacatgatctggcatgaacattcattatcatggcacgaaccgatggcatcaggcatcgcttttgccttcggctttatgggggaaaccgcttcagcggcagtgttctacgcggcgtggtgggcgcaccttctcatcctgctgacatttttagtctatgtaccgcagtcaaagcacgcccacttaattgccggaccggcaaacgtatttttcagccggctgacaaacccgggaaagcttcaaaaaatcgattttgaagatgaaacaaaagaaacgttcggcgtcggacggatcgaggaattcaggcagtcccagctgatcgacctttacgcatgcgtggaatgcgggcgctgtaccaatatgtgcccggctacaggaacaggcaagatgctttcgccgatggatctgattttgcggctcagagaccatttgacagaaaagggagcagcagtgacatcgagaacgccttgggtacccgcaccgctctttcagcatacgaaaggcaaccagctggccatggcggcagggggagaagggtcaagggaagcggctgcttcagaactttacaacccgagcttaatcggcgacatcatcacagaagaagaaatttgggcctgcacaacatgccggaattgtgaagatcagtgcccggtcatgaatgagcacgtcgataagatcatcgatctccgccgctatctcgtgctcacagaaggaaaaatggatgcagatgcccaacgcgccatgacgagcattgaaaggcaggggaacccttggggattaaaccgaaaagaacgtgaaaactggcgtgatataagagacgatgttgaggtgccgacagtaaaagaaatgaagaaaaaaggcgagtcctttgaatacctgttttgggtcgggtcgatgggatcgtatgaccggagaagccagaagatcgccatggctttcgctcgcctcctcaatcaagccggggtcacgttcgcgatattaggcaataaagaaaaaaattcaggcgatacgccgagacggcttggcaacgagtttttattccaggagctagctgcaaaaaacattgaggaatttgaaaaaaatgatgttcaaaaaattgtaactatcgacccgcatgcatacaatattttcaaaaatgaatatcctgattttggtctgaaagcggaagtttatcatcatacagaaattcttgctgccctcattgaagaaggaaagctgaaacctgagtttccggttcacgaaaccgtcacctttcatgattcatgctatttgggccgctacaacgaggtttacgatccgccgcgcgctattctccgctccattccgggcatccgtttagcggaaatggagcgcagccgtgaaaacggaatgtgctgcggagcggggggcggcctcatgtggatggaggaagaggcgggcgcgaggatcaacgttgccagaacggagcaggcgctcagcacatcaccttctgtcatcagctcgggctgtccttactgtttgacgatgctcggcgacggaacaaaagccaaggaattggaggatcaggtcggcacgtatgatgtagcggagctgcttgaacgcgccgtattcgggtcagagcaaaaagaacatgcctcatag

SEQ ID NO: 3801 - DNA, 1191 bp, Bacillus licheniformis
ttggtgccgcttatgattatggtatgttttctcatcctgcttcttgcgctcgatttccattttggccgcaaagcctttgagaagaaagcctacgagcccgttttttcagagaagaaaagcgatattgaactgattcataatggagaagacttgtgtgagcggctgctggatgacatccgccaggccgaatcgtcggtgcatgtcatgttttatattgtgaagaacgatgacatcagccttgaatttttgaaggtgctgaaggataaagcgaaatccggcgtatgcgtacgattgctgatcgaccggatcggcgcgatgaaggtgaagaaaaaaacgctctccggcctgaaacaaagcggtgtgcacgtttttttcgccaacaagccgggcttcccctatttcttttaccggctgaatgcgaggaatcatcgaaaaatcgccgtcatagacggaaagatcggctatgtgggcggatttaacatcgcgaaagaataccttggtaaaaaagcggaattcggaccgtggaaggattaccatttgcgaatgacgggagaaggcgttgccgacttgcagcacatttttatatcggacttcaaaagagaagcgccgcaggcaaagccggccaacagcgtatttccgccgctgcagcaaggagctgtcacccatacaacccatgcgacaaagggattttctctagaggaaaaatacatttcatttatcgaacaggcaaaagaaagaatcatgatttgcacgccgtactatattccgagcccggctttgcagcaggctgttctctcagccagggaaaggggcgtgatcgtgtcggttctcgtgccgatgaaacccgatcatccgcttgtcaaagaggccgcctacacgcactttccagcccttttaaaagcgggctgctatatttaccggtactacagaggcttttatcatgcaaaagcattaatcgtcgatgaccggcatgtgatgatcggaacatcgaattttgacaacaggagcctgtttctcaatgatgaagtgaatgtcgtcatccatgataaagactggacaaagcaattcttcgacgtcgtcaaggaaagcattgaacacgccgagcttctgacaaaggagcggtatgcgaagcggccggtgatgcagcggcccgtcgaatggctggcgaaatcgatttcattctttttataa

SEQ ID NO: 3802 - DNA, 267 bp, Bacillus licheniformis
atgaaccaagcagagtcgattaaactccgcgcccaatcgatgacgttaaaaaacttgattgagctgtacaagctttgccgctcagccagacatcagctatatatatgctcaagaaaaacgatgtgcaaaatcaaagatttaattgagctggaaatgttcagaatggccaatcgcgaaaatgagtgcctgattgtcatcgaagggaaaatggcgcaggaattagtaaaaaaagcacaatcgattctttctgacgctcaagttcaataa

SEQ ID NO: 3803 - DNA, 1671 bp, Bacillus licheniformis
atgaacatagtcgaacaaatgaaagatgtgctgaagcaggaaattaaggaagctgtcatgaaagccggcctcgccgaagaaagcgagattccagaagtcgtactggaagttccgaaagacaagtcgcatggcgactattccactaatatggctatgcagctggcgagaatcgccaaaaaagcgccgcggaatattgccgaagaaatcgtcgcatcctttgacaaaggaaaagcgtcgatcgacaaacttgatatcgcaggacctggctttatcaatttctacatgaacaatcaatatttaacgaagctgattccggctgtgcttgaagcaggagaggcctacggtgaaacaaatatcgggggcggggaacgcgtccaggtggaattcgtctcagcaaacccgacgggcaacctgcaccttggacatgcccgcggagccgctgtcggagattccctctgcaatgtacttgaaaaagcggggtatgaagtgagccgcgaatattatatcaacgatgccggcaatcaaatcaacaacctcgcgttatccgtcgaagcccgttactttcaggcgcttggaaaagataagccgatgcctgaagacgggtatcacggcgaagatattaaggaaatcggccaaaagctcgccgacgaattcggcgatcgttttgttcatgaagaagagagcgaacgcctcgcgtttttccgcgaatacggcttaaagtacgaattgggcaaacttcgtgaagacctggagaatttccgtgtcccatttgatgtctggtactctgagacatcgctttaccaaaacggaaagatcgatcaggcgctcgaagcccttcgcgaaaaagggcatatctatgaagaagacggagcgacatggttccgctcgacggcgttcggcgatgacaaagaccgcgtgctgatcaaaaaagacggatcctacacgtatcttctgcctgacatcgcttatcacaaagacaagcttgaccgcggcttccaaaagctgatcaatgtatggggagcagaccatcacggctatatcccgcgcatgaaagcggctattgaagcgctcggttatgacaaagaaacgcttgaggtcgagatcattcagctcgtccacctttacaaaaacggcgaaaaaatgaaaatgagcaaaagaaccggaaaagccgtcacaatgcgcgatcttattgatgaggtcggccttgacgctgtgcgttacttctttgcgatgcgcagcgccgatacccatatggactttgaccttgatctggccgtctcaacatctaatgagaatccagtttactacgcgcagtacgcccatgcgagaatttgcagcatgctgcgccaaggcgaagaaaaaggcatttcttttgaagggaaccttgatcttacgaagatcggttctgagaaagagtatgatctgcttaaagtgatcggctcgttccctgaggccgtcgctgatgccgcagagaagcggattccgcaccgcattacaaactatatttttgaattggcatctgtgcttcacagcttttacaatgctgagaaagtcctcgatccggcagatgaagaaaaaagccgggcccgtttatcattgatgaaagcaacgcaaatcacattaaataatgccctcaagctgatcggcgtatcagcgcctgaaaaaatgtaa

SEQ ID NO: 3804 - DNA, 429 bp, Bacillus licheniformis
atggatcaggagacacccgttcatatctatgtgaaatctgttatccgggaaggatcggacacggagacgatcgagttccggacaactggattttattatatgaaaaaagataaaatatatctttcttatcatgaagagcatgatgctggaaaggtgaagtcgatcgtcaaggcaagtgaaaacgaagttctggtcatgcgttccggcgccatcgaaatgaaacagcgcttcaggccgggcagccgcaccgtcactcattataaaatgccattcggcagactcgagctcggcgtggatactaaagctgtatcagtcacacatcagccgccggacggaaagatcagcattgagtacgatatgattgtaagcgatgaacaaaagcatttacataagatgtcgatttcgtatagaggaggacacgagtcatga

SEQ ID NO: 3805 - DNA, 873 bp, Bacillus licheniformis
atgagatttgatgaagcatattccggcaaggtgtttatcgcaagccgccccgattgggaagaggcggacgccatcctttacggcatgccgatggattggacggtcagctaccgtcccggctcccgcttcggtccggcgagaatccgcgaggtgtccatcggacttgaagaatacagcccttatttggacagggagctggaagaggttcatttctttgacgccggcgacatcccgctgcctttcgggaacccgcagaagagcctcgacatgattgaagaatatgtcgacagcattttagataaaggaaaattcccgctcggtatggggggagagcatctcgtttcatggccggtcattaaagcgatgtacaaaaaatatcccgatcttgccatcatccatatggatgcgcacacagatctccgcgtcgactatgaaggagagccgctctcgcattcgacgccgatccgtaaagccgcggaactgatcggacccggcaatgtctattcattcggcatccgctccggcatgaaagaagaatttgaatgggcaaaagaaaacggcatgcacatttctaaatttgaagtgcttgagccgcttaaagccgtcctgccgaaactcgcggggcgtccggtttatgtgacgatcgacatcgatgtcttagatcccgcgcatgcgccgggaaccggtacggttgacgccggaggcatcacatccaaagagctgctcgcttcgattcacgaaatcgcccgctcagacgtcaatgtcgttggaggagaccttgtcgaagtcgctcctgtctatgaccattcggaacaaaccgcaaatacggcaagcaagctgattcgcgaaatgctgctcggctgggtgaaataa

SEQ ID NO: 3806 - DNA, 831 bp, Bacillus licheniformis
ttgagcggactttggtatacagagaagcaaacgaaaaatttcggtattacaatgaaaatcaacaggactttacatacagagcagacagattttcaaaagctcgaaatggccgagactgaagaattcggcaacatgctgtttttggacggcatggtcatgacatctgaaaaagatgaatttgtctaccacgaaatggtggcgcacgtgcccctgtttacgcatccgaatcctgagcatgtgcttgtggtcggcggcggagacggcggcgttatccgtgaaattttgaagcatccgagcgtgaaaaaagcgacgcttgtcgatattgacggcaaggtgatcgaatattccaagaaattcttgccttccattgcaggcaaacttgacgatccgcgcgtcgaagtaaaagtcgatgacggcttcatgcacattgcccaatctgaaaatgagtacgatgtcatcatggtggattcaaccgagccagtagggcctgctgtcaacttgtttacaaaaggcttttacgccggcatagcaaaagcgctaaaggaagacggcattttcgttgctcagacggacaacccttggtttacacctgaactgatcacaaacgttcagcgcgatgtaaaagagatcttcccgattacaaagctgtatttggccaacattccgacatatccaagcggattgtggacgtttacgatcggttcgaaaaaatacgatcctcttgaagtggaggacagccgcttctttgatattgagacgaaatactacacaaaagaaattcataaagcggcattcgtccttccgaaattcgtcagcgatttaatcaaataa

SEQ ID NO: 3807 - DNA, 492 bp, Bacillus licheniformis
atgcggcgttcagcaggtgcaattgcaacaaacagaacggtgttgccgttgattttgctcggctgcaccgtttctgcttttgtgatgatctgcctgctgttttggagtgcggccatcggctggtttacattcggcggctacggtgcggagaatgttcatcctttttttgagctgtcgggttctcccctctggtttgttgtctcacgcctgttcattgactggtggtcgctttgctttctgatttttctcggcttggcgggagtgctgatcgcaaagaaagagcagcttgctctatggctgccgcttgcgtggtcctcgggtttaatgctccttttcaaattcaatatatcctttaaagggctgctcccgggggaaggcatgctgttgtccatccatgcagcaggagcttccccgattctggccgcatcagtcagcgaaggtgcagttttcgtattatggctgatttcatatgtggcgaccgccaaaaaatag

SEQ ID NO: 3808 - DNA, 2076 bp, Bacillus licheniformis
atggacataatgacggacaagcgggtccgtttaaccatcaagacgatacgcgcatttttgttcatgggagcattgatgctgatcttcctttcaatcgttgtcatgacggtggtcttggcggccaaatggcaaggcgctccttcgattcaggtgccgaggtctaccgtgctgtatgacggaagcggaaagcaaatgggggaaacgcattacgggcaaaagcggtactgggtttcgctgaagaacatcaatcccgcagtcatcgatgccacgcttgccgttgaagaccggaactttttccggcaccacggctttgactatatgaggatgggcggcgccctcattgccgatttaaaggcgatgtccaaagttcagggagccagcaccatcacccagcaatatgcgagaaacctctacctcggccacgataaaacatggaaaagaaagtggaatgaagctttttatacgataaggcttgaacaaaactacacaaagaaagatattttggaaggctatttaaatacgatttattacgggcatggagcatacggaatcgaagcggcttcccggctgtattttggcaagcgggccaaagatatcaatacggcggaggctgcaatgcttgccggcattccaaagggtccttcagtttattcgccctttgtcaatgaaaaaaaagcgaaagaacgccaggaaatgatcctgacaatgatggagaaacaaaacaagctgacggaaatgcaggcggcagcactgaaaaaaatgccgctccgctttgaaaaacaggataagcaaacaaccgaaaaaaccgctccgtacttttatgacgaagctgttaaagaaatttcgcgattgctgcgtttgacgccggagcaagcggaaacaggcggctacaacgtattcaccacgctcaacccgcgtctccaaaaaattgccgaggatacgatcgaacacacgatagattcgtcatccgacattcaggcgggatttgcagcgatcaacccgtccgacggcagcgttctcgcgcttgtcggaggacgcgactacgaaaaaagcccttttaaccgcgtaacgcaggctatgcggcagcccggctccaccatgaagcctttcctttattattcggcggttcaaaacggctttacaccggccacccgaatgaggagcgcggaaacgacatttgagctcgggcaaggcagcgcttattccccgagcaactatcacggctattatgcagacggtccgatcacgcttctgcaggcactggctttgtccgataacatttacgccgtgaaaacccaccttttcctcggcatggacaaactgattgatgccgcaaagcaattcggcatcaacagcccgctgcaaaaagtgccgtcgcttgcgctcggaacatcccctgtgaagccgattgaaatggtgaacggatacgccatgtttgccaacggcgggaaaaaaatcgaaccttcctttattacgaaaattaccgatccgaacgggaaggttctttatgaaaaaccgaagcggagcaaacaaatccttgacccaaaagcggcttttatcacggcgaacatgatgagcgggatgttcgacaaatcactcaacggctatacatctgttaccggccggacgatcgcagatcagctgacgcgccgatacgccggaaaatcgggaacgaccagcaccgacagctggatgatcggcttttatcccggtcttgcttcaggcgtgtggacgggatatgacaaagagcggacaatcgatgccgtcgcagagaaaaactatgccaaacaaatttgggctgagtttatggaaaaagcgcttgaagacgcgcccgccgcagctttaatgccgcctgaaggcgtgaaagggatgtacatcgacccggctacaggttatgcggcggcgcccagctgcccgtccaaatatttcgcttattttatcaaaggtactgaacccgagcaggtttgctatggaaaggaaatctataaggagcaaaacgccgggcacgaaaagcccgccgctcccccccataagcggcaaaagtggtgggaaaaatggtttaaaaaaggagaataa

SEQ ID NO: 3809 - DNA, 516 bp, Bacillus licheniformis
atggaacaaggaaaaaagaaaaaaacaatcggattcaacattattaaaagcgatccgacagacggacacgggggatttggagcaggcgcattaagccttgacaacatctcgcctgtcattgtcgatgttgaagagaaagaagcgtttgtggatatcggcgccatgcacgcccgcagcacggttgaaaaaggaatcaaatttttgccgaacaaagaagaggtgccgaacggaaaaccttactggcttgtgtgggttacgatcgaccgcagggaagaaggcccttattatgcgggtgtgacggcatgcgaaatgacggtcgacagaagcatccgccgcggctacaaatcgcttccggagcacgtcaatttaatggataagtcgatgaagcggaagattatcgtcgagcatatggatgaaggttctaagcgcgttcttgccgattttctgaaaaaccatgatcaagggctttgggaccgttcatcagacgagctgaaaaagggactgctccagcaatag

SEQ ID NO: 3810 - DNA, 690 bp, Bacillus licheniformis
ttgtatatgagaaagagggaaagccacattttagaccgttttcttatttatccgctggaaatgattccgtatgttgttttgacacttgctgccgcattcactgtgcatgaggtcgcccatgcgtatgtggcttacaaattcggcgatgagacggccaaacggcagggcaggctgacgctcaacccgcttaagcatcttgatccgtttggaacgattttgatctttatattgggattcggctgggcaaagccggtgcccgttaaccgcttttattttaaaaacccgaggctggccggatttctcgtgtcaatcgccggaccgatcagcaatctgatccttgctttcatcggttttatattgctgcttttgtccgtgaagctgtccgggacgctgcctgccggtttttacagcggtttgcttcaattttttacgatttgggtgaatctcaacctgcttttatttctgtttaatttaatgccgttcccgcctcttgacggttttcgggttatacaggatgtggtcgcccccgaagtgcgggcgaagctgtcgaaatatgaggcgtacggctcgatcgtctttctgattatcgtcattacaccgcttggccaatatgtattctggccgtttttgaatgacgggcgggaattgatcatatcgatatttaacagcgttttccggccgctgatgtag

SEQ ID NO: 3811 - DNA, 186 bp, Bacillus licheniformis
atgccatacgtaactgttcaaatgctggaaggccgcacagatgaacaaaaaagaaatctcgttaaaaaagtgaccgaagccgtctccgaaacaacaggcgcacctgcagaaaaaatcgcggtcatcattgaggaaatgaaaaaggaaaactacggtgtcgccggcaaacgaatgagcgatatgtaa

SEQ ID NO: 3812 - DNA, 807 bp, Bacillus licheniformis
gtgaagaaacgttctttattcttatctctattactttccgtcagtctcattcccggtgtgacggccggtgccgccaagacgggcgggcatgagcacgagcacgatcatgaagcaagaggaacttatattgattctttgcctaaagcgaaagattttaaagacttgaaaggaaaagttcaaattgaaagaacggtcaatacgaaaatactggatgagaaaggaaatgtgacgggaacgaaaacgtttaaaaagaatacgggcaaagggtcgttttcaacccaggcaggcacgggaagccagaaagtgagcgtccttgccgtggctgacgctcagtatcgggcgaaatacagcgattggcagacaagaatcgtccaaattattgagcaggcggatgtcatgttcaacagggatcacgatgttgattttgtcgtcgaagctgtggcgccttggacctcttcaggcagcaacagctctcaaattctatcaaaccttcagagcaatttcagcgggcgcagctataaattcgtcgtcggatttacggcgaacagtaattttgacgccggcggcatcgcatacgtatacaacagcaagccgaacggcagcgccttcagcgtaaacctcgaccagggaacggccaacacggcaaaagctgcaacccacgaattttcccataacttcggcttgaaccacgatgcgcaaggaagcggaatccgctgcattatgaactacgactacgcatacacggtcgatgtttgggattcagctcacaatagccagatcactaaaaacaaagcttggtataaataa

SEQ ID NO: 3813 - DNA, 504 bp, Bacillus licheniformis
ttgttaaaagaacatgcaaagctgatgaaggtcttctcggattcgggggagattgtcgggcggaaaaagctgcagaaaatcatttatatcgcaaagaaattggagcttcctttttatgaaaagtatgattttcatttttacgggccttattcagaggagctgacgcttcaagtcgaagaactttgcaatctcggatttctccatgaagtcaaagaaaaaaagggcggctattatcaataccgctattcacccactgaagcgggaaagcagtttttgagccagtgtgagctggatatgcgggatattaaagcctatttagacgacgtaaacggccagtcatcgcgttttttggaactggtgtcgacgattttgtattttgaggggctggagcaggaagagattagagaaaaagtgtttaccgtaaaaagcaaacagcggtatacggacgaagaattcgatgaagccgtcgcttacataaaaaagctcagaaatctttgttcataa

SEQ ID NO: 3814 - DNA, 1299 bp, Bacillus licheniformis
atggcgtatccaaacggaaaattatcagaagaaaaagtgtttaaagatcctgttcaccgctatgtccacgtacgggacaagctgatatgggacttgatcggaacccgcgaatttcagaggctgcgcagaatcaaacagcttgggacgacctatttgacgtttcacggagccgaacacagccgtttcaaccattctctcggcgtctatgaaattgtcagaagaatggttgatgacgtttttaaaggcagggaggaatgggatgacagcgagcgcgatctgtgcctttgcgccgcattgctgcacgatttggggcacggcccgttttcccattcgtttgaaaaggtcttccggcttgatcatgaagactttacgagagcgatcattttaggcgatacagaagttaaccgagtattaaacaaggtaagtccgacatttgcaaaggatgtcgctgaagtcatcgcgaaaacctatcaaaataagcaggtcgtcagcctgatctcaagccagattgacgctgaccgcatggactaccttcagagggacgcctattacaccggcgtcagctacggtcattttgatatggagcggattctccgcgtcatgcggccgcgcgaagaccaaatcgtcattaagcaaagcggaatgcatgctgttgaggactatattatgagccggtaccagatgtactggcaggtctacttccatcctgtgacaagaagtgcggaagtgattttgacgaagattcttcaccgtgcaaagcagcttcatgaggaaggctatgttttcacgcatgcgccagtgcatttttattctatttttgaaggcaatgtcacattggaagattatttaagtcttgatgaatcaatcattctttattattttcaggcctgggaaaaagaagaggacgaaattttgtctgatttatgccgccgttttatcaaccgcaggctgttccagtatgcggaattcaatccgaatgaggaaatggcgacttactttgaactgaccaacttgtttaaagaatcagggattgatcccgaatattatcttgtggtggattcgtcctcagatcttccttatgatttctacagaccgggggaagaagaggaacgcctcccgattcaattgctgacgcacaacggccagattaaggagctgtcgcggcagtccgatattgtcgatgcgatatcaggcaagcggagaacggaccataagctgtatttcccgctcgatttaatcgaagggctgcctgacggccgtcatgcgaaaagaatgaaagaattgctcggactgaaatag

SEQ ID NO: 3815 - DNA, 225 bp, Bacillus licheniformis
atggctaatgaatttcgagtatgcgacgattgccaggccaccaatttaaagacgcttttgccccgtctgaaagaaattgatccggatgcaaaagtggaaatcggctgccagtcttactgcgggccgggacgaaaaaaatcgtttgcgtttgtcaataatcgtccgctgtcagctcctgatgaagacgagctgatcgaaaaagtgaaaaagaaactcaaaaaataa

SEQ ID NO: 3816 - DNA, 786 bp, Bacillus licheniformis
atgaaacaaagacaagacgcttggtctgaggaaaatgatttactgcttgctgaaacggtattgcggcatgtcagggaagggagcacacagctgaacgccttcgaggaagtcggagacagactgaacaggacatcagccgcctgcggttttagatggaacgcagttgtccgccaccaatacgaaaaagcattgcagctggctaaaaaacagaggaagcaaagaatgcgcgccctcggaaacggacagccggcgaaaaaacgcttattatacaagccgccggtcgaaacgaatgctgaacctcctgcagaaagcgttgttgagcagaagaaagcaaccgcagattcaagcgaacagcagccgatcgccagcgagcatctgccttatgttgatgagagctttaaagaagagttagctagtttatctcaccttctatcgccaaatcagccgcaggccggccatacagccgatacatcgaaagacatgacgatcgatgatgtgatccgcttcctgcaaaactatacaggaaacgaagaacaaactgccgctttaaaaatggaaaatgaacgtttaaaacaggaaaacgaagaactgacgaagaaagttgaaaagcttgaagcggaagtcaaaaagctggaaaaagaccagacaaccatccaggaagactacgaaacgctcgtaaaaattatgaaccgtgcaagaaaactagttttattcgaagaagacgaacacgctgcgcccgccttcaaaatggaccggaacggcaatttagaaaaaatggctgaatag

SEQ ID NO: 3817 - DNA, 330 bp, Bacillus licheniformis
atgaagtttgttttatatgcggttcagttcggcactgcggcccttttgtttttgttttctgcattggcaagctggtatcaaggcagcgagcttttaaaggtgccgtgggagtggaaatatacagccaagtttacaagttggctgtacggagaggactccattaaaaacgcacataatatttcacagcttgattttttcgtctatgcggccaagcatacgccggcaaccgttattttaatggccgtcagtttggcgtatatcatcgctttggcggcttatcttctcatcaaaacatatgtaaaacgaaaaagcgcttcgagcgcagcataa

SEQ ID NO: 3818 - DNA, 846 bp, Bacillus licheniformis
atggcaaagcaaccgattgatctactcatccagccgaaatggagaatcattgaccaatccagtctcggcccatattttgatgcaaaacaatcatttgcgatagatgatacgctgtgcgcttctgtcgggaaaggtttatctccggcgaccgcgcgttcctgggtgcaccatgacacgattgtgctcggaatccaggatacaaggctcccttatttacaagaagggatttcattgcttgaagaagcgggctatcaagccatcgtccgcaattccggcggactggccgtcgttttggacagcggggttttaaacgtttccctgatttttcaggataagaaaaacggaattgatatcgacagaggctatgaagcgatgtttgagctcgttaagcgaatgctgtcatcctatgacgcagcaatcgaagcctatgaaatcaaaggctcctactgtccaggaagctttgatttgagcatcgggggaaggaaatttgcgggaatttcccagaggcgcctgagaggcggagtggctgttcaaatttatttgtgcgctgatcaaagcggaagcgggcgcgctgagctgatcaaacgcttttacgacaccgccttgaaagacatgcgcgggaaaacaaaagccgtttatcccgatattcgcccggaaacgatggcttcgctttctgagcttctcaatgaagacatttcggtgcaggacttgatgctcttgcttctgacacagctgaaagagctgggcggggagatttatcaaggccctctcacgcccgcagaagaggaagtgtatgagaaaaaccttgtccgcatgattgaacggaatgaaaaggtttttggatag

SEQ ID NO: 3819 - DNA, 1206 bp, Bacillus licheniformis
ttgcggacacaagtgggaattatcggagcgggacctgccgggcttatgctcgctaacctgctccaccgcaggggaatcgaagcggttgtgatcgaatcccgctcgcgaaaggagattgaagagaccgtccgtgcaggcgttctagaacagatgacggtagatttgctgaatgaaacaggtgccggtgaacggatgatgaaaacagctatgtttcatcaaggaattgagattcgctttggcggcaagcggcacagaattgatatgcacaagctgacgggggggaaatacattgccatctatccccagcatgaagtgatcaaagatttaatcgccgcccgcctgcaatcggaagggcgcatcgttttcaatgtgtctgacgtccgcctttcaaatattgatacagaagcgcctgtcatcacttatcagaatgaaaacggcgatacagaagaactgaactgcgatttcatcgcagggtgcgacggctttcacgggccgagcagacaaagcattccgaaggagatccgcaaagagtacgaaaaggtgtacccttacggatggctcggcatattggctgaagcccctccgtcctcgcctgaacttgtatatgcccatcatgaagacgggtttgccctcgtcagcacaaggacaccggaaatccagcggctttacctgcaagtcagtcctgcagattcagtcgggaactggccggacgaaaggatatgggagaagcttcacctaaggctgtcggccgatgacggatggaagctgactgaaggcccgatcattcaaaaaaacattgtctcgatgagaagctttatatgcgatccaatgcaatacggcagactctatttagcgggggatgccgcgcatattgtacccccgacaggtgcgaaaggcctgaaccttgcgatggcggatgtccagcggcttgcatgggcgctcgaagactattacgaaaccggaagaatcgaacggctggccggctattctgagtcttgcctccgccgcgtctggaaagctgaacgcttttcctggtatatgacatccctgctgcatcgccatcacggctacaccccttttgactaccagattcaattggctgaacttgaccatgttacgacttcaacggcggccgctcaaagtcttgccgagaattacgtcgggctgccgcttgaattcggagaaccgtctttaagcgtcacttga

SEQ ID NO: 3820 - DNA, 1377 bp, Bacillus licheniformis
atgaaaaatcgttcagttcatccagcggaagtcatggcggccagcaaatttaacaaagtgcacctgactgttttcctgtggtgttttttcgccattgcctttgacggttatgatattgcaatgtacggcgtcagcctgccatggctgatggaggaatggagcctgaccgccatccaagccggagcgatcgggagctatacattgatcggcatgatgctcggcgcgcttattttttcgccgatcgcagatcaatacggccgcaaaaaggtgttgggcttctgtatctttctgttcagcctgtttactgcagcagccggtctgatcgattctccgcttttgtttacgatcatgcggtttctcgctgcgcttggaatgggcgggttgatgccgaatgccatttcgctgatgacagagtattcgccgaaaaaaaacagagcggtgattgtagccgctatgtattgcggctattctgcaggcggtgtgctggcttccctcgtcggcatgttcgccgtgcccgtgacaagctggagagtgctctatctgatcggagccgtgccgctcttcgtgctcccgttctttttcagcaggtttcccgaatctctgtcattttacgttttgaagaaaaagacgaaagcgctggctgagattttcaatcaggtgcatccggcgggacgctacagggaagacgacaattatcaaatctcggtgattgcgaaagaaaagaaaggctttccggtaaaaaaactgtttggacaaaaacgtgcagccagcacattcgcattctggctttccgttttcagctgccttctcatggtttacggcttaaatacatggcttccgaaaatgatgcaggcgtcaggctacgggctgtcgtcaagcttgtcattcaacttggcgctttgctgcggacaagccgcaggagcggtattcggcggatatttggcagataaagccggccataaaaatgtgcttgcggctatgtatgtcatcggagccttttgttttgcagcatttggaatgacgatgaaccccgttcttctgtacttgctgattgccttaggcggggcatgcaccgtcggagcgcaaaatatcgccaatccttatatttctgagtattatccgaaagaaatcagagcgaccggcatcggctgggcgctcggggtcggcagactcggagcgatcattgcgccttcgctgtttgcattgatccttgcttccggcatggagccgaagcaggctttcatggtgttcgcgatcccgagtgtttttgctgcactcggcatcatgctcgtccaagagaaacacgcttcatttgattttgtctctaagtcggaaagcgccgggtatacattagaagccacatcaaaacatggataa

SEQ ID NO: 3821 - DNA, 852 bp, Bacillus licheniformis
atgtcaatcgaattggcggcgcttgttccgcatacaccgaggatgtgttttgaagataaaacccctgacttccaaagagagctggtcaagggcatgaagaggctctccaggattattgaaagaattgagcccgatgccgttgtcctgatttcctgtcactggacgtcaagctttgaccatctgatcgatgcagctcccgaccatcaaggcgttttaacggctttggagtgtccgaatttaatttccgatgttccgtattcttaccccggggacactgaattggcgctgcaattggctgaagccggcagagaaggggggctttccgtcattcctgtcaatgatccagcttactgctgggattacgggacggtcgttccgctgcgctacctcgttccaaagggagatattccggttatcgatttatcggttacattggccgcgaacctggaagaaacgcatttgtggggccggcttgccggaagagtgctgaaagaaagcagaaagaaaaccgtgttcatcagcagcggggcgctaagccatcatttggtgagggggccggaatgtatgccgacattggccgaacaggccctcgatgcacaatttttgacctacttaacagacaacgatcttttatcagctcagcagatgctgcctcaatatgctaaaaacgccgggcttgaagccggcggccgccacattgcaatgctattgggcgtgctggaggacggatgtaaaagcacgttttacggatacggtcagtcttccgggagctccaatgtcgtcatggcattcgagccggcgggacaaaaagctcgcacgcacgctttcaatgaaaaagataccgtgcgttaa

SEQ ID NO: 3822 - DNA, 192 bp, Bacillus licheniformis
atgccgattgttcatattcaactattagaaggccggccgcctgaaaaggtcgaggaagtcattcgaaaagtgacggaaacgttgagcgccaccctagactctccgaaggaaaacgtccgcgttcttgtcaccgaagtttctaaaagccactggggcataggcggcacaccggtctcaaaattaagaccttaa

SEQ ID NO: 3823 - DNA, 786 bp, Bacillus licheniformis
atgaataccgcagcattaaaagatacggcgcgactcttgtatcttgccgaaacagagaagcgtgaagttgaaagaatcacaaaggactacccggagctgaccgttgaagaggcgtatgcgatccaagaagagctgattcagcttaaattatgggatggcaatagcatcatcggtccgaaaatgggactgaccagccgggcgaaaatgaagcagatgaacgtcgaggagccgatctacggttatatttttgaagatatgatcgtgccaaacggcggaagcatccggatgaacgagctgattcacccgaaggttgaagcagagattgcttttgtgctgggggaggatattgaaggaccgggtgttacaaaggagcaggtccttgaagccgttgctgaattgattcccgttctagaagtgattgacagccgctatgaaaatttctcattcactttgcctgacgtcatcgcggacaatgcgtcatcttcaagagtggtgttaggtgaaaaagtgaagaagccggacgatttcaagctggatgaagcaagagtctctttaatgataaacggcgaggtcaaagagcggggcactggagcagcggttgtcgggcatcccgcaaattcggcggccatgctcgccaacatgctctcccggaaaaaacaaaagcttgcggctggcagcatcattttaacgggcggtgtaacgggagctgtcatgctgcagccgggcgaccgcgtttcagcacaagtagaagggctgggagatgtatcattttcggtcaagccataa

SEQ ID NO: 3824 - DNA, 1476 bp, Bacillus licheniformis
atgaatgttcaaactccatcggaaaaactcgtaaaaccttttgactgtcagcactacataaacggcaggtactttccttcagagaaaggcagcacgtttgacaacatcaatccggctacacaggaaattatcggaagcgttgcggaaggaggcaaaaaagaggtcgatcttgcagtcgcggcagccaggcgtgcattaaacggacgctggaaaaacatgaccgctgacgaaaggattcggatcatcagaaaggtcggcgacatcatacttgagcgtaaagacgaactggcgaggcttgagacattggatacgggaaaaccgctttcgctctcaagcactttggatattccacgtgccgctttcaactttcatttctttgcggattttatgagaggagccggaacggaagcttatcaaactgacgatcttgcaatcaattatgcgattcgccgtccggtcggcgtcgtcgggctgatcaatccgtggaacttgccgcttcttttgctgacgtggaaattggcgccttgcctggcggcgggaaatacagccgttatcaaaccggctgaactgacgccgatgacagccacccttctcggggaaatctgccatgatgcagggatgcctgacggagtcgttaatatcgtccacggatttggaccagattccgccggtgctgcgctttctgagcatcccgatgtcgatgcgatatctttcaccggagaaacgacaaccggcaaagtcattatggaagctgcttcgaaaacattaaagaaactttcctttgaattgggagggaagaacccgaacattatttttgccgatgccgacatggatgaagccgtcagcacctcattgaaatcgagtttcgtcaaccagggggaagtatgtatgagcggctcccgcatctatgtcgagagggaagcgtatgacgaatttctgaacaagttcgttgagaaaacgaaaaagctcaaagtcggcgatccttttgatccggacacgaatatcggcgccttgatttcttctgaacacacagagcgtgtgatgaactacatcgaattggccaaacgggaaggcggcaatattttaaccggaggaaaacgccatgaaggacaggaatccggctgctttcttgaaccgacgattatcaccggactttcacgcaattccaggctcatcaaagaagaaatcttcggtccggtcgtaacggtgattccgttcgacgatgaggaggaagtgattgcacaggctaacgacacacattacgggttaagcgcgaccttatggacgaacgacctccgccgggcgcaccgcgtagccgggcaaatcgaatcgggcatggtgtgggtcaacagctggtttctccgcgatcttcggacgccgtttggcggcatgaaacagagcggactcggacgagaaggaggcattcacagcctcgaattcttcagcgaattaaccaatatttgcatcaagctgtaa

SEQ ID NO: 3825 - DNA, 780 bp, Bacillus licheniformis
atgactgttgagacgaaggaccaccagctgctcggttcagtaaaaaatgcgcttcggctgcttcaatcgtttaccttagacacaccggaaaagaaactaaccgaactcgcctcgtcgcttggcctcggaaaaagcacggtctcgcgccttttgtctacattggaaagcgaagggtttgtcatgaaggacccggaatccagaagatacaagctcggcttatcggtcctgcagttaaacaccattgtcaactccactcttgaaatcaaccgcgaatccctgccggtcctcaaacggctgaccgatgagaccggcgaaacgtcgcatatcgcgatgcgccgcggtctcagcgtcgtttatctcaatcggacggaatgcccccgcccggtcgaacttctctcatatatcgggcggcaaaacccgatgcactgcacaagctcaggtaaggtgcttctcgcctttgatgaagagggcatattggacgagtatgtgaaggaaggcttgaaaagctgtacgaaagaaaccattacagacggggacaaattgagggatgtgctgaaaaccgttaaagaaaacggatttgacgtcagttgcggggaattcatagatggtgtcacatcaatctcagctcccgtcagaaaccacgcaggtcgagtgttgtacgccgtcagtgtcgtaggccctgcaaaacgcatcaaggcccggcaggcgaaaatcatttaccaagtgaaacaagcggcccgggatatttccgaaaggatcgggtactggaaacgaatataa

SEQ ID NO: 3826 - DNA, 951 bp, Bacillus licheniformis
ttgtatgatcttcacacgcactttataccgcgcgatgtgctgctttggctggaagacaatgaaaagagagtccacgctgtccgcgaaaaaaaggctggatgccaagcggagtttttgacggtcaatcacaaatggggctttgaattaaaagagcttttctaccaggaggctttatatttggaagcccagcaggaggccggcgtcacacactcattggtatcgccggttccccagcttttcctttacgatctcgccgaagaaatcacggacgaattatcttttgtatacaacaaagcgcttgccgaatgggttaaaaaatacgacggccgcctctcgggactcggcacagtcccgctgaacagcccttcaaaggcgagcgagcgcctgaatgaagcgatgaacaacgggcttaaaggagcgattatcggacccggcgcttcgcaactacttctctcggacgaagcatttacaccgttttgggaaacggctgatagaagaaaagcgattatctttatacatccgctcctttctgaagatccgcggctccgccgcaggatgctgccaaacttgatcggcgttccgtgggaaacgacgatttgtgccgcagaccttttgttaagcgggtttacagaccggtttcgcaatgtgaaaattcttttggcccacggaggcggctttttgccttatcagatcggaagactgaacaaagggtatgacaaatgggccggcgtttcttcatcgctttcggctccgccgcgcgaatatttgcggaagttttggtttgatggtgtgctatgggagcaagaaagcgcggcatatttgaagaagcttgtcggagaagaccgccttgttccgggttccgattttcctttcgacctttgtcagtggccgcctctcgatcccggccggaaaggagcggagtctctgctgaatgtagcgattgaagcataa

SEQ ID NO: 3827 - DNA, 972 bp, Bacillus licheniformis
gtggcagatctatttacaacagtgcagggaaaagtagcaggaaaaggagttaaaatcgtatttccggaaggtttggacgagcgtattcttacagctgtcaacaaattggccggaaacaacgtgttaaagccgatccttgtaggaaacgagcaggaaatcaaagataaagcaaacgggttgaatttaacgctggatggcgttgacatatacgatcctcatacatatgaagggatggaagaccttgttcaggctttcgttgaacgccgcaaaggcaaagcgacggaagagcaggcccgccaaatccttttagacgaaaactactttggaacgatgcttgtttataaagggcttgccgacggccttgtcagcggtgcggctcattcaacagcggatacggttcgcccggcgctgcaaattattaaaacaaaagaaggcgtgaagaaaacatcaggcgtctttatcatggcgcgcggcgatgagcagtacgtattcgcagactgtgcgatcaacattgcgcctgacagccaggaccttgcggaaatcgcaatcgaaagtgcgaacacagcgaaaatgttcgacatcgaacctcgtgtcgccatgctcagcttttcaacaaaaggttcggcaaaatcagacgaaactgaaaaagtagccaacgcggttgcaatcgcaaaagaaaaagcgcctgagcttacacttgacggcgaattccaatttgacgcggcattcgttccgtctgtcgctgagaaaaaagcgccggactccgtcattaaaggagatgcaaacgtatttgttttcccaagccttgaagcggggaatatcggctataaaatcgctcagcgcctcggcaactttgaagcggtcggtccgattctgcaagggctgaacatgcctgtaaacgacctgtccagagggtgcaacgctgaggacgtttataatcttgcgctgattacggcggctcaagctctgtaa

SEQ ID NO: 3828 - DNA, 765 bp, Bacillus licheniformis
atgagcgaacagcaaaaaacgaatgaagccgcacaaacgcttgacggctggtatgcccttcacgatttccggacaatggactggtccgcatggaaaatgctttcaagcgatgagcgccagatcattatcagcgaatttaccggccttcttgaaaaatggggagctgcccaaaaagaaggaaacggaagccatacgctttacagcatcgtcggccagaaagcggacttcatgctgatgattttgcgccctacgatggaggaattaaatcaaatcgaactcgagttcaataaatccaaactcgctgaatacacgatacctgcttattcatacgtatccgttgtcgagctgagcaactatatgggaagcggagacggagacccttacgaaaatccgcaagtgcgggcgcgcctgtaccctgagctcccggatgccaaatatgtctgcttctatccgatggataaaagaagatcgggcgatgacaactggtacatgctgtctatggaagagagaagaaacttgatgcgcagccacggaatgatcggacgcggctatgcgggaaaagtaaaacagattattaccggctcaatcggatttgacgattatgagtggggtgtcacgctcttttcagatgatgtgcttcagttcaaaaagctcgtctatgaaatgcgctttgatgaagtaagcgcccgctacggtgaattcggttcgttctttgtcggcaaccgccttgcaaaagaacagctgcctgcatttttgcatgtgtaa

SEQ ID NO: 3829 - DNA, 540 bp, Bacillus licheniformis
ttgaaaagaatgtatcgttctaaattgtcaatcttggcggttagtctcgtgatgatggcttcgattttcctgccttcgttccaggccagcgcccaaacaacaaaaactgaatctgtctaccgcccggctgcgagcgcttccttgtattcggtgataacaggcgccagcaaacaggagtggtcgttctcggatattgagttaacatatcgtcctaactcaatcttggcgctgggaacggttgaatttactttgccgtcgggattttccgccacaacgaaagatacggtgaatggaagagcgctgacaacagggcaaattttgaacaacggaaaaacggtaaggctgccgcttacaattgatctgctgggcattgcggagtttaagctggtgctggccaacaaaacgctgcctgccgcaggaaagtatacattccgggcggagaacagagtactggggctcggatcgactttctatgccgaatcttcaatcgaagtgcaaaaacgggcgactccgcctacacagccgtgcaactgcaagtaa

SEQ ID NO: 3830 - DNA, 1347 bp, Bacillus licheniformis
atgcctaaattggtttcttcaaatcttgtaaaaggtaagatcatcaatattagtccgccgcagacgctggctcttagtttcttgattatcattgcgatcggggcttgtttattgaagctgcctggcgcctccactacttatatctcatgggtggatgctttatttacggccacctcggcaactacggtaactggccttgttgttgtagatacaggggcagattttacagttttcggacaaaccgttattatgtgcctgattcaaatcggcgggctcggcttaatgacgtttgccgtcctcgtcgtcatgatgatcggcaaaaaaatcggcttgcagcagcggattcttgttcaagaagcatttaaccagacttctttaggcgggcttgtccgcttggtcaagcacctgtttattttcacgattgtcatagaatttgtggcgtttctgatcctttcgatcagatgggttcctgaatatggtttgcaaaaaggcttgtttcatagtttgtttaacacgatttcagcctttaacaatgcgggattttccctgtggcctgacaacttgtctcaatatgtcggcgatccgattgtcaaccttgtcatcacaggccttttcattacagggggaatcggctttaccgttctgctggatttatggacaaagcgaaacttccggaaattatcgctgcattccaagctcatgatcgttggaacattgatcatcaatacgacagccgcgttgctgattttcattttagaatactcgaatccgggtacgctcggcggactgcctttggccgacaaaatgtggggcgcttacttccaaggcgtgacaccgagaactgccggattcaatacgcttgatatcgcccagatgacaacgccgtccctcctgttaatcatcgttttgatgtttatcggagccggaagtgcgtcaacgggaagcggaattaaactgacaacgtatatcgtgatgatcttggcgacgatcacctttttaagggggaaaagcgagacggttgtgttcaaaagggcgattaagatgaaaaccattttaagagctttagccatcattgtgatcagttttttattcgtgcttttcgcattatttatattgacgatcacagagaatgccccatttttgaaaatcgtctttgaagtattttccgctttcggaacagtcggcctgtcgatgggactgacacctgatttaacggccgcaggcaaagcggttatcatgatgatgatgtttatcggccgcgtcgggcctctgactatggcgtttacgctggccaagccgaagaaggcgccgatccgccatcctgaagatgaagtgattacaggctaa

SEQ ID NO: 3831 - DNA, 537 bp, Bacillus licheniformis
atgaaatttaaaaaaaatcagtttcagccgcttcaggagcttgagatgccggatttccggcagcaaatgggccccaatccttatccgcagatggggcagatggggcaaatgtaccagcagcagggacagcagcctttcacccaaatgggagggcagcaatcgtatcagcagcccggtccccagctgacccagccgcagccggcaggcgtccaggtccctccaatgccttcaggacagcagccttcaccgagcatcccaggcatgctgccgcttgagcaatcctacattgaaaacattttgcggctcaatcgcggaaaagtggcaaccgtatatatgacattcgaaaacaatccggaatggaatgcgaaagtctttcggggagaaattgaagcagccggccgcgaccacatcattttaagcgacagaaaaacgggcacacgctatttgctgctcatggtgtatcttgactatattacgtttgatgagccgatcacttatgattatccgtattcaatggcctcatatacaccaagataa

SEQ ID NO: 3832 - DNA, 1146 bp, Bacillus licheniformis
atgaaagaaatgctatggcttgtcaaaaacacactgaatgtcacttttaaaaagaagatcaatatctttctgtttgtatgtctgcccttgctaggcatattcgtatcgcttttgacagagggaagcatggaaaagacggatttgcgcgtcggaatcatcaatcatgacggcggacgaatcgccgaagatactaaggattttttgaaggggatcgagaatgtcaacatcagtgcggtcagtgaagcagaagggaaaagtcaagttgcggcaggggagcttgattgcgtcattacgtttgaacaaggcttttctcaaagcgtgcagagcggcgaaccggctcacatcgcaatcgcatctgtcaaaggcgctgaaatcaccggattcgtgaaatcgtatgtctatcattatattgataatatcgccgcaatcggcaaatcggcgcaggggaatgaaaagcgctttgaggaaatgtataaaaattaccggaattctgaaacgagtgtcaaaacatctacgattgaagacacggcgaaaaatagaaacatgacggagcggacggtcggttttcttctgatggcgatgcttttttcagcgggaagcttgaccgaactgttagtaaaggaaaaagagaacagaacgtatttcaggcttttgaccacaccgataacggcaaggcagtacgtcatgtccaatgtggccgtcagtatgtctgtcatcacatgccaaacctttttaacattgattatggtgaaatatgttttccggatggaaaccggcatctcattttgggagatggcagcggtgctgctgatctttgcgctgagcgcggtcggcctggcattgatcacagtcgtctttgcaaacagctccaggtcatccggggtattgcgaaatttgatttttatgccgacgatcatgctgtcgggatgtttttggccggttgaaatcatgccgtctttcgcacagcgaatcgcggactttcttccgcagcggtgggtgttggatacgctggcaaaattgcaggagggacagcagcttcaaggtctgtatttgaatatcatgattctgtttgctttcgctgctgtctttttcctcatcgtcatttacaaattcaaacgcaataatgatgtgagaaacttcgcttaa

SEQ ID NO: 3833 - DNA, 1122 bp, Bacillus licheniformis
ttgaatacactcatcattgcgaaaaaagaaattgtatctgcttttcgggacaaacggacgttcctttttatgctggcatttccgattgtactgattatgattttaggcactgcgctgacgaatgctttcgatcaacaagcagcggtcggcgaggttcgtgttttgtataaagacaattctgacggagcgttttcgcaaggctttaaaacattcgtaaaggaagcgaaaacatccggcgttcattttaaaaaagtgttgtccgatatggatgaaaaacaagaaatcaaacaggggaactacgatgcttatcttgagatcgaaaacagcggcatcaagctttaccaaatggataaaaacagtatgaaaaacagcattattcaaggaatgctgaccgcgtttgcaaaccggtacaatgccgcagcggagatcatcaaagctgctcctgagcaagcgggcgccgtgctcggggacgcaccgggcgacaattatatcaaggagacgtcgctcagctcagacagaaagcccagctccatggattattatgcggttgccatgaccactctgatcgcgctttacagtgcattaagcgccagctatttaataaggggggagcggcttagaaaaacagccgaccggctgatcgcggcaccggttcataaaggcgagatctttgcgggtaagctgatcggcaatcttgtgacaaacggattgtgtatttttgccgtcgtcgcagtcagcaaatacgtatttaaagcgtactggggagagcatcttgggcttgtagcggccgtgctgttcagcatcgtattgtttgccgtatgcctcggcctcggcgtcagttatttgacgagaacgggggaagcggcagtggcgatcattaacgtgttgattccgctagttgcatttttcgggggcgcttattttcctgtcgacgatgcggaaggtgttttagctttgatcacagacctgtctccgctcgcctggacgaacgaagctattatgaacatcatatttgcggacgatttagcggcagggctgcctgccatcttgctgaacatcggcttatccctgttatttctgctgattgccgttgtctcattgcagagaagggaggggctgtag

SEQ ID NO: 3834 - DNA, 936 bp, Bacillus licheniformis
atgaatgtattggaaatccatcatctgacgaaaaaattcggcgacttcgttgccgtcgacaatatatcactctcgatcgaagagggcgaaatatttggattgctcggcgcaaacggggcgggaaagagtacgaccattcacatgatttcgagtttgttgagaagcaatgaaggcgagatcacgattctcggaaaaaacattgcgaaacaccgcaagttcgccaagatgaacatcggcattgtcccgcaggatctggccatttacgaagatttaacggcatatgcaaatgtgaaattttttgccgggctttatggtctgcgcggggcccatttacacaatcgggttgaagaagcattgcagttcgtcggtttaagtgataagcataaaagcttcccgaaaaatttttcaggcgggatgaaaagaaggctcaatatcgcctgcgcgatcgcccacaggccaaagctgatcatcatggacgaaccgacggttggaattgatccgcattcgagaaattatattttggaatccgtcaaaaagttaaatgcgatgggatgcacgattatttacacgagccattatatggaggaagttgaagagatctgtactcggatcgccatcgttgatcacggaaaaattatcgccgagggaacgaaggagcagctgaaatcgatcattaccaacacaaaagatattcaagtcgttcttaaatctgcggaaaatatcgatatcggcgaactgaaaacgatcagcggcgtggaagcggccgttcttgaagacaatacgatcaaaatcaactcggatgcaggcgtcaataatttaaaccagattattgaaaagctgatgaaaaacggggccgagattcgttcattggaagaaaaagcgcctaatttggaaaccgtgttcctgaccttgaccggaagacagttgcgcgattag

SEQ ID NO: 3835 - DNA, 1107 bp, Bacillus licheniformis
atggaattgcggattatgaccggcaaactgattttgttgggatttatcatctatcaatgcgttttttcggaaagtgacaatctgccgtggcttgtgttcagccttcttgtttacgtctgtatcaacctcgggattgcgattttacctaaaggaaaaacaaaaaagctttttattatcatttctgtcatcatttcaatcgtttcttatgcagaagtgcaccccctatttattttattccttccttttaccctgtgtgaaggagcagccgattttgggctgccgaagtgggcggtacttgccgcttcaatcgttccggtcttgtttatcaatgaaagcatctcagcggtctacgcgttgacggccgcttttcaatttttgctgtactgggcggcaagccatgatgcagcgcggattgaaaagcttgaacatcatattgatcaaacgagaagagacctgcagaagctgacaaacatgctgcgtgaaaacaaagagtttatcagacaatccgaatatacttataagcttgaggagcgcaaccggctttcccaggaaatacacgataaaatcggtcattccatgacaggagcgctgattcagctcgaagcggcgaagcgcgtccttgacatagacaaggaaaaagcttcagagctcctgcaaaatgcgattaacatctccaaggacgggatcgaaaatattagattgacgttaaaaagcgtcaagccgccctcagaacagatgggcatccacagattgaggctgtttatcgatgaatgttcggcgcagtaccatatgaatatttcatttttgcataaaggcgatttggatgttatttctcagattcaatggaagattatttttgaaaacatcaccgaagcgctgacaaactcggtgaaatatgctgaagcgacacatgtatccatctgtattcatgtgctgaatacgctcattaaagccgaagtgaaagacaacggaaaagggcggcagaaaatcaagaaagggatggggatcatcgggatggaggaacgggccgcttctgttaacggaaaggtgatcgttgacggttcaaacggcttctctgtcaccaccctgctgcccaagcatgaatga

SEQ ID NO: 3836 - DNA, 693 bp, Bacillus licheniformis
ttgcattttgacagaagggatgtgcacggcggaggaccggtctccgtacaaacgatgaaaattaaagtgatcattgcggatgacaattcattcataagagagggcatgaaaatcatattgagcacttatgatgaatttgaagtgctggcgacggtggaggatggcttgcaggcggtcgaattttgccgcgcccaagctgtggatattgcactccttgatgtccgcatgcccaacatggatggagtggaagctgcgcggctcatttcagaaacgggcgccaagccttttatcttaacaacgtttgatgacgacgaatacatcgtcgctgcgatacggaacggcgcaaaaggctatttgctgaaaaatgccgaacccgagcgaatcagagacgcgattaaaagtgtgttcaacggccatattgtgatgcaggatatcatcctcgacaagattaagtccaatttggcggagcataaagaagcggaacctaagatagacgaaagcctgtttaccgaacgcgagctcgggattatggcgctgatcgccagagggctgtccaataaagaaatttcgaaggagctgtttatctctgaaggtacgattgccaattatatttcctcgattttggggaaaacagggcttgaacatcggacgcaaattgcgatttattatttaaccggtaaagttaacttttaa

SEQ ID NO: 3837 - DNA, 372 bp, Bacillus licheniformis
gtgaaattatttttgattttaggtgctgtcaatgctatgcttgcggttgctttaggagcgttcggagcccatggtcttgaagggaaaattcccgagaaatatttgcaaatctggcagaccggcgtccagtatcatatgtatcatgcgctcggtttaattgccgtcgcgctcatcgcgtcaaaactggcaggtgcgggaagcgtttctgcggcagggtggctgatgtttgccggaatcgttttattttctggaagtttatatgtcctcagccttacgcaaatcagcgtcctcggtgcgattactccgctgggcggcgtggcgtttattgccgcatggatcatggtcgttgtctcagcggtcaaatatttgtag

SEQ ID NO: 3838 - DNA, 1302 bp, Bacillus licheniformis
ttgaaactgctttttggggctttacaatggacggcatttattattgcgtccgcaatcgtggtgcccattgcaatcgggcagtcattcgggctgaaccagggagagaccgcggggttggttcaaagcacttttttcgtgctcggcacaacggcttttatccaatgtttattgggacaccgcctgccgattaatgagagtccggctggcctctggtggggcgtctacacgatttatgccggtcttacagggaccgtattcgcgactcacatcgaaacgctccaggggctgcagggagcgatgctgctaagcgcggttttcttctttatttttagtttatttaaagtcattgataagctggctgtgatgtttactcctgttgtgacaggcatttatttactgctgctggtcatccagcttagcgatccgatcgttaaaggtgtcatggggatcggctaccggaaaaacgaggtcgatatacccgtgtttttgctggcggttgtgattatgctggctacgtttctgatgagccggtcaaacgttccgattctcaagcaatattcaattttaattgcgcttttcggcggctggatcttatttgccgtattcggcgtggcgaaggcgcccgagcgtgcgaaccagctgttccaccttccggatatttttcctttcggcatgccgatgtttgacagcgggctggttgttacttcgttgttcattacagttttgttaatcgtcaatatgctcgcaagcatacgggtggttgaaggagcagtcaaacagtttgagaagctggaagagaggaagcgggcccgtccggccgggtttatcgcctctgtcagccatttgctgagcggactgctcggagctgtagggaccgtgccgatatccggagctgcagggtttattcaaacgacgaggatgtcttccaaaaaaccgtttttgctcgggagtctgatcgtaatcgtcatcagcttcttcccgctggtcatgaatacttttgccagcctgccgtctccggtcggttttgcggtgaacttcgtcgtgttttcaacgatggtcggcctggcatttgccgaattcgattcttatgaaaaggacgaggccggccgcatccgctttgttaccgggattgcgctccttgccggtgtgggggttatgtttgtacctgagagtgctttggaagggatgcatcctgtttttgtttccattttaagcaatgggcttgtccttggaacaatcgtagcgattgctgcggaacaaatacagcttaggaaaaagaaatatgacaatatcgtgtcatga

SEQ ID NO: 3839 - DNA, 348 bp, Bacillus licheniformis
atgaaatggaaactgaaaacggtttggaggatcgatttgatgaacatacatatatcaagtttgctgcaaaagatggaggacgaattgaaaaaagcaaaggaatgccaccaggaaaacgaattgaaaatgcacatcgcggtgatccgctccctttgcgacgtcattgtggaaccgcagcaggggccgtccgtccagtcttcgccttatgttcaaacggccaataaaccatcgagcgatcagctgatgctcgaaaaaatgatggggagcgccggtgctgaacaatacaaaaaacaagagaaacaaaagcatgaagatgacggcaacggagattctatttttgatttctag

SEQ ID NO: 3840 - DNA, 1383 bp, Bacillus licheniformis
atggcagaacgaacaacctccatcgaaacgaccgttaccgagcaaaagcaatattttttaagcggggcaacactagctgttgaaaatcgtctggaacagctcaacattctaaaagatgctgtaaaaaagaatgaacggaacatacttgaggcccttcagaaagatcttaataaatcagagcacgaagcctatatgacggaaataggcattgtactggaagaaatccgcttcatcagcagacgattaaaaaaatgggccaaaccgaaaaaggccaaaacggccgtttcgcacatcggttcaaaaagcatcgtcattcctgagccttacggcacggttctgatcatcgcgccatggaactatccgtttcagcttgccgtctcgcccctgatcggcgcacttgctgcggggaataccgccgtcatcaaaccgtctgagcttgctcccgccgtatcaaccgttatatccgagatgatcaaagatatctttccgcccgaatatgtgtccgttattgaagggggagtgaagacaaaccaagagctcttgcggcaaaaatttgactatatcttttttacgggcagtgttcccgtaggcaaagttgtcatggaagccgcggcaaaacagcttattccagtcaccctcgagcttggcggaaaaagcccctgcatcgtgcacaaggatgctgatctcaagcttgcggctcaaaggattgttttcggaaagctgacaaacgcaggacagacttgcattgcgcctgactatctgctcgtacacaaagatgtaaaaaatgagctgatgcgcgctctgaaacaatcgatccaaacattttacggagaaaagccggaaagccatctggcttacggaaaaatcataagtaaacgtcatttcgaacggttaatccgctttttacaaaacgagaatatcgtcacaggcggaacatatcaaaaagacgcactcaaaattgctccgtccattatcgatgaacctgactgggaatcgccggtcatgcaggaagagattttcggaccgatccttcccgtcatcggctatgaaacgatcgaagacgttatccaaatggttcaaagccgccctaaaccgctcgcgctctatttgtttacgaatgaaaaaacggtacagaggcacatcctcagccggatttcatttggcggaggatgtatcaatgacacgctgatgcacacagccacaccttacctccccttcggcggcgtaggcgaaagcggaatcggaagttaccatgggtatcacagctttaagacgttttcccatgaaaaaagcgttttaaaacagacaaacctgtttgacatttcattccgttatccttcatcgaaaaacgggctgcggatcatcaaaaaacttctcaggtag

SEQ ID NO: 3841 - DNA, 678 bp, Bacillus licheniformis
ttgaaacagattttgaatgacagctggtggcaacagctgaaggacgagtttgataagccttattatcaagaactgagggaaatgctgaaaagggagtatgctgaacacaccgtatatcctgaaccgaacgatatatacaatgctttgcattatacttcctatgaaaatgtgaaagtcgtaattctcggccaagacccgtatcacggtccgggtcaggcccatggcttaagtttttccgtacaacccggcgtcaatccaccgccttctttgaaaaatatttttatagaattgcagaatgacatcggcgccgacatcccgaatcacggttctctcgtcagctgggctaagcaaggcgttctgctgctgaacaccgttttgaccgtgagacggggccaggcaaattcgcataaagggaaaggctgggaacagctcacagatagtataatagatgttttaaacaaaagagacaaaccggtcgtttttattctctggggccggcatgcccaaatgaaaaaagaacgaatcgatacatccaagcattttattatccaatcgccgcatccgagcccgttctcggctagaaacgggtttttcgggagcagaccgttttcaagagccaatcagtatttggaacaaatcggggatgagccgattgactggtcccttccgaatctttaa

SEQ ID NO: 3842 - DNA, 819 bp, Bacillus licheniformis
atgaacatatctatcgtagttgtcacgcataatcgggtcaccgctttgtgcgaattgcttgaatctattgcaaaacagtctgttgaaccgtttgaagttattattgttaatgatgccggggagagcgtcgactttgttgagcgcctttattcagagcttccgatcagagttatacatctgaaagaaaacgtgaagcatgtaaaagcgagaaatataggggtgaaagaagcttccggagacgttattatgctgtgtgatgatgatgattttttcacgccgtgccatatggagagaatgttgaatgcgctggagaccgccgattttgtttattcggatgctgagattgtgtcttttgaagaaaaagaggatatgagaattccgacaagccgttacctttttgcgtattcctttaacttggatgaaatgaggaagttttctacatatgttccttcaggaagtatgtacaaacgatctcttcatgacgaaatcggctacttcgatcctgccgtccacaattattgggattgggactttttcctgagagcggctgagcggtttcgcgtgaaaagagttcctttcgcaagcgtaatctatgcgttttcagaccagggtgacaaccagtccggagatcttggcggaatgaggcagtattacttggatgtcttgagtgaaaagcatcagcttggcaagctgccgacaaagaactttttcgtgctactcgaagaacctgccatgaaaaaaagggaagcggaaagcgaaatcgtctgggatggaaaaccggttgcatccaggctcactgctgcaagacaattgaactaa

SEQ ID NO: 3843 - DNA, 813 bp, Bacillus licheniformis
atgacaatgcacaaagcactgacaatcgccggctctgactcaagcggaggcgccggcattcaggcggacttaaaaacgttccaggaaaagaacgtctatggaatgacggcccttacggttgttgtcgccatggaccctgagaacaattggaatcatcaggtgttcccagttgatacggaagtcatccgcgctcagctgtcgacgattgtggacggcatcggtgtagatgcgatgaaaacgggcatgcttccgacagttgacataattgaattggcggcagacacaattaagaagcacagcatgaaaaatgtcgtcattgatccggttatggtatgcaaaggggcaaatgaagtgctgtatcccgagcacgcaaaggctttaagagagcttttggctccgcttgccacggtcattacgccaaatctttttgaagccggccagctcagccgccttggagaaattaaaacggttgagcaaatgaaggaagcggcaaaggccatccacggcctcggcgcccaacacgtcctcattacagggggaggcaaactaaatcacgaaaaagcggtagatgtattatttgacggccgggatgcagaggtgatcgaaggagaaagaatcgacaccccatacacgcacggggcgggctgcacctactccgcggcaattacggctgagcttgccaaaggttcaaatgtaaaagaagccatttattctgcaaaagcgtttattacggaagcgattcgcgaatcgttccgtttgaatcaatacgtcgggccgacaaagcactccgctttacgactcagcggcaaataa

SEQ ID NO: 3844 - DNA, 339 bp, Bacillus licheniformis
ttgctattttctgtacaatccctttatgatatgctttttttagagagagtgcagtataaaggggttgtttttgtggatcaaaaccagcagaaattgaccgctatgcgtttgaaaaaaatagcggaccatattgaggatacgagagaggaatacaatggtttgctcctccagatgaagaagctgatcggcggtattgaagataaaccaattccaaatgatgaggaagtacaaaagaaacttcaggacacttatgaacaaatgaaagaatatgctctttttgtggaatcgatcgaatctttcttaagatcatctgcaagaacgatcaaacgggaaagctaa

SEQ ID NO: 3845 - DNA, 1437 bp, Bacillus licheniformis
atgaatcaagatcaggagcttcgtcaaaaggcaatgaaccgggttgaagaataccgggatattgtaaaccttgatccctatcggctgcattatcatatcatgcctcctgtcggactgctgaatgatccgaacgggttcattcagtggaaaggggtgtaccatcttttttatcagtggatgccttttaaaacggggcacggtgcaaagttatggggacactactcctcagcagatctggttaactggcggcatgaagagatcgccctcacgccgagcgactggtttgataaaaacggttgttattcaggaagcgcgatcgctgaaaatgatgtgctgcatctgttttacacggggaatgtcagagacggcgagggaaatagggagacctatcaatgtctcgccgtctcaaaagacggcatctcgtttgaaaagcagggggttgttgcaaggcttccgaaagggtatacggctcatttccgcgacccgaaagtatggaaaaagaacggcagctggtacatggtgctcggcgcccagactgaaaatcttgagggaagggcggtgctgtttcaatcggataatctgaaggactggcagttcctcggcgatatcacaggttcaaatacagatcagctcggggaattcggctatatgtgggaatgccctgacatgttcgaactggacggcaaagacgtcttaattgtctgtccgcaaggccttgaagcagaagagatgctctaccaaaacgtctatcagtcaggctattttgtcggtgaattgaacgagctgaaaccctggtttacacacggagatttcgaagagcttgaccgcggctttgacttttatgcgccgcagacgacaaaagacgaatcaggccggaggatattggttgcctggatgggtgttccagaccaagatgaacagagccagccgacgattccgcatcaatgggtgcactgtatgacattgccgagggaattgcatttacaaaacgataaaatcgttcaaaaaccggtcgaggagcttagaacgctccgccaaaacgaaaaaaacgcggcaatatcgcttaatcaaggcaccgaaaaattggacattgttcaaccggacaaagctgagcttttcatcagtccgaaagttattgaagagggttttgagatttccttcaggggtgcagcccgactcatatacaataaagcagaaggcatcataaccttggagagaaacagttatgttgatgaaaaaacggaagccagacagtgccgtttgcaggagcttcgcaatttaaacatctttttagacgcctcttctattgaaatcttcgtcaatgagggagaggaagtctttacggcaagatattttccttacccgggaaataatgatgtttggatcagtgccagaaaagaaatcataatgaatgtgacatcctggacaatggcataa

SEQ ID NO: 3846 - DNA, 1380 bp, Bacillus licheniformis
atgattcataaagaaatcgctgtacgtcttatacagcttcttggcggagaagataatgtcatcagtgcagctcattgtgcgacaaggcttcgtttggtgattaaggacgaagcaaaaatcgaccaggaaaaggtcgaagagctggaaggtgtaaaaggagccttttcaagctctggtcaataccagattattttcggaacagggcttgttaataaagtgtatgaacagtttgccaaagagctgaatcttgaccaaaaggaaacggttcagcacagcgatgccgcaaagggaaaaatgaatcctttagcgcgatttgcgaaaacgctgtcaaatattttcgtgccaatcatcccggccattgttgcaagcggtttattaatggggctgttgggaatgatgaaggcatttcagtgggtcgatcctgatgcggcgctgtataaaatgcttgatatgttctcgagcgcggcatttattatccttccgatcttgatcggtgtcagtgctgcgaaagagtttggcagcaatccttacctgggggctgtacttggaggaattttaattcacccgagcttgttcaatccttggggacttgcaactgcatcaccggatgtgatggacttttacggactcaaaatcgagatgcttggctatcaaggaaccgttgttccaattttgcttgccgtatatgtgatgagtaaaatcgaaaaaggcgtaagaagaatcgttccaaatgcgatcgatctattagtaacaccgtttgtcacgattatttcaacgggattcattgcttttatcgcgatcggtcctttaggaagaatgcttggtacagggatcacgaacattttaacatatgtgtatgacgttgccgggcctgttgccggactgattttcgggggaacatactcgctgatcgttctaactggtgtccaccacagtttccatgcgattgaggccggccttatcgctgatatcggcaggaactacctgctcccgatctggtctatgtccaatgtcgcccaaggcggggccggacttgccgtattctttttggcaaagcgtgcaaaaacaaaagaaattgctttacctgccgctttctcttcttttctcggcattaccgaacctgttattttcggtgtcaacctccgttaccgccggccgtttatcgcggcaatggccgggggagcgctgggagctgcatacgttgtctttatgaatgttgcagcaaacgcatacggtttgacgggaattccgatgattgcgattgtcgccccgcttggaatgggcaacctgatccactatttaatcggaatggcgatttctgtgactgtcgcatttatcacagcctttatcttaggcattaatgaagacgagaaaaagtga

SEQ ID NO: 3847 - DNA, 831 bp, Bacillus licheniformis
ttgaaaatctataaagtattgaacaacaatgcagcaatcataaaggaggatggtcaagaaaaaattgtcatgggacctggtatcgcttttcaaaaaggcaaaaacgataccattccaagaaacaaggtagaaaaaatttttaccattcatgaagaaaatgaaaagtttaaacaaatcctcgaaacacttccggaagaacatattgaagctgccgaagagatcatcagctatgcggaagggcagctgtccgcaccgttgagcgatcatatccacatcgcccttgtggatcatttgtcatttgcgatcgagcgagtccgcaaaggattcgtcattcaaaataaattgttaaatgaaatcaaagcgctttataaaaaagaatatgagatcggactctgggcaatcgatttggtcaaagaaaaactgaaagtcgaattgcctgatgatgaagcgggttatattgcgctgcatattcataccgcaaaaatggatgcggaaaacatgcagaagactctaaaatacacgaacatcatcaaagaattgatagaaaaaatcgaatgctgtttcaatcagaagattgacgaaaacagcatctcatatcagcgtcttgtcacgcatctcaggtatgccatcaaccggctggaatcaaatgaagcgtttcatgtcatggacgatgacatgctttatttcatccggcaaaagtatcctgaaagctaccgatgtgcggcagggctggcggattacgtaaaaactgaatatgatcttcatcttccggaatcagaagtcggatatattacgctgcatgtccagcgtttaaatgattcctataggtaa

SEQ ID NO: 3848 - DNA, 291 bp, Bacillus licheniformis
atgaaaggtttgatatcatttttaaaattatggacagccgtgctgctgaatgcggtgatgcctgtcagagaaaatcagatgaaggtgacggcgttcgccggcggtacatatcaggctgccgatgcttatcaggcaggcggcttttcggaaaaaagagaagagaagacagagcggatgtcgggctgtaagagaatgaagcccggcagttatacgacagaacccagccgggctgtttgcaaaaaagcggtgaaaagggtaagagccggaccaactctttacacgggaacttaa

SEQ ID NO: 3849 - DNA, 2409 bp, Bacillus licheniformis
ttgagaaaaagtatcgtgcgctattttgttatggcttttattctattatttgcgttatccacattcctcaccggagtgcaggcaacttccgttcccgataaaaagtcgcctgagcttgagaaagctgaaatctacggtgatattgatgtgacgtctgataaacagacgacggttatcgtggaactgaaagaaaagtcgcttgccgaagcaaaagcggacggagaaaaacaaacgaaggcttctctaaaaacagctcgaagcaaagcgctgaaaacacttaaaaaagcgaaagtaaaccgcgaatacgaccgtgtattttcgggcttttctatgaaactgccggccagtgaaattccaaagctgctcgccgtcaaggaagttaaagcggtttatccaaacgcaacttacaaacctgacagcgtaaaaggaaaagacgtgacacttgcagcagacgccatttatccacagatggataaaagtgccccgttcatcggagcggatcaggcatggaaatcgggctataccggtaaaggcattaaggtagccgttattgatacgggcgtggattacacccatcccgacttaaagaataatttcggcccatataagggctatgactttgtggataatgattatgatccacaggaaacaccgacaggcgacccgcgcggcggagcgactgatcacggcactcatgttgcaggaacaatcgccgcgaacggacagattaaaggcgtggcgcctgaagcaacgcttcttgcttaccgcgtgctcggccccggcggctcaggcacaaccgagaatgtgattgcgggcattgaaaaagccgttgcagacggagcaaaagtgatgaacctctcattgggaaattcgctgaacagccctgattatgcaacaagcatcgcactggactgggcgatggctgaaggggttgtcgccgttacgtcaaacggtaacagcggaccggaaaactggacggtcggctcgccgggaacatcaagggttgcgatttccgtcggcgcatcacagcttccgtataatgagtattcggtgacgcttccttcgtattcatcagcaaaggtgatgggataccaagaggaaaaggatcttgaagcattgaacggtcaagaggtggaactcgttgaagccggcctcggacaagctgacgatttctcaggcaaagatgtgaaaggaaaagttgcggttatccagagaggcgtcataccatttgttgataaggctgaaaatgccaaaaacgccggcgctatcggagccgtgatttacaataatgcaacaggggaaatcgaggcaaacgtcatggggatggccgtaccgaccgtcaaattgtcaaaagaagagggcgaaaagcttgttcaacagatcaaagaagggaaacactccgttgtcttttctttcaaattggacaaaaagctgggggaaacaattgcctcattctcgtcccgcgggcctgtcatggatacatggatgattaaacctgacgtttcagcgccaggcgtcaacatcgtcagcaccattccgacccacgatccgaaaaacccgtacggttacggttcaaaacagggaacaagcatggcttccccgcatgtcgcgggaacggcagccatattaaagcaggccaaaccggattggacgcctgagcaaatcaaaggcgtactgatgaatacggcggaaaaactgacggatgaaaatggaaagcctctccctcacaatacgcaaggagcgggcagcatccgcatcatggaggcccttaaagcttcatccattgtaacgccgggcagccattcatacggaacattcctgaaagacaaagggaaacagacgaaaaaacaagcgttcacgattgaaaacctttcttcacacagaaaagcctatcagctcgaatactcctttaaaggaacgggcatcacggtatcaggaacggaacgagtcgtggtaccggccaatcaaacaggtaaagcagcggcaaaagtaaccgtcaattccgcgaaaacgaaagcaggcacatatgaaggcacggtttacatccgtgaagacggaagaaaagtcgccgaaatcccgctcctattgatcgtcaaagagccagactacccgcgcgtcacatccgtaacagttgaaccgggagcaaagcagggcgcttacacgatcgaagcctacctgccgggcggggctgaagagctcgcatttctcgtctatgatgaaaacctgaaccttctcggccaggccggcgtttacaaaaaccagggcaaaggctatcaatcttatcaatggaacggcaaaatcaatgacgccgcatcccttaagtccggaaaatactatatgcttgcctatgcatccgccaaagggaaatcaagctacgtattgacggaagacccttttatcgtcgaataa

SEQ ID NO: 3850 - DNA, 255 bp, Bacillus licheniformis
gtgtatatgctttcttttatcgtattattcggcttatccttcattattgtctgctttatatttttcacgattttgtacttcgccgtcaacctgcagaagcgcgagcccaagccttttcaaaaagctgcggagcaaaccgtcgataccatcatcctcattccgatcagctggctgtttaccgctttatacatatgcattctgtttattcttttcccaatccgccattttctcgatttttttcagcaaaaacgctaa

SEQ ID NO: 3851 - DNA, 1005 bp, Bacillus licheniformis
ttgtcattaagcatactggatcagactcctgtttctgaaggaagcaaacctgaactggctttgcagcatacggtggagcttgcgcaagcggcggagcggctcggatacaagaggttttgggtttctgagcaccatttttccaggaacttggcagggtcaagtccggaggttctgatcggttatcttgcggctaaaacagagaagatccgtataggatccggcggcgtcatgcttccgcattacagcgcctacaaggtggcggaaaacttccgcgtcttggaaggactagcgcccggcaggattgatctaggtgtcggacgtgctccgggagggatgccgatcgcttcaatggcccttcaaaatggaggaagacggatggctgaccaatatccagaacaaattcaggacctcgtcacatatttatacgatcaagccgatgaacatcaccgctttcccaacttgaccgcaacgccgaacatcgccacagcgcccgctgtttggctgctcggctcctcaggggaaagcgcaaggcttgccgcccaaacaggggcatcatatacatttgctcaatttattaacggtgaaggcggagaagaggcggccagactgtacaaagagaggttcgaaccttctgtattaggggaacagccaaatgtgatcgttgccgtatttgtgatttgcgctgagacagaagagaaagcggagaaccttgccaaaagcttggatttttctttattggccaatgaacaggggatggtgaccgaaggctttccatcattggaaacggccctgtcctatcaatattctccttatgaaagaaagagagtggaagacaatcgaaaacggatggtcatcggaacgccgcagcaggtaaaggaacagctgcttgaactggccggcgcttacggaacggacgaaatcatggcggtgacgatcacccacgattttcaagacagattggattcataccggctgctggccgaagcgtttcatcagtcaatttag

SEQ ID NO: 3852 - DNA, 750 bp, Bacillus licheniformis
atgaataaaacgattgaaactattttaaatcaccgttcgatcaggtcttttacagatcggctcctgaccgaagaagaggttcgcctgcttgtggagagcgctcaaagcgcatcgacgtcaagctatattcaagcatattcaatcatcggtgtcaccgatccggacaagaagcgcaagcttgcggaattggccgggaaccagccatatgttgaaaaaaacggccatctgtttgtattttgcgcagatctttacaggcatgacaaaatcgctcggaaaaagggtgtagatattacagcttctcttgaagggacggaaacctttatggtcagcgtcatcgatgcagcgcttgccgctcaaaatatgtcaatagcggccgaatcaatgggcctcggcatctgctatatcggtgggattcgcaacaatttgaacgaagtctccgagcttcttgaaacacctgaatacgttcttccgctgttcgggcttgtcgtcggccagccggccaacccttcggccaaaaaaccgcgtctgccgcttgatcacatttatcatgaaaatgtctatcaagcggatgatgccgagtttgaaaagcatttgtccgcatatgacgaaacgatttcaaactattatcaaaagcggacggacggcaaacggtctgacaaatggacagaccagatcaccggcagcctcaaaaagccgccgcgtgcgtatatgaatgaattcgttaaaggaaaaggtttgaacaaaaggtaa

SEQ ID NO: 3853 - DNA, 1176 bp, Bacillus licheniformis
gtgaaatccgtaattgaagaattagatgcattatttccggaaatgatcgaactaaggagacattttcaccaatatccggagctttcccatcgcgaggtcaatacaccgctcaccattgcaaattacttggaaagcctcgggattggcgtgagaacgaatgtcggcggccaaggggtcgtcggtcacattaaaggcggccgccccggcaagacggtcgccttgagagccgatttcgacgctctgcctttacaggatcaaaaaaatgttccgtaccggtcgactgtccccggcgtcatgcatgcctgcgggcacgatgcccacacgtctgctctcctcacagccgcaaaagccctggcaaagcatcgaaaagacttgaagggaaatgtcgtgctgatccatcaattcggtgaagaggttacaccaggcggcgccaagccgatgattgaagccggctgtctcgaaggcgtggatgccattttcggcacccacatctgggctccgatgcccgtcggtcaagtcggtgtcaaatcaggcccgatgatggcagccgctgataaatttaaagtcacgatatccgggcggggcggacacggaggcgcgcctcacctaacgacagacgctttaatcacgggagcctcggtcgtcaaccatctccagcaaatcgtcagccgcagaatcgatccgacagaagcagccgtcttgtcgatcggaacatttcattcaggccaggcatttaacgtcattgccgaagaagcggtcattgaaggaacggtccgcaccttttcaaagcatgtccaggaaacgatcatcgccgagatcgaacgcgtaattaaaggcgtctgcgacagcaacggggcctcgttttcactcgattatgaaaaaggctacccgcctgtcgtcaaccatgaaaatgaaacggacatcgtccgtcaatgcgccaaacatgtcgtcggccctgaagccgtcatcgaactcgaaccgaatatgatcggcgaagatttctcttattatcttgaacatgtccctggatcattcttttttaccggcgcgggcaatccgcagactggagccgtttacccgcaccatcacccgatgtttgacatcgatgaaaaaggcatgctgaacgcggcgaaaattcttgtgtcggcggctctagcatttttaaaccaagactaa

SEQ ID NO: 3854 - DNA, 1170 bp, Bacillus licheniformis
atgggccagaagaaaaatacgacaagtccctattatcagggcgatttgatttttatattagccatgttctttttaatcagtgtgatcgctgtttacgctgcggagccgtctttttcaccgaagggttatccggcaaagcaattgttcttttatctgctcggcatttcggtgatcgtcggctttctctattttgatctggagcagcttgaaaagttaagcatttacatatatttattcggcatcttgtcgttgctcgtgttaaaagttagtccggagtcgatcgctccgattaaaaacggcgcaaaaagctggtttcaatttggtacgatcacgctgcagccgtcggaatttatgaaaatcggcctgattatgatgctggcttcggtgatttccaaagcaagtccgaaaggctcgcgctcgatgcaggaggatgttcgcctgttgctgaaaatcgcgggagtgtcggcggttccggtcggattgattttaatgcaggacgccggtacggccggtatctgcatgttctttgtcgccgttatggtgtttttatcaggcgtgaactggaagctgattttcatagtcgcgggatcgggcatcacgctcgtactgctcgttctgtttttggtgatcaattttccggagttttcaaaggatacattgcatatccagcaatatcagatcaaccgggtgatgacatgggtcgattcgagccagcaggacgcgaatgatacgtatcagaccgaaaaagccgttacggcgatcggctcaggagaaatcttcggaacgggcattaacaatttgaaagtatacgttcctgaaggccaaaccgatttcatctatgccgtcatcggcgaaagtttcggctttatcggctgtacatttgtcgtcatcatgtttttccttctcatttaccggcttgtcgtgctgattgataagatacacccgtacaacaagtttgcatcgtttttctgtgttgggtatacggcgctgattgtcatccacacattccaaaatatcggaatgaacgtcgggctgatgccggttacgggcgttccccttctgttcatcagctacggagggagctctgtattgtccgcgctgatcggctatgcgatcgtttataacgccagctgccagctgacgaaatataaaggctatatgtttaaataa

SEQ ID NO: 3855 - DNA, 1185 bp, Bacillus licheniformis
atgagtcagaaaaagaatattacaaatcccttttaccagggggatttgatttttgtctatattgtcttttttatcataagcgttgtggctgtgtacgctgctcagcagtttaatcaatataatgaaccctttgcgatgaaacagtccctttactatttactgggggccttcatcatcatcgtgtttctttattttgatttggagcagcttgaaaagctcagcttttatttctatctgctcggcattttgatgctgatcgtgttaaagttcagtccggcatatatcggatcatacaggtttgcgccggtcatcaacggtgccaaaagctggtttatgcttcccgggtttacgctgcagcctgcggaatttatgaaaatcgggctgatcatgtacttggcttccttcatgtctaaaaacggccctgtcggcaagcgtacgttgaaagaagactggatttttctgctgaaaatcgccggtatcatcattgttccgttcggcttgattttagagcaggatacgggtacagccgggatcgtcgcgtttgtgatccttgtgatggtattcctgtcgggcgtgaactggaaattgatctctcttatcttcggaacgggtcttgcagccgttgctttgattttatatgtcatcatcaaatttccccgatgttgcggagcgctcggggttgaacaataccaaatcaaccgcgttatgacctgggtcaatccgagcgaacagaatgccgacgataaaatgcaggtcgaaagggcgcaaatggcgatcggttcaggaaaagtattcggaaatggtgtaagcgatcttcaagtctatgtacctgaggcgcaaacagactttatttttgccgtcattggcgagagtttcgggtttgtcggatgcacttttgttgtcattatgtttttcttcttaatttaccggcttgtcgtgctcatcgaccgaatacatccgttcagcaggtttgcctcatttttctgtgcgggctttaccgctttaattgtcattcatacctttcaaaatatcggaatgaatatcggcattatgcccgtgaccggcgtcccactgcttttggtcagctatgggggcagctcagtcgtagcaaccttgctcggcttcgcggttgtctacaattcaagctgccagttaacaaagtatcaaagctatatgttcaaataa

SEQ ID NO: 3856 - DNA, 1356 bp, Bacillus licheniformis
ttggataaagcacttcaaaagcgtaaacggcttgatatcataaaatttttggtcccttcgcttatcggaattattctgtttatgattcccgttaaaattgaaggaaatttaacgattccaattgctgttttttcaaatgcattgcaggagctgcttcagcagcaattgccgctgatcatgacggtcatcgtaaccgcaacatttatcttaacctttatcaccaaaacctttcatccggctttcatcaaaaaaagcgagtttttctataacctgctgaatgtatctttattttggtatatcgtccgcctagtcggcatgattttcgccgtgatggcgtactttaagatcggacctgaagcggtgtatgccaagagtaccggcggaacattattattcagcctgcttcccgttctcttctccgtctttctatttgcaggcctttttctgccgtttctgttgaatttcggcttgctcgaactgtgcggcgctttgatgaaaaacctgatgaggcctgtctttaagctgccggggcggtcatcgatcgattgtatggcttcatggctcggcgacggcacgatcggcgtgctcctgacgagcaaacagtatgaagaaggattctacacgaagcgtgaggccgccgtcatcggcacgactttctcagtcgtctccatcacgttttgccttgtgattatttcacaggttggccttcctcatatgttcgttccgttttatttgacgatattgctggcgggtgccgcagctgcggtgatcagcccgcggattccgcctttatcaagaaaggctgatacttatattacagatcaagcggatcaggatcaagagaagattcccgaaggatacactccgttccaatgggggctcagccaggctgtcgcaaaagcaaaacaaaatacaagcgtcaaagatttcttgcaggacggggctaaaaacgtactcgatatgtggatgggcgtcgctcccgtcgtcatggcgctcggcacagccgcgctgattgtcgctgaatatacgccggttttcaaatggcttggactgccgttcattcctcttctcgagctgctgcaggttcctgaagccgctgaggcctcacaaacgcttgtcgtcgggtttgccgacatgttcctgccgtccgtgctcggaagcggcattgaaagtgaaatgaccaggttcatcatcgcctgtgtatcggttacacaattaatctacatgtccgaagtcggcggccttttgctaggttccaaaatcccggtgacgttccttgacctcgtcttgatttttctcgttcggacgcttattacgctgcctgtcattgtactgtgtgccaactttattttttag

SEQ ID NO: 3857 - DNA, 261 bp, Bacillus licheniformis
atggatatgtttttcgcttacttgctgattgcaagcgccactcctttatttttatggctggacaacaaaaaggtcgcaatttcttctattccgcccatcattttaatgtgggtattcttctttttctatatgaccagcagcctttctcctacaggacactctctcatgatcgcactctttattctcaacgttgtcatcgcccatgtcgccgctttcatcatctacggacttccattgatccggaagcacatgagccgataa

SEQ ID NO: 3858 - DNA, 1200 bp, Bacillus licheniformis
atgaacttgatcaaatggattttgttttccgttatttcattcgccttttttcagccggcaccagccgctctattaaaagaaaaggacgactatactattcttgtttatatgattggttctgacatggaaagcgattttcatatggcaagcgatgacattcaggaaatgatggatgcgggttcatcttcaaacgtcaatgtcgttcttcagacaggaggagcaaaaaaatgggcgaacccgtcgatcagtcacaaggtgaatcagaggtggaaagttgaacatcagaagctggtgcccctcgaaaatgtcgggaagaaaaatatggacagtcccggctccgtcacagattttatcacatggggagtcaaaacatatccggctaaaaaatatgtattgatcttttgggggcatgggcttggctcagttgacggctacgggggagacgaaaacttcggcaataagaaaatgaaaataagcgagctgcagtcgggaatcaaaacggcctatgaacatacgaagcaaaagtttgatttaatcggttttgacaactgcaaaatggccgggattgaaacggcatatgccttgagggattatggtaagtacatgctggcttcagtcgactatacgaatcaaaacggctgggattataaaagggcgctgcagtctgtacaagacgacccttcaatcgatccgaaagagcttggcagggaaatcgctgcaggctacgtacagcagtcaaaagaaaacggtgaaacagaagacctgcagcagtctttaattcaattgaaccgtgtcaaagacgctgtcgatgccctcgacagattgagcgtaaacatgaacctggcattgaaagagcctgacggaaagcgcctgctccactacgcgcgtctcgctgctgaagattatgcagatgaatcggatatggttgatttggcggatttgtcaagcttgatcggtcagcagatcggagccgagaaagaagcaaaagaggtcgtaaaatccgtcaagaaggctgtcatcatgaacatcaaatctccggagcatccaagaggaagcggcatgtccgtttattatccggccagagacaaccataagcggtttgcggaaaaatcgaaaatataccgcctgcttgacttcagcagccggtatcaaacattcatcaaagattactcgcattcaacatttaactttgatctatag

SEQ ID NO: 3859 - DNA, 456 bp, Bacillus licheniformis
atgagcaatatagaagaacttcgtctttttcgaaaagaagatattgaatggctgcagacctggtttgaggatgcagaggtgaaaaggcggctggaagggatgctccctcttgacgaatggttcaattttgcaggcggtaatgaaaactaccgggtatgggcggctttagaggacggcaagcctgtcggcgttgtcatggttgaagttgaggaggacttgaccgggaacattgcccttttagtcgatccgtttttgcgcggagggggatatggaaaagcgctcatcaaaaggacgatggcattgccggaaatgagccggatcaacaaatggttcgccggaattgaagaggataacaagaggtgcttagcgtgcttccgatccgtcgggtattcattggaacacgaacagccggacgaagactgctactactctcttatttatttcccggaatcttaa

SEQ ID NO: 3860 - DNA, 1809 bp, Bacillus licheniformis
ttgctgaaattttattcgtttttcaaaaagctgcctcaaaccgcttccatcatattttacggtttaacgttgttttggcgctgcgatccttttaagtcggcggttctgtttttaattacactgctgaatgcaatgctcggacctctcctagtctggctgagtgcagaggtgatcgatgagattgcacgggcgccgtttgagctgtcttcttggaatgcactggtttgggcggcctttgcatacattgcttttacgctgatcgtagatgcccttcagcctgtagctgaaatgcagaaaaggctccttaccgccaagctcgaagcttatcttgatgaaatgctcatgaaaaaggcaatttccattcctgatatcgcggcttttgaagacgcatcttttcataccaatacacaaatcatccgctataatgaatattttgtcacgatgtgggtttccatcgtgtctcaaaccttcggcggaatggtgatgattgcagccagcagtttattgattggcatggctgcaccgtgggtgccgctgctgtttctcatattggccgttcccaaactgtactgggaggcgaagttaaacaacgcgacctttgaaggacggaaagaggttcaggaactgaggcggcgcgcggaatattatgcaggtgtccctcttatgtctgaaacagccggagaggtcaagatatacaatcttgttcctttttttaaatccttttataaaaacacctcaatggagctcctccatacgctgtccaacgatcaaaaaaaactggcgctgtatcagctgttctggtcggtattacaatctttggccgcaggtgccgtcctgatttacatcgttcaccaggcttttcatgggggattatccatcggggatgtgatgctgtttatcggagccgcggttcagttcaatgaaggaatcaatgaaatgttcgctgcttttgcgatcggagcaagagaaacgaggcacctcggaaatgtgcattcttttttaaacagcaaaaattccatggaaaatggggaaaccgctccagctgttcaaaagcaaaaaggatttacatgtgatcaagtggaattttcttatgatggaaccaaaacggtacttgatattcaacagcttgatattccattgaataagacgaccgttctcgtgggagaaaacggatcaggcaaaagcacactcgttaaattgcttctgcgttattttgatcccaatcaaggcacgatctcgtataatggtttaccgctttataagtatgatatagagcattaccggtcaaatgccgcggccgtgtttcaggattttttgcggtacgaaatgacattgaaatacaatatcggtctgggcgacatttcttcatgcaccgacttggccaaaataaaaagtgcttcggctttcggcggagtggatcagtttttgcataagcttgaagacggctatgaaacagagcttggcagattgttcggcggcaggaatttgtcggggggagaatggcagcggatcgccatatcccgcgcatttatgcgtgatgagtctgccgacattttaatatttgatgaaccctcttctgcgctggatgtatttattgaggaagagatatttgataagctgcaaaagctgacgcagggcaaaacagtcattattgtctcgcaccggttaagcacggcccgttttgccgaccacatcatctttttagaaaaaggaagggtggcggaggccggaacccatcaagaattgatgaaaaatcaggcacagtacgcagagctttatcgcctgcaagctgaaaaatacgcgcaataa

SEQ ID NO: 3861 - DNA, 1950 bp, Bacillus licheniformis
atgaaggtgaagcatgtgtggaagatgaagcatattcaagagccgctgcaaacggcgggcctgcttgggaaaatggtctggaaatccggtccgcggctgatgatttgcatggttatcttcatgctgatcgaagccggagcacctttaatccaattgtacgcttcaaagcaaatgatcgacggcattgtcgatcaggaagccgtcatctatgcagaaatatgggctgtcatttatgcgggaagcctggtcatggtcagtgtcgttaaatcattggaaaaatgggtgaaggcaatgctttctgagaggtcgatgatcacagtcaacagtttgttgatcgacgcttttgaccgcattccggggatgcgtttttttgaggatccaaagtacagggaccggctggaaacactgcgggatcgttcgacatggcttccttcccaattcattaatatcagttcgaacttggtgaccgccgttatgtctttggcgggcgtcgttttgatcatcgcctatctgtcgcccgtccttgctttcatccttattttgtcgaccgctccatttgcttttgtccataatcattacaatgaaatggagtgggaatatcacaaggattatgcccctgtaagaaggagggccgcatatgcgcgccacattctgctcgggagacgatcggccaaagaagtacgcctttttggcctggggtctttctttcttgatttatatcaatctgcttttaaaggcctatattctgtgctgcggaatattcaggtcagaagcgcgcgctggtcggttttaacgggtttcttatcgggggcgggaacgggtttggggtacttttggattctgtcccaatcccattcaagcagtttttctgtgggggatatatcgctgtacttgggggccgtgttccaattatcaacggcactccgggatatcgccaaagaaggtgcagatacgttggatatatggagaatgggaagagacttttttctttttatgaacgccgaaaaggatatcaggcttccttccaatggcgaatctctcgagggcgaaggaccgctggcagtcgaattcaaaaatgtcaccttccgctatcctttcagagaagcggctgccggctcccgggtaaatgaagctgatgtggatgaggaagacttggatatgctcgatgagcttgaagatgaagagatgcggggacaagacgaacagcctgaatcgtatgacatgcacacaggctatgttctgaatcgaattagcttttcagtatcaccgggagaaagaattgccattgtaggggcgaatggatctgggaaaacaacgctcatcaaactgctctgccgtttttatgagtatgatgagggtgagattaaagtgaacggcaaagacatccgcaaggtcgatcttcaacagctgagaaacaaaatggcggtcgtgtttcaggagtttggcagatacgaattgtcactccggcacaatatcgcgataggccgaacggaagctttaggcgatgaagaaaaacttcgcgccgccgctcgggccgccaagctggaaccgattgtcgaagagttgcctgaagggctggaaacaatgatcggccctgaatggggcggcaccgatttttctggaggccaatggcagcggatcgctttagccagatcgtttatgaaagatgccggacttgtcatattggacgagccggccgcatctttggatattcgggctgaatatgatattttccggcagtttcaaagcttcacagagggaaaaacggtgatcatgatttcccatcggttcagtacggtaaagatggctgaccgcatactggttttgaaaaacggaagaatcgcagaagagggaagccatcaggaacttatggacaagaacggggaatacagcagaatgttccgcatgcaggccaaatcgtttcaggggaaggatgaggtatattgctga

SEQ ID NO: 3862 - DNA, 1422 bp, Bacillus licheniformis
gtgcctgcggcgtcctacgcttttctcggccgggatcaagcggttcacgtgcacagctattgggggcttccgcagctattaaacgagaaagatcttgctggagacgctgttccgaggttccgggagctttttcaggaagtgacagcagatcgtttaaaggatgaaaggcatattgtcgaattaagcggcggactggattcagctgccgtaaccgccgccgcagttgcaggcggacgcaaggaacagctgctggccgtcaatatatcatttgccgaacccgacatgatattaagccacgacagggaccttgtaaagaatatgatgcgagatatggatatccccggcctgatcattcttggagacgctacagccaaaattccaaacgcggaaattgggcgtgatccgctttggtttgtagacggtcctgatccgagagccaattcactggttaatgagacttttacagtgatcgctgaggagtatggtgcctcgtctgtccttacaggtgagggcggggatttcatttttagcggagaagtgtcagtgatcgattccttgcttcggcagagacggttttctgaaatctacaaattgcttcgcgaatggtcaggcggcagcatgaaagagatgctgaagctcggatttcaatacggaatcgcccctttcatgccttatattggagaaaagctctattacgacctgctgtggtcagatacggaatatgagctgcctgaatatttcactgaagaacaccgaaagagagaatgggagatcaataaagaggatcatctacgctatcgaaaaagccgggagctctcagtgtggggcaagaggtttcactatgactttttgtggccgagagcgaggtacatggatgctgttggtgtgacattgcatacgtaccatccatttttggaccggcggctgatcgagttctcattttctgtaccgcctgaacagcattttgatgttttaaaagggcttgaagaacattatgcaggctctaaaatgcttcttcgcaaatctttcaccgatatcctgcctgcctatgtttataacagatcaacgaaaacaacatatgcccatatggccaggaaaagctttatgaatgaccgcagacacgttcttcagttatttgagccgggagagcgcgtcttcgttgaagaactcggcatcattaagcgcgatatatggtggaaacacttgctggctatggctatccgctctgaagatccaaataatgatctgggcatgggctatcagtacatgagatctgttattgacttggaaatatggctaagagaagcatccaaggggaaggagcaccttctcgaccggagccgtccggtaaagccaagggtcatggctgatatcgaaaccgtcaatacgccggagaaagccaaaatatactcgtatcaatga

SEQ ID NO: 3863 - DNA, 660 bp, Bacillus licheniformis
atgaaaatatggtttggaatgcagggaaacaacaccgctttatggcaagagtgggtttccgccgtcaagaaatggggacgggcggaacggattcacagctacagctgcgggatcgcaaacatggctgaagcgcatatccgatacgatgaagcttttagaccttcaactcaaataaatcttttgcaccccgtcatcttagacggctggatcagcggcggtcttaacgcaaaatcggatggcacccgaaagatcgagcaatatgacaagctgtacgcatcattgaagcaggacaaagctgccatgctgtctcactcgcatggcgaatatacgatggtctggtgggatgacagtctgcatagccttgttttggcgactgatacatacgcaacccgtccggtttactactgggtcagtccgaaaggagaatggtatgcagcgaatgacatgcgcatccttttgcttgttcatgacattccttttgcgatcgatcaagatgtgtgcagaatgtttcctacttcgggctttgctgtaggagaaaacggctttgagatcggacgttttttaaaggaatacgcaaagtgcctgcggcgtcctacgcttttctcggccgggatcaagcggttcacgtgcacagctattgggggcttccgcagctattaa

SEQ ID NO: 3864 - DNA, 465 bp, Bacillus licheniformis
atgaaaaaaagagcgcttgtcaaaaaccacgaatattttacaaccgttcatgcttttgtacgtatgatgctgttaaattatgactttgaagaagcttatgaaaaaattgcgatccacctgtttccgctgtatgcgagcgcaaagcaaagaggtgcagggcttcttgatatagacgaactgcaccggaacggcgaatatttgtattcccttgatgaagacgaccatttggtcacttcatgcgtttctattgcattaacgattcaatctatattattcagcaatgggtctgatgctgatctcatgatcggggtcaagaaaattgatgacaagctgttttctcacgcgtgggttcaaatggaaaacggcaaatcgatcgatccgaatcataaaaataagaatttaaaagttttacagacatataagatgagcgcttacgctgaaaggtgggtgttatctctagtatga

SEQ ID NO: 3865 - DNA, 273 bp, Bacillus licheniformis
ttgaaaattattcgaaatcaagagacagcgacaaccgtgttggaaaatgaatgcatcgtcctaaacctggacaatgggcagtatttcggattggaaggggctttaaaagagctgtggatcgaaattgaaaatgagcgaaaggataaaaaagatattctgatcaagtggcaatcggcgttcgatcagacggaagaagaactatcagcgatattaaatgaggcgatacaggaactgacacatcataagctcattaaaatagaggataaaagctga

SEQ ID NO: 3866 - DNA, 633 bp, Bacillus licheniformis
atgatacgcgtgttgttagtagacgactacagggttctgacatccggaatgaaggaaatattaaaaaaatataatatggatgtcatcgtttgccacgaaggaaatgaagctctcgacctcttaaaaaaccaagaggtacatatagacgtttttctttatgatttaaaaatgccggggatgaacgggttggaactgtctcttaaaacgctggaaatcgaacctcaatccaaaattatcattatgttttcgggagatgaaattcactcatattttaataagttgatcgaggccggagttaaagggtttatagataaatcgtatacagacagcatgatagcttcgagtattttattgtgtttaaaaggggctgtgttatttcccgacggcttgctgcaaaaactgagactcgactccgatctctcggtggacgagcatttaacagacacagaactggatattttgcagaaggtggccagcggtaaaacaaataaagagatcgcagcagacctgcaaatgtcgacgcggaacgtagagtatcacttgagcaaaatctataaaaagctcaaagtaacgtcgcggtactgcgcagtaaaaaaagggacgatgcttaatttgatcaagcagaaagtatag

SEQ ID NO: 3867 - DNA, 117 bp, Bacillus licheniformis
atgcgcaaattggaaagtgctcaagttaaaagctatggttcattcctgactgttactctttctaaaaagagcaagccgggcgacggcaaattcggccgcggcgtaaaacgcggttaa

SEQ ID NO: 3868 - DNA, 366 bp, Bacillus licheniformis
atggcagcaaaacaatcggctgaacacagccactttccttggaagcatattgtcgggttcgtgttgtccattgtgctgaccttattggccttgtgggtgatctatacggatttaagcatggctgcaaagctgtggattattttcggttttgcgatcattcaagctggacttcagctcttaatgtttatgcatatgactgagagtgacagcggcaaaatccaagtcgggaatacgctgtttgccgcgtttattgcggttgcgattattgccggttccgtctggatcttcgctgctcacaactatcacggagacaaccctgagggcggttctccaggtgcaaaacattctgagcacagcggacattaa

SEQ ID NO: 3869 - DNA, 615 bp, Bacillus licheniformis
atggaacatgcagaacacagcaattctaacgctcctatggaataccgttctgaaatcggaaggttgaatatccttggcttttggatttttcttggagcggagattgctttattctctacgttatttgcgacctatgctgttcttcataacagaacagcgggaggcgtactgccggcagaactgttcgacgcgaagctcgttttaatcatgacgttcctgctgttaacgagcagtttcacatgcggcattgcagtgcatgaaatgcgccgcggcagtttgaaaggcgtgatgatctggatgatcattaccctgttgctcggtgctggctttgtcagctatgagctttatgagttcaatcattatgtacacgaaggtgccactttatcgacaagtgcttactggtcagcattctttgttctattgggaacccacggactgcacgtatcgattggtatcttctggattatcggcatattgcttcagacgaaaaagcgcggcctcaccccgcaaacgtctgctaagctgtttatctcaagtttgtattggcacttcttagacgtggtatggatcttcatctttaccggtgtctatttgatagggttggtgaatgtataa

SEQ ID NO: 3870 - DNA, 1950 bp, Bacillus licheniformis
atgaatttgaaatgggacgaattcataattacaggtgacccattaattcttggagcacagatttccattttgcttacttcaattgcaatcgtatttgtgctgacatacttcaaaaaatggaaatggctttggagagagtggattaccaccgtcgatcataaacgtttaggaatcatgtacatcattgccgcagtcattatgttcttccgcggcggtgtcgacgggttaatgatgcgtgcccagctcacgcttcctaataacggctttttagattccaaccactataatgaagtatttacgactcacggtacgatcatgatcatcttcatggcgatgccgtttcttattgggttaatgaacgtggtcgtaccgcttcaaatcggtgcgcgggacgttgcttatccttacttgaacaacttgagcttctggaccttcatggtcggagcgatgctgtttaacatttcattcgtcatcggcggatcgccgaatgcaggatggacggcttacatgccgcttgcaggcaacgagctgagtcctggacctggacagaactattacttgctcggacttcagatcgcgggtatcggtacgcttctcaccgggatcaactttatggttaccatcctgaaaatgcgtacaaaaggcatgactctatggcggatgccgatgttcacttggacaacgctgatcacttgtgtgattatcattttcgccttccctgtcttgacagtggctttggcgctgatgacatttgaccgcttgttcggaacagcctttttcactttggcaaacggcggtatgccgatgctatgggcgaacctgttctggatttggggacatcctgaggtttacatcgttattttgcctgctttcggtattttttcagaaatcattgcaacatttgcgagaaagcagctgttcggctataaagcgatggtttattccattgtggcgatttcggttctcagctttatcgtttggctgcaccactttttcacaatgggcaacagcgcggcggtcaactcgttcttctcgattacgacaatggcgatatcggtgccgaccggggttaaaatctttaactggctgttgacgctgcatcgaggcagaattaaaatcacaacgccgatgctgtggtcgcttgcatttattccgaacttcgtcatcggcggtgttacgggcgttatgcttgcgatggcagctgcggattatcaatatcacaacacatacttcctcgtatcgcacttccactacgtgctgatcgcgggtactgtgtttgcatgtttcgccggattgatcttctggtatccgaaaatgttcggtcacaaactgaacgaacgcatcggaaaatggttcttctggctgttcatgacgggctttaacatctgtttcttcccgatgtatttccttggattgcagggaatgcctcgccgtatttacacatacggagcagaagacggctggactgcattgaacatgattgcgacattcggcgcattgctgatggccgcaggattcatcgttctctgctataacattttctacagcttccgtcattcaaaacgcgaggaatcaggagatgcttggggaatgggtcgcacgcttgaatgggctacatcttctgcgatcccgccgcactataactttgcggttctgcctgaggtcacttcacctgacgcatttgcgcaaatgaaggaagacaatgtcgagattcatcctgaaagcaagtttaaaaagattcatatgccgagcaattcaggccgtccgtttatcatgtcattatgcttcggatttgctggattcgggcttgtctttgaatggttctggatgggaatcgtcggtctgatcggtgtattcctctgtatgattcttcgttcatttgaatatgacgacggctactatgtaagtgttgaggaaataaaagagactgaacgaaagaatgccaagtaa

SEQ ID NO: 3871 - DNA, 960 bp, Bacillus licheniformis
ttgttcagagcatttaaaccactgattatgctgactctgctttcctccgtttttttattgggcggctgcagtcaaatcgcggtattggatcctaaaggaccggttgcttcgcagcaaagagatcttattctattatcgattggatttatgctgtttatcgtagcggtcgtatttgtcctttttactgtgatgattgtgaaataccgtgagcgtaaagacagaaagtctccttacagcccggaagtagaaggcaatacatttttagaaatcgtctggacagtggttccgattttaattgttattgcgctgtcagtgccgacagttcaaacaatttattctctagaagaggctccaaaagcatcaaaggacaaggaacctttggtcgtatatgctacatctgtcgattggaaatgggtattcagctatccggaacaggatatcgaaacggtcaactatttgaatatcccgacagacagaccgatcttgtttaaaatctcatctgccgactctatggcatctctgtggattccgcagcttggcgggcaaaaatacgccatgtccggaatggaaatggagcaatatttacaggcagaccatgagggtacttataaaggccgaaatgcaaacttcacaggcgaaggttttgcagaacaaaagtttaatgtcaatgcggtatctgaaagcaagtttaatgactgggtgaagaaaacgcagaaagaagctcccaagctgacgaaaacccagtacgatgaactgatgcttcctcagcatgcggacgaaatgacgttctcatctacacacctgaagtacgttaatcacggaaatgatgcggaatacgccattaaagcgcgcgaaagactgggctataaaccgttgtctccgcactctaaatcagatccgtttgaaaacgtaaagacaaacaaagatcaaaaacaatctgaagaccaagattctcactag

SEQ ID NO: 3872 - DNA, 990 bp, Bacillus licheniformis
ttggcaatattagtatgcggaggggcgggctatattggaagccatgctgtagcggaactgttaagccgcaatgaagatgtcgtaattattgataacctgcaaactggacatgaagaggcggctttaaagggagcttctttctataatggagatctgcgcgatgaagcatttctaagaaaggtgtttcaggaaaacgacattgaggctgtcatgcatttcgcggccgattcattggttggagaaagcgtaacagatcctctcaaatattatgacaacaacgtttacggagctgtttgcctgttaaaggtcatgaaagagttcgatgtgaagcaaattgttttctcatcaaccgctgcaacatacggagaaccggatcgggtgccgattatggaaacagatccgacggatccgacaaacccgtacggggaaacgaagcttgcaattgaaaaaatgctgaagtggtctgaaaaggcatacggaatccgtcatgtcgtccttcgctactttaatgttgccggggcgcatgtagacggcttgatcggcgaggaccaccagcctgaaacgcacctgattccgatcattcttcaagtcgcgctaggcaaacgggacaagattatgattttcggcgacgactatccgactccggatggcacgtgcatcagagactacatccatgtgatggatctggtcgacgcgcatattctcgctgtcgagaggcttcgaaacggcggagaaagcgccgtatacaatctcggaaacggaacgggcttctcagtcaaagaagtcgttgaaactgcccggaaagtgacaggctgtccgataccggcggaggttgcagagcgccgcgcaggagacccggcacagctgatcgcctcttcggaaaaagcggtgaaagagcttggatggcagccgaagtacgccgaactggaaacgatcattgacagcgcgtggaagtggtttaaagcacatccgaacggctatcaaagctag

SEQ ID NO: 3873 - DNA, 108 bp, Bacillus licheniformis
ttgcttttttcattttaccaccttcagcattttccggcttgtattttcatcatttcttcaaataaaaagttgggggaaaaacgaattgagagaccttcattccattaa

SEQ ID NO: 3874 - DNA, 126 bp, Bacillus licheniformis
ttggacaaagattgggtgattttgatgaaggaggcgaaaaaacttgggctgcaaattgaagatgtgaaagaatttcttcgcagtcagcccatccaaagcgatgctgaaaaacagataaagcaataa

SEQ ID NO: 3875 - DNA, 219 bp, Bacillus licheniformis
atggtatcaaaaggattaaggccaaaagctccgccccctttcaggagaaaggcaatcgaaaccgatacagaagaaagtgtatggggctgctggcatcagcgttggtcagcaatgcctctaaaacgccttaatcaatccggtctggtaccccttaagagagtgaagctggaaaaagtgaaacaacctatgtacagggcaaaaggtaaggctgctccttaa

SEQ ID NO: 3876 - DNA, 630 bp, Bacillus licheniformis
atgatgaatatggggatagcagcaatctgcggaagctcccgcgaaaacggaaatacggaagagttggtgaatcgattagtagacggacttgatgccgataagatctacctgcgaaactatcacattgagcccgtatcggactacaggcacggcaatacagcccctttgtatcctgatgatgactacagagacctgatcagccgggtgctggagaaggatatcctgatttttgccactccgatctattagtacggaatgtcgggtttgatgaaaaactttattgaccgctggtcacagacattgattgagcacgggagatctgcatttaaacagcaaatggcgaaaaaaacggtctacgtcgcggctgtcggagacgatgatccccgcttgaaagggctgccgcttattcaacagtttcaatatatctttgattttatgaacatgacattcgacggctatttgctcggcaaagggaacaagcccggcggcgtggtgacagaccggacagcgattgtgtctgcaaatgaactgagaaggaagctggcagaggcggaaacggggcggaaagcatggcaaataaaaaggcgaacaaacggttttatttatggaaaaagcatttattcgagatga

SEQ ID NO: 3877 - DNA, 315 bp, Bacillus licheniformis
atgggagaaggcaaaatagattacagcaaagctgcggcatctccggagttccagcggttgttaaagcggaaacgggcttttattgtaccgatgacgattttctttttgctcttttatttcctgctgccggttatgacatcatacttcacatttttgaatcagccggcagtcggggccatcacgtgggcatgggttttcgcgattgctcagtttgttatgacgtggacgctgtgcattgtgtatacgaaaaaagccggtcaattcgatcaaattgcaagcgatttcaaaaagaagattggaggcgttgattcatga

SEQ ID NO: 3878 - DNA, 1539 bp, Bacillus licheniformis
atgagtgccacagcctttattttgtttcttgccattgtcgccctcacgcttgtcattacgtatttcgccgctaaacagacaaaaacggccaatgagttttacacggcgggagggggacttaccggcattcaaaacggactggctattgcgggagattacatgtcagcggcttctttcctcggaattgccgggatgatcgctttgaacgggtttgacggtttcttctacagcatcggcttcctcgtcgcttatttagttgtcctttatattgtggcagaaccgctccgaaacctcggcaaatttacaatggcggacatgattgcctctcgttttaaacaaaagaaaattcgcggtgtcgccgcattaaacacaatcacgatctccaccttttatatgattgcacagttagtcggcgccggcgcgctgatcaagcttctgctcggcatcgattatacgctggcagtgtgcattgtcggggttttgatgaccatctacgtcgtattcggaggaatgattgcaaccagctgggtccagatcatcaaggccgttcttttgatggcggggacgctaatcatttcggtcatcgttttttcaaaattcggcttcagcctgacgaacatgttcgaacaaatgaaaacagctactccgctcggggcggattttctaaaccccggcaataagtataaagttcctcttgaaacactttcactcaatttggcgctcgtccttggaacagccggcctgccccacattctcatccgcttttatacagtaaaagatgccaaaacggcaaggaaatcggttgtctcggcaacatggattatcggtatattttatattatgacggtctttctcggttttggtgctgccgcttttgtcggttttgaaaacattttagctgccgataaagcggggaatatggccgcaccgctgcttgctcaggcgctcggcggagattttctgttcgccttcgtctcagccatcgctttcgccacgattttggcggtagttacaggacttgtcctgtcggcggcttctgcttttgcgcatgatatatacagccagattatcagaaaaggcgcggctacggaaaaagagcaaatgattgctgcaaggtgggcttccatcggcgtatccgtcctttcaattctgcttgctgtctttgcccaatcgctgaatgtcgcgtttcttgtctcgctagcatttgccgtggcggcaagcgccaatttgccgcttattatcttcaccgtcttctggaaaagattcaatgccgccggcgctttggccggcagcctgaccggccttttaagcgctctgatccttgtctccatcagcccgagcgtatgggacccggccggaaacgccatctttgttggagacccgctcatcccgctttccaacccgggaatcatctctattccgctcggctttttaggcgcttatcttggaacgattctatcttcaaaaacccctggtcaagacgcgtttgcagaaattcaggtcaaagcgcatacaggcatccacatggatcaatcttaa

SEQ ID NO: 3879 - DNA, 1500 bp, Bacillus licheniformis
gtggaatacgtaatcggggtcgatctcggcaccagcacggttaaaatcatccttgtcaatcagcggggagagctgtgcggcgaggtctccaaaccgttttccatcattgagccccattccggttattccgaacaggatcccgcagaatgggcggacaaaacgaaggaagccattaaggaattggtcgggcatttcccgggaaaagcatctcagattaaaggggtcagcttttccggacagatgcatggattggtacttttaaacggcaaaggagaggttttgcgaaacgcgatcctgtggaacgatacacggacaaccgaacaatgccggctgattaacgacaaaatcggaaaggagcgcctgctcgagatcgcgaaaaatccggcgctcgaaggttttacccttccgaagcttttatgggtgaaagaatatgaaaaagagctgtttgaaaaggcggccgtttttttgctgccgaaagactatgtcaggtacaccatgacggggcgtcttcacagcgaatattcagatgcggccggaacgctcctgctagatgtgagacatcaaacatggagcggggaaatctgcagaaagctcggcatcccggagtccttatgtccggatttgattgaaccgggcgcttgtgtcggcggcctcagaccggaattcgcggccgaaaccgggctgtctcctgaagtcaaggtgtttgccggcggcgctgataatgcatgcggcgctgtcggcgccggtattttaaaagaaggaaccgccctttgcagcataggcacctcgggggttgttctcacatatgaatcaaaccgtgatcaagagtttaatggcaatattcattttctgaaccatgcagcccccgatgcgttttattcgatgggagtgacgctttctgcaggacgcagcttcagctggtttaaagatgtatttgccgggcaggcgtcatttgacgaattaatcagcgatattggccattcccgtcccggggccgggggactgctgtttaccccttacttgtcaggggagagaactcctcatgccgacgcagatattcgcgccagcttcatcgggatggacagcgcacatacacgggcggactttgtcagagccgttattgaaggcattacattctcccttcatgaaagcattgaacaattccgtgccgggggaaaagacatcagccgtgtgatttcaatcggaggaggcgccaaaagcaatcaatggctgcaaatccaggcggatatcttcaacgccgacatcatcagactgacaagcgaacaggggccggcatacggtgcagccatgatcgcggccgtcgggtgcggctggtttccgtcgcttgaggcttgtgcagaccgattcgttctcatcaaagaaaccttttcgccccgccgtgaatacagcagacaatacgaagctctctttcaaatttacagagatgtctaccggcacacgaaaacgctgaacgagcggctggcaagctttcgggaataa

SEQ ID NO: 3880 - DNA, 1347 bp, Bacillus licheniformis
atgttttttagaaatatcggaatgattgagtatgaaggggccgattcggaaaatccttacgcatttaaatattacaaccctgatgaatttgtcggcggcaaaacgatgaaggaacaccttcgcttcgctgttgcgtattggcatacctttgatgcggacgggaaagaccctttcggcgacgggacgatgttccgggcgtggaaccggctgacacatcctttggataaagcgaaagccagggcggaagcggcttttgaattttttgaaaagctcggcgtgccctatttctgttttcatgatgttgatattgtcgatgaaggagcaacattgcgtgaaactttcacgtatttggatcaaatgtcgtcttttctcaaagaaatgatggagacaagccatgttcagctgctttggaatacagccaatatgtttacgcatccgagatatgtccacggggccgcaacttcttgcaatgcagacgtctatgcctatgcagctgcaaaagtgaaaaaaggcctggacatcgccaaagagcttggagcggaaaactatgtgttctggggcggaagagaaggttatgaaacattgctgaatacagatatgaagcttgagctcgaaaacttgtcttcattttatagaatggcagttgagtatgcgcgtgaaatcggttttgacggccaatttttaatcgagccgaagccgaaggagccgacgaagcaccaatacgattttgatgcagccacaacgatcgcttttttagaaacttacggtttaaaagaccattttaaacttaatcttgaggcgaaccatgcgacattggccgggcatacatttgagcatgaactaagggtggctgccttgcacgatatgctgggttccattgatgccaaccagggcgatttgctcttgggctgggataccgatgagtttccgaccgatctgtattctgcggttctggcgatgtatgaaattttgaaagcaggcgggtttaaaaccggcggcatcaacttcgatgctaaagtaaggcgcccgtcatttgccgatgaggacttgtttcacgctcatatcgcaggaatggatacgtatgcagtcggcttgaaagtcgcctcccgtctgcttgaagataaagcgctcgatcaggttatcgaagaacgttatgagagctatacgaaaggcatcgggcttgaaatcaaagaaggccgcaccgatctgaaaaagctcgccgcttacgctcttgaaaacgaccatattgaaaatcagtcaggccgccaagaacggctgaaggcgaccgttaaccgttacttattgaacgctttgcgcgaagcgccggcaggaaaggagacacactag

SEQ ID NO: 3881 - DNA, 1164 bp, Bacillus licheniformis
ttgaatacagcggatcaagcccttgtaaaaaaaatgaacaaagccctgatttttgagcagattattgaaaacggacccgtctcaagggccaaactttcggaaataacaggattaaataaagcgaccgtttcctcccaagtgtcttccctgcttcaaaaggacatcatttatgaaaccggccccggcgagtcaagcggcggcagaaggcccgttatgctgaaattcaatcgaaaagccggctatgcggtcggtgtagatgtcggaaccaattatataattgttgcgttaaccgaccttgaagggcatttgattgaacaattcgaacgaacgcttgatgaagaagacattcaggcgacagaagaggcattaatcgaattgacggggcttgccgttgacaaaataccgccttccccattcggattgaccggaatcggcgtgtgcgtgcccggcttggtggacaacgaacggcatgtagtctttacgccaaataagccgatccatttgattccgataaaagaaaaactggaagaaaggttcggcgttcccattttaattgaaaacgaagccaacgccggcgccgttggcgagaaggaatacggggaaggcggccagcttgagcatgccgtgtttgtcagcattaataccgggatcggtttagggattttaatgaatggaaaattgtttagaggtgtgcaaggtttttccggagaagccgggcacatgtccattcactttgacggtccgttatgccggtgcggaaatagaggctgctgggagctttacgcttcagaaaaagccgtcttctctcactatgcagcgaattccggggcccagctttacgaaaccgttaaagaacttgcagaccgcggtgatccgggcacgatggagacgtttgaacgctttggctttcatatcggcatcgggcttctcaacatcttgaaaacgttgaatcccgacaccattatcttgcggaataccatagtggaatcctatccgagcatcgtcgatgcgatcaaaaaaacgattgcctcaagaagcgcagcagaagccttgtctaattatcatttaaaaatctccacgctcggccgcaccgcctcagcgcttgggatgtcctcccttgtaaccgaacgttttctggaacggtttatgaacgagagattttaa

SEQ ID NO: 3882 - DNA, 675 bp, Bacillus licheniformis
atgacgcgagtctcagaagaagcaatgaaagatctgttgtcggtctattttattatggggtcaaacaataccgcaggggatcctttaactgttattgaaaaagctttaaaaggcggtgcgaccctttttcaattccgcgaaaaaggcgagggtgcgttgaaagccggagatcaaacggcgtttgcccgacaggtgcaggcgctgtgcaaacagttcaatgtaccgtttattatcaacgatgatgtagaactcgcgcttgaacttgacgcagatggcgtgcatatcggccaggatgatgataaggccgcagacgtcagagcgagaatcggggacaaaatcctcggcgtttccgcgcatacacttgaagaagtcttaaaggcggaaaaggatggagcggattacatcggtgcggggcctgtttaccctactgaaacaaagcgggatacaaaagctgtgcagggcgtctcgctcattcaagagatccgcaggcagggaattggcattcctgtggtcggaatcggcgggatcacggtcgaaaactgcgtccccgtcatcgaggccggggcggacggcatcagtgtcatcagcgccatcagcaaagccgccgatccaaagcaggccgccgaggcgtttagcgagaaagtccaagctaccaaacaaagcgcacattcctaa

SEQ ID NO: 3883 - DNA, 810 bp, Bacillus licheniformis
atgaatatggaagatgccgcaaggggaattgagttagtcagaaagcaaaaaccgctcgtacacaatatgacaaacaatgtcgtcaccaactttacggcaaacggtttgctggctctcggcgcatcgccggtgatggcgtatgcgagggaagaggccgccgacatggcaaagatcgccggagcccttgtgctgaacatcggcacgctcagccgtgaatctgttgaagcgatgattattgcaggaaagtcagctaatgaacatggggtgccggttatttttgatccggtcggtgcgggggcgacgccgtttcgaacggaatcggctcaagcgatcatgcgcaaagtgaaggtttctgccgtcagaggcaatgctgcggaaattgccaacacgcttggggaagactggctgatcaaaggcgtggacgcgggtgaagagagcggcgacagaacggagctcgcaaaaaaagccgcgaaattatgggatacagcagtcatcataaccggtgctgaagacgtgataacggatggtacaaaaacgtataccgtgggcaacggacatcagctgcttacgaaagtgacggggacaggctgcttgtttacctctgtcatcggtgcgttttgcgccgttgaaaaagacgtttgccgtgccgctgtatctgcagccgctttttatggaacagcggccgagttggccgcggcgaaaacggaaagccgggggcccggaagtttccaaatcgagtttttgaatcagcttgctgccgttgaagctatggatataaaagaacgcggcaggatcagagaggtggaataa

SEQ ID NO: 3884 - DNA, 594 bp, Bacillus licheniformis
gtgataggggatttcagagataagtatccgaacgtcacctttcagcttgttgaacacgggtctgtgaaagtgcaggagggagtagaggacggatcgcttgatatcggcgttgtcgtcctgcctgcaaaagaggagatttttcactcctttacaattgttaaagaagacttaatgctaatcgtccacctgtcccatcgttttgccgatgcggaagagatcgagcttcggcagttaagcgaagaaccgtttattttcttccgggaagactttgttcttcacgaacggatcattacggcctgcttgaaggcgggatttcagccgaatgtcatttatgaaacctcacaatgggatttcatcagcgaaatggtttccgcgaaccttgggataggtcttttgcccgaaaggatctgccgggatcttgaccctgaaagggtgaggatcattccgctggtgaggccggccattccttggcatgtcgccgtcatttggagaaaagaccgctatctgtcgttcgcggcgagggcgtggattgatcatacaaaatcgtatatatggagcgagaattcaaaaacagaaaggaatgcaggcgaatga

SEQ ID NO: 3885 - DNA, 327 bp, Bacillus licheniformis
atggacatacgccacttaacctatttcttggaggtagcccgtctgaaaagcttcacaaaagccgctcagtcattatacatatctcagccgacgatttccaaaatgattaaaaaccttgaagaagagctgggcatcgagctgttttaccggcgcggccggcagatcgagctgactgatgcggggcaaagcatgtatgtgcaggcccaggaaatcaccaagtcatttcaaaatttaacttctgagctgaacgacttgatggacgtcaaaaaagggcatgtgaggatcggtctgccgccgatgatcggctccggttttttccgaaagtga

SEQ ID NO: 3886 - DNA, 270 bp, Bacillus licheniformis
atgagcaaaacgattaaacttaaccatgcagcggttatgaagaagctggaacaagtaagcagcacgcttcaagccgtatctttaaaaagcccgccagccggagcgctcgggcggaacaaccttgattttacgaaaaagtggcttgaacgagaagccgaaatttgcaatatggtcaaacagtataaagaggctgttcgtaaaaacattgaggacacccgctcaaatgtggacacgctgaaggaacaggatgaggcgattgcccgaagatag

SEQ ID NO: 3887 - DNA, 438 bp, Bacillus licheniformis
gtgacaataatggactactcagacacgctgcaaaaaatacacggtgtcctctcccataaggcggcagagctggaagaacaaattgcaaggctggagcgggcaaagcgcgatgtagagcgggaacaaaacctcggaatcgaagaaatcaggcagattttgcggccgaatcttaatgagtcgtggaccggaagcagggcagccgattttgacgaagcacgtgatgaagcgcacacggcaatgtacagaattttcaccgatgagtatgatcggtatattcataaaatcgatttaaagatatttgctttagatgctgaaaaaggagctgttcaggctgcaagctggtcagccgaccgggcggactttctgatggaaaaaggagaggaagccgtcgacgctctgcacagcacaatcaacggtttaaaaggatggttgaaatga

SEQ ID NO: 3888 - DNA, 387 bp, Bacillus licheniformis
atgaaaacattcattaaaggattaggtcaggtcgctcttttgtttttattcgcccgtttcatgaatctgattgtcgaggttcttcatataaacattcccggcagcattctcgggattatcgtcatttttgcgcttctccatttcaaaatcattaagctggaatggattgaaatcggcgcgctgtggcttctcgcggagctgcttttgttcttcgtcccttcagccgtcgggattatgaactacggagatattctggctgaattcggcacaagcattatactcgttgtcctcatcagtacattcgtcgtcatggtgtcgaccggaatgctgactcaattgattgccaaaagaaaggaaagaaaaaaaacatgctcatcggatgcttaa

SEQ ID NO: 3889 - DNA, 684 bp, Bacillus licheniformis
atgctcatcggatgcttaagcctgatcgcaacagttttaatctatttgggcgcaaaagcggtgtattcacgccatccaaaggtgtatgcgtcacctttattggtcacgccggtgatactggtcggcctgctgcttttcatcaacgtcccttttgaagcgtacaatgcgggcggacgcttgttgacggacatgctccagccggcaaccgtggcttttgcgattccgctgtacaaatactttccagtcttgaaaaaatacgcggttgagatcattatcaacgtggctgtaggctgctgtatcgcgatcctgtcaacagcgtttatcgcaaaactcttcaagctgaatgaagacctgatcgagagcctcgttcccagatctgtcacaacgccaattgcaatgaacgtttctgaaatgatcggcggaatgccggcggtgaccgctgtttttgtcatattgaccgccttgttcggatcagtgatcggaccgatggtcattcgctacttccggattgataatgaaatcgcgaggggcgtactgcttggcacaagcgcccacggcgcaggtacgtcaaaagcatttgagctgagctccgtgtccggaacgatctcaagcgtgtcgatgatcctggccgcgatcatcacgctttgcgcagcgccgtttctgatttcccttattgcagtgtaa

SEQ ID NO: 3890 - DNA, 288 bp, Bacillus licheniformis
gtgatggcctttgtcaaagtattgttgacgaccgcttttctcacaggggctttcgcaggattcctgtgggcattttccaaagaaaaaggcgatggatttttctcggaaatggcggcggatggatcgggagtcttcacacttttcggtttgatcggtttactgaacgtcaaactgttaaaagcaatttccccaaaactgctgcatgacaggtcttttaggtgtatttcttttattctggccgttgtattattgatgatgtctatattcatatggctgatcgatttctaa

SEQ ID NO: 3891 - DNA, 1467 bp, Bacillus licheniformis
atgaattacggaattttaatatcgataggtatttatatggcgggaatgcttttcatcggatattttgcatatcgcaggacatcaaatttgaccgattacatgcttggcggaagaaatctgggtcccgccgttaccgcgttaagcgcaggagcttccgatatgagcggctggctattaatggggctgcccggtgcgatgttcctgaacggattgagcagcggctggatcgttgtcggtctgacaatcggcgcttatttgaactgggtgtatgtcgcgccgaggctaaggacgtatacggaaacggccggcaacagcattactatacccgattatttcgaaaaccgttttaaagacggttcaagactgttacggatgacgtcggcttttgttattttagtatttttcactttttatacatcatccggaatggtggcgggcggagagctgttcagaaccgcattccacctggattatcggatcggcatctggctgacggccggggttgtcattctttatacgctcttcggaggctttttggctgtcagctggaccgattttgttcaagggacgatcatgtttatcgcgctcatcttaatgccggtagtcgtgtttgttcaactggggggaattgcgccggcgttttcggaagtgaacgcggttaacccggatctcctccgtccgtttcaaggaacaaccgtaatcggtatcatatctttactggcatggggtctcggctactttggacagcctcatattattgtcaggtttatggcgatttcaagcgtgaaagaattgaagagtgccagaagaatcggcatgggctggatgatcttttcgatttgcggagcgatgctgacaggactcgtcggcattgcctatttcagtgcgaatcatcttacgttaaagaatgccgagacgatattcattaagcttgccgaccttttgttcccttcaatgattacggggttcttgctggccgccatattagcagcggtgatgagcacaatttcttcacagcttcttgtaacctcaagcgcgctgacagaggatttttataaagcgtttatccggaaaggggcttctgataaagaacttgtacttgtcggaaggctgtctgtcctcgccatttcactgatcgcactcttgatggcgcttcatccgaatgaaacgattctgaatcttgtcggctatgcatgggcaggcttcggggcggcatttggccctgtcgttttgctgagcctgtattggaaacgaatgacgaagtggggcgcgcttgcagggatgctgtccggagcgctgaccgttattgtgtgggagcaagtgaaagcgtttgacccggtttatgaaatcattcccggatttattgtttgtacagtcgtgatcatcgccgtcagcctgatgacaaagaagccgcgggcagagattgaaaaggaatttgagactgcggttgaacagctgaaaggttga

SEQ ID NO: 3892 - DNA, 1191 bp, Bacillus licheniformis
atgcatacattaaaaataaaacatccattcgctgcaaaaatgaaaaagggctatcccctaatcgaaaaagaggccgtttcttcgcaagaaaacggcataaaagaaggatcgctgatcaggataaccgatgaaaacggcaggtttttaggaaagggctattatggcgagcaaaacaaagggatcggctggattctgactcgaaacgagggggaatcgattgaccagtcattctttttaagcaggctggcgaaagcatttcaagccagaaaatcgctttttcaagacccggatacgaccgcttttcgtttgtttaacggggaaggcgacggaatcggcggctttacgattgactattatgacggctactatttgttccaatggtacagcaaagggatttatacgcttaaagaaacgattatggaagcccttgatgaattgacggattataaagctgtttatgagaaaaaacggtttaatacggccgggcagtatgtggaagatgacgactttgtcaaaggcgaaagaggagactttccgatcattgtgaaagagaacggcattcattttgccgtttacctcaatgacggagcgatgaccggcgtttttctcgatcagcgccatgtccgcaaggcggttagggaccggtatgcggaagggaaaaccgcgctcaacacattctcatataccggcgcattttctgtggcggcggcgctcggaggcgctgaaaaaacgacgagcgttgatgttgcaaaccgcagcttaagcaggacgatcgaacaattcagtgtgaacgggctggactatgaagctcatgagattaaagtcatggacgtttttaaatattttcaatacgcggccaaaaaagaactcgcctttgaccttgtcatccttgatcccccttcatttgcgagaacgaaaaagcatacattcagcgcggcaaaggattacaaaaatctgttaaaagacgcgattcgaatcactaaagatcaaggtgtgatcgtcgcttcgacgaacagcagcgcatttggaatgaaaaaattcaaaggctttatcgaagaggcatgcaaagaaacggggacgcgctttacagtgcttgaggagcattcgcttcccgaagattttaaaacggtgaaaagctatcctgagggcgattatttaaaagttgtctttttacaggttcgccatcgttaa

SEQ ID NO: 3893 - DNA, 381 bp, Bacillus licheniformis
atggcgcgaatcgaccacgtaggactgatggtgaaagacattgatgcttcgatcgcattctaccagaatgtgatcggaatgacgctgaaaggcagaatgacccatacaaacggcgtcatgaaactcgcttttttaggctttgagaacagagacgagacagagctcgaactgatcgagggatataacgacaaccttcctcaggaaggaaaagttcatcattttgccgtctcgaccgatgatatcgaggctgaatttgatcgcgtaaaaggcgccggcatcaagctgatggaagatgagattaccgtattgccgaacggcttccgctatttttttctttttgggcccgaaggagaaatggtcgagttttttcaaagaacataa

SEQ ID NO: 3894 - DNA, 621 bp, Bacillus licheniformis
ttggcattcggtcttctgctgtctggcgcccgttcgatcccgcagtcaaacgcggcagtcaaagcgggcttatggcaagcggcgatgggctatgagctcgatggaaaaacgctggggcttatcggttttggggaaatcggcaaaaaggttgcaaggcgggctgccgggtttaatatgaacgttttggcgtacggcacatacaaagactacaatgcagccaaacggctgaatgtgaggttcgccgagcttgacgatctcctggaaaaatcggactttgtatgtatcagcacatcattgagacctgccacctatcatttaatcaatcaagaaaaactggcaaaaatgaagaaaaccgcgtacctgatcaacattgcccgcggagaagtggtggacgaaagcgcgcttattcaagcgcttgagcaaaaacagatcagaggcgcagcattggacgtctttgaaaccgaaccgccggctgcccggatcgccggtctcagcaatgtcatttgcacggcgcatatcggcggcgctacgtatgagagcatcaggcgcatcgaagagatgacatatcaaaacatcaaaaggtttatcgaaaaacagcagccggctttccgcgttcaataa

SEQ ID NO: 3895 - DNA, 306 bp, Bacillus licheniformis
ttggttaaagtgctgttgacgctcaacggactgttttaccgcgctgcgccgcgcttgagagaaagggtcgaacggctcggcgccgaatttgcgtttttggattcaaatcggttgacgagacaggatttactgactcatatcaaggatgtccatatttatatcgccggcgttgaaaaagcggaccgggagctgatcgacgccgctccgggactccggtatatcatgaaattcggcgcgggaatcgacaatattgatgtggaatatgcaaacgaaaaagggattctcgtcacgaatgcacccggctaa

SEQ ID NO: 3896 - DNA, 864 bp, Bacillus licheniformis
atgaaaagcgaccgaaccatgcatattatttcttgtacagacaataactacgcacagcatttaagcgtgatgttctcatcattgctgacgaatatggatcagacgcgcgaggtgaaactgtatgtcatcgacggagggattgaaccggagaataaaaagcgtctggaagagacgaccctccaattcggagctcctattacatttcttaatgtggaaaaaagccagtatgacaaagcggtcgaaagcagccatattacaaaagcggcttactatcgaatttccattcccgatctgattgatgacgaatccgttaaacgaatgatctatgtcgactgcgacgccttagttttagaggatatatcgaagctgtgggacatggacatttcaccttatttcgcggcggcggttgaagatgcaggccagcatgaacggctgaaaaagatgaacatcagcgatgaagcaaaatattttaactcgggcttaatgatcatcgatatggaagcttggagaaaaaacgacatttcgaaaaaagtcatcgactttatcaataacaacgatgaagacatgtttgtgtttcatgaccaagacgcattgaacgcgattctttatgatcagtggctcgaacttcatccgaggtggaacgcccaaacacacattattttaaaagaaaaaacaccggcttccctcatcgatcaaaagcgctatatggaaacaagggcaaacccggcaatcgttcatttctgcggcggaaacaagccttggaattcaaacacctcacacccgtacgcccgtcaatattttaagtatttgcagtccacagcctttaaccagccggccaaattgtctaaaaaccatgtcagctaa

SEQ ID NO: 3897 - DNA, 1224 bp, Bacillus licheniformis
ttgctgataaggaatcctttcaaagaaaaatactactcacatgataggcgggcattaaatatgcttgcactcagagtgccgggcctggcttttattctcatgatctatgtcgcctctatcgtgctgcaatttcttaatgggagctggtccattttattgcttaatgtgtttacggtattgaccgccatctttgctttgttgcattggcactcatatcgctgggttaagaaaagggtgattctgtacttcgtattacaaggtttgatcacttttacacttgctaatgtcatgtcaggctttttagtgctaatcatcattggcctttatgcatttttgatcggacagattataggaatggcagacagaagaaagacgttcctcatcctttatttattgcttctgctgtcaatcactgtactatatcatattcacaaaggtgaatatttgcattttcttgtcatagcagtacctattatgatcgtgattatcacatatgccgctacattttttgcccaagtcgatgaaaagacaaaagcgcagctgactcttgaaaggctggagctggctcatcagcaggtagaacagctgacgctgcaaaacgagagacagcgtatggcccgggacttgcacgatacgcttgctcaggggctggtcagtttaaatatgcagctggacgctattcatgttcatctcgccaaagacaacacagagagagcaaaagaaatcgttcaacaatctatgaatagagtgaaaagcacactagctgatgcacgttcagcgattgacgatctgcgcagcaaatcagaagaaatcggttttttaaaagaaagaattacctcattaatggatcattttcaagagtcgacaggcatggcttgctttttagactacagattagaccaagtgccggacgttcgaacagctgaaaactgttattacatcattggagaatgcatagcgaatgccgtaaagcatgctgaagcagaaacgatctcagtgtccatttgggatgatgataagaggaggctccatttaaccgtcaaggataacggcaaaggatttgatgttgaaaaaggcaagaaaaagagaggacattatgggcttctcggcatagaagaacgcgtcagagcaatgaaaggccaattcaatataaagagtacaacatctaaaggaacacaaattgatatcactgtaccaattcagggagagatgccagatgaataa

SEQ ID NO: 3898 - DNA, 639 bp, Bacillus licheniformis
atgaataaggttttaatcgttgatgaccatcttgtcgtgagggaaggtctgaagcttttaattgaaacgaatgatcactacatcatcataggagaggcggaaaatggcaaagcagcagttcgccttgcagatgaattaaaaccggatattattctcatggatttgtatatgccggagatgagcgggttagaagccattaaactaataaaagaaaaacacgacatccccatcattattttgactacgtataatgaagatcacttaatgatcgaaggaattgaattaggggcgaaaggatatctattgaaggatacaagttcagaaaccctttttcatacgatggacgcagcaataagaggaaacgtgctattgcagcctgatatcttaaaacgtctgcaagaaatccaattggagcggatgaagaagcagagcagtgatacgcagctgacagaaaaggaagtcatagttctaaaagcaattgctaaaggtcttaaaagcaaagcgattgcctttgatttgggcgtctctgagagaacagtaaagtctagactaacgtccatttacaataaattaggcgcgaattcaagaactgaagcagtgacgattgccatgcaaagaggcgttctgacattagactaa

SEQ ID NO: 3899 - DNA, 2175 bp, Bacillus licheniformis
atgtcaaaaatgttatataaattaggaggatgggttgctcgcaatcgcataaaagtaatatgcgcatggatcgttgtgctagttgcttcgataggccttgcaatcacgttaaaaccaagtttttctgaggatatgtccatacctgacacaccttcggaaaaagcgatggatgtcattcaaaaagaatttccccacggtcctgataaagggagcatacgggttattttcggtgctgaagatggggagaaactgacttcgaagtcagcggaaaaagcaatagaaaatacgttaaaggaaatcgataaagatggttccgttgactcgattgcaagtccttttgtgacaggaacaatcgcgaaagatggcacagttgcctatgctgatatcaagtataaatcatcagcagatgatattaaagattactctatcaaacacttaaaagacagtttgaaaatggctgattatgaaggattgcaaactgaactaagcggagatgtaccaggagctgagatggagataggcggtatctctgaaattgtcggcattattttggcctttatcgttttggccattacgtttggctctttattaatagcaggtttgccgattttaacagcactgattggattaggtgtaagtattgggcttgttttgattgggacacaagtattcgatatcgcttccgtcagtctatcattagccggaatgattggccttgcagttggaattgattatgctttatttatttttacgaagcaccgccagtttttaggcgaaggtatacaaaaaaatgaatcaattgcgagagctacaggaacagccgggagtgcagtcgtttttgccggacttactgttatcgtagcactttgcggattgactgtcgttaacattccttttatgtctgcaatggggctgacagcaggacttagtgtactgatggctgttctcgcttcaatcacgcttgtgcctgccgtcttgtcgatagcggggaaacggatggttccgaaagcaaacaagaaaaaagaaaaacaaagcgcggaaacaaatgtctggggacgctttgtcacaaagaatcctatcatgctaagtgtatgcagcattctgattttgctcgttattagtatcccatctatgcatttggagctgggcttgcctgatgcagggatgaaagcgaaggataacccggatcgccgggcttatgacttgcttgccgacggttttggagaaggatttaatggtcaattaacaatcgtagcggatgccgcaagtgtaacagaaaataaggcggaagccttcgcagatgcagtgaaagaaataaaggaactggaccatgtagcgagtgtcactccggcaatgcctaataaagaagggaactttgccatcattacagtagttcctgaaacaggtccaaatgatgcagcaacgaaggatttggtaaaggatgtacgcagcttatcagataaaaacggagtagatttgctcgttactggatcaaccgcagtgaatattgatatttcagatcgccttaatgatgcgataccggtgtttgctgtactcattgttggttttgcgtttgtattgctgacaatcgtattccgttcgttgcttgtgcctcttgttgctgtcgcaggtttcatattgacgatgacagccactcttggaatctgtgtatttgttttacaagacgggaatctcatcgactttttcaaaatacctgaaaaagggccgatactcgcgttcctgccgattttatccattgggattctgttcggattagcgatggattatcaagtattccttgtaagcagaatgcgtgaagaatatgtaaaaacaaagaatccagtacaagccattcaggctggattaaaacacagcggtcctgttgtcaccgcagccggcctgatcatgatattcgtttttgcagggtttatctttgctggtgaagcttctattaaagccaacgggttggctctttcctttggtgtgctctttgatgcatttattgtacgaatgacactgattccaagtctgatgaagctgatggggaatgcagcctggtatttgccaaaatggctggacaagatcattccgaatgtagacatagaagggcatcaactcacgaaggaaatacagccagaaacagctcatgaacaaaagaaacaaatcagtatgtaa

SEQ ID NO: 3900 - DNA, 741 bp, Bacillus licheniformis
atgaaaacatactttcaaaaagattatcagctcggctcgtttcagctattttcagcatcccatattgtgactttgctagtgattgcggcgcttggtgtttgtctgttcgtcttcaggaagacgctccaaaagccggaatggaaccggttaattcgttatgtctttgtggcggttctcattatttcggaaatcggctaccactcctggttcgtttatgtgaactcatggacgccgcgctattgtttgccgctccacctcagcgacctttcggtttaccttgtcatcatcctgttattgacgaaaaacctcaacttgtttaaatttctttattttgccggtttgggaagcgcgctgcaggcgattctgacgcctgacttgggaaggtacggctttcctcatttccgcttttttgaatttttcatttcccacgggatcgtcgttctcgcctgcctcctgatgattgcagccgaaaggtataagccgacggttcgctctctctgggtcacgtttcttcttgtcaatgtttatggcgctctcatttttttgatcaaccgtttgctgaactcgaactatatgtacatgatgaagaagcccggcggcggagcatcgctgttagatgtgctcgggccatggccgtggtatcttttatcagctgaagcggtcacgatcgtcttcttctatcttctctatttgccgttttggatcgccgggaaggtgagagaaaaaaaggatcatgcatga

SEQ ID NO: 3901 - DNA, 1332 bp, Bacillus licheniformis
atgaaacaaacaactttaaaagagaagccgacaaaggttagagtgcgggtactgctgtttatttttgtatgtgtcgtgatcaattatatggatcgaagcaatatctctgttgcagcttctgcaatcggggacgatttaaacttgtctgccgttcaattgggcttgattttttcagctttcggctgggcttactgcgcactgcaaataccgggcggcgggcttgtcgaccggtttggcccgaggcttgtctacggctttaccttggttacatggtcgctcgcaacattgcttcaggggtttgtccgcggcttcggttcgctattcggcttgcgtcttgcgaccggagcgtttgaagcgccggcttttccgaccaataaccgggtggtgacttcatggttccctgaacaggaaagagcttcagccattgcattttatacgtcggggcaatttgccggccttgcatttttgacgccggcgctcagcgccatccagcatgtcgtcggctggcgcggcctttttattgtaacaggggtgatcggcatcatctggggcctgatctggtatatcttttatcgtgatcctgatcgtcatccaaaggtaaacaaggctgaacttgaccatattgaaaaaggcgggggtatcgtccgccgcggccggacttccgagaaagagaaattggcatttacttggaagcattttaaacaagtgaccgctcatcgcaagctgtggggcatatatatcggacagttcgccgttaattcgactttatggttttttctgacgtggtttccgacataccttgtaaaatatagaggccttgattttctccaatccggttttctcgcctcgcttccatttcttgcggcatttaccggtgttctgttgtccggcttcctgtccgactttttgatcaaaagaggcgtatcggccggggttgcccgcaaaacaccgattattaccggattgttcctgtctatttcaattatcggtgccaattatgtcgatcagacatctctgatcattttgtttatgacgctcgccttttttggaaacggtttggcctccattacatgggtgcttgtatcgtctttagcgcctaagcatttgatcgggctgaccggcggagtatttaattttgtcggcagcctcgcctccgttatcgttccgattgtcatcggctttctcgccaacggcggaagctttgcgcccgccctcgtctttatcggagccctcgcccttgcgggagcgctttcctacatctttcttgtcggaaaggttgaacggattcaggtcaatgataacgcagaggaaaacgattctatttctatgtga

SEQ ID NO: 3902 - DNA, 1149 bp, Bacillus licheniformis
atgaaaataacaggattcgagtgtttcctaattccgccgcgctggcttttcttaaaaatcgaaacggatgaaggcattacaggatggggagagccggtaatcgagggaaaggccgcgacagttaaggcggctgtgggcgagttaatggaatatttgatcggcaaagacccgatgaacatcgaagaccattggaatgtcatgtacagaggcgggttttatcggggcgggcccattctgatgagcgcgattgcaggcatcgatcaagcgctttgggacattaagggcaagttttacaacgctcccgtgcatcagctgctcggagggaagaacagggaatcgatcaaggtctattcatggattggcggagacaggcctcaagacgtcggcctcgctgccaaacaggtggttgataaaggctttacagccgtcaaaatgaacggcacggaagagctgcaatacatcgattcacatgaaaaaatcgatcaggtgattgaaagaatatcagcagtcagagaagcggtcggcccgtacatcggaatcggcattgactttcacggcagggtgcacaagccgatggcgaagatcttggcaaaggagcttgaaccgtttcggccgatgtttatagaagagcctgttctgccggaaaacaacgaggcgctccgcgatatcgccagcctcgtctcaattccgattgcgactggagaacggatgttttcaaagtggcagtttaaaaacctgctgactgacggctatgtcgatatcattcagcctgacttgtcacacgccggcggaattaccgaatgcaaaaagatcctgtcgatggcggaagcatttgatgtcgccgccgcccctcattgtccgctgggcccgatcgctctggcggcatgccttcaggttgatgcaacgtgccacaatgcatttatacaggaacaaagcttagggatccattacaacaaagggacggatttgcttgattatatagtagatcaaaaggtgtttttctatgaggacggctatgtccggattccggatggacctggccttggggtggacatcaatgaagatcacgtccgtaaaatggctgatatcgggcacaactggcgcaatccggtatggcggcacaaggacggaagcatagctgaatggtaa

SEQ ID NO: 3903 - DNA, 624 bp, Bacillus licheniformis
atggtattgtcacacatcgaagaacaaaaactgattgcgatcatccgcggatacaatccggaggaggcagtgagcattgccggcgccttaaaagcgggcggcatcaggcttgtggagattacgcttaattcccctcaagcgatcaaagcgattgaagcggtttcagagcattttggggacgaaatgcttgtcggagcgggaaccgtacttgatcccgaatctgcgagagcggcgcttttagccggcgcgcggtttatcctgtctccgaccgtcaatgaagagacgatcaagctgacaaaacggtatggagcggtcagcattccaggcgcttttaccccgactgaaatattgacggcgtatgaaagcgggggagacatcatcaaggtatttcccggaacaatggggcctggctatatcaaggatatccacggaccgcttccgcatattccgctgcttccgactggaggagtcggattggaaaaccttcacgagtttctgcaggccggtgcggtcggagcgggaatcggcggttcgcttgttcgggctaataaagatgttaatgacgcgtttttagaagagctgtccaaaaaagcaaagcaatttgttgaagcagcaaaacagtaa

SEQ ID NO: 3904 - DNA, 954 bp, Bacillus licheniformis
atggatgttattagcataggagagacaatggcgctgttcactccgaatgaagacggccctctcagatacgcaagaaactatcaggtgagaatagcgggcgcagaaaccaacacgctgatcgggctttcgaagctcgggaaaaaagccggctggattacacggcttggaaaagacgagttcggggcgatgattctttcttctgtcagaggagaaggagtcgatgtgagccaggtgaagctcgatgacgcggcgccgaccggtttgttttttaaagaaaggaaaagcgcggccaaagtcaatgtcttctattacaggacgctttcagcggcgagttttttaaagaaatgcgatattgatgagcaatacattgagaaagcggggcttttatacattacgggaattaccccggctttaagtgaaagcgcttcagatgcggtgttttatgcagtggagctcgccaaaaagcacaataaatgcgttgtatttgatccgaactttcgaaaaaagctctgggacggagagcgggcgcggcagaccatgtttgaacttatcaaacggtctgatatcgtgcttccggggttgagcgaagggcgttttttgttcggcaccgctgatgagaaaaaaattgcggaagccatccgcgggctgggggctgaaactgcgatcatcaagcttggttcaaaaggcgcctattatgccggcgggaacgaaagcggctatgcggaaggctatcagattcaggcagcagcggatcccgtgggtgccggagacggctttgcggccggcgtattatcgggtttgattgatcaaattccgctttcagaagctgtcaaacggggctgtgccgtcggcgccatggtagcggcggtaaacggtgatattgaagggctgcctgaccgcgaatcactgtttgcgtttatggaacaatctgatgaagaagatgtcagccgataa

SEQ ID NO: 3905 - DNA, 759 bp, Bacillus licheniformis
atgtcagtaaaatccgcggtacgtgttgtacgtatatttgaattgctgtcaaatcatccggatggattaaccgtaaaggaaatcagcaaagaactttcgctgcctcagagcagtacattcaatttggccgctacacttttggatgaaggttaccttcagcaggatgctgtcaagcgttacaggctgggggcaaaattgattcaagttggaaccgctgccatggagtcgatagacatttcatcgcagggcgttccttttttaaaacagctgatggacggcgttcaggaaacggtgtttatggccgttctatccgatgatcagctcgtctacatcgcaaaaatcgataacaacaggtcaatcagaacaaccgcacagcccggctcgcgcaaaccgctttattgcaccgggcttggcaaggcatttttggcattcatgccggaggacaaaagggaagggctgctcgaccgcatggagtttatccggtttaccgggcataccatcactgccagagaagagctggaaaagcagctgcagacatttttggaacagggatatgccgttgacaatgaagaaaatgaagaaggtttgttttgtctggcggcgcctgtctatggtccggatggcgtgatgaaggcggcgatcagcaccgccgggccaaaggagcgcatgctcgcaagaaaggccgttatcgttgagcagctgcttcacacagccggaaaaattacagaaagcattggcggatatagaaagccgctttag

SEQ ID NO: 3906 - DNA, 1350 bp, Bacillus licheniformis
atgaagagaaaaatgatgatgttcggattggcgctatcgatcattgcaggcggcgtggtcgccgatggaacggggaatgcagctcaagcggcccctcaggaaacagccatcgcaaaagatatcgaaaaattcagcaaaaaattcaacgagaaccgcgcctatcaaacgatttaccatttaagcgaaacgatcgggccgcgtgtgacaggcacggcagaagaaaaaaagagcgccgcttttatcgcctcacagatgaaaaagtcaaatctgaaagtaagcacacaaaagttcagcatacctgaccggctggaaggaacgcttaccgttcagggaaataacgtgcctgcgcggcctgccgccggttccgccccgactgcagcagaaggcttggccgctcctctctatgatgccggcctcggcttgcccggcgacttcacagaagaagcgaaaggaaaaatcgccgtcattttgagaggagagctgacattctatgaaaaggccaaaaacgctgctgacgcaggcgcaagcggagttatcatttataataacgtcgacagcctcgtccctctgactccgaatctaagcggtaataaagtcgatattccagttgtcggcgtcaaaaaggaagacggggaaaagctgctttctgaacaagaagcgatcctgaagctgaaagctcataaaaatcaaacctcgcaaaacgtaatcggcgtccgcaaagcaaaaggtgtcaaaaatcctgacatcgtttatgtgacttcgcattatgacagcgttccatatgcaccgggagccaatgacaatgcctccggcacttcagtcgtccttgaactggcccgaattttgaagacagtgccagccgacaaagaaattcgctttattacattcggagccgaagaaatcggactcctcggttcgcgccattatgtcagcacattgtcaaatcaggaagtcaaacggagcgttgccaactttaacttagatatggtggcgacaagctgggagaatgcttcacagctgtacatcaatacgcccgacggttcggcaaacctcgtctggcagctaagtaaagccgcttctttaagccttggaaaagacgtattatttttacatcaaggcggatcatccgaccatgtcccattccatgaagccggcatcgactcggccaactttatttggagagagccgggaacaggcgctttggagccttggtaccacaccccttacgacacgattgaacatatcagcaaagacaggctgaaaacagccggtcaaatcgcgggaacagctgtgtataacttcaccaagaaggaaaacagaaaaccgtcttacagctcagttgcccagtaa

SEQ ID NO: 3907 - DNA, 1362 bp, Bacillus licheniformis
atggccggattgaaaaagaaacgggccctgtttttaacagccgttgcatcagggacgatgctgaatccgctcaactcttcaatgatttctttggcgctgcacagcatccagcatgagtttcacctttcatttgcaaccgtatcgtggctgatttcatctttttatctagccagtgcggtcgcacagcctgtcacaggaaaaattggcgatttaatcggccggaaaaagatgtttttgtcagggcttgttctcgttgccgtatcggcaatcggcgctcctctcgcaccggctttttccgtcttgttgatcatgcgtttgtttcaatcgattgggagcggcgccatttacccttcgggagtgggcctgatcagaagccacattcatgagaagcaggcgtctgcactcagtgtgctgtccattttttcttcggcaatgaccgcctttggaccgaccgtggggggatttttaatcgtactcgggggatggcccgccatcttcctcgtgaactttccatttattttgttcagctttttgctggggatgtacatgttcccgaaagatgagaaaaaagccggcttaaatgtccgcgccgtgatcaagcggcttgatctcaccggaattcttctgtttgcgggcggaatcgttctcctgctggcatttctgctctcattgagcacgggcgagccccgttttgccgaggggatgttcggactcgtcttgcttttgatgtttgtttggtgggagctgagagtgaacagtccgtttattgatatcaggctgttgatcgcacgcaggacgttaacttcggtctatgctcaatttattatgctgaacatctttaactactgtttgttttttggacttccgagttattttcaggatgaaatgcacctttccgttcaaacgagcggtcttttgatgctgttcatgtccgggacgagcgtattgatctcgcctttcgtcgggaaatggattgaccgttcaggagaaacgcagcccgtgttaattggttcttgcttaatggcagcgggcgctatcctgctcacattgttttttgtcgatgcaccgatgttgtggaaaggcatcatcctctctttgctcggggtcagctacggcctcggcaatgtcgccctgcaggctgccatgtttacggcaagtccgccggacatcgtcgggacgacttcggggctttttcaaacatgccgctatcttggctcgatcttttcgtccgtcattctgggtctgttgtttggagaagaaataaccgcggggcattttcaggatctggggatggtcatgattgcggttgccatcggcagcattttgatgagcttcagatttatcaagctgatgaaggattga

SEQ ID NO: 3908 - DNA, 213 bp, Bacillus licheniformis
atgaaatcggatattgaaaaacgtgcggaatgcggtttgcaaaacggaacggaagcaatgatgaaccgggagtcgcaacggcttgatgctgctttatacggggccgtcctcaatgctttcggctgtgatgataggagccgtctgatgagcggggaagcgggggcgggcggtaaagcgggcggagctggcgaaaggctgctgtaccctaagtaa

SEQ ID NO: 3909 - DNA, 660 bp, Bacillus licheniformis
atggatatggcgatagataagatgataggactgcctgaagcccagatagaagatttgagaaacctgatggaggactggaagaacgaactcctcgtctataaatttgccttggatcaaatggatacgaagttttcgattatcagccaggaatataatttaattcacggccacaacccgattgaacatacgaaatcaagggtgaaaagctttgaaagcctgattaacaagcttgtgcggaagggctgcgatattacgacaaaggccgctaaggagcacatcaatgatatcgccggtctcagaatcgtctgctcgtttttatccgacatttacaatatggttgaagtgctgaaggaacatgaagacatcaaaattttaaaaatgaaggactacattaaaaatccgaagccgaacggatacaggagtcttcacttaattgtagaagtgcccgtttacttgaccaaccgcgtcgagcacgccaaggtggagattcaaatcaggacgatcgcgatggatttctgggcgagcctcgagcataaaatctactacaaattgaacaatgaagtgccgaaccagctcactgatgagctgaaagaagcggctgacatcgcgaactacttggatgaaaagatgcttcatattcgaacaaaagcggatcaataa

SEQ ID NO: 3910 - DNA, 111 bp, Bacillus licheniformis
atgaagtggctgctcaacacttcctattactttctcattctggtgctgctgtttttaatttacggattccatacagcaaatacaggttcatatatttataatgacttttaa

SEQ ID NO: 3911 - DNA, 1509 bp, Bacillus licheniformis
atgaaactgattgaaacaattaaaaaatacgcgcaaacacaacccgatacccttgcttttgtgaatgaagaagaaaagctgacatacggagagctttggtcacaatctgagcgccttgccgcaaggattcaaagcgaagctttaacagatgcttctccgatcattgtctacggacatatgaaaccggttatggcggtttccttcctggcttgtgtaaaagccgggcatccgtacattccagttgacgtatcgattccggcagaccggattctgaaaatcatcaacagttcaaaagccgagcttctgctcaataattcaggcacttcggttgacacgggagatgccctcatttccgtagtggaaccgggcgttcttgaaggagacggggtgccggagacagatcccggacgctgggtacatggggaagatactttttacattatctacacatccggaagcacgggaaatccaaaaggcgtgcaaatctcagccgataaccttcagagcttcacagattggatcacgaatgactttccggtggaaagcggccaagtgttcttaaatcaagccccgttttcctttgatttatcggtaatggacctttatccgtgcctgcagtccggaggcaccttatggacggttacgaaagacatgattaatcggccgaaactattgtttgaagcactgaaacagtccaacgtcaacgtctggacatcgacgccttcattcgcacaaatgtgcttgatggatccgtcttattcggaagagctgcttccggagctgagcttgtttatgttctgcggagaaacgcttcctgcgtcagtcgccagacagcttaaagaaagatttccaaaggctcgtgtttttaacacatacggcccgaccgaagcgaccgttgccgtcacttccatcgaagtaacagacgacgtattaaacaagtattcttctcttcccgtcggttctgaaaagcccgaaaccgaaatcgtaatcatcaatgaagacggaaaagccgtccaagacggggaaaaaggcgagatcataattaccggagcaagcgtcagcaaaggctatttaggcgaaaaagcgctgacggaaaaagcgtttttctcttacaacggctcccctgcttaccgcaccggtgacgcaggttacaaagaaaacggccagctcttcttcctcggaagactcgatttccaaatcaaactgcacggctaccggattgagcttgaagaaatcgaatatcagatcaatcagtcccgatatgtgcagtcggcagtcgttattccattctaccgcgaggagaaaatcgagtatctgatcgccatgattgtgcctgccgaacacgatttcgaaaaggaataccagttaaccagcgcgattaagaaagatttgggcagcaagctgccggcctatatgattccgagaaaattcatgtatcaaaaagagattccgatgacagcaaacggtaaaatcgaccgcaagagattaaaagaagaggtaaccgtatga

SEQ ID NO: 3912 - DNA, 1158 bp, Bacillus licheniformis
atgacgccttatggttcatttcttttcttcattatattaggaattttactggcgccgaccatcattctcggactgaacggaaaaagcttccgcttatataatatggcggtttccgttctggttctggcgcttattttttcgaacagcctgcacgggctgatcatgctgtgcctgtttacgctttggcagacggttctgatcaaaggctatatcgcttaccgtctaaaagcgaacagcggcatcgtattttgtctggctgcagcagcttctatcctgcctctggcactgtcaaagctgctgccgtttttcgccgttgacaactgggcaacatttctcggaatctcgtatttaacttttaaaggggttcagctcatcattgaaacccgcgacggtctcattaaaaagcagctcccaatcagcagactgctttactttattctcttttttccaaccatctcgtcaggtccgatcgacaggtaccgccgttttgaaaaagacgatcagacggtttggacaaaggagcaatacgaagaactgctttacaaaggaatcaataaaatttttctcggctttttgtacaaattcattatcggctactgcattaatacgtatgtcataatgaaactgccgtttttgacttccggcagcttctcgcatggattggcatacatgtatgcgtacagcctttatctgttttttgatttcgccggatacacggcttttgcggtcggcgtcagctatatcatgggaatcaaatcccctgaaaactttaataagccgttcatcagccgcaatattaaagatttctggaaccgctggcatatgtcgctttccttctggttcagagactacgtcttcatgcgctttgtcctttggatgacgaagaaaaaatggatcacaaaccggatggctgtttccaatatcggatatgtgctgctgttccttctgatgggcgtctggcacggccttgcccctcagtacatcgtctacgggctgtatcacgcgctgctcatggtcggctttaacttctttgaaaaatggaataagaagcacaagtggtggccgaacaacaagtggacgacagccgtctcaattgtggtgaccttccactttgtatgttttggatttttaattttctcagggaaactaatacactaa

SEQ ID NO: 3913 - DNA, 237 bp, Bacillus licheniformis
atggattttaatcaagaagtactttcagttttagcagaggtatgtcaggacgatatcgtaaaggaaaatccggatattgatatattcgaagagggaatcctcgattccttcggcacggtggaattgctgctcgcattcgaaagccattttaacatcacagtgccgattacagagtttgaccgggatgcatggaacacgccaaatcaaatcataaagcagctgaatgagttgagataa

SEQ ID NO: 3914 - DNA, 1170 bp, Bacillus licheniformis
atgaaaaagcgttttttattcgggccaatcatcttggcatttttactttttttcaccgcgatcttgatcccaaatgcatggctgacaaagctggttcctaaagatcgcgtcgaaacttcagctacagaattaaacccgatgatgttccaggggatgtatcttcaaggcaaagcgcttgaagacccgaaatatctgccgattttcggatcatcggaattgtcccggttagatgcattccatccgtctaactattttaaagtaaacaatcaagggttcacgccttacctggtcggaaaaggcggctcacagtccttgattcacgcgatcaactttgcggcgcagtctgatcaattaaagggcaagaaaatcgttttcattatctctccgcagtggtttcaaaaacacggctcggacgaagcccactttgcgccgaacttctcggctttgcaggcatacgatcttgtgttcaatcaaaatgtcgattccgggctgaagaaaaaaatcatcaaacgcatgcttaaatttcatgcagtgaaaaatgacgctctgctttcagccctttttaaagccgagctcgaccaggacaaggtggcactgtctcttctgacgccgccggcaaaagcttaccaaagcattctggagaaaaaggacatctattattccatggttgaaggagacggaccgaagcggaccatttcccaagatgtaaaaaacaaatcgtgggatgaattaaaacagatggccgaaaaggtcggcgccaaagaatcccggaacaatgagtttaaaatctcaaacggcgtttataagaaattgaagccgaagctgaaaaagcttaaaggccataataaaaagatgaactatgccgagtccgtcgagttccacgatttccatctcatgatggatgttttgaaagaatccggcgcagaaccgctgttcatctcggttccggtccacggcaaattttacgactataccggcttccctaaaaaaggccggacggatttctataaaaagatcaaaaaagaaatcgaacaagagggctttcaagttgctgatttaacgaatcatgaatatgatccgtacttcttgaaagatacgctccaccttggctggaaaggctgggtttacgtcgatcaggagatcgaagctttttataaaaagtcatcataa

SEQ ID NO: 3915 - DNA, 1092 bp, Bacillus licheniformis
atgacaaaacaaacgatcagcgtacagctcagtacagcaaaaaagcaaaagccagaggctgacaagctcgaattcggccggacctttaccgaccacatgtttatcatggactatacggctgaaaacggctggcacgatccgagaatcgttccttaccagccgattgaaatggacccggctgcaatggtttaccactacggacaatccgtttttgaaggattaaaagcttatttatcaagcgaaggcagagttcttctgttcagacctgaaaaaaacttcgagagactcaataaatccaacgaccgcctctgcattccccgggttgatcctgaaatcgttctggaagggctgaagcagctggttcagatcgacaaggaatggattcctcaagctgaggggacatccctttatatccgtccgttcattatttcaacagaaccgtaccttggcgtcgccccatccaatatgtataaaatgctgatcattttatcgccggtcggatcttattacaaagaaggcatccgccctgtgaaaattgctgttgaaagcgaatttgtccgtgctgtggcaggcggtacaggcaatgcaaaaacggccggaaactacgctgcgagcctgaaggctcaggaagttgcggaaagcaaaggcttctcacaagtgctgtggcttgacggagttgaaaagaaatacattgaagaagtaggcagcatgaacatcttcttcaaaatcagcggtgaaattgtcactccggctctaaacggaagcattttggaaggcattacgagaaactccgtcatccatctcttaaaacaatggggactctccgtaaccgaaagaaaaatttcagttgatgaactggttcaggctcacaaagacggcctgcttgaggaagcattcggcaccggaaccgccgctgtcatttcccccgtcggcgagctgatctggaaagacgaaagccttgtgatcaacaacggtcaaactggagaaatcgccaaaaggctctaccaaacgatcaccggtattcaaaaaggcgctttgcctgacacattcggctggacagttgaagttgataaagtaagccagtcctgctaa

SEQ ID NO: 3916 - DNA, 1263 bp, Bacillus licheniformis
atggatcaaacaaaattgagcgtctgggaaaagaattacacgttccttttcatctccaggctaatcaaaatctctgctgactgttttgccttcaattctattttatggtttttaatctttgacggaaaaggtgcaatcggcacttccctgcttcttgccgtcacttttctccccgaagcctttttggcgccgattacagggcctttagtcaaaagaagcgccctgaaattctggatgtacttttcggatttaacaagggcagccgtcgtcattactataccgatttgctatttaaacggcttttcaccgatgtggtttgttttaggcctcatgatcatccattcggcaacaggcgcgacatataacccggcgtcaattacgctgattccgcagatcgtgaacgaaaatctcatccaaaaagccaacgcgattctccagtcttcttcagaaatcatcaggctgggagccgttacattgtgcggagtgctgctgacttttatcggtcctgcaacgactttggtcttttcatttatcttttatatcatatcgggcctattcatgctttgcatcaaatacagcatcacccggactcattcacagtctaagtctcttgctcaaagaggtacatattttgcgagattaaaaagaggatttacattggtgaaaaaccacaaaatattatatccgctcgcgatttattgcatcttcatgaacctggcggcttcaccctgggaagccctttccgcggtatatgttgctgaggatttaaacggaacgccgttcatccactcgctgctgaaggcgacgacggcaggaggagcatttttactgggatttatccttgcaaaagtaaaaatcaacaggtacggactcctttttattacggcaggcattctcgaaggtgcagcttattttatcgcaggactgaatactttcctgccgctcgtatttctcgccgcctttgcattcggggcagccatcagctcgattaatgtccccgaattcacgattatccagacatctgtcgaaggggatgaccagcctcaagtgtttgcagtcatccatatgatcacaaatctatcgcttcctttaggggcaattgcctgcggatatgccgcaaaaatgcttggcgcgggaaacgtgattgcaatcggcggcttcatcgaaatcattgcgggcatcggcatcctcatatttactcagcttgccagggcccggcggtcagatctgataaaagaaaaagaagctagcgcaaatatgtag

SEQ ID NO: 3917 - DNA, 1329 bp, Bacillus licheniformis
atgaaaaaaggattgaaaatcgtaacaattggcggaggttcaagttatacgcccgagcttgtcgagggattaatcaaacggcatgacgagcttccggtcagcgagctctggctcgtcgatataccggaaggggaagaaaaacttaatatcgtcggcacgctggcgaagcgaatggtcgaaaaagcaggcgtcccgatcaaagtccatctgacgctagaccgcagggaggctttaaaagacgctgattttgtcacgacgcaattccgcgtcggcttgctcgaagcgagagcaaaagatgaacgaattcctttaaaatacggggtgatcggtcaggaaacaaatggaccgggcggccttttcaaggggcttcgcaccattccggtcatccttgagattgcaaaagacatcgaagaactgtgccccgacgcgtggcttgtcaattttaccaacccggcaggcatggtgactgaagcgctgctccgctattctaatttgaaaaaagtcgtcgggctctgcaatgtgccgatcggcatgaagatgggggttgcaaaggcgctcgatgttgatgaaagccgcatagacattcaatttgcaggattaaatcatatggtgttcggactcgacgttttccttgacggcgtcagcgtcaaagacaaagtgatcgaagcgatggcagatccagaaaatgcgatgacgatgaaaaatatctccggagaatcgtgggaacccgactttatccgcggccttggcctgattccgtgcggctaccaccgctactactataaaacacaggaaatgcttgaacacgaactggaggcttcaaaaacggaaggaacgcgtgcagaggttgttcagcaagttgaaaaggaattgtttgagctgtataaagatccggagctggcgatcaaaccgccccagcttgaaaagcgcggcggcgcatattacagtgatgccgcctgcaacttgatcagctcgatttacaatgacaagcacgatattcaacctgttaacacgatgaataacggagcgatcgcaagcattcctgatgactccgcagtggaagtcaactgtgtcatgacgaaaaacgggccgaaaccgatcgcggtcggagatttgcctgtcaccgtgagaggtcttgtccagcaaattaaatcgttcgaacgcgttgcggctgaagcggctgttacaggcgattacaacactgcacttgtggccatgacgatcaacccgctcgttccgtccgacaaaattgcgaaacaaatactggacgaaatgcttgaagcgcataaagagcatcttccgcagttttttagatctgtagaagcatag

SEQ ID NO: 3918 - DNA, 330 bp, Bacillus licheniformis
atgtccgaggaattggaacaaacgatatttcaaattatccttcacggaggaaacggcaggagcttttgcatggaagcgatagccgaagccaaaaagggagatttcgcagctgcaaaagaaaagatccgggcggctgacgaagaactgatcagggcgcatcactttcagacagctttgattcaaaatgaagcgaagggtgcgaaaaccgaaccttcactgctcatgattcatgcccaggatcatttaatgaatgcgatgaccatgaaagatttggccgcggagattgtcgagctctatgaaaaaatgaatatccacggaggtgtcaattga

SEQ ID NO: 3919 - DNA, 1353 bp, Bacillus licheniformis
gtgaacaagtttaatgcatttttagaggagaagatcatgccggttgccggcagaattgccgcccagcgccatttgcaggctctcagagacggcattattctgaccatgccattaatcattatcggatcgctgtttctcattttagccaatttgccgattccgggatatccggaattcatggcggggattttcggcgatcaatgggctgagaaattaagctatccggttaatgtcagctttgacattatggcgctgatcgccacgtttggcatcgcctaccgtctggcggagaaatatgatatcgatgccctgtcatcgggcgccattgccgtagcagcttttctgcttgcgaccccctaccagattccgttcacacccgaaggcgcaacagaggaaattttagtgtcaggcggcatcccgatttcattaatgggaagcaaaggtctgtttgtcggcatgctgatcgcgatgttctccactgaggtttaccgctgggtcgttcaaaaggatattgtcgtcaaaatgccggacggcgtaccgccggctgtcagcaaatcatttatcgctctgattccgggattcgccgttatcggctcgatctgggcggcccgccttttaattgaaatgacgccgtttgaaagcctccataatgtcgtcaacgtccttttgggaacgcctctttccgtccttggcggcagtctcggcggaagccttattgccgaaactgtgaaaatgctgctgtggtcctgcggccttcatggagcaaacattgtcggcggagtgatgtcgccgatctggtacggagcgatggacgaaaaccgtctcgctttccaagccggagaagcgctcccgaacatatttacgacgcagttttttgagatttggatcaacatcggcggcagcggcgctactttggctttggtcattacgatgtttcttagggcgcgaagcaagcaaatgaaacagctcggcagactcgccatcggccccgctgtttttaacatcaacgaaccgattatcttcggcatgccgatcgtcatgaacccgatgctgctgatcccgttcatcgtgtcgccgctgctgatgataacggcaacctatattggaatgagcacaggtcttgttgcaaagccggctgggattgccgtgccgtggacgatgccgcccggcttttccggatatttggcaacaggagggaaaatttccggagcggtcatgcagctgatcaatctgttgatctcgtttgtcgtatactatccgttctttagaatgtgggataaacaaaagctgaaagaagagagcgaactggagaccggaacggctgcaagcgatggtcaacaggtcagtgtatag

SEQ ID NO: 3920 - DNA, 306 bp, Bacillus licheniformis
atgaatatcttattagcttgcgccgcaggaatgtcaacgagtctgcttgtgacgaaaatggaaaaaagtgcagaggaacaaggaaaagactataaaatctgggccgtttccggaggagaggttcagaatcatatcgataaagccgacgtattgcttcttggcccgcaagtccgttacatgctcccgcaattaaagaaattaggagaatcgaaaggtgtatccgtcgatgtcatcaatacggtccattacggaacttgtaatggagctgaagtgttaaaatccgccgaacagcttgccggctcttaa

SEQ ID NO: 3921 - DNA, 1950 bp, Bacillus licheniformis
atgctcaatgctcggcttaagcttatcctcggcgaattgataggggcagaatcaccattaaccagcgcatatttggccaatgagctaaatgtgacctctcggacgatcagatcagatgtgaaagaattagaccggcttctctccaaaaacggcgctgccgtccaatcgatcaggggtgcaggctatcggctctccatcaagaatgaccgcctctttcgccagcttctgcagcacacatttcatcaagagctttctactcccgtttttccaaatgagcgtattctctatttattaaaaaggcttctcttaactgaggagtatgtcaaacttgaagatttagccgctgagatgtatatcagcaaatcgacggtccaaaacgatatgagagatgtgaagaaaaggcttaaaccttacgacattgagctgaagatcaagccgaattacggctttaagctgaagggagatgagatgaagctgcgatcgtgcatcgcagagcacctttttccaaagcgggaaacggatattgatattatgaacacccggatatccattctcccaaaagaagagcttgctatgatccgtcaaacgattttagaaaaaataagcgaagatcaaatttctctttcagatatcggactaaacaatcttctcatccacgtcgccattgcatgcaaacgcatccgaagcggcaaacatgtttctctttattccaaagatgtaaaggagattatgaatcataaagaatatgaagtggcgagggcgattgtccgcactcttgaacaaaagctgcacgtggcgtttccagaaaaagaaacggcctacatcgccatccatttgcttggcgcgaaaaggacggttatggccgccattcgcagcggtgcaatcgaaagcatgatggatgaagaagagacagaccggctgacgcaattgatcatgaaaaccatcgatcaaaaattcaccctcggcattggggatgacaaagaattaaaaatcggtctcggccttcacctaaaaccggctttgaatcgctgcagatacggcatgaatatcagaaatccaatgctggatgcaattaaggccaattatccgctcgcatttgaagcgggtattcaagccggtgaagtcatcaaaagagagacgggatttgacattcaggaaagcgaggtcggctacctcgcgttgcatataggcgcagccatggaaagaagaaacatgaacaggccctcaaaacgctgtatgattgtctgtgcttcaggggccggaagcgccatgctgcttcaggacagactgcgggcaacattcggttcaaagcttgagatccttggaacggttgattactacaagctgaatcaaatgtcgctccatgcactcgactttgttatcagcacaataccgctgtccgatgatcttcccattccggtgattcaagtaaacacaatactgggagggggagatttaacgaaaatagaacaagtgcttgccgaagatgacggaatcgcttcgacttatacgagaaaagagcttgtctttttgcgggaaagtctgtcttcaagagaggatgtccttcgctttctgtgcggaaaagtgacgcaatcagggcttgcagacgcggggcttgaagcctcggtctttgaacgggaggccgttgcgcccacttgcttcggcaatctggttgcgattccgcatccgatgacaccaaaaaccgcttcaactttttgggcggtttgcacgctgcaaaaaccgatagtctgggagaataagagggttcaattcgtctgccttctttgtgtagaaaaggacaatacagcaaatttgcaggagatgtacaaatttttgggccgtgttttagatgacagggcgattgtccgggaactcctgaaatgcaaaacgtacggggagtttatgtccgtctttaaaaaaagcgggccggctcatcgatatgccaaatga

SEQ ID NO: 3922 - DNA, 108 bp, Bacillus licheniformis
atgaaaaaaatgattaaaagcgccgtcaaatgggcgcctgtcatctatccgatcgcatggaaaatcattaaaaaccgaagggagaaaaagaatctgaaagccggttaa

SEQ ID NO: 3923 - DNA, 591 bp, Bacillus licheniformis
atgaatccagctcacgaacctctcccgctcgaattttacaacaagccaacaattgaacttgccaggtccctgttgggctgtcttctcgttaaagaaacggaagaagggcctgcttcaggatatattgtggagacagaggcttataaagggccaggggacagagcagctcacagctatggcaaccgccggacaaagcgcaccgaaatcatgtatcgtgaagccggcgtggtgtatacgtacaccatgcatacccacacactcatcaatgttgtaagcggaggagccgatgaacctgaggccgtgctgatcagagcgcttgaacctcatgaaggcctcgcgctgatggagaagcgaaggagcggaaagaaaccgcgcgattggacaaacggtccgggaaagctgacaaaggcgctttccatcacgatgaacgattacggcagaccgctgacggggccgccgctttatatcgcaaaagggtatgaaccccaagatattttgagcggtccgcgaattggcattgacaactcaggtgaagcgagggaatacccttggcgattctggataaaagggaaccgctatgtctcaagatag

SEQ ID NO: 3924 - DNA, 672 bp, Bacillus licheniformis
atgcactcttcaaatccagtcaaaagacagtctgcaagtgattacgcttataacgaattaagaacgaaaatcatcgaacttgaatatcctccctctgaacagcttgctgaagacagtcttgcaaagggtttaaacatcagcagaactcctcttcgccaggctctttaccggctggagcttgaaggattggtcagtaaacagccgaacggccggcttcgcgtatgcccgatttcgctcgctgaagcgaaagaggtttttaaagtgcgtgaagcgcttgaaggactactcactgccgaagccgcacagctggtgacgccggagagccttcatcagcttgaagaccgcatcgaactgatgaagctggctgccgtaaagggccgcaaaacagatacggtcaaatacggatcagaatttcattctatcttgcacgccatcagcacaaatgcaaccgcaaaacgttttctggatcagcttgaaagcaggattgaacggtatcgcagaatcagcggatacaaaaatcctgactacaaaccgtctgtatctttcaatgaacacttggatatttttaatgccgtcaaagaaaaaaacagcgttttggcagaagccgccatgcgttcccacattaaacgaagcttacgttcaattgaagaaacgctcgaacgttcatactaa

SEQ ID NO: 3925 - DNA, 1116 bp, Bacillus licheniformis
atgggcaaacaaggtgtatttaaaccgggattagaaggcgttattgctggagaaacgaacatttctttcttagatacggaagcggaacaaatcgtcattaaaggctatgatttaatcgaacttgcagaacaaaaaacatatcttgacctcgtctatcttctccttcaagataagctgccagatccaatggaattgaaaggaattgaaagcgctttaaaaagtgcgtatgaactgcccggcggaatctatactattctgaagtcgcttccgaataatacccatccgatggatgcgctccgaaccgggatttccgctttagcaggatatgatcccgaattgaatgacagatctcaagcagcaaacagaagcaaagcgctgcgcttgatcgcacaggttccgaatattaccgccaacagctaccgcatccttcaccagaaaaacgtcatcacgcctgacaaacagctttcattcagccagaactttttatatatgctgacggaaaaagaaccgactccccaagaaacagccgtctttgatcagacattaatgctttacagcgagcacgaaatgccgaactccacatttgccgcaagagtcatcgcatcgacaaacacagatatatacggtgctttcacaggcgctgcagcatcgctaaaaggacatttgcacggcggtgcgaatgaagcggtcatgtacatgctgctcgaaggagaaacaaaatcgggcttctgcaagctgattgaacataagttaagcagaaaagaaaaaatcatgggctttgggcaccgcgtctatatgagaaaaatggacccgcgcgcagccttgctgaaaaaggcgctctattcgctttctcataaaaccggcagacaggatttatatgagatgtgcgatgccggcgaaaagctgatgcgcgaagaaaaaggcctgtatccgaacctcgactactatgcggctccagtctattacctgctcggcataccgatcgatctctatactccgatatttttcgcggcacggtcggtcggtcttagcgcgcatgtcattgaacagcatgaagacaacaggctgttccgcccgagagttcactatacgggaccgcgtcatcttcatccataa

SEQ ID NO: 3926 - DNA, 1440 bp, Bacillus licheniformis
atgaaaactgaaagtcaaacgctccaaaactgtgatcaattgctggaagagatcgccgactatacggtaaatgccaagatttcaagcgaagaagcgattgaaaccgcccgttacgtcttaatggatacactgggctgcggaatattggcgctcaaatatccggaatgcgccaagcatctcggcccgattgccccgggtaccgtcgtcccgaacggcacccgcgtcccgggaacgcaatttgagcttgatcctgttcacggcgcctttaatatcggctgcatgatccgctggctcgattataacgacacatggcttgcggccgaatggggccatccgtcagataacctcggagcgattttagcctgcgccgactatgtcagcaggcagctgctcgcggcgggcaaggaaccgctcacgattaacgatgtcctgacggcaattgttaaggctcatgaaatccaaggcgtccttgctctcgacaacagcttaaacagaaacgggcttgaccatgtgctattcgtaaaagtcgcctccactgctgtggcatgctcactattggggggcacaaaacaggatgttatcaatgccgtctcccaggcctgggtcgataattcaagcctgcggacgtaccgccatgctccgaataccggctcgcgtaagtcctgggcagccggtgatgcgactagccgcggcgtgaggctcgcgatgatgaccttgaaaggcgaaatgggatataaaaccgctttgtctgctccaatgtggggttttcaggatgtcttattcggaggaaaagaattgacgctcgccagaccgctcgactcttatgtcatcgaaaatgtcctttttaaaatttcgtatccggctgaattccacgctcaaacggctgctgaagccgcgatcaggcttcaccctgaagtgaaggacagacttgatgacatcggccaaatcgtgatcacgacgcacgaatcggccatccggattatcgacaaaacgggagaattacacaatccggctgaccgtgatcactgccttcagtatataacagcgatcggactgatctacggcgatattaccgctgaccattatgaagacgaaaccgcgcaaaatccggagatcgacaggctgcgcgaaaaaatgacgacagtcgaaaacaaacagtattccgtcgattatctcgacccggaaaaacgctcgatcgccaacgctgttcaagtgttttataaagacggcacacactcggaaaaaatcgcggtcgaatacccgattggtcatcggcgccgccgcaacgagggcatcccgctcttaaaagacaaatttatcaataatttaaaaacgcgctttccggcggggcaagcggaacgaatcaacgccctgctgaatgatcctcacagattaagcggtgcacctgtaccggatttcatggaattgtttgtcatttag

SEQ ID NO: 3927 - DNA, 918 bp, Bacillus licheniformis
atgtggattgtctcgaaacaatcaactcaggaagagctggccaatgcattcagaaaactgatgaaagcacctgatattttgaaaatacccggtgttcatgacggaatggctgccattaccgcaaaaaacatcggcttcaaagcgctctatctctccggggccgcctacacggcaagccgcgggctccctgacctcggaatgatacactcccaggaaatcgctgaaaaagcaagcgaacttgtgagagccgcaaatcttccgcttttggtcgatatcgacaccggctacggcggtgtcctaaatgcggcacgcacggccgccgaaatggccgagagcagagtcgcagccgtccaaatcgaagatcagcaactgcctaaaaaatgcggacatttaaatggaaaaacgctcgtacccgcagaggacatgatcgcaaaaattagagcgataaaagaaaccgccccttcgctcgttgtcgtggctcggacggatgcaaaagcagcagaagggatggaagccgccgtcaggcgcgccaatttatatgccgacgcgggagccgatgccatctttcctgaagcattaacgagcgcagccgaattccgggaaatggcttcttccattaaagcgccgctcctggccaatatgaccgaattcggaaaaacgccttattatacggctgacgaattccaaatgctcggctgcagcatgattatttaccctgtgacttccctgcgcgccgccgcgaaagcttatgagcgggtcttcgcggagattttcgaaaaaggcacgcaaaagggtgtgctcgatgacatgcagacacgcgaagaattatatgatgcgattcattactacgactatgaaaaactggacgaaaatattgccaaaacggtgcttcccgaaatcggaaaagaacaccgttga

SEQ ID NO: 3928 - DNA, 1194 bp, Bacillus licheniformis
atgacaaagcataaagcggacagaagcttgaagtcgctgcttgaaattctattcgtttcaaccaggcttggattgacatcattcggaggtccgatcgcacatttaggatattttcatgccgaatatgtccgtaaaagaaaatggatggacgaaaaaaactatgccgatctggtcgctttatgccagtttctgcccggtcctgccagcagccaggtggggatcggaatcggcgtgatgagagccggcgtcctcggcggaatctcagcgttcatcgggtttactcttccatctgtcatagcgcttgtattatttgccatggttctgcaaggcttcgatattggaacagccggctggattcatggactgaaaatcgtcgccgtcgccgtagtcgcccatgccgttatggggatggcgcaaaagctgacacctgataaaaggcgcaaagcgattgcgctgtttgctctggtcgccactcttctctggcagacggcttttacacaggtcggagtcatcctgctcgccgctttcgccggatatcttatctataaagagcaagttgaaacggatgattccgtcatgcagtttcctgtgtcgcgccggtttgcagcggtctgtctcagcttgtttttcgggcttctcattttgctgccggtgctcagggaaatgacatcttccggctggattgccatgtttgacagcttttacaggtcgggttctttggtcttcggaggagggcatgttgtcctgccattattagaacgggaatttgtaccggcgggatggttaagtgaagaggcatttttggccggatatggagccgcacaagctgttccggggcctttgtttacattcgctgcatatcttggtgcggtgatcagcggctggcaaggcggattgctcgccacagcggcgatttttctgccggcgttcctgctgattctggggacgctgcccttctgggatacgctgcgccgcaatcctaaagtaaaaggcgctttaatgggagtgaatgcagctgttgtggggatattgatttccgcgttttatcacccgatctggaccagctccgtattggcgccgatcgattttgcattcgctgcggttttgttcagcctgcttgtctactggaagctctcgccgtggatcatcgttgcagccggtgctgtcggcggtgcgatgttgcagctgttgtaa

SEQ ID NO: 3929 - DNA, 309 bp, Bacillus licheniformis
ttggaagataaggtattgcgaaagctatttctaggatttattcaaattcatattctgcaccacgccagcgaacacccgattttcggattgtggatgcttgaggaattgaaagagcacggatataacatcagtgcgggaacgctgtatccgatccttcattctatggaagctgacggacttcttcgaaaagaagaacagaatgtggacggaaagatcagaaaatactattcaaccacggaaaaaggagcaagcgtactgaaggaagccagattgaaagcatatgaactgtttaaagaaattaaagaatag

SEQ ID NO: 3930 - DNA, 1716 bp, Bacillus licheniformis
atgatacgccgctttttttcatactataaacctcataaacgtttgttcttcatcgatttcagcagcgcgatcgtcgttgcagtgctggagctggcttttcctctagttgttcagtggttcattgatacgctgattcccgggggagactggcttgaaatcgtctgggtaagcatcggcctcttactgatctacctgctcagcacaggtctgcagtacattgtcaattatctcgggcataagctgggcatcaacattgaaacagatatgcgccaggagcttttccaacatgtacagcgccaatctttccgctactttgacaatacaaaaacaggacatatcatcagccgcatcacaaatgatctgtttgatatcggagagctggcccatcacggaccggaagatttgttcatcgccgtgatgacctttttaggtgcattttggattatgctgacgattaatgtgaagcttgcattggttgcagttctgtttgtgccgttattgattatcttgatcatctattccaatatcaggatgaaccgggcttggcgccagatgtacagcgaaatcgccgatgttaatgccagggttgaggacagcgtttcaggcgttcgcgtcgttcaatcttttacgaatgagcgctttgagatatcccggtttttaaaaaacaatcaaaagttccgcaaggcgaagctgaagggctacaaaacgatggctctcacgactgccggaacctttttgatgacgcggctgatgattctggcagtgctcgtgttcggagcttggctcagtttttccgggaatatgtcctacggggaattcgtcgggtttgttctttatgtcaacgtgctgtttaagccgattgataaaatcagcgccattttggagctttatcctaaaggaatggcaggatttaagcggtttacggagttgatcgatacaaagccgcagattgtcgaccgcaaagatgcgattgatgttccggcgctggaaggaaacatcgtcttcaagaatgtgacgttcggctatgaaaaacataaacccgtcctgcgaggcatcgatctgtcaattaaagccggagaaaccgtcgcctttgtcgggccgtcgggagcgggcaaaacgacgatcagctcgctgattccgcgcttttacgatatagacggcggggccatcacaattgacggcatcgatattcgcgatatgacaaaacgctctctccgttcgcaaatcggcatcgtccagcaggatgtgtttctttttacgggaacgctccgcgaaaacattgcctacggaaaactggatgccacagatgaagaaattcagcgggccgccaaaatggcgcatttggaacagctgatcgagtcgctccccgacggttatgaaacccaggtcggcgaaagggggctgaagctgtcagggggccaaaagcagaggattgccatcgccaggatgtttctaaaaaacccgccgattctcatattggacgaagccacatcagcacttgacacagagacggagcaggtgattcaaaacgctttgacggagctcgcaaaagacaggacgacgcttgtcattgcccacagacttgctacgatccgcaatgccgaccggatcgtggtcgtgacagagaatggaatcgcagaagaagggacacatgatgaactggttgagcgcggcggtattttcgcaaatcttcatcgtgtacagtatcagtcgtaa

SEQ ID NO: 3931 - DNA, 660 bp, Bacillus licheniformis
atgcgagacattcagttgtttttggccggggactcaacggtttgcgattatgatgagaatagggcgccgcgtgcaggctgggggcagaaaatcggcgagtttttaagcgcaggtgttttgatccgcaatgaagcggcatcaggaagaagctcaaaaagctttattgaagaaggcaggctgaagcgaatcataacacagatcaaaagcggcgattatttgtttgtccagttcggtcataacgaccaaaaaccggatgatcgctatacagagccatacacaacttacaagcagcatttgacccggtatatagatgaggcacggttaaagaaagccaatcctgttctgattacaccggtccagagaagatcatttgcaagcgatggccgctttaaaaatacccatggcgactatcctgatgcgatgatacagcttgcggaagagcttcgggtgccgcttatcgatctcgccttcaaaagccgtcaattgcttgaatcgctaggaccggaagcttccaaaaagctgtatttatggcttgaaccgggggaacaccccaactatccggacggagccagggatgacacccacttttgcgacttcggggcaaaagaaatcgctaagcttgttgcacaggaagcaaaagaagcgggaattcctttataa

SEQ ID NO: 3932 - DNA, 528 bp, Bacillus licheniformis
ttgttttcatttatcattcctacccaaggagcaaatgctcaagaggtgaaaacaaatcattttagaggaccgatcttttgtccgccgccattcaagccggcacctaaaccacagccgcctcaaaaaccgcagccggacaatccgcaaccggataacccgactcagaagcctgtgcttgaggcaaaaactattaacagcaataaagagtggtcaacttcagacatcgaaattacttatagaccaaacgcatttgtcggttcaagctatgttgaatttcattttccgtaccgctttcatgcaagcacaagagatacactaaatggaaaaacgcttgactatacacaaattttaaatgatggacaaacggtcagagttcctgtctatgctttaagttcctctgagttcaaactggtcatggttcggaaaacgcttccaaatgccggcactcacagaattactgctgaactgcagcaaaatggaaaaaacatcaaccatgctgaaacaactttggagattgtccctcgttaa

SEQ ID NO: 3933 - DNA, 474 bp, Bacillus licheniformis
atgttgaaacgtaaatttatcggtaaaattggagtcggcctattaacttcagccgcattgttttctttcattcttccgacggaagaggcgagcgccactttttacagaaacgctccgacgctgcatgtcgagacggttgacagcaataaagaatggacaacttcagacattgaagtcacttacaaaccgaacttttttgtcggttcaagctatgttgaatttaacttcccataccgcttccatgcgaatacgagagattcgctgaacggcagaacactgaactatacacagattttaaatgacgggcaaacggtcagagtgccggtttacgctttcagctcttctgagttcaaactggtcatggttaggaaaacgcttccaaacgccggcactcacagaatcaccgcggagctgcaaaagttcgggcgaaactacaaccacgcagaagctacagttgatatcctgccacggtaa

SEQ ID NO: 3934 - DNA, 1230 bp, Bacillus licheniformis
atgggtacgcttaacagccaggcagatcttgcggctcattcgaaagcaaagccgaacagggtatggatcgctgtcatattgggtattttatcgggaatcggtccggttgtgatcgatttatatttgcccggccttccacagatggcaactgatttacatacgaatgcttccgtcgttcagctcagtttaacatcgtgtttactggggctggcaatcggccaaattgtcatcggccctttcagcgatgtccttggaagaaggcttccgctgatcgtgtcgctgtccgtttttgccgcggcctcttttttatgtgctatgacatcttctgtatgggttttgatcgcgatgcgctttattcaaggcgcggcgggggcaggcggcatcgtcatatcacgcgcgattgcccgtgatctatattctggaacagaattgacaaagttcttttcgctcttgatgcttgttaacgggatagcgcctatcatatctccggtagcgggcggacagctgatgaaatggacgacgtggaacggcgtatttttcatcatcggcctttttggcctgctgatgattttgtccgttatattcggggttaaagagtcgctgtctccggaaaaccgtacggcaggcggattcaaagagacgtttgtatcatttggaaggctcttcggccagcgtacatttatgggatacgccttggcgcaagggctgatcgtagcggggatgttcggctatatatcggcctctccgtttgttttgcaggacatttacaaattgtcggctcaagcctttagtttttgtttcgcattaaacggcctgggcattattatcgcagctcagattacgggcaggcttgccggccggttcggtgaagcgtcccttttgcggagcggtttgctgctgtcttttaccgcaagcgttgttttatttgtttctgtcttttttaaagctccgctgattcttattttaatcccgctgtttgtcgtggtttcctgcatcggaatcgtgacgacgaccagcggatccttggccatgcagagccaggggaaatcagccgggagcgcatctgcgcttctaggactgcttccgtttattttaggagctgccgcggcgccgctcgtcggtattgccggaagccatacagctttgccgatggcagtcgtcattctgttttgcaatatcagcgcgctcgcttgttttaacatactggttcggcgggcagcgcttaaatga

SEQ ID NO: 3935 - DNA, 777 bp, Bacillus licheniformis
atgaattcattttttatgttatttcaaaaagaatggacggaaagatggagagacggaaagctgctttggctgcctgtcattttgatccttctgggcttgattcagccgctcagcctgtattatatgcctcaaattatcgatatggccgggaatttgcctgagggatccgtgatcgacataccaaggccgagaggtgaagaggtaatggcgagcaccttgtcccagttcggcacggttggtacggcaattttcgttttcagtgtgatgggcagcattgtccacgaacgaaaccaaggatccctttcattggtgatggcgagacctgtcagcccgcttcagtatatcggcagcaagtggcttcagcaggtgctgctcgtattggtttcgtttgctgcaagctacggtttggctttctactatacaaatctgctattcggcaaggttgaatttgaccggtttttatttagtttatccgtgtacagtatatggattatatttgtcatgtcggtcacgatgtttttcagtgctctgtttcgccatatcggggggattgccggcatgagcatctgtttcatcgccttcgtttcattggcgggatccttatttccccgctttaccgaatggatgcctgataaggcgaaaagccaggctgattattttatcatgcacggttcatgggaccatgctttcggctggatggtgttttcgtctttgggaattgtaattcttttgttcatgtgcaccgtttttgtttttaaaagatatgaatcttactaa

SEQ ID NO: 3936 - DNA, 888 bp, Bacillus licheniformis
atgctgtccgtcaatggcttaacaaaaatgtatcagcagcaccaagctgtccaaaatgtcagctttgaccttgaatatcagcaatgcgttgcccttctcgggccgaacggagcgggaaaaacgaccacattgcaaatgctttccggtttattggcccctacatcaggacgcatccgctttttggggagagaatcgataaacaggctggaaatcggatatttgcctcagcatcctgcgtttttttcatggatgacagctttagaatatacggtattcgctgcaaggctttccaaaatgaaacgtcgtgaagccctggaaaagagtcgaaccgctttgcgctatgtcggtctggaaaaggaagaagaccggaaaatcggcggtttttcaggagggatgaagcaaaggctcgggctggcgcaggctttggttcatgagcagaggctgttgattttggatgaacctgtttccgccctggatccggcggggcggcgcgaagtgcttgatatgatgaaggatttaaaaaagaagatgacaatcctattttcgactcatgtgctgcatgatgccgaagaggtgtgcgatcaagtgatcatgctgaaagaaggggctgtcaaatggtctggtccgcttcacagattgaagaaccgtcatttaaagccatcatatatgctgacagctgaagaaagtcttgaaggatggctggaacacctgccttatgtcagcaaagtcgtgtatcataagccttcacaagctgaattttatttaacagatcggtctgacagccgccgactgttggctgaatgcttgaacagacaagtatcgattgttcgttttgaacaaaaaacgatgtccttggaagatatgtatctgaaggtgatggggctatga

SEQ ID NO: 3937 - DNA, 213 bp, Bacillus licheniformis
atgactggagcagatataccttgggcgctgctcgcccctttcattgtgctgtctttcattttagcagtgtccgcattggtcagttgcataaaacaggagaaaacgaatggcccaaagtggatgtggattttgatcattttcgggatcagttttgtcggtcccgtctcttactttatcatcggtaaaaaaacatatgagaggaggcgggtgtga

SEQ ID NO: 3938 - DNA, 222 bp, Bacillus licheniformis
atgaatcttgacatgactcaggaaaaactgctgctgctgctgctttgcatttcaccgcttttatttgcgcagagtatctttctatttcttaatgcgaagaaaaagggagccaatgcgtggttctggggaatatggggcttgatccaaacaccgatgcctttattattctattatttatttgttgtaaggccgtttcataaaaaaaggaggccgttatcatga

SEQ ID NO: 3939 - DNA, 324 bp, Bacillus licheniformis
gtgaatgaacgagatgaaaaagaaacggttacacatttgaaacgcgaactcgaaagaattgatgataattttgtgccgccggttcctcaagcatttgaactgaatcagcgtttagcgcggtttaagcaagagcgcaagcgggcgcttaaaaaggaattgctttgttttatcgtcatggcgctggtgattttatcggcctacttgacgatttccgttcaagtaccggctgtttttatcatggtgcagggagcggcgcttatcttgctgccagcgcttgccctgatagaaaaaaggcggcatacggctgatgaggaggctgattaa

SEQ ID NO: 3940 - DNA, 534 bp, Bacillus licheniformis
gtggatcaagcagatgaaaaagaactgatcatacgggcaaaagacggtgaagatgcggcttttacgaaactgtttcagcttcattacccctttgtatatcaatatgttctgaaattaacgctgaacccagatctcacagaggacttggtccaggaaacgatgctgaaagcgtatgtcagccttcatcagtttcagggcaatgcaaaattttcaacatggctgatctcaattgcttcccggctgtttatcgaccatcagcgccggaaaaaacgcgaaaaccgcaaaacgcaagcagcaggagaggaagccttgcgaaaaatgaaatggaattctgcccttcacggccacgaatggagcgaatacttggagatgtttgctgcgcttgagcctgagttcagaatgccaatcttgttaagacactattacgggtttacttaccctgaagtggcaaacatgctgaaaataaaagaaggtaccgtcaaatcgcgcgtgcatcatggattaaagaaaattcgaaaggagtggggacagtga

SEQ ID NO: 3941 - DNA, 1254 bp, Bacillus licheniformis
atggagcggcaaaaacaaatcgtctatgaagaaaaacaaattttaaggaaagatcatatgatcttttggggtgccgtcttttgtttctggtttgctacatacatctatgtccctgttttcggattatatttagacaacatcggattttcatattcagcgataggaatcgtacttggaagctacggcgtcactcagatattactgcgttttccgttcggcatcctgtctgatgttctttcgccgcttagaaaacagctgttgatcagcggctttgcaatgtctctgttgagctgctgcatatttctgttgtccgattcgttcatcatggtgatcacagccaggctgctcgccggtatgaccgcggcgatgtgggtgatggcaaccgttttatactcgcagtattttacaaaagatcaatcatcaaaagcgatgggcatcctgcagtttttaacggtccttccccaattcatcagcatggcagtcagcggctacctcgtccatttgttcggctggatgtttccgttttggatcggtgttgccgtatcatgcatcggactgattctgtcattttacattaaagataacgggccccgccatacggccaaggggatggctttgtcagactatgttaaacagacgttgcgtcttcctgatttaaaagcgattacaacattatcgtttttagcccacgctgtactatttatgaccgtgttcggatttacgccgatttacgcggaatcggtcggaatcgatgagaaacagctgatttgggttatgttcgccttttttgttccgcaaacgctggcttccgtgtggtgtatcttttacaaagtaaaggccgccgatgcactgatatggatatcttatgtgataacggctgttttcttttgcttgctgccgtttgccgaaacccttttcgcggtatgtatcgtccacgccgtgacaggactgacattgggatttatttttccgcttttggtcagcaaagtcgttcagcttggtacgcctcagctcaaaatgtctgtgatgggtttctatcaatctttttatgcgctcggtttttttctcggaccggttgtggcgggaaaagtggctgaactgttcgggctgccgaaggtgttttggtttgccggcgcattgtcactggccgctgcatgtatcatgcttttttccaaacagtttcgtatatttacagcaggaagacgggataaatcctcaaatatcgttcagccgacgaaggtcttccgtaagtga

SEQ ID NO: 3942 - DNA, 1599 bp, Bacillus licheniformis
atggatcagcattcaaacgagcagaaatctgacatggagactgatgatacgttaacaaaccggcagggccacccgatcacaaacaatcagaatatcagaaccgtgggcaaccgggggccatcaacattggagaactatgatttcctggagaagatcagccactttgacagggagagggttccagagcgggtcgtccatgccaggggagccggagcgcacggctattttgaagcttatgggacagcaggcgatgagccggtctcaaagtatacgagagcaaagctttttcaggaaaaaggcaagagaaccccggtgtttgtccgtttttcgacggtgactcacgggatatcctcaccggaaacgctgcgggatccccgcggatttgcggtcaagttctacactgaagacggtaactgggatctggtcggaaacaacttgaagatcttctttatccgcgatgcggtaaagtttccggatttaatccatgcatttaagccggacccggttacgaatttgcaggatggcgaaagaatctttgacttcatttccaacacgcctgaagcgatgcatatgatcacatttttgttttcgccttggggtattccggcgaactaccggcagatgcaggggtccggggtgaacacgtacaaatgggtgaatcaagaaggggaagccgtgcttgtgaaatatcactgggaaccgaagcagggcataaaaaacttgacgcaaaaagaggcggaagaaattcaggcgaagaatttcaatcacgccacacaggatttatatgaagcgattgagcgcggagattatcccgagtgggagctgttcgttcaaatcatgagcgatgatgagcatcctgagctcgattttgacccgcttgacgacacgaagctgtggcctgaagatcaatttccttggctgcctgtcggcaaaatggttttaaacaaaaatccggaagactactttacagaagtcgaacaagcggcatttggaacaggggttcttgtcgacggacttgacttttccgatgacaaaatgcttcagggacgtactttttcctactcggatacacagcgctacagagtgggagccaactatctgcagctgccgatcaatgcgccgaaaaaaagggtggcaaccaatcagcggggcggccagatgcagtacaaggtcgatttaggcaaaaatcaaagcccgcacatcaactatgaaccttcaaccatcaacgggctgaaagaagcaaagcaggatggcaaagaatacaccccgcatgtggaaggaaaccttgtgcgcgaaagtatcgacaggcagaataatttcaagcaggccggggacacttacaggcatttcgaagactgggaaaaggacgagctgattacgaatctggtcaatacacttgccccgtgcgaccaaagaattcaaacgaagatgatcgatatgctgaagcaatgcgacaaggaatatggaagcagagtcgaggaaggattaaaaaacgcctccagccaaaatacatccagccgggagccgatcggagcagaaggcgccgaagatgccccgagacaggcggaagaaaaagggcactctcaagacccgtattaa

SEQ ID NO: 3943 - DNA, 1458 bp, Bacillus licheniformis
atgacgacaaataaaaacaacctaacaaccagctggggcgctccagttggagacaaccaaaactcaatgacagctggttcacgcggaccgacgctgattcaggacgtccacttgctcgaaaagctcgcccacttcaatagagagcgtgtgcctgaacgggttgtgcatgcaaaaggcgccggtgcgcacggttattttgaagtcacaaatgacgtttccaaatatacaaaagccaaatttttatcagaagtcggaaaacgcacgccgttatttgtccgtttttcaactgttgccggcgaaaacggttcagccgattccgtccgcgacccgcgcggtttcgctgttaaattttatacagaggaagggaactatgatctcgttggaaacaatacacctgttttctttatccgcgatgcgattaaattccctgacttcattcatacacaaaagcgccatccggtcacacatttgaaaaacccggatgccgtatgggatttttggtcattgtctcctgaatccctgcaccaggtaaccatcctgatgtctgacaggggcatccctgcgacttaccggcacatgcacggcttcggctcccacacattcaaatgggtgaatgccgaaggagaaggcgtctggatcaaataccacttcaaaacagaacaaggcattaaaaacctgaccgaagaagtggggacaaagattgcaggtgaaaaccccgattatcacacacaggacttgtatgaggcgattgaaaaaggcgacttcccggcatggaagctgtacgttcaaataatgccgctggaggatgcggatacgtaccgttttgatccgttcgatgtgacaaaagtatggtcgcaaaaagattatccgctgattgaagtcggccgcatggttctaaaccggaatccggaaaactatttcgcagaggttgaacaagctacattctcccctggaacattggtgcccggcattgaaccgtctcccgacaaaatgcttcagggacgcctgttcgcatatgcggatgcacaccgctaccgcgtcggcgcaaaccataacagcctgccgatcaaccgtccgaaagcggaagttcataattatcaaagagacggacaaatgcgctttgattcaaacggcggcggctctgtctactatgagccgaacagcttcggaggccctcaggaaactccggaaaacaaaacaacggcttatccggtgtcaggttcggcggacagcacggcctacgaccataacgaccactatacacaggccggagatctttaccgcctcttgagcgaagaagagcggacccgccttgtcagcaatatcgtaggttcgatgaagcaggtgacaaaagacgaaattaagcttcgtcaaattcagcatttctataaagcagatccggagtacggcacacgagttgccgaaggattgggcttgtctgttccgcaggaagtttaa

SEQ ID NO: 3944 - DNA, 417 bp, Bacillus licheniformis
gtggaagacgagcagctcgtccctttattaaaaaagcggggtttacgaattacagctcagcgcgtcctgattttaaaaacgattgcttctttgggcggccatccatcggcggaagacattcaccgggaattgccgtacatgagtctcccgacaatctacagcaacttgaaactatttgtgaagctcggcattttaaaagagctgtctcacggagacgcaaaaagcaaatatgaactgtttacatcacagcattatcatgtcatttgtaaatcatgcgggaagatcgctgatctggactatcctcacctcaaagaggtagagcatgcggcagcacaattgacgaactttaaagtgaactcgcattttctaggaatctatggaatctgtacaacatgccaagaacagcagcagaggtga

SEQ ID NO: 3945 - DNA, 954 bp, Bacillus licheniformis
atggaacgaaaaaaagtcggcctgttagtcatggcatacggaaccccttatcaggaagaagatatcattccgtattacacgcatatccgtcatggaaaacgaccgtccgatgatatgattgaagacttgaaaaaacgctacaagcatatcggcggaatctctccgctcgcgaaaattacgctcgctcaggcaaaagagctggaaaaaacgttgaacgagcgccaagataaagtcgaatacgtgatgtatctcggcttaaaacacatctctccgtttatcgaggatgcggttgaacaaatgaaaaaagaccaaattgaagaggccgtttccgtcgtcttagctccccactattccaccttcagcaccgaagtatacaatcggcgcgccaaacaggccgcagcagcaatcggcggaccacggatcgcatcgattgacgagtggtatcaggaagaaggctttattcgctattggtctgaagaaatcggcagcattttaaacgacatgtctgaaaaagagcgggaaaaagcggccgtcatattctcagcacacagcctgccggaaaaaatcagggagcatggcgatccttacccggatcagctcgagaaaacagcacaactaatcggagaacggctgtcatttgaccagatcgccgtaggctggcaaagcgagggcaacacgcccgatccttggctcggcccggacgtccaagacttaacaaaggaactgtatgaagaaggcttccggtcattcatttacgcaccagtcggttttgtatctgaccacctggaagttctgtatgacaacgactatgagtgcaaagtggttacggacgagcttggcgcaagctatcaccgtccgcctatgccgaacactgatccgcggttcatcgatacgcttgcttcagtcgtggagcgaacatacaacagcacagaacaggagaaagcggagctgtaa

SEQ ID NO: 3946 - DNA, 942 bp, Bacillus licheniformis
atgagggtcttgaaaaatgaactttacaggctgatggtgacgaaaagtacctggattgtgttaagcttgctgcttgtcatgacaatcgctgttgcatggatggtcagcaatggcgaaaaggagaaggagacaggtaactggaaagagcaattaaccgttcaaaacgctcagtatgaaagagaaatgagagagctgagcccagcggttcccaaataccaatttttaaaagaagagatcgcggtcaatcaataccggcttgagcataatttgccgccttctgcgaaatacaatgtttggacgatgctgaaggagttaaaaccgatcacaacattaatcgcgttgattgcaatcgtgctggcagcgaactccatcgcgcttgagcacagcaaaggaactattaaatttgcgattgcaacaccggtcaagcgttggcattatctattggggaaatacttgtcgatcttgctcaacactgtatttatgtttgctgcgacacttttatttgcgtttgttttagggtatgccctgctaggtttggagggaagccaatactatttgtcctatcgaagcggcgaagtgataaagatgtcaatgctgaagtttttagccttagactatggagccgctttattgaatattattgtgctggccacgctggcctttatgatttcggtcatcctaagaagcgcggtcgtctctgtcggtctttcgctgttcgtcttttttacagggtctgcgattactcaatttttagcggcaaaatttgattggaccaagtatacgatctttgcaaattcagatctcagtcaatacattgatggggagccgtttattcaagatatgactctttcattttcagcggctgtgattgctgtttattttattctttttctggctgtctccttttgggtttttcaaaagcgggatattgtcacgtcataa

SEQ ID NO: 3947 - DNA, 903 bp, Bacillus licheniformis
atgagtcaagtcgaatttgaaggtgtaagtaaacgaataaaaggcagaccaattgtccaaaatatcacatttcaaattgccccaggtacaatttttgggctgctcgggccaaacggcgctggcaagacaacacttatcaaaatgattgtcgggatggcaaagccgacatcaggagatatccgcatcgacggctattcagttaaaagcaattacgaggaagcggcagcccgagtcggttctgttgttgaaaacccatccttttatgagcacttaacaggataccaaaaccttaaatatctcggcggattccacagccacgtgtcaaaggagcgcatagaagagatcgttcagcttgttgatttgacaggaagtattcataaaccagttaaaacgtattcattaggcatgaaacagcgtttgggccttgccgtcgcgctcttgcatgatccggaatttctcattctcgatgaaccgacaaacggccttgatcctcagggaatcattgatttgcgcgaacaccttcagtacttggcgaaaaccttcaacaaaacgattttgatttcgagtcatcttctgtctgaggttgagatgatttgtgatgaatacggcgtcatgaaaaacggagaactcctgcaaattaagagcaatcaccgcgataccgatacggttcgttatcggcttacattaaacggccacgccgatgaagcggctgacctgttgaatgagtaccagtatgcaggcggtctcacggaagataaaaatgagatttatgtcctttgcatggaagaagacattatgaaagtcgttaatctgttaatggagaacaaaataagagttctgcatatgaagcaggaaaaacagtcgatagaacaaagctttctggaattgatcaataaggggtga

SEQ ID NO: 3948 - DNA, 750 bp, Bacillus licheniformis
gtgaaaaatttgctcaaagcggaatggatcaaactcaggaactctgattttacaatgacgagcatattcattcttaccgcatctttagtgtttacagggtttatggcaaaacgaatcaccccgtttgcgggagggaatgaatggacatcgttaaggcatcttacattgctgttggtattcagcacgatttatccctggcttgtctcttcggtcacagtatttttgcataaggatgaactgaaaaaccgagtgtggctgaatcgaatcttatcgccgcagcctttcgcagccatgctttttgctaaggttttgtttattggactgttcgcagccgcattatatgccgtctgtgtgatcgaatcgcttgccttcggtttaatatcggggttccccgggcctgccccttggttttcttggatgaagggcttcattctcaatctcttgtcaacctttccgctgatctgtacggtcctatggcttaaattcaccagtaaggaaaagacctcattaaacattatcgtattcatttgttcactgctgagtttcggcgtttcgcaatcccctttagggcttctctttccatggtcttttcctgtgacggccctcattgcaatggagaagtcagttgccgttcttatcggttcgattgtttggttcacggcggtttcgcagctctttttttctcttctattgaaacagatcaggccataccaaaaaggaggaatacaaaatgagtcaagtcgaatttga

SEQ ID NO: 3949 - DNA, 657 bp, Bacillus licheniformis
atgaaatttcagacgtttgcatgtacggttatgatcatcacggtgctcgccgttttgcttaattatcttctcttttataaaaacggggcaaataaagaaatccgtagcatggagggaatggctgtttatgtcgtctcggtttggctgacttatattacaggcagaagattatttggacgcatgatgcatcaagcttttatcttgcggtatcccgttcgcctgttcacttgggtgctgactggaatcgccgtgataactatcgtctcagcgctggtcttgctttacggctgtttggcagtcagtctgctgtttcaaaaggatgttttgttttcgccagagcgtttagccgctgttgcgatactggcggtgatcatgtcttccgtccagttttttctgaagacgttaaaggcagaatatctatttgtgctgttgatgacgctgacgccgttttttatgcaaagtggaacactttatttgccgtggggagtttcttggcttttgttgactgaatattcagtgaacgatataggcctggcagtttatcttatttcggcgggttatatagcggtctgtatgtgttggatcttaaggagcggggaggaaaagatccgtgaaaaatttgctcaaagcggaatggatcaaactcaggaactctga

SEQ ID NO: 3950 - DNA, 636 bp, Bacillus licheniformis
atggttgagcttccaattgtcatgaaccatgttgaggtgcgggcgggagacaggaaacttcttgaaaacgtcagccttgctgtggacaaagggagccgggttttgctcaaaggagaaaacggatcgggaaaatcgacgtttcttaaagcaattaccggcttgtctttatttgcgggcgaaattttgatttacggtcaatcgattatccaaaacagggaagctgctgtcgggcatatcggctatgtcagtgacgaagtgccgcttcatgagcaccttactggaacggacaatctgagagtccatgccttgcttcacggaatagatgacgatgaccggatctattctgaactagagcggttcggtatcaatccggctgatgacacgaaagtacagtactattcaacaggcatgaggcaaaagctgaagatcgcaatggccttatttcatcagccttccatcttaatattggatgagcctttaaatgggctcgaccgaaaagcgcaggaaagcgttgtagacatcataaggcggtatgacgggaccatcatggcatcaagccattggaacgaaacttttatcgaattgtttgatcgttttctagccatagaaagcgggcgtttaaatgaaattgtttaa

SEQ ID NO: 3951 - DNA, 288 bp, Bacillus licheniformis
atgctagaaatgatcaattcaattggtgctgtcgcaggatttgcggggtttatcggaatcattattttaatcagccttgacggaaaggatgaacgcggggcatatattcaaaacaaattctttcgggtgatgttctttttgcttacacttggaatatccgccgttatttttacaagttcatgggtcgatttgtcgttcgccaattataaaaacatggtcacactggctttttcgctgccgtatttcattggattcttcattttgttgggaattcgttcaagggtgtag

SEQ ID NO: 3952 - DNA, 279 bp, Bacillus licheniformis
ttgtactctatatatgtaaatgatttgcaaataaagagggtgattgagattgaaaagcaaagcggggtgttaaccaaccggattcctgtgctgcgagcagagaaagggtggacgcaaaagcagcttgccgatctattgggtgtaacaagacaaactgtgatttccattgaaaagaataaatacaaaccatccctgttaatggggtttcgcattgccgcgttatttgagaaggacatcaacgaggtatttcaataccaactagaggaggatgatcgctga

SEQ ID NO: 3953 - DNA, 189 bp, Bacillus licheniformis
atgtatgaatatcaaacagtttcaatcgctgtaggagcattcaacggaaaacttgagaaaaattattctgatgtgattcatgaatatgctgaaaaaggctggaagcttcacagcgtcttttctgttccatcaagggccggaggccaggtttcttctatcgaactgatttttgaaaaacctaaatcttga

SEQ ID NO: 3954 - DNA, 1332 bp, Bacillus licheniformis
gtgaaaagaatatatatttttctcttatgttttgcagtcctgctgccggtcggcggaaagacggctcaagcaaaagaacaagcaggagaacagtatcttttgcttgaacatgtaaaagataaatcgaaactgctggacacggcggaacaatttcacatccatgccgatgtcattgaagaaatcggatttgcaaaagtgaccggtgaaaaacaaaagcttgctccttttacaaagaagcttgctgaaaaagtcggggctgacgtcattgaaaagccgattgcaaatacagcagtaaacgaaacggaatcagtcatcagcggttcgcctgcatgggggcttgacggtattttggaactaaaagaatatctatggttcgctgcaaagcagacggattcctatcgcacgtatcaaatcgaaagagggcatccggacgtcaaagttgccttgattgacagcggactggatcttgaccatccggacttaaaagcgtccgtcaatacaaatggcggctggaattacattgacggcaagcctgtatccggagatccgacaggacacggaacacaaacagccgggatgatcaatatcattgcgccagatgtgacgataacgccttatcaagtgctggacgaaaaaggcggagacagctacaacatcatgaaggcgatggttgatgcagtcaatgacgggcatgaagtcatcaacatcagtacgggaagctatacttctcttgacagggaaggaaaagtgctgatgaaagcttatcaaagggctgcaaactacgctgcaaagcatcaggtgctggtcttctcttccgccggcaataaaggagtcaaccttgatgagatgaggaaaacggaaaacaaggtgcatttgccgagcgctttgaagcacgtcgtatcagtcggcagcaatatgaaaagcaacaatatttccccatactccaatcaagggcgggaaattgaattcacagccccgggaggatatttgggagaaacgtatgatcaggatgggatggttcgtgtgacagacctcgtactgacaacgtatccgaaagggaaggacaacaccgcattagaccagatgctaaacatcccaaagggatattccctctcatacggaacaagcttggccgccccgcaggtagctggaacagctgcactggttatatctgaataccgggagcgccatcacaggaagccatcggctaaacaagtgcatcacatcctgaggaaatcggcattagacctgggcaaaccggggaaagatgttatatacggctacggggaagtacgcgcttatcaagcgctgaaaatgatgaacaaggagtga

SEQ ID NO: 3955 - DNA, 2157 bp, Bacillus licheniformis
ttgttttttcataagacaccgtttatagaacagatgcagcagacggaatgcggactgtgctgtatggcgatggtagccggacggtatggttcgcatcatactctgcatgagctgagggatttatcgggatgcggcagggacggtatgaccctttttcatatgcgtcagctcagcgaaaatctgggatttgacgcaaaggtgtacagggcaggcgcggcagaacttccacatgtgcgtctgccggcaatcgctttttggtccgataatcattatgtggttattgatcaaataaaagaccggcatgtcaacatcatcgatcctgcgattggacgaaaaaaactcagtatcgaagcttttctcgaaaattacagcgggatcgtgctggagatgatccctaccgagcggatcaggccgaagaaaaaaccgcccgtctggaggcattttctttttcatttaaaagaatccccttctctgcttgcgaccgtgctgttgtttgcgatgatctttcagctcgtttcattaggcataccgatgctcgtgcaatacctgatcgatgacatccttgctcaaaatcagcaggctctgctgcaaacatttatgacgggcgttcttgttttaatgctcgttcaaggcacggttcaattgatcaggggtcaatttatcattaaattaaataacttccttgacaaacgaatgatgagaacatttttctcgcatattctgaagcttccctatcaattctttcaattgaggtcgttcggggatctccttttccgcgcgacaagcctccggattgtcagggatatgatgtcttcccaattggtcctcggcgtactcgattttggcgcacttttatttatctcgttttatatgttttataaatcgccgcctttagcagggctggttattctgctggctcttctgaatgtcgggatcacggcgctcagccgcgggaagctgagagaaaaaaaccaggacgaaatcgcaaagacttcgcagattcaaagctatcagactgagtttttatatgggatttttggtattaagactgcgggaatcgaaaaagaaacgtatcaaaaatgggatcactatctgggggaactgatcggggcataccgacgcaaggaagggtttcttaacatcgtgaactctctgacaggcacgatgcagatcatatcaccaatgctgattttatggattggtgcaatgctcgtgttcgaagggaatttatcggttggggagctggtggcatttcatgctttatccacacaattctttaatacaagcagctcgatcgtccaaaccgtcaactcggtaatcttgacgacgtcttatcttcatcggatacaggatatccttcaaagcccgattgaagagacacctggaaataaagacaactccccgattaagggggagatccggcttgaacgggtttcgttccgttacagcccgcacagcgaagaagttattaaagacgtaagcctgcatatcaagcctggcgaaaaaatcgctatcgtcggacaatccgggtccggaaaaagcacgctggcaaaacttattcttggcctctatatgcctacaaaaggcagtgtgttctatgatggcgtgaatattaaaaacaaggatttaagcgctcttcgcaaacaaattggtgttgttccccaagatgtaacgctgttcaaccgcagcattaaagacaacatttctttatacagtgaagatgttgacattgagcggatacatgaagtcgcaaaaatggcgcaaatatacgatgacattcaaaatatgccgatgggctttaatacgatgatttctgaaatggggatgaatatttcgggagggcagcgccagcggattgccttggcccgtgcactgctaaaccgccccgctgtgatgctgttggatgaagcgacgagttcgctggatcatcaaaatgaaaaaaaaatcgacgcctttttaagggagctgaaatgtacaagaattgtcatcgcgcataaactgacttcaatcatggatgccgataaaatcatcgttttggaagacggcatggttttaaatgtgggtacgcatgaaacattgctgaatgagagcaagttttacggagatttttatcgaaagttccttgaaaaagagcaatctgcagaggtgatgatgtga

SEQ ID NO: 3956 - DNA, 3081 bp, Bacillus licheniformis
atgagcatgaaagaattcgaaatttatctgtataaagctctttacagcaatgaacgaggcggtcaaggtcaagaacatccgtccggcttttttccggaaaacggaaaaactccgtctcgtcctacggattttcacctttcttctgtccaacattcacccaatgagcctgtgcagctgcaaggcaaaatgccggaatgggctgcctgtttgtctgaaattatgaaatacaaccctaaagcggtttccgaattaaaacacccgcttccccacatgtcatttgtcaccttcttggttccttttcttttatttgcacaagaacggatgtcgaaagctttttctgaatttgagaagcaggaaggcggtctatccggcataatcgacgctgccggctatcaagacggcatcatgtctgaacttcaccaatgccttgataagctggcgacgagaacacttatcacagagctgaatgtagcccgggaagacggccggctaaagggggcgtcaccggaagagcgatatgtttactttgttgaacaatacatttccgatcctgaaatttaccgggaatttttcgagctttaccctgtgcttggcaggctgatggctgagaaggttctcagggtgctcgagattcatgaagaaattattgggagatttttaagcgaccgcagcctgattgcgaaaaaatttaatatcgcttcccccgaattggttggatttgaaggggatttgggagattcccacaaaaacgggcagagtgtcaaagtgctggtgttaaacaacggaaagctcgtgtataaaccgcggtccttgtcaattgacgaacattacagggagctgctgaactggctgaacggacggggaatgaagtacagcctccgtgctgcggaagtgcttgacaggggaaattacggctggcaggaatttgtaaagcatgaaggctgttcttcagaagaagaactggaaagattttatttccggcagggcggacatttggcgatattgtacggattgcgctccgtcgattttcataatgaaaatatcatcgcctcaggcgaacaccccatcctgattgatctggagactctttttgacaaccatgtcagcattttcgctcaaaatcaaaacctccatgtcaccgcattggagctgaagcattccgtgctgtcttcgatgatgcttccggtcaaattcaaacatgatgaagtgctcgattttgatttaagcgggatcggcggcaaaggcggccagcagtcaaagaaagcgaagggctacgccgtcctgaattacggtgaggacaggatgtctttaaaagaaacatcgctgaccaccgaggaaaaattgaatgcgcccaaactaaatggacgtccggtgtccgccgttttctatacggactttatcgtggaaggatttaaaaatgcttatgccattatgatgaaacataaagaagaactggcaggaccctcggggtttttgaatctgtttaagcacgacgaagtccgccacgtcttccggccgacacatgtgtacggcaagtttctcgaagcgagcacccaccctgactacttgaccgccggagataaacgagagcaattatttgattatatgtggatgctcgccaaacagtcggaaaaggcaaacgtgtttattccggacgaaattgtcgatctgctgcttcatgatattccctactttactttttatgctgggggcacttccctgctcaattcaagaggggaagaatcggaaggtttttatgaaacatcaagtattgatttggcaaagaaaaaaattcaatctttctcggaaaaggatttgaatcatcagctccgctatatttctttatcaatggcgacgttgattgaaaatgtctgggaccatgcagaaagcgggcttggacagaaggaaacggtcgctgatctcggaaaagaggtcaagcatatagctgatgatttgctgcagaaggcgatctattcagagcgcggtgaaggtcctttctggatcagcaataatgccggagacgaaaaaatggtgtttttgtcgccgcttcctatggggctttacgacggaatggcagggctggcaatattttttgcacaagcaggcaaggtactgaacgagcaggtatatacggatacggcaagatcaatgatagaagaaattcaaaaggaagaaagttattgggttcaaaatgggaattcccattctgcttttttcggcacaggctcattcatttacctgtattcctatcttggcagtctatgggaagacgattccttattggaaagggcgttgaacctcattccccgagttttggatcagccgaatcaaacacaaaacccggattttatcgcaggggattcaggattgctgacagtgcttgttaatctgtacgaaatcaagcagcacccagcagtattggactctataagacaggtactgagcagattgaatgatcgaattggccgcttacttgattcaatcgagcaggatgccgtttcgttgacgggattttcacacggcttgacggggatcgcattttctatcgcaaaggcggcgaaggtgatacacgatgacagctgcaaagagcttgtcctaaagcttgtcgaagaagaggaccgctattttcaaaaggatcatctaaactggctagatttacgaaatgattcgcatacgctgtccccaagctactggtgtcatggagctcccgggattttgctggggagagcgcacattcaggcttttattcctgaattgactacccggactttaaagcttcaagaagcgcttcaaagttctttaaatctagcagactgtcaaaatcattcgctgtgccacggtttaattgggaatttgaacattctgctggatatcaaaaggctgaaccgggaacttcatgtccctgatgatatattttgcatttataaaacgaaaaaccggggatggaaaacgggtttgcattccgatgtggaatcgcttggcatgtttgtcgggacggcaggaatagcctacgggcttttgcggctcctcgatgaatctgttccatccgtattaactctcgatattccgacgggcaggtga

SEQ ID NO: 3957 - DNA, 225 bp, Bacillus licheniformis
atgtcaaaaaaggaaatgattctttcatggaaaaatcctatgtatcgcactgaatcttcttatcatccagcagggaacatccttaaagaactccaggaagaggaacagcacagcatcgccggaggcacaatcacgctcagcacttgtgccatcttgagcaagccgttaggaaataacggatacctgtgtacagtgacaaaagaatgcatgccaagctgtaactaa

SEQ ID NO: 3958 - DNA, 3159 bp, Bacillus licheniformis
atgaatgaaaaatccgccggatatcacgaacggcttcccgtcgcccaaactcaatccccgctcgtaaacgataagataaagtattggcgttcccttttcggcgatgatgataaatggctcaataaagcagtttcattattaagccatgaccctttgtcctccatcgcacaatcctcggtatcccagtcagtcgggctgaaagacagccgtcgcggcccatggcagaagatgcaaaagcggatctttgaaacgcccttttcctacaaggattctgctctgcaagattcagaattgctgttcgactccctgctgacccgttttgcgtctgcagcacaagatgctttggaggaacaaaatatcatactttctcctcctctttgccggcaggtgctgacacatttaaaacagacgcttcttcaaattgcccatcaaacattaatactggaactaaacattttaaggcttgaagatcaattgaagggcgacacccccgaaatgcgctatcttgatttcaatgataactttttagtcaatccaggatacctgcggaccctgttcaacgagtatcccgtattgctgcgccttctgtgcacaaaaaccgattactgggttcaaaacttttctgaactgtggaagaggctgaggcaggaccgcgaacagctgcaggctgcatttcatattgccggcgatcctgtccatattgagcttggggtgggagactcgcacaataaaggaaagatggcagccatccttacatattccgatggaaaaaagattgtctataaaccgagaagccatgatgttgacgacgcatttcaacttcttctatcatggatcaatgaccgaaattcaggcagccctttaaaaactttgagattaatcaataaaaaacggtacggatggtccgagtttattcctcacgaaacgtgccatacgaaaaaagaactggaaggctactatacacgcctcggcaaacttttggccgttttatacagcatcgatgccgttgactttcaccacgaaaacattatcgcctccggcgagcatcctgttttaatcgatcttgaatcaatttttcatcaatataaaaaacgagacgaacccggctcgaccgccgttgacaaagcaaactacattctttccagatccgtacggtctaccggaatcctgccgttcaacctttacttcggaaggaaaaaccgggataaagttgtggacatcagcggaatgggggggcaggaagctcaggaatcaccgtttcaggcgcttcaaatcaaaggatttttccgcgatgacattcgcctggagcatgaccgatttgaaatcggcgaggcgaaaaatctgccgactttagatcaccagcatgtccctgtcgcagattatcttcattgtatcatcgaaggattttcagcagtataccgtctgatttctgatcatggcgaaagctacctggctacgattgaacattttaaaaactgcaccgttcgaaatattttgaagccgacagcgcactacgcctctcttttgaataaaagctaccaccctgattttctcagggatgcggtagaccgtgaagtgtttttatgccgggtggaaaagtttgaagatgcagacacagatattgcagcggcaaaaacagagctgaaagagctcattcggggagacatcccctattttctgtcgaagccttcagatacctatttgctcaatggcgaagaagaaccgattgccgcttattttgaaacgccgtccttcacaagagtaattaagaagatctcatcattttcagaccaggacttaaaggaacaagcgaatgtcatacgcatgtcgattctggctgcatataacgcgagacatgaaaaagacgcaatcgatatagaccaaaatcacccgagtcctagatcaggcgccttgcagccgctcgccatcgctgagaaagcggctgacgatttggctgaaaagcgaattgaaggcaatgatggaaaggacgtcacttggatcagtacagttattgaaggcgtcgaagaaatctcttggacgatctcccctgtcagtcttgatttatataatggcaatgcaggcatcggactttttatgagctatctgagccgcttcgcaaaacggccggagacttactcgcatataaccgagcagtgtgtatttgcgattcagcgagcgttgaatgaactgaaggaaaaagaagaattcctgaagtacgccgactctggggcattcacgggggtttccggctatctgtattttctgcagcatgcgggaacggttcagaaaaaaaacgaatggatcgaactcatacatgaagctctgccagtccttgaagctgtcatcgaacaagacgaaaactgcgatatcatcagcggttctgccggtgctctaatggttctgatgtcattgtatgaacaactggatgacccggtttttctaaagctcgccgaaaagtgcgccggccatttgcttcagcataaaacaaatattgaaaacggagcggcctggaaagatcctcatacacaaaactattacacaggatttgcccacggcacttccggcatcgccgcagctttatcccgattcaataaagtgtttgattcgcaatcactgaaaaaaatcatttcgcaatgcctggcatttgaaaagcagctgtacatcgcttccgaaaaaaattggggatcaaaaggaagagaacaactgtcagttgcatggtgccatggcgctgccggcatattgttgtcgagaagcatcctccgagaaaacggagtcaatgatcccgggctgcataccgacatcttgaacgctcttgaaacaactgttaagcatgggctcggcaataaccgctcattctgtcacggcgatttcggccaactcgaaatcctaagagggttcagggaagaattcagcgaactgaacaccattatacagaatacggaagatcggctgttgacatattttcaagaaaatccattcagtaaaggggtatcacgaggtgtggattcagccgggctcatgcttggtttaagcggagtcggctacggcatgctgcaatgccaatatggagaagaactgccggaactgcttcagctcagtccgcctcaagcgcttatcaaaaagaacagcaaagcttttaaaagagaaaacgtgttttaa

SEQ ID NO: 3959 - DNA, 1026 bp, Bacillus licheniformis
atgaagaaattaatcagcatcatctttatctttgtattaggggttgtcgggtcattgacagcggcggtttcggcagaagcagcttctgccttaaactcgggcaaagtaaatccgcttgccgacttcagcttaaaaggctttgccgcactaaacggcggaacaacgggcggagaaggcggtcagacggtaaccgtaacaacgggagatcagctgattgcggcattaaaaaataagaatgcaaatacgcctttaaaaatttatgtcaacggcaccattacaacatcaaatacatccgcatcaaagattgacgtcaaagacgtgtcaaacgtatcgattgtcggatcagggaccaaaggggaactcaaagggatcggcatcaaaatatggcgggccaacaacatcatcatccgcaacttgaaaattcacgaggtcgcctcaggcgataaagacgcgatcggcattgaaggcccttctaaaaacatttgggttgatcataatgagctttaccacagcctgaacgttgacaaagattactatgacggattatttgacgtcaaaagagatgcggaatatattacattctcttggaactatgtgcacgatggatggaaatcaatgctgatgggttcatcggacagcgataattacaacaggacgattacattccatcataactggtttgagaatctgaattcgcgtgtgccgtcattccgtttcggagaaggccatatttacaacaactatttcaataaaatcatcgacagcggaattaattcgaggatgggcgcgcgcatcagaattgagaacaacctctttgaaaacgccaaagatccgattgtctcttggtacagcagttcaccgggctattggcatgtatccaacaacaaatttgtaaactctaggggcagtatgccgactacctctactacaacctataatccgccatacagctactcactcgacaatgtcgacaatgtaaaatcaatcgtcaagcaaaatgccggagtcggcaaaatcaatccataa

SEQ ID NO: 3960 - DNA, 852 bp, Bacillus licheniformis
atgtctgcagaacaattgccgatatggacgaaagactgcgtgaagggctcattgccgaaaaggggaaatgatagtcataaaggaacttatggaaccggccttttgctcgcgggaagcgatgatatgccgggagcggctctccttgcaggaatcggggcgatgcggagcggtctaggaaagcttgtcatcggaacgtgcgggagtgcgattccgctgatcctccccgttcttcctgaggcgacgtattggcgggacggcgccgaaaaggcggcgtcaggcgagattgccgaaccttaccgggcgattgcgatcgggcctgggctgccgccttcgcaaatgactgagcaagcggttcaaagcgtattagcgaaagactgcccggttgtgcttgatgcgggtgctctttcaaaacgatcgtatcatgaacgggaagcgccggtggtattaacgccgcatccgggcgaattttcgaaaatgacaggcttgtccattcgagaaattgaagcaaaccgggccggttatgctcgagattatgcggaggaacaaggtattacccttgtcttgaaaggcaatgaaacgatcgttgctttccccgacggcgagtgctggaggaatgtaacgggaaatggggcgctggcaaagggaggaacgggggatacgttaacaggtatgcttctcgggatgctgtgctgtcatgagaattcgagagaagcggtgctgaatgctgtccacttgcacggcgcatgtgcggacgcatggacaaagaccagatcggctcatgcgcttcttgcgcatgaactttccgatctgctgccaacggtatggaaagcgtatgaggatggaaataagtga

SEQ ID NO: 3961 - DNA, 1749 bp, Bacillus licheniformis
atgaacaatgaagacgggtggattctgccctacatcaagaaaaatacaaggcttttgatcattgtcgtgctgcttggcgggttgacggcatgctcggcggctgctctcatgtttacctccggttatttaatatccaaagcggctacgcgtccggaaaatgttttgatgatctatgttccgatcgtagcggttcgcaccttcgggattctgcgctcggtgtcgcgctatgttgagcggttgacagggcaccatatcattttgaaaattttatccgatatgcgcgtcaggctttacaggatgctcgaacctcaagctttaaaatggcgtgaacgtttccgaacgggggatatgctcggcattttggccgacgatgttgaacatttgcaggacatgtatttgagaacggtatttcccgggctgtcggctcttcttttatatggcgtattcatcgcagctatcggctttttttcatggccttttgctggactaatggcggtctatgccgcggttttcgtatttcttgttccgcttgtttccctgcttgtgacaagggcaaaaaatgttgcgctgaaaagaggacggagccacttgtaccgtcagctgacagacgcggtcatgggggtgagcgattgggttttcagcggccggcaaaacgactttgtccattcgtatgaagcggcagaacatgaatggctggcgatcgaaaagaaacaggtgcgcttcagtcgttggagggactttgccatgcaatgcctggcggcaggacttgttcttctgatgctaatatgggcgggcggccaaagcgcggaaggggctctggctcctgtgtttattgcggcgtttgtccttgttgtgtttcctttgacggaagctttctttccgctttcggacgcagcggcttcaatccctgagtatcaggattctttagaaagaatggacggtctgcagccgccgaaaagggggaacggggccgatgttcagcaggaacgggcggaggctgtaggtttggacgatgtcacgcttcgctttgaagacgtttctttttcttatgagcaaggccagccggtgttggacggtgtttcatttatattaaagcagggtgaaaagaccgctttgctaggcccgagcggtgcgggtaaatcgaccatcttgtcgttgatacaaggggcgcttgctccttctaaaggaaacattacattgaacgatatttctgtgcagtctcttcagggagaaatttcacgcgtagtctccgttttcaatcagcagccgcacctgtttgatacgacggttttgaataatatccggctcgggaaccctgacgcgagcgatgaggacgtgtattgggcggcgcgccaggtgaagcttcacgattatattcagtctcttcccgatggatatcatacatctgtacaggaaacgggcatccgtttttcaggtggagaacgccagcggattgctttggcgcggattctgctgcaggacgcacccatcgtcgtgttggacgaaccgaccgtaggccttgatcctaaaacagagaaggagcttctttcaacgatgtttcaagtacttgatggaaagaccgttctatggattacacaccatttggcaggagccgaagcggccgaccggattctgtttttagacaaagggaagcttgcaatggcagggagccatcagcagcttttggaaaacaatccgcgctattcaagactttatcgtctggatgcgcctgtcagccggcttttttag

SEQ ID NO: 3962 - DNA, 1725 bp, Bacillus licheniformis
atgggaaaagatcttttgcaatataaagggatgaaacgaatacttgcagtactcactgtcctgacatgcatgcagggcgccgccattatcatgcaggccgaatggcttgctgaagcggttacccgcctttttaacggagaacgcgtcggttcgctctttccgctgctcatcttatttaccgccgcttttttatttcgacatgctgttacccttgtcaggcaaaagctgatatttgactatgccgccgagacgggggccggcatgcggaaaaagtttttggagaagcttttccaatccggccccaggctggcgaggaaagaaggaaccggtcatgtcgtcacgctcgcgatggaaggaattgcacagttccgccgctatttggagctgtttttgccgaaaatggtcagcatggccgttataccgccggcggttgtctgttatgtcttttttaaagacacatcttccgctgcagtcttaatgattacgatgccgattttaatcacttttatgatccttcttgggtatgcggctaaaagaaaagcggacagccaatggaaaacgtatgagatgctttcaaaccattttacagattccttgcgcggcctggaaacattgaaagtgctgggcatcagccgttcacatactaagaatatatttcatgtgagcgaacggtacaggaaggcgacgatgagtacgcttaagatcgcctttctgtcatcgtttgcacttgattttttcaccatgctgtccgtagcgaccgttgctgtttttctcggtctcggtcttgttgacggcagcatctcgctggagccggctcttgccattctgattcttgcccctgagttttttctccctgtccgggaagtcggcaatgactatcatgctacattgaacggacgcgaagccggtaaagcgatcaaggcgatattggattcgccgggtttcaaggatgaggcgcctttaagtcttgagcgatggtctgacgacgatcaaatcgagttcaagcatgtagatgtgcggcatgaagatgaggaaaactgctctttatccgggatttctctttcatttaagggaaagagaaaaatcggaatcatcggggaaagcggtgccggaaaatctacgcttatcgatgtgctcggcggcttcctggaaacgaaaagcggcgttatcaaagtcgggggaaaaaagagaacgcatttgcagacggacagctggcaaaatcagctcttgtatattccgcagcatccctatatctttccggatacgctcgcagccaatatccgtttttatcatcccgccgcttctgacgaagacgttgaacaggcagcaagagctgccgggctctcggagctgattgatcagcttccaaacggcttgaaagagcggatcggtgaaggcgggagggcattaagcggtggacaggcgcagcgtacagccgttgcccgggctttccttggcaaccgtccgattattcttttagatgagcccactgctcatttggatatcgaaacagaatacgagttgaaaaaaacgatgttaaaactgtttgaagacaagctggtttttttggcaacccatcgccttcactggatgcttgatatggatgaaattatcgtgctgaaagatgggcaggtggctgaaaccggtacacatcaagaactgattgaaaagcggggcgtttattacgagctcgtgaaggcgcagtcgtttggaggtgcatcatga

SEQ ID NO: 3963 - DNA, 1017 bp, Bacillus licheniformis
atggtatctcttaatgaattttggtttatattagtcgctgtgctgttcatcggttttttctttcttgagggctttgatttcggcgtcggaatggcgacgcggtttctcgggcgcaacgatcttgaacggagggtgatgatcaatacgatcggtcctttctgggatgcaaatgaagtctggctgctgaccgggggaggcgcgattttcgccgcttttccgaactggtatgccacgatgttcagcggatattacattccgtttgtctttgttcttcttgcattgatcggccgcggggtcgcgtttgaatttagaggaaaagtcgaaaccgcaaaatggaagaatacatgggattgggtcgtatttttcggcagcattctgccgccgtttttgttcggtgtattgtttgcgagcatcctgcgcggcatgccgattgatgccgatatgaatctgcacgccggttttaccgattatgtgaacgtctattccgtgacagggggagtcgccgttacgcttctctgcctgctgcacggcctgatctttattacattgagaacggaagccgatttgcgcgaccgggcaagacagctggccaaaaaagtcgtattcgccgttttggcggcgcttgttgcctttgttgcattatccatttttgaaacggacttgttcacgggcagggggcatgtgacgataccgcttgcggctctgattgtcgtttgctatgtgctgtcgatcgtgtttatgaaacaaaaacgcgacggctggacatttgccatgacgggcgcagggatcgctcttacagtggcgacgattttcactgcgctgttcccgcgcgtcatgatcagctcggtgaaaagcgcatatgacttaaccgtttataatgcttcatcaggcgactattctttaaaggttatgacgatcgtcgcgctggcactgcttccgttcgtgctgggctatcagatctggagctactatgtttttagaaaacgggtcagcagcaaggagccaatgatttattaa

SEQ ID NO: 3964 - DNA, 1407 bp, Bacillus licheniformis
gtggacgaactcattttggcaagatttcaatttgcttcaacaacgatctttcactttatttttgtaccgatgtcaatcgggcttgtctttatggttgctttaatggaaaccctttatgtcgcaaagaaaaaagacatttacagaacgatggctaaattttgggggcacttatttttaattaattttgcagtcggtgttgtcaccgggattttacaagaatttcagttcggaatgaactggtcggagtactcccgctttgtcggtgatgtattcggcgctccgctcgcggtggaagcgctgctcgctttctttatggaatcgacgtttatcggtttgtggatcttcggctgggaccgccttccgaagaagattcatttgctgtccatttggcttgtttcgcttggcacgatcatgtcggcgttttggattctagcggccaactcgtttatgcaggagcctgtcggatttgcgatcaaaaacggacgcgcggaaatgaccgatttttttgcgattattaaaaacccgcagctatgggttgaatttccgcacgtcattttcggtgcgcttgccactggggcgtttttcattgccggtgtcagcgcgtataaaatgctgaaaaaacaggaattgctcttttttaaaaaatcctttcaaatcgcgatgattgtggcgcttgtttccgggggcggcgttgcgttcagcggacatgagcaggcacagcatctgatgaagagccagccgatgaaaatggctgccagcgaagcgctttgggatgacagcggcgatccggctgcatggacggtgcttgcgaacattgacacggacaagcaggaaaacaaatccgagctcagcatcccgtatgcgctcagctatttggcttataaacaattcagcggcgatgtgcccggaatgaagacactgcaaaagcaatatgaagaaaaatacggagaaggaaattatattccgccggtgaaaacgacattctggagtttcagaatcatggccggatcaggacttttaatgatcgttgccgctttgaccggtctttatctcagcttccgcaaaagactcgaaacaagcaaatggttcttgcggacaatggtggctttgatcgcctttccattcattgcaaatacggcggggtggatcatgactgaaatcggacgccagccgtggacggtgttcggtattttgacaacggcgcagtccgtgtcgccgaacgtatcagcgggaatgctgctgttctctgtcatcgcgtttacagcgatttatcttgtgctggcgctcgttcttgtctacttgtttgtgcgggagattaaaaaaggggctgcacaccatgaccaccatcatgatgattccgtatcgacagacccgtttgatcaggaggtttaccatggtatctcttaa

SEQ ID NO: 3965 - DNA, 789 bp, Bacillus licheniformis
atggaatctaaatcacttgttctagtcgaagagcttgctttaaaaaagcaaagcatctttgtgcaaagcccgcttcgctatcttttacgggctatgctggccagtatgtttatcgggttcggagtcattgtagcgtttaaaacggggaatctcttttatgttgaacattctccgttcacatatccaattgcagcaatcacctttgggggcgccattattctgatcgtctatggcggaggagatttatttacgggaaatacattttattatacattggctgcgcttcgtaaaaaaatgcgctggcccactgtgatcaagctgtggatgttcagctatgcaggaaatttaatgggcgccgtttttttcgcaggcctcatctttgcgaccggcttatttaaagatccttcttccaccggctttattctcagcgtggcggagcataaaatgaatacgccggtgaccgaattgttctttaaagcgattctgtgtaactggcttgtctgccttgcgtttttcgttccgatggcgcaaaaaggggacggagcgaaaatgttctctatgatgctgtttgtctttactttctttatttccggttatgaacacagcatcgcgaacatggccacttttgccgtctctctggtcaccgagcatccggagaccatttcgattgcaggcgcaatccataacctaattccggtaacactcgggaacctggtcggaggcgcgtttatgatgggcttcatgtaccactatgccaacaagccgggcggtgaagaaatcatcaaataa

SEQ ID NO: 3966 - DNA, 330 bp, Bacillus licheniformis
ttgaaccacggtgtctgttctgtcagcatcaaacggaatttgcgtgtcgcgattcaaggaagaccgagccggggagtcggcatggaagaaatcatgttcgaatcgctcgatcaaaacggaatcgccttgaatatggccgaagtcgcaattttgcctgaagaagttccgctgtttacaaaaaagcttgtcgatcagggcatcattatcagtgctctccacaatcattggatttttacagaaccgaatattttatatattcattttcaatctgtagaaccgccgttaacattcgcgaaaaaaacagctgccgctttatccgtattgcgatga

SEQ ID NO: 3967 - DNA, 1332 bp, Bacillus licheniformis
atgaatggcaacaatattattcggaatttgatgctggaaatcccttcagcacccggaaaccttggaaaggtgacaacggcgatcggccttgccggcggtgatatcggagagattgaaacgatcaaggtagggccgaattatacgatgcggaacattacggttcaagttgagcatgaagaacagctcaccgagattcttgaagtgatccgcaacttaaaagaaggcatccatcttcataccgtttcagatgacgtgctggctgcacatgaaggcggcaaaatccgcatgaaaagcaagatgccgattcgctcgcttgctgatctgcgtcgggtgtatacgccgggtgtcgcgaacgtgtgcgagctcattaaagaagagccgcaaaaagcgaatatttataccggaatcggcaattcggttgcaattgtaacggacggcacggccatccttggcttgggagacatagggccagttgctggaatgcctgttatggaagggaaagccgctcttttcgaccagcttgcggatatcagcggggttccgattctgctcgacacgaatgatcctgatgaaatcgtaaggacggttaaaaacatcgcgcccggctttagcggcattttgcttgaagacatcggttcaccgcattgttttgaaattgaagagcgcctgaaaaacgacctgaatattccggtcatgcatgacgaccagcacggtacggcggttgtgacgctggcggccgccatttcagcagccaagagtgcaggggtggatctgaagcaggcccatgtcggccaaatcggcctgggcgcggcgggtgtcgcgatctgcaggatgtttatggcatatggagtaaaacgtgttgtcggaacggataaatcgcttgaggcgatggcgcgtttagagaactatggcggccatgcggctgaaagcatcgaagaattgatggaaagctgcgatatcgtcgttgcgacaaccggtgttccgggattgatcaataagaaatgggttcgggaaggccaggtgattttggctctgtccaatccgaagccggagattgagcctgaggatgcgctcgaggccggggcagcctacgctgcagacggacggtctgtcaacaatgtgctggggttcccaggtattttcaggggcgtgttaaatgccggagccgattcgatcagccacccgatgctggttgcggccgctgaagcgatcgcatcctgcacaagacaaggcgatcttgtgcctcatccgctgaaccctgaagttcacgagattgtggccaaagcagtcgaaagggtcgcactttcagaaatgggaaaaatcaacggataa

SEQ ID NO: 3968 - DNA, 1398 bp, Bacillus licheniformis
ttgaaaacagcacggttgccatcaatgttggaaatcatttgtgtattaggtgcatttttagcgatagtttgttcatttacagtcaaattcgagctgccgattcagctggcattgtttatttcatggttcttggtgattttgctcggactgcgcctggggcaccggtatgaagatttgcaaaaatcgattacaaacggaatttcaaatggacttgaagcgatattgatcctgattgccgtcggcgctcttatcggcacatggatagccggcggtgttgtgccgactttgatttattacgggcttgagtttatccacccgagcatattcctgcttgccacgctcattatttgttcgatcacatctgttgccacaggtacgtcttgggggactgtaggaacggccgggatcgccatgatggcaatcggggaagggctggggcttccgcttccgcttgtagccggagccgtgctgtccggagcctactttggagataaattatcgccgctttccgatagtacggtgcttgcgtcatccctttcaaaggtcgaagtgattacccatgtcagagcgatgctgtacttgtcgattcccgcctatttaatcacggcggtcctgttcaccatcaccggctttatgtatggaagccgaaatgttgatttggaaaaagttgaatttttgaaagcttctttgcagaacacgtttgatattcacatttggatgcttgttccggctgttgtcgtcatcgttctattggcgatgagaaagccatctgtgccgacgatcgcgatcggcgcacttttgggcgcgatctgggctgcggtcttccaaggcatggactttgcggatgcgatcggcacagcatacaacggcttttccattgacaccgggatcaaatttatggacgagctcttaaatcgcggaggaatagagggcatgctcggttcggtcgtcgtcatcattctcggtctgggctttggcggcctcttggagcacttaggcgttctaaaagtgatcgtctccaagttccagcaaaagctgacttctgccggcaacgtcacattctcgacgattatcgtcgccttcttggcaaatgtgttcggctgcgcgatgtatgtctcgctcattttaacaccgaaaattatggaaaaaagctatgacaagctcggaattgaccggagggtgctgtccagaaacgcggaagtcggcggtacgatgacgtcgggcatggtgccgtggtcggacaacggcatatatatggcggggattctcggcgtctcgaccttctcttatgtgccgttcatgtggctgagctttgtttcaatcggccttgcgattttgtacggatacacaggtaaatttatttggtacaccgataaaaaagactcgccggttcagtag

SEQ ID NO: 3969 - DNA, 1134 bp, Bacillus licheniformis
atgaaagctgaaatgacataccggacggaaaaggattttctcggagagaagaagattccggccgatgtctactacgggattcagacattgcgggcagcggagaacttcccgattacaggatataaaatccacgaagaaatgatcaaggcgctggcagtggtgaaaaaagcggcggcgcttgccaacatggagacaaaacgtctttataaaggccttggagatgccatcgtccaagccgctgatgagatccttgaaggaaagctgcacgatcagttcatcgttgatccgatccaaggcggcgcaggcacttcaatgaatatgaacgcgaacgaagtcatcggaaaccgcgcacttgaactgctcggccacaacaaaggcgaatatattcacctgagtccgaatacgcacgtcaacatgtctcaatcgacaaacgacgtattcccgacggcgattcatatttcaacgcttaagctgctggaaaagctgctggacacaatggaatacatgcttgatgcctttaagaaaaaagcacgcgactttgaccacgtcattaaaatggggcgcacccatcttcaagacgccgtgccgatccgccttggacaggagtttgaagcctacagccgcgtgatcgaacgcgacatcaaacggattaaacaatcgcgccagcatttgtatgaagtcaatatgggcgctaccgcggttggaacgggattaaacgcggatccgcgctatatcgaaaatgtcgtcaagcacttggctgagatcagcggtcttccgcttgtcggcgctgaccatctggtagatgcgacgcaaaatacggacgcttacacagaagtttcagctgcattaaaagtatgcatgatgaacatgtcgaaaatcgccaacgaccttcggttgatggcatcaggtccgcgcgcaggacttgcggagatttcccttccggcaagacagccgggttcatccattatgccggggaaagtcaatccggttatggccgagctgatcaaccaaatcgccttccaggtcatcggaaacgatcatacgatctgccttgcttctgaagccggacagctcgaactgaatgtgatggagccagtgctcgtctttaatctcctgcatccatcagcatcatga

SEQ ID NO: 3970 - DNA, 990 bp, Bacillus licheniformis
atgaaaaagttactgctgttgaccaccggcgggaccatcgcttcagtagaaggcgaaaacggactggctccgggggttaaagcggaagagcttctcagctatttatctgatgatcattcaaattatacgatagattgccaatctttaatggatatagacagcaccaacatgcagcctgaacactgggtgatgatggctgaggctgtatatgaaaattacagccgctacgacggctttgtgatcacgcacggaaccgatacgatggcctacacctcagcggcgctttcatacatgctgcagaatattgataagcccgtcgcgattacgggttcccaagttccgattacgtttaagaaaacggatgcgaaaaaaaatataaaagatgcggtccgctttgcgtgcgacggcatcggcggagtatatgtcgtctttgacggccgcgtcattttaggcacgagagcgatcaaattaagaacaaaaagctacgatgcatttgaaagcatcaattatccttacatcgctttcattcacgataaggaaatcgagtacaacaaacgggttcccgaagtaaagccaggcgctttgaaactcgatacctctttaaataccgacgtttgtctggtgaagcttcatccgggtttaaaaccagagtttttcgattgtctgaaaggttcatataaaggcattgtgattgagagctacggaagcggcggcattccttttgagaaaagaaacattttagaaaaagtgaacgagctgatcgattccggtatggtcgtagcgatcacgacgcaatgccttgaagaaggagaggatatgagcatttacgaggtcggccgcaaggtaaaccaggatgccattatccgctcgagaaatatgaacactgaagcgatcgttccgaagctgatgtgggctttagggaaaaacggacaacaagctgaagtcaaaaagatcatggaaacgccgattgcagacgatatcatcatataa

SEQ ID NO: 3971 - DNA, 402 bp, Bacillus licheniformis
atgaatttagatcgattaacaacactgagaaaaaacaaaaaatggtcattgcaatatactgccgaccgcggccttcgggttatttggcggaaaaaggcacctttaccgtctggtgccgaccgcctcggtattgcgaaaagcacttacgcgggctatgaatcgggataccgccgcccttctttagaggcgcttatcgaaatcgctgatttattcaatacctccaccgattttttgctcggaagagttgacgatccccgggatgaaaaggctaaaaacgaagccattgaactgacggattgggctaagctcaagctggcagtcgacggaacgcttctttccgaagaagaaatcaagcagatggttgcgtttatcaaggtcaaaaaagggctggatgcggagtaa

SEQ ID NO: 3972 - DNA, 1047 bp, Bacillus licheniformis
atggcgaaatacagaggttatatcggaacatatacaaaagcagacagcgtagggatttatacatttgagcttgatacggaaaaaaaggcgttaagcacgccgaagccggcagcaaagctgggcagtccgacatatttgaatatcgccaaagacaatgacatgctttatgcagtggtcaaagacggcgataagggcggggttgccgcatatcgtattgacggttccacaggagagctgactatcgtcaaccagcagaccggggaaggaccgtcgccttgccacgtcagtgtggatcaagataaccgttatgttctgtccgccaattaccacaacgggacgatcttggcatatcctttaaatgaaagccgcggcctgcttgagccttcatcaaaagtacagcatgagggatcaggaccgcatgagaggcaggaaaaagcgcatactcattattcaggattctcacctgatgagaaatatgcagtggccgtcgatctcggaacggatcatatcatcacgtatcaattgaaagagggccggcttgaagaagtgaaaaaacacgctgctgcaccgggctcagggccgagacatatcgagttccatccacaggaaaagtatgcgtatgtattaacagagctgagtaatgaagtcatcgtgctggaatacaaccccgatttgggtgaattcagagagattcaagtgatttcggcattgccggaaggctttgacggccatagccaaggcggcgccatccacatcacgaaagacggcaaatttgtatacgcttcaaaccgcggccacgacagcatcgccgtcttcagcgtcaacgagtattcgggcgaactttccctggttgaacacgtatcaactgaaggggaatggccgcgcgactttgagattgatccttcagagcaattcttagttgcttccaaccaggaaacagggactttgacattgtttgaaagagaccggacaacgggccggctgacgcttttagagtctggagttcctgctcctgaagcggtttgtgtgaaatttttacatcaataa

SEQ ID NO: 3973 - DNA, 689 bp, Bacillus licheniformis
atgacgaaaatcatgattgtcgaggacagcgaagacattcggaagcttttacgcgatcatttagaaaaatacggatacgaaactgttgcagcgactgatttcacctctatccttgaaatatttctccaagagaagcccgacctggcattgcttgacatcaatctgccggcatacgacggttactactggtgcaggcaaatccgccagcattcgacttgtccgatcattttcatttcggcgagaagcggagaaatggatcaggtcatggcgatcgaaaacggcggcgatgattatatagagaagcctttttcctatgaggtggtctcgctaaaattaaaggccaaattcgcagggcatttggagaatacgcagtaaaacaaggtgaaaaagtgattgaatttgaaggcgtccagctgtttgtcgaacgttttgagctgcactgccgaaatgagaagctcgagctttcaaaaaaggaaagcaagctcttggaagtgctgcttgaaagaggagaaaaggtgacaagcagagaccggttaatggagaagacatgggaaaccgatacatttgtagatgaaaacacgctaaatgtctatattacaaggattcgcaaaaaactgcgaagcatggacgtgcccttctcaattgaatctgtgcggggcgaagggtatcagctgaggacgaaatcatga

SEQ ID NO: 3974 - DNA, 981 bp, Bacillus licheniformis
atgaagctgttcctaaaaaaccatgccgttctcatttttctgtttctctttcagggcggattcgtatttttttactattggtttgccggcatgcagactttcacccaccttttttacattctcggcgttcagcttctggcgcttgcgctttatctttcatacaaatggtatgaagaacacagagtctaccaatggatcggctcagatcaaaaagatacagaaattccttttttggggacgtctgaattttgctcagagctctatgaaaaacatatggagctgagccggctccaccaccgcaaaatacatgatatggagtccaagctggaagatagggtaacctacatgaatcaatgggtgcatcaggtgaaaacaccgctttccgtcatcaatctgatcatccaggaagaggacgaacccgtttttaaacaaatcaaaaaagaagtccagcagattgaatacggactggagacgctcctctattcatcaaggcttgacctgtttgaaagagattttaaaattgaggccgtgtcactagacgagctgcttaattcgctgattcagcgctataaacgctattttatacagcatcgtgtctatccaaataaacaggttcccgctgaagacgccgttatttactccgatcgcaaatggctcagattttccactggccaagtcatcactaacgctgtgaagtactcgtcaggaagaagcgaacgcatcgatttgacgatattccgtaaaggcgaacgcatcattctggaaatcaaagattacggaatcggaatcccttcacaagatgtgaaacgcgtatttgagccttattacaccggggaaaacggacggcgctttcaggaatcaacaggcatcggcctctaccttgtaaaagagattgccgaaaagctcaatcatgatgtgagcatcgattcagaagaaggaaaagaaacgactgtgcaattttcatttcttacaaaaatgtaa

SEQ ID NO: 3975 - DNA, 777 bp, Bacillus licheniformis
atgacaacaaatatgctggtcgttaaaaacatcaataaaacatataaaggacaagtctcccatcaggctttaaaagatatttcattcaatgtcgaggaaagtgagttcacggcgatcatggggccgtccggttctggaaaaacgacgcttctcaatatcatttcgacgattgaccgcccggattccggcgacattttaattcgcggagaagacccgcatcatttaaaaagggcgaagcttgcccactttcgccgcaggcagctcgggttcgtattccaggattttaatttgctggatacactgacgatcggcgaaaacatcatgctgccgttaacgcttgaaaatcaaccgctttccgtcatggaagataaacttcaggcgattgctgaaaaactcggcattgaacaacttttgaacaaacggacgtttgaagtatccggcggacaaaagcagcgggcggccatcgcaagagccgtcattcatcagcccgccctcatcctcgccgacgaaccgacaggaaacctcgattcgcaggcatcaaaagacgtgatggagacgatgcagcatcttaatgaaaacgacaatgccacgatattaatggtcacgcacgacccagttgccgcaagctattgccgtcgcgtcatttttattaaagacggaacattattcaatgaaatttaccgcggcgccaaccgccaagtattttatgaagagattctgaatgtgctgtctatgctgggaggaaataccaatgacctttcttcagttcgcttataa

SEQ ID NO: 3976 - DNA, 1878 bp, Bacillus licheniformis
atgacctttcttcagttcgcttataaaaacgtcgtccggaataaaagagcctatctcgccttctttttaagcagctcattttcagtgatgatttttttcacatttgcgatgtttttgttccaccccgctttagaggaaggctacttaaacaccattgcaaaacgggggttgtcggtggctgaatggatgattttcgccttttccattctgtttgtgctttattccgtcaacgcctttctcaagtcgagaagcaaggaattcgggatcctcaccatccagggaatcgctccgggtcaattgaggaagctgattaccgcagaaaacatcatcatcggcgtgctttcgatcgttacaggcatcatcggcggtcttgtttttgcaaaaacattctttacgatcggcgcttatattctggaaatggacgctttgccattgtatctgccttggaaagcgatggcccttacatccgcctgctttcttgcgctgtttattctgctgtcgcaatttacggtgttatttattaaatcaaaaaccgttgtcaagctgatcaaaggcaccgggaaaattaaaccggagccaaaaccgtccattattttttcggtcgtcggcatcggctgcctcggctccggctactggcttgtattgttcgccgacatccattttccccaagccgtcacgatcttaattttgacgatcatcgggacttatttcttcttcagccaaagcagcatttggctgctgcggctgttaaaaaagcggaggtcattttatttacgaggaaaaaacgtgctttggatatccgatcttgtttatcggctgaaggataatgcccgcctgttctttctcgtttgcatcatttccgcggtcgcctttaccgccatgggtgcattggtaatttccaagacttctatcggaaaattggattcccgatatgagatagagtacttattatacagcgggagccaaaaggaacaaacacacgttaaggtgatcgaacaaaaattgaaggacggacatttttcgtatgcaaaggaagtgacaaaaggaatttatatgagctatagccagggagatctccttcctccggtgctcctggtctctgaaggcgaattccaaaagcacttcaagttaaattccggtgaactgaaagacggtgaggcgctgtattatccaaacgcctttgaggcaaaagaaaagcgggaaattcctgagaccttggacatgttgaacaaagatttgaagccggcaaatgaacggctaaaggtaaaaggtattaaaaaaccgctcatttcgttagaaagcatcgttgtcgtaaacggcaaaaccttcgaaaagctgaaaaaacaaggcgaatccctcacattgtacggctatcagtacaaccgctggaaagagagcctcgacatgagccaatcattggaaaaagatctcagagaaaaatctcacaatatccaatttcaatttgaagcaaaggccatcaattattttgaaactgttcagcttccaagcctgagtctgtttatcggattctttattgcggttctcttttttacggcatccgggagctttctgtacttccgcctgtttaccgatcttgaagaagatcaagagcgctaccggtcactctcaaaaatcggcctgagcgaaaaggaaatgtcgcagagcgtaacgattcaattggccatcctgttcttctttccgttcgtactcgcctcaattcatacgtattttgcgatgaagacgctcgaggcacagagccttggtcatttcgcatctccggtgatcatgacaataggcggatttctgatcttccaactattattctttatgatgattcgaaaaagctatctgaaaaaattaaaaggatttttaaggtga

SEQ ID NO: 3977 - DNA, 351 bp, Bacillus licheniformis
atgaaaaaaacaatttctctcattacagccgctttagctgtatgtatcggcgcatttctgttgattcataatgaagtgacagacaggttcaatccacttgtgaagaaagaaagcgtatatgtccagatcaacaaagacggtaagcacctgagcccgggccgctatgagtacacgctggaaggatataatgacaccggtaaggaaaaagaaattacattctccgccagcgattcccttcgaagaaacgcctatctaaaggtaaacgcgaagggaaaatatgttgagacatgggaagaagtacagcccggcggcatgccgagtgccgttcagaaaaaattgatcaagcaataa

SEQ ID NO: 3978 - DNA, 840 bp, Bacillus licheniformis
gtgaaaaaaacgaaaatgttacttgtgctgtctatgttgatgggggtgctgtacgggtgttccggtcatgaaacaaaaggagaggaaaaaacagaaccaaatacggctcaaaaagcggcaaaacaatcaaaacagcaggcggaacatgatccatcatccaagtgggtcaaagtgaaaagcccggcccgcattccgattctcatgtatcacagcatttcctcaggaaacagcctgcgcgtaccggaaggggaattccgcgggcatatgaagtggctgaaggataacggctattacacgttgacacctgaggaagcctatattgtcttaacgcaagataaaatgccgagtgataaatgcgtgctgattacgtttgatgacggttatacagataactttgaaaaagcgtacccgattttgaaaggctatgggatgaaggcgacaatttttatgatcggcaaatcggttggcgggaagaaccatttgacggagaaacaaatgaatgaaatgaggcgaaacggcatttcgattcaaagccataccattcatcacgttgaattgaacggactggcaccgggacagcagctcgatgaaatgacgcgttccaaagcgctgtttgatcgcatgttcagccaaaatacggtgatgctgagctatccggtcgggcgctacaacgaagatacgctgaaactcgcaaagcaggcaggctatcaaatggccgtcacaacagaaccgggagcggcatctagggatcaggggatgtatgcgctccaccgcgtccgaatctcgccggggatgtcgccggacgcctttgggaaaatggtggaacacagcagacaatag

SEQ ID NO: 3979 - DNA, 630 bp, Bacillus licheniformis
atgaacggccgattggttgcgttggaaaatccgggatatgatggtgtgcgttctgttttccttaaccatggatgtgatattcagccaattggtctggagacggatgggatcaatttgacacagcttgctgcaacacgggcgaaactcgtttatattacgccatcgcatcagtttccgtatggaatggttctgccgatacagaagaggctgaaattgcttgaatgggcaagccgtgagaaggcctatattatcgaagacgactatgacagcgaattccgctatcagggcaggcctattccatctttaaaagcgcttgataaaaaagaaaatgtcatttatttagggactttttcaaagtcatttcttccgggagcgagattgagttatatcgttctgccttcaaaactggcggatgaatttcaagagaagcttggccgctacagccagtctgcttcacccatcattcaaaaagcgatgtttttatttaggaaagaagggtttttcgaaaggcacatccgtaaaatgaaaaaagtatatcaagaaaagcacaaaacattaatatcggccattaaaacgcatttcggaaatgacgtggaatcatcggcgaaaaagcggggctccatattttga

SEQ ID NO: 3980 - DNA, 2259 bp, Bacillus licheniformis
atggaatttattttacactactatcccgcggcaatgattgctctgattctcatcggtttttggggatcgcgggtgaattcgcgttttaagaagtttttaatcatactgtgtcttatgacgaacggtgtgtatattgtatggcggttcggctttacgctgcccgtctctcgccccgccgatatcgtgatgggcgtcatcctgattgcaactgaatgtatcggctttttacagctcttggtcttttatacgctagtatggaaggaaaagaagcgggagccggaaaagctgggcgatcaagaccatcggccgagcgttgatattctcattgcaacttataacgaggagcgccatgtgctgaaaaagtcggtggcaggctgtctgaacctcgactatccaaaagagcttgtcaacatttatttgtgtgatgacggaaggcggacggctattcaaaagctggctgaggaacttggcgttcattacgttacaaggcaaaacaatgagcatgcaaaagcggggaatttaaaccatgcgatgagctgctcaaacggggaactgattgtgacgatggatgccgatatggttccgctcccttcatttttgcagaaaaccgtcggctattttaagaaggaaaaagtggcttttgttcaaacgccgcaggctttctataatgaagatccttatcagtacaacttattttccggagcgaacattccgaatgagcaggactttttcatgcgcaggctccaggctgggaaagaccgttttaatgctgtcatgtacgtcggcagcaatacggttttcagaagaacggctttggaggaaatcggcggttttgcgacaggtgtgattacggaggatatggcaacagggatgcttttgcaaacaaaatttaaatctgttttcgtcaaagaagtgcttgcggtcggtctctcgccggaaacgtggatggatcttttgaaacagcgcgaccgctggtgcaggggaaacattcagtgcggaaagaagtggaatccgcttttcttaaaaggcttgacgcccatgcagcgaatcctttattttgacggcattctcttttggtttttcggcgtttttaagatggtatacatcctcgcgccgctcatgtttttgctgtttggcatacatagcttaaagactgatctgtggtcgatcacttcgttttggctgcctgcgtttttaggttcttacctttcatttaaagccgtttcggaccggcagcgcagtatgaactggagccatatttacgatacatcgatggcgccgcacatggcgatatcggccttgtcggaattcattttcaaaaagcggtttgattttaaagtcacaccgaaaggcgtcaacacagatcggcgaaaattcaaatatacaacggcgctgccgtgtgcgattttgctcgcaatgacgctgcttgcactcggaaaaaccctttatgaattgttgtttcttcatacgtttgatataaacgtcacttcgtataatttattttgggttctctataacatgacagggctcatacttgcgctgctcgttgcctttgacaggccgaggttccgaagctctgagcgtttcacagtcaacaagccggcggctttttccaccgtttcagtagatgagcacaaatgtgaactgatcgatgtgagcgacacgggcgcgcgtatcagactgccttatacggctgattcggatatgtactatcatgtagacggtctgatcatagatgcggtcggaaaagtcccggcccgggtgatgtggacgacgaaggacgaggccgacattgaaatcgggctgcacttcaaagagatggacaaggaactgtatgtgaaactgatcggttttatgtttaatgaagaaaatgcaaaaaaggccgaccgggaaaagcgggctgatacgttgtcaacagtgatacgctttttaacgaaaactgaaaaaagccctgatgcattcaagagaaaatacgtgcgcgaggcctttcaaggtctgggaacactgctgtttccccgtgattcagagaaaggggctcacgaggttatgattaaggatatcagcttgtcaggctgtcagattgaatccggcttcccgcttgaaatcaatgaacatgtgctggtttctatcaatgagaaggacccggatcagcggctggcgctcgtctgctggataaagaagcggagaaagcgatacacagcgggattgaaatttttagatgaacatgcatcaaaatcaatgggagacccggtagcataa

SEQ ID NO: 3981 - DNA, 1353 bp, Bacillus licheniformis
atggaagcaaaaacaaaggtacaacatataccgattcaaacaacaaaagaacaggatgaaaatttttttgcaagagcaatgaatgttaaaatcggcatcattccgctgcccgtatatttgctgctcttcgctttgattgtgacgtttgtctatatgcacgatctgaaaagcgacattttaacagccattgcggttacgggctttttcggattcaccttcgcccaaatcggaaagtcgctgccgcttcttcgttctgtcggcggtgccgctatacttgcgacgtttattccttcagctatcgtctattaccatctcattcccgatgacattatcaaatcaacaactgaatttacagaaaactcaaactttctttatttgttcatctctgccattgtagtcggaagcattttaggaatgaaaagagaaacgctggtcagggcgttcattaaaatttttattcctctgattgcagggaccattgctgcagcggcagtcggtctggcggtcggtacaatgctcggcctcggatttcagcatacgctgctgtacattgtaattccgatcatggccggaggggttggcgagggagctattccgctgtccatcggctattcggaaatcatgcacatgtcacaaggggaagcttttgcacttgtcattccttccataatgttcggaagcttaagcgccgtcattttgtccggaattttaaatgtaatcgggaagaaaaagcctgaattgacaggcaacggaaaagttgaccgttttgatagcggggacgcacagccgctcgaaagccgcgacaaagacaaagaaagcctttttaatctttcccactttgcgtcaggaggcattctcgccgtctcattatatttggtcggtatgctttcacatgacttgttcggatttccagcacccgtcatgatgcttctgctggctgttgccctgaaactgtttcgtctggctccggcgaatttggaaaacggcgcctacggcgtgtcgcgcttcttttcaactgctgtgacatatccgctgctttttgccattggcgtctccatgacaccgtgggacaagctgatcgcagcttttaatatcgccaatattattacgatcgtatccgtcgtggtcacgatgatagccgtcggcttttttgcagggaagtggctgaatatgtacccgatcgaaaccgcgatcatcaatgcttgccattccggccagggaggcaccggcgacatcgcaattctcagcgccgcagagcgcctcgagcttatgccgtttgcccaggtgtccacaagaatcggcggagcgataaccgttacgctgacgctgctgctgctagcccagttttattga

SEQ ID NO: 3982 - DNA, 861 bp, Bacillus licheniformis
gtgtcagctttattcaaaaaattgatgttatcttcattgatcggggtttccatcgggtcagcgctgtttgcaccgaatgcgggtgcacaagagccggcggtgaagcctaaaaaagtggatgtcattgcacacagaggcgcttcgggatatgcgccggaaaacacgatggctgcttttgataaagcgcttcagatgaaagcagattatatcgagctggatgttcaaatgtccaaagacggggagcttgtcatcattcacgatacgaccgtaaaccgtacgacagatattgactcagtgctgccggttgccgtaaaggatttgacgcttgccgagctgcgcaagcttgatgccggcagcttcttcggtccgcagttcgcaggagagcgcattccgacatttgaagaagtgcttgaccggtataaagggaaggtcggaatgctgatcgaattgaaagagcctgcacgctatccgggaatcgaaggaaaagtgtcagcagcattgaaagagcggagaatggataagcctaaaaacggaaaaatcattgtacaatcgtttgattttaactctgtctataaaattcatcagctgcttccatcgatgccgacaggtgtcttgacgtcaaaagcggcggacttaacagatgcaaagcttaaggaattttccggctatgccaaatacgtgaacgccaacttgaaaaatgtggccgctgatcctacgcttgtgccgagaattcatgcgctcggcatgaagattacgccttggaccgtccgctcccgcgatgaagtgcctccgctattaaaggccggcgtggacgggattgtgacagactttcccgactatgttccgaaaaaagtacggtag

SEQ ID NO: 3983 - DNA, 270 bp, Bacillus licheniformis
atgaaaaaaatagcagcgggtcttttgtctgccggtctgatcatcggtttttcctggggcgccggcgatgtggcagaagcaaaaacgaaggtaaagacgtacaaaaactgcaaagctttaaacaaagactataaaggcggcgtcgcccgtacgaaatcggtgaaaaacaaaggcggaaaaacgaagtacaagccgtatgtttcaaaagcgctttatgatgccaataagaagctggaccgcgataaagacaaaattgcctgtgagcgctga

SEQ ID NO: 3984 - DNA, 660 bp, Bacillus licheniformis
atgaaagaggatgtgagagcgttgaccaaatctcagtatttctttaaattgcatcctttgatggtgccggccggctggaaggtgaaggaaaatcatttgtatcaaaagccgattcgcgacccccgccatacgctattgatcttggagaatgaaagctgcggtaaaatggtacaagttgaatatgctggagaactgaagtacgtcatcaggatgcaaaatgctgatcaatcgaaggtcagcgaagattctgacgcgccgtatgaacagctgatcgaacggttggaagacttgatgcgtgcctctgatggcgcccgcaatttgctaaggcttagaatcccggccggctggacagttgcgcatcactctttaactgatacaaaccccgatgaactagcgcctgacagcaaggcttggctgtctgacttcaaacgggaccttttgaagctgcggcatgatgaagaacgccttctgctcgatgtagagtggtatcccgagtgcagtccggcaggccattatgcgctgaaattgataaagaacgggaactgggacagccctttggaagacatgctgtgcatccatccgaaggaattagcgtatgagattaacgctgttttgaaaaagacttgcgaacatcaatatgtggatgaaaccggcgcataa

SEQ ID NO: 3985 - DNA, 1920 bp, Bacillus licheniformis
atgaaaaaaatattctctcataagctaagcttttttgtattagctgttgtttttgtatgggctaaaacctatgcttcctactttttagagtttaatttaggtgtgaaagggtctacgcagcacatgctgctgttcatcaacccattgagcttcacgattgctgcactcggtttggctttgtttgcaaaaggccgccggtcggcgatatggatcatcatcattgatgctgtgatgacgtttgctttatatgcaaatgtcctgttttaccgtttctttgatgactttttgacgtttgcaaacttaaaacaagccggaaacctcggcaatatgtctgacggcgtttttgacatcatggcatttcatgacatcgtctatttcgcagatttgatcattttgattgctctatgtgtgaagctgcctgaactgaaggcgtcacaactgaaaaaaagatgggctgctgccgttgttctcggcggagtggctctgtttttcatcaaccttgcagttgccgagacagaccgtccggagcttttgacaagaacatttgaccgaaattacatcgtcaagtatttggggccttacaattacatgatctatgatggtgttcaggccgctcaaaacgcgagccaaaaggcatacgcgagcagcgacgacctgacgagcgtcatcaactatacaaattcgcattatgcgaaaccgaatgacgagtatttcggcgcagcaaaaggtaagaacatcatcaagattcatttggaaagcttccagacgtttttgatcgattataagctgaacggaaaagaagtcacgccgttcttgaacaagctggcgcacggccaggatgacatgatgtatttcgataactttttccatcagaccggccaaggtaaaacagcggatgccgaattgatgatggacaacagcctttacggacttcctgaaggcagtgcgtttgtaacaaaagggcaaaatacgtaccagtccctgccggcgattctgaaccaaaaagaaggctacacaagcgccgtgctgcacggggactacaagtcattctggaaccgcgaccaggtgtataaacaaattggctatgacaaattctttgacgccagcacatatgatatgtcagaggataatctcgtcaaccttggcttgaaagacaagccgttctttgaagaatcaattccgaagctgaaatcgctcaagcagccgttctatgcgcatttaatctcgttgacaaaccactatccgttcattttggatgaagaggatgccacccttgaaaagggaacaacgggagacaaaacggtagacggttacttccagacggcgcgctatcttgacgaagcgcttgaagatttctttaaagagctgaaaaaagcgggattatttgatgattctgttatagtgatctatggtgaccacaacggaatctcagagaatcacaaccgtgcgatgaaagaagtattaggtaaagagattacaccgtatcaaaacgcgatgaatcagcgcgtaccgcttatgatccgcattccgggcaaaaaaggcggagtcaaccatacgtatggcggtgaaatggatgtcatgccgacacttcttcacctgcaaggtattgacagcaaaaaatacatcaactttggtacagacctcttttctaaagaccacgaccaaaccgtggctttcagaaatggaaactatgtaacgccgaagtacacgatgattgatacgaccgtatatgatacaaagacaggaaaagagatcaagggcaaccaagagacggaaaacctgaaatcgcaggtgtccgaacagctggatctgtccgaccaagtactctataaagatctgttgagattccacgagatttcagacttcaagcctgttgatccatcaaaatatcattacggaaaagaaaaaaccggagaataa

SEQ ID NO: 3986 - DNA, 558 bp, Bacillus licheniformis
ttggaacaggaaaaaaagcagacatttgatgtgaaaagcagaatgtcctttagagtatgggtttttgcagggactgcaggtttcggattgattggagcatggctcttttatgaagcaataaaactcgaatcaaaatattccttgctgtacgtgggagttggaactttcggggtcatctacggtttgatgacctttctaatggtttttccggccttcacgaaaaaaggaaacatcatcttcaccattatcgagggagaagacgggcggatattctcagggaagaaatctgtgttgttcaaggacatcaaaagccttaaaatggcggagcgccgctacagcccgaaaggcattttcttgatggatatactgatagagacacgggggaacggcagggtgcggattccgacgtacaacattctgcctgagccggaattttataaagcggtcgagctgtacatcctgccgtatatgacggaggaagcgcgtgcggaatggatcggtcagtttacagaagcgcaaagaaaggcttatttaaatgaatttcataaagatatttaa

SEQ ID NO: 3987 - DNA, 837 bp, Bacillus licheniformis
atgaaaaagaaagcaatggacataatattgatcattataggcgcatttttctttgcgttagccgtgaatctgttcgccatcccgaatgacttgggagaaggcggcgtcacggggatcacgctgattttatactacgtttttgaatggtctccgggcatcacaaactttgtactgaacggcattcttctgattatcggctatcgctttttggataaaaagacgacgatttacactattattgcggtggcggccaattcgttctttctgcacgtcaccgaagattggacggtgccggccgatgaagtgatcatcagcaccatctttgccggggtatttgccggcgtcggaatcggcatgatcatccgtgtcggcggaaccaccgccgggtctgcgattctcgcgagaatcgccaataaatattttgactggaacatcagctatgccttgctgatgatcgatttagttgtcgtcttcagttcctactttatcattggagctgaaaagctgatgtttacgattgtcatgctgtacatcgccacgaaggtcatggacttcattatcgaagggctcaacacgaaaaaggcgatcacgattatttccgagcataaaaacgagatcgcggcgcaggtcaataccctgatggaccgcggcgtcacgatattatcgggacgcgggcactatacgggcgactccaaagaaattttatacattgtcattaataaacaagagctgtccatgctgaagaaaattattagaagcacagataaaaaagcatttgtcatcatccacgatgtcagggatgtattcggcgagggatttgttgatatttcaaaatag

SEQ ID NO: 3988 - DNA, 465 bp, Bacillus licheniformis
gtgttttgcctgggaggcgctcttatgaacaaacaaaaacggcaatggctcatcaagcagaccattctcgaacatccggtagaaaatcaggaacagctggcatccctgctggaaaaacgcggcatcaccgtttcgcagtctaccatttcccgcgatattaaagaaatgtatcttgtgaaacagcccggtgaaaacggaaaacttgtctacacgacaaatgcttctttatccatcaatccttccaaaatattaaaagataaaatctctgacgttgtcctgcatgtgcatcgaacggacaacttgatcattattaaaacaatgcccggcaacgcccatgccatcggcgttcttcttgataagctcggaagcccggaaatgctgggctgtatatgcgggaacgatacatgccttgtgatttcccagtcacctgaggcagcccaatcattttatgaccatttatgctga

SEQ ID NO: 3989 - DNA, 1236 bp, Bacillus licheniformis
atgacaacaccgatacacgtttactcagaaatcggccctttaaaaaccgttatgctgaagcggcccggtcgggaactggaaaaccttacacccgaatatctggaaaggcttctctttgacgatattccctttttgccagcggtgcaaaaagagcatgaccaatttgcagaaacattaaagcaacagggggctgaagttctttatttagaaaagctgacggccgaagctttggatgacgcattagtccgcgagcagtttatcgatgagcttttaacggaaagcaaagcggatatcaacggcgcatacgacaggctgaaagagtttttgcttacctttgacgccgattcaatggttgaacaggtgatgagcggcattcgaaaaaatgagcttgaacgcgaaaaaaaatcgcatcttcatgagctgatggaagaccattatccattttatctcgatccgatgccgaacctttatttcacaagagatccggcggccgccatcggcagcggactgaccatcaacaaaatgaaggagcctgcccgccgaagggaatcgctgtttatgcgctacattatcaatcaccacccgcgttttaaaggacacgagattccggtttggctcgaccgtgatttcaaattcaatatcgaaggcggagatgagcttgtcttaaatgaagaaaccgttgcgatcggggtatcggaacggacaacggctcaggcgatcgagcgtcttgtccggaacttgtttcagcggcagagccggattcgccgtgtactggccgtcgaaataccaaagagcagagcctttatgcatttagataccgtcttcacgatggttgaccgagatcaattcacgatccatcccgccatccaggggcctgaaggagacatgcggatcttcgttcttgaaagaggaaaaacggcagacgagattcatacaactgaagaacacaatttgccggaagtgctgaagagaacgctcggcctttcagatgtcaacttgatcttctgcggcggcggagacgaaattgcttcagccagggagcaatggaatgacggctccaatacactcgcgatcgctccgggggttgtcgtcacctatgaccggaattacatttctaacgaatgtttgagagaacagggcattaaggtaatcgaaatcccgagcggggagctttcaagaggacgcggcggcccgcgctgcatgagcatgccgctctaccgagaagatgtgaaataa

SEQ ID NO: 3990 - DNA, 1008 bp, Bacillus licheniformis
atgaaccaaacgattaatttaaaaggcagaagctacttagctgaaaaagatttttcagaagaagaaatcctctatttgctcgatctggcccagaaactaaaagaaaaaaaagcacaaggcatcaggcatcgctatttggaaggcaaaaacatcgctttgctgtttgaaaagccttctacaagaacgcgctgcgcttttacgacagcctgtatcgacctcggtgcgcatcccgaatatttgggcaaagacgacattcagctcggcaaaaaagagtcgatcgaagacacggccaaagttctcggccgcatgttcgacggaattgaattccgcggatttgaacacgaaaaagtgatctcactggcagagcattccggtgtgccggtatggaacgggctgaccgatttatggcatccgacgcagatgcttgcggactttatgactgtgaaagaacatacgggacgcgtaaaaggcgtcaagctcacctatatcggcgacggccggaacaatgtcgccaacagcctgctcatcggcggcgcaaaagtcggcatggacgtaagaatctgttcgcctcaagagcttttccctgatcaggacatagttaaaatggcggaagcgttcgctgaagaatccggcggaaaaatcaccgttacaagcgatacagataaagccgtgtccggagccgacgttctgtatacggacgtctgggtatccatgggggaagaagacaagtttgcagaaagaatcaaactgctcaagccttatcaagtgaatatggatctcgtcaagaaaacaggcaacgacaacgtcatcttcctgcactgtctgcctgccttccacgaccttcatacaacctacggacaaaatgtttacgaacagcacggccttaaagaaatggaagtgacggacgaagtgttccgcagcaaacactctaaagtgttcgatgaagctgaaaaccgcatgcacacgattaaagctgtcatggcagcgacgctcggcgatcttgactga

SEQ ID NO: 3991 - DNA, 1407 bp, Bacillus licheniformis
atggcggaagaaaaaaaacttgggctgtttgcgctcatcgcgcttgtcatcggatcgatgatcggcgggggcgccttcaaccttgcaagcgacatggcttcaggggcgggggcgggagccattttaatcggctggatcatcaccggagtcggcatgattgccctggcattctctttccaaaacttgacgacgaaaaggcctgatttagacggcggtattttcacttatgcccgggaaggattcggccatttcatgggctttaacagcggctgggggtactggttcgcagcccttctcggcaatgtcgcatatggaacgctgctgttcagcgcaatcggatatttcatccctgcgtttggagacggacaaaacatcgcatcaattatcggtgcaagcgtgatcctctggtgcgtgcactttttgatcctccgcggtgttcagtccgctgccatgatcaacttaattacgaccatttcaaaacttgtaccgattttcgctttcattatcgccattatctttgtgtttcatcttgatttatttacgaacgatttctggggaaaagggctgtcgctcggttccatcggaacacaggtcaagagcacgatgctggtgaccgtctgggtgtttaccggaattgaaggggccgtcttattttcaagccgggccaagaaatcaagcgatgttggcaaagctactgtcatcggcttgatcagcgtactcgtgatttacgtcatgattacgatgctgtcgctcggcgtcatgaatcagcaaaacttggccgagcttccgaatccttcaatggccgcgatcatggagcatatcgtcggcaaatggggagccgtgctcatcaacctgggattgatcatttccgtattgggcgcctggctggcctggacattattcgcgggcgaactcccgctgatcgcggcacgcgaaggggtcttcccgaaatggttcggcaaagaaaataaaaacggtgcgccgacaaatgcgctgactttgacaaacgccattatccagctgtttttgctgacgtttctcatttcagatgcggcctaccagtttgcattttccttggcttcctcggccatcttgatcccgtatctgttttccgggctttatcagcttaaatacagctggctgcacaaagagcctaaccggggcaaaaatctcatcatcggcatcatcgcaagcatatacggcgtctggctcgtatatgccgcgggacttgattacctgcttttgaccatgattttatacgctcccggcattctcgtattccgggctgtgcgcaaaggaaaagaaggcccagtcttcaataaagccgagcttttgattgccgccctgattcttgtattggccgtgatcgccgtgatcagactggcttcgggaagcatttcaatttaa

SEQ ID NO: 3992 - DNA, 951 bp, Bacillus licheniformis
atgaaaaaaagaaaaattgtcgtcgcacttggcggtaatgccattcaaaccggagatgccagcgcagaagcgcaaaagcgcgcgcttgaagaaaccgccatgtatttggcggatatgatcgacagcggcgctgaattaatcatcacgcacggaaacggcccgcaggtcggaaacctgatgatccagcaaaaggaggcggattctccgaaaacgccggccatgccgcttgaaacctgtgtttcgatgacccagggaatgatcggctattggctgcaaaatgcccttgaccgggcgcttcacgcaaaagggaaaggcggacatgcggcaaccgtcatcacccgcgtcgccgttcgaagcgatgatgaagcgttccgcaacccgacaaagccgatcggtccattttacagcgaagaagaagcgaaagaactgatgaacagccgaaacggcggcctcgtttttaaagaagatgccggaagaggctggcgccgcgtcgtaccgtctccggccccggtatcgattcttgaacacgatgttatcaatgatcttgtcgaacacggacatatcgtcattgcagccggcggcggaggcgttcccgtcatcgaaaacggcgatgccgtctccggtattgacgccgtcatcgacaaagactttgcagcctgcaaactggcggagcttgtgcaggctgacgaactggtcattctaacaggtgtcgactatgttgccgtcgattatttaaagccgacagaacgtgcgctgaaacgcgtcaccaccgaagaactgaaaggttatataaaagaaaagcaatttgcagaaggaagcatgctgccaaaagtcaaagcagccattcagtttgctgaagctaaaaaaggcaacaaaacggtcatcacatccctgaaattagccaaagacgctctccaaggaaatgccggcacgattgtcgtccaagcctaa

SEQ ID NO: 3993 - DNA, 678 bp, Bacillus licheniformis
atgaagaacaaagacatcgtacatcagctgaaaaagtttcctcttctcgcttccctgaataaaagagatctggaagatatgaaacagtttatctattggcgctcttaccataaaggccagatattatttatggaagacgacccccgggaacgaatgtaccttcttctcgacggctttatcaaactcgaaaaatcaaacgaagccggatccatgttttataccgactatgtacgtcctcataccctctttccatttggaggcttgtttcgggatgagcattatcactatgccgccgaagccttaacagatattgaactctactatatacccatgaacatcttcgaagatctcgtccgggacaacaaaaacctgctttacgatattctcaatcatttatcagacatccttgcccttcacgaggaaaggctgaagcgcatcacactctcccatgcccacgacagggttacacaagccatttattatttaaccgaaagcctcggtcaaaaagaaagcaactcaaccgtcatcaactgtccgatcaccgctgccgaaatcgccaaaatctcggggacatcccgcgaaaccgtcagcgccgtcctgaaaaagctccgctgcgaaggcgttatcagtcaaatgaacaagcagatcatgatcaatcggccggaatattttatgtag

SEQ ID NO: 3994 - DNA, 1437 bp, Bacillus licheniformis
atggccagacaaacgtggaagattcccgacgattttattctcggcgcagcagcgtcggcgtggcagacagaggggtgggacgggaagcggccgacacaggattcctatttggatatgtggtacaaaaatgatcctgatgtatggcatgacggatacggaccggctgtggcaaccgatttttataaccgctacaaagaagatattcaatatatgaaagacatcgggctaacccactaccggacatccattaactggtcgcggtttcttttggattatgaaaccgccgaagttgacgaggtgtatgcaggctacattgatgacgtcatcgatgagctgaagagatgcggagtagaaccgatgctttgtcttgagcactacgaaatcccgactgtcctgctggaacagtatggcggatggggatcaaaacacgtggttggcttatttgcggcttatgcagaaaaagcgtttgaacggtatggggacagggtgaaatactggtttacctttaatgaaccgatcgtgccgcaaacacggatctaccttgacgcacttcgctatccgtacgagcagaacacgaaaaaatggatgcagtggaactaccataaagcactggcgacagcaaaggccgtggcaattttccggaaaaggaagcccagttttagagaaggcgcaaaaatcggcgtcatcttaaatcctgaggtcgcgtatgcgaggtcaagcgcgccccatgatcagaaagcggcccaagtttatgatttgttttttaacagggtttttttagatccgagcataaaaggcgtctatcccgatgaattgatggagctcatggccaaacacgacatcctttttgaccatgatgaagaagagctttccgtcatcaagcggaatacggtcgattttgtcggtgtgaacctgtattatccgaagagagttcaagcgccttcaaggcaatggaatgaatcgacgccttttcatcctgcttattactatgagccctttgagctgccaggcagaaagatgaatccgttcagaggctgggagatctgcccgcgcattgtgtacgatatggctatgagacttaaatatgagtatggaaatatcgaatggctgattgctgaaaacggcatgggcgtcgaacatgaagagcgttttaaaaatgaagagggggtcattcaggacgactacagaatcgattttatttcagcccatttgcgagaggcgatgaaagggatcgccgacggcgcaaactgcaaaggatatatgctttgggcattcacggacaacgtctctccgatgaacgcctttaaaaaccgctacggccttgtcgagattcgattggagaacaaccgcagcagggcgctgaaaaaatcggcttgcttttatcgggatatcatcaaaaacagacggtttgaaacagaggaattccggtataaataa

SEQ ID NO: 3995 - DNA, 1320 bp, Bacillus licheniformis
atgagcaggatggcgaaggtgactgagatgtttgagcgggtcgcttttaaaattacaagtttcaaatatatcatggtcattaagtcggcgtttgtcacactgatgccggtcatcattgccggggcgtttgcggttttgatgcagaatatggtgatgagccccgagacgggacttgcggttttcaggccttttcggttcttgtctgcgcttgagccgattatggcgtcaatcaattatgcgacgctgaactttattacgatcggcgcggtgtttttgatcgggattgagctcgggaagctgaatgggcatgaatcgttttttcccggcttgatggcgctcatgtcctatatctctgtcattccatcggcggtgctgttggaagtgaacggttcgatgcaggaagtggttaacgtgctggccaaggaatttacggatccgaagtcgctgtttttggggatgtttatttcgattgtgtctgttgaaatcttcagcaagctgtcaagcatggaccggctcaagattaaaatgccggacagcgtgccggcaaatgtctctgtatcattcggcactttatttccttcgattattaccgtcacgatcatcgccagcttcggatttgcgtttcatcggctgacgggggtatatcttcatgaagccgtgtacaatgtcgtgcaaaagccgcttgagggcgcgattcaaggtcttcccggcattctcttgctggtgtttgtcgcacagtttttctgggtgatcggcatacatggaaaccagatggtgaagccgatcagggagcctttgctgctcgcttcgattaccgtcaatatgaatgcatacgcagccggcgaatcgattccgaatatcattacgatgccgttttgggatgtgtacatgagcatcggcggatccggcgtcacaatcggtctgttgatcgcgatgtttatcgcggggaaacgggaggatttgcgcagcattacaaagatttcgtttggtcccggcatcttcaatatcaatgaaccggtcatctttggggttcccgtcatgctgaatccgttaatggcgattccatttattgtgacgccgcttgtgacgggtgcgatcggttacatcgcgacagcggcgggctttgccggaaaagccgttgtcatggtgccgtggacgacaccgccgattatcaatgcctggctgtcaacaggaggaagcctcggtgccgtcgtcacacaaatcgtatgcatcatcgtctccgtccttatttatcttccgtttgttattttattgaatcggacctttacgattagttctgaaaaaaatgtgtctatgtaa

SEQ ID NO: 3996 - DNA, 1392 bp, Bacillus licheniformis
atggacaaacaacggttcaaaaacgaagtaaacaagatcgatgtccctacaaaagaaatccgcgaatcgattgataaaggcatcaagcgggccaagcgggaaaaaacgtttcggccgaagcgcgccgtgaaaaggactgtttttgtttcgagcgcggccgccgtgctccttctcggtagcggcttcgtttccccagcgatgcaaagcgtgttggctgacgtcccgctgattggaaaagcgtatcaacaattccatgactatgtcggccaaaacttggtggcgggccagcttgtcactgaactgaacgagaaagcgtccagcaacaacatagacgtgacagctacaagcgtttattttgacggcggaatcatcggtatgacgtttaaggtgaaaagcgatacaagaaaagatttagatgatggagcgagaatgattcatttcacattatttaatggcgagcgcaaatgggctatcgcttctcaaggagacttgaagaaaacagaggacggctataccggctacattcaagtaggctatccagacaaacatattcccgataaactgacactcccggttacgatcacaaatattaacggaatcagagggaaatggaagttcgacattccggttgataaactgccgtataaaacgctccacataaccaaaaacaatacacaatcggcggatggccataagctcgccgtaaaaacggtaattctcggaaaagaatcgactgtcatcgactatgaagtatccaattcagaggaacatccgaacgatcgtacatcggttataaaagtgaccgatgataaaggaaatgaaattccttatttgagtggcgggcagtggacgacggacagtacaaagaacggaaacaaggttcgtcacgaagaaaggctgatccttggaaaagtgaataaaggaacaaaacacctcaagattgaggcgagcagcagtatgggcgattccgaaaagacgctgcctctcacaaaaacgcccgccgcgctgagcgctgaccgtcatgacttccagattgccgttgatcaggtgaaacaaaacggaagtaaattgtctgtcgactatcatctgaaacatgtcgatcaatctaagattgatattgacagcatgcaaaactttttagaaacgatgtcactggttgattctgcttataaaagcattgacgaagcgccgatgggacacagcgtaaaaggtaattttacaaaagtgcttgatcctaaaaagctccgattccgatcagactttacgttagatggtgaatttggagcgaaaaacttcagccttgaccgatattcgcttgatgtcgaatttggttatttaagcgcattttattctacaccgtttaagccgatcaaagtgcagttgccacagtaa

SEQ ID NO: 3997 - DNA, 549 bp, Bacillus licheniformis
gtgaagcaaatcagattagttaagaaagctgtcgcaggcaacgccaaagcttttgaaatgctgtttcaaaagcacagcgaacagctttacagaacagcttacatatatgtgcgaaataaggaggacgcgttagatatcgtacaggaaacggcgtacaaggcatttttatcgattgcccagttgaggaatcccgaatactttttgacatggctgacgaaaatcctcattcatcatgcatatgccatattggacaagaaaaagaaagtggttttaatggacaggccgctgcaggacgaaggccgggagcaggagatgcatgcggacgacagaatagggatgcttgaagctgttcagcagttgcgaaaagaatatcaaaccgccatcattttattttattatcacgacctgccgattcatgatatcgccgaggtgatgaatgctcctgaaggaaccgttaagacctatctgaaaagagcgaagcttgaattaaaacaactactgactgggggagaagacgcatggacaaacaacggttcaaaaacgaagtaa

SEQ ID NO: 3998 - DNA, 630 bp, Bacillus licheniformis
atgaaaatacgaatccatcgttttttgccgcttactgaagcagaaggacccggtaaacgggcgtgtttatgggtgcagggatgttcggtacgctgcgaaggctgcggagtaccgtggacatggtctgacaagggtggaaaagacatcagtgtagacgacctctttaaaaagattgttgattcaaaaaaagaaaacaatattgaaggtgtaacatttcttggtggtgagccaatggatcaagcggaagcccttgcagaacttgcggataaaataaaaattgctggactttctattttgacctttagcggcagatacttggaagatataaagtcgaatccacgaaagggccagctagagttacttgaattgactgatttgttcattgatggtcctttcgaaaaagaaaatatagatttaagccggccatggacaggttcctctaatcaacgatatcattttttgactgagagatatcgttatcttgaaggtcagcttcaatcaatttcaaataaaatagaagttcggttagaacccgatggcacagtttcaatcaacggaatgattcgtcaagaacaattgcaaagtttatacgaagaattatctaaacataaagtttccaacagaaactaa

SEQ ID NO: 3999 - DNA, 666 bp, Bacillus licheniformis
atggctaatggatataccaataagggagtgaaatgggagctgtttcaatccatatgggtcctatttgtatttactccttttggctttttaaattgggtttcttttttctatattttcgctcgggcaaaacaaaaaaaatggttaattgccggatggatctattttgctatttttttattcactattctttctaatggaacacctttattcaatgcggccatggttcttttgatcatcggctggggtgtctcaattgttcacgctttaaaagtgcggccggagtttttaattcggttagagtccattcaacagttgaaacgcgctgaaatagatcagctgcgtaaatctctgaaaaatgagtatccagagaccgccgcggctcgaacgagccaaaccgataaacaatcggaacggaaaatagacattaatcaagcgagtgtggaagacatcgcttcgattccgcagttgggaattatcctcgccaaaaaagcggtcgccatgcgtgaagaaatcggtggcttttcatctattgatcatttcggcgaacagttaggattgaagccgcatgtgcttttgaaggtagagccgtatctctcattctctaaaccagttgaccgaagggatagaaaagatgagaatgctgaaggaagggttttggatatttaa

SEQ ID NO: 4000 - DNA, 219 bp, Bacillus licheniformis
atgagtcagcgaattattgttgaaattcagcaggatggtcaaattaatgtggaaacaaaagggattaaaggaccgaaatgccgagattatattcgagttctggaacagctgcttgaggctgaaacgattgattcatcatatacggcggaatactttgagacggaacaggttgatgttttgaggcatcagcaaattataagggggcaccgtaatggctaa

SEQ ID NO: 4001 - DNA, 444 bp, Bacillus licheniformis
atgagtattgaaattgttttattaccagttgcgattgcagcgacccaagcgattgcatcctatttggcagaaaacgaatcaggccgtctttatacaatgcctaccgttatgaaggatgaagaccttctcaaaaaagcgcttgaccaaaatggatgtaagacgatcgagcttggaacaacaaacgtcgaagcaatcatggaagattcagctgtaactttccatttgacagaagaaggcacctttaaagctgcatttgatcgttcagttgataaaaaccaggcgcgggaatttattgatcaaattgaagaggagtacaaacggatattgcagcaggaaacatatttgaaacttatagaaaaggccgaacatgaaggattggttttagaaaatgaaacggtgacaaatgagaattcggtggtattgacgttcaaggtgaatggataa

SEQ ID NO: 4002 - DNA, 1665 bp, Bacillus licheniformis
atggaaggatatcatcactttagaaaagaagtagcgaattatttcagggcccgctttccgttcctgtatatttctacatgggaagaagaacgtgtcatagatcaactgagtcatattgtttcggatacagaattgattagaacaccaagaaccttatttgtttggagtttaaccaaagggtttgaaagcaatggaatgcctccatcagccgaaacaaaagacccgttaaaggctttggcgttcattgaaaaatatgatcagccagcagtctttatattgaaggatttttatgtttatttgggtgcaaataatcgcccccctgaataccgtttgattcgtaaaatgaaagatcttgtctctgtattggaaaagagtcttgtttccaaaaatgttgtgcttgtggcgccaacattaacgcttcctcctgaattggaaaaggacatcacaattgtagagtttcaattgcccagctttgcagaaattaaagaaacgctcaagaaaatgatcgaaatgaatcaagggcaaaatcgggcaatcgttagcttgactgaggacgaagaagaacgcctagtaaaagcagcactgggattaactttaaaagaagcagaaaatgcgtttgcactggcgctagtaagcaaagggcgtctagattcggatagcgttgatcaaattctttttgaaaagcagcaaatcattaaaaaaaccggcgtattagagtttattaaaagtgaaccaaatatccaggatgtaggtggattggaaaatatcaaacgttggttgaataaaagaaacaagtcatggatggactccgctcaggactatgggctgccatcccctaagggtcttctattaacgggggttcccggctgcggaaaaagcttaattgctaaagctgtcagctctatgtggaagcttcctcttttaaaattggacatgggaaaaatattcagcggcattgtcggaagcagtgaagaaaatatgagaaacgctttatctacggcagaggccatttctccgtctattttgtgggtcgatgagattgaaaaaggattggggaatagcggaacagctggagacggggggacttcgaagagagtgcttgggaatttcttaacctggatgcaggaaaaatcaaagcctgtatttgtgatagcaactgcaaataatatagacgctcttccgcccgaattcttaaggaaaggacgttttgatgagatattttttgttgatctgccaacgaaaaaagaaagaaaagaaatctttcgcatccatcttgaaaagaggctaacaaacccgaaagctgccgggaatttttcaatagaaccacctgtcttggacaagcttgcagaactgacggaatcatttattggtgctgaaatcgaacaagtcgtaatttctgcattatttgaagccttttctgaaaatcgaagcttaacggttgaggatcttgagaaagtgattaagcagactgttcctttggctgttacgcaatcagagcaaattcttgcaattcgggaatgggcaagtcttcgggctgtatcggctgcccgtcaggaagatctgaaggaataccaatctattcagctaaagaaagatgacgaaaatccgcgtgataaagatgccgatttacatacaagccggggtggcagagctgtagagttttag

SEQ ID NO: 4003 - DNA, 1233 bp, Bacillus licheniformis
atgaagaacaaattgattgaacgcctcatttcttatgcgaaagtggatacgcagtcaaatgaaaacagtcagacgacgccttccactcccgggcagctggcgcttgccaatatgcttgtcgaagagctgaaagagatcggcatgaaggacgtcacaatcgatgaaaacggctatgtgatggcgacgcttccttcgaatacagaaaaagaggtgccgacgatcggtttcttggctcatgtggatacagcaacagattttaccggaaagaacgtcaatccgcaggttatcgaacaatacgacggaaaggatattgtgctgaatgaatccctcaatgtcgtcttatcgcccaaggaattccccgagctagcagattatgcgggacatacgttgattacaaccgacggaacgactttgctcggcgccgacaataaagctgggatctctgaaatcatgacggcaatggaatatttaattgcgcaccccgaaatcaaacacgggaagatcagagtcgcttttacacctgatgaagagatcggcagagggccgcacaagtttgacgtcgaggcgttcaatgccaaattcgcgtatacggttgacggcggaccgcttggcgaactgcagtacgaaagcttcaatgccgcagccgcgaaaatcacttgtaaaggaacgaacgtccaccccggcacagcaaaaggaaaaatggtcaatgccgccaaaatcgcgatgcagttccacgccgcattgccggaaaacgaagctcctgaatttacagaaggttatgaaggcttttatcatctgctttcaatcaagggcgatgtttctgaaacgagcctctcttatatcattagagattttgacagagaccgatttaacgagagaaaagacaccgtccaaaaaatcgcaaacaaccttaaagcgaaatacggcgaaaacagcgtcacagtggacatgaatgatcaatattacaacatgagggaaaagatcgaaccggtcaaagagattgtcgacattgcctataaagcgatgaaaaaccttgatattgaaccggtcgttaaaccgatccgcggcggtacagacggctctcagctctcatatatggggcttccttgtccgaacattttcacaggcggggaaaactttcacggaaaatacgagtatatttccgccgacaatatggtaaaagccgcgaatgtcatcgtggaaattgtgaagctgtttgaagaaagagcttaa

SEQ ID NO: 4004 - DNA, 1479 bp, Bacillus licheniformis
atgaacagaattcagcaggcagaagaagcattaaagaaagccgggaaaaaagtgaatcgccgttaccgaatgggctatcacatgatgccccgggcaaactggataaatgatccaaacggacttattcaatataaaggggagtatcatgtcttttatcaacatcatccgtatgatgagaattgggggccgatgcattggggccatttgaagagcaaggatcttattcactgggagcacttgccggttgctttagcgccgggagacgaatttgatgagagcggctgtttctcaggaagcgcagtcgaatataacggcgacctcgctttaatctatactgggcataatatgatagatgaagagaaagacgatttctaccaaactcagaatatagcagtcagcaaagacggtatcgtctttgaaaaactgaaagaaaaccctgttattgcagagccgccggaagacagcgcacgtcactttcgcgatccaaaagtatggaagcatcgtgagaactggtatatggtggtcggaaactcctcaaaagagaacgtcgggcgggtcatcttataccgctcgcctaactttgtagattgggagtacgtaggcgttctcgcccaaagcgacggaaatctcggctttatgtgggaatgtccggatttctttgaactagacggcaaacacattttgctgatttcccctcagggtatagaggctgatggtgaatcatatcaaaatctgtatcaaacaggctatttgattggagactatgatgaagaaacgaatgagtttgtacatggctcctttaaagagttggatcacggccacgacttttatgccgtgcaaactttattggatgacaaaggccgcagaattgcgattggctggatggatatgtgggagtcagagatgccgacgaaagcagacggatggtgcggggcattaactttgccgcgtgaattgacgttgaaggatggtcacaaaattttaatgaatcccgtcgaggagactaaattacttcgtggatcggaacatcatgagtgtgacaatcaatcgatttccggcagctattttataaagacagccgaaaagcttcttgaagtggtggccgtttttgatttgacaatttgcagtgccgaaacggttggcttaaagatccggggaattgaacaggaagaaacaaccatcaagtacagcttgattgatcaaaagctgacgctcgactgttcaaagtccggcaaagcgagggacggtgtgagaaacgtacggcttgaagcggatgagaagctcactttgcatctgtttctcgacagatcgtctattgaagtatttgcaaatcatggtgaagcgacaatgacaagccgcatatatccgaaggaaggaagagcggggattgagctgttttctgagaaaggcaacgtacgggttgaagaattcacttactggacgttgaaagatatttggaaaggtgatgaagccaaatga

SEQ ID NO: 4005 - DNA, 1236 bp, Bacillus licheniformis
atgaaaagctcaaacagtctgtattggaaactaagcgcctattttttctttttcttttttacttggtcttccagctattctttatttgcgatttggttagggcaagaaatcaatttgaacgggtccgcgacgggcattatcttttctgtaaacgctatctttactttgtgcatgcagcctttgtacggttttatctccgataagctcgggctgaagaaaaacatattatttatgatcagtttgctgctcgtatttacgggtcccttttatattttcgtctacggaccgcttttgcaatacaacgtctttcttggggctatcgtcgggggaatttatttgggaactgcttttctcgccggaatcggtgcgattgaaacctttattgaaaaggtcagccgcaaatatcaatttgaatatggaagaacaaggatgtgggggtccctcggctgggctgcggcgacattttttgcaggtcagctgttcaatatcgatccgaatatcaacttctgggttgcgtccgcctcagcaatcatattggtggccattattgtttccgtaaaaattgagatgacagatgatgaaaaggaaagagcagactcggtcggattaaaagacgtaggagggctttttctcttaaaagatttctggtttttgatgctgtacgtgatcggcgtaacatgcgtgtacggcgtctatgaccagcagttcccgctttactacgcttccttatttccgactgcggccttggggaaccaaatatttggataccttaattcattccaagtatttattgaagcgggcatgatgtttcttgcgcctttcatcgtcaataagctcggtcctaaaaaaagcttgattttagcggggctgttaatggctttccggattatcggttccggacttgtcagcggaccggtcggaatttcatcgatgaaactcattcatgctttagaattgccgattatgctgattgcgatgtttaaatatttggcgactaattttgataatcgtctttcatccgtactttatcttgtcggctttcaattcgcatcccaggtaggcacgtcgattttttcgccgcttgcgggaggtttatacgacagcatcggatttcgccacacttatctcatcatgggagcaatggtcctttgttttaccattatttcgatttttaccttgctagactcaaagaaagatgttgaatttgctcaaaatctacaaagcaatcatatatag

SEQ ID NO: 4006 - DNA, 849 bp, Bacillus licheniformis
atgagaaggaaattcggacctttaacgatactggaatatatatgccttgttttgctggcggctctgtttatatttccgctgatttggatggtcgcttcatcgatgaaaccggaagccgatatttacaacaatatcagcagcattaaagcgtttcttccgtcttttcatccgtcggaatggtttcaatcctacagggaagtgctgtcacggtttgatttactaatgtatattggtaacagtctgttttacggtttgtgtgtggcagcgggagcggtcattatcaacggaatggcgggctttgcattcgccaagctgcaattcacaggtaaaaaagtgctgtttaccatattgctggcgcttttaatcgtgccgatggaaacgattttaatctcgcagtttacaattgttcataagctcggacttgttgatacgcgccttgccgtgattttgccggcgcttgcgggggctttcaatatttatttgttccgaaactttttcatggcgatcccgggggagatgattgagtcggccaagctggacggagcaaatacatggcagattttctggcgggtgatgctgccgatgtccaaaccggctgtcgctacggtggggacattggcttttatcggcagctggaatgactatatttggccgctgatggttttgacggataagtcgaaatttccgatccaggtggcgattacagccatcaacagcaccgagccggtttatacgaaccaggtgatggctgtcttgacgatttccacgattccgctgattctgatctacattgtagcccaacgctacattttagatggcctgggcggttcagggacaggcatcaaatag

SEQ ID NO: 4007 - DNA, 939 bp, Bacillus licheniformis
atgaataaaattccgttgaaagaagcaaggacggcctttccgctgaaaaaaatccctgccagtaaaatagggtggcgggacaatgtgctggcctatacatttttaggtccggccttgctgattttgtcagtgtttctcgtgattccttcgattatggcggtttactacgcatttacagattattatttgttaacacctgacctgcgcaagtttgtcggttttgacaactttatcaaattgttcaaagaccctattttcttgaaaagtttgagcaacacattgaaatttgttgtccttgtgattccattacagatcggggccgctctcgggctggcccttctgttgaataaaaagcgcaaggccaatacgtttttcaaagtcgcatactttagccccgtcgtcatgtcgcttgttgtcatctccgttttgtggctgtacttgctgaatccgaatgaaggaatgataaataacgtactgacgcatgtcggtttgccgccacagccgtttttgacaagtcctaatcaggcgatctttacaattgttttcgtttcagtctggcagggagccggatttcagatgctgatttttttagcgggcctgcaaaacattcccggagatgtctacgaggcggcgcaattggatggtatgaataaatggcagcggtttatttatattacattgcctttgttgaaaccgacgtcggtttttatctttattacgacgctgatcagtgcgtttaagctcctcgtgcagccaatggtcatgacccaggggggaccggtcaattcaacgatgacagttgtctattatatttatcaaacgggatttaccgatcggatggtcggctatgcaagttcaattgcgctcttgtttggcacgataattggattggtgacgcttgcgcagcgcaagttggtgaaggaggatgaaggcggatga

SEQ ID NO: 4008 - DNA, 1194 bp, Bacillus licheniformis
atgtgggtgcacgtatctgatgacagtgaagaaggaaaggtctatcaaaagcgggtggacgcttttaataaaaagtatgcctctgaaaacatcgaggccaaaattgatttcatccccagaagcggaaacggcggcggatatgaagacaaagtgaacgcggcgctgacaacgaataccctgccggatgtgatcactttggacggaccgaacacggcggcttatgcgaaatccggcgttattgcgccattggatgagtatatcaaagaccaggatgatttattgccgagcattaagcaacagggaacctaccaggggaaactgtatgcgatcggtgtcagcgaatcatcggtcggtatttactataacaaaaaaatgctgaaggacgccggcgttgacttgaaaacgctgccaacggttgagaatccatggacgtgggacgaattccttgagctttgcaaaaagctgaaaaataaatatgacaaaccggccatcgatatgcagttgcagtcaaaagacgaaatgctgacctatgcgcttttgccatttgtttggtcggctggcggcgatgttctttcaaaagatggcaagaaagcggagggtgtttttaacgacaaactgaccgttgaagcgatgacatttattcaaacaatgctgaaagagggttacacgacccggactccggttaagcaggcgtttgaaacggaaaaatatccgatgaaaatgagcggtgtctggacggtaaccgacatggaaacaaattttcctaatgtcgattatggtgtgatgccgtatcctgtgtcgccaaaaacaaaaaagcttgtgtccccttcaggaagctggcagtttgccatgacacagacgtctgaaaacaaggaatgggcggcaaaattggtcgattggatgacaaacaaggaatccaacttggaattgagccgttcgatcgccgcgctgcctgtgcgctattcatcagagaaagtgctggcaaaagaattctcagatgaaatgaatgtcttcttgcagcagctgaaagaaacggggcatgcacgaccggtgacaccggcatatccacaggtgacgcgcgcatttcagcaagcgatcgatgacatcagcttctttgatcagcatcaggatattcaatcggttctggatacgcgtgcaaaagaaatgcaatcagccatcgataaggcaaactag

SEQ ID NO: 4009 - DNA, 975 bp, Bacillus licheniformis
atgaagcctagcattcacgacgttgcaaaaaaagcgggagtttcaccaacaaccgtatcgcgggtattaaataaccgcggctatattagtgaaaaaacaaaagaaaaagtctataaagcgatggaagaaatcaattactttccaaacgatttggcccgctctttatttcgtaaacgaactcatttaatagggctcatcatccctaactccagcaacccgtttttcggcgaactggcctttcatattgagagcatctgcgctgccatgggctacaaactgctgctttgcaacagcttaaaccgcaaagacaaagaagaaaaatacttggaaatgctgatgcgaaatcaagtggacggcgtcatcgccgtgacttacaacaggggaattttaaattatcatcggcaaaacctgccgattgtcgccatcgaccattacttgtcggaaacgattcccgtcatcggctctgataactatgacggaggaagaaaagcgacagaactgttaattgcaaaaggctgccggcacatcatccatatcaacggaccaattgagctgaaaacaccggcaaatcttagaagaaaagcatatgaagatgtgatgcgacaacacgggagacagccgattacatatgaagttccctttcatcaaaattaccgggaaatcatttcaaaactgtttgatgaacagcctgcagctgacggcatttttgccagtgatgacctcatggccgctacagtcatcaccgaagcaaaaaaacgcagaaaagacattcccgggcaattaaaggtgatcggctacgacggaacggaagcggttcagtccattctcccggaattgacaaccatccagcagccgatcgaactcatttccaagacggccattgagattttgtccaaagccattgaaggcgaattcgatgatttgccgctggaaacctatttgcccgtacagcttttagaaggagagacgacttaa

SEQ ID NO: 4010 - DNA, 531 bp, Bacillus licheniformis
ttgaacgtaagccacttttttcctgaaacctttgtttctcttgtaaaagacatgttaaccaaaaccgatggttcaacaaccaaagcgattgaaacgctgatcggcggcaaagccgaaatcgaagtttttcagcaaaataatattgattatgacaagctttcacctgaggaagcaaggctgtttcaacgcgatgatgacatcttgtttagaacctcgtctttgaaaacaggcgatgattatttatcttataattatgtctatgtcaaaacaaacttactgccgcccgccatcaaacaagatttgcaggaagaaaggcttcccatcgggaaaatcattgcagaactggagtcaaggcgtgaaattttcagcacgggcgactgcctgggaaaacatttcacacaacttgtacctgtttcagcagaccggacatatgcttttaaaaaataccagatcatcagcggccgacagtgcatgttctatgtctgcgaactgtttgatttagaaaaaatctgcaaactgactgcgggctga

SEQ ID NO: 4011 - DNA, 684 bp, Bacillus licheniformis
atgaacaaaaaaacagtgtttaaagcgttcggaatgttgatgacaggggtattgttttttgcgctgtacagtgcggccgcacttccttctgcacacgcggcaaacgaaaaaaaaccgacggtcacgagccatacgtacaaaaacattaaggctttgaaatacccgcaagtttcaaatgtaagccccaaatctctccaaaacaagatcaacaaagattttaaacattatattgagcagtcctacaaagattatgtaaaaaacaagaaagacggccaacagcacggataccaaacggattatcaaacgtcctttgaagtgaaataccggaccggccaaaagctgagcatcctgacaagcaattacgtctattccggcggagcgcacggaaatacggcagtccgctctttcaactatgaccttgtctctaaaaaacgggtgtatttatccgacatcctaaatacaaaatcgaaaatggataagacaaaaacatacatttacaactatattcaaaaacacagcgacattttctttccggatgtgaagaagaaagacatcgtcctcggtaaaaacacggccttctattacactaacgacggcattgcgatcgtcttccaacaatacgatgtcgccccttatgccgccggaaatccggtcgttgcagttccgaaaacggtgtatcaataa

SEQ ID NO: 4012 - DNA, 1131 bp, Bacillus licheniformis
atgacacaatcaaccgatgtactgaagcaaacgcctggaagaaaaatcggaccgtacagagctgatcaggtgggcagtcttttaaggtctgagcccgtaaaaaaagcgcgcctccaaaaagcgaacggcgaaattagcgctgaacaattgcgcgaagtcgaaaacgaagagatcaagcgcattgtcgaaaagcaaaaagaaatcggtcttaaagccgtgacagacggggaattccgcaggtcatggtggcatttcgattttcttgaaggacttgacggcgtagaaggatatacagcggacaagggcattcaatttcataatgttgaaacgaagccgcgcggcatcaaagtaacaagcaaagtcgactttacaaaccatccgatgctggaagattataaatttcttcatgatattgcgggcacacatacgccgaaaatgacgattccgagcccgaatatgctgtttttcagaggaaagcttggagaaagcccgtatgaggatcttgatgaatttcatcacgatgtagctcaggcttacaaaaaagcgatccgcgcattttacgatgccggctgccgctatttgcagctggatgacacggcctggtccgtatttttctcagacaaaggacatgagcagatcaaagctttcggccgccagcctgatgaactgcgccagtctttcgccaacacgattaatgaagcagttgaagggcgcccggacgatttgacggtcaccatgcacatctgccgcggcaacttccagtcgacatgggtggcggaaggcggctacgatgcggctgctgaaacgattttcgacggactcaatttagacggacttttccttgaatttgatgacgagcgctccggcggcttcgaaccgcttcgctacgtccaacggaaagacttgcaaatcgtcctcggtttaattacatctaaattcggcgagcttgaaaacccggatgatattaagcggcgcattgaagaggcgtcccgatatgccgatctgaaccagctgtgcttgagcccgcagtgcggctttgcttcaacggaagagggcaacctgcttaccgaagaacagcagtgggaaaaactgcgccatgtcgtcgagatcgctgaagacgtatggaaataa

SEQ ID NO: 4013 - DNA, 2235 bp, Bacillus licheniformis
atgattaagaaaaggaaaatcgatatattcctggtcttcattcttgtattatctgcagcattaaacttgtacggcatctggaatagtgacacagacaacgcctactatacggcggccgttgaaagtatgacccaaagctttcataacttcttttacgcatcatttgatccggcaggctttgtaacagttgataaaccgcctgtcgcactctggattcagacactttttgcacttgtattcggcgtgcacggctggagcgtcgttctccctgaagccattgcggaagtgatttccgtagcactcttgtactttattgtaaaacctacttttggcaaaacggcggccagaatttcagctcttattatggcgtgtacgccgattgccgttgcggtcagccatacaaacaacgtcgacagcattctcgtcctttgcttgatgattgcaacgtggctgttgtttaaagcagtccggaaaggaaaaatcggctggctgctcggcgcattctgtatgatcggtgtcggttttaacgtcaaaatgctgcaagcttacatggtattaccggcattcctgctgttttacatgattggagccaaaacgacgattcgcaaaaaagttgtgtctcttatcacagccgtgatcgttctggcaggtgtttccgtttcctgggcggttgtcgtcgacagccagcccgagatttcgcgcccttatatcggaagcagccagaccaactctgtccttgagctggcgtttggctataacggcatccagcgtctcacaggtcaaaacggtgcaggcgggggcggaacctcctcatctgatcatgatcaaaagaatcagcagcaaagcggcgatattgaaaacaactcagactcggcaaatggacaaatggctccgccgagcggaggcgaaatgccttcgggcggaccggatggccggcagggtgatgtccaaagcggcggcggaggtcccggtggcggcacaggcggcatgtttggcactggaaccccgggtcctctcagactattccaatctgagctttcaggacaggctagctggctgatcccgtttgtcctcttcggcatcatcggtttgctgatcgcgggtcttcgcagacaaagaaaattcaatgaaacaacgactgaaacaattttctggatgatgtggcttctgccggtcgctgcattcttcagcatcgcaggattcttccatcattactatctgattatgctggcagctccaatcgccgctttgtcaggtgcaggctggacggcgctcgttcgcctctatcaggaagaaagcggctggaaaaaacggctgctgccaatcggcattttgctgacaaccgcatttgaattgtatattttgagtccttatctcagcgaaatcggcttcatctggagcatattgatcggcgctttcggcattgtcacaagctgtcttctcatctttctcaagaaaggaaagtcattcagctactatgtatcacttgcagcgctgcttggcatgctgatcgggcctttctattggacaacggcgacgcttgctgacggtgtaaacggcatgattccacaggccggacctaaatccgcacaatcatttgccggcggtggcggaggaggtaagatgcagaataacgacggcagcggacctcccggatttggcagccaagacggccaaacagacagtaatcaaaacaacaataatggccctggcttcggtccaggttcaaacagccaaaacagcaacgattcttcagctgataccggttccggccaaaacagccaaaatcagaatgacgaaggcgcaagcggccgtcaacaaggcagaccaagcggcggcggcagccctggaagcggcgagtcggtcgatgaagaactgttgagctaccttgaaaagaacaacaccggtgaaaaatatttatttgcagtctcaagtgcaacttctgctcaatcttacatcatcaaaacgggcaaagctgtgatggcgatgggcggattctcaggaagcgacccgattttgacggttgaaaaacttgagaagctcgtcaaaaacggcgaagtcaagtacttcatgatcggcgacggccgaggccgggacaattcagaaatcaccaactggattaaagaaaacggcacagaaatttcaaaaagcgaatacagcagctcttcttctgatgattcacagtcaggcggacctggcggaaatcaaacgctttataaagtggagctggattga

SEQ ID NO: 4014 - DNA, 999 bp, Bacillus licheniformis
atgaaaggaaaggtgatgaatatgcagaaacaagtcacattttcaatcgtagtacctgtctacaacgaagcggaagtgcttcaaagcacctatgaccgattaaaaaccgtcatggactcgacaggcgatccctatgaactgatttttgtaaacgatggttcaagcgatgacagcattcacacgctgaagtcgcttgctcagtcagaccaggcagtaaaatgcatcaatttctcaagaaacttcggtcatcagatcgcgattacggccggcacagactatgctgccggcgaggcgatcgttgtgatcgacgccgatttgcaggatcctcctgaattgattttggaaatggcggaaaaatggcgccaaggctttgacgttgtatacgccgtccgcacaaagcgagaaggagaaacatttttcaaaaagcaaacggccgccatgttctaccggattttaagaaaacttacagacgttgatatcccggtggatacaggagacttccggctcatggaccggaaggtggtcaatgaaatgaacaagctgaaagaaaaaaacccgttcgtccgcggtcttgtcagctggctcgggttcaagcagacagccgtctattacgagcgccacgaacggcttgcaggggaaacgaagtacccgctgaaaaaaatgctgaagctctcgctcgacggcatcacttcattttcctttcagccgctgaaactggcaagctactcaggaatcgtgctgtcagcgatcggctttatatacgccttcatcgtcgtctgcatgaagctgtttacgacaagcaccattacaggatggtcgtcgatgatcattctgcaatgcttgttcagcggatttatcctgatcatcctcggggcaatcggcgaatacatcggccgcatttatgacgaagtgaaagacaggccgctttatatcattgacggaaaatacgggtttgaagaacagcggcgggcgcgagctccccagcgccatattatgtag

SEQ ID NO: 4015 - DNA, 996 bp, Bacillus licheniformis
atgagcgtactagttgtcgggggagccggttatatcggttcccacgccgtttacacgttaattgagaaaaaagaaagagtcgttgttgtggattccctggcaacaggacacgcagaagccgttcactccgaagctgcgttttataaaggggacattcgcgaccggcattttctcaagcaagtatttgaaaacgaggacattgaagccgtcatgcatttcgcagcatctccgatttcctcgaaatccaaaaacgtgtttacttcctttaacgaaaacatcacaggaatggaaacactgcttgacgtgatgaaagaatacgatgtcggccggatcgttttcgcgtcaagcgcggccgtctacggcagtccagaagacctccctgtcacggaagaaaccgaacctgagcccgttcacgcgcacggcaaagtcaaatggatgatggagaaaatgctgatggaagcggaaaaagcgtacgggctgaaatatgtgatcctccgctccttcaatgcgtgcggcgctcacccatccgccatcatcggcgaagaccgggggagcgaaacacatctcatttcaaatgttctgcgaaccgctctcggacaccttccttttgttcacatagatcaatctgaagacggaactggcgtccgcgattatgttcatgttcaagatttggcagaagcacacgtgctcgccatcaatcacttgcggaaaggcaaggatagccgaatctacaatctcagctatggcgaaagctactccgctgaacaaatcatccttgccgcccaatatgtcacaggcattcccctcatcgccgcaaagctgacagaaacggacatcgattcacaagcaacatttgccgcttcttcctccagagccagaaaagaattaggctggaccccacagcacaacagcctgatcgcgatcatccgcgacgcctggaactggcactctgcgaatccgaatggatatgcgtcggagaaggtgaagcaagggtga

SEQ ID NO: 4016 - DNA, 1140 bp, Bacillus licheniformis
atgaaaaagaaagggtttataagtatattttttttaatagtgtttctactgctcgccaccaccggctgcggcaaagatgatgttcaggaagccatctataaaaaaggcttgcccaaagaagacagtccagcatttagagaatttatgagacatgaacttgatttagcgacagacgcaactcttagttatcaaaatagtacatatacgattatgcgcagtgataaaaaggggctacggtactatcaatatacagatcaagaagtagacgatttttacagtccctttctttcggctaataaatatcctgcgacaaaattatatgatttgaaaacaactgaatttttaactaaagaaaaacttatccacaataaacttgaatataatctgccggaaatgacattagataaaaagaatgttctaaaagtgaaaacaaaaagcggagaaaaaaaaatagagtttccatcagccaaggataaaaaagtacatctggcgttagcagctgttagcaaagacagcatgcttatacaagtggacgtatatgaaaaatttaaaaatggtgaccttggagacagacaaatatattatctttttttaaaaagtgatctttcaaaataccggattgttaaagaagaggaattaaattcaacaattgagtctgggaaactgaaggaatacttatccgtatttccaaatgtagcgaaggatggagcatatcgtaagttatttgataaatacatttttgatgaaaagaaaaacaaagttaggaaaatcaaaaacactgatattctgagcaaagacggtaagtatgtttatattaacggagcaaaagaaaaagaaacaaatgtaatgcctgatggtatccaacagatacaaacaatggataattatctaaaaggaaatgaaaaatatgaagctcaatttaagattgatttcaaacaaattgcaaaagagatggatttaaacgcgggtgatgcgaggatagctaatattcattattttaataaagattatgtagttttgtatatttcttatcatgggaagacaattggtacagcaggttctgttaatgtacttattgatttacaaaaaaacaaacaacagccaacggcttatttagttgatttaggaattgaatcatag

SEQ ID NO: 4017 - DNA, 1431 bp, Bacillus licheniformis
atggcttatcataatagagaaaaagaaatcacgaacattctcaaaaaccatgaaagaaaagcgaaccagctgctgcggttagcccaatccagccgtctgcttgatacttttaataaaatatgggtttcgatagaaaataaagaacttccgaattttgtatcaaaaaacgtaatggattttaatgtggcggatatcaaatcggaaatcaacgattggataaaggatttaaaagagtgccaggagaatgccaggcgcaaatttgagtctatggaagaccccacaccggaagacttaagaaaacgcaacaatatttcgagtgacgctgttcttttaattagccaatacgagaatctaaaaaatggcattgatcaggtggaacaagatttcagcaatgtcgcccgcacccaccgcgccccgatgcgcgaagctttgacagacctctcaatcttgtataattcagttaaccatgtaaaaggcgatttttcggattataagaatgtttctgtttatgtgcatgggattgaggatagtgggaatggtttctataaaagtgtaaaggatgctgcgaaaaagggcgaccttatcgttcgtattacaacaaatgaaaaaaacgaatatgtttatgaatactattatattgacaaatatggaaaaatgtatataaaggaaacttatgaagaaataaaaggtcttgaatacttcgacactaacggccgtctccatattgtttatgacacaaatgaacccaatgagcatcggcaagcaacaagtgacgatttagcagaaaagttaaatgagatggggctgatgaatgaggagacaaagatcgatatgttcgggcacagctatggaggaagaagatcgctgcaatttgcgatggattaccctgaccatgtgcgaagcatcacaacaatcggaactccatatgataaaaatctcttagctgccggggcaaatagagcgcgctggcttgcagataatgctgctggaagagatactatgaatacaagtgattatttagattttaatgaagaaaacaaaaacaatgataatggaaaagattacagtaatgcctacactgatatggactgtgaggcgatgactgaagatattaatcatttgaaatctgccaatcctgaggtgtatcaaaagctgcagaagatggacattaccgctgcggcgggatacagaacagaggatactgtaagtttttccccttactataccgcaagcggaaaacataaaataaacagtgatgatatcgtttcggtcgaaagtcaacacggtgacatattaggcgatctcattgataaaaagccagaaattgaagtaagaggttccggtgtaaccaatcctggacatatttatgaaattgaagactctgaatttgttgacttgattcgagaggtcaacaaaaaagaagcagaatag

SEQ ID NO: 4018 - DNA, 639 bp, Bacillus licheniformis
atgggacattttcgcttcaacaaagaactttcacacaaggcagcgggaaccattagtcagctggaaaacgcctttatccatgtatttgagaacatggtgttttttcgtgaagaattagaccggcacagcggaaaagccgcagcagcgctgcagaaaaaaatgagcgacaacatcaactttttcagtaaagcaagcagctgtttattatattttgcagacagtgtacgctgttttgcaaaagcggtcgaactgacggacgaatccgacaagccggccaatgttcagccgcagtcgagatcagaaagaaaccatacgttttcggctgaaagagttcaaagtgaaattaaagtaaacggtgaatcgttacaccaggcaaccggaaagtttgaatcaaatctatctacacttgatgaagttttgcaccattttgacacaatgctcagagaaatgatgtatgaaacagaatttccgtgggaaaaattcgatgacgtctggtctgatgcaaagtcgcacatcaactcaatcatgacggagcttaaaaaaagagtcaaagaactttcggcaaatgctaaaaacatcgttaaggaattaaagcgcgtcgataacataatctcacagcaactgcaaagagtgaaatga

SEQ ID NO: 4019 - DNA, 297 bp, Bacillus licheniformis
atgctgttaaaaaagaactatcttcctgtcggcagtgttgtcggcttatataatgattcaaggcgtctgctcgtcatcggccggcaaatgttttctgaaacaaatcacgtgatcagagattatgcagctgtcgactatccaaatggatttaccgatccaaaagagcagcttgttctatttaataaacaggacatagaagtggtataccattacgggtatgttgatcaaaaagaattgcagcttgatgaactgctaacagaagctgaagcaggaaaaaaagaaaataaggagcaatga

SEQ ID NO: 4020 - DNA, 105 bp, Bacillus licheniformis
ttgaatagatttgatcatgtaaaaagtgtattgcgcaaacaatatatctatttttcatttgctcttatttttcatgctttctttatcggaacccatgaaaaataa

SEQ ID NO: 4021 - DNA, 1194 bp, Bacillus licheniformis
atgtattttctcattaatattttaggcattttcattgtcatgtctgtaatttatttttgttccccgcgaaagaaaagcgtaaaatggaggccgattctctcccttttcatcgttgagcttttggtgacgtggtttatgcttgggacaaaaatcggcggatgggccatcaacctgatcgcctctttcttttcgtggctgatcgcttgtgcaagcgacggcatcgcttttgcctttccgtccgtgatgggcaatgaaaccgttgactttttcttcagcgccttgctgccgattatttttgttgtgacattttttgatatactggcttatttcggaattttaacatggatgattgataagatcggctgggtaatttcgaaagtctcacgccttcctaaattagaaagtttcttttcgattcaaatgatgtttctgggcaatactgaagcgctcgccgtcattcgcgggcaattggctgtattaaaggataaccgcctgctgacgttcggcattatgagcatgagcagcatcagcggatcgattctcggttcttatttaacgatggttcctgcgacatacgtatttaccgccatcccgctaaactgcttaaatgcgttgatcttggccagcattttaaacccggtggaagtcactaaggatgaagacattatttacgtaccgccaaaagaagagaaaaaggactttttctcaacgatttcaaacagcatgatggtcggaatgaatatggtcatcgtcattctcgccatggtcatcggatatgtcgctttaacctcatgtttgaacggtattttgggcttgatcgtagacggtttgacgattcaaaagatcttttcttatatcttcagtccgttcgcattcctgcttggactggcgccgggcgacgcgatgtatgttgcacagctgatgggcatgaaactcgccacaaacgaattcgtcgcgatgatggatttaaaaacgcagctagacgcgatttcaccccatacagccgccgtggccacaacatttttgacgtcgtttgccaacttcagtacgatcgggatgatctatggaacgtacaattccttatttaacggagaaaaatcggcgattatcggaagaaatgtgtggaagctcctcgtcagcggaatagcagtgtcgctgttgagcgcggggattgtcgggctgtttgtttggtag

SEQ ID NO: 4022 - DNA, 1461 bp, Bacillus licheniformis
atgtctgacagggcgattccgcgaagctacaggatgatggaaggcttcggcgttcatacgttcaggtttgtaaacgaagaaggcaaggcgcactttgttaaatttcactggaagcccgtcctcggcgtccattcgctcgtctgggacgaagcgcagacaatcgccggaaaagatcccgactatcaccgccgcgatctgtgggaagcgatcgaaagaggcgatgaagtggagtatgagctcggcgtgcaaatgattgacgaagaagacgagttcaagtttgacttcgatatccttgacccgacaaagctttggccggaagaaatcgtccctgtcaaaatcatcggcaaaatgacgctgaatcgaaaccaggataacgtttttgcggaaaccgaacaggccgctttccatccgggccatgttgtgccggggatcgatttcacaaacgatccgctattgcaaggccggctcttttcttatacggacacacagctgatccgattgggaggtccgaactttcacgaaattccaatcaaccgcccggtctgtccgttccataacaaccagtatgacggctatcacaggatgacgattaacaaagggcctgtcgcttatcataaaaattcgcttcaaaacaacgatccggcgcctgcttcagaagaagaaggcggatatgtgcactacgaggaaaaagtcgagggcaaaaaaatccgccagcgcagcgaaagctttaacgaccactattcgcaagcgaagctgttttggaacagcatgtcccccgttgaaaaagaacatatcatttcggcgttccgctttgaagtcggaaaggtcaaaagcaaggacgtccgccgccaagtcgttcatatgtttaaccgggttgacggggagcttgccaagcaaatcgctgcgggtgtaggcgtagagccccctgaaaaagacgaaggctccaacgtgacgttcaaatcccctgcgctcagccaggagaatacggtgaaactgccgcagacaaggacagtcgccattttagcagaacaaggttttgatgatgaagacttgagccgtgtgttgaaagaattcaaaaaagccggcatcattccggacatcgtcagctcggcactcggagtaatcgaaggggccggcggcacagaaattgaagtcggaaacactttgcagacggtcgattctgtgctgtacgatgccgtttatattccgggcggccaagaaagcatagaacgcctgaaattgcataaagccgcatcggattttgtcaatgaagcattcggacattataaagcggtcggagccgcaggcgaaggggtcgatctcctgctgtccgccgccggggcccacgcggcttcacagccgggcattatcacctctcgtggtgataagaacaaagacgacttcggcaaaaagctggtcgaagcgatcagcgggcaccgccattgggataggcaagtttaa

SEQ ID NO: 4023 - DNA, 618 bp, Bacillus licheniformis
gtgaataacaatgatggccgccgcaaagtcaatgggcacagcaaggatcaacaactcgaacagtaccggtctgacaacaggggcaaaaaaatgacgacgaaccaaggtttgcgcgtatctgaagacgagcactccttaaaagcaggcgtgcgcggtccgacgctgatggaggactttcatttccgtgaaaaaatgacccattttgaccatgaacggattccggagcgagtcgttcatgcgagggggtttggcgcgcatggctattttcaggtttacgagccgatgacggagtatacgaaagcaaagtttcttcaagatccgtcagtgaaaacaccggtgtttgtcaggttctcgactgtcgccggttccaggggctcgggtgacactgtacgcgatgtcagaggatttgcgacaaagttttatacagaagaagggaactatgatcttgtcggcaacaacatccccgttttcttcattcaggatgccatcaagttccctgacctggtgcacgcctttaaaccggaaccgaacaacgaaatgccgcaggcttctacggcgcacgatacgttttgggactttgtcgccaacaatgaagaaacggcccacatgatcatgtga

SEQ ID NO: 4024 - DNA, 450 bp, Bacillus licheniformis
atgaaattcaaaatcgaaacacttccaaactaccgcattgcatatatgcgccgagttggtccatacggccccgccaacattgaggtaatggaaagattaaaaaaatgggctaagaaaaaagatcttcttgaatccgccattctgtttgcgattccacaagataacccgaaaacaacgcctcctgatcattgtcgatttgatgcttgtattgtgataccgcatgattatcaagtcgatgataccgtttttgaaggcgaaatttccggcggacaataccttatttacgaggttgaacatacagcagaagctattcaaaaagcatattcagatattttctcatctctgcaaaacaaataccaattggacaataggccaatcatggaaaaatacgttggtgatatggtgaacagtccgtattgcgaaatatgtgtgcccttaaaatcggtttaa

SEQ ID NO: 4025 - DNA, 1419 bp, Bacillus licheniformis
atgaaatataaaacattagctcaatttccgaaagattttttgtggggcgcgtctacttccgcttatcaagtggaaggcgcttgggacgaagatggaaaagggccttctgtcatcgatgcgcgcgaaagctacccggaagggacaaccgattttaaagtcgcaagcgaccattaccagcgctataaagaagatatcgctttatttgcggaaatgggcttcaaagcgtaccgtttttcgattgcctggacgcgcatcattccggacggggacggtgatattaatccgaagggaatcgaattttacagccgtttgatcgatgaacttctaaagtatggaatcgaaccaattgttacgatgtaccactttgatctgccgaatgctttgcagaaaaaaggcggctggtcggacagggccacgattgatgcttttgaaaagtatgcgaaggtcctttttgaaagctacggtgaccgcgtcaaatactggctgaccatcaatgagcaaaatatgatgatcctccacggatctgcactcggtacactcgatccgaacttggaaaatccgaaaaaagagctttatcagcaaaaccatcacatgctcgtcgcacaggcgaaagcgatcaagctttgccatgagatgctgccggaagcaaaaatcggtcctgcgccgaatattgcgctcatctatcccgcttcttcgaaaccggaggacgtgctggcggcttttaactataatgcgatccgaaactggctttacttggatatggccgtattcggacggtacaatacaacagcgtgggcatatatgaaagaaaaaggctgcacaccggtcatcgctgaaggggatatggacattctgcggtcggccaagccggattttatcgcgtttaactactatacatcgcaaacggctgaagcaagcaggggtgatggcagcgacacggctgctcgaggcggagaccagcatttgcagacgggagaagaaggcgtatataggggaagcagcaatccgcacctaaagaaaaacgcatttggctgggagatcgaccctgtcggtttccgttcgacgctgcgcgaaatttacgaccgctaccagctgccgctgatcgtcactgagaacggcctcggcgcgtttgatcagcttgaagacggagatgtcgtaaatgacgattaccgcatcgattatttaaaagagcatatcaagcaaattcagctggcaatcacggatggagtcgatgttttcggctactccccatggtctgccatcgacttaatttcgacccatcaaggctgttcaaaacgctacggatttatttatgtgaaccgcgatgaatttgatttgaaagacttgcgccgcattcgcaaaaaaagcttttactggtataaaaacctgattgctacaaacggcgaaacactcgattaa

SEQ ID NO: 4026 - DNA, 1860 bp, Bacillus licheniformis
atgaatgttcaatcaatggcaaaagaaattctggcgcgcgtcggcggggagaagaacgttgtatcgctagtccattgcgcgacaaggctccgcttcaaactgaaagaccgttccaaagcagacagagaagcgcttgaaaatacggatggcgtggtaaccgtggtggagagcggcgggcaatttcaagtcgttatcggcaataacgttcctgaagtatataaagaaatcggccggatctctcaactgttggaaagttctgcggccgatcacagtcaaaaagagaaaggaagcctcgccggtagattagtagatgtcgtatccagcattttcactccgctgctcggcgtcatggcgggagcggggattttaaaaggcctgcttttgatttgcacaaacgccggctggctctcgccggaagagacgacatatacgattctatacgcggcagccgacagcctgttttatttcctgcctttgctgctcgccgttacggccgccaaaaaattcggagcgaacccgttcatagcgctgacgattgccggagcgctgatctatccgacgatactcgaactgaaaaacagcggcgcccatacggagtttttcggcattccggtcgtcttgatgaattatacgtcgaccgttatcccgattatccttgcggtatttgtgatgagctatcttgaaagattatgtatgcgctttattcatgaaagcgtgaagaactttatcacccctttattatgcctgacggtgatggtgccgttaactttgatcgtattcggaccgctcggcgtttacacaggaaacgggatcgcggcggcgattctgtccgtttttgatttcagcccgattctggcaggagcgattattgcggccttatggcaaatccttgtcatcttcgggattcactgggggatcgtccctgtcattttgaacaacattgccgtccacggcaaggactacattaagccggcgacggcagccgccgtgtttgcccaaacaggagccgcatttggcgtcatgctgaagacgaaaaacaagaagctgaaagcattggcaggatcagctgccgttaccgggatattcgggattacagagccggccgtctacggggtgacgctcaggctgaaaaagccgtttgtatgcggtgtcatcagcgcggcggcaggcggagccattatcggatactccggcagcgtcgccctcgcttccggcgctccgggcttgttgacgattccgattttttacggaccgggctttctcggcttcatcatcggcatttcagtttcatttgttttatcgattttgctcacttacattgtcggctttgacgaccctgtggaggtgacaaaagaggagcctgttgaaaaaagcgccggtgaaccgatttacagccctttgcaaggagaagtcctgccgttaacagaagtatcagataaagtgttcgcatcgggggcgcttggagagggaatcgcggtggttccgtcaaaaggcgttgtcaccgcccctgcggacggcatcgtgacaacggcatttccgacgggtcacgcatacggcataacgaccgaaagcggagccgagattttgattcatattggaatggacacagtcaggctcgaaggaaagcacttcaatcctaaagccgtgcaggggcaaaatgtgaaacggggtgatatactcgcagaattcgatctggacgctttgaaagaagaagggtttgacgtgaaaacgccgatcatcgttacaaattccggtcaatacacggatgtcattccaacggatcaaaaaaaggtgaaaactgaagaacggatcatcactttaatttcatcaccaagggaggaaaataatcatgaaatataa

SEQ ID NO: 4027 - DNA, 834 bp, Bacillus licheniformis
gtgaaaattgccaaagtgatcaacaacaatgtgatcagtgttttaaatgaacagggtcaggaattagtggtcatgggcaggggaatcgcttttcaaaaaaagcctggcgaagcggtggatgaatcgagaatcgagaagattttcaggcttgataataaagatgtatcagaaaggtttaagacgctgttggacgaaattccaattgaatttatggaaatgtctgaagaaattatctcctatgcgaaattaaagctcggcaaaaagctgaatgacagcatttatgtctcgctgaccgaccatattcatttcgccgtcgaacggcataaaaagggactggatattaaaaatgccctgctttgggagacgaaacggctgtataaagatgagttcgccatcggcaaagaggcgctggccatcattgaaaagaagacggggacagctcttccggaggatgaagccgcctttatcgcgctccatatcgtaaacgccgagctgaatgaagaaatgccgaacatcgtcaatattacgaaagtcatgcaggagattttaagcatcgtcaagtatcactttcatatcgaatttgacgaagaatcgcttcactattaccgcttcattacccatttgaaatttttcgcccagcggctgttcagcggaacctatatggaaagccgggacgactttttatttgaaaccgtcaaaaataagtaccgggacgcttatgtttgtacaaataaaatcaggcagtatatcgaaaaagaatacggtcatcagctgacaaacgaagagcttctgtatttgacgattcatatcgagcgagtcgttcatcaaaaatag

SEQ ID NO: 4028 - DNA, 735 bp, Bacillus licheniformis
atgaaaagcaatggttcacttctttcggcattgaacccgagcgccaagctcttttcccacctcctggtcatgtgcattctcatgtttgtttcaaatccgaaaccgacttttttcatttggctgtttgcggttgtcatcgggatttttttcgggggatggactttgtcttatttaagtaaacggctgctgccttatcttattttttttattctcgtattttggatgatggccgcttttgggaaaggcgaggaaacgatttgggaatgggcctggttccgcgttaccgaggaaagcgtcggcaatgggctgacaatcgcgctgcggatgctcggctttgtcacatacggtctcttgtttacgtcaacaaccgatttgacgcagtttattatgagcctgattcatcaatgcagattgtcgcctaaatgggcttatggcttgctggccggcttccgttttgtcccgctttttcagtcggagctttcgcaaatgaaggcggcgcacaaaatcaggggctataagcaaaaaaacagctggaaggcgtttattcgctatgcgctgccgttgttttcgcaaggcatccgcaaatcggaaagaatcgccgttgccatggaagcgagagggtttaccggtacaaaagaccgcacctactatcaaacagcggggctttccggaaaagacttcgtatattttgcgggtctggcatcagtcgcagcggggattttgctcactttttaa

SEQ ID NO: 4029 - DNA, 1593 bp, Bacillus licheniformis
atgcgttcatttctcggatgcagtaacctttccgtccgtttttatcatcgtcctgaaacagtcttggaccgggtctcgctgtcgattgagcagggagaaaaagtgctgatactcgggccgagcggaagcggaaaatcgacgctgttgtccgtgctttccggcatcattcctgaacatatcgaagctgaagtcacaggcgaggtcaaccgcagaaagagcgccggcgttatgtttcaggatccggattcgcagttttgcatgcttcatgttgatgaggaaatcgcgtttagccttgaaaatcgatccgttccgccaaaagatatggaccgcatcatctcggagctgatggagctggtcggtttaaagatagataagaaaacgccgatcgaaaccttgtcaggcggtatgaagcagaggctggcattagcgtgcctgctcgctttggagcctgaagtgctgttttttgatgagccgacggcgcagctggacccggccagccggcaagacatctttgccttgctccgcgacgtttcccgaaaaagcggacagacgatggtgttcgtcgaacacgtgctggacggctgtatcgagtggatggaccgagtcatccttttcaatgaaaagggacagatcatcgctgatggaaagccggaagaaatcgtcaaacattttcagccggaaatgaaagcggcaggcatctggcagcccaaactgtaccccgcagtatgggaagatgttaccacacaagatgatcatccgctcgccgtcaagctctcttctacattgaaaatgaaagaggaggaagcgaaaaacaggccgtcagcagacagggacatattgatccgcacagaggacgcggcgatcggctatcggaaaaagatcgttgccgacggcatcaacctggagattccaagaggggaatggatttccgtcatcggcgggaacggcagcggaaagagtacgtttttaaaaagtctgatcaggcttgaagcggtcaaaaaagggcgcatttatctggagggccgggagctgaagaaatggtccgatcgtacgctttacgagaaggccggctttgtctttcaaaaccccgagcttcaatttattcgggacacggtgtttgacgagatcgcgttcggagcgagacagcggagctggccggaggagcaggtcgaaaggaaaacggctgaattgctgcaggaattcggacttgatggtcatcaaaaagcgcatccctttacattaagccttgggcagaaacggcgtttaagcgttgcgacgatgcttttgtttgaccaggatttgctgctgcttgacgagccgacattcggtcaggacgaaaagacggcaaaagaattgatcaagcgcttaaaggagcggcaggaacggggaacgacgattgtgatggtgacgcatgacatggacatcgtagacgagcactccgaccgggtcatcgtatttcatcaagggaaagcggcatatcaaggaacgccgtatcaattgttctctgaccaagacctggtccgccgcttttcattgataccgccgcttcactaccggttcatgcacgaaagaaaggagagggttcccgtatga

SEQ ID NO: 4030 - DNA, 600 bp, Bacillus licheniformis
atgaattggaacatgaaagaagtcgtcatgacagtcatcttgtctgtggcatgcggcgtcatttatttagggtggtctaccttgtggatccctgtttcagctatcgtcgggcccgtcggagcgaactttatgttcggcatatgggtgatcgccagcccgattgtcgcttatatcatccgtaaaccgggtgcggcgctgattgccgagacggcagctgcggcggtcgaactgctgaccggaagccattttgggctttcagcattattaatcggtgtgttccagggagccggtgcggaaatcgcgtttgcgatctttcgctataagcgctataacttgtttacccttatgctttccggtgcgctagccgcggtggggagcgcgacatacagcctgatggcaaacggttttgcctactatacgacgcaaacgctgatattgacgcttatcatccaaatcatcagcggcattgtactcggcggctggctggcaaaagccgttgtcgaagcgcttgcgaaaacgggagtcctgaaccagtatgagatcatgaaagaacaccggaagaaggatgatgccgatgcgttcatttctcggatgcagtaa

SEQ ID NO: 4031 - DNA, 687 bp, Bacillus licheniformis
atgagtttttccgcagaacttcgccgcgaggcagaccctatttttgaagccatttttgagcatccgtttgtactggggctggcgtccgggaggctggaaaaggagcagcttattcattatgtaaagcaagattacgagtatttgaatgcctttattcaaatctacggaattgcgatttccaagtgtcaaaatcgaaaagatatggaaatgtttcatgagcagatttcatttgtgctagacagcgaagtgcacccgcacaaaaacctgtgccgggccgctggggtggagtacgaaactctgcagggctatccgcttgcgccttccgcccatcattatgtccgccatatgctgacggcggcgcacgaaggtacgctgggagagatattagccgtcttgctgccttgtccatggacatattgggagatcggaaaaaaactgatgaaggacgttcagcctgatccatcgcatccattttatgactggatctgtttttacggaaacagaacggattcaatcacgacaaagttttgcgcccgcctggatgaatgggccgaaacagcgggcaaggctgaaaaagaaaaaatgaaggagctctttttgcaaagctgtcagcttgaatacggcttttgggagatggcttatacggttgaagattggcctgtggaaatgggggcggtgagacgatga

SEQ ID NO: 4032 - DNA, 1272 bp, Bacillus licheniformis
atgctgaaagaaaaacaactcgcagaaagctgggagcatgatgaacgctggaaagggatcacaaggccgtatgaggcggcagacgtcattcggctgaggggcacgctcgagattgaatacacgattgcaaggcgcggcgccgaaaagctgtggaagcttctccatacagaggatttcgtcccggcgctgggcgctttgaccggaaaccaagccatgcagcaagtaaaggccggattgaaagcgatttatttaagcggctggcaggtggctgccgatgcaaatatgtcagggagcatgtatcctgaccaaagcctttatccggcaaacagcgtcccggaagtcgtcaaaaaaatcaaccgcacgctgcagcgcgccgatcaaatccaccatatggaaggaaaggaagacatcgattggtttgctccgattgtggccgacgctgaagcgggcttcggcgggcagctgaatgtgttcgagctgatgaaaagtatgattgaagccggcgccgcgggagttcactttgaagaccagctgtcgtctgagaaaaagtgcgggcatttgggcggaaaagtgctgcttccgacgcaaacagcggtacgtaatttgattgccgcgcgcctcgccgcagacgtgatgggagtcccgaccattcttattgcccgcacggacgcgaatgcggcagacctgatcacaagcgacgtcgattcatatgatgcaccgtttttgacgggagagcgaacagcggaagggttcttcaaaacaaagcctggccttgatcaggcgattgccagaggcttggcgtatgcgccgtatgccgatttgatctggtgtgaaacgtctgagccgaatattgaagaagcccgccggtttgcacaggcgatccatgaaaaattcccgggcaaactgctcgcctacaactgttccccttcgttcaactggaaggccaaactggatgacaacacgatcttgaacttccagaaacagctcagtgaaatgggctataaatttcaatttgtcacactggcgggcttccacgccttaaatcacggcatgtttgaattggcccgccaatataagcaccgcggaatggcggcgtactctgatctgcagcaggccgagtttgccagcgaagtccacggctatacggcgacaaggcatcagcgcgaagtcggaacgagctactttgatgaagtcgcccaggttgtgacaggcgggacttcatcaaccactgcactgaagggatcgactgaagcggaacagtttcaatcataa

SEQ ID NO: 4033 - DNA, 1590 bp, Bacillus licheniformis
atgaaaacagaggagaagagaattcatataaccggatcgataaatccgcattatgaagagattttgacaaaagaagcgatggagtttatcggacgtcttgaacgccatttcgggggaagaagacgggaattgctgcatttgcggacgatcaggcaggctgaaattgatcaagggaagaacccttgttttttggcggaaacgaagcacatccgcgaggcggactggacagtcgcgccgctcccccgggatttggaggaccgcagggttgaaatcactggcccggtcgacagaaaaatggtcatcaacgctttaaattcaggagcgaaagtctttatggccgactttgaagatgcgaactcgccgacgtggaaaaactgcattgaaggccaggttaatttgcgggatgcggtccgcgggacgatttcttttacgaatgaacagggcaaacgctatgagctgaaagagaaccccgccgttatcatggtcaggccgaggggatggcacttggaagaaaagcatgtgctgatcggcggcaggcccgtgtcagcaagcctgttcgattttggtctttattttttccataacgcaaaagagctgatcaaaaaaggaagcggcccttatttctaccttccaaaaatcgaaaaccacctggaagcaaggctgtggaacgacgtatttgtttatgcgcaaaacgacttgcgcattccgcagggcacgattaaagcgacggttctcgttgaaacgatcctggcggcctttgaaatggatgaaatcctctacgaattgaaggaacattcagccgggcttaactgcggcaggtgggattatattttcagctttattaagaaattcaggaacagggatgaagtcattcttccagatcgctcagccgtgacgatgacagttcccaacatgagagcctactccctcttggcgattcaaacgtgtcataaacgcaacgtccatgcgattgggggaatggcggcgcaaattcccgctaaagacaaacctgagatcaatgaagccgcatttgccaaaatccgcgaagataaggaacgtgaagtaaaagacggccatgacggaacatggatcgcgcatcccggcatgattcaaacggcgctcgatgtattcaatcagcatatgccgtcggcgaaccagattcatagaaagcggaaagacgtaaaggtcgaggaaaaagacttgctggaagtaccgaaaggcagaattacagaagcaggcgtccgtaccaatatcagcgccggcatccgctatttagcttcatggctgtcgggcagaggcgccgctccgatcgaccacttaatggaggacgctgcaacggcggagatttccagagcccagctgtggcaatggattcgccatccgaaaggagttcttgacgatggccggaaagtcaccgcggaaatggtcaagatgatgaaagagaaagaaatgcagaaaatcatcgatgaagcaggcgtggaacattttcggagcggccggtttgaagaggccggacagttatttgaacagctgattttggatgatgaattcgcggagtttctaacgataccggcttatgaaaatatataa

SEQ ID NO: 4034 - DNA, 138 bp, Bacillus licheniformis
atgagcttgaaaagtccgatggaatttttcagaacgcttccgaaaaaaacgtgccctgaatgcggcgaaaagatggaggagcaggctgaatcttacttcatggaatgcgagcgctgtcttgccaaaaaaggcgagtag

SEQ ID NO: 4035 - DNA, 2079 bp, Bacillus licheniformis
atgaaaataaaaaacaaacaacttgatgtcattctggttctaattttgttggcagctcttattctgaatacatataacatttggctggacgatgccgccaaccagtattacttggcagcagtcaaaagcatgacgcaaagcttccacaatttcttcttcgcgtcattcgactcttccggattcgtatcagtagataaaccgcctgtcgttttatggattcagactatatttgcgaaaatcttcggcgtgcatacgtggagtgtgattttgccgcaggcgcttgcaggggcgggttccatctatctgctttacgcactgataaagccgaaattcggaaaaggcgccgcccgcatttcagcgctggtgatggcgctgacgccgatcgcggtcgccgtaagccgaacgaataatatcgacagcatgctcgtcttcacgctcctacttggtacatggtgcctgatgaaggcggtcaaacaaggcaggctgatctggcttctcgctgcattcggtctcatcggcctcggattcaatatgaagatgtttcaggcattcatggtgcttcccgcgttcttgctgttttatctcattgcggcccatgcgaattggaagaaaaaaatcgtttcagcggttttatcgcttattgtcctcaccggcatttcgctttcttgggcgcttgcggtcgactatacatcagccgacagccgcccgtatgtcggaagcagccaaaccaactctgtgcttgaactggctttcggctacaacggcactgagcggcttctcggccagacgacgggcaacgcccgcggcgatatgaacggctttggaggagacatgcagcagccgaacggcaatgcgcaagctcagaacggaaaccgttcgtccggcggctccaatggacaaaacggcgcgatgcagccgccgggtgcgggcggttcggcagacggcagttctcaaggggcaaacggcggcagccagcagccagccggaggcggaccgggcggaggcaacggcggtcccggaggcaatggcggcccaggcggaggtcaaggcggcggacaaagcatgaacatgttcggcaccggtgacgcaggaccgctgaggctcttccaatcggctttatcgggccaaatcagctggatgctcccatttgcattattaggactgctcggcacgatcatcacctggtttcgcggccgccgcgaaaaagcaggcgaaatgaaagaaacgatcttttggtctgcatggctcgttcctgtcgccgggttcttcagcatcgccggattcttccaccactactacttgattatgatggcgccgccgatcgccgctctgtcaggaatcggatggtacgcgatgtacggcctttacaacaatcataaagactgggcaagctatctgctgccggcagccgttctcacgacagcagcattccaagtgtacattttaagcgcttatacaaaccaaatcggcagcgcttggatgtatgtcatgggaatcctggggctgggtgtcaccatcgccttactaatgctgaagcgacgccatccattcggaaagcagctcaccatcatcagcttgtgcgtgcttcttttgacaccggtctattggtcggcaacaccgatcctttacggagggaacagcgttcttcctgaatcagggcctcagctgcaaagctccaacggaggcggaatgttcagctcggacgtggacacaggactgctcacatacctccgggaaaataataccggcgaagagtaccttttcgcgacattgacaacggtaaccgcagccacgtatatcatcaatgccgacgaaaatgtcatggcgctcggaggcttcaacggcacagacccgatcctgtcggtcagtgaactgaaaaacctcatcaaaaaaggaagagtaaaatacttcctgattagtgaaaactcaggcaacagcgagctcgtctcctggatcaaagaaaacggaaccgaaatttcgtctgaccaatacagcagtacagacagcttcgcacagcagggtgcaagaggcggcccaggcggcggacagcggcaaacgctctacaaggttgagctgtag

SEQ ID NO: 4036 - DNA, 1941 bp, Bacillus licheniformis
atgagcattaatcagctgatcatccgcaacctgaaaaaaaatatacggaactattacctttatgtgtttgcgttgatcttcagcgcagcgctttattttgcgtttgttacgctccagtatgatccagcgatcaatgaagtgaaggcatcgataaaaggcgcagcggctttgaaggcagcttccattctccttgtggcagtagtagcggtgtttgttttgtatgccaatacgatatttatcaaaagacgaagcaaagaaatcggtttattccaattaatcggcatgaggaagcaaaaaatcttccgcatcttaagcttggaaaatgtcatgctgtatttcggctctttggtcattggggtgtttgccgggttttcgatctcaaagctcgtgctcatgattttgtttaaaattgtagatgttcaagccgaagccaaattgaatttttccgtcgaagcgcttgtgcaaaccgtcattgtattctgcggcatctaccttctcgtaatggtgatgaattatgcgtttatcaaaaagcagagcattttatctttatttaaagtgacatcagctacggaggataaggtaaagagaatatccgttttccaaatgatcatcggcttattgggcatcttgtttattttatccggatactatgtatccactgagcttttcagcggaaaattcaagaccgtagatgagctgttttatgcgatgagctttattctcggaaccgtcatcatcggaacgtacctcttctataaaggatcggtcagctttgtctccaacatcatccgcaaaagcaaaggaggctacttgaatatttatgaagtgctgtccctttcatcgatcatgttccggatgaaatcaaacgccctattattaacaatcattaccaccgtttcggcgctggcgatcggattgttatccttgagctatatttcgtactattctgcagagaaaaccgccgaacaaaacgtggcggctgatttcgccatgacaaatcaaaaggatgcaaagcgttttgaacaacttttggacgaaaataacatttcctacagcaaaaaagaaattcatgtcattcaagcggtttttaatctggaacaaattgtcgatggagatcctgaaaatatggctggagacccggggaaattgcccctcgccgtggtcagcgatgcagagattgccgggatggacgtgccaaaaggagacgtcattttttcaggatataccgaccttctccagaaatttatggctttaaaagagaccggtgccgttaaggtaaagagcaggcatgagacaatcccattaaactatttaggcttgaaaaaagagtctcttttatccttcaactttaccagcggcggattgcctgttgccgttgtagatgatgcgctgtttaaacgtcttagccaagacaaagatccaaagctgcagcagaagccgagccttttttacggaatcaatttaaaacatgaagatcagcttcagcaggcaaatgagctgtttgcaacagtgaatcaaaacgatcagcatttatcgctccttgatgcaagcacagctcaaaaatcgcttttcggccttgccatgtttattgtaggctttttaggactaacgtttctgatcacttcaggatgcatcctatattttaaacaaatggacgaaagcgaagatgagaaaccgaattacacgattttgagaaaactcggtttcacacggaacgatctgttgaaggggatacgaatcaaacaaatctacaacttcggcattccattagttatcggcctgtctcacagctacttcgccgtccagtccggctggttcctattcggggcagagctgtggacgccgatgatcatcgtgatggtgctgtacaccgtcctgtactctattttcggcttgctttccgttctttacggcaagaaagtgatcaagtcggcgctgtag

SEQ ID NO: 4037 - DNA, 762 bp, Bacillus licheniformis
atgatgattttagaagcgaaaaaaatacgaaaaagctatggaaataagcacaataaacacgaagtgttaaagggaatcgaccttcagattcaaaagggggaatttgtcagtattatgggcccgtctggttcaggcaaaacaacattgctcaatgttctgtcctctattgaccaggtgagcggcggaacgattaacatcaaccaagctgagatgacgaatatgaaggaaaaacagcttgccgagttcaggaagcagcatttaggatttatcttccaagaatacaatttgctcgatacgctgacagtgaaagaaaatatccttctgccgctgtcgattacgaaaatatcaaaaaaagaagccggtcaaaagtttgaggaagtcgcgaaagaattaggcatcttcgagctgaaggataaatatccgaatgaaatttccggggggcaaaaacagcgcacatcagcagccagggcgtttattcatgagccgagcattattttcgctgacgaaccgaccggtgcgcttgattcgaaatccgcatcagacttgttaaacaagctgagccaattaaatcaaaagcgccgggccacaatcgttatggttacccatgatcccgtcgccgcgagcttctgcagcagagtggttttcattaaagacggacaaatttatacgcagctgaataaaggcggacaggacaggcagatgttcttccaggacatcatgaagacgcaaggcgtgttaggcggggttcagcatgagcattaa

SEQ ID NO: 4038 - DNA, 1011 bp, Bacillus licheniformis
atgagaatgctgaaagcgtttttgaccgagaggcgaagctggatcgccatatttgttttgcagcagatcctctttctgtttatcgcttatgtcgatgcatccattccttttacgtcgattttgtatatgacctatttgtcctcgtttatttttatcgtttttgtaattgtccgctttcggaaggaaacgaagttttataaaagtcttgaagaatgggaccacaatctcgatgtgacaaacattcgagaggcggaaaccccttttgaaacgatgattgaaaaaagcatagccgaacaaacgaaacagttaaagcaagaggcggcacagcatcgcctggcattggagaatgaaaaagatgagctcatggcctggatacatgaagtcaaaacgccgcttaccgccatgcatttgatcatggagacgattgaggatcaatctttaaaagcgaggcttgcgtacgaatggctgcgcatccacctgctgctcgaccgccagctccatcaaaagcggatgtcatttatcgaaaatgacttgtcccttgaagtcctagagcttaaacctatgatctttaaagaaataaaagatttgcaatcatggtgcattccaaaagggatcgggtttgatatacagctggaggcgggggaagtgctcagcgatgcgaagtggctgtcttttatcattaggcagctgctgacaaacgcggtgaaatacagcgaagcatccgatgttttgattaaaagctatgagcaggatggcaaagtgcatctcgctgttcaagactttggacggggcatcgatccaaaagatatgccgcgcgtgtttgacaaaggctttacatcaacaacggagcatcatgatcaggccgccacgggaatggggctgtacttggcaaaaaaagcggcaaagccgctcctgattcatatcgaggttgattctaaaccgggaacgggtacaacctttacgctgatttttccaatgcggaatgaattttcccgtgtgctgggcgtgtga

SEQ ID NO: 4039 - DNA, 687 bp, Bacillus licheniformis
atgtttaaactgctgttgatagaagatgatgaatcgctgtttcaagaaataaaagagcggttaaccgggtggtcatacgaggtatacggcatcaacgatttcagcgaagtgatgcaggagtttgcggcgattaagccagactgcgtcatcatcgatattcagctgcctaaatatgacgggtttcattggtgccggcagatccgctcccgttccaacgttccgattctctttttatcttcgcgcgatcatcctgctgatatggtcatgtccatgcagttcggagcggatgattatattcagaagccgtttcattttgacgtgctgattgccaagatccaggcgattttccgtcgcgtctacgactataatacagagcctgagattcttaaaaaaacgtggtgcggtgcaaccgttgatcccgaacaaaaccgcgtcagcaataaggcgggggcgatcgaactgacaaggaatgaaatgttcattttaaaacaattgatcgaccaaaaaaacaaaattgtcagcagggaagaattgatgagaagcctatggaacgatgaacgctttgtcagcgataacacgctgacagtcaacgtaaaccgcttaagaaaaaaactcgatgccttgaacttggggcaatatatcgagacgaaggtcggccagggctatatggcgaaagaagaaggatga

SEQ ID NO: 4040 - DNA, 1410 bp, Bacillus licheniformis
atgactgaacaaacgaaaaagtttcctgaaggttttttatggggcggagcggttgccgcaaaccaagtggaaggcgcctataatgtcggcgggaaaggactctcgacagccgatgtgtcgccgaacggcgtcatgtatccattcgatgagtcgatggagtcattgaacctgtatcatgaaggcatcgatttttaccaccgctacaaagaagatatcgctcttttcgccgaaatgggatttaaagcattccggacatcgattgcctggacgcggatttttcctaacggcgatgaaactgaaccgaatgaagagggactcgaattttatgatcgcctctttgacgagctattaaaatacaatattgagccagtggtgacgatttcccactacgaaatgccgctcggtctgattaaaaaatacggcggctggaaaaaccggaaagtgatcgattgctatgagcattatgcgaaaacggttttcacccgctataaagaaaaagtaaaatactggatgacattcaatgaaatcaacatggttctgcatgcgccgtttacaggcggaggccttgtgtttgaagaaggcgaaaacaagttaaatgcgatgtaccaagcggcgcatcatctatttgtcgcaagcgctcttgccgttaaagcggggcacgacatcattccggacgctaaaatcggctgcatgatcgccgcaacgacgacatacccgatgacgccaaagccggaagacgtgctcgctgcgatggagaatgagagaagaacgctgtttttctcggatgtacaggcgcgcggggcttatccgggctatatgaagcgcttctttaaggaaaacggaattacgattgaaatggctgaaggtgatgaagacatcttaaaggaaaacaccgtcgactatatcggtttcagctactacatgtcaatggtcgcaagcacgagtccggaagacttggcaaaaacggaaggcaacctgctcggcggcgtcaaaaatccgtaccttgaatcgtccgaatggggctggcagatcgatcctaaagggatccgcattacgctgaatacattgtacgaccgctatcaaaagccgcttttcattgttgaaaacgggctcggcgccgtcgatgtcgtcgaagaagacggctccatccaggatgactacagaatcaactatttgcgcgatcatttaaaagaagtaagagaagccattgcagacggcgtcgacttaatcggctacacatcatggggcccgatcgacctggtcagcgcatccaccgccgaaatgaaaaagcgctacggctatatttacgtcgatcgtgacaatgaaggaaaaggcacgctttcaagaacgagaaagaaaagcttttactggtataagaaagtaatcgaaacgaatggcgagagtttgtga

SEQ ID NO: 4041 - DNA, 1845 bp, Bacillus licheniformis
atggattataataaagtatcgaaggacattttacaactcgtgggcggtgaagagaacgtacagagcgtgattcactgcatgacaagactgcgtttcaatctttatgacaatgcgaaggcagaccgcgcgaaactggaaagtcttccggctgtaatgggcaccaacatcagcggccagcagtttcaaatcatcattggaaatgatgtccctaaggtgtataaagcgatcattgccaacagcgggctcagcgatgaaaaagcgggcgagcagcaagctggcaaaaagaaaaacgtgctgtccgccatttttgatgtgatatcaggcgtatttacgccgattctcccggcgatcgccggagcgggtatgatcaaggggatcattgcaatcgccgtcacgttcggctggatgagcgaaactagccaggtccacaccattttatccgccatcggcgacggagcattttacttcctgccgattttgctggcggtcagtgccgcgagaaaattcggcagtaatccttatgttgcggcggcgatcggagcggcgattctgcatcccgatctgacagcgcttctcggttcagggaaaagcatttcctttgtcggattgcctgtaaccgctgccacttattcgtcgaccgtcattccgatcctgctcgcgatttggattgcatcttacgttgagaaatggattgacaaagtcaccccgacttcgttgaagatgatttttgtaccgacgctgacgctgctggttgtcgtgcctgtcacattaattacggtcggtccgctcggtgcgattgcagggaactatctgtcaatcggtgtgaacggtttatttgaaaatgccggtttaatcacgatgatccttttagcaggaacgttctcgctgatcgtcatgacaggaatgcactatgctttcattccggttatgttcaacaacattacgcaaaacggctacgattacttgatacctgcgatgttcttggcgaatatggggcaggctggcgcgtcatttgccgtcttcctgcgatccagaaataagaaattcaaatcattgtcgctgacgacaagcatcacggctttgatggggattacagagccggcgatgtacggtgtcaacatgaggctgaaaaagccgtttgtatccgcgcttctcggcgccgctgtcggaggagcattttacggcatcaccggcgtagcagcatatattattggcggaaacgtcggtttgccgggaattacgacgtttatcggcccgacttttatacaggcaatgatcggtatcgtcatcgcgttctttgccgcaacggcgtttgcttttgtattggggtttgaagacattccttcagatgaagccgctgaacaaggagccgctccatctgaagcgggcgcgggagagatcattcaaagcccgctgaaaggcgaagtcaaagcattgagtgaagtggatgatgcgacattttctggagaagtcatgggaaaaggcgtcgccattgagcctgaagaaggcaaagtggtgtcgccggtatcaggcacgatcacaaccgtttttcaaacgaagcacgccctcggcattacaagcgacaatggggcggaaattattatccatatcggaatcgacacggtgaaattgaacggcgagcactttaccgtgcatgtcaataaaggcgacgctgtaaaaccgggagacgagcttgtctcatttgatatggatgcgattaaggatgcaggctatcagttgatcacgccggttatcatcacaaatacggaccggtaccagtcgatcaaacctttgaaatcagatgaaagcgttgacattgaggaagcgctgatcgcgctggcgtag

SEQ ID NO: 4042 - DNA, 543 bp, Bacillus licheniformis
ttgcaaaacaaagcagcagacagactcattttattaggcatcagtttacatagcatatattggttgttcattttatttttgttttttcatttcaaacatcagcttgacgcttatgctgtttggaatccaaatgtcacggacggatatatggaggctggaactttcgtagctgcgctgaaattgatgctctactcaggcacattatttaatttgggcctcttgttcattttgggcttgctgatagtgatattagcacagtcgatcatttttattgccttggaaatcgccgcttacgtaaaaatcaaaaaagatccgttttctccatggggatcttttattttagcgatgggcattaaaaacattttcacgaacttatcagggattccgtttatggctgccggattcattcttcataagcagcaggaaccgaaagaagcagttgtagagccggcggcgcgaaggaaagcaaggcgaaaccctgcattgcttatgaaaaaggcggcgaaagctagaaaacgaagaaatgaaggtataaagtcttag

SEQ ID NO: 4043 - DNA, 990 bp, Bacillus licheniformis
atgtgtacaagtatcacgttgacgactgcgggccgggagcatttattggcgaggacgatggattttgattttgagcttaacggggaggtgctgttgcatccgcgtcgctacaaatggaaaagtgaagcggacggcagcgagcatgccggccggtatgcgtttatcgggatgggcagaaggctcaagaatgctctgtttgccgatggtgtgaatgaaaaaggattgtcttgcgcggcgctttatttcccgggctatgctgtgtatgaaaacgaagcaaaagagcaaagccgcaatcttgcgccgcacgaattcgtgacatgggtgctgtcggaatgcggcgatttggaggatgtgaaaaaagcggctgtttccttaaacattgttgagagagaggtcagcttgctgagtacggtgacgccgctgcattggctattaacggaccgctccggggcaagcgtcgttgttgaaccgacggcagacggcattcaaattcatgataatccggtcggcgtgctgacgaacagtccggatttcccttggcatttgaccaatttgcgcaactttatcggtcttcagccgggacagtttgccgcgaaaaaaatgggaggcctgacgctgtcggcttttggtcaaggttccgggctgtccggattgccaggagattttacgccgccatcccgctttgtcagggctgcatttttgaaagagcacatgaagcctgtgtccgatgaaacagaaggcgtctctgccgcgtttcatgtcctctccaatatgaatattcctaaaggggttgttatgactgatcaaggcgaagacgattacacccaatatacggcggtaatgtgcagcgagacgtgcagctactattttcaccattatcaaaacaggcagattcaaaaggtttgcttattacaggaagacctggacagcaacgaattaaaggcgtttcagccaaagcaggaagagacggttcattctcttcaatcataa

SEQ ID NO: 4044 - DNA, 846 bp, Bacillus licheniformis
atgagtcttattttattaatcattttattaattattattgcatgtatagtaaagtttggatctaactttgttcttgataaatttatatttccttctatcaaatacatgagtaaggagagctttaaaaagtttagaaagtttgttgaacaaaaaaataccttattaatttataaaaagacattgagagctagtgagtacttttttattttattaatgattatctttattgccgtaagtttattttgtgttttatcaccaagcaactctcttctcaattttttattttttggattactagctttctttcttttttgtactatctttataggggattttaatttaaatattaaaaaagaattagaaaaaaatcaaaaagaatacgagagtttaattgaaaatactatctctaaagtgaatagaaatagttatatttttgatagattaaaagtgttttttggaaaaacaggaatgagtctgtattttcattgtttatttttaattttaattttaacttttttaaccgaagttaacagtataccttatagtattttttatttatttttattgaccctacctctaacgttagcaagttggatttacttttcaactttcaatacggaagaacaaaatattagaaggattattgggtacctgttattgttgattataaccatttcaaaaagtttttccgattttaaaattgtaatagggttagaggttgctgattctgctaatgactatatcatgttcttaatccttacggtatttacagctatagatcgacttttaaaaagtatagttgatgattatactaaatttaaagaaaaaagaaaaattgttgaatga

SEQ ID NO: 4045 - DNA, 969 bp, Bacillus licheniformis
atgcctggtgtcaaacttaatataaataaaaaaagtgttgggatgactttagggggcaaaaatggcaggataacttataatacttctggcaaagtaacaacaagtgcaaaaatccccggtacaggtctatcttatagttccagtaaatctatttcttcatcacaaaaacaaagtcacttgaataataacaattattcaaataatttagagcttaatgcttacctcaatcatttaacttcatttcatacgagattaacgagcaggcaaataaattgggaagaaattaaaaaagagtcaccgccagagattaatgtagctcaattaaaaagtgatttaaataattataaacccaatttctttgagagaattcttagattagataaaacaaaaattgaaaagttaaataaagaaattactgatgcagaaactaaatataagaaagaatatgatgagtgggtaaagcaacaaaaatttgtgaaaattattgatgacaaaaacagtgttgcttatagtgaaattttagaagatattattaagattgaagatactataggaaaaataaaagagattatttcgaatgaaaatagtgaagttttattgaatctattagtggacacatcaattttaccgaatcaagaagaatacatctcttctgctgggaacttgttaactaaaaagctaaccaaaacaaaatattatcaaaaccaattaaactttattgccagtctttctataggtttagcaaaagtaatctttcaaataattcctgttgagactgtatcgattaatgttttagaaaaaagaattgatacagtggatggacatgagaaaacaatgactatctttggcgttaaatttaaaaaagagcagttcatggctttaaatattaattacattaaaccaattgatactcttcaactctttgaaactagtttggattttaaaaagactaagggtctccaactgtag

SEQ ID NO: 4046 - DNA, 1422 bp, Bacillus licheniformis
atgagaaagtgtttcatccaagtccttgcattgcttttcatcattgctgcatgtttcgcgccaaaccaagcctctgcacaaactcaaaaacctgttttttcagaagtgacggtacatgatccatcgattattaaagcgaatggcacgtactatgtcttcggctcccatttagcttcggccaaatcgacggacctgatgaattggacgcaaatttcctcgagtgtccacgacggcaatcctctgattccgaacgtctatgaagaattaaaagaaacctttgaatgggctgaatctgatacgttgtgggcacctgatgtcacccagcttgaggacggcaagttttatatgtattacaacgcctgccgcggggattctccgagatccgccctcgggcttgctgtcgcagacgacattgaaggtccatacaaaaataaaggcatttttctgaagtcgggaatggatgggatcagcaatgacgggacgccttatgacgcgacaaagcacccaaatgtcgtcgatccccacacattctttgatcaaaacggaaagctgtggatggtgtacggctcctattccggcggaatttttattttagaaatggacaagaaaaccggatttccgcttccgggacagggatacggcaaaaagctgatcggcggcaaccacagccgtattgaaggcgcatatattctctaccatcctgaaacacagtattactacctgtacatgtccttcggggggcttgccgctgacggcgggtacaacattcgcgtcgcccgctccaaaaaccctgacggcccttattatgatgcagaaggccacgcgatgattgacgtccgcggcaaagaaggaacgctttttgacgatcgttcaatcgaaccgtacggcgtcaaactgatgggaaatttctcatttaacaataaaaacggctatgtgtcgccgggccataactctgccttttacgatgaaaaaagcggtaaatcatatttaatcttccacacccgcttcccgggacggggcgaggagcacgaagtccgcgtccaccaattgctgatgaacaaacaaggctggccggttgtcgcccctcaccgctatgccggagagaagcttgaaaaggtgaaaaagtcagatgtgattggcgattacgaattggtgaggcacggcaaagacatctccgcagatattaaagaatcgaaagaaatccgcttgaatcaaaatggcaaaataacaggcgcagtagccggaacgtggaagaacacggggcataacaaaatagaactcaagatcgacggaaaaacctacgatggcgtgtttttgcgtcagtgggatgcggcttctgagcgtaaggtgatgacgtttagtgcgttgtctcgtgagggagatgcggtttgggggagtagtttaaaaagagcggaattttaa

SEQ ID NO: 4047 - DNA, 1446 bp, Bacillus licheniformis
atgagcaaagccagttttagagactatgcattaagcggcgatattacgaaagcgctcgatcacttaggatataaggagccgactgcggtgcagagcgaagtgattcccgcggtgcttaaaaagcgggatgttgtggtgaaatcgcggacggggagcgggaagacggccgcgttcggaattccgctttgcgagctgaccgaatgggaagagaacaaaccacaagccttggttttgacaccgacgcgcgagcttgccgctcaggttaaggaggatttgacgaacatcggccgctataaaagaataaaagcagcggctgtttacgggaagtcatcctttgaacggcaaaaaacggagctcaagcaaaaatgccatatcgttgtcgggccgccgggccgcgtattggatcacattgaaaaaggaacccttccattagaaaaactgaaataccttgtcatcgatgaggccgatgaaatgctgaatatgggatttatcgatcaagtgggagcaatcatccgccatttgcctgaagaacggctgacaatgctgttttcagcaacttttccggaggatgtggagcatctatcccttcaatatatgaaagaccctttgaaaatcgagattaaagcaggcggtacgacaaccgcagacatcgagcatcaactgatcattgtaaacgaaaatgatccattttcgcttttagtggatctgttcattgttgaaaacccggacagctgcatcgtcttttgccgcacacaggagcaagtgaatgagttgcagtggcgcctatccgttttgggttatccgtgcgagaaaattcacggcggcatgcctcaggaggatcgttttgccgtgatgaaccgtttcagacggggagcgttccgctatttaatcgcgacagatgtggcggcaagaggcatcgacattgagaacatcacacatgtcatcaactatgagctgccattagatcaagaaagctatgtgcatcgtaccggaagaacaggccgagccggcagccggggaaaagcgattactcttgccagtgcgcgtgaaaagaggatgattgctgacattgaagactatatcggttttcatattcctattattgaggagccgtcaaaagaagaaattgcacgggcaaaagcggcgtttcaaaagaaaatcaataggaagccggagcttaaacaggacaagagcgaatcgttaaataaggaaatcatgaggctctactttaacgggggaaaaaagaagaagcttagagctgttgatttcgtcggaacgattgctaaaattgacggcgtctccgccgaggatatcgggattatcacgatccaggagcaaggttcattcgttgaaattttaaacggcaaaggtccgctcgtcttagatgcgatgaaaaacacgacagtgaaagggaaattgctgaaagtgcataaagcgaggaaataa

SEQ ID NO: 4048 - DNA, 603 bp, Bacillus licheniformis
atgttctcttttaaaaaaagccgattcttttggctgagaagcaatgttattctaatattgttaactgctctattgttgttgaataaaccttattgggaaaaaaacgccaatgttatgttttttatgtttgtttgcattgctgagctgtttatcattttacttgcattggtatatggttttcaaacaaaaaagacaattgcgcgccctccttcaagagctataagaaagaccaatatcccaataggtatatttgttttttctatttttagtttattttttggatttgcgatgtcaggggatataccgtatcccaattctgcgcttatcatatatttaacaattaacatggtgtttgcatttgtttctttgtttgtaccaacattaatcattaagctatatgaagtcaacgtatatgacgaatcaaatgggctgatcaccgacttttttcgatatgtagccattctggtttcctctttaaattacgaagtccaaatcgttttagcccgcctcccttttgtattacagcgtctactgggcgtcattttcatcgctgttttgctgtgggagcttactatgatcggattaatttttgaaaacaattga

SEQ ID NO: 4049 - DNA, 780 bp, Bacillus licheniformis
atgttagactctaaaattatattaacaacaaatgaactcgttgccgcatttttattgtgtaggtatgaaaaagctgctgaagatattatcaatgatcagcagttgattcaagatgaaaaagatattgagccattttcaattcaagccgaaaatcttttaaaacaaagaggatattgggctgatggcacagaatctaatttacaaaaagggttagaaaacctgattcacttactcattcaatcaaagcgaaaagttcgttgtatccatcggaaaagggtgctgattgtacaccatgttcaaaaagatgaactcattgtgcaggagatcgaaaatcaaaatcatagtttttcgattttaagaagcagagagtcgtttttagaaatgttgaaaacattttatcattcatatacagataaaaaaccagaacatgaaatttttgaaatggatgaagattcatttgatgagtttcacgaggttgaagctgacgttattaaaagaatggcggaagacccgaaaacgcatccgactataagtcaattttcctttgactttttagcaaacaaccaagagctcgataatatttcttttgtagaaagtgactatattcaaaatcaaacaagattagatcaagttgcttttttattaagaagtgataatttcatttggcatttagattatgaaaatattaaaaaaactggctcgctatatcttctaccagtggcagtcgacgaatattttgggaaaatagtggatacaatgaatgaattttatgatttatag

SEQ ID NO: 4050 - DNA, 1593 bp, Bacillus licheniformis
ttgaaagttttagatgtttctgaagtcattgacgcgattgaccaattgattaaggaaaaaaagcaggaggaaaaagagatcaacgccataagggaaagtgtacaaaaaattgcagagcttgatgatgcattaaaaggagaaggcggaaatgcgatcaaagaacacttttctgttcttcatcttcccgtgctgctttattttcagcactttatagatcaatacatacagaatttaaaagacattaaagcaaaaatcagaacttatgaatcaacagagggttttgtaaaagaagaatttctgacgcatgacgtcaaaaagggcttaacagaactgaaacgtcaaacgaatgatacggttgattcgattaatgacgaagttgataaaatcagccacttaattgggggcggatctatctctttggcatcatttaatgagcatatttccgaagccaaaaaacatgtgaacaacacggtgtctgatttaaaagagcttgatcgcgatgctaattctatattaaaacaatcgtcaaattcgatcgctcagctatccaagctcactgaaaaggtgaacacttggtcaaagggaggcgcgatcttatctaaaaaaacgattaaagaggttgaaaactacttttctgaaacagatgtcgttaaacaaatgattgacgaagccgttgatttagcagaaaaacaagacgatccgacaatgatgggcagaatcgctgaatggcttgatttaatcggaacaggaaacggcgcgttggccgtaacaaaaggcgtcatagccgtgaatgtactggcgacgaaaatgcttgagcttgaaaaagacggaaaaggaaacttccgtgtgaaagcctctccgaaatggacgcaaggagctaacggaaaatacgattccaaggtggctcagtttgtttacaacatcctgaaaaaaggcgatccaaactcaagcaaaccaataaaaaaatggctcggcaaatttcaaaataaaccaagcggccttttgagaaagattgttggattggggcctaacacaacaaggatctcctacaagaaaattttggagagccaaagtttcctaaagcataagccagaggaactgaagagttataagactaaggttgatgtgaaagggactgttgggaagtttaaggatgaagctagtattacaaaactcgccaaaaaaataccttatgctggaacaatattctccttgactacaaatggagctgagttttttagtgatgataataaagataaatcttggttcgaaaaatttggccgattttcagcagggattggaatggatgctggagttggagcgttgaccgctagcggagctggactgggttcattagtatgtccaggtcctggcacccttattggaggagcaattggagctggtattggtataactggatccataattgcgggagatcaagtaaaagaatggggagaagatgctgcaggttggatagaagataaaggtaaggaagctggtgaatggttaagtcaaaaggcctctgaaactacagatacaatttcagacggactctcaggtgcaaaggaatttgtcactagctggttcaggtaa

SEQ ID NO: 4051 - DNA, 270 bp, Bacillus licheniformis
atggcagaaataaaggtaaaagcagaagaagtcaaaacggtgttttcaagccttcagacaaaaatcagcgcactttcgatatcaggttcaaaagccgatatctctaattcttcaatggatgtagtgaacaaaataaaaaaaatcgaaaaggaatacgagcaactactaaaaaaatacaaggaggcgctatcatcagttgaaaaggacgcatggtcaaacattaaagtcttgattgatactgataaaaacatctctcaaaaaatgaaataa

SEQ ID NO: 4052 - DNA, 393 bp, Bacillus licheniformis
atgtctaaccatgctgctaaaatctcttctttggaaaaagatatttcttctttatctcacaatataaaggatacccaaagcaaaatcgctgaactgaaaaaagcaaaaacagctattaccggtgaacttcacaccctttcaaacaatgccactctcatcaatcagccagatattacatcacatatatggaatggcagacatacaaagcaatttatcaatattagatcaaacattgcacacagctatcaaaatatacagagagaaacagatggtctgatttcgcatattgagcaagagattgaaaatcttgaaatgcaaatttctaatatggagatgtttctaagtatacaaaaacaacagcttacagatataaaaaaacaagtcaatcattga

SEQ ID NO: 4053 - DNA, 1302 bp, Bacillus licheniformis
atgagaatggttgatatcatcacaaaaaaacaaaatggagaagaattgacaacagaagaaattcaatttttcattaaaggctacaccgacggcagcattcctgactatcaagcgagcgctctggcgatggccatctattttcaggacatgacggacagagagcgggccgatctcacgatggcgatggtcaactcaggcgaaacgatcgacctttccgcgattgaaggtatcaaggtcgacaaacactcaacaggaggcgtcggcgacacgacgacgctcgtacttgcaccgcttgtcgcggctctcgacgtacccgtcgccaaaatgtcgggacgcggcctcggacacacagggggaacaattgacaagctcgaagcgatcaaagggtttcacgtggaactttccaaagatgaattcatcgagctcgtcaaccgcgacaaggtcgccgttatcggccaaagcggaaacttgacgcctgctgacaaaaaactgtacgcccttcgcgatgtgacaggcacggtcaattcgatcccgctgattgccagctcgatcatgagcaagaaaatcgccgcaggggcggatgcgattgtccttgacgtcaaaacgggcgccggcgcatttatgaaaaccgatgaagatgcagtcaaccttgcaaaagcaatggtccgcatcggaaacaatgtcggccgccaaacgatggccgtcatctccgacatgtcccagccgctggggtttgccatcggaaatgcgcttgaagtgaaagaggcgattgatacattaaaaggcgaaggtcctgaagacttgactgagcttgtcttaacattgggcagccaaatggtcgttctcgccaaaaaagcggagacccttgacgaagcaagagagaaactgatcgacgtgatgaaaaacggaaaagcgctgcaaaaattcaaagacttcctgcagaatcaaggcggcgacagctctgtcgcggataacccagaaaagctgcctcaggctgcctataaaatcgacgttcctgccaaagaagcgggtgtcgtgtctgaaatcgtcgccgatcaaatcggcgttgcggccatgctgctgggcgccggccgcgcaacaaaagaagacaaaatcgacctcgccgtcggcatcatgctccgcaaaaaagtcggcgacgcagtcgaaaaaggcgaaccattggttaccctatacgcaaaccgcgaaaatgtcgatgacgtcatcgcaaaagtctacgacaacatccaaatcgcggaaacagccgaagcaccgaagcttgtgcatacggtgattacggaatag

SEQ ID NO: 4054 - DNA, 1182 bp, Bacillus licheniformis
atgaaatatctcatcgggctcattggtttatttgtcgtcttagggcttgcatggctggtcagcagcggaaagaaaagagtgaaataccgcccggttatcgtcatgatcgtgctgcaattcgcattgggatatatattgctgaacacgggtgtcggaaactatctcgtcggcggttttgccaagggcttcggctatttgcttgaatatgcggcagaaggtgtgaattttgtctttggcggactggtgaatgtgaatgaatccacattcttcatcagcgtacttctaccgattgtttttatatctgctttaatcggtattctgcaatattggagaatccttccgtttattataaaatatattggtcttgcgctcagcaaaatcaacgggatgggcaaactggagtcatacaatgccgtggcttcggcgatactggggcaatctgaagtattcatttcgttaaaaaagcagcttggcctgctgcctaaacacagactttatacgctgtgcgcttcggcgatgtcgaccgtctcgatgtctatcgtcggcgcctatatgacgatgctgaagcccgaatacgttgtcaccgcgctcgtattgaacttattcggcggatttattatcgcttcgattatcaatccttatgaagtcgatcgagaacatgatatggtagaggtacaggaagaggaaaaacaatccttctttgaaatgctgggcgaatatattatggacggctttaaagtcgccgtcgtcgtggccgccatgctgatcggatttgtcgcgatcatcgcaatgattaacggcattttcagcgccgcactaggtatatcattccaggaactgctcggatttatttttgcgccgtttgccttcctgatgggtattccatggcatgaagcggtgaatgctggaagtatcatggcaaccaaaatggtctcaaatgaatttgtcgcgatgcagtctctcgcacaaggcagcttccatttcagcggccgcaccgaagcgattgtttccgtcttcctcgtctcatttgccaatttctcatcgatcggtattatcgccggtgcggttaaaggactgaatgagaaacaaggaaacgtcgtcgcgcgcttcgggttgaaattgctgtacggcgcaacgctcgtcagtttcttgacagcgaccgttgtaggattgatctattga

SEQ ID NO: 4055 - DNA, 672 bp, Bacillus licheniformis
atgacgattgcaaatctcattgatcatacagcattgaaaccgcatacacaaaaatccgagattaagaaattaatagaagaagcgaaagcataccaattcgcttcagtctgcgtcaacccgacatgggtcgaatttgccgccgaagagctgaagggaacggaaatcgacgtttgcacggtcatcggttttccgctgggcgccaacacgacagagacaaaagcgtttgaaacaaaagacgctatcgcaaaaggcgcgacagaggtggacatggtcatcaacatcgccgctttaaaagacggaaacgatgactttgtcgaggccgacatccgcgcggtcgttgaagccgcaaaaggtaaagcgcttgttaaagtcatcattgaaacgtgtctgttgacagacgaagaaaaagagcgcgcctgccgcctggctgttgctgccggtgccgactttgtcaaaacctcaaccgggttctcaaccggcggagcgacagcggaagatatcgccctgatgcggaaaaccgtcggacctgacatcggtgtcaaagcatccggagggattcgtacaaaagaggacgttgaaaccatgatctcaaacggcgcgacccggatcggtgcaagcgcaggcgtttccatcgtcagcggagcagaaggaaaaaatgaagataactactaa

SEQ ID NO: 4056 - DNA, 939 bp, Bacillus licheniformis
atggacaaggaaaaacagcaattgagcattgaagcagcgaggctctactatcagtctgactacagccagcagcaaatcgccgaacagctgcagatttcaagaccgacggtatcaaggctgctgcagttcgccaaggaaaaggggtatgtccaaatccgcgttatggacccgtttgaagatatggatgcgctcggtgcgatgcttgaggaaaaatacgggcttctagaagcgcatgttgtcttttcgccgaccgcggattatacgaccatcacgcattatctcagccgcttcggggccgaatatatgcacggcgcagtcaaggacggcgacattgtcggcgtcagctgggggacgacgatgtaccaaatcgcccaaaatatgcagcctaaacaggtgaagggcgcagaggtcgttcaactgaaaggcggaatcagccattccagcgtcaacacttattcgtctgaaacgattcagctgtttgccgaagcttttcaaacgatgccgaggtatttgccgcttccggtcgtgtttgacaatccggaagtcaaacagatggtggaacaggacaggcacatcaagcggatcatagaaatgggaaaacaggcaaacattgcgttatttacagtcggcacggtacgcgatgaagccttgctgttcaggctggggtattttcatgaagaggaaaaagccctcctgaaagaacgtggagtcggcgatatttgttcgcgcttttttgatgcggaaggaaacatttgcagcgatgctatcgattcgcggacgatcggcattgaattggctgacttgagggaaaaagaacggtcgattctcgtagcgggcggcagccggaaaaaagccgctattcatggtgcgctcaaaggcaagtatgccaatgtgctgattattgatcagcacacggcgaaagaactgcttgatgactga

SEQ ID NO: 4057 - DNA, 435 bp, Bacillus licheniformis
atgtacatcatcagcaagcttgaaagacaaaatgtgaaagtgacagaaataccgaagtggggctcttacttgagaaaaacgtgggaaaaccgttttgccgcaagcatggagcttccggaaagggacgcgatcttggtgagccattttttgtggcatttattcagctatgggatgaagccgtgttttaccggcggacaggccgatcaagcctttagcgaacagccgaagcgcgattgctttttattctaccagcacacggatgacgcctatattcttgaacatgctgaacaactgatagccgcagatctgaaaggagaagaagatgcatatataacggataaacatatgacatggacatatgcggtgacgcatgagtctgcatacggaccgtattttgcaattcagctggatgagaaggagcatgaacctatataa

SEQ ID NO: 4058 - DNA, 1095 bp, Bacillus licheniformis
gtgaaagcacccgtgaggtatatatggattggtatgatcctgtgctttttatccgtcagtctggccgtcggctgcatcaaagctgaagatcagtcagatgatgagaaaaatgatgaagcgcttcagcctgccgaacacttcgtttaccgtcatttaatgagcgatcaggggctgatcaaaaccggcttttccgaccagcctgtttacttgtcggaatcgcttggcttgtggatggagtttttgatcagcaaaaaagacggcgagcatttccatgagcaatatcagcacctgaacgaatccttccttatgaacaacaacctggtgtcatggcaaatccaaaacggccaggcaagcggggtgaacgccctgatcgatgatctcagaatcatggtgagcctcgatcaagcggcagctctatggggaaacagcgagtataaacaaaccgctcggaacatcggtgccgcattaagaaaatacaacatgaacaacgggatattgacggacttttacgactccgcctctcaatccgcggcaaaagatatcacgctttcctatatcatgccggatgcgctatccatcttgaaaaagaatggagtgataaataaagaactcgaaagtcggaatgccagcattctttatctcgcccctttgaaaaacggttttctcccaaaagcatacagtacagaaacgaaagcatacacctatgaccatgaagtcaatctcattgatcagctttacgcagcttggcatttacctccgaaggatcaaaaagccgctgtattagcggattggctcaaacagacgtttcaaaccggcggaaaactgtatggccggtattcgctcgatacaaaaaagccggcggtccaatacgagtctccatccgtctacgcgttggcgattttattcttcatcaaccaaaacgaagataaaaccgtcattaaagcgctgtatgatcgaatgaatgattttgaaattcttgattcgtccgagacgtattatgggggatatatgagcggaaatgatacgcattcttttgataatctgctgcccctattagccgaaaggaagcttttaaatgaaaatctcattcaatga

SEQ ID NO: 4059 - DNA, 852 bp, Bacillus licheniformis
atgaaaatctcattcaatgaatcgcataaaatgttcgcttatatgacaggacttgcagcagcgcttgcgttgttcatccattatatctcagtccagcggttcgaacccgttctcatcatttgcatcacacttgccatcatcgcagcaggaatatggctcggatcgatttacgcactggctgggaccatcatcgtcctgtttgttctcggcactttgatgatgttttttcacacaggccaaggagaagctgcttcgtctgaaaccggactgcaaatgctcgtcatctggggagtggcgctgttgctgttttcctttatgtcagggagaatacacgacatcgcgatcggacttcaccgctccgtcaaacaccttcaagacgaaatcaaaagctttgttgcgattgacagggtgacaggctttgataataaacagaggatgaagctggagctgtcagaagaaatcaagcgggcggagcggtatggcaactcgtttgtttttttactgcttcatatgcattatttcaaagagttcaaatccctgtacggagaaaaagaaaccgatcgtctctttcaatttgtcagcagtcaaatcagatcatgtgtccgggaaaccgataaaaagttccggcctgccgaggagcggttcggcatcctgctgacacacacgcctgccgaacatatgcccgccgtccttgaaaaactgaagaaacagctggatacgtaccagctgaaaaacggcaagtatgtcaccttgaccttccacgtgtgccacttatcatatcagaacgatttaaagactgccgatcaatttttagaagaactagaaaacgagatgatgatgaatgaactgtaa

SEQ ID NO: 4060 - DNA, 1731 bp, Bacillus licheniformis
atgaactgtaagcggctattacttctatacgcggctgtgcttatcctgtctgcggctttttatgttccggacagcgccgaggcaaagcagcaggagcacggcattctcatcgtctattcaacattggatggaaaagagtcagccgatgtgaaaattctcgaccttatcgccggccatttttcatcccgtgtggccgtcataaaagacgcggatgtcaaagcatcggatctcgcaacaaaagaccgcgtcatctattacggacaaacgaaaagaaagctgagcaaaaagctcgcgcagctgatcagctcctccaaaaaacctgtgatagcgatcggctttaacgccgggcagttcagccaatttgcaggtcttacgctcaaaagcaaagacaatgtgtatcagattcgcagcacaaatgaggaaaacgattcctctttagaaagcggagtccgtgtcctcgacgtatcaggattgaagggaaaagcattgtacacatacaaagctgacgaaggaaaagctcgtccttttggatggaaaaccggcaaaggaaacgtgtacatcgggttaaccgatttgctaaacaacagcctcctcgccgctaaacagctcagacaggcatttggtgaaacggccggcagcacgctgttatatttgcggcttgaggatatcagcccgatgtcggatgaaaaactgctgctccaagccggatcttatctgcataaacggaatattccttttatcctttctgtgattccggtatatgtcaatcctgaaacaggcgacaaagtctatatgtctgataagccgaagctggtcaaagtactgaggaagcttcaggatatgggcggaagcgtaattgtccacgggtatacccatacataccgctacagcgaaaccggtgaaggattcgagttttgggatgccaaagccgatcagccgatcacatcggaaaatgcggaagagcccgcgacccttttgcaaaaggaacagagctttccgaatgaagaggcatatcgaaactatttgaagccgttcagaaagaatgaagaaacttacacgcggcagaagctgacgaacgctattgaggatctcaccgcggaagggctgtatccgctcgcgtttgaagcgccgcactatacggtgtcagagcacggctatcaaatcgcctcacaatatttcacaagcttgttcggccaggttcagcttagcgatacaacatggaaaacgtcaggcgccggtccatttgttacgaatccggccatgctccatgggatgacgctctatcccgagacaatcggctatgtcgatcaatcggagcaaaatccgctcggcaaagtcgaggagcgcatctctcaaatgatcgattttgaaggcggagtagccggcgcattttatcatccttatcttggaatgaaatatcttcctgaactggttgatcaaatggaacgcattccaaacagcgaatggctcgatattaaaaagacaaagcaaactgttaacacagataaagtagaaattcacacaagcggagatggaacgattcaagtcaaaagcaaagtcagccccattgagacgtttttcgatcatcaccagcaaagcccgctggaaaaggcgctttggattctctctcttattgtgctcttgtttgttgtcatgtttgtgagctataccctttacttgagagccacattaaaaaaacgaatctttaaggagagaaaaagccgtgggtaa

SEQ ID NO: 4061 - DNA, 1500 bp, Bacillus licheniformis
gtgggtaatgttctgttcctagtctcgttaagcttaatatgggtcatgcttctgtatcacatgtttttgatgcagggcggattccgccactatatgaccttcgaacggaacattccgaagtggaaagagaacgtgaaggatctcccgaaggtcagcgttctgattccggcgcataacgaagaggtcgtcattcggcagacgctgaaggcgatggtcaacctctattatccgaaggaccggctggagattattgtcgtcaacgacaattcatccgaccggacgggtgacattgtggatgaattttccacgcaatacggctttattaaaatggtcgtgaccaaaccgccgcatgccggaaagggaaaatcgtcggcgctcaactgcggttttgccgagtcaaacggggacgtcatttgtgtatatgacgccgacaacacgccggaaaaaatggctgtttattaccttgtcctcgggctcatgaatgatcagaaagccggagcggtggtgggaaaattccgcgtcatcaatgcggcgaaaacattgctcacaaaatttattaacatcgaaacgatttgttttcaatggatggcacagggcgggagatggaaatggttcaaaatcgccacgatccccggcaccaatttcgccatcagaagaagcattatcgaacagctgggcggctgggatgataaggcgctggccgaagataccgagcttacgatccgggtctacaacctcggctaccacatccgcttctttccggcggccgtcacttgggaacaggagccggaaacgtggaaagtctggtggcgtcagcggacaaggtgggctcgcggcaaccagtatgtcgtcctgaaatttttggctcagtttttcaagctgaagagaaaacggattatttttgatttgttttatttcttttttacgtattttttgtttttctttggcgtcatcatgtcaaatgcgatttttgtcatcaatttattttataatctgcatctttcattcggttttttgtctatcattttatgggttttggctttctttctatttatgacgaaggtcatgattacactgagcatcgaaaaaacagaaatgaacaggcaaaactttttcatcgtttttctgatgtactttacatactcgcaggcttggattgtgctcgtgatttattctttattcgtagaaatcaagcaccgcctgttcaagcaacatggtacaaaacagaacgatacaatcaaaagaaaagcgggtgacttttttgaaatatatcatcatatgtctggcaagcttcttgctgatcacggcgacgggacaagcggctgcagccaaagacgttacagtagacggctcgatcctgggggaaaacagccgggaacaagccaagcagcaagtgctcacaaacgatctcttgactttatacggggcaaaagacagcgccgagctgacgtatcaaataccggcgggcgcctcctctacccatcagcagcttacacttaa

SEQ ID NO: 4062 - DNA, 2127 bp, Bacillus licheniformis
ttgaaatatatcatcatatgtctggcaagcttcttgctgatcacggcgacgggacaagcggctgcagccaaagacgttacagtagacggctcgatcctgggggaaaacagccgggaacaagccaagcagcaagtgctcacaaacgatctcttgactttatacggggcaaaagacagcgccgagctgacgtatcaaataccggcgggcgcctcctctacccatcagcagcttacacttaaatacgaggcctcagaccttttaatctcaccgtcttctttaacagccgagattgatggcgaaccggtcaaaacggttaagcttgaagggaataacgggaagaaaacgctgaagctctcgctgaacaaaagccagtcgtctccagggtttcacagcttatcactgaagttctacggagtggttcatgaaggcgtctgcgtcagacaggactcctccgggaactggatcaaaatttatccggacagtcgtctgaatatcggggaaaagaacgaatctaaaggagcggcgctcgaacattatccttatccgttcgcccagtccggcagctccgtggaaaaaacggcaatcgtcattccggaccatccaagttcggctgaaatcgaagcggcagttaaaacagaagcatacctcaaaacggttgacaacagcatcagcacgaagatcttgggtgaatctgacctggcgaagatcgacaggccgacgattgtgatcggcgttcaccatcactggagcggcaaagtgaaaaagctgttgaaacaagcgaaactcgaagcaaaagaagacaagcttttgcttgcgaaacggatgctcaaagcaaaggataagcagcagcctgtattgtttgcggccgcagcatctgatgatgtgctttctgaaaaaatcagcgtcatcaccgacaaaacgtatgccgcccagctcagcggcgacacgctggcaatcggcaaacttcagcagcatagcaaacggggcggcagcaagctgacacttgaggatttcggggcgggggatttgacaatcggttcgggacagacatcttccgagcatttttattatcccgcgccagctctattagacaagaatcagcctgcaaagctttcgcttgcgatgaaaaaatcgaaaacgattcaaaagcaggccggccaaagcgacttagctgcggaacaggcggagctgaaggtcatgatcaatggccagcctcattccgtcggacttgacgatataggaaaagaagacaaaaacggcttttaccatgtttctttaaaagtcgatccgaaacttttgcaaaaaagccgttacattgatattcaatttgccgcttcaggcttgaaagagaacaacccttgctacgcggtgaacgaggacaaatggatttttatcgataaacaaagtgcattgtcttaccatgtcagcgacacgtcagcttcagcagattttcaagcgtggccgcttccctacgcgggtgatcataacaataaaacgctgatgatcctgcccgacaatgcggatcagtcgaagattgatgagctttcgcttgtagtcggctccttcggcagcgaagcccggcaggcattcacagtaaaaacatcctcggaagtcaaaccggatgacgtgaaaggaagaaacgtaatcttcatcggaagcgtcgatcaattctctctgctgaaggaaaaaacagccgaattggctgttccgacggcgaaaaacggaacatttgatgtgtcatcttttcaaatgctgaatgaaacgacaaaacaagtcgcgtttactcaaacgtcgctgtgggattcaaattactcgatggctgttttcgcgccgtttaaagggcaaggcacagcagtcacaaaagaaatgatcaactttttgaacagcaatgatttcgcagcaaccgttgtgaatgaaacggacagccatcagctatttacaaaccatcaacagctgacagcaaaatccgccgaaaccaagacggatgataaacaggaaagcaatcagcagcatgtgctgtacattgccatcctgatcgtaatcatagcggcagcggttattttgatcttgacaacggcaaggcgcagaaaaagaaaggccaatgccggcggagggattgacgaataa

SEQ ID NO: 4063 - DNA, 1278 bp, Bacillus licheniformis
gtgaagccgccattaagcaaaatcggagagaaaatgattgagaaaacaggggtcagggctgtgatgagcgatattcaggaagtcctggccggcggtgaacggtcatacattaatttaagtgcgggcaatccgatgattttgcccggcgtgtcagccatgtggaagtcggctcttgccgatctccttgacgatgacaggttttcttcggtgatcggccaatacggatcgagctatggaaccgatgaactgattgcaagtgttgtccgcttcttttcagagcggtatagcgccggcattcgaaaagagaacgtgttgattacagccggaagccagcagctgttttttctggcgatcaattcgttttgcggaatgggaagcggatctgtgatgaaaaaagccttgatcccgatgctgcctgactattcgggatacagcggggcggcactggagcgggagatgattgaggggatccctccgctcatatcgaaattggatgatcatacgtttcgatatgagctcgaccgtaaggggtttttagagaggatgcgcatcggtgctgtcttgctatcgcgcccgaacaatccttgcggaaacatcttgcctaaagaagatgtagcattcatttcagacgcatgccgagaagcgaatgttccgctgttcattgattccgcatatgctccgccttttccggcgattcactttatcgacatggaaccgattttcaacgagcagatcattcactgtatgagcctttcaaaagccggcctgcctggcgaaaggatcggaatcgccatcgggccgtcccggtatattcaggcaatggaagcttttcagtcgaatgcggcgatccattcttcaaggctggggcagtatatggctgcatcagtattgaatgacgggcgcctcgccgacgtgtcgctgaatgaagtcaggccatattaccgcaataaattcatgctgctcaaggaaacgcttttatgcaagatgcctgaagacatcaaatggtatctgcatcaaggggaaggatcgcttttcggatggctgtggtttgaagacctgccggtgaccgatgcagcgctgtatgagtatatgaaagcggatggagtcattatcgttcccggatcatctttctttcaccgtcaatcccggcgcctggcgcattcacaccagtgtatacgaatcagcctaaccgcggcggatgaagatattataaggggaatcgatgttttagctaaaattgcgaagggtgtatatgagaaacaggttgaatacttataa

SEQ ID NO: 4064 - DNA, 1239 bp, Bacillus licheniformis
atgacgactttgacaggggacattgtaaacatggtcaacgagcagattgtaccgaacatacatgaattgcagacgtaccaaaatgataaaggacagattacagagcatcacgaaagggcggaacagcttctgctgcaattgattgaagacgcaggagccatttatgaagcggttcacttaacggctgcaaaagaggcgtttaaagaggacgttttggattggatcagccgcggattaggggagacgccgtattttgaccggttattgacggcttaccgggctccgcatgatcaggagacgaccttttttgcggcgccgatcgtgacgccgaatgggcctcatgcgaaaggctgctattttgaagcctttttagccgttcgtgaagaacctgccatgatgaggccgatagaagaggatctgcctcatcctgaaaacggctgccaatcccttaagctgctcgccggaacaaaggggttcacggaagaaaaatgcatcgtattcttccctgaaaatgtgaaaacaaaagagaaaatcacatcacagacattcgcgattttctactttaataagttttatcacatttaccatgaggacacgctcaaaagagcgagggccatttttgaacatgcgcctttcaagtcggctcagctttcccacgaccgcacatatgaagcaagggtgttgtggggctaccttcacgactattttcatcattgcggaaaaaaaccttttcatctccatattcaggcgaaaatgaattttttcgcaggcattttagaagaagtcaaggtcgattgccaagcaatcctgaccttgtgggagcggcaatatgacggctgggaggaaattatcgaatttgttttgtatgagcggctgctgcgctatccgagccagcataatgcaacgcggaattttgattccgggacaggctattttctgttcagctggatgattgaaaacggccgttccattcaaaaaggagaagagaagcgcgtgtcgcttgaccttccacgctgcatggacgatttaagaaagcttgtggccgaaattgaacagctggaagaaatcgaggatgacacggcatacaaagaggccgcggagcgctatgtcagacaatacctgcctccgggacgggaaggcgagcgattcagcgtcccggaacagtatttcattgacgagatcaataagaaaatcgaaaccgcccgtcttcgatttgaacgggagagactggaagcgtga

SEQ ID NO: 4065 - DNA, 567 bp, Bacillus licheniformis
atgatctcgactaaagtgcacaaagagcaagccgtgatgattgtccatacgctcggtcccaaaggcacgaactgtgaaaaagccggcctgctatggctcaaaaataaaggggtccgcggggaagtcaggctttatgaaacgttggaagaagcgctgctccatgttaaatcgacagaaaattcagtcctcttaggctgcgccgtttacccgtttttgcatcaaatcgtatttgagaatctagcggacttaaagattatagacagttttgtgatgcctacatacaacatggtgtttgccgcaaaacagcacacgatggcatcggatattcaaatcgtcgcttcacaccctgctccggctcatctggcaaagctgttcagcagtcaagtccaatttgtcaccagcaatgctcaagcggccctggcctgcgcttcaaacgcggctgacggctgcatcacgacgattaaagcagccgatgaacaccgtttgaaagtcattaaagattttggggaagtaccgatgtgctttacaatccacgggcttaaatcaatcgaaggaggaagccgatga

SEQ ID NO: 4066 - DNA, 1278 bp, Bacillus licheniformis
ttgacgaaacgaaacaaaaacttggccatcatttgtcaaaataagcacctgccatttatttttgaagaagctgagcgtttaggattgaaggtcacgttcttttacaattcggccgaagatttcccgggcaatcttccggctgtggaacgctgtgtgccgctgccgttgtttgaagatgaagaagcggcgatggatgtcgtcaggcagacatttgtcgaatttccgtttgacggcgtgatgacactgtttgaaccggctttgcctttcacggcaaaagctgctgaagctttgaatctgccggggcttcctttcacaacaatggaaaactgccgcaataaaaataaaacccgcagcatacttcagcaaaacggattgaatacgccggtttttcacgagttccatacgctcgctgacctggaaaacaggaaactgtcgtatccattagtcgtcaagccggtcaacggcttctcaagccagggcgtcgtccgtgttgatgatcggaaggagcttgaggaggccgtccggaaagtcgaggccgtcaaccaaagggacctcaatcgattcgtgcacggcaaaacgggcatcgtagccgagcaatttatcgatgggccggaattcgcgattgaaacgctgtcgattcaaggaaacgtacatgttctttcgattggatacaaagggaacagcaaagggccgttttttgaagaaggggtctatattgctccggctcaattgaaagaagagacgcgccttgcgatcgtcaaggaagtgacgggcgccgtttcagcgctgggcattcaccaggggccggctcatacagagctgaggctggacaaggatggaacaccttatgttatcgaggtgggcgccagaatcggcggttcaggggtttcccattacatcgtcaaagagagcacaggcatcaactttatgcagcttgtcttgcaaaatgcattaaagccgctggagagcagcgagtttgaaggcgagatcaggcctgtaaggacagccggcaattatatcattcctgtacagggctccggcacttttgaaaaaatcgacggactggaagaagtcaaacagaggcaggaggttaagcgggtgtttcaatttatgagaagaggcgcaaagatcctcccgtacccgcacttttccggttatccggggtttatattaacaagccatcattcttatgaagaatgtgaagctttctaccgggagctggatgatgagcttcatatcatttatcaaaataatttgacgggtacaataggaggttaa

SEQ ID NO: 4067 - DNA, 939 bp, Bacillus licheniformis
atgctgacaaacgttttaaagtatcgggttcatattttatttatcgtgttatgtttgatcggcgggacgacatgggcttttcaaaaagccgggctgagtgacagccttccattttggtccgccggcatgcggttcatgatcgcaagcattttgatcgcggcgtttctgttggcacggaggcagtttgttctgtcaaaggaactgctagtgctgtcgtttttgaacggcatcatgtatttttccgttccattcggatctgtttattgggcctctctttatttgccgagcgggttggtgtctatattagcggcaagcatttcagtctttgccctgatgatcaaccgcctcgtcaaagggacaccggcgacgaaactgcagaaatgggggatatgcctggctttgctcggcattacaatcgtgtttggcaaccaactgctgatcaaagtcgatgttattgaaattgtcgcaatgattgtgattttgtgtgcgatgtttggctcggcttttattcaaatcaaagtacagcagagaattcgttcgcttccgatcttaagctttaactccctttcaatgctgagcggcggagcggtattgctcatcagcagcctcatctttgaaagcgggacaagaacgttttccggtgtgagtctttatgcgctgctttatttagcggttgtcggctcgattttgggtttttggatcaacatttatctgcttaaaaaatggcacatctcaaaagcgacttcccacttgttcatctcccctgtcattgcgctctatatcggatttctgtttctggatgaaaaactgaatgcgaatatttatttaggaacgctgtttgtcatattcggtgtgatgttcatcaacttaaaaaaagaagagaggatcgcgaaaattgacgaaacgaaacaaaaacttggccatcatttgtcaaaataa

SEQ ID NO: 4068 - DNA, 879 bp, Bacillus licheniformis
gtggctttcgtttccatgaaagaacttcttcaagaagcaaaggaacatcattatgcaatcggtcaatttaatattaatggccttcaatggacaaaagcgattctagaggcagcggaagaagaacggtcacctgtcatcgcagccgcttcagatcggctcatcgattatttgggcggatttaaaacggtttccgcaatggttgcggctttgattgaggaaatgtcgatctccgttcccgtcgtgcttcaccttgaccatggcaaaagtccggagcgctgcaagcaagcgatagacgcgggttttagctcagtcatgatcgacggctcgcattcaccaatcgatgaaaatatcgccatgacaaaagaggtcgtgtcatatgccggggtccgcaatgtttcggttgaagcagaggttggcaccgtagggggcatggaagacgggcttatcggcggagtgcagtatgccgacatcggtgaatgcgagcggattgtcaaagaaaccggtatcgatgctttggcagccgcgctcggctccgttcatggaaaatatcaaggcgagcctaatttgggatttaaggaaatggaagaaatctcacgggtaacggacattccgctcgttctccatggagcttcgggcatcccggctgatcaaatcgcaagaacgatccgtctgggccatgcgaaaatcaacattaataccgaatgcatggtggcctggactgagaaaacgcgcagcatatttaaagacaatcccgatttatatgaaccccgcgcctatatgacgccagggatcagcgcagtcaaagaaacggttaaacataagatgagagaattcgggtcatccggaaaagcggtatgcacccaaaagatagaaatataa

SEQ ID NO: 4069 - DNA, 837 bp, Bacillus licheniformis
atgaagctatgctttaatgaagcaacgacgttggaaaattcaaaccttgcaaaagacctcgaatactgtgagaagcacggatacgattatatcgaaatccggacgatggataagctgcctgagtacttaaaagaccatgctctctcagagttagccgagtattttcaaactcatcatattaagccgctggccttgaatgcccttgtctttttcaacaaccgcgatgaaaaagggcaccgtgaaatcatcgaagaatttaaaggcatgatggaaacgtgcaaaatgcttggtgtgaaatacgtggtcgcggtaccgcttgtcaccgaacaaaaaatcttaaaagaagatattaaagcaagctccgtcgaagtgctgacagagctgtcagacatcgctgagccgtacggcgtaaagatcgctgtcgagtttgtcggtcacccggagtgtacggtcaatacgttcagccaggcctatgacatcgtcatgaccgtgaaccgcgataatgtcggccttgtttttgacagcttccatttccatgcaatgggctcaagtcttgaggatttaaaaaaggcggacggcaagaaaatcttcatttatcatatcgatgacacggaagactttccaatcggatttttaagagatgaagaccgtgtttggccgggacagggagccatcgacttggatgcccacttatcaactttgaaagacatcggtttttcggatgtcgtatcagttgaattgttcagacctgaatactataagctgagcgcggaagaaacgattcgaacggccaaagaaacaacagttgaagttgtttcaaaatacttcaagatttaa

SEQ ID NO: 4070 - DNA, 867 bp, Bacillus licheniformis
atgaaattagcattggatccatcgatgtatcgtgatgatttgactttggaagaaacggtctataaaacggcggagcttggctacgaatatatcgaactatcgccgcgcgaagatttttgtccattctataaatatccgaaagtcgattcagctaaaatcaaacaattaaagcggcttttaagagataccggtgttaagctttcatcgctccttccgctttaccactgggcaggtcctgatgaagatcgccgtcaggccgccgtgcgcaattggaaaagggcaatcgaaattgcggtcgagcttgaagtcgatttgatgaacagtgaattcagcggttcaaaatacgatcctttaacaagtgaagaaaaatttatcaaatccatggatgagcttctgccaatctttgaaaaagaaggcattaaactcaatcttcaagcccatccatacgattttatcgaaacgcacaaaggtgcgttggatatgatccgcgcgcttgacaaggattggattaatcttgtctactcgactgcgcatacattcttttatgatgacggcaaaggcgacatcgagacaatgtttgacgaagccggcgaccgcctcacacatgttttattcgcagatacgtataatcataaagcggctcatggccttcgctacatcgtcaatccgcctgacgcaaaagtaacggttcaccagcatttggacattggtcaaggcgaggtcgattttgatatgatcttcagaaagctgagagagatgaagttcgacggaattgcgacgaacgccgtttttgcttgggtcgatgaaagagcggatgaatcaagcagattcatgcttgaaaaattgaaacaagaattattaggctaa

SEQ ID NO: 4071 - DNA, 1035 bp, Bacillus licheniformis
atgaaactacgcattggtgttattggtacaggagcaatcggaaaagaacacatcaaccgcatcacaaataaattagccggcggcgaaattgtcgcggtcaccgatgtgaaccaggaggcagctcagcaagttgtaacggactacagcctgaacgccaaggtctatccggatgacgacagtctaatcgcagccgaaaatgtagacgcagtcttagtaacaagctggggaccggcacatgaatcaagcgttttgaaagcgattaaagcaaacaaattcgtattttgcgaaaagcctctggcgacgactgcggaaggatgcatgcggatcgtcaatgaagaagtcaaagcgggcaaacgtctcgttcaagtcggctttatgcgccgctatgacagcggttacgtacagctgaaagaagcgatcgacaatcgggtcatcggcgagcccctcatgatccactgtgcgcaccgcaacccggttgtaggcgacaactatacaacagatatggctgtcgtcgatacgcttgtccatgaaatagacgccctgcactggctgattaatgatgactacgaatccgttcaggtcatttatccgaaaaaatcgaaaaacgcgcttcctcatttgcgtgatccgcaaatcgtcatcatcgaaacaaaaggcggagtcgtgatcaatgcggaaatctatgtcaactgcaaatacggctacgatatccagtgtgaaatcgtcggcgaggacggaatcgtgaagcttcctgaaccatcaagcatctctctcagaaaagacggcaaattctcgacggatatcctcatggattggcagcgccgctttgtagacgcttacgatgtagaaattcaagatttcattgactcgatccaacagaaaggcgaggtcagcgggccgactgcgtgggacggctatatcgccgccgtgacgacggacgcctgtgtgaaagctcaggaatccggacagaaagaacctgtggcgcttcaggagaagccggaattctatcaaacgttcacaactgttaaaaaataa

SEQ ID NO: 4072 - DNA, 1305 bp, Bacillus licheniformis
ttgagcaatggaagtgcagcagtctcaccattcaataaacgaaccgtcgcagcagctttggcaaattacattgatgcaggctccattgtcgcaggatcggcaggattatctttatgggtcagttacctgaagctttctgatacacagatcggactgctcggcgcatttagcgccaacgccatttcggcagcaatcggagcgctgctcggaggctttttggccgacaaaattggccgaaaggctgtctatacgaacagtatgctggtttatgcactgggcatttgtttagttttattcggcaccagcttcccctttttgttaagcggttacattattatcggtttatcggtaggagctgatattacggcttcctggacgatcatcgcagagaacgcacctaagaaaaacagggcgcgtcattgcggggttgcacaggtcgcatgggctgcgggagcggttgtggttctgctgctgtcggtcctgctcggtgatttaggcttattgggcaataaaatcgtgtttgggcatttgctcgttatcgcactgattacttatgttctgcggaaaaggctgccggaatccgatgcctggcaggatcaatccgaaatggctcaagccgtcaggaagccgaagacgccttatctcgatttgcttcagcctaagtatttgaaaagcattttattcttaatgggcgtgtacttggtttggaatctggctgcaggtgtcatggggttttttatgccttacatttatcagcaggtcggcgatgtatcagcgaccatggcaaatattttgcagatggggctgtttattttcaccgggcttggcgtcgcttttatcttcatgccgtttgcagacaaatacaggaagacagtgtttgggatctccgcatttgcggcggtgatcggctggtcattgtttctgcttccggcagagggcatgccgattctcatcctctttatcgtgatgatcggcataaacaacggggcggggcaacaggccaactatcaattatgggcgagtgaaattttcccgacggaatatcgcgcatctgcacaaggattgatgttcttccttgttcgtatctcaatcggggcttggagccttttcgttccaatgatcatctcgaattttggaattgcatttatggcggccattctccttggatgtgtaacggccagcatgctcatcgggctcttttttgcaccgaatacatccggtaagtcgcttgaacaaattcaggaagagctgtatgggactcctccggctcaagctgggcaagtgcaaacaagaaaaattatgtaa

SEQ ID NO: 4073 - DNA, 903 bp, Bacillus licheniformis
atgggcaagacacaaattctatggggcatcgcccccataggatggcggaacgatgatattccggaaatcggcgcgggaaacacacttcagcatttgttgagcgacattgttgttgcgggctttcaaggcacggaagtgggcggcttttttccggaaccggccattctcaataaagagctcgagctgaggaatctaaggattgccggcaagtggttcagcagctatatcattcgggacggcattgaagaagcagccaaggaatttgcggctcactgccagtacttaaaagacgtccatgccgatgttgcggtcgtatcagaacagacgtacagtgtgcagggcttggataaaaacgtgtttaaagaaaagccttatttcaccgatgaagaatggcagcggctatttgaaggtttaaatcacctcggggaaatcgccggccgttacggactgaagcttgtctaccatcaccacctcggcacaggcgtgcagacagaggaagaggtggaccggctcatggcgggaactgacccggcacttgtgcaccttctgtacgatacggggcatgcctacatttcagatggaaattatatgaacattttagagaagcatattgaccgtattaggcacgttcattttaaagacgcgcgccttaagatcatggagaaatgcaagcgggaaggaaattcgttccaacaggcgtttctgcaagggatgttcacagttccaggcgacggctgcatcgattttagagaagtatatcaaacgcttttaaagcacggctattccggctggatcgtagtggaagccgagcaggatcccgatgttgccaacccgcttgaatacgcattgatcgccagaaagtacatcgatcgtcacttgttgaatgtcccagcaaccaattaa

SEQ ID NO: 4074 - DNA, 1914 bp, Bacillus licheniformis
gtgggcaagaaaatacgtttaaccacagcacaagcgttaattaagttcttaaatcagcagtacatccatgtagatggagaagaaactccgtttgtcgagggaatctttacgatttttggccatgggaacgtcgttggaatcggccaggcgcttgaacaggatgccggccacttaaaggtgtttcaaggcaaaaatgagcagggaatggcgcatgcagcaatggcttacagcaagcaaatgctgagaaggaagatctatgccgtgtcgacatcagtcggaccgggagcagctaaccttgtggcagccgcaggtactgcgcttgcgaacaacattccagtcctcttgattccagccgatacatttgccacgagacagcctgatcctgttcttcagcaagtagagcaggaatacagtgcggcgattacgacgaacgatgcattgaagcctgtttcgaggtattgggaccgtattacgcgccctgaacagttgatgagcagtctgattcgcgcttttgaagtaatgacagaccctgcaaaagctggtcctgcaacgatttgcatttctcaagatgttgaaggcgaggcctatgatttcgatgaaagcttttttgaaaaacgcgttcactatgttgatcgcaaagagccgagcgagcgtgaactgaagggagcggcagaactgatcaagtcgagcaaaaaaccgctcatcttggtcggcggcggagcgaaatattccggcgcgcgcgacgaattgatcgccatgtctgaagcttacaatattccgctggtagaaacccaggccggtaaatccacagtagaagccgattttgccaacaatttgggcggaatgggaatcaccggtacgctggcggcaaacaaagcggctcgcggggcagacctgatcatcggaattggcacgcgctataccgattttgcgacatcatcaaaaaccgcttttgactttgacaacgcaaaatttttaaacattaatgtcagcagaatgcaggcttataaactggatgctttccaagtcgttgccgatgcaaaagtaacgctcggcaaactgcacggcttattggaaggctataagagcgagttcggttcaaccatcaaggagctgaaagacgaatggcttgctgaacgcgaccgcttaagcaaggtaacatttaagcgcgaaaacttcactcctgaaattaaagatcacttttctcaagacatactcaacgaatatgcggatgtgctgcaaaccgaactgccgcaaacaacggcattgctcgccatcaatgaaacagttgatccggacagcgtcgtcatttgttcagcaggctctttgccgggagatctgcagcggctgtggcattcaaacgtaccgaatacgtaccacctggaatacggctattcctgcatgggatatgaagtatcgggaacgctcggcttgaaattggcgcatcctgatagagaagtttattcactggtcggagacggaagcttcctgatgctccactcagagctcattacagcaatccaatataataaaaaaattaacgtgctgctctttgacaactcaggattcggctgcatcaacaatctgcaaatggaccatggaaacggcagctactactgtgaattcagaacagcagacaatcagattctcaatgtcgattatgcgaaagtggccgaaggctatggagcgaaaacctacaaagcgaacacgattgaagaattaaaagcggcgctggaagatgccaaaaaacaagatgtctcaacattgattgaaatgaaggtgctgccgaaaacgatgacggacggctatgacagctggtggcacgtaggtgttgcagaggtttccgaacaggaaagcgtgcaaaaggcgtataaagcaaaagaaaaaatgctggaatctgcaaagcagtattaa

SEQ ID NO: 4075 - DNA, 978 bp, Bacillus licheniformis
atgaagtatacgtttaatgaagagaaagaatttgacattgtagcgatcggccgcgcatgcatcgatttaaacgcagtcgaatacaacaggccgatggagcagacgatgacattttcaaaatatgtcggcggctccccggctaatattgcaatcggcagttccaaattaggcttgaagaccggatttatcgggaagattccggatgaccagcacggcagattcatcgaaacctatatgagaaatacaggtgtcgatacgtcacaaatggcggttgataaagacggacataaagctgggcttgctttcacagaaattttaagccctgaagaatgcagcattttaatgtacagggatgatgttgcagatctttaccttgccccttctgaagtgaacgaagactatattgccaaatcgaagatgcttcttgtgtcaggtacggcgctggctaaaagcccttcccgcgaagcggtgctgaaagccgtacagctggcgaaaaagcatcaagtgaaagtggtctttgagcttgactatcgtccatatacgtggacatctgcggaggaaacggccgtctactatacgcttgttgccgaacaatcagacattgtcatcgggacgcgtgatgagtttgatgtaatggaaaataagagcggcggcagcaatgaagaatctgttcagcatttatttgcacattccgcagatcttgtcgttatcaagcacggtgtcgaaggttcatatgcatacagcaaatccggggacgtcttccgggcgaaagcgtacaaaacgaaggtcttgaaaacgtttggagcgggcgattcatacgcctccgccttcctctacggactcgtttcaggcaaagatattgaaaccgcgctgaaatacggaagcgcttccgcctcgattgttgtttcaaagcacagctcatctgaagcgatgccgacagtcgccgagattgaagagcttattgcggctcagtcttaa

SEQ ID NO: 4076 - DNA, 816 bp, Bacillus licheniformis
atgagtcatttgttgcgcaagccgcaggcgaatgagctgtcacaaggcgtgaagcttgtacacgaagtgaaaaaatcgaattccgatctaagttatgtcgagtttaaagtccttgatcttgcaccgggatccagctatgaagaatcgctgagcaaacaagaatgctgcatcgtcgcgcttaccggaaagattaccgcaaccgatcatgaacagacatttgaaaatatcggcacgagagaaagcgttttcgaaagaaagccgaccgacagcgtatatgtgtcaaatgaccgcaagttcggcattaccgccgttacagaggcaagagttgccctgtgctattcaccttctgaaaaccagcttccgacgaaactgatcaaagctgaagacaacggtattgagaaccggggaaaattcagcaataaacgaaccgtccataacatacttccggattcagatccttcagcgaacagtcttttagtcgtcgaagtctacactgaaagcggaaactggtccagctatccgccgcacaagcatgaccaagacaacctgcctgaagagtcctttttagaagaaacatactaccatgaacttgatccgcagcaaggcttcgtatttcagcgcgtatacacggatgaccgttccatcgacgagacgatgactgttgaaaatggaaacgttgtcatcgtgccggccggataccatcctgtcggggtgcctgacggatacacatcctattatttaaacgtgatggcagggccgacgcgtaaatggaagtttcataacgaccctgaccatgaatggattttggaacgctaa

SEQ ID NO: 4077 - DNA, 1464 bp, Bacillus licheniformis
atggcagaaatcagaaagttaagaaactatattaatggagaatgggttgaaagcaaaaccgacaaatatgaagatgtagtcaatccagcgacgaaagaagtgctgtgccaagtgccgatttcgacgcgagaggatatagaatacgcagcgcaaacagcggctgaagcgtttaaaacatggtcaaaagtggctgttccgcgccgggcaagaattctatttaactttcagcagcttttaactcagcataaagaggagcttgcccacctcatcacgattgaaaacggaaaaaacacgaaagaagcgttgggtgaagttggacgcggcatcgagaatgtcgagtttgcagctggagcgccttcactgatgatgggagattcacttgctacaattgcaaccgatgttgaagcggcgaactaccggtacccgatcggagtcgtcggcggaattgcaccatttaacttcccgatgatggtaccatgctggatgttcccaatggccattgcgttaggaaacacatttattctgaagccttccgaacggacgccgcttttgacggaaaagctagttgaactgtttgaaaaagccggacttccaaaaggggtcttcaatgtggtatacggcgcacatgatgtagtaaacggcattctcgaacacccggaaattaaagcgatttcattcgtcggttcaaaaccggtcggagaatatgtctataaaaaaggaagcgaaaatctgaaacgcgttcaatcgctgacaggcgctaaaaaccacaccatcgttctgaacgatgccaaccttgaagatacggtaacaaatattatcggcgctgctttcggatctgccggcgaacgctgcatggcatgcgcagtagtaacggttgaagaaggaattgcagatgagttcatggaaaaattggttcagaaagcatctgaagtcaaaatcggaaacggacttgacgacggtgtattcctcgggcctgtcattcgcgaagacaacaagaaacgcacactcggctatatacaaaaaggaattgaagagggtgcgagacttgtctgcgacggacgcgaaaatgttacagatgaaggctatttcgtcggcccgacaatctttgacaatgtcacaactgatatgacgatctggaaggacgaaatttttgctcctgtactatcggtcatccgtgtgaagaacttgaaagaagcggttgagatcgccaaccagtccgaatttgcaaacggcgcatgcttgttcacatcgaattcgaatgcgatccgctatttccgtgaaaacattgatgcgggaatgctcggcatcaacctgggtgtaccggctccgatggcattcttcccgttctccggatggaagtcttcgttctttggtacattgcatgccaacggaaaagacagcgtcgatttctatacgcgcaaaaaggtcgtcactgcaagatatccggcgcctgacttcaattaa

SEQ ID NO: 4078 - DNA, 765 bp, Bacillus licheniformis
atgaagttaatgcggattaaagaaatggaagattatattttgaccaatggcaccgtttcgcttgatgaactatgccaggtctttaatgtttcaaaaaacacggtcagacgcgacattaacaagctgaccgagaaaggagttataaaaaaagtctacggcggcgtaacagcgatcgaaaaaacggccttgatcccttttgaaaacagaaccattcaaaacaaggatgccaagacaaaaatcgcgcgctatgcttcacgctttattgaagaccatgacctgatttttattgattccggcacaacgacccgatccatattggaaactcttgatccaaataaaaatgtaaccgttttaacgaacagcctcgacattatcaacgctgctgcagcgatgcaaaatataaacttgatcatcatcggcagcaactacaaacggaaaacgcagtccttcgtcggcatggatgatccgggaacgctggataaatataatattaataaagctttcatgtcggcaaccggcgcaacacttacccatggactgacaaactccgatctgcttgaatatgaaattaaaaagaaaatatccgaaaaagcaaaacaagtatatttgctggccgaccattccaaattcgggaagtcgaccctgctgacgtacgcgccgtttgacagattgcacgcgatcgtcacatctcaggcgcttgatgaggaatatcacgtgtactgtaaagatcgcaaaattgaaatccatttggcaaaacatgtatag

SEQ ID NO: 4079 - DNA, 936 bp, Bacillus licheniformis
atgaaaaaagttaaagttggcaaatcagacttgcacgtatttccgattggtttgggaaccaatgctgtcggaggacataacctttatccgaatctcaatgaagaaacgggaaaagaattggtgcgggaagcaataagaaacggcgtcacttttttagataccgcctacatatacggcatcggccgttccgaggaattaatcggcgaagtccttaaagaattcaaccgcgaagatgtcgtgattgcaacaaaagccgcccataagaaagaaggagacgattttgtctttgacaactctcccgcatttttgaaaaagtccgtcgaagaaagcctgaagcggctgcaaactgactacatcgaccttttctatatccattttcctgatgaaaatacgccgaaagacgaagcggttcaggcgctccatgaactgaagcaggaaggcaaaatcagagcaatcggtgtatccaacttttctcttgagcagctgaaagaagcgaacaaagacggattggtggatgtgctccaaggcgaatacaacctgctgaacagggaagctgagacgacattcttcccgtatacacaggagcataacatctcatttgttccttacttcccgctcgtctccggattgctcgccggaaaatacagcgaagatacaacgttcccggaaggcgacctgagaagagaaatggaaaacttccaaggcgaacgcttcaaagaaaacattagaaaagtgaaccagcttgcgccgatcgcggaaaaacataatgtcgacatcgcccatatcgtcttggcctggtacttggcgcggcctgaaatcgacgtgttgatcccgggcgccaaacgcgctgatcagctgatcgacaacctcaaaacggcagaagtcaatctgtctcaagaggacattgatttcatcgaccggctgtttgcccgctaa

SEQ ID NO: 4080 - DNA, 894 bp, Bacillus licheniformis
atgaaaagactagtccgcagcatcttccttataacggccgcaatcgctgcttttggttttggattcagcgggcatgcggaggcggcaagccattcccagccgcagctcaatccgaacaagctactaaatgtcgcgcaccgcggcgcatcggggcatgctcccgagcacacgcttttggcttataagcttggacaaaaaatgaaaggcgattacatagaaatcgatcttcaaatgacaaaagacggccacttggtcgccatgcacgatgagacattggatcgtacgactaatggtacgggttttgtcaaagactatacgctgaaagaaatcaaagagcttgatgcaggctcctggtttaacgaagcatatcctgagcgggcaaaaccggagtacgccgggctgaaagtgcccacccttgaagaaatcatccaaacattcgggagaagcgcgcgctactatatcgaaacaaaatcaccggaagactatgatcatatggaagaaaagctcctggacatcctgaagcaatacaaattgaccggagcagacattcattcaagcaaagtcatcattcaatcttttagtcctgaaagcttaaaaatcattcataacgctaatccaaacattccgctagtgcaattattatggtacgacaaacctgctgccattactgacgccgaattaaaacaatatcaatcttacagcgtcggactcggcatgaactttgaccgcattggccgggcatacgtgcaaaagattcgacgcaccggcatgctggtccatccttatactgtgaataaaaaagaagatatgaagcggctgctcgattggggagcgaccggaatgttcaccaactttccggaccggctgcgcgatgttttgcgcgaaaagaagtaa
